United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 71

SEQ ID NO: 2994860 - DNA, 14 bp, Homo sapiens
ggacgtgggccctg

SEQ ID NO: 2994861 - DNA, 15 bp, Homo sapiens
ggacgtgggccctgc

SEQ ID NO: 2994862 - DNA, 19 bp, Homo sapiens
ggactagagggacctctcc

SEQ ID NO: 2994863 - DNA, 12 bp, Homo sapiens
ggactagggcct

SEQ ID NO: 2994864 - DNA, 23 bp, Homo sapiens
ggactatatttgggcctgctcca

SEQ ID NO: 2994865 - DNA, 17 bp, Homo sapiens
ggactccaggccagctc

SEQ ID NO: 2994866 - DNA, 11 bp, Homo sapiens
ggactccatct

SEQ ID NO: 2994867 - DNA, 22 bp, Homo sapiens
ggactccatctctcatcctcca

SEQ ID NO: 2994868 - DNA, 16 bp, Homo sapiens
ggactgaaaacctctc

SEQ ID NO: 2994869 - DNA, 18 bp, Homo sapiens
ggactgaaaacctctcct

SEQ ID NO: 2994870 - DNA, 21 bp, Homo sapiens
ggactgaccttgtaaaagaca

SEQ ID NO: 2994871 - DNA, 21 bp, Homo sapiens
ggactgagcgaggaaaaacaa

SEQ ID NO: 2994872 - DNA, 22 bp, Homo sapiens
ggactgagcggccgcagagact

SEQ ID NO: 2994873 - DNA, 23 bp, Homo sapiens
ggactgcacagcgtcctgtccac

SEQ ID NO: 2994874 - DNA, 20 bp, Homo sapiens
ggactgcagtcggcatgcca

SEQ ID NO: 2994875 - DNA, 14 bp, Homo sapiens
ggaaacccgagggt

SEQ ID NO: 2994876 - DNA, 15 bp, Homo sapiens
ggaaacgtctcccag

SEQ ID NO: 2994877 - DNA, 14 bp, Homo sapiens
ggaaactaaaactt

SEQ ID NO: 2994878 - DNA, 11 bp, Homo sapiens
ggaaactggct

SEQ ID NO: 2994879 - DNA, 21 bp, Homo sapiens
ggaaacttctgtaaggggcag

SEQ ID NO: 2994880 - DNA, 20 bp, Homo sapiens
ggaaacttgtcacttgcatg

SEQ ID NO: 2994881 - DNA, 15 bp, Homo sapiens
ggaaagaagagccgg

SEQ ID NO: 2994882 - DNA, 15 bp, Homo sapiens
ggaaagacactgcct

SEQ ID NO: 2994883 - DNA, 16 bp, Homo sapiens
ggaaagacactgcctg

SEQ ID NO: 2994884 - DNA, 20 bp, Homo sapiens
ggaaagacactgcctgggct

SEQ ID NO: 2994885 - DNA, 17 bp, Homo sapiens
ggaaagacaggaagacc

SEQ ID NO: 2994886 - DNA, 22 bp, Homo sapiens
ggaaagacatccataaagaagc

SEQ ID NO: 2994887 - DNA, 22 bp, Homo sapiens
ggaaagatggataaactgagcc

SEQ ID NO: 2994888 - DNA, 15 bp, Homo sapiens
ggaaagcaataaatg

SEQ ID NO: 2994889 - DNA, 19 bp, Homo sapiens
ggaaagcagctcaaaggca

SEQ ID NO: 2994890 - DNA, 22 bp, Homo sapiens
ggaaagcagctcaaaggcacag

SEQ ID NO: 2994891 - DNA, 16 bp, Homo sapiens
ggaaagggcagtggac

SEQ ID NO: 2994892 - DNA, 17 bp, Homo sapiens
ggaaagggcctggccag

SEQ ID NO: 2994893 - DNA, 21 bp, Homo sapiens
ggaaaggggcaggccagagct

SEQ ID NO: 2994894 - DNA, 21 bp, Homo sapiens
ggaaaggtttcaagacttgat

SEQ ID NO: 2994895 - DNA, 23 bp, Homo sapiens
ggaaagtcctcctattccagtgt

SEQ ID NO: 2994896 - DNA, 17 bp, Homo sapiens
ggaaagtgtaaagcatt

SEQ ID NO: 2994897 - DNA, 16 bp, Homo sapiens
ggaaatatcagttact

SEQ ID NO: 2994898 - DNA, 22 bp, Homo sapiens
ggaaatatcagttactcagccc

SEQ ID NO: 2994899 - DNA, 14 bp, Homo sapiens
ggaaatatgaatgc

SEQ ID NO: 2994900 - DNA, 17 bp, Homo sapiens
ggaaatatttagcaaat

SEQ ID NO: 2994901 - DNA, 15 bp, Homo sapiens
ggaaatgagatgaca

SEQ ID NO: 2994902 - DNA, 13 bp, Homo sapiens
ggaaatgagcagg

SEQ ID NO: 2994903 - DNA, 16 bp, Homo sapiens
ggaaatgagtggccag

SEQ ID NO: 2994904 - DNA, 17 bp, Homo sapiens
ggaaatgagtggccagc

SEQ ID NO: 2994905 - DNA, 18 bp, Homo sapiens
ggaaatgcagggcacatg

SEQ ID NO: 2994906 - DNA, 15 bp, Homo sapiens
ggaaatgctgggctg

SEQ ID NO: 2994907 - DNA, 16 bp, Homo sapiens
ggaaattctgctcaga

SEQ ID NO: 2994908 - DNA, 12 bp, Homo sapiens
ggaacactgccc

SEQ ID NO: 2994909 - DNA, 15 bp, Homo sapiens
ggaacactggcagac

SEQ ID NO: 2994910 - DNA, 15 bp, Homo sapiens
ggaacagacaggaga

SEQ ID NO: 2994911 - DNA, 16 bp, Homo sapiens
ggaacagacaggagaa

SEQ ID NO: 2994912 - DNA, 23 bp, Homo sapiens
ggaacatttattttatgagaaat

SEQ ID NO: 2994913 - DNA, 21 bp, Homo sapiens
ggaaccaaagcgaattttaaa

SEQ ID NO: 2994914 - DNA, 22 bp, Homo sapiens
ggaaccaaagtctaaactgagc

SEQ ID NO: 2994915 - DNA, 12 bp, Homo sapiens
ggaacctcagcc

SEQ ID NO: 2994916 - DNA, 14 bp, Homo sapiens
ggaacctcagcctg

SEQ ID NO: 2994917 - DNA, 16 bp, Homo sapiens
ggaacctcagcctggc

SEQ ID NO: 2994918 - DNA, 20 bp, Homo sapiens
ggaacctcagcctggccaga

SEQ ID NO: 2994919 - DNA, 23 bp, Homo sapiens
ggaacctcagcctggccagacac

SEQ ID NO: 2994920 - DNA, 16 bp, Homo sapiens
ggaacctcgagtactg

SEQ ID NO: 2994921 - DNA, 19 bp, Homo sapiens
ggaacctcgagtactgtgg

SEQ ID NO: 2994922 - DNA, 16 bp, Homo sapiens
ggaacgcagcctccag

SEQ ID NO: 2994923 - DNA, 17 bp, Homo sapiens
ggaacgcagcctccagt

SEQ ID NO: 2994924 - DNA, 16 bp, Homo sapiens
ggaacgtgactgcccc

SEQ ID NO: 2994925 - DNA, 17 bp, Homo sapiens
ggaacgtgactgcccca

SEQ ID NO: 2994926 - DNA, 17 bp, Homo sapiens
ggaactcagatccaggg

SEQ ID NO: 2994927 - DNA, 19 bp, Homo sapiens
ggaactcagatccagggac

SEQ ID NO: 2994928 - DNA, 20 bp, Homo sapiens
ggaactcagatccagggaca

SEQ ID NO: 2994929 - DNA, 20 bp, Homo sapiens
ggaactgcttgcccagggtg

SEQ ID NO: 2994930 - DNA, 15 bp, Homo sapiens
ggaactggttcaaga

SEQ ID NO: 2994931 - DNA, 14 bp, Homo sapiens
ggaagaaaagagct

SEQ ID NO: 2994932 - DNA, 23 bp, Homo sapiens
ggaagaaaatggaattactccaa

SEQ ID NO: 2994933 - DNA, 21 bp, Homo sapiens
ggaagagacatgagaaaggga

SEQ ID NO: 2994934 - DNA, 20 bp, Homo sapiens
ggaagagatccaaagactct

SEQ ID NO: 2994935 - DNA, 22 bp, Homo sapiens
ggaagagctcaagggacaagga

SEQ ID NO: 2994936 - DNA, 21 bp, Homo sapiens
ggaagatctacctgcaacaca

SEQ ID NO: 2994937 - DNA, 15 bp, Homo sapiens
ggaagcaacgtgtta

SEQ ID NO: 2994938 - DNA, 20 bp, Homo sapiens
ggaagcagagcaaaatgctc

SEQ ID NO: 2994939 - DNA, 17 bp, Homo sapiens
ggaagcatgtaggagaa

SEQ ID NO: 2994940 - DNA, 21 bp, Homo sapiens
ggaagcatgtaggagaatcca

SEQ ID NO: 2994941 - DNA, 22 bp, Homo sapiens
ggaagcatgtttattctgttcc

SEQ ID NO: 2994942 - DNA, 21 bp, Homo sapiens
ggaagccaccctcccagctct

SEQ ID NO: 2994943 - DNA, 20 bp, Homo sapiens
ggaagcccactgcctcctcc

SEQ ID NO: 2994944 - DNA, 13 bp, Homo sapiens
ggaagccccacat

SEQ ID NO: 2994945 - DNA, 22 bp, Homo sapiens
ggaagcccccaccgtgggcagg

SEQ ID NO: 2994946 - DNA, 12 bp, Homo sapiens
ggaagccctcct

SEQ ID NO: 2994947 - DNA, 23 bp, Homo sapiens
ggaagccctggatttcagaaaga

SEQ ID NO: 2994948 - DNA, 20 bp, Homo sapiens
ggaagcctgaactgaggcct

SEQ ID NO: 2994949 - DNA, 14 bp, Homo sapiens
ggaagcctgtcctc

SEQ ID NO: 2994950 - DNA, 13 bp, Homo sapiens
ggaagctgctagg

SEQ ID NO: 2994951 - DNA, 15 bp, Homo sapiens
ggaagctgctccgtg

SEQ ID NO: 2994952 - DNA, 18 bp, Homo sapiens
ggaagctgtgttgaaaca

SEQ ID NO: 2994953 - DNA, 22 bp, Homo sapiens
ggaagctgtgttgaaacagaaa

SEQ ID NO: 2994954 - DNA, 15 bp, Homo sapiens
ggaaggacagctgtg

SEQ ID NO: 2994955 - DNA, 12 bp, Homo sapiens
ggaaggacccct

SEQ ID NO: 2994956 - DNA, 14 bp, Homo sapiens
ggaaggacccctca

SEQ ID NO: 2994957 - DNA, 17 bp, Homo sapiens
ggaaggacccctcacca

SEQ ID NO: 2994958 - DNA, 14 bp, Homo sapiens
ggaaggagacacag

SEQ ID NO: 2994959 - DNA, 15 bp, Homo sapiens
ggaaggagactcacc

SEQ ID NO: 2994960 - DNA, 12 bp, Homo sapiens
ggaaggagcaca

SEQ ID NO: 2994961 - DNA, 12 bp, Homo sapiens
ggaaggagcggc

SEQ ID NO: 2994962 - DNA, 15 bp, Homo sapiens
ggaaggagcggcgcc

SEQ ID NO: 2994963 - DNA, 17 bp, Homo sapiens
ggaaggcaaaggcagag

SEQ ID NO: 2994964 - DNA, 19 bp, Homo sapiens
ggaaggcctaggctaggac

SEQ ID NO: 2994965 - DNA, 19 bp, Homo sapiens
ggaaggcttggtcccatcg

SEQ ID NO: 2994966 - DNA, 14 bp, Homo sapiens
ggaagggagggagc

SEQ ID NO: 2994967 - DNA, 16 bp, Homo sapiens
ggaagggagggagctg

SEQ ID NO: 2994968 - DNA, 18 bp, Homo sapiens
ggaaggggcccgtgggag

SEQ ID NO: 2994969 - DNA, 21 bp, Homo sapiens
ggaaggggcccgtgggagtca

SEQ ID NO: 2994970 - DNA, 12 bp, Homo sapiens
ggaaggggccgg

SEQ ID NO: 2994971 - DNA, 13 bp, Homo sapiens
ggaaggggcctcc

SEQ ID NO: 2994972 - DNA, 18 bp, Homo sapiens
ggaaggggtgcaggtggg

SEQ ID NO: 2994973 - DNA, 19 bp, Homo sapiens
ggaaggtcccttgtttcca

SEQ ID NO: 2994974 - DNA, 18 bp, Homo sapiens
ggaaggtctgatttgcag

SEQ ID NO: 2994975 - DNA, 16 bp, Homo sapiens
ggaagtacgtcccagc

SEQ ID NO: 2994976 - DNA, 16 bp, Homo sapiens
ggaagtaggaagtaaa

SEQ ID NO: 2994977 - DNA, 22 bp, Homo sapiens
ggaagtcagaatttttaactgt

SEQ ID NO: 2994978 - DNA, 15 bp, Homo sapiens
ggaagtccaatgtgg

SEQ ID NO: 2994979 - DNA, 21 bp, Homo sapiens
ggaagtcctaagaagtggggc

SEQ ID NO: 2994980 - DNA, 15 bp, Homo sapiens
ggaagtcctgggagg

SEQ ID NO: 2994981 - DNA, 23 bp, Homo sapiens
ggaagtcctgggaggatcctgag

SEQ ID NO: 2994982 - DNA, 14 bp, Homo sapiens
ggaagtctaggagc

SEQ ID NO: 2994983 - DNA, 19 bp, Homo sapiens
ggaagttgccatgggaaac

SEQ ID NO: 2994984 - DNA, 20 bp, Homo sapiens
ggaataaactagagaaggga

SEQ ID NO: 2994985 - DNA, 23 bp, Homo sapiens
ggaataaatatgcctctcctttg

SEQ ID NO: 2994986 - DNA, 20 bp, Homo sapiens
ggaataataggccacagaag

SEQ ID NO: 2994987 - DNA, 17 bp, Homo sapiens
ggaatacaaaaggtttg

SEQ ID NO: 2994988 - DNA, 23 bp, Homo sapiens
ggaatataaggaaagcaataaat

SEQ ID NO: 2994989 - DNA, 19 bp, Homo sapiens
ggaatatttgctgtgaagg

SEQ ID NO: 2994990 - DNA, 14 bp, Homo sapiens
ggaatcctcctcca

SEQ ID NO: 2994991 - DNA, 17 bp, Homo sapiens
ggaatctcccagacttg

SEQ ID NO: 2994992 - DNA, 16 bp, Homo sapiens
ggaatgaagcttttta

SEQ ID NO: 2994993 - DNA, 12 bp, Homo sapiens
ggaatgagggag

SEQ ID NO: 2994994 - DNA, 18 bp, Homo sapiens
ggaatgatgggcttttgt

SEQ ID NO: 2994995 - DNA, 20 bp, Homo sapiens
ggaatgcacagggcaattga

SEQ ID NO: 2994996 - DNA, 22 bp, Homo sapiens
ggaatgcggccgcattccctga

SEQ ID NO: 2994997 - DNA, 13 bp, Homo sapiens
ggaatgggcaggt

SEQ ID NO: 2994998 - DNA, 15 bp, Homo sapiens
ggaatggttgagtga

SEQ ID NO: 2994999 - DNA, 15 bp, Homo sapiens
ggaatgtgtggcctg

SEQ ID NO: 2995000 - DNA, 22 bp, Homo sapiens
ggaattagcttggggccaggga

SEQ ID NO: 2995001 - DNA, 14 bp, Homo sapiens
ggaattattttaaa

SEQ ID NO: 2995002 - DNA, 15 bp, Homo sapiens
ggaattattttaaaa

SEQ ID NO: 2995003 - DNA, 16 bp, Homo sapiens
ggaattattttaaaag

SEQ ID NO: 2995004 - DNA, 17 bp, Homo sapiens
ggaattattttaaaaga

SEQ ID NO: 2995005 - DNA, 17 bp, Homo sapiens
ggaattccaattaaatt

SEQ ID NO: 2995006 - DNA, 20 bp, Homo sapiens
ggaattctttacaataaaca

SEQ ID NO: 2995007 - DNA, 21 bp, Homo sapiens
ggaattctttacaataaacat

SEQ ID NO: 2995008 - DNA, 16 bp, Homo sapiens
ggaattgacattctct

SEQ ID NO: 2995009 - DNA, 14 bp, Homo sapiens
ggaattggtgtata

SEQ ID NO: 2995010 - DNA, 11 bp, Homo sapiens
ggaatttaaaa

SEQ ID NO: 2995011 - DNA, 13 bp, Homo sapiens
ggaatttataatt

SEQ ID NO: 2995012 - DNA, 17 bp, Homo sapiens
gcttgggggtttttgaa

SEQ ID NO: 2995013 - DNA, 14 bp, Homo sapiens
gcttgggtggagaa

SEQ ID NO: 2995014 - DNA, 16 bp, Homo sapiens
gcttgggtggagaagc

SEQ ID NO: 2995015 - DNA, 19 bp, Homo sapiens
gcttgggtggagaagccat

SEQ ID NO: 2995016 - DNA, 22 bp, Homo sapiens
gcttggtgtttgtaagaaaatg

SEQ ID NO: 2995017 - DNA, 16 bp, Homo sapiens
gcttgtaactccacca

SEQ ID NO: 2995018 - DNA, 11 bp, Homo sapiens
gcttgtacatt

SEQ ID NO: 2995019 - DNA, 13 bp, Homo sapiens
gcttgtacatttt

SEQ ID NO: 2995020 - DNA, 19 bp, Homo sapiens
gcttgtactaagccaggag

SEQ ID NO: 2995021 - DNA, 16 bp, Homo sapiens
gcttgtcccctcctca

SEQ ID NO: 2995022 - DNA, 15 bp, Homo sapiens
gcttgtctgcagtca

SEQ ID NO: 2995023 - DNA, 18 bp, Homo sapiens
gcttgtgcctcccttccc

SEQ ID NO: 2995024 - DNA, 19 bp, Homo sapiens
gcttgtgcctcccttccca

SEQ ID NO: 2995025 - DNA, 17 bp, Homo sapiens
gcttgtgctcatgtgtg

SEQ ID NO: 2995026 - DNA, 18 bp, Homo sapiens
gcttgtgtatccattatc

SEQ ID NO: 2995027 - DNA, 14 bp, Homo sapiens
gctttaaaaagaaa

SEQ ID NO: 2995028 - DNA, 17 bp, Homo sapiens
gctttaagctccagctt

SEQ ID NO: 2995029 - DNA, 23 bp, Homo sapiens
gctttaagctccagctttaaggg

SEQ ID NO: 2995030 - DNA, 22 bp, Homo sapiens
gctttaagtaaaaatccaaaaa

SEQ ID NO: 2995031 - DNA, 18 bp, Homo sapiens
gctttacaggatcatgta

SEQ ID NO: 2995032 - DNA, 16 bp, Homo sapiens
gctttaccaaacagca

SEQ ID NO: 2995033 - DNA, 18 bp, Homo sapiens
gctttactgtggctgtct

SEQ ID NO: 2995034 - DNA, 18 bp, Homo sapiens
gctttagggtttaaaata

SEQ ID NO: 2995035 - DNA, 17 bp, Homo sapiens
gctttataccccatttg

SEQ ID NO: 2995036 - DNA, 20 bp, Homo sapiens
gctttatgataatagattct

SEQ ID NO: 2995037 - DNA, 21 bp, Homo sapiens
gctttatgataatagattctc

SEQ ID NO: 2995038 - DNA, 17 bp, Homo sapiens
gctttattccagaatgc

SEQ ID NO: 2995039 - DNA, 15 bp, Homo sapiens
gctttcaaacatgtt

SEQ ID NO: 2995040 - DNA, 23 bp, Homo sapiens
gctttcaaaggagctcgaaggat

SEQ ID NO: 2995041 - DNA, 20 bp, Homo sapiens
gctttcagcgcccccaggcc

SEQ ID NO: 2995042 - DNA, 21 bp, Homo sapiens
gctttcagcgcccccaggcct

SEQ ID NO: 2995043 - DNA, 14 bp, Homo sapiens
gctttcagggcagc

SEQ ID NO: 2995044 - DNA, 21 bp, Homo sapiens
gctttcatcacacccttttaa

SEQ ID NO: 2995045 - DNA, 17 bp, Homo sapiens
gctttcatccaactcta

SEQ ID NO: 2995046 - DNA, 22 bp, Homo sapiens
gctttcatcctgtgtcccctga

SEQ ID NO: 2995047 - DNA, 15 bp, Homo sapiens
gctttcatgtaaact

SEQ ID NO: 2995048 - DNA, 21 bp, Homo sapiens
gctttcatgtaaactgtgcac

SEQ ID NO: 2995049 - DNA, 14 bp, Homo sapiens
gctttccaaagcca

SEQ ID NO: 2995050 - DNA, 15 bp, Homo sapiens
gctttccatgggacc

SEQ ID NO: 2995051 - DNA, 15 bp, Homo sapiens
gctttcccacttccc

SEQ ID NO: 2995052 - DNA, 13 bp, Homo sapiens
gctttcccccagg

SEQ ID NO: 2995053 - DNA, 15 bp, Homo sapiens
gctttcccttggata

SEQ ID NO: 2995054 - DNA, 18 bp, Homo sapiens
gctttcctcaaaaagcag

SEQ ID NO: 2995055 - DNA, 14 bp, Homo sapiens
gctttcctggaagt

SEQ ID NO: 2995056 - DNA, 23 bp, Homo sapiens
gctttccttttttaaaaatgcaa

SEQ ID NO: 2995057 - DNA, 19 bp, Homo sapiens
gctttcgtccacagcttcc

SEQ ID NO: 2995058 - DNA, 21 bp, Homo sapiens
gctttctattacccctcattt

SEQ ID NO: 2995059 - DNA, 18 bp, Homo sapiens
gctttctccccaatgaga

SEQ ID NO: 2995060 - DNA, 10 bp, Homo sapiens
gctttctctt

SEQ ID NO: 2995061 - DNA, 16 bp, Homo sapiens
gctttctctttcagta

SEQ ID NO: 2995062 - DNA, 17 bp, Homo sapiens
gctttctgatcaaggcc

SEQ ID NO: 2995063 - DNA, 17 bp, Homo sapiens
gctttctgccttagcct

SEQ ID NO: 2995064 - DNA, 13 bp, Homo sapiens
gctttctgctcag

SEQ ID NO: 2995065 - DNA, 19 bp, Homo sapiens
gctttctgctcagcttctc

SEQ ID NO: 2995066 - DNA, 13 bp, Homo sapiens
gctttctggtata

SEQ ID NO: 2995067 - DNA, 13 bp, Homo sapiens
gctttctgttcat

SEQ ID NO: 2995068 - DNA, 18 bp, Homo sapiens
gctttctgttcatctctt

SEQ ID NO: 2995069 - DNA, 13 bp, Homo sapiens
gctttcttctttc

SEQ ID NO: 2995070 - DNA, 14 bp, Homo sapiens
gctttcttgtttct

SEQ ID NO: 2995071 - DNA, 10 bp, Homo sapiens
gctttgaaaa

SEQ ID NO: 2995072 - DNA, 14 bp, Homo sapiens
gctttgaacgtgcc

SEQ ID NO: 2995073 - DNA, 15 bp, Homo sapiens
gctttgaacgtgcca

SEQ ID NO: 2995074 - DNA, 16 bp, Homo sapiens
gctttgaacgtgccag

SEQ ID NO: 2995075 - DNA, 19 bp, Homo sapiens
gctttgacgggccaggccc

SEQ ID NO: 2995076 - DNA, 20 bp, Homo sapiens
gctttgattcatagtaactt

SEQ ID NO: 2995077 - DNA, 19 bp, Homo sapiens
gctttgcctcgaaagtgtc

SEQ ID NO: 2995078 - DNA, 12 bp, Homo sapiens
gctttgcgcact

SEQ ID NO: 2995079 - DNA, 12 bp, Homo sapiens
gctttgctgctg

SEQ ID NO: 2995080 - DNA, 18 bp, Homo sapiens
gctttgctgctgaaggct

SEQ ID NO: 2995081 - DNA, 16 bp, Homo sapiens
gctttgctttgtctgg

SEQ ID NO: 2995082 - DNA, 14 bp, Homo sapiens
gctttggcctgagt

SEQ ID NO: 2995083 - DNA, 21 bp, Homo sapiens
gctttggggtcctagcccagt

SEQ ID NO: 2995084 - DNA, 13 bp, Homo sapiens
gctttgtagtttg

SEQ ID NO: 2995085 - DNA, 16 bp, Homo sapiens
gctttgtagtttgctt

SEQ ID NO: 2995086 - DNA, 15 bp, Homo sapiens
gctttgtcccctgct

SEQ ID NO: 2995087 - DNA, 16 bp, Homo sapiens
gctttgtcccctgctt

SEQ ID NO: 2995088 - DNA, 18 bp, Homo sapiens
gctttgtctggaagaaag

SEQ ID NO: 2995089 - DNA, 16 bp, Homo sapiens
gctttgttcttgtcat

SEQ ID NO: 2995090 - DNA, 15 bp, Homo sapiens
gctttgttgcactga

SEQ ID NO: 2995091 - DNA, 19 bp, Homo sapiens
gcttttaacagagtctgaa

SEQ ID NO: 2995092 - DNA, 19 bp, Homo sapiens
gcttttactgaactttctt

SEQ ID NO: 2995093 - DNA, 13 bp, Homo sapiens
gcttttatagttg

SEQ ID NO: 2995094 - DNA, 22 bp, Homo sapiens
gcttttatagttgtattttgta

SEQ ID NO: 2995095 - DNA, 18 bp, Homo sapiens
gcttttatatctgtatgt

SEQ ID NO: 2995096 - DNA, 15 bp, Homo sapiens
gcttttattaatgca

SEQ ID NO: 2995097 - DNA, 18 bp, Homo sapiens
gcttttattaatgcactt

SEQ ID NO: 2995098 - DNA, 22 bp, Homo sapiens
gcttttattaatgcactttcta

SEQ ID NO: 2995099 - DNA, 18 bp, Homo sapiens
gcttttatttcagtgcca

SEQ ID NO: 2995100 - DNA, 21 bp, Homo sapiens
gcttttattttttcttttgta

SEQ ID NO: 2995101 - DNA, 14 bp, Homo sapiens
gcttttcccaaccc

SEQ ID NO: 2995102 - DNA, 18 bp, Homo sapiens
gcttttccccggtccctt

SEQ ID NO: 2995103 - DNA, 22 bp, Homo sapiens
gcttttccccggtcccttgaga

SEQ ID NO: 2995104 - DNA, 21 bp, Homo sapiens
gcttttccttggggcaggcag

SEQ ID NO: 2995105 - DNA, 22 bp, Homo sapiens
gcttttccttggggcaggcagt

SEQ ID NO: 2995106 - DNA, 23 bp, Homo sapiens
gcttttccttggggcaggcagtg

SEQ ID NO: 2995107 - DNA, 17 bp, Homo sapiens
gcttttctgtttcctgt

SEQ ID NO: 2995108 - DNA, 13 bp, Homo sapiens
gcttttgattagt

SEQ ID NO: 2995109 - DNA, 23 bp, Homo sapiens
gcttttgcctgcctgtgctattt

SEQ ID NO: 2995110 - DNA, 14 bp, Homo sapiens
gcttttggtcatca

SEQ ID NO: 2995111 - DNA, 13 bp, Homo sapiens
gcttttgtagatg

SEQ ID NO: 2995112 - DNA, 21 bp, Homo sapiens
gcttttgtctaattaaaacac

SEQ ID NO: 2995113 - DNA, 16 bp, Homo sapiens
gcttttgttctgaggg

SEQ ID NO: 2995114 - DNA, 17 bp, Homo sapiens
gctttttatttctgcat

SEQ ID NO: 2995115 - DNA, 16 bp, Homo sapiens
gctttttgtcttttct

SEQ ID NO: 2995116 - DNA, 21 bp, Homo sapiens
gcttttttcctcctttctctg

SEQ ID NO: 2995117 - DNA, 22 bp, Homo sapiens
gcttttttcctcctttctctgt

SEQ ID NO: 2995118 - DNA, 18 bp, Homo sapiens
ggaaaaaaaaaaaagagg

SEQ ID NO: 2995119 - DNA, 17 bp, Homo sapiens
ggaaaaaaacataaaaa

SEQ ID NO: 2995120 - DNA, 20 bp, Homo sapiens
ggaaaaaaacataaaaagca

SEQ ID NO: 2995121 - DNA, 17 bp, Homo sapiens
ggaaaaaaagactcttt

SEQ ID NO: 2995122 - DNA, 17 bp, Homo sapiens
ggaaaaaagatttttaa

SEQ ID NO: 2995123 - DNA, 15 bp, Homo sapiens
ggaaaaaataaaaat

SEQ ID NO: 2995124 - DNA, 13 bp, Homo sapiens
ggaaaaacaacaa

SEQ ID NO: 2995125 - DNA, 13 bp, Homo sapiens
ggaaaaagccata

SEQ ID NO: 2995126 - DNA, 14 bp, Homo sapiens
ggaaaaataatcaa

SEQ ID NO: 2995127 - DNA, 15 bp, Homo sapiens
ggaaaaatgagtaat

SEQ ID NO: 2995128 - DNA, 22 bp, Homo sapiens
ggaaaacagaacatcattagaa

SEQ ID NO: 2995129 - DNA, 22 bp, Homo sapiens
ggaaaactattccatgttttaa

SEQ ID NO: 2995130 - DNA, 20 bp, Homo sapiens
ggaaaactccaccttcccac

SEQ ID NO: 2995131 - DNA, 13 bp, Homo sapiens
ggaaaacttattt

SEQ ID NO: 2995132 - DNA, 18 bp, Homo sapiens
ggaaaagaaatcaatttt

SEQ ID NO: 2995133 - DNA, 15 bp, Homo sapiens
ggaaaagagctggga

SEQ ID NO: 2995134 - DNA, 14 bp, Homo sapiens
ggaaaagcagctct

SEQ ID NO: 2995135 - DNA, 20 bp, Homo sapiens
ggaaaagccaagaggctgca

SEQ ID NO: 2995136 - DNA, 23 bp, Homo sapiens
ggaaaagcgtctttaagagactc

SEQ ID NO: 2995137 - DNA, 14 bp, Homo sapiens
ggaaaatgcattgt

SEQ ID NO: 2995138 - DNA, 19 bp, Homo sapiens
ggaaaatgtatccagagga

SEQ ID NO: 2995139 - DNA, 22 bp, Homo sapiens
ggaaacaaagcttagcaggaga

SEQ ID NO: 2995140 - DNA, 16 bp, Homo sapiens
ggaaacaacagcttta

SEQ ID NO: 2995141 - DNA, 20 bp, Homo sapiens
ggaaacaattctttcaactg

SEQ ID NO: 2995142 - DNA, 18 bp, Homo sapiens
ggaaacagaggtaaaaaa

SEQ ID NO: 2995143 - DNA, 17 bp, Homo sapiens
ggaaacagcaaacagtg

SEQ ID NO: 2995144 - DNA, 18 bp, Homo sapiens
ggaaacatatttaagaaa

SEQ ID NO: 2995145 - DNA, 19 bp, Homo sapiens
ggaaaccaagtcaggccag

SEQ ID NO: 2995146 - DNA, 22 bp, Homo sapiens
ggaaaccaagtcaggccaggtg

SEQ ID NO: 2995147 - DNA, 19 bp, Homo sapiens
ggaaacccataggcccaca

SEQ ID NO: 2995148 - DNA, 23 bp, Homo sapiens
ggaaacccataggcccacacaca

SEQ ID NO: 2995149 - DNA, 23 bp, Homo sapiens
gctgtggtgtgtccccctctgtc

SEQ ID NO: 2995150 - DNA, 16 bp, Homo sapiens
gctgtgtaaagttagt

SEQ ID NO: 2995151 - DNA, 18 bp, Homo sapiens
gctgtgtccttgcacctg

SEQ ID NO: 2995152 - DNA, 23 bp, Homo sapiens
gctgtgtccttgcacctgcatcc

SEQ ID NO: 2995153 - DNA, 13 bp, Homo sapiens
gctgtgtctctgt

SEQ ID NO: 2995154 - DNA, 13 bp, Homo sapiens
gctgtgtgacctt

SEQ ID NO: 2995155 - DNA, 16 bp, Homo sapiens
gctgtgtgctctccaa

SEQ ID NO: 2995156 - DNA, 14 bp, Homo sapiens
gctgtgtgtcccag

SEQ ID NO: 2995157 - DNA, 18 bp, Homo sapiens
gctgtgtgtcccaggcag

SEQ ID NO: 2995158 - DNA, 20 bp, Homo sapiens
gctgtgtgtcccaggcaggg

SEQ ID NO: 2995159 - DNA, 23 bp, Homo sapiens
gctgtgtgtcccaggcagggaga

SEQ ID NO: 2995160 - DNA, 19 bp, Homo sapiens
gctgtgtgttttcaatcct

SEQ ID NO: 2995161 - DNA, 17 bp, Homo sapiens
gctgtgttaactgttca

SEQ ID NO: 2995162 - DNA, 14 bp, Homo sapiens
gctgtgttacttga

SEQ ID NO: 2995163 - DNA, 17 bp, Homo sapiens
gctgtgttacttgaagt

SEQ ID NO: 2995164 - DNA, 18 bp, Homo sapiens
gctgtgttacttgaagta

SEQ ID NO: 2995165 - DNA, 23 bp, Homo sapiens
gctgtgtttggctttcagggagg

SEQ ID NO: 2995166 - DNA, 13 bp, Homo sapiens
gctgttaaagata

SEQ ID NO: 2995167 - DNA, 19 bp, Homo sapiens
gctgttaaagatattttta

SEQ ID NO: 2995168 - DNA, 21 bp, Homo sapiens
gctgttattatatttgacatg

SEQ ID NO: 2995169 - DNA, 22 bp, Homo sapiens
gctgttcacccacagggctaag

SEQ ID NO: 2995170 - DNA, 17 bp, Homo sapiens
gctgttccacaaagcag

SEQ ID NO: 2995171 - DNA, 13 bp, Homo sapiens
gctgttcctgtgt

SEQ ID NO: 2995172 - DNA, 16 bp, Homo sapiens
gctgttgaacttttta

SEQ ID NO: 2995173 - DNA, 14 bp, Homo sapiens
gctgttgcaggcag

SEQ ID NO: 2995174 - DNA, 15 bp, Homo sapiens
gctgttgcaggcagt

SEQ ID NO: 2995175 - DNA, 16 bp, Homo sapiens
gctgttggtcctctct

SEQ ID NO: 2995176 - DNA, 22 bp, Homo sapiens
gctgttggtcctctctctgtgg

SEQ ID NO: 2995177 - DNA, 11 bp, Homo sapiens
gctgtttcctt

SEQ ID NO: 2995178 - DNA, 14 bp, Homo sapiens
gctgtttgcttcac

SEQ ID NO: 2995179 - DNA, 15 bp, Homo sapiens
gctgttttcctccct

SEQ ID NO: 2995180 - DNA, 22 bp, Homo sapiens
gcttaaacttgacccaggtggc

SEQ ID NO: 2995181 - DNA, 17 bp, Homo sapiens
gcttaagggagtttaat

SEQ ID NO: 2995182 - DNA, 17 bp, Homo sapiens
gcttaataaaaatgaca

SEQ ID NO: 2995183 - DNA, 19 bp, Homo sapiens
gcttaataaaaatgacaga

SEQ ID NO: 2995184 - DNA, 21 bp, Homo sapiens
gcttaataaaaatgacagact

SEQ ID NO: 2995185 - DNA, 20 bp, Homo sapiens
gcttaataataattgaagaa

SEQ ID NO: 2995186 - DNA, 21 bp, Homo sapiens
gcttaataataattgaagaat

SEQ ID NO: 2995187 - DNA, 15 bp, Homo sapiens
gcttaatcattttca

SEQ ID NO: 2995188 - DNA, 19 bp, Homo sapiens
gcttacaagccagctggag

SEQ ID NO: 2995189 - DNA, 22 bp, Homo sapiens
gcttacaagccagctggagaaa

SEQ ID NO: 2995190 - DNA, 16 bp, Homo sapiens
gcttacaatctttatt

SEQ ID NO: 2995191 - DNA, 19 bp, Homo sapiens
gcttacaatttttttaatt

SEQ ID NO: 2995192 - DNA, 18 bp, Homo sapiens
gcttacaggcatgagcca

SEQ ID NO: 2995193 - DNA, 18 bp, Homo sapiens
gcttacagtaaatgaact

SEQ ID NO: 2995194 - DNA, 22 bp, Homo sapiens
gcttacgtactacttgtttcaa

SEQ ID NO: 2995195 - DNA, 18 bp, Homo sapiens
gcttagaacccttctgct

SEQ ID NO: 2995196 - DNA, 17 bp, Homo sapiens
gcttagattctgtatgc

SEQ ID NO: 2995197 - DNA, 23 bp, Homo sapiens
gcttagcaggagaggagagccag

SEQ ID NO: 2995198 - DNA, 14 bp, Homo sapiens
gcttagcgctctgg

SEQ ID NO: 2995199 - DNA, 23 bp, Homo sapiens
gcttaggagacagatcactcctg

SEQ ID NO: 2995200 - DNA, 15 bp, Homo sapiens
gcttatctccctgct

SEQ ID NO: 2995201 - DNA, 17 bp, Homo sapiens
gcttatctccctgcttc

SEQ ID NO: 2995202 - DNA, 15 bp, Homo sapiens
gcttatctcttttat

SEQ ID NO: 2995203 - DNA, 18 bp, Homo sapiens
gcttatgatgggctcccc

SEQ ID NO: 2995204 - DNA, 15 bp, Homo sapiens
gcttatggtaccaga

SEQ ID NO: 2995205 - DNA, 12 bp, Homo sapiens
gcttatgtttct

SEQ ID NO: 2995206 - DNA, 19 bp, Homo sapiens
gcttattacatttaaatcc

SEQ ID NO: 2995207 - DNA, 20 bp, Homo sapiens
gcttattgtgtgcgctgcct

SEQ ID NO: 2995208 - DNA, 14 bp, Homo sapiens
gcttatttagaaaa

SEQ ID NO: 2995209 - DNA, 19 bp, Homo sapiens
gcttcaatagttcaaggaa

SEQ ID NO: 2995210 - DNA, 15 bp, Homo sapiens
gcttcaattaaaatt

SEQ ID NO: 2995211 - DNA, 13 bp, Homo sapiens
gcttcacagtgat

SEQ ID NO: 2995212 - DNA, 19 bp, Homo sapiens
gcttcaccccaatcccagc

SEQ ID NO: 2995213 - DNA, 20 bp, Homo sapiens
gcttcagatgtggagccagg

SEQ ID NO: 2995214 - DNA, 16 bp, Homo sapiens
gcttcagccacagttt

SEQ ID NO: 2995215 - DNA, 17 bp, Homo sapiens
gcttcagcctccccacc

SEQ ID NO: 2995216 - DNA, 16 bp, Homo sapiens
gcttcagctccagccc

SEQ ID NO: 2995217 - DNA, 22 bp, Homo sapiens
gcttcaggaacctcgagtactg

SEQ ID NO: 2995218 - DNA, 23 bp, Homo sapiens
gcttcaggaacctcgagtactgt

SEQ ID NO: 2995219 - DNA, 21 bp, Homo sapiens
gcttccaagaccatttgtagt

SEQ ID NO: 2995220 - DNA, 15 bp, Homo sapiens
gcttccagagctctg

SEQ ID NO: 2995221 - DNA, 19 bp, Homo sapiens
gcttccagagctctgaccc

SEQ ID NO: 2995222 - DNA, 12 bp, Homo sapiens
gcttccaggctg

SEQ ID NO: 2995223 - DNA, 15 bp, Homo sapiens
gcttccaggctgggc

SEQ ID NO: 2995224 - DNA, 15 bp, Homo sapiens
gcttccatggcttcc

SEQ ID NO: 2995225 - DNA, 19 bp, Homo sapiens
gcttccatggcttcctgag

SEQ ID NO: 2995226 - DNA, 15 bp, Homo sapiens
gcttcccacacctgc

SEQ ID NO: 2995227 - DNA, 19 bp, Homo sapiens
gcttcccacacctgcctgc

SEQ ID NO: 2995228 - DNA, 18 bp, Homo sapiens
gcttcccctctctcctcc

SEQ ID NO: 2995229 - DNA, 14 bp, Homo sapiens
gcttccctgactca

SEQ ID NO: 2995230 - DNA, 18 bp, Homo sapiens
gcttccctgacttgcttt

SEQ ID NO: 2995231 - DNA, 14 bp, Homo sapiens
gcttccgcatccta

SEQ ID NO: 2995232 - DNA, 12 bp, Homo sapiens
gcttcctagctt

SEQ ID NO: 2995233 - DNA, 22 bp, Homo sapiens
gcttcctagcttatctccctgc

SEQ ID NO: 2995234 - DNA, 23 bp, Homo sapiens
gcttcctagcttatctccctgct

SEQ ID NO: 2995235 - DNA, 12 bp, Homo sapiens
gcttcctccaga

SEQ ID NO: 2995236 - DNA, 18 bp, Homo sapiens
gcttcctccagaggaggg

SEQ ID NO: 2995237 - DNA, 14 bp, Homo sapiens
gcttcctcccaaca

SEQ ID NO: 2995238 - DNA, 23 bp, Homo sapiens
gcttcctgagaaagcccacctgg

SEQ ID NO: 2995239 - DNA, 17 bp, Homo sapiens
gcttcctgagcagtccc

SEQ ID NO: 2995240 - DNA, 21 bp, Homo sapiens
gcttcctgagcagtccctgct

SEQ ID NO: 2995241 - DNA, 20 bp, Homo sapiens
gcttcctgtccccatctgtc

SEQ ID NO: 2995242 - DNA, 16 bp, Homo sapiens
gcttcggtgtgcagat

SEQ ID NO: 2995243 - DNA, 23 bp, Homo sapiens
gcttcggtgtgcagatcatccgt

SEQ ID NO: 2995244 - DNA, 17 bp, Homo sapiens
gcttctaaatgcccagt

SEQ ID NO: 2995245 - DNA, 17 bp, Homo sapiens
gcttctaccatgaacag

SEQ ID NO: 2995246 - DNA, 20 bp, Homo sapiens
gcttctacggccatgagact

SEQ ID NO: 2995247 - DNA, 20 bp, Homo sapiens
gcttctagttctgccaggag

SEQ ID NO: 2995248 - DNA, 18 bp, Homo sapiens
gcttctcccggacctgga

SEQ ID NO: 2995249 - DNA, 17 bp, Homo sapiens
gcttctcctttggcatg

SEQ ID NO: 2995250 - DNA, 22 bp, Homo sapiens
gcttctcctttggcatgtttaa

SEQ ID NO: 2995251 - DNA, 14 bp, Homo sapiens
gcttctctctgtgg

SEQ ID NO: 2995252 - DNA, 20 bp, Homo sapiens
gcttctctttacagctttgt

SEQ ID NO: 2995253 - DNA, 13 bp, Homo sapiens
gcttctcttttcc

SEQ ID NO: 2995254 - DNA, 19 bp, Homo sapiens
gcttctgcgtccaccaggc

SEQ ID NO: 2995255 - DNA, 20 bp, Homo sapiens
gcttctgcgtccaccaggcc

SEQ ID NO: 2995256 - DNA, 18 bp, Homo sapiens
gcttctggctttgttctt

SEQ ID NO: 2995257 - DNA, 19 bp, Homo sapiens
gcttctggggtccccaggg

SEQ ID NO: 2995258 - DNA, 20 bp, Homo sapiens
gcttctggggtccccagggc

SEQ ID NO: 2995259 - DNA, 21 bp, Homo sapiens
gcttctggggtccccagggct

SEQ ID NO: 2995260 - DNA, 18 bp, Homo sapiens
gcttcttgtgaaggccat

SEQ ID NO: 2995261 - DNA, 13 bp, Homo sapiens
gcttgaacccagg

SEQ ID NO: 2995262 - DNA, 15 bp, Homo sapiens
gcttgaacctgggaa

SEQ ID NO: 2995263 - DNA, 12 bp, Homo sapiens
gcttgagctcag

SEQ ID NO: 2995264 - DNA, 19 bp, Homo sapiens
gcttgatgggattctggac

SEQ ID NO: 2995265 - DNA, 13 bp, Homo sapiens
gcttgcagccagg

SEQ ID NO: 2995266 - DNA, 16 bp, Homo sapiens
gcttgcagccaggaga

SEQ ID NO: 2995267 - DNA, 17 bp, Homo sapiens
gcttgcagtgaagtgtt

SEQ ID NO: 2995268 - DNA, 15 bp, Homo sapiens
gcttgccaaagcaga

SEQ ID NO: 2995269 - DNA, 19 bp, Homo sapiens
gcttgccagggatgggcag

SEQ ID NO: 2995270 - DNA, 14 bp, Homo sapiens
gcttgcctgcaggg

SEQ ID NO: 2995271 - DNA, 15 bp, Homo sapiens
gcttgcctgcagggc

SEQ ID NO: 2995272 - DNA, 19 bp, Homo sapiens
gcttgcctgggctgggcag

SEQ ID NO: 2995273 - DNA, 23 bp, Homo sapiens
gcttgcctgggctgggcagcctt

SEQ ID NO: 2995274 - DNA, 16 bp, Homo sapiens
gcttgcgaactagaga

SEQ ID NO: 2995275 - DNA, 21 bp, Homo sapiens
gcttgcgaactagagatgtgc

SEQ ID NO: 2995276 - DNA, 14 bp, Homo sapiens
gcttggagcagagg

SEQ ID NO: 2995277 - DNA, 14 bp, Homo sapiens
gcttggagctgagc

SEQ ID NO: 2995278 - DNA, 15 bp, Homo sapiens
gcttggagctgagca

SEQ ID NO: 2995279 - DNA, 19 bp, Homo sapiens
gcttggatcctgggctggg

SEQ ID NO: 2995280 - DNA, 14 bp, Homo sapiens
gcttggcatctgtg

SEQ ID NO: 2995281 - DNA, 15 bp, Homo sapiens
gcttggcatctgtgt

SEQ ID NO: 2995282 - DNA, 22 bp, Homo sapiens
gcttgggaaaggtggtgtttct

SEQ ID NO: 2995283 - DNA, 16 bp, Homo sapiens
gcttgggctggtcaga

SEQ ID NO: 2995284 - DNA, 13 bp, Homo sapiens
gcttggggccagg

SEQ ID NO: 2995285 - DNA, 19 bp, Homo sapiens
gctggcctccctccgtccc

SEQ ID NO: 2995286 - DNA, 13 bp, Homo sapiens
gctggcctgctct

SEQ ID NO: 2995287 - DNA, 13 bp, Homo sapiens
gctggcctggagg

SEQ ID NO: 2995288 - DNA, 12 bp, Homo sapiens
gctggccttggt

SEQ ID NO: 2995289 - DNA, 16 bp, Homo sapiens
gctggcgacactcagg

SEQ ID NO: 2995290 - DNA, 23 bp, Homo sapiens
gctggcgacactcagggcagctg

SEQ ID NO: 2995291 - DNA, 16 bp, Homo sapiens
gctggcggctactcag

SEQ ID NO: 2995292 - DNA, 20 bp, Homo sapiens
gctggcggctactcagcagc

SEQ ID NO: 2995293 - DNA, 21 bp, Homo sapiens
gctggcggctactcagcagcc

SEQ ID NO: 2995294 - DNA, 18 bp, Homo sapiens
gctggctcacgccccgct

SEQ ID NO: 2995295 - DNA, 14 bp, Homo sapiens
gctggctccagatg

SEQ ID NO: 2995296 - DNA, 22 bp, Homo sapiens
gctggctccagatgcagggcag

SEQ ID NO: 2995297 - DNA, 17 bp, Homo sapiens
gctggctctgtggaggg

SEQ ID NO: 2995298 - DNA, 23 bp, Homo sapiens
gctggctgcttgcagccaggaga

SEQ ID NO: 2995299 - DNA, 21 bp, Homo sapiens
gctggctggggtggcctgtgt

SEQ ID NO: 2995300 - DNA, 15 bp, Homo sapiens
gctggcttgggcagc

SEQ ID NO: 2995301 - DNA, 21 bp, Homo sapiens
gctggcttttctgtttcctgt

SEQ ID NO: 2995302 - DNA, 20 bp, Homo sapiens
gctgggaaacactccttgca

SEQ ID NO: 2995303 - DNA, 22 bp, Homo sapiens
gctgggacgtggctcagccagc

SEQ ID NO: 2995304 - DNA, 21 bp, Homo sapiens
gctgggaggagggcaggcatc

SEQ ID NO: 2995305 - DNA, 21 bp, Homo sapiens
gctgggaggtataggggtcct

SEQ ID NO: 2995306 - DNA, 22 bp, Homo sapiens
gctgggattacaggcgtgagcc

SEQ ID NO: 2995307 - DNA, 19 bp, Homo sapiens
gctgggattacaggtgtga

SEQ ID NO: 2995308 - DNA, 19 bp, Homo sapiens
gctgggcacttccctgctg

SEQ ID NO: 2995309 - DNA, 21 bp, Homo sapiens
gctgggcagcacaaggccttg

SEQ ID NO: 2995310 - DNA, 11 bp, Homo sapiens
gctgggcagcc

SEQ ID NO: 2995311 - DNA, 15 bp, Homo sapiens
gctgggcagccttgg

SEQ ID NO: 2995312 - DNA, 13 bp, Homo sapiens
gctgggcccacag

SEQ ID NO: 2995313 - DNA, 22 bp, Homo sapiens
gctgggcccacagcccccaccc

SEQ ID NO: 2995314 - DNA, 13 bp, Homo sapiens
gctgggcccagca

SEQ ID NO: 2995315 - DNA, 22 bp, Homo sapiens
gctgggcccgacatggctccgg

SEQ ID NO: 2995316 - DNA, 16 bp, Homo sapiens
gctgggccgcaagggc

SEQ ID NO: 2995317 - DNA, 13 bp, Homo sapiens
gctgggctctcca

SEQ ID NO: 2995318 - DNA, 19 bp, Homo sapiens
gctgggctctccacctcag

SEQ ID NO: 2995319 - DNA, 21 bp, Homo sapiens
gctgggctctccacctcagcc

SEQ ID NO: 2995320 - DNA, 13 bp, Homo sapiens
gctgggctgagcc

SEQ ID NO: 2995321 - DNA, 14 bp, Homo sapiens
gctgggctgagcca

SEQ ID NO: 2995322 - DNA, 20 bp, Homo sapiens
gctggggaagtacgtcccag

SEQ ID NO: 2995323 - DNA, 18 bp, Homo sapiens
gctggggccggggctgag

SEQ ID NO: 2995324 - DNA, 16 bp, Homo sapiens
gctggggcctcagacg

SEQ ID NO: 2995325 - DNA, 15 bp, Homo sapiens
gctgggggagggact

SEQ ID NO: 2995326 - DNA, 14 bp, Homo sapiens
gctgggggcaactg

SEQ ID NO: 2995327 - DNA, 13 bp, Homo sapiens
gctgggggctccc

SEQ ID NO: 2995328 - DNA, 18 bp, Homo sapiens
gctgggggctccccttgc

SEQ ID NO: 2995329 - DNA, 23 bp, Homo sapiens
gctgggggctccccttgcccttc

SEQ ID NO: 2995330 - DNA, 18 bp, Homo sapiens
gctgggggtgggccaggc

SEQ ID NO: 2995331 - DNA, 19 bp, Homo sapiens
gctggggtacacagtgaga

SEQ ID NO: 2995332 - DNA, 14 bp, Homo sapiens
gctggggtctcagg

SEQ ID NO: 2995333 - DNA, 19 bp, Homo sapiens
gctggggtctcaggtccag

SEQ ID NO: 2995334 - DNA, 18 bp, Homo sapiens
gctggggtggcctgtgtg

SEQ ID NO: 2995335 - DNA, 17 bp, Homo sapiens
gctgggtcacaggaagg

SEQ ID NO: 2995336 - DNA, 15 bp, Homo sapiens
gctgggtcaggcagg

SEQ ID NO: 2995337 - DNA, 16 bp, Homo sapiens
gctgggtcaggcaggg

SEQ ID NO: 2995338 - DNA, 18 bp, Homo sapiens
gctgggtgagctcttcca

SEQ ID NO: 2995339 - DNA, 22 bp, Homo sapiens
gctgggtggtagatttcctcct

SEQ ID NO: 2995340 - DNA, 17 bp, Homo sapiens
gctgggtttgctgtctt

SEQ ID NO: 2995341 - DNA, 20 bp, Homo sapiens
gctgggtttgctgtcttggg

SEQ ID NO: 2995342 - DNA, 15 bp, Homo sapiens
gctggtagctgaggg

SEQ ID NO: 2995343 - DNA, 16 bp, Homo sapiens
gctggtattctctcta

SEQ ID NO: 2995344 - DNA, 17 bp, Homo sapiens
gctggtattctctctat

SEQ ID NO: 2995345 - DNA, 13 bp, Homo sapiens
gctggtcactctg

SEQ ID NO: 2995346 - DNA, 18 bp, Homo sapiens
gctggtcactctgccctc

SEQ ID NO: 2995347 - DNA, 19 bp, Homo sapiens
gctggtcactctgccctct

SEQ ID NO: 2995348 - DNA, 12 bp, Homo sapiens
gctggtcagagt

SEQ ID NO: 2995349 - DNA, 22 bp, Homo sapiens
gctggtccgagctgaggactct

SEQ ID NO: 2995350 - DNA, 14 bp, Homo sapiens
gctggtgacagcct

SEQ ID NO: 2995351 - DNA, 15 bp, Homo sapiens
gctggtgcccccaga

SEQ ID NO: 2995352 - DNA, 18 bp, Homo sapiens
gctggtgcctgaagaccc

SEQ ID NO: 2995353 - DNA, 15 bp, Homo sapiens
gctggtgcctgagcc

SEQ ID NO: 2995354 - DNA, 16 bp, Homo sapiens
gctggtgcctgctttg

SEQ ID NO: 2995355 - DNA, 20 bp, Homo sapiens
gctggtggattgggcagaat

SEQ ID NO: 2995356 - DNA, 12 bp, Homo sapiens
gctggtggccca

SEQ ID NO: 2995357 - DNA, 14 bp, Homo sapiens
gctggtggcccagg

SEQ ID NO: 2995358 - DNA, 20 bp, Homo sapiens
gctggtggtcatgaattcat

SEQ ID NO: 2995359 - DNA, 13 bp, Homo sapiens
gctggttcctctc

SEQ ID NO: 2995360 - DNA, 13 bp, Homo sapiens
gctggttctgttt

SEQ ID NO: 2995361 - DNA, 23 bp, Homo sapiens
gctggtttatttgttgttttctg

SEQ ID NO: 2995362 - DNA, 14 bp, Homo sapiens
gctggtttgttctg

SEQ ID NO: 2995363 - DNA, 15 bp, Homo sapiens
gctgtaatcatttgt

SEQ ID NO: 2995364 - DNA, 22 bp, Homo sapiens
gctgtaatcatttgtttacatt

SEQ ID NO: 2995365 - DNA, 21 bp, Homo sapiens
gctgtaatttagttaataaaa

SEQ ID NO: 2995366 - DNA, 20 bp, Homo sapiens
gctgtacatctattttggat

SEQ ID NO: 2995367 - DNA, 16 bp, Homo sapiens
gctgtagataacagca

SEQ ID NO: 2995368 - DNA, 13 bp, Homo sapiens
gctgtaggtgtgc

SEQ ID NO: 2995369 - DNA, 21 bp, Homo sapiens
gctgtatataaacgtgtcccg

SEQ ID NO: 2995370 - DNA, 18 bp, Homo sapiens
gctgtatcttgtttttcc

SEQ ID NO: 2995371 - DNA, 21 bp, Homo sapiens
gctgtatgatttgttttgaat

SEQ ID NO: 2995372 - DNA, 17 bp, Homo sapiens
gctgtattaagccactt

SEQ ID NO: 2995373 - DNA, 13 bp, Homo sapiens
gctgtattcatga

SEQ ID NO: 2995374 - DNA, 17 bp, Homo sapiens
gctgtattgaatcatgt

SEQ ID NO: 2995375 - DNA, 17 bp, Homo sapiens
gctgtatttacagacac

SEQ ID NO: 2995376 - DNA, 14 bp, Homo sapiens
gctgtattttgagt

SEQ ID NO: 2995377 - DNA, 16 bp, Homo sapiens
gctgtcaccaaggaaa

SEQ ID NO: 2995378 - DNA, 21 bp, Homo sapiens
gctgtcacctctcccacggga

SEQ ID NO: 2995379 - DNA, 22 bp, Homo sapiens
gctgtcacctctcccacgggac

SEQ ID NO: 2995380 - DNA, 13 bp, Homo sapiens
gctgtcagcctgg

SEQ ID NO: 2995381 - DNA, 17 bp, Homo sapiens
gctgtcatcaacattct

SEQ ID NO: 2995382 - DNA, 11 bp, Homo sapiens
gctgtcatctg

SEQ ID NO: 2995383 - DNA, 14 bp, Homo sapiens
gctgtcatctgtgc

SEQ ID NO: 2995384 - DNA, 22 bp, Homo sapiens
gctgtcatctgtgcactgccca

SEQ ID NO: 2995385 - DNA, 20 bp, Homo sapiens
gctgtcccaagctcccaaga

SEQ ID NO: 2995386 - DNA, 19 bp, Homo sapiens
gctgtcccaagtcctccgg

SEQ ID NO: 2995387 - DNA, 15 bp, Homo sapiens
gctgtccctgcactg

SEQ ID NO: 2995388 - DNA, 18 bp, Homo sapiens
gctgtccctgcactgtgc

SEQ ID NO: 2995389 - DNA, 19 bp, Homo sapiens
gctgtccctgcactgtgcc

SEQ ID NO: 2995390 - DNA, 20 bp, Homo sapiens
gctgtccctgcactgtgccc

SEQ ID NO: 2995391 - DNA, 18 bp, Homo sapiens
gctgtccctgtcaccaag

SEQ ID NO: 2995392 - DNA, 13 bp, Homo sapiens
gctgtcctggtgg

SEQ ID NO: 2995393 - DNA, 18 bp, Homo sapiens
gctgtcctggtggctggg

SEQ ID NO: 2995394 - DNA, 19 bp, Homo sapiens
gctgtcctggtggctgggc

SEQ ID NO: 2995395 - DNA, 17 bp, Homo sapiens
gctgtccttacccatct

SEQ ID NO: 2995396 - DNA, 19 bp, Homo sapiens
gctgtctctctgggctgca

SEQ ID NO: 2995397 - DNA, 23 bp, Homo sapiens
gctgtctggatccttcccaaggt

SEQ ID NO: 2995398 - DNA, 18 bp, Homo sapiens
gctgtctgtcatctgctg

SEQ ID NO: 2995399 - DNA, 17 bp, Homo sapiens
gctgtctttgcagggca

SEQ ID NO: 2995400 - DNA, 22 bp, Homo sapiens
gctgtgaataaaaagaaagatt

SEQ ID NO: 2995401 - DNA, 19 bp, Homo sapiens
gctgtgacattgctggtca

SEQ ID NO: 2995402 - DNA, 18 bp, Homo sapiens
gctgtgacgcagccggag

SEQ ID NO: 2995403 - DNA, 18 bp, Homo sapiens
gctgtgactctgggcagg

SEQ ID NO: 2995404 - DNA, 19 bp, Homo sapiens
gctgtgactctgggcaggg

SEQ ID NO: 2995405 - DNA, 17 bp, Homo sapiens
gctgtgactgtgtcccc

SEQ ID NO: 2995406 - DNA, 15 bp, Homo sapiens
gctgtgagacagtgg

SEQ ID NO: 2995407 - DNA, 18 bp, Homo sapiens
gctgtgagacagtgggaa

SEQ ID NO: 2995408 - DNA, 20 bp, Homo sapiens
gctgtgagacagtgggaaat

SEQ ID NO: 2995409 - DNA, 20 bp, Homo sapiens
gctgtgagtctttggttcta

SEQ ID NO: 2995410 - DNA, 19 bp, Homo sapiens
gctgtgcaacgccgtgggc

SEQ ID NO: 2995411 - DNA, 17 bp, Homo sapiens
gctgtgcccctccccca

SEQ ID NO: 2995412 - DNA, 18 bp, Homo sapiens
gctgtgccctcctgggag

SEQ ID NO: 2995413 - DNA, 11 bp, Homo sapiens
gctgtgcctgg

SEQ ID NO: 2995414 - DNA, 17 bp, Homo sapiens
gctgtgctacgtgtgaa

SEQ ID NO: 2995415 - DNA, 23 bp, Homo sapiens
gctgtgctacgtgtgaaatctgt

SEQ ID NO: 2995416 - DNA, 15 bp, Homo sapiens
gctgtgctatgaatt

SEQ ID NO: 2995417 - DNA, 17 bp, Homo sapiens
gctgtgctatggtgctc

SEQ ID NO: 2995418 - DNA, 19 bp, Homo sapiens
gctgtgctgccctgaagaa

SEQ ID NO: 2995419 - DNA, 20 bp, Homo sapiens
gctgtggaatgaagcttttt

SEQ ID NO: 2995420 - DNA, 23 bp, Homo sapiens
gctgtggagacaatgtctgcagc

SEQ ID NO: 2995421 - DNA, 17 bp, Homo sapiens
gcaccgaccccgggccg

SEQ ID NO: 2995422 - DNA, 16 bp, Homo sapiens
gcaccgacccgaggcc

SEQ ID NO: 2995423 - DNA, 20 bp, Homo sapiens
gcaccgacccgaggcccaga

SEQ ID NO: 2995424 - DNA, 20 bp, Homo sapiens
gcaccgccggctttcagggc

SEQ ID NO: 2995425 - DNA, 13 bp, Homo sapiens
gcaccgcctgccc

SEQ ID NO: 2995426 - DNA, 19 bp, Homo sapiens
gcaccggggcctgggcagg

SEQ ID NO: 2995427 - DNA, 20 bp, Homo sapiens
gcaccggggcctgggcagga

SEQ ID NO: 2995428 - DNA, 22 bp, Homo sapiens
gcaccgtgccaaccccacccag

SEQ ID NO: 2995429 - DNA, 15 bp, Homo sapiens
gcaccgttctgtgca

SEQ ID NO: 2995430 - DNA, 18 bp, Homo sapiens
gcacctaatccaggcaga

SEQ ID NO: 2995431 - DNA, 18 bp, Homo sapiens
gcacctatctcagccata

SEQ ID NO: 2995432 - DNA, 18 bp, Homo sapiens
gcacctcagcctgcacag

SEQ ID NO: 2995433 - DNA, 18 bp, Homo sapiens
gcacctccacatcctcca

SEQ ID NO: 2995434 - DNA, 21 bp, Homo sapiens
gcacctccccccactgcaggc

SEQ ID NO: 2995435 - DNA, 20 bp, Homo sapiens
gcacctctgagccggagggc

SEQ ID NO: 2995436 - DNA, 18 bp, Homo sapiens
gcacctgaccgctgccca

SEQ ID NO: 2995437 - DNA, 19 bp, Homo sapiens
gcacctgaccgctgcccag

SEQ ID NO: 2995438 - DNA, 22 bp, Homo sapiens
gcacctgaccgctgcccaggtg

SEQ ID NO: 2995439 - DNA, 21 bp, Homo sapiens
gcacctgccgacctcgtcctc

SEQ ID NO: 2995440 - DNA, 14 bp, Homo sapiens
gcacctgcctagct

SEQ ID NO: 2995441 - DNA, 14 bp, Homo sapiens
gcacctgcctcagc

SEQ ID NO: 2995442 - DNA, 15 bp, Homo sapiens
gcacctgcctcagga

SEQ ID NO: 2995443 - DNA, 16 bp, Homo sapiens
gcacctgcctcaggac

SEQ ID NO: 2995444 - DNA, 20 bp, Homo sapiens
gcacctggaccccctgcccg

SEQ ID NO: 2995445 - DNA, 17 bp, Homo sapiens
gcacctggtgggtggtg

SEQ ID NO: 2995446 - DNA, 22 bp, Homo sapiens
gcacctgtacagtggaaccgtt

SEQ ID NO: 2995447 - DNA, 23 bp, Homo sapiens
gcacctgtacagtggaaccgttg

SEQ ID NO: 2995448 - DNA, 14 bp, Homo sapiens
gcacctgtgctgga

SEQ ID NO: 2995449 - DNA, 14 bp, Homo sapiens
gcaccttggcccag

SEQ ID NO: 2995450 - DNA, 16 bp, Homo sapiens
gcaccttggcccagga

SEQ ID NO: 2995451 - DNA, 18 bp, Homo sapiens
gcaccttggcccaggagc

SEQ ID NO: 2995452 - DNA, 14 bp, Homo sapiens
gcaccttgtgcctg

SEQ ID NO: 2995453 - DNA, 14 bp, Homo sapiens
gcaccttgtgtctg

SEQ ID NO: 2995454 - DNA, 22 bp, Homo sapiens
gcaccttgtgtctgtacacgtg

SEQ ID NO: 2995455 - DNA, 18 bp, Homo sapiens
gcacctttctagttgaaa

SEQ ID NO: 2995456 - DNA, 17 bp, Homo sapiens
gcacgaacccacctgct

SEQ ID NO: 2995457 - DNA, 17 bp, Homo sapiens
gcacgacccttaggcct

SEQ ID NO: 2995458 - DNA, 15 bp, Homo sapiens
gcacgatctcagctc

SEQ ID NO: 2995459 - DNA, 16 bp, Homo sapiens
gcacgatctcagctca

SEQ ID NO: 2995460 - DNA, 20 bp, Homo sapiens
gcacgcacctgtagtcccag

SEQ ID NO: 2995461 - DNA, 13 bp, Homo sapiens
gcacgcctgccat

SEQ ID NO: 2995462 - DNA, 16 bp, Homo sapiens
gcacgcctgccatctt

SEQ ID NO: 2995463 - DNA, 22 bp, Homo sapiens
gcacggacatggtctgtcctga

SEQ ID NO: 2995464 - DNA, 19 bp, Homo sapiens
gcacggcccggcccctcac

SEQ ID NO: 2995465 - DNA, 19 bp, Homo sapiens
gcacgggcatgcacacggc

SEQ ID NO: 2995466 - DNA, 19 bp, Homo sapiens
gcacgtgtgggccgtggct

SEQ ID NO: 2995467 - DNA, 14 bp, Homo sapiens
gcactaaggggccc

SEQ ID NO: 2995468 - DNA, 12 bp, Homo sapiens
gcactacattca

SEQ ID NO: 2995469 - DNA, 20 bp, Homo sapiens
gcactaccactcctgccaag

SEQ ID NO: 2995470 - DNA, 21 bp, Homo sapiens
gcactaccactcctgccaagg

SEQ ID NO: 2995471 - DNA, 18 bp, Homo sapiens
gcactagaaattgggcag

SEQ ID NO: 2995472 - DNA, 18 bp, Homo sapiens
gcactagtcaccgacagc

SEQ ID NO: 2995473 - DNA, 21 bp, Homo sapiens
gcactagtcaccgacagcggc

SEQ ID NO: 2995474 - DNA, 19 bp, Homo sapiens
gcactatctttcagctcca

SEQ ID NO: 2995475 - DNA, 13 bp, Homo sapiens
gcactatttttat

SEQ ID NO: 2995476 - DNA, 13 bp, Homo sapiens
gcactcaacatga

SEQ ID NO: 2995477 - DNA, 19 bp, Homo sapiens
gcactcaaccttaagacct

SEQ ID NO: 2995478 - DNA, 22 bp, Homo sapiens
gcactcaagttgtttaactgtg

SEQ ID NO: 2995479 - DNA, 13 bp, Homo sapiens
gcactccaaccta

SEQ ID NO: 2995480 - DNA, 14 bp, Homo sapiens
gcactcccccagga

SEQ ID NO: 2995481 - DNA, 16 bp, Homo sapiens
gcactccctccagcac

SEQ ID NO: 2995482 - DNA, 17 bp, Homo sapiens
gcactccctccagcaca

SEQ ID NO: 2995483 - DNA, 16 bp, Homo sapiens
gcactccggcctgggt

SEQ ID NO: 2995484 - DNA, 16 bp, Homo sapiens
gcactcctgattttta

SEQ ID NO: 2995485 - DNA, 15 bp, Homo sapiens
gcactctagattcca

SEQ ID NO: 2995486 - DNA, 21 bp, Homo sapiens
gcactctggcggtggccacag

SEQ ID NO: 2995487 - DNA, 16 bp, Homo sapiens
gcactgaagtttttga

SEQ ID NO: 2995488 - DNA, 19 bp, Homo sapiens
gcactgaagtttttgaaat

SEQ ID NO: 2995489 - DNA, 21 bp, Homo sapiens
gcactgagataccagcgagga

SEQ ID NO: 2995490 - DNA, 16 bp, Homo sapiens
gcactgagtgaaggaa

SEQ ID NO: 2995491 - DNA, 21 bp, Homo sapiens
gcactgcccatggacaggctg

SEQ ID NO: 2995492 - DNA, 18 bp, Homo sapiens
gcactgctgcctcagctc

SEQ ID NO: 2995493 - DNA, 16 bp, Homo sapiens
gcactgcttgaggaaa

SEQ ID NO: 2995494 - DNA, 18 bp, Homo sapiens
gcactggaaccacctgga

SEQ ID NO: 2995495 - DNA, 16 bp, Homo sapiens
gcactggagccacagg

SEQ ID NO: 2995496 - DNA, 15 bp, Homo sapiens
gcactggagctggga

SEQ ID NO: 2995497 - DNA, 17 bp, Homo sapiens
gcactggagctgggagg

SEQ ID NO: 2995498 - DNA, 23 bp, Homo sapiens
gcactggagtggctcgccaggcc

SEQ ID NO: 2995499 - DNA, 14 bp, Homo sapiens
gcactgggaagctg

SEQ ID NO: 2995500 - DNA, 19 bp, Homo sapiens
gcactgggaagctggagtg

SEQ ID NO: 2995501 - DNA, 16 bp, Homo sapiens
gcactgtagttctaag

SEQ ID NO: 2995502 - DNA, 18 bp, Homo sapiens
gcactgtagttctaagac

SEQ ID NO: 2995503 - DNA, 22 bp, Homo sapiens
gcactgtcccagtagccaaggc

SEQ ID NO: 2995504 - DNA, 10 bp, Homo sapiens
gcactgtctg

SEQ ID NO: 2995505 - DNA, 22 bp, Homo sapiens
gcactgtctgtacctaaagcaa

SEQ ID NO: 2995506 - DNA, 14 bp, Homo sapiens
gcactgtgaaggac

SEQ ID NO: 2995507 - DNA, 16 bp, Homo sapiens
gcactgtgaaggaccc

SEQ ID NO: 2995508 - DNA, 19 bp, Homo sapiens
gcactgtgacccccagctc

SEQ ID NO: 2995509 - DNA, 18 bp, Homo sapiens
gcactgtgttcacacttt

SEQ ID NO: 2995510 - DNA, 18 bp, Homo sapiens
gcactgttccccctgtgc

SEQ ID NO: 2995511 - DNA, 20 bp, Homo sapiens
gcactgttccccctgtgcag

SEQ ID NO: 2995512 - DNA, 14 bp, Homo sapiens
gcacttaaacagaa

SEQ ID NO: 2995513 - DNA, 21 bp, Homo sapiens
gcacttaaacagaagcagagg

SEQ ID NO: 2995514 - DNA, 13 bp, Homo sapiens
gcacttcatatct

SEQ ID NO: 2995515 - DNA, 14 bp, Homo sapiens
gcacttcatatcta

SEQ ID NO: 2995516 - DNA, 13 bp, Homo sapiens
gcacttcccagga

SEQ ID NO: 2995517 - DNA, 14 bp, Homo sapiens
gcacttccctgctg

SEQ ID NO: 2995518 - DNA, 15 bp, Homo sapiens
gcacttgaagaatat

SEQ ID NO: 2995519 - DNA, 18 bp, Homo sapiens
gcacttgcctgggtcaca

SEQ ID NO: 2995520 - DNA, 22 bp, Homo sapiens
gcacttgggggttcaggcccgg

SEQ ID NO: 2995521 - DNA, 12 bp, Homo sapiens
gcacttgtatat

SEQ ID NO: 2995522 - DNA, 17 bp, Homo sapiens
gcactttagtgattgct

SEQ ID NO: 2995523 - DNA, 23 bp, Homo sapiens
gcactttccgtcaacgttgtact

SEQ ID NO: 2995524 - DNA, 15 bp, Homo sapiens
gcactttgagaggct

SEQ ID NO: 2995525 - DNA, 16 bp, Homo sapiens
gcactttgagaggctg

SEQ ID NO: 2995526 - DNA, 16 bp, Homo sapiens
gcactttgggaggcag

SEQ ID NO: 2995527 - DNA, 17 bp, Homo sapiens
gcactttgggaggccaa

SEQ ID NO: 2995528 - DNA, 14 bp, Homo sapiens
gcactttgtaaatt

SEQ ID NO: 2995529 - DNA, 14 bp, Homo sapiens
gcagaaaaagaaaa

SEQ ID NO: 2995530 - DNA, 17 bp, Homo sapiens
gcagaaaaaggctgtgc

SEQ ID NO: 2995531 - DNA, 19 bp, Homo sapiens
gcagaaaaaggctgtgctg

SEQ ID NO: 2995532 - DNA, 15 bp, Homo sapiens
gcagaaaagcacctg

SEQ ID NO: 2995533 - DNA, 18 bp, Homo sapiens
gcagaaaagcacctgccg

SEQ ID NO: 2995534 - DNA, 18 bp, Homo sapiens
gcagaaaataaaggaagc

SEQ ID NO: 2995535 - DNA, 12 bp, Homo sapiens
gcagaacacctg

SEQ ID NO: 2995536 - DNA, 21 bp, Homo sapiens
gcagaacgtattggtccagct

SEQ ID NO: 2995537 - DNA, 21 bp, Homo sapiens
gcagaactaaactcatttata

SEQ ID NO: 2995538 - DNA, 18 bp, Homo sapiens
gcagaactctctgtcttc

SEQ ID NO: 2995539 - DNA, 21 bp, Homo sapiens
gcagaagaattgaacccagga

SEQ ID NO: 2995540 - DNA, 23 bp, Homo sapiens
gcagaagaattgaacccaggagg

SEQ ID NO: 2995541 - DNA, 21 bp, Homo sapiens
gcagaagcaagggggtgatgt

SEQ ID NO: 2995542 - DNA, 20 bp, Homo sapiens
gcaagtgggagatgaaaacc

SEQ ID NO: 2995543 - DNA, 15 bp, Homo sapiens
gcaagtgtctggagc

SEQ ID NO: 2995544 - DNA, 13 bp, Homo sapiens
gcaagttgcagtc

SEQ ID NO: 2995545 - DNA, 16 bp, Homo sapiens
gcaataaatctgaccc

SEQ ID NO: 2995546 - DNA, 15 bp, Homo sapiens
gcaataacttctata

SEQ ID NO: 2995547 - DNA, 20 bp, Homo sapiens
gcaataacttctatatttta

SEQ ID NO: 2995548 - DNA, 14 bp, Homo sapiens
gcaataatgcagta

SEQ ID NO: 2995549 - DNA, 13 bp, Homo sapiens
gcaataccaagta

SEQ ID NO: 2995550 - DNA, 23 bp, Homo sapiens
gcaataccgtgttggttttgact

SEQ ID NO: 2995551 - DNA, 23 bp, Homo sapiens
gcaatacgggagtgacccagcta

SEQ ID NO: 2995552 - DNA, 13 bp, Homo sapiens
gcaatacgtttgt

SEQ ID NO: 2995553 - DNA, 20 bp, Homo sapiens
gcaatacgtttgtgcagaat

SEQ ID NO: 2995554 - DNA, 16 bp, Homo sapiens
gcaatagtcattaaaa

SEQ ID NO: 2995555 - DNA, 22 bp, Homo sapiens
gcaatcacagctcactgcagcc

SEQ ID NO: 2995556 - DNA, 18 bp, Homo sapiens
gcaatccacaatctgaca

SEQ ID NO: 2995557 - DNA, 10 bp, Homo sapiens
gcaatcctaa

SEQ ID NO: 2995558 - DNA, 18 bp, Homo sapiens
gcaatcctcctacctcag

SEQ ID NO: 2995559 - DNA, 20 bp, Homo sapiens
gcaatcctcctacctcagcc

SEQ ID NO: 2995560 - DNA, 14 bp, Homo sapiens
gcaatcctgtcttt

SEQ ID NO: 2995561 - DNA, 17 bp, Homo sapiens
gcaatcgcatcccggct

SEQ ID NO: 2995562 - DNA, 20 bp, Homo sapiens
gcaatcgtggatgtctctga

SEQ ID NO: 2995563 - DNA, 17 bp, Homo sapiens
gcaatctcgccttcctg

SEQ ID NO: 2995564 - DNA, 16 bp, Homo sapiens
gcaatgatgaatgaga

SEQ ID NO: 2995565 - DNA, 15 bp, Homo sapiens
gcaatgccatcatct

SEQ ID NO: 2995566 - DNA, 19 bp, Homo sapiens
gcaatgccatcatctcctg

SEQ ID NO: 2995567 - DNA, 20 bp, Homo sapiens
gcaatgctgatgaatcactg

SEQ ID NO: 2995568 - DNA, 23 bp, Homo sapiens
gcaatgggtcttagctctttctc

SEQ ID NO: 2995569 - DNA, 21 bp, Homo sapiens
gcaatggtgactgatttcaaa

SEQ ID NO: 2995570 - DNA, 17 bp, Homo sapiens
gcaatgtaagcatactt

SEQ ID NO: 2995571 - DNA, 14 bp, Homo sapiens
gcaatgtgctactg

SEQ ID NO: 2995572 - DNA, 18 bp, Homo sapiens
gcaattactgcctgcaga

SEQ ID NO: 2995573 - DNA, 14 bp, Homo sapiens
gcaattatttaaag

SEQ ID NO: 2995574 - DNA, 16 bp, Homo sapiens
gcaattcaaaagttcc

SEQ ID NO: 2995575 - DNA, 23 bp, Homo sapiens
gcaattctcctgcctcagcctcc

SEQ ID NO: 2995576 - DNA, 15 bp, Homo sapiens
gcaattgatttcttt

SEQ ID NO: 2995577 - DNA, 23 bp, Homo sapiens
gcaatttaatattttgcacagtt

SEQ ID NO: 2995578 - DNA, 23 bp, Homo sapiens
gcacaaaacccagacctgttagc

SEQ ID NO: 2995579 - DNA, 16 bp, Homo sapiens
gcacaaacacaaggtc

SEQ ID NO: 2995580 - DNA, 22 bp, Homo sapiens
gcacaaacttgtgagcatcaga

SEQ ID NO: 2995581 - DNA, 17 bp, Homo sapiens
gcacaagaatcacttga

SEQ ID NO: 2995582 - DNA, 18 bp, Homo sapiens
gcacaagaatcacttgaa

SEQ ID NO: 2995583 - DNA, 21 bp, Homo sapiens
gcacaataaaaccaagcctct

SEQ ID NO: 2995584 - DNA, 22 bp, Homo sapiens
gcacaataaaaccaagcctctg

SEQ ID NO: 2995585 - DNA, 19 bp, Homo sapiens
gcacaatattgaacttttt

SEQ ID NO: 2995586 - DNA, 14 bp, Homo sapiens
gcacaatctgttct

SEQ ID NO: 2995587 - DNA, 16 bp, Homo sapiens
gcacaatctgttctac

SEQ ID NO: 2995588 - DNA, 16 bp, Homo sapiens
gcacacagcggctgcc

SEQ ID NO: 2995589 - DNA, 18 bp, Homo sapiens
gcacacagctactctccc

SEQ ID NO: 2995590 - DNA, 15 bp, Homo sapiens
gcacacatcaccagg

SEQ ID NO: 2995591 - DNA, 13 bp, Homo sapiens
gcacacccctggg

SEQ ID NO: 2995592 - DNA, 15 bp, Homo sapiens
gcacacccctggggc

SEQ ID NO: 2995593 - DNA, 16 bp, Homo sapiens
gcacacccctggggct

SEQ ID NO: 2995594 - DNA, 16 bp, Homo sapiens
gcacacctctggctgt

SEQ ID NO: 2995595 - DNA, 14 bp, Homo sapiens
gcacacgcctccca

SEQ ID NO: 2995596 - DNA, 22 bp, Homo sapiens
gcacacggctggtcactctgcc

SEQ ID NO: 2995597 - DNA, 17 bp, Homo sapiens
gcacactatttccctct

SEQ ID NO: 2995598 - DNA, 14 bp, Homo sapiens
gcacactttgccat

SEQ ID NO: 2995599 - DNA, 17 bp, Homo sapiens
gcacagaagcacatgca

SEQ ID NO: 2995600 - DNA, 13 bp, Homo sapiens
gcacagaagtcct

SEQ ID NO: 2995601 - DNA, 15 bp, Homo sapiens
gcacagaagtcctgt

SEQ ID NO: 2995602 - DNA, 12 bp, Homo sapiens
gcacagaatatg

SEQ ID NO: 2995603 - DNA, 22 bp, Homo sapiens
gcacagacaggttttcacataa

SEQ ID NO: 2995604 - DNA, 17 bp, Homo sapiens
gcacagatgaccaaagt

SEQ ID NO: 2995605 - DNA, 18 bp, Homo sapiens
gcacagatgaccaaagtc

SEQ ID NO: 2995606 - DNA, 14 bp, Homo sapiens
gcacagattcccag

SEQ ID NO: 2995607 - DNA, 19 bp, Homo sapiens
gcacagattcccaggccag

SEQ ID NO: 2995608 - DNA, 21 bp, Homo sapiens
gcacagattcccaggccaggg

SEQ ID NO: 2995609 - DNA, 22 bp, Homo sapiens
gcacagattcccaggccagggc

SEQ ID NO: 2995610 - DNA, 22 bp, Homo sapiens
gcacagcagcctggggctggcc

SEQ ID NO: 2995611 - DNA, 12 bp, Homo sapiens
gcacagcctggc

SEQ ID NO: 2995612 - DNA, 19 bp, Homo sapiens
gcacagctcctcccctgcc

SEQ ID NO: 2995613 - DNA, 20 bp, Homo sapiens
gcacagctcctcccctgccg

SEQ ID NO: 2995614 - DNA, 21 bp, Homo sapiens
gcacagctcctcccctgccgc

SEQ ID NO: 2995615 - DNA, 22 bp, Homo sapiens
gcacaggacatgcggtagccag

SEQ ID NO: 2995616 - DNA, 16 bp, Homo sapiens
gcacaggaggcaggca

SEQ ID NO: 2995617 - DNA, 22 bp, Homo sapiens
gcacaggaggcaggcatggccc

SEQ ID NO: 2995618 - DNA, 15 bp, Homo sapiens
gcacaggtctctgtt

SEQ ID NO: 2995619 - DNA, 16 bp, Homo sapiens
gcacaggtctctgttt

SEQ ID NO: 2995620 - DNA, 13 bp, Homo sapiens
gcacaggtgggag

SEQ ID NO: 2995621 - DNA, 17 bp, Homo sapiens
gcacagtggctcacgcc

SEQ ID NO: 2995622 - DNA, 16 bp, Homo sapiens
gcacagtggtggcagg

SEQ ID NO: 2995623 - DNA, 17 bp, Homo sapiens
gcacagtggtggcaggg

SEQ ID NO: 2995624 - DNA, 21 bp, Homo sapiens
gcacagtttagaacagaggga

SEQ ID NO: 2995625 - DNA, 22 bp, Homo sapiens
gcacagtttagaacagagggac

SEQ ID NO: 2995626 - DNA, 13 bp, Homo sapiens
gcacagtttgaac

SEQ ID NO: 2995627 - DNA, 14 bp, Homo sapiens
gcacagtttgaaca

SEQ ID NO: 2995628 - DNA, 17 bp, Homo sapiens
gcacatactacctagaa

SEQ ID NO: 2995629 - DNA, 18 bp, Homo sapiens
gcacatactacctagaag

SEQ ID NO: 2995630 - DNA, 21 bp, Homo sapiens
gcacatactacctagaagtaa

SEQ ID NO: 2995631 - DNA, 23 bp, Homo sapiens
gcacatactacctagaagtaaga

SEQ ID NO: 2995632 - DNA, 17 bp, Homo sapiens
gcacatatcaagaagtc

SEQ ID NO: 2995633 - DNA, 12 bp, Homo sapiens
gcacatcacctc

SEQ ID NO: 2995634 - DNA, 14 bp, Homo sapiens
gcacatcacctctt

SEQ ID NO: 2995635 - DNA, 20 bp, Homo sapiens
gcacatccgcgtgtgcctgt

SEQ ID NO: 2995636 - DNA, 19 bp, Homo sapiens
gcacatctaaattgatcat

SEQ ID NO: 2995637 - DNA, 13 bp, Homo sapiens
gcacatctgtcct

SEQ ID NO: 2995638 - DNA, 17 bp, Homo sapiens
gcacatctgtgtcttgt

SEQ ID NO: 2995639 - DNA, 18 bp, Homo sapiens
gcacatctgtgtcttgtt

SEQ ID NO: 2995640 - DNA, 19 bp, Homo sapiens
gcacatgaacagcttgcca

SEQ ID NO: 2995641 - DNA, 15 bp, Homo sapiens
gcacatgaagaaata

SEQ ID NO: 2995642 - DNA, 16 bp, Homo sapiens
gcacatggctggggga

SEQ ID NO: 2995643 - DNA, 20 bp, Homo sapiens
gcacatgttaccatgtctga

SEQ ID NO: 2995644 - DNA, 18 bp, Homo sapiens
gcacattgagctgtgcaa

SEQ ID NO: 2995645 - DNA, 18 bp, Homo sapiens
gcaccaacccactgccca

SEQ ID NO: 2995646 - DNA, 15 bp, Homo sapiens
gcaccacactcagcc

SEQ ID NO: 2995647 - DNA, 14 bp, Homo sapiens
gcaccaccaggtct

SEQ ID NO: 2995648 - DNA, 14 bp, Homo sapiens
gcaccaccatgccc

SEQ ID NO: 2995649 - DNA, 13 bp, Homo sapiens
gcaccacggccag

SEQ ID NO: 2995650 - DNA, 23 bp, Homo sapiens
gcaccacgggacatcacagggtg

SEQ ID NO: 2995651 - DNA, 14 bp, Homo sapiens
gcaccactgcactc

SEQ ID NO: 2995652 - DNA, 16 bp, Homo sapiens
gcaccactgcactcca

SEQ ID NO: 2995653 - DNA, 14 bp, Homo sapiens
gcaccagtccctgt

SEQ ID NO: 2995654 - DNA, 19 bp, Homo sapiens
gatttccctccagagaaag

SEQ ID NO: 2995655 - DNA, 20 bp, Homo sapiens
gatttccctccagagaaagc

SEQ ID NO: 2995656 - DNA, 21 bp, Homo sapiens
gatttccctccagagaaagca

SEQ ID NO: 2995657 - DNA, 11 bp, Homo sapiens
gatttcctgtg

SEQ ID NO: 2995658 - DNA, 20 bp, Homo sapiens
gatttcctttatactgtgaa

SEQ ID NO: 2995659 - DNA, 18 bp, Homo sapiens
gatttctagaatggtttt

SEQ ID NO: 2995660 - DNA, 16 bp, Homo sapiens
gatttctgccttgaaa

SEQ ID NO: 2995661 - DNA, 14 bp, Homo sapiens
gatttcttaaattt

SEQ ID NO: 2995662 - DNA, 21 bp, Homo sapiens
gatttcttgctaagctccagc

SEQ ID NO: 2995663 - DNA, 17 bp, Homo sapiens
gatttctttgctgtaag

SEQ ID NO: 2995664 - DNA, 18 bp, Homo sapiens
gatttcttttcttcctgg

SEQ ID NO: 2995665 - DNA, 23 bp, Homo sapiens
gatttcttttgtaataaactatt

SEQ ID NO: 2995666 - DNA, 13 bp, Homo sapiens
gatttgaacactt

SEQ ID NO: 2995667 - DNA, 20 bp, Homo sapiens
gatttgaagaacatgtgaga

SEQ ID NO: 2995668 - DNA, 18 bp, Homo sapiens
gatttgaagatctgattt

SEQ ID NO: 2995669 - DNA, 13 bp, Homo sapiens
gatttgacattgc

SEQ ID NO: 2995670 - DNA, 12 bp, Homo sapiens
gatttgacctcc

SEQ ID NO: 2995671 - DNA, 18 bp, Homo sapiens
gatttgatgctgtttgac

SEQ ID NO: 2995672 - DNA, 11 bp, Homo sapiens
gatttgcaata

SEQ ID NO: 2995673 - DNA, 19 bp, Homo sapiens
gatttggtgtacaattcag

SEQ ID NO: 2995674 - DNA, 16 bp, Homo sapiens
gatttgtccaaacagg

SEQ ID NO: 2995675 - DNA, 18 bp, Homo sapiens
gatttgtgtttttctttt

SEQ ID NO: 2995676 - DNA, 13 bp, Homo sapiens
gattttaaactag

SEQ ID NO: 2995677 - DNA, 14 bp, Homo sapiens
gattttaaactaga

SEQ ID NO: 2995678 - DNA, 23 bp, Homo sapiens
gattttaatagggaatatatctc

SEQ ID NO: 2995679 - DNA, 18 bp, Homo sapiens
gattttacaattgaaatg

SEQ ID NO: 2995680 - DNA, 19 bp, Homo sapiens
gattttatgatcagtgttg

SEQ ID NO: 2995681 - DNA, 22 bp, Homo sapiens
gattttattactggcgtggatt

SEQ ID NO: 2995682 - DNA, 17 bp, Homo sapiens
gattttatttttgcaaa

SEQ ID NO: 2995683 - DNA, 16 bp, Homo sapiens
gattttcatctattat

SEQ ID NO: 2995684 - DNA, 17 bp, Homo sapiens
gattttctagtttcctg

SEQ ID NO: 2995685 - DNA, 19 bp, Homo sapiens
gattttctagtttcctgcc

SEQ ID NO: 2995686 - DNA, 19 bp, Homo sapiens
gattttctccatttgtcat

SEQ ID NO: 2995687 - DNA, 15 bp, Homo sapiens
gattttctggttcta

SEQ ID NO: 2995688 - DNA, 13 bp, Homo sapiens
gattttcttcttt

SEQ ID NO: 2995689 - DNA, 22 bp, Homo sapiens
gattttgtatctttttgaaaat

SEQ ID NO: 2995690 - DNA, 17 bp, Homo sapiens
gatttttaaaaaatatt

SEQ ID NO: 2995691 - DNA, 22 bp, Homo sapiens
gatttttaattaaaaactagta

SEQ ID NO: 2995692 - DNA, 16 bp, Homo sapiens
gatttttactgtgttt

SEQ ID NO: 2995693 - DNA, 22 bp, Homo sapiens
gatttttttgtcattaaaattg

SEQ ID NO: 2995694 - DNA, 21 bp, Homo sapiens
gcaaaaaatactttttctaat

SEQ ID NO: 2995695 - DNA, 16 bp, Homo sapiens
gcaaaaagaggatccg

SEQ ID NO: 2995696 - DNA, 13 bp, Homo sapiens
gcaaaaaggactg

SEQ ID NO: 2995697 - DNA, 14 bp, Homo sapiens
gcaaaaaggactgg

SEQ ID NO: 2995698 - DNA, 15 bp, Homo sapiens
gcaaaaatgctaata

SEQ ID NO: 2995699 - DNA, 16 bp, Homo sapiens
gcaaaaatgtaaaaaa

SEQ ID NO: 2995700 - DNA, 18 bp, Homo sapiens
gcaaaaatgtaaaaaaca

SEQ ID NO: 2995701 - DNA, 19 bp, Homo sapiens
gcaaaaatgtaaaaaacaa

SEQ ID NO: 2995702 - DNA, 20 bp, Homo sapiens
gcaaaaatgtaaaaaacaaa

SEQ ID NO: 2995703 - DNA, 18 bp, Homo sapiens
gcaaaacactatgtatag

SEQ ID NO: 2995704 - DNA, 20 bp, Homo sapiens
gcaaaactaaatacttgctc

SEQ ID NO: 2995705 - DNA, 22 bp, Homo sapiens
gcaaaagagctactcagaaatg

SEQ ID NO: 2995706 - DNA, 23 bp, Homo sapiens
gcaaaaggatctttgtggccaag

SEQ ID NO: 2995707 - DNA, 13 bp, Homo sapiens
gcaaaagtggggc

SEQ ID NO: 2995708 - DNA, 21 bp, Homo sapiens
gcaaaagtggggctaaatgaa

SEQ ID NO: 2995709 - DNA, 13 bp, Homo sapiens
gcaaaagtgtaac

SEQ ID NO: 2995710 - DNA, 13 bp, Homo sapiens
gcaaaatcatgga

SEQ ID NO: 2995711 - DNA, 12 bp, Homo sapiens
gcaaaatccaaa

SEQ ID NO: 2995712 - DNA, 19 bp, Homo sapiens
gcaaaatccaaactgctgt

SEQ ID NO: 2995713 - DNA, 23 bp, Homo sapiens
gcaaaatccttacttccagcaaa

SEQ ID NO: 2995714 - DNA, 13 bp, Homo sapiens
gcaaacacaataa

SEQ ID NO: 2995715 - DNA, 23 bp, Homo sapiens
gcaaacagggtggcccaggtggc

SEQ ID NO: 2995716 - DNA, 21 bp, Homo sapiens
gcaaaccaagagattgctaat

SEQ ID NO: 2995717 - DNA, 17 bp, Homo sapiens
gcaaaccacactggact

SEQ ID NO: 2995718 - DNA, 18 bp, Homo sapiens
gcaaaccacactggactc

SEQ ID NO: 2995719 - DNA, 20 bp, Homo sapiens
gcaaaccacactggactccg

SEQ ID NO: 2995720 - DNA, 23 bp, Homo sapiens
gcaaaccctgttcaggctggctc

SEQ ID NO: 2995721 - DNA, 14 bp, Homo sapiens
gcaaacgctgcctg

SEQ ID NO: 2995722 - DNA, 16 bp, Homo sapiens
gcaaacgctgcctgcc

SEQ ID NO: 2995723 - DNA, 13 bp, Homo sapiens
gcaaactctgctg

SEQ ID NO: 2995724 - DNA, 14 bp, Homo sapiens
gcaaagaggcaaga

SEQ ID NO: 2995725 - DNA, 18 bp, Homo sapiens
gcaaagaggcaagaggct

SEQ ID NO: 2995726 - DNA, 15 bp, Homo sapiens
gcaaagatatatatt

SEQ ID NO: 2995727 - DNA, 21 bp, Homo sapiens
gcaaagatctgtcctcagcct

SEQ ID NO: 2995728 - DNA, 20 bp, Homo sapiens
gcaaagattttcaaacaaaa

SEQ ID NO: 2995729 - DNA, 20 bp, Homo sapiens
gcaaagcatcggtcatgtgt

SEQ ID NO: 2995730 - DNA, 19 bp, Homo sapiens
gcaaaggagacaaagcagg

SEQ ID NO: 2995731 - DNA, 20 bp, Homo sapiens
gcaaaggagacaaagcagga

SEQ ID NO: 2995732 - DNA, 22 bp, Homo sapiens
gcaaaggatgtgttttcagtct

SEQ ID NO: 2995733 - DNA, 23 bp, Homo sapiens
gcaaaggatgtgttttcagtctt

SEQ ID NO: 2995734 - DNA, 11 bp, Homo sapiens
gcaaaggcaga

SEQ ID NO: 2995735 - DNA, 15 bp, Homo sapiens
gcaaaggcagtcccg

SEQ ID NO: 2995736 - DNA, 15 bp, Homo sapiens
gcaaagggcatgggt

SEQ ID NO: 2995737 - DNA, 18 bp, Homo sapiens
gcaaagggtccagaagga

SEQ ID NO: 2995738 - DNA, 14 bp, Homo sapiens
gcaaagtactgtaa

SEQ ID NO: 2995739 - DNA, 22 bp, Homo sapiens
gcaaagtactgtaagaataatt

SEQ ID NO: 2995740 - DNA, 16 bp, Homo sapiens
gcaaagtattgtaaat

SEQ ID NO: 2995741 - DNA, 17 bp, Homo sapiens
gcaaagtattgtaaatt

SEQ ID NO: 2995742 - DNA, 18 bp, Homo sapiens
gcaaagtattgtaaatta

SEQ ID NO: 2995743 - DNA, 18 bp, Homo sapiens
gcaaagtgttttgtacca

SEQ ID NO: 2995744 - DNA, 17 bp, Homo sapiens
gcaaatattagcaaaga

SEQ ID NO: 2995745 - DNA, 18 bp, Homo sapiens
gcaaatattagcaaagaa

SEQ ID NO: 2995746 - DNA, 20 bp, Homo sapiens
gcaaatccttgtgggaaaag

SEQ ID NO: 2995747 - DNA, 22 bp, Homo sapiens
gcaaatctttctgtaaacagaa

SEQ ID NO: 2995748 - DNA, 23 bp, Homo sapiens
gcaaatctttctgtaaacagaat

SEQ ID NO: 2995749 - DNA, 22 bp, Homo sapiens
gcaaatgcattctatcgttatt

SEQ ID NO: 2995750 - DNA, 14 bp, Homo sapiens
gcaacacagcctgg

SEQ ID NO: 2995751 - DNA, 14 bp, Homo sapiens
gcaacagatctgga

SEQ ID NO: 2995752 - DNA, 20 bp, Homo sapiens
gcaacagatctggaacctca

SEQ ID NO: 2995753 - DNA, 22 bp, Homo sapiens
gcaacagatctggaacctcagc

SEQ ID NO: 2995754 - DNA, 23 bp, Homo sapiens
gcaacagcctacaaagagatgct

SEQ ID NO: 2995755 - DNA, 13 bp, Homo sapiens
gcaacatcttttt

SEQ ID NO: 2995756 - DNA, 22 bp, Homo sapiens
gcaacattgttcacctttgtag

SEQ ID NO: 2995757 - DNA, 20 bp, Homo sapiens
gcaaccaaaagggaaaaaat

SEQ ID NO: 2995758 - DNA, 22 bp, Homo sapiens
gcaaccatttttagaaggaaaa

SEQ ID NO: 2995759 - DNA, 19 bp, Homo sapiens
gcaaccccaggctgaagca

SEQ ID NO: 2995760 - DNA, 14 bp, Homo sapiens
gcaacctacccagc

SEQ ID NO: 2995761 - DNA, 18 bp, Homo sapiens
gcaacctacccagcgtgg

SEQ ID NO: 2995762 - DNA, 23 bp, Homo sapiens
gcaacctctgcctcctgggttca

SEQ ID NO: 2995763 - DNA, 22 bp, Homo sapiens
gcaacgccgtgggctgcgtcct

SEQ ID NO: 2995764 - DNA, 16 bp, Homo sapiens
gcaactaaatgagacc

SEQ ID NO: 2995765 - DNA, 18 bp, Homo sapiens
gcaactaactaaccacat

SEQ ID NO: 2995766 - DNA, 22 bp, Homo sapiens
gcaactacccaaaacaagcctg

SEQ ID NO: 2995767 - DNA, 13 bp, Homo sapiens
gcaactcttgtat

SEQ ID NO: 2995768 - DNA, 17 bp, Homo sapiens
gcaactgaatacttgaa

SEQ ID NO: 2995769 - DNA, 15 bp, Homo sapiens
gcaactgacactccc

SEQ ID NO: 2995770 - DNA, 19 bp, Homo sapiens
gcaactgacactcccaccc

SEQ ID NO: 2995771 - DNA, 18 bp, Homo sapiens
gcaactgctcagctctgg

SEQ ID NO: 2995772 - DNA, 20 bp, Homo sapiens
gcaactgctcagctctggtc

SEQ ID NO: 2995773 - DNA, 22 bp, Homo sapiens
gcaacttagatctctcctgcaa

SEQ ID NO: 2995774 - DNA, 14 bp, Homo sapiens
gcaacttgcttcta

SEQ ID NO: 2995775 - DNA, 12 bp, Homo sapiens
gcaactttcttc

SEQ ID NO: 2995776 - DNA, 18 bp, Homo sapiens
gcaagaaaaaaaaatgcc

SEQ ID NO: 2995777 - DNA, 17 bp, Homo sapiens
gcaagaaagaaacccga

SEQ ID NO: 2995778 - DNA, 14 bp, Homo sapiens
gcaagaaagcttga

SEQ ID NO: 2995779 - DNA, 20 bp, Homo sapiens
gcaagaactcatcactgtgg

SEQ ID NO: 2995780 - DNA, 21 bp, Homo sapiens
gcaagaactcatcactgtggc

SEQ ID NO: 2995781 - DNA, 22 bp, Homo sapiens
gcaagaactcatcactgtggct

SEQ ID NO: 2995782 - DNA, 21 bp, Homo sapiens
gcaagaaggcaacttgaagaa

SEQ ID NO: 2995783 - DNA, 22 bp, Homo sapiens
gcaagaaggcaacttgaagaaa

SEQ ID NO: 2995784 - DNA, 15 bp, Homo sapiens
gcaagaatttgatcg

SEQ ID NO: 2995785 - DNA, 15 bp, Homo sapiens
gcaagacctcatctc

SEQ ID NO: 2995786 - DNA, 14 bp, Homo sapiens
gcaagaggccattg

SEQ ID NO: 2995787 - DNA, 16 bp, Homo sapiens
gcaagagggaaggtga

SEQ ID NO: 2995788 - DNA, 18 bp, Homo sapiens
gcaagattggaaagacag

SEQ ID NO: 2995789 - DNA, 17 bp, Homo sapiens
gatgtttacctggtgct

SEQ ID NO: 2995790 - DNA, 19 bp, Homo sapiens
gatgtttacctggtgctcg

SEQ ID NO: 2995791 - DNA, 12 bp, Homo sapiens
gatgtttccaga

SEQ ID NO: 2995792 - DNA, 13 bp, Homo sapiens
gatgttttaactt

SEQ ID NO: 2995793 - DNA, 13 bp, Homo sapiens
gatgttttaattc

SEQ ID NO: 2995794 - DNA, 20 bp, Homo sapiens
gatgttttacgcaaggaagg

SEQ ID NO: 2995795 - DNA, 23 bp, Homo sapiens
gatgttttagccattgttggctt

SEQ ID NO: 2995796 - DNA, 14 bp, Homo sapiens
gattaaaaattata

SEQ ID NO: 2995797 - DNA, 20 bp, Homo sapiens
gattaaaatctcttgattat

SEQ ID NO: 2995798 - DNA, 12 bp, Homo sapiens
gattaaacttat

SEQ ID NO: 2995799 - DNA, 14 bp, Homo sapiens
gattaaacttatga

SEQ ID NO: 2995800 - DNA, 18 bp, Homo sapiens
gattaaacttatgaatgt

SEQ ID NO: 2995801 - DNA, 17 bp, Homo sapiens
gattaaataagattcta

SEQ ID NO: 2995802 - DNA, 18 bp, Homo sapiens
gattaaataagattctaa

SEQ ID NO: 2995803 - DNA, 19 bp, Homo sapiens
gattaactcttagaagtgt

SEQ ID NO: 2995804 - DNA, 24 bp, Homo sapiens
gattaactcttagaagtgttgtaa

SEQ ID NO: 2995805 - DNA, 22 bp, Homo sapiens
gattaagagatgggtttgacaa

SEQ ID NO: 2995806 - DNA, 13 bp, Homo sapiens
gattaagagccat

SEQ ID NO: 2995807 - DNA, 22 bp, Homo sapiens
gattaagatctcagtggttaag

SEQ ID NO: 2995808 - DNA, 20 bp, Homo sapiens
gattaatcagctgttgcagg

SEQ ID NO: 2995809 - DNA, 15 bp, Homo sapiens
gattacagaaactga

SEQ ID NO: 2995810 - DNA, 16 bp, Homo sapiens
gattacagaaactgat

SEQ ID NO: 2995811 - DNA, 18 bp, Homo sapiens
gattacaggcatgtgcca

SEQ ID NO: 2995812 - DNA, 14 bp, Homo sapiens
gattacccaagcaa

SEQ ID NO: 2995813 - DNA, 18 bp, Homo sapiens
gattagactggacagctt

SEQ ID NO: 2995814 - DNA, 19 bp, Homo sapiens
gattagcaagttacagtga

SEQ ID NO: 2995815 - DNA, 15 bp, Homo sapiens
gattagcctttgaca

SEQ ID NO: 2995816 - DNA, 22 bp, Homo sapiens
gattaggcaaaaataatttatt

SEQ ID NO: 2995817 - DNA, 17 bp, Homo sapiens
gattaggggatggggag

SEQ ID NO: 2995818 - DNA, 18 bp, Homo sapiens
gattagtataatatttct

SEQ ID NO: 2995819 - DNA, 17 bp, Homo sapiens
gattagtattcaggcac

SEQ ID NO: 2995820 - DNA, 22 bp, Homo sapiens
gattagtattcaggcactgaga

SEQ ID NO: 2995821 - DNA, 20 bp, Homo sapiens
gattagtgaactaagttatt

SEQ ID NO: 2995822 - DNA, 15 bp, Homo sapiens
gattagtgatgtcct

SEQ ID NO: 2995823 - DNA, 14 bp, Homo sapiens
gattatagattcta

SEQ ID NO: 2995824 - DNA, 18 bp, Homo sapiens
gattatcgtcttctaaga

SEQ ID NO: 2995825 - DNA, 20 bp, Homo sapiens
gattatctatttgtgtgtgt

SEQ ID NO: 2995826 - DNA, 19 bp, Homo sapiens
gattatgtagcaaaataca

SEQ ID NO: 2995827 - DNA, 16 bp, Homo sapiens
gattattaaatcgttt

SEQ ID NO: 2995828 - DNA, 13 bp, Homo sapiens
gattattcagtgt

SEQ ID NO: 2995829 - DNA, 14 bp, Homo sapiens
gattattcagtgtc

SEQ ID NO: 2995830 - DNA, 15 bp, Homo sapiens
gattattcagtgtca

SEQ ID NO: 2995831 - DNA, 13 bp, Homo sapiens
gattattgaaata

SEQ ID NO: 2995832 - DNA, 21 bp, Homo sapiens
gattattttctacacatacat

SEQ ID NO: 2995833 - DNA, 21 bp, Homo sapiens
gatatactatgggatgtatat

SEQ ID NO: 2995834 - DNA, 20 bp, Homo sapiens
gatatagacagtccttaaaa

SEQ ID NO: 2995835 - DNA, 14 bp, Homo sapiens
gatatatattcacc

SEQ ID NO: 2995836 - DNA, 20 bp, Homo sapiens
gatatatgtgtttttcacat

SEQ ID NO: 2995837 - DNA, 22 bp, Homo sapiens
gatatatgtgtttttcacattt

SEQ ID NO: 2995838 - DNA, 17 bp, Homo sapiens
gatatcaaaattctagc

SEQ ID NO: 2995839 - DNA, 16 bp, Homo sapiens
gatatcggtgctatgt

SEQ ID NO: 2995840 - DNA, 19 bp, Homo sapiens
gatatcggtgctatgtgtt

SEQ ID NO: 2995841 - DNA, 16 bp, Homo sapiens
gatatcttttctttag

SEQ ID NO: 2995842 - DNA, 18 bp, Homo sapiens
gatatctttttcattatt

SEQ ID NO: 2995843 - DNA, 15 bp, Homo sapiens
gatatgaaaaataaa

SEQ ID NO: 2995844 - DNA, 17 bp, Homo sapiens
gatatgaaaaataaata

SEQ ID NO: 2995845 - DNA, 21 bp, Homo sapiens
gatatgaaactctacatttaa

SEQ ID NO: 2995846 - DNA, 15 bp, Homo sapiens
gatatgctagaaaag

SEQ ID NO: 2995847 - DNA, 16 bp, Homo sapiens
gatatgcttagtaatg

SEQ ID NO: 2995848 - DNA, 20 bp, Homo sapiens
gatattaaaatttggtgctt

SEQ ID NO: 2995849 - DNA, 12 bp, Homo sapiens
gatattaaattc

SEQ ID NO: 2995850 - DNA, 22 bp, Homo sapiens
gatattatctacctgttctgta

SEQ ID NO: 2995851 - DNA, 23 bp, Homo sapiens
gatattatgtggcttttatttca

SEQ ID NO: 2995852 - DNA, 15 bp, Homo sapiens
gatattattcttgta

SEQ ID NO: 2995853 - DNA, 20 bp, Homo sapiens
gatattcttctcttgcttta

SEQ ID NO: 2995854 - DNA, 13 bp, Homo sapiens
gatattgtgaaca

SEQ ID NO: 2995855 - DNA, 14 bp, Homo sapiens
gatattgttctcca

SEQ ID NO: 2995856 - DNA, 20 bp, Homo sapiens
gatatttcatgtgctataga

SEQ ID NO: 2995857 - DNA, 17 bp, Homo sapiens
gatatttctctagtagt

SEQ ID NO: 2995858 - DNA, 13 bp, Homo sapiens
gatatttcttgct

SEQ ID NO: 2995859 - DNA, 17 bp, Homo sapiens
gatatttcttgctttca

SEQ ID NO: 2995860 - DNA, 21 bp, Homo sapiens
gatatttgacagacatccttg

SEQ ID NO: 2995861 - DNA, 15 bp, Homo sapiens
gatatttttattcaa

SEQ ID NO: 2995862 - DNA, 14 bp, Homo sapiens
gatcaagctgtgag

SEQ ID NO: 2995863 - DNA, 21 bp, Homo sapiens
gatcaattatagtttctgagg

SEQ ID NO: 2995864 - DNA, 19 bp, Homo sapiens
gatcaattttcattaaact

SEQ ID NO: 2995865 - DNA, 11 bp, Homo sapiens
gatcacaggag

SEQ ID NO: 2995866 - DNA, 19 bp, Homo sapiens
gatcaccatgtattttgta

SEQ ID NO: 2995867 - DNA, 13 bp, Homo sapiens
gatcacctgaggt

SEQ ID NO: 2995868 - DNA, 22 bp, Homo sapiens
gatcacgccattgtactccagc

SEQ ID NO: 2995869 - DNA, 13 bp, Homo sapiens
gatcactgaattg

SEQ ID NO: 2995870 - DNA, 18 bp, Homo sapiens
gatcagaaaaatggagca

SEQ ID NO: 2995871 - DNA, 17 bp, Homo sapiens
gatcagatgctccaaga

SEQ ID NO: 2995872 - DNA, 15 bp, Homo sapiens
gatcagattgcatgt

SEQ ID NO: 2995873 - DNA, 23 bp, Homo sapiens
gatcagattgcatgtgactctga

SEQ ID NO: 2995874 - DNA, 16 bp, Homo sapiens
gatcagcaaaaagact

SEQ ID NO: 2995875 - DNA, 19 bp, Homo sapiens
gatcagcaaaaagactgga

SEQ ID NO: 2995876 - DNA, 17 bp, Homo sapiens
gatcaggcttcctggtg

SEQ ID NO: 2995877 - DNA, 23 bp, Homo sapiens
gatcagtcctttgatcagtataa

SEQ ID NO: 2995878 - DNA, 11 bp, Homo sapiens
gatcagtgttg

SEQ ID NO: 2995879 - DNA, 21 bp, Homo sapiens
gatcatatgaattgctgtcta

SEQ ID NO: 2995880 - DNA, 23 bp, Homo sapiens
gatcatcgccagaggtgcttcac

SEQ ID NO: 2995881 - DNA, 14 bp, Homo sapiens
gatcatctgctgtg

SEQ ID NO: 2995882 - DNA, 14 bp, Homo sapiens
gatcatctggggac

SEQ ID NO: 2995883 - DNA, 15 bp, Homo sapiens
gatcatgtacttttt

SEQ ID NO: 2995884 - DNA, 20 bp, Homo sapiens
gatcatgtactttttagtaa

SEQ ID NO: 2995885 - DNA, 23 bp, Homo sapiens
gatccaaaagaagcccccagcta

SEQ ID NO: 2995886 - DNA, 17 bp, Homo sapiens
gatccaagctaagcact

SEQ ID NO: 2995887 - DNA, 21 bp, Homo sapiens
gatccacccacctcagcctcc

SEQ ID NO: 2995888 - DNA, 22 bp, Homo sapiens
gatccacccgccttcagcctcc

SEQ ID NO: 2995889 - DNA, 21 bp, Homo sapiens
gatccagcctggggtctggag

SEQ ID NO: 2995890 - DNA, 19 bp, Homo sapiens
gatccagctgtgtgttttc

SEQ ID NO: 2995891 - DNA, 12 bp, Homo sapiens
gatccaggacta

SEQ ID NO: 2995892 - DNA, 18 bp, Homo sapiens
gatccaggcttctcccgg

SEQ ID NO: 2995893 - DNA, 13 bp, Homo sapiens
gatccagggacag

SEQ ID NO: 2995894 - DNA, 14 bp, Homo sapiens
gatccagggacaga

SEQ ID NO: 2995895 - DNA, 15 bp, Homo sapiens
gatcccaaagcaagg

SEQ ID NO: 2995896 - DNA, 17 bp, Homo sapiens
gatcccaacactgccag

SEQ ID NO: 2995897 - DNA, 21 bp, Homo sapiens
gatcccaagtagaatctcagt

SEQ ID NO: 2995898 - DNA, 17 bp, Homo sapiens
gatcccacagccctagt

SEQ ID NO: 2995899 - DNA, 22 bp, Homo sapiens
gatcccaccccattttctgtgg

SEQ ID NO: 2995900 - DNA, 16 bp, Homo sapiens
gatcccagctcactgc

SEQ ID NO: 2995901 - DNA, 14 bp, Homo sapiens
gatccccaagtgtg

SEQ ID NO: 2995902 - DNA, 20 bp, Homo sapiens
gatccccaagtgtgaacaaa

SEQ ID NO: 2995903 - DNA, 13 bp, Homo sapiens
gatcccctgtccc

SEQ ID NO: 2995904 - DNA, 18 bp, Homo sapiens
gatcccctgtcccctggg

SEQ ID NO: 2995905 - DNA, 20 bp, Homo sapiens
gatcccctgtcccctggggc

SEQ ID NO: 2995906 - DNA, 16 bp, Homo sapiens
gatcccgttttcccca

SEQ ID NO: 2995907 - DNA, 23 bp, Homo sapiens
gatccctctacagagcttccctg

SEQ ID NO: 2995908 - DNA, 20 bp, Homo sapiens
gatccgcctacctcagcctc

SEQ ID NO: 2995909 - DNA, 19 bp, Homo sapiens
gatcctacaatattttatt

SEQ ID NO: 2995910 - DNA, 18 bp, Homo sapiens
gatcctcacgccttggcc

SEQ ID NO: 2995911 - DNA, 20 bp, Homo sapiens
gatcctcagttctcaaatgt

SEQ ID NO: 2995912 - DNA, 19 bp, Homo sapiens
gatcctctcacctcagcct

SEQ ID NO: 2995913 - DNA, 14 bp, Homo sapiens
gatcctgcccccaa

SEQ ID NO: 2995914 - DNA, 12 bp, Homo sapiens
gatcctggaggc

SEQ ID NO: 2995915 - DNA, 17 bp, Homo sapiens
gatcctggaggcccagt

SEQ ID NO: 2995916 - DNA, 17 bp, Homo sapiens
gatcctgggctgggtgg

SEQ ID NO: 2995917 - DNA, 12 bp, Homo sapiens
gatcctgtctct

SEQ ID NO: 2995918 - DNA, 22 bp, Homo sapiens
gatcctgtgaggagccccatct

SEQ ID NO: 2995919 - DNA, 17 bp, Homo sapiens
gatccttcccaaggtac

SEQ ID NO: 2995920 - DNA, 22 bp, Homo sapiens
gatcgcaccactgcactccagc

SEQ ID NO: 2995921 - DNA, 18 bp, Homo sapiens
gatcgctcccttggcttt

SEQ ID NO: 2995922 - DNA, 18 bp, Homo sapiens
gatcgtctgactggtgtt

SEQ ID NO: 2995923 - DNA, 16 bp, Homo sapiens
gatcgttcaaagcatg

SEQ ID NO: 2995924 - DNA, 17 bp, Homo sapiens
gatctacccgtgcctgg

SEQ ID NO: 2995925 - DNA, 22 bp, Homo sapiens
gatctacctgcaacacaacatt

SEQ ID NO: 2995926 - DNA, 13 bp, Homo sapiens
gatctagaaggga

SEQ ID NO: 2995927 - DNA, 14 bp, Homo sapiens
gatctatttattat

SEQ ID NO: 2995928 - DNA, 19 bp, Homo sapiens
gatctcaagtatatgtcat

SEQ ID NO: 2995929 - DNA, 13 bp, Homo sapiens
gatctcactctgc

SEQ ID NO: 2995930 - DNA, 11 bp, Homo sapiens
gatctcagcca

SEQ ID NO: 2995931 - DNA, 14 bp, Homo sapiens
gatctcagctcact

SEQ ID NO: 2995932 - DNA, 14 bp, Homo sapiens
gatctccctgccgc

SEQ ID NO: 2995933 - DNA, 17 bp, Homo sapiens
gatctcctgacctcatg

SEQ ID NO: 2995934 - DNA, 21 bp, Homo sapiens
gatctcgcctggaaacagagg

SEQ ID NO: 2995935 - DNA, 20 bp, Homo sapiens
gatctcggtttgccaaaatt

SEQ ID NO: 2995936 - DNA, 23 bp, Homo sapiens
gatctctgcaggaaatggctgtg

SEQ ID NO: 2995937 - DNA, 15 bp, Homo sapiens
gatctctgcagggcc

SEQ ID NO: 2995938 - DNA, 16 bp, Homo sapiens
gatctctgcagggccg

SEQ ID NO: 2995939 - DNA, 17 bp, Homo sapiens
gatctgaaaacttggct

SEQ ID NO: 2995940 - DNA, 16 bp, Homo sapiens
gatctgaattaaataa

SEQ ID NO: 2995941 - DNA, 15 bp, Homo sapiens
gatctgcacagtcag

SEQ ID NO: 2995942 - DNA, 18 bp, Homo sapiens
gatctgctttctgttcat

SEQ ID NO: 2995943 - DNA, 19 bp, Homo sapiens
gatctgctttctgttcatc

SEQ ID NO: 2995944 - DNA, 12 bp, Homo sapiens
gatctggaaccc

SEQ ID NO: 2995945 - DNA, 15 bp, Homo sapiens
gatctggaacccaga

SEQ ID NO: 2995946 - DNA, 12 bp, Homo sapiens
gatctggaacct

SEQ ID NO: 2995947 - DNA, 18 bp, Homo sapiens
gatctggaacctcagcct

SEQ ID NO: 2995948 - DNA, 21 bp, Homo sapiens
gatctggaacctcagcctggc

SEQ ID NO: 2995949 - DNA, 24 bp, Homo sapiens
gatctggcttacaggggggtcgga

SEQ ID NO: 2995950 - DNA, 18 bp, Homo sapiens
gatctggggcatgaaaaa

SEQ ID NO: 2995951 - DNA, 21 bp, Homo sapiens
gatctgtcattatcaaaagtg

SEQ ID NO: 2995952 - DNA, 15 bp, Homo sapiens
gatctgtttccaaat

SEQ ID NO: 2995953 - DNA, 19 bp, Homo sapiens
gatctgttttgaaggcaaa

SEQ ID NO: 2995954 - DNA, 20 bp, Homo sapiens
gatctgttttgaaggcaaaa

SEQ ID NO: 2995955 - DNA, 16 bp, Homo sapiens
gatcttatttttctaa

SEQ ID NO: 2995956 - DNA, 19 bp, Homo sapiens
gatcttatttttctaaacg

SEQ ID NO: 2995957 - DNA, 24 bp, Homo sapiens
gatcttcaaaagtaatgcctctgt

SEQ ID NO: 2995958 - DNA, 23 bp, Homo sapiens
gatctttatatttcaataaatga

SEQ ID NO: 2995959 - DNA, 11 bp, Homo sapiens
gatctttgtgg

SEQ ID NO: 2995960 - DNA, 14 bp, Homo sapiens
gatctttgtggcca

SEQ ID NO: 2995961 - DNA, 22 bp, Homo sapiens
gatgaaaatattctgattggtc

SEQ ID NO: 2995962 - DNA, 15 bp, Homo sapiens
gatgaaaatatttaa

SEQ ID NO: 2995963 - DNA, 16 bp, Homo sapiens
gatgaaaatatttaaa

SEQ ID NO: 2995964 - DNA, 17 bp, Homo sapiens
gatgaaaccgtccctga

SEQ ID NO: 2995965 - DNA, 22 bp, Homo sapiens
gatgaagagctatttaatgaca

SEQ ID NO: 2995966 - DNA, 19 bp, Homo sapiens
gatgaagccgaccttagat

SEQ ID NO: 2995967 - DNA, 22 bp, Homo sapiens
gatgaagttttacattgttgag

SEQ ID NO: 2995968 - DNA, 23 bp, Homo sapiens
gatgaagttttacattgttgagc

SEQ ID NO: 2995969 - DNA, 13 bp, Homo sapiens
gagtctagattca

SEQ ID NO: 2995970 - DNA, 23 bp, Homo sapiens
gagtctagattcaaaggttctag

SEQ ID NO: 2995971 - DNA, 16 bp, Homo sapiens
gagtctcaggaggagg

SEQ ID NO: 2995972 - DNA, 21 bp, Homo sapiens
gagtctccctccgactccaga

SEQ ID NO: 2995973 - DNA, 16 bp, Homo sapiens
gagtctccttctcttc

SEQ ID NO: 2995974 - DNA, 18 bp, Homo sapiens
gagtctctacccctttct

SEQ ID NO: 2995975 - DNA, 11 bp, Homo sapiens
gagtctctcca

SEQ ID NO: 2995976 - DNA, 15 bp, Homo sapiens
gagtctctccagcct

SEQ ID NO: 2995977 - DNA, 16 bp, Homo sapiens
gagtctctccagcctc

SEQ ID NO: 2995978 - DNA, 17 bp, Homo sapiens
gagtctggcaaacatgt

SEQ ID NO: 2995979 - DNA, 22 bp, Homo sapiens
gagtctggcaaacatgtgcaac

SEQ ID NO: 2995980 - DNA, 15 bp, Homo sapiens
gagtctggtggagga

SEQ ID NO: 2995981 - DNA, 18 bp, Homo sapiens
gagtctgtatttttctaa

SEQ ID NO: 2995982 - DNA, 20 bp, Homo sapiens
gagtcttgctatattgccca

SEQ ID NO: 2995983 - DNA, 15 bp, Homo sapiens
gagtctttggttcta

SEQ ID NO: 2995984 - DNA, 16 bp, Homo sapiens
gagtgaaatattgtaa

SEQ ID NO: 2995985 - DNA, 17 bp, Homo sapiens
gagtgaaatattgtaaa

SEQ ID NO: 2995986 - DNA, 16 bp, Homo sapiens
gagtgacccagctact

SEQ ID NO: 2995987 - DNA, 23 bp, Homo sapiens
gagtgagacccagccctcatccc

SEQ ID NO: 2995988 - DNA, 13 bp, Homo sapiens
gagtgagtcagtg

SEQ ID NO: 2995989 - DNA, 19 bp, Homo sapiens
gagtgagtcagtgatgagg

SEQ ID NO: 2995990 - DNA, 21 bp, Homo sapiens
gagtgcaagcccctgctccag

SEQ ID NO: 2995991 - DNA, 19 bp, Homo sapiens
gagtgcaatgacacagtct

SEQ ID NO: 2995992 - DNA, 16 bp, Homo sapiens
gagtgcagccgtttga

SEQ ID NO: 2995993 - DNA, 22 bp, Homo sapiens
gagtgcagtcctgatcagagcc

SEQ ID NO: 2995994 - DNA, 23 bp, Homo sapiens
gagtgccccattcttttgtaatt

SEQ ID NO: 2995995 - DNA, 16 bp, Homo sapiens
gagtgcggcgtggaga

SEQ ID NO: 2995996 - DNA, 18 bp, Homo sapiens
gagtgctgcttgtgcctc

SEQ ID NO: 2995997 - DNA, 19 bp, Homo sapiens
gagtgctgtgctgtgttta

SEQ ID NO: 2995998 - DNA, 19 bp, Homo sapiens
gagtggaggttaaggctga

SEQ ID NO: 2995999 - DNA, 19 bp, Homo sapiens
gagtggccacggcccaggg

SEQ ID NO: 2996000 - DNA, 21 bp, Homo sapiens
gagtggccacggcccagggag

SEQ ID NO: 2996001 - DNA, 16 bp, Homo sapiens
gagtggccagcgccag

SEQ ID NO: 2996002 - DNA, 15 bp, Homo sapiens
gagtggcctagagca

SEQ ID NO: 2996003 - DNA, 17 bp, Homo sapiens
gagtggcgtgagctgcc

SEQ ID NO: 2996004 - DNA, 20 bp, Homo sapiens
gagtggtctcctctcagctt

SEQ ID NO: 2996005 - DNA, 15 bp, Homo sapiens
gagtgtctttccacg

SEQ ID NO: 2996006 - DNA, 19 bp, Homo sapiens
gagtgtctttccacggagc

SEQ ID NO: 2996007 - DNA, 12 bp, Homo sapiens
gagtgtgaccaa

SEQ ID NO: 2996008 - DNA, 21 bp, Homo sapiens
gagtgtgaccaaaagttacat

SEQ ID NO: 2996009 - DNA, 18 bp, Homo sapiens
gagtgtgagccacctaag

SEQ ID NO: 2996010 - DNA, 16 bp, Homo sapiens
gagtgtgctgaacaca

SEQ ID NO: 2996011 - DNA, 12 bp, Homo sapiens
gagtgtgggaag

SEQ ID NO: 2996012 - DNA, 17 bp, Homo sapiens
gagtgtgtatgccaaga

SEQ ID NO: 2996013 - DNA, 17 bp, Homo sapiens
gagtgtgtcagagccca

SEQ ID NO: 2996014 - DNA, 18 bp, Homo sapiens
gagtgtgttttataaact

SEQ ID NO: 2996015 - DNA, 23 bp, Homo sapiens
gagtgtgtttttgcactgtctgt

SEQ ID NO: 2996016 - DNA, 12 bp, Homo sapiens
gagttaaaatgt

SEQ ID NO: 2996017 - DNA, 13 bp, Homo sapiens
gagttaagacctg

SEQ ID NO: 2996018 - DNA, 18 bp, Homo sapiens
gagttaggctattcacaa

SEQ ID NO: 2996019 - DNA, 18 bp, Homo sapiens
gagttatatgttcactgt

SEQ ID NO: 2996020 - DNA, 17 bp, Homo sapiens
gagttcaagaccagcct

SEQ ID NO: 2996021 - DNA, 15 bp, Homo sapiens
gagttcctgctccgt

SEQ ID NO: 2996022 - DNA, 15 bp, Homo sapiens
gagttcgtgaagagg

SEQ ID NO: 2996023 - DNA, 16 bp, Homo sapiens
gagttctttggctcta

SEQ ID NO: 2996024 - DNA, 17 bp, Homo sapiens
gagttgatctggaaccc

SEQ ID NO: 2996025 - DNA, 19 bp, Homo sapiens
gagttgcaccattctttct

SEQ ID NO: 2996026 - DNA, 20 bp, Homo sapiens
gagttggagacccgcctggc

SEQ ID NO: 2996027 - DNA, 17 bp, Homo sapiens
gagttggggaaggcaag

SEQ ID NO: 2996028 - DNA, 14 bp, Homo sapiens
gagttgggggcagg

SEQ ID NO: 2996029 - DNA, 20 bp, Homo sapiens
gagttgggggcaggtcagga

SEQ ID NO: 2996030 - DNA, 19 bp, Homo sapiens
gagttgtgagccctctagg

SEQ ID NO: 2996031 - DNA, 21 bp, Homo sapiens
gagttgtgagccctctagggc

SEQ ID NO: 2996032 - DNA, 17 bp, Homo sapiens
gagttgtgattgaaagt

SEQ ID NO: 2996033 - DNA, 22 bp, Homo sapiens
gagttgttttcagactcagact

SEQ ID NO: 2996034 - DNA, 22 bp, Homo sapiens
gagtttatacagtgtacatgta

SEQ ID NO: 2996035 - DNA, 18 bp, Homo sapiens
gagtttcagctttcttca

SEQ ID NO: 2996036 - DNA, 18 bp, Homo sapiens
gagtttcatgtacaagat

SEQ ID NO: 2996037 - DNA, 16 bp, Homo sapiens
gagtttggttaatcag

SEQ ID NO: 2996038 - DNA, 21 bp, Homo sapiens
gagtttggttaatcagtgttg

SEQ ID NO: 2996039 - DNA, 18 bp, Homo sapiens
gagttttccatggcagga

SEQ ID NO: 2996040 - DNA, 13 bp, Homo sapiens
gagttttgtttta

SEQ ID NO: 2996041 - DNA, 22 bp, Homo sapiens
gagtttttcccagctacacctt

SEQ ID NO: 2996042 - DNA, 15 bp, Homo sapiens
gataaaaaggaagga

SEQ ID NO: 2996043 - DNA, 16 bp, Homo sapiens
gataaaatgttccttt

SEQ ID NO: 2996044 - DNA, 19 bp, Homo sapiens
gataaaattatagatggga

SEQ ID NO: 2996045 - DNA, 16 bp, Homo sapiens
gataaagaataataat

SEQ ID NO: 2996046 - DNA, 13 bp, Homo sapiens
gataaagatttct

SEQ ID NO: 2996047 - DNA, 16 bp, Homo sapiens
gataaagcagctcagg

SEQ ID NO: 2996048 - DNA, 11 bp, Homo sapiens
gataaaggaaa

SEQ ID NO: 2996049 - DNA, 15 bp, Homo sapiens
gataaatattatatt

SEQ ID NO: 2996050 - DNA, 18 bp, Homo sapiens
gataacaagcaaggatat

SEQ ID NO: 2996051 - DNA, 18 bp, Homo sapiens
gataagatggtttccgtg

SEQ ID NO: 2996052 - DNA, 21 bp, Homo sapiens
gataagattgaaattccagtt

SEQ ID NO: 2996053 - DNA, 13 bp, Homo sapiens
gataaggaaatca

SEQ ID NO: 2996054 - DNA, 12 bp, Homo sapiens
gataaggaagaa

SEQ ID NO: 2996055 - DNA, 21 bp, Homo sapiens
gataaggaagaaacagaagag

SEQ ID NO: 2996056 - DNA, 14 bp, Homo sapiens
gataaggggtgggg

SEQ ID NO: 2996057 - DNA, 20 bp, Homo sapiens
gataaggtaaaatgccatga

SEQ ID NO: 2996058 - DNA, 17 bp, Homo sapiens
gataagtgttcttcagt

SEQ ID NO: 2996059 - DNA, 23 bp, Homo sapiens
gataatccaaagcgatcatgtca

SEQ ID NO: 2996060 - DNA, 15 bp, Homo sapiens
gataatgctgttgcc

SEQ ID NO: 2996061 - DNA, 21 bp, Homo sapiens
gataatgtccaactaaaaaca

SEQ ID NO: 2996062 - DNA, 15 bp, Homo sapiens
gataattcttatttt

SEQ ID NO: 2996063 - DNA, 20 bp, Homo sapiens
gatacaacttcaagtgcatg

SEQ ID NO: 2996064 - DNA, 19 bp, Homo sapiens
gatacacccaaagtatcag

SEQ ID NO: 2996065 - DNA, 23 bp, Homo sapiens
gatacagcagtagacattttaac

SEQ ID NO: 2996066 - DNA, 21 bp, Homo sapiens
gatacaggcccctgggtttct

SEQ ID NO: 2996067 - DNA, 18 bp, Homo sapiens
gatacagtcaacaagcct

SEQ ID NO: 2996068 - DNA, 14 bp, Homo sapiens
gatacatacagaat

SEQ ID NO: 2996069 - DNA, 17 bp, Homo sapiens
gatacatccaaagcaga

SEQ ID NO: 2996070 - DNA, 23 bp, Homo sapiens
gatacatccaaagcagacagctc

SEQ ID NO: 2996071 - DNA, 23 bp, Homo sapiens
gataccacttttcattgcaaagt

SEQ ID NO: 2996072 - DNA, 22 bp, Homo sapiens
gataccagcgaggaggctccag

SEQ ID NO: 2996073 - DNA, 22 bp, Homo sapiens
gataccataaaaagaggatgat

SEQ ID NO: 2996074 - DNA, 13 bp, Homo sapiens
gatacgcactttg

SEQ ID NO: 2996075 - DNA, 16 bp, Homo sapiens
gatactcaaagtggaa

SEQ ID NO: 2996076 - DNA, 22 bp, Homo sapiens
gatactgctgatgctgaaataa

SEQ ID NO: 2996077 - DNA, 17 bp, Homo sapiens
gatactgtctctttcat

SEQ ID NO: 2996078 - DNA, 19 bp, Homo sapiens
gatactgtgagcttacatt

SEQ ID NO: 2996079 - DNA, 23 bp, Homo sapiens
gatactgtgagcttacattgaaa

SEQ ID NO: 2996080 - DNA, 17 bp, Homo sapiens
gatacttcagctttgtg

SEQ ID NO: 2996081 - DNA, 21 bp, Homo sapiens
gatactttgtatttttctttt

SEQ ID NO: 2996082 - DNA, 19 bp, Homo sapiens
gatagaaatgccaagcact

SEQ ID NO: 2996083 - DNA, 14 bp, Homo sapiens
gatagaactgtact

SEQ ID NO: 2996084 - DNA, 20 bp, Homo sapiens
gatagacacatatgaggggg

SEQ ID NO: 2996085 - DNA, 21 bp, Homo sapiens
gatagacacatatgaggggga

SEQ ID NO: 2996086 - DNA, 13 bp, Homo sapiens
gatagagcctttg

SEQ ID NO: 2996087 - DNA, 14 bp, Homo sapiens
gatagagcctttga

SEQ ID NO: 2996088 - DNA, 16 bp, Homo sapiens
gatagatattgtccta

SEQ ID NO: 2996089 - DNA, 20 bp, Homo sapiens
gatagatgctggcccagggc

SEQ ID NO: 2996090 - DNA, 21 bp, Homo sapiens
gatagattgtatctcttaaag

SEQ ID NO: 2996091 - DNA, 17 bp, Homo sapiens
gatagccttgaaaacaa

SEQ ID NO: 2996092 - DNA, 18 bp, Homo sapiens
gatagccttgaaaacaaa

SEQ ID NO: 2996093 - DNA, 22 bp, Homo sapiens
gataggactccatttctttctt

SEQ ID NO: 2996094 - DNA, 17 bp, Homo sapiens
gataggagggggcggca

SEQ ID NO: 2996095 - DNA, 22 bp, Homo sapiens
gataggagggggcggcagggct

SEQ ID NO: 2996096 - DNA, 14 bp, Homo sapiens
gatagggtggcaca

SEQ ID NO: 2996097 - DNA, 15 bp, Homo sapiens
gatagggtggcacat

SEQ ID NO: 2996098 - DNA, 14 bp, Homo sapiens
gatagtagcttcct

SEQ ID NO: 2996099 - DNA, 14 bp, Homo sapiens
gatagttactgttg

SEQ ID NO: 2996100 - DNA, 17 bp, Homo sapiens
gatagttactgttgtga

SEQ ID NO: 2996101 - DNA, 11 bp, Homo sapiens
gatataaatac

SEQ ID NO: 2996102 - DNA, 17 bp, Homo sapiens
gatataaattaattgtg

SEQ ID NO: 2996103 - DNA, 21 bp, Homo sapiens
gatataacaactggatgcatc

SEQ ID NO: 2996104 - DNA, 24 bp, Homo sapiens
gatatacgccctctttcatctgta

SEQ ID NO: 2996105 - DNA, 18 bp, Homo sapiens
gagaccaggccctggcta

SEQ ID NO: 2996106 - DNA, 14 bp, Homo sapiens
gagacccaaggagg

SEQ ID NO: 2996107 - DNA, 12 bp, Homo sapiens
gagacccaggac

SEQ ID NO: 2996108 - DNA, 14 bp, Homo sapiens
gagacctcagccat

SEQ ID NO: 2996109 - DNA, 16 bp, Homo sapiens
gagacctttgcccaca

SEQ ID NO: 2996110 - DNA, 17 bp, Homo sapiens
gagacctttgcccacac

SEQ ID NO: 2996111 - DNA, 22 bp, Homo sapiens
gagacggtgtcttgttctgtca

SEQ ID NO: 2996112 - DNA, 17 bp, Homo sapiens
gagacggtttccaggga

SEQ ID NO: 2996113 - DNA, 15 bp, Homo sapiens
gagactactaagagg

SEQ ID NO: 2996114 - DNA, 16 bp, Homo sapiens
gagactcacctctgcc

SEQ ID NO: 2996115 - DNA, 12 bp, Homo sapiens
gagactcagcct

SEQ ID NO: 2996116 - DNA, 14 bp, Homo sapiens
gagactcagcctgc

SEQ ID NO: 2996117 - DNA, 17 bp, Homo sapiens
gagactcagcctgcagt

SEQ ID NO: 2996118 - DNA, 14 bp, Homo sapiens
gagactccatctct

SEQ ID NO: 2996119 - DNA, 14 bp, Homo sapiens
gagactcctgaagg

SEQ ID NO: 2996120 - DNA, 22 bp, Homo sapiens
gagactcctgaaggtctgggtc

SEQ ID NO: 2996121 - DNA, 15 bp, Homo sapiens
gagactgcccagcta

SEQ ID NO: 2996122 - DNA, 15 bp, Homo sapiens
gagactggcaggcgg

SEQ ID NO: 2996123 - DNA, 14 bp, Homo sapiens
gagactgggctctg

SEQ ID NO: 2996124 - DNA, 17 bp, Homo sapiens
gagactgggctgaggga

SEQ ID NO: 2996125 - DNA, 20 bp, Homo sapiens
gagactgggctgagggagcc

SEQ ID NO: 2996126 - DNA, 21 bp, Homo sapiens
gagactgggctgagggagcct

SEQ ID NO: 2996127 - DNA, 22 bp, Homo sapiens
gagacttctgtttgatcactgt

SEQ ID NO: 2996128 - DNA, 19 bp, Homo sapiens
gagacttgagtctattttt

SEQ ID NO: 2996129 - DNA, 13 bp, Homo sapiens
gagacttgccttc

SEQ ID NO: 2996130 - DNA, 11 bp, Homo sapiens
gagagaaaaag

SEQ ID NO: 2996131 - DNA, 15 bp, Homo sapiens
gagagaaaaagaaag

SEQ ID NO: 2996132 - DNA, 13 bp, Homo sapiens
gagagaaaataaa

SEQ ID NO: 2996133 - DNA, 17 bp, Homo sapiens
gagagaaaatatatgta

SEQ ID NO: 2996134 - DNA, 21 bp, Homo sapiens
gagagaacctaactgtatctt

SEQ ID NO: 2996135 - DNA, 15 bp, Homo sapiens
gagagaatagagctg

SEQ ID NO: 2996136 - DNA, 18 bp, Homo sapiens
gagagaatagagctgcca

SEQ ID NO: 2996137 - DNA, 19 bp, Homo sapiens
gagagaatagagctgccac

SEQ ID NO: 2996138 - DNA, 22 bp, Homo sapiens
gagagaccagcctttcttcctt

SEQ ID NO: 2996139 - DNA, 14 bp, Homo sapiens
gagagacccaagga

SEQ ID NO: 2996140 - DNA, 15 bp, Homo sapiens
gagagacccaaggag

SEQ ID NO: 2996141 - DNA, 14 bp, Homo sapiens
gagagactgtggag

SEQ ID NO: 2996142 - DNA, 16 bp, Homo sapiens
gagagacttggatgag

SEQ ID NO: 2996143 - DNA, 13 bp, Homo sapiens
gagagagagaaag

SEQ ID NO: 2996144 - DNA, 21 bp, Homo sapiens
gagagaggccattctttccca

SEQ ID NO: 2996145 - DNA, 17 bp, Homo sapiens
gagagataccttgaaaa

SEQ ID NO: 2996146 - DNA, 18 bp, Homo sapiens
gagagataccttgaaaaa

SEQ ID NO: 2996147 - DNA, 16 bp, Homo sapiens
gagagccaccaagagg

SEQ ID NO: 2996148 - DNA, 19 bp, Homo sapiens
gagagccagagaagtgaca

SEQ ID NO: 2996149 - DNA, 22 bp, Homo sapiens
gagagccagagaagtgacaggg

SEQ ID NO: 2996150 - DNA, 13 bp, Homo sapiens
gagagccagccct

SEQ ID NO: 2996151 - DNA, 18 bp, Homo sapiens
gagagcccctcacacagc

SEQ ID NO: 2996152 - DNA, 21 bp, Homo sapiens
gagagcctgctcccccacccc

SEQ ID NO: 2996153 - DNA, 23 bp, Homo sapiens
gagagcctgctcccccaccccct

SEQ ID NO: 2996154 - DNA, 11 bp, Homo sapiens
gagaggaagga

SEQ ID NO: 2996155 - DNA, 12 bp, Homo sapiens
gagaggatttga

SEQ ID NO: 2996156 - DNA, 16 bp, Homo sapiens
gagaggccctctggag

SEQ ID NO: 2996157 - DNA, 23 bp, Homo sapiens
gagaggccctctggagtggccac

SEQ ID NO: 2996158 - DNA, 12 bp, Homo sapiens
gagaggcctgct

SEQ ID NO: 2996159 - DNA, 12 bp, Homo sapiens
gagaggctggtg

SEQ ID NO: 2996160 - DNA, 23 bp, Homo sapiens
gagagggagaagaagtcagagag

SEQ ID NO: 2996161 - DNA, 12 bp, Homo sapiens
gagaggggacgc

SEQ ID NO: 2996162 - DNA, 16 bp, Homo sapiens
gagaggggacgcaggc

SEQ ID NO: 2996163 - DNA, 18 bp, Homo sapiens
gagagggtctggagaagc

SEQ ID NO: 2996164 - DNA, 13 bp, Homo sapiens
gagagggtgacaa

SEQ ID NO: 2996165 - DNA, 13 bp, Homo sapiens
gagaggtggccac

SEQ ID NO: 2996166 - DNA, 22 bp, Homo sapiens
gagaggttaaagcaaaccagcc

SEQ ID NO: 2996167 - DNA, 15 bp, Homo sapiens
gagagtacactgtgt

SEQ ID NO: 2996168 - DNA, 15 bp, Homo sapiens
gagagtgaggtggaa

SEQ ID NO: 2996169 - DNA, 14 bp, Homo sapiens
gagagtgtcaacca

SEQ ID NO: 2996170 - DNA, 16 bp, Homo sapiens
gagagttaaaagcagc

SEQ ID NO: 2996171 - DNA, 14 bp, Homo sapiens
gagagtttcctgaa

SEQ ID NO: 2996172 - DNA, 14 bp, Homo sapiens
gagataacttcctt

SEQ ID NO: 2996173 - DNA, 17 bp, Homo sapiens
gagatacagaattttat

SEQ ID NO: 2996174 - DNA, 17 bp, Homo sapiens
gagatagcctgtggccc

SEQ ID NO: 2996175 - DNA, 19 bp, Homo sapiens
gagatagcctgtggccctg

SEQ ID NO: 2996176 - DNA, 17 bp, Homo sapiens
gagatatggcagcgaaa

SEQ ID NO: 2996177 - DNA, 12 bp, Homo sapiens
gagatcagaaaa

SEQ ID NO: 2996178 - DNA, 22 bp, Homo sapiens
gagatccaaaagaagcccccag

SEQ ID NO: 2996179 - DNA, 20 bp, Homo sapiens
gagatcccaacactgccagc

SEQ ID NO: 2996180 - DNA, 19 bp, Homo sapiens
gagatcccatccccttgtc

SEQ ID NO: 2996181 - DNA, 18 bp, Homo sapiens
gagatcgtgccattgcac

SEQ ID NO: 2996182 - DNA, 21 bp, Homo sapiens
gagatcgtgccgttactctcc

SEQ ID NO: 2996183 - DNA, 19 bp, Homo sapiens
gagatctgcacagtcagaa

SEQ ID NO: 2996184 - DNA, 17 bp, Homo sapiens
gagatgacccctacccc

SEQ ID NO: 2996185 - DNA, 22 bp, Homo sapiens
gagatgagaaatgatgaaaagg

SEQ ID NO: 2996186 - DNA, 16 bp, Homo sapiens
gagatgctgagggtgt

SEQ ID NO: 2996187 - DNA, 21 bp, Homo sapiens
gagatgcttggagcaatcaga

SEQ ID NO: 2996188 - DNA, 17 bp, Homo sapiens
gagatggagtcttgcta

SEQ ID NO: 2996189 - DNA, 23 bp, Homo sapiens
gagatggatcaatcaaacccggc

SEQ ID NO: 2996190 - DNA, 14 bp, Homo sapiens
gagatgtaattgtt

SEQ ID NO: 2996191 - DNA, 20 bp, Homo sapiens
gagatgtgtggactgtggca

SEQ ID NO: 2996192 - DNA, 14 bp, Homo sapiens
gagattacaggcat

SEQ ID NO: 2996193 - DNA, 16 bp, Homo sapiens
gagattattaaatcgt

SEQ ID NO: 2996194 - DNA, 17 bp, Homo sapiens
gagattcagttttcatt

SEQ ID NO: 2996195 - DNA, 21 bp, Homo sapiens
gagattgcaccactgcactcc

SEQ ID NO: 2996196 - DNA, 15 bp, Homo sapiens
gagatttcttaaatc

SEQ ID NO: 2996197 - DNA, 16 bp, Homo sapiens
gagatttcttaaatct

SEQ ID NO: 2996198 - DNA, 14 bp, Homo sapiens
gagatttttgtttg

SEQ ID NO: 2996199 - DNA, 22 bp, Homo sapiens
gagcaaaaatgtaaaaaacaaa

SEQ ID NO: 2996200 - DNA, 22 bp, Homo sapiens
gagcaaggtttcgtggcagcac

SEQ ID NO: 2996201 - DNA, 13 bp, Homo sapiens
gagcaagttgcag

SEQ ID NO: 2996202 - DNA, 18 bp, Homo sapiens
gagcaatcagaacttcag

SEQ ID NO: 2996203 - DNA, 23 bp, Homo sapiens
gagcaatcagaacttcaggtgtg

SEQ ID NO: 2996204 - DNA, 19 bp, Homo sapiens
gagcacaaaacctgtccta

SEQ ID NO: 2996205 - DNA, 20 bp, Homo sapiens
gagcacactttagtggccga

SEQ ID NO: 2996206 - DNA, 14 bp, Homo sapiens
gagcacagacacag

SEQ ID NO: 2996207 - DNA, 15 bp, Homo sapiens
gagcacatactacct

SEQ ID NO: 2996208 - DNA, 21 bp, Homo sapiens
gagcacatactacctagaagt

SEQ ID NO: 2996209 - DNA, 23 bp, Homo sapiens
gagcacatactacctagaagtaa

SEQ ID NO: 2996210 - DNA, 14 bp, Homo sapiens
gagcaccacggcca

SEQ ID NO: 2996211 - DNA, 18 bp, Homo sapiens
gagcaccacggccagaag

SEQ ID NO: 2996212 - DNA, 13 bp, Homo sapiens
gagcaccaggcac

SEQ ID NO: 2996213 - DNA, 23 bp, Homo sapiens
gagcaccaggcacgaacccacct

SEQ ID NO: 2996214 - DNA, 15 bp, Homo sapiens
gagcacctggacccc

SEQ ID NO: 2996215 - DNA, 21 bp, Homo sapiens
gagcacctggaccccctgccc

SEQ ID NO: 2996216 - DNA, 23 bp, Homo sapiens
gagcaccttttaaacccctccct

SEQ ID NO: 2996217 - DNA, 23 bp, Homo sapiens
gagcacgcctgccatcttctccc

SEQ ID NO: 2996218 - DNA, 16 bp, Homo sapiens
gagcactctcacccca

SEQ ID NO: 2996219 - DNA, 13 bp, Homo sapiens
gagcagaatacaa

SEQ ID NO: 2996220 - DNA, 19 bp, Homo sapiens
gagcagagaggtggccacc

SEQ ID NO: 2996221 - DNA, 13 bp, Homo sapiens
gagcagcggctct

SEQ ID NO: 2996222 - DNA, 15 bp, Homo sapiens
gagcagcggctctgg

SEQ ID NO: 2996223 - DNA, 20 bp, Homo sapiens
gagcaggactccaggcccaa

SEQ ID NO: 2996224 - DNA, 22 bp, Homo sapiens
gagcaggcggtgggcacccacc

SEQ ID NO: 2996225 - DNA, 13 bp, Homo sapiens
gagcaggggctgc

SEQ ID NO: 2996226 - DNA, 17 bp, Homo sapiens
gagcaggggctgctggg

SEQ ID NO: 2996227 - DNA, 13 bp, Homo sapiens
gagcagggtcctg

SEQ ID NO: 2996228 - DNA, 22 bp, Homo sapiens
gagcagtaactgtccctgcttt

SEQ ID NO: 2996229 - DNA, 21 bp, Homo sapiens
gagcagtgaatgattcagtgt

SEQ ID NO: 2996230 - DNA, 21 bp, Homo sapiens
gagcagtgggagggtaccagc

SEQ ID NO: 2996231 - DNA, 16 bp, Homo sapiens
gagcagttcagagtgg

SEQ ID NO: 2996232 - DNA, 16 bp, Homo sapiens
gagcatacaaaataaa

SEQ ID NO: 2996233 - DNA, 14 bp, Homo sapiens
gagcatcacagaat

SEQ ID NO: 2996234 - DNA, 20 bp, Homo sapiens
gagcatcagctgtctgtcat

SEQ ID NO: 2996235 - DNA, 21 bp, Homo sapiens
gagcatccctaattcttcata

SEQ ID NO: 2996236 - DNA, 18 bp, Homo sapiens
gagcatctcaaatgtttt

SEQ ID NO: 2996237 - DNA, 20 bp, Homo sapiens
gagcatctcaaatgttttct

SEQ ID NO: 2996238 - DNA, 23 bp, Homo sapiens
gagcatctcaaatgttttctgca

SEQ ID NO: 2996239 - DNA, 21 bp, Homo sapiens
gagcatgcggagccagcaggc

SEQ ID NO: 2996240 - DNA, 18 bp, Homo sapiens
gagcattaaaataactat

SEQ ID NO: 2996241 - DNA, 16 bp, Homo sapiens
gagcattaagcccaat

SEQ ID NO: 2996242 - DNA, 18 bp, Homo sapiens
gaactcatcactgtggct

SEQ ID NO: 2996243 - DNA, 22 bp, Homo sapiens
gaactccagctggtgcccccag

SEQ ID NO: 2996244 - DNA, 18 bp, Homo sapiens
gaactccaggctgggctg

SEQ ID NO: 2996245 - DNA, 13 bp, Homo sapiens
gaactccagtgtt

SEQ ID NO: 2996246 - DNA, 15 bp, Homo sapiens
gaactcctgacctca

SEQ ID NO: 2996247 - DNA, 20 bp, Homo sapiens
gaactcctggaaatatcagt

SEQ ID NO: 2996248 - DNA, 18 bp, Homo sapiens
gaactcgcacctgtgctg

SEQ ID NO: 2996249 - DNA, 20 bp, Homo sapiens
gaactcgcacctgtgctgga

SEQ ID NO: 2996250 - DNA, 15 bp, Homo sapiens
gaactctcccctccc

SEQ ID NO: 2996251 - DNA, 18 bp, Homo sapiens
gaactctcccctccccat

SEQ ID NO: 2996252 - DNA, 20 bp, Homo sapiens
gaactctcccctccccatct

SEQ ID NO: 2996253 - DNA, 23 bp, Homo sapiens
gaactctcccctccccatctgtg

SEQ ID NO: 2996254 - DNA, 16 bp, Homo sapiens
gaactctctgtcttct

SEQ ID NO: 2996255 - DNA, 20 bp, Homo sapiens
gaactctctgtcttctctcc

SEQ ID NO: 2996256 - DNA, 16 bp, Homo sapiens
gaactctgcaactgaa

SEQ ID NO: 2996257 - DNA, 13 bp, Homo sapiens
gaactctgggctc

SEQ ID NO: 2996258 - DNA, 14 bp, Homo sapiens
gaactctggtggca

SEQ ID NO: 2996259 - DNA, 17 bp, Homo sapiens
gaactgaaaagagagca

SEQ ID NO: 2996260 - DNA, 16 bp, Homo sapiens
gaactgaaataaaaaa

SEQ ID NO: 2996261 - DNA, 20 bp, Homo sapiens
gacttaactgcatttttaga

SEQ ID NO: 2996262 - DNA, 16 bp, Homo sapiens
gacttagatattaaaa

SEQ ID NO: 2996263 - DNA, 18 bp, Homo sapiens
gacttagatattaaaatt

SEQ ID NO: 2996264 - DNA, 19 bp, Homo sapiens
gacttagatattaaaattt

SEQ ID NO: 2996265 - DNA, 16 bp, Homo sapiens
gacttagtaacttttt

SEQ ID NO: 2996266 - DNA, 20 bp, Homo sapiens
gacttattgtggataacaaa

SEQ ID NO: 2996267 - DNA, 16 bp, Homo sapiens
gacttcacactgcaag

SEQ ID NO: 2996268 - DNA, 22 bp, Homo sapiens
gacttcacactgcaagagcctt

SEQ ID NO: 2996269 - DNA, 20 bp, Homo sapiens
gacttcagaacagtgtttga

SEQ ID NO: 2996270 - DNA, 24 bp, Homo sapiens
gacttcatctcccacctagcagca

SEQ ID NO: 2996271 - DNA, 22 bp, Homo sapiens
gacttccccgcattccaggctc

SEQ ID NO: 2996272 - DNA, 19 bp, Homo sapiens
gacttcctgtccagctcca

SEQ ID NO: 2996273 - DNA, 22 bp, Homo sapiens
gacttcctgtccagctccaacc

SEQ ID NO: 2996274 - DNA, 20 bp, Homo sapiens
gacttccttgagacacggag

SEQ ID NO: 2996275 - DNA, 21 bp, Homo sapiens
gacttctgcggggcctgaggc

SEQ ID NO: 2996276 - DNA, 22 bp, Homo sapiens
gacttcttttcacattcttata

SEQ ID NO: 2996277 - DNA, 16 bp, Homo sapiens
gacttgacagtggaac

SEQ ID NO: 2996278 - DNA, 15 bp, Homo sapiens
gacttgagtctattt

SEQ ID NO: 2996279 - DNA, 17 bp, Homo sapiens
gacttgagtctattttt

SEQ ID NO: 2996280 - DNA, 23 bp, Homo sapiens
gacttgagtgttcctttttaaat

SEQ ID NO: 2996281 - DNA, 18 bp, Homo sapiens
gacttggtacagttgcag

SEQ ID NO: 2996282 - DNA, 20 bp, Homo sapiens
gacttggtacagttgcagga

SEQ ID NO: 2996283 - DNA, 22 bp, Homo sapiens
gacttggtacagttgcaggagc

SEQ ID NO: 2996284 - DNA, 20 bp, Homo sapiens
gacttgtaggaatctgcctt

SEQ ID NO: 2996285 - DNA, 13 bp, Homo sapiens
gacttgtgtgttc

SEQ ID NO: 2996286 - DNA, 12 bp, Homo sapiens
gacttgtttcct

SEQ ID NO: 2996287 - DNA, 13 bp, Homo sapiens
gacttgtttcctg

SEQ ID NO: 2996288 - DNA, 14 bp, Homo sapiens
gacttgtttcctgt

SEQ ID NO: 2996289 - DNA, 12 bp, Homo sapiens
gactttaattta

SEQ ID NO: 2996290 - DNA, 22 bp, Homo sapiens
gactttatttctgagcaaagca

SEQ ID NO: 2996291 - DNA, 17 bp, Homo sapiens
gactttcttctaaatga

SEQ ID NO: 2996292 - DNA, 17 bp, Homo sapiens
gactttgcagatggaaa

SEQ ID NO: 2996293 - DNA, 18 bp, Homo sapiens
gactttgggataggaaaa

SEQ ID NO: 2996294 - DNA, 17 bp, Homo sapiens
gactttgtttttaaaat

SEQ ID NO: 2996295 - DNA, 12 bp, Homo sapiens
gacttttaaaat

SEQ ID NO: 2996296 - DNA, 14 bp, Homo sapiens
gacttttaaaattt

SEQ ID NO: 2996297 - DNA, 18 bp, Homo sapiens
gacttttgaaaagaggtg

SEQ ID NO: 2996298 - DNA, 23 bp, Homo sapiens
gacttttgaagaacaaaaggctt

SEQ ID NO: 2996299 - DNA, 17 bp, Homo sapiens
gacttttgtaaaatcaa

SEQ ID NO: 2996300 - DNA, 18 bp, Homo sapiens
gacttttgtaaaatcaaa

SEQ ID NO: 2996301 - DNA, 23 bp, Homo sapiens
gacttttgtaaaatcaaatcatc

SEQ ID NO: 2996302 - DNA, 13 bp, Homo sapiens
gactttttataaa

SEQ ID NO: 2996303 - DNA, 20 bp, Homo sapiens
gactttttgtttctttgtgt

SEQ ID NO: 2996304 - DNA, 19 bp, Homo sapiens
gactttttttttttataat

SEQ ID NO: 2996305 - DNA, 10 bp, Homo sapiens
gagaaaaaaa

SEQ ID NO: 2996306 - DNA, 22 bp, Homo sapiens
gagaaaaaaaaacacacaaaaa

SEQ ID NO: 2996307 - DNA, 12 bp, Homo sapiens
gagaaaacactt

SEQ ID NO: 2996308 - DNA, 12 bp, Homo sapiens
gagaaaactctt

SEQ ID NO: 2996309 - DNA, 12 bp, Homo sapiens
gagaaaataaaa

SEQ ID NO: 2996310 - DNA, 16 bp, Homo sapiens
gagaaaataaaaagtt

SEQ ID NO: 2996311 - DNA, 17 bp, Homo sapiens
gagaaaataaaaagtta

SEQ ID NO: 2996312 - DNA, 17 bp, Homo sapiens
gagaaacctgtatcttt

SEQ ID NO: 2996313 - DNA, 17 bp, Homo sapiens
gagaaacgtccatctct

SEQ ID NO: 2996314 - DNA, 21 bp, Homo sapiens
gagaaactttgagtacagata

SEQ ID NO: 2996315 - DNA, 13 bp, Homo sapiens
gagaaagaaaact

SEQ ID NO: 2996316 - DNA, 14 bp, Homo sapiens
gagaaagaggccag

SEQ ID NO: 2996317 - DNA, 16 bp, Homo sapiens
gagaaagaggggcctg

SEQ ID NO: 2996318 - DNA, 17 bp, Homo sapiens
gagaaagcccacctggg

SEQ ID NO: 2996319 - DNA, 12 bp, Homo sapiens
gagaaaggagaa

SEQ ID NO: 2996320 - DNA, 18 bp, Homo sapiens
gagaaaggagaaattttg

SEQ ID NO: 2996321 - DNA, 18 bp, Homo sapiens
gagaaagggagaggaaga

SEQ ID NO: 2996322 - DNA, 18 bp, Homo sapiens
gagaaaggggagcccact

SEQ ID NO: 2996323 - DNA, 17 bp, Homo sapiens
gagaaagttggtgctgc

SEQ ID NO: 2996324 - DNA, 19 bp, Homo sapiens
gagaaagttggtgctgctc

SEQ ID NO: 2996325 - DNA, 23 bp, Homo sapiens
gagaaatctggcttctggccagg

SEQ ID NO: 2996326 - DNA, 14 bp, Homo sapiens
gagaaattgacaga

SEQ ID NO: 2996327 - DNA, 14 bp, Homo sapiens
gagaaccagtgcag

SEQ ID NO: 2996328 - DNA, 19 bp, Homo sapiens
gagaacctaactgtatctt

SEQ ID NO: 2996329 - DNA, 18 bp, Homo sapiens
gagaacctttccactccc

SEQ ID NO: 2996330 - DNA, 16 bp, Homo sapiens
gagaactaaaggtggc

SEQ ID NO: 2996331 - DNA, 22 bp, Homo sapiens
gagaactccagctggtgccccc

SEQ ID NO: 2996332 - DNA, 18 bp, Homo sapiens
gagaactgaaaagagagc

SEQ ID NO: 2996333 - DNA, 19 bp, Homo sapiens
gagaactgcatatgtttcg

SEQ ID NO: 2996334 - DNA, 14 bp, Homo sapiens
gagaactggttctt

SEQ ID NO: 2996335 - DNA, 15 bp, Homo sapiens
gagaagacaaaatta

SEQ ID NO: 2996336 - DNA, 14 bp, Homo sapiens
gagaagacaacaga

SEQ ID NO: 2996337 - DNA, 18 bp, Homo sapiens
gagaagacaacagaaaga

SEQ ID NO: 2996338 - DNA, 13 bp, Homo sapiens
gagaagaggagga

SEQ ID NO: 2996339 - DNA, 15 bp, Homo sapiens
gagaagaggaggagg

SEQ ID NO: 2996340 - DNA, 21 bp, Homo sapiens
gagaagaggaggaggtggggg

SEQ ID NO: 2996341 - DNA, 16 bp, Homo sapiens
gagaagatcgcatggc

SEQ ID NO: 2996342 - DNA, 19 bp, Homo sapiens
gagaagcaaaatctttttt

SEQ ID NO: 2996343 - DNA, 14 bp, Homo sapiens
gagaagcagtgagc

SEQ ID NO: 2996344 - DNA, 18 bp, Homo sapiens
gagaagcagtgagccgca

SEQ ID NO: 2996345 - DNA, 13 bp, Homo sapiens
gagaagccacctt

SEQ ID NO: 2996346 - DNA, 14 bp, Homo sapiens
gagaagccaccttc

SEQ ID NO: 2996347 - DNA, 15 bp, Homo sapiens
gagaagccaccttcc

SEQ ID NO: 2996348 - DNA, 22 bp, Homo sapiens
gagaagccaggaatttcccagg

SEQ ID NO: 2996349 - DNA, 20 bp, Homo sapiens
gagaagctaatatgattttt

SEQ ID NO: 2996350 - DNA, 21 bp, Homo sapiens
gagaagctctcgggctaggaa

SEQ ID NO: 2996351 - DNA, 15 bp, Homo sapiens
gagaaggaaagcttt

SEQ ID NO: 2996352 - DNA, 21 bp, Homo sapiens
gagaaggaaggagactcacct

SEQ ID NO: 2996353 - DNA, 20 bp, Homo sapiens
gagaaggcctcccctgagga

SEQ ID NO: 2996354 - DNA, 15 bp, Homo sapiens
gagaagggctggggc

SEQ ID NO: 2996355 - DNA, 16 bp, Homo sapiens
gagaagggctggggcc

SEQ ID NO: 2996356 - DNA, 23 bp, Homo sapiens
gagaaggggcgggaatattgttt

SEQ ID NO: 2996357 - DNA, 20 bp, Homo sapiens
gagaagtctttcaagaatga

SEQ ID NO: 2996358 - DNA, 16 bp, Homo sapiens
gagaagtgacagggaa

SEQ ID NO: 2996359 - DNA, 17 bp, Homo sapiens
gagaagtgacagggaag

SEQ ID NO: 2996360 - DNA, 22 bp, Homo sapiens
gagaagtggggaccccacccct

SEQ ID NO: 2996361 - DNA, 21 bp, Homo sapiens
gagaagtttcgaggggtcctc

SEQ ID NO: 2996362 - DNA, 16 bp, Homo sapiens
gagaatagagctgcca

SEQ ID NO: 2996363 - DNA, 18 bp, Homo sapiens
gagaatagagctgccact

SEQ ID NO: 2996364 - DNA, 18 bp, Homo sapiens
gagaataggcagccccca

SEQ ID NO: 2996365 - DNA, 20 bp, Homo sapiens
gagaatataacatgaaatga

SEQ ID NO: 2996366 - DNA, 23 bp, Homo sapiens
gagaatattagctttactgtttg

SEQ ID NO: 2996367 - DNA, 20 bp, Homo sapiens
gagaatcacctgaaccccag

SEQ ID NO: 2996368 - DNA, 14 bp, Homo sapiens
gagaatgagaaatg

SEQ ID NO: 2996369 - DNA, 13 bp, Homo sapiens
gagaatgagggtc

SEQ ID NO: 2996370 - DNA, 23 bp, Homo sapiens
gagaatgatagtaataggataca

SEQ ID NO: 2996371 - DNA, 17 bp, Homo sapiens
gagaatgcagcccacca

SEQ ID NO: 2996372 - DNA, 19 bp, Homo sapiens
gagaatggaaaccacaact

SEQ ID NO: 2996373 - DNA, 14 bp, Homo sapiens
gagaatgtatttcc

SEQ ID NO: 2996374 - DNA, 15 bp, Homo sapiens
gagaattaaactcct

SEQ ID NO: 2996375 - DNA, 18 bp, Homo sapiens
gagaattcttacatgttt

SEQ ID NO: 2996376 - DNA, 19 bp, Homo sapiens
gagaattgggcggctctga

SEQ ID NO: 2996377 - DNA, 14 bp, Homo sapiens
gagaattgggggct

SEQ ID NO: 2996378 - DNA, 18 bp, Homo sapiens
gagaatttaatttttaaa

SEQ ID NO: 2996379 - DNA, 23 bp, Homo sapiens
gagaatttaatttttaaaagact

SEQ ID NO: 2996380 - DNA, 19 bp, Homo sapiens
gagacaaagcaggagtgga

SEQ ID NO: 2996381 - DNA, 20 bp, Homo sapiens
gagacaatgtctgcagccct

SEQ ID NO: 2996382 - DNA, 20 bp, Homo sapiens
gagacacctgcacctccccc

SEQ ID NO: 2996383 - DNA, 20 bp, Homo sapiens
gagacagagcctcgctctgt

SEQ ID NO: 2996384 - DNA, 23 bp, Homo sapiens
gaccatctgtgactataaagctg

SEQ ID NO: 2996385 - DNA, 13 bp, Homo sapiens
gaccatgtgaatc

SEQ ID NO: 2996386 - DNA, 14 bp, Homo sapiens
gaccatgtgattat

SEQ ID NO: 2996387 - DNA, 20 bp, Homo sapiens
gaccatgtgattatggacat

SEQ ID NO: 2996388 - DNA, 20 bp, Homo sapiens
gaccatgtgcggagcagcct

SEQ ID NO: 2996389 - DNA, 16 bp, Homo sapiens
gaccattggctgcgct

SEQ ID NO: 2996390 - DNA, 15 bp, Homo sapiens
gaccatttgtagtga

SEQ ID NO: 2996391 - DNA, 13 bp, Homo sapiens
gacccaacaatga

SEQ ID NO: 2996392 - DNA, 22 bp, Homo sapiens
gacccaagtagctgctaccttc

SEQ ID NO: 2996393 - DNA, 15 bp, Homo sapiens
gacccacagcctcca

SEQ ID NO: 2996394 - DNA, 19 bp, Homo sapiens
gacccaccaaggtctcaca

SEQ ID NO: 2996395 - DNA, 18 bp, Homo sapiens
gacccacgtggctgcgtg

SEQ ID NO: 2996396 - DNA, 19 bp, Homo sapiens
gacccacttctcatcacac

SEQ ID NO: 2996397 - DNA, 23 bp, Homo sapiens
gacccacttctcatcacacacat

SEQ ID NO: 2996398 - DNA, 20 bp, Homo sapiens
gacccagcccgcggcctgga

SEQ ID NO: 2996399 - DNA, 17 bp, Homo sapiens
gacccagccctcatccc

SEQ ID NO: 2996400 - DNA, 15 bp, Homo sapiens
gacccagggaacagc

SEQ ID NO: 2996401 - DNA, 11 bp, Homo sapiens
gacccagggag

SEQ ID NO: 2996402 - DNA, 21 bp, Homo sapiens
gacccagggagaggctgtgtc

SEQ ID NO: 2996403 - DNA, 12 bp, Homo sapiens
gacccagtgcag

SEQ ID NO: 2996404 - DNA, 13 bp, Homo sapiens
gacccagtgcaga

SEQ ID NO: 2996405 - DNA, 14 bp, Homo sapiens
gacccagtgcagaa

SEQ ID NO: 2996406 - DNA, 17 bp, Homo sapiens
gacccagtgcccccact

SEQ ID NO: 2996407 - DNA, 20 bp, Homo sapiens
gacccattctacacagagca

SEQ ID NO: 2996408 - DNA, 16 bp, Homo sapiens
gaccccacccctcatc

SEQ ID NO: 2996409 - DNA, 12 bp, Homo sapiens
gaccccagagga

SEQ ID NO: 2996410 - DNA, 13 bp, Homo sapiens
gaccccaggccca

SEQ ID NO: 2996411 - DNA, 18 bp, Homo sapiens
gaccccatcttccagcca

SEQ ID NO: 2996412 - DNA, 18 bp, Homo sapiens
gacccccactctcattcc

SEQ ID NO: 2996413 - DNA, 19 bp, Homo sapiens
gacccccactctcattccc

SEQ ID NO: 2996414 - DNA, 23 bp, Homo sapiens
gaccccccccattagaatgtgat

SEQ ID NO: 2996415 - DNA, 11 bp, Homo sapiens
gacccccgccc

SEQ ID NO: 2996416 - DNA, 16 bp, Homo sapiens
gacccccgccccctgc

SEQ ID NO: 2996417 - DNA, 19 bp, Homo sapiens
gacccccgccccctgccct

SEQ ID NO: 2996418 - DNA, 23 bp, Homo sapiens
gaccccctccccccaatccctca

SEQ ID NO: 2996419 - DNA, 15 bp, Homo sapiens
gaccccctgcccgcc

SEQ ID NO: 2996420 - DNA, 14 bp, Homo sapiens
gaccccgggccgga

SEQ ID NO: 2996421 - DNA, 22 bp, Homo sapiens
gaccccggtggcggccccagca

SEQ ID NO: 2996422 - DNA, 18 bp, Homo sapiens
gacccctaccccctcatc

SEQ ID NO: 2996423 - DNA, 21 bp, Homo sapiens
gacccctcaccacccccactg

SEQ ID NO: 2996424 - DNA, 13 bp, Homo sapiens
gacccctcctggg

SEQ ID NO: 2996425 - DNA, 17 bp, Homo sapiens
gacccctcctggggcca

SEQ ID NO: 2996426 - DNA, 23 bp, Homo sapiens
gacccctgcctcgagggccgcct

SEQ ID NO: 2996427 - DNA, 13 bp, Homo sapiens
gacccgaggccca

SEQ ID NO: 2996428 - DNA, 14 bp, Homo sapiens
gacccgaggcccag

SEQ ID NO: 2996429 - DNA, 23 bp, Homo sapiens
gacccgccagccccgctcccacc

SEQ ID NO: 2996430 - DNA, 12 bp, Homo sapiens
gacccggcggcc

SEQ ID NO: 2996431 - DNA, 16 bp, Homo sapiens
gacccggcggccctgc

SEQ ID NO: 2996432 - DNA, 15 bp, Homo sapiens
gacccgggaaggaag

SEQ ID NO: 2996433 - DNA, 17 bp, Homo sapiens
gacccggggtctcctgg

SEQ ID NO: 2996434 - DNA, 21 bp, Homo sapiens
gacccggggtctcctggacct

SEQ ID NO: 2996435 - DNA, 14 bp, Homo sapiens
gacccgtccatttg

SEQ ID NO: 2996436 - DNA, 20 bp, Homo sapiens
gaccctcatctttcttccaa

SEQ ID NO: 2996437 - DNA, 18 bp, Homo sapiens
gaccctcccggcctggct

SEQ ID NO: 2996438 - DNA, 17 bp, Homo sapiens
gaccctcgtttgatagt

SEQ ID NO: 2996439 - DNA, 16 bp, Homo sapiens
gaccctctgctgaaga

SEQ ID NO: 2996440 - DNA, 12 bp, Homo sapiens
gaccctctgtcc

SEQ ID NO: 2996441 - DNA, 19 bp, Homo sapiens
gaccctctgtccccaggcc

SEQ ID NO: 2996442 - DNA, 20 bp, Homo sapiens
gaccctctgtccccaggcct

SEQ ID NO: 2996443 - DNA, 16 bp, Homo sapiens
gaccctctttcttgtt

SEQ ID NO: 2996444 - DNA, 14 bp, Homo sapiens
gaccctgcggcctc

SEQ ID NO: 2996445 - DNA, 14 bp, Homo sapiens
gaccctgggcctgg

SEQ ID NO: 2996446 - DNA, 17 bp, Homo sapiens
gaccctgtatatagccc

SEQ ID NO: 2996447 - DNA, 21 bp, Homo sapiens
gaccctttccttccttccctg

SEQ ID NO: 2996448 - DNA, 22 bp, Homo sapiens
gaccctttccttccttccctgg

SEQ ID NO: 2996449 - DNA, 16 bp, Homo sapiens
gaccgagcccagcaga

SEQ ID NO: 2996450 - DNA, 14 bp, Homo sapiens
gaccgcccagctct

SEQ ID NO: 2996451 - DNA, 15 bp, Homo sapiens
gaccgcccagctctc

SEQ ID NO: 2996452 - DNA, 16 bp, Homo sapiens
gaccgcccagctctcc

SEQ ID NO: 2996453 - DNA, 16 bp, Homo sapiens
gaccgctgcccaggtg

SEQ ID NO: 2996454 - DNA, 22 bp, Homo sapiens
gaccgttataaagtgtgccaca

SEQ ID NO: 2996455 - DNA, 16 bp, Homo sapiens
gacctaggcagtaggc

SEQ ID NO: 2996456 - DNA, 16 bp, Homo sapiens
gacctcacctggtcct

SEQ ID NO: 2996457 - DNA, 11 bp, Homo sapiens
gacctcagcca

SEQ ID NO: 2996458 - DNA, 15 bp, Homo sapiens
gacctcagcctgcac

SEQ ID NO: 2996459 - DNA, 16 bp, Homo sapiens
gacctccagtcctgct

SEQ ID NO: 2996460 - DNA, 18 bp, Homo sapiens
gacctccagtcctgctgg

SEQ ID NO: 2996461 - DNA, 23 bp, Homo sapiens
gacctccagtcctgctggcctgc

SEQ ID NO: 2996462 - DNA, 19 bp, Homo sapiens
gacctccgtgcccaggccc

SEQ ID NO: 2996463 - DNA, 15 bp, Homo sapiens
gacctcgtcctcccc

SEQ ID NO: 2996464 - DNA, 21 bp, Homo sapiens
gacctcgtcctccccctgcca

SEQ ID NO: 2996465 - DNA, 14 bp, Homo sapiens
gacctctcccaggg

SEQ ID NO: 2996466 - DNA, 16 bp, Homo sapiens
gacctctctcagcccc

SEQ ID NO: 2996467 - DNA, 16 bp, Homo sapiens
gacctctctcggcccc

SEQ ID NO: 2996468 - DNA, 17 bp, Homo sapiens
gacctgagggacccttc

SEQ ID NO: 2996469 - DNA, 21 bp, Homo sapiens
gacctgatttattgaaatttt

SEQ ID NO: 2996470 - DNA, 12 bp, Homo sapiens
gacctgcctgta

SEQ ID NO: 2996471 - DNA, 21 bp, Homo sapiens
gacctgcgggtcctcagctgc

SEQ ID NO: 2996472 - DNA, 11 bp, Homo sapiens
gacctggacaa

SEQ ID NO: 2996473 - DNA, 16 bp, Homo sapiens
gacctggactagggcc

SEQ ID NO: 2996474 - DNA, 10 bp, Homo sapiens
gacctggcag

SEQ ID NO: 2996475 - DNA, 16 bp, Homo sapiens
gacctggcagctctgg

SEQ ID NO: 2996476 - DNA, 18 bp, Homo sapiens
gacctggtccacagggca

SEQ ID NO: 2996477 - DNA, 13 bp, Homo sapiens
gacctggtgctct

SEQ ID NO: 2996478 - DNA, 22 bp, Homo sapiens
gacctggtgctgcctctacctg

SEQ ID NO: 2996479 - DNA, 19 bp, Homo sapiens
gacctgtgagcccagctgg

SEQ ID NO: 2996480 - DNA, 19 bp, Homo sapiens
gaccttacgatcaggcaca

SEQ ID NO: 2996481 - DNA, 21 bp, Homo sapiens
gaccttagtgtttctgtgcat

SEQ ID NO: 2996482 - DNA, 22 bp, Homo sapiens
gaccttagtgtttctgtgcatg

SEQ ID NO: 2996483 - DNA, 13 bp, Homo sapiens
gaccttcagctca

SEQ ID NO: 2996484 - DNA, 16 bp, Homo sapiens
gaccttcatttcatgt

SEQ ID NO: 2996485 - DNA, 17 bp, Homo sapiens
gaccttcatttcatgta

SEQ ID NO: 2996486 - DNA, 22 bp, Homo sapiens
gaccttccataatgctactgtc

SEQ ID NO: 2996487 - DNA, 16 bp, Homo sapiens
gaccttgacagagcag

SEQ ID NO: 2996488 - DNA, 21 bp, Homo sapiens
gaccttgggaccaaaggggga

SEQ ID NO: 2996489 - DNA, 22 bp, Homo sapiens
gaccttgggaccaaagggggag

SEQ ID NO: 2996490 - DNA, 16 bp, Homo sapiens
gaccttgtaaaagaca

SEQ ID NO: 2996491 - DNA, 18 bp, Homo sapiens
gaccttgtaaaagacagt

SEQ ID NO: 2996492 - DNA, 19 bp, Homo sapiens
gaccttgtctctacaaaaa

SEQ ID NO: 2996493 - DNA, 19 bp, Homo sapiens
gacctttgtacagcccaga

SEQ ID NO: 2996494 - DNA, 19 bp, Homo sapiens
gacgaactggctacagtac

SEQ ID NO: 2996495 - DNA, 16 bp, Homo sapiens
gacgaagaagagccac

SEQ ID NO: 2996496 - DNA, 16 bp, Homo sapiens
gacgaatgcatattca

SEQ ID NO: 2996497 - DNA, 22 bp, Homo sapiens
gacgagacccaagggcagagca

SEQ ID NO: 2996498 - DNA, 23 bp, Homo sapiens
gacgatgtgttgaccggctgccg

SEQ ID NO: 2996499 - DNA, 18 bp, Homo sapiens
gacgatgtttatgttctt

SEQ ID NO: 2996500 - DNA, 19 bp, Homo sapiens
gacgcagcaggaggccagg

SEQ ID NO: 2996501 - DNA, 20 bp, Homo sapiens
gacgcagccggagggaggca

SEQ ID NO: 2996502 - DNA, 12 bp, Homo sapiens
gacgcaggcccc

SEQ ID NO: 2996503 - DNA, 16 bp, Homo sapiens
gacgcaggcccctctc

SEQ ID NO: 2996504 - DNA, 18 bp, Homo sapiens
gacgcaggcccctctcct

SEQ ID NO: 2996505 - DNA, 19 bp, Homo sapiens
gacgcaggcccctctcctc

SEQ ID NO: 2996506 - DNA, 20 bp, Homo sapiens
gacgcaggcccctctcctcc

SEQ ID NO: 2996507 - DNA, 18 bp, Homo sapiens
gacgcaggccctgtccag

SEQ ID NO: 2996508 - DNA, 20 bp, Homo sapiens
gacgcaggccctgtccagcc

SEQ ID NO: 2996509 - DNA, 21 bp, Homo sapiens
gacgccccggggcgcctagag

SEQ ID NO: 2996510 - DNA, 22 bp, Homo sapiens
gacgcctgttgttttggctcaa

SEQ ID NO: 2996511 - DNA, 18 bp, Homo sapiens
gacgctaataaaaattta

SEQ ID NO: 2996512 - DNA, 13 bp, Homo sapiens
gacgctgaataaa

SEQ ID NO: 2996513 - DNA, 17 bp, Homo sapiens
gacgctgaataaatgtc

SEQ ID NO: 2996514 - DNA, 20 bp, Homo sapiens
gacggcaaggctgaggtggc

SEQ ID NO: 2996515 - DNA, 17 bp, Homo sapiens
gacggcgctgcctcagg

SEQ ID NO: 2996516 - DNA, 18 bp, Homo sapiens
gacggctgtgggaccagg

SEQ ID NO: 2996517 - DNA, 14 bp, Homo sapiens
gacgggccaggccc

SEQ ID NO: 2996518 - DNA, 17 bp, Homo sapiens
gacggggtttcaccatg

SEQ ID NO: 2996519 - DNA, 22 bp, Homo sapiens
gacggtcagtttggtgtcaaca

SEQ ID NO: 2996520 - DNA, 23 bp, Homo sapiens
gacggtgttttgccatgttggcc

SEQ ID NO: 2996521 - DNA, 18 bp, Homo sapiens
gacagatcggatccagtt

SEQ ID NO: 2996522 - DNA, 20 bp, Homo sapiens
gacagatgaggctttccatg

SEQ ID NO: 2996523 - DNA, 18 bp, Homo sapiens
gacagatggacgcaggcc

SEQ ID NO: 2996524 - DNA, 19 bp, Homo sapiens
gacagatgttatttttgta

SEQ ID NO: 2996525 - DNA, 18 bp, Homo sapiens
gacagatttcagtaatgt

SEQ ID NO: 2996526 - DNA, 22 bp, Homo sapiens
gacagcaacaaaatcatggctt

SEQ ID NO: 2996527 - DNA, 15 bp, Homo sapiens
gacagcagcctgtga

SEQ ID NO: 2996528 - DNA, 17 bp, Homo sapiens
gacagcagcctgtgagg

SEQ ID NO: 2996529 - DNA, 15 bp, Homo sapiens
gacagccccaccctg

SEQ ID NO: 2996530 - DNA, 17 bp, Homo sapiens
gacagccccctgccccg

SEQ ID NO: 2996531 - DNA, 10 bp, Homo sapiens
gacagccttc

SEQ ID NO: 2996532 - DNA, 19 bp, Homo sapiens
gacagccttgggcctttca

SEQ ID NO: 2996533 - DNA, 22 bp, Homo sapiens
gacagcgctgtatttacagaca

SEQ ID NO: 2996534 - DNA, 16 bp, Homo sapiens
gacagctctttttgtg

SEQ ID NO: 2996535 - DNA, 16 bp, Homo sapiens
gacagctgctcagagc

SEQ ID NO: 2996536 - DNA, 17 bp, Homo sapiens
gacagctgctcctagag

SEQ ID NO: 2996537 - DNA, 15 bp, Homo sapiens
gacagctgtagtcat

SEQ ID NO: 2996538 - DNA, 16 bp, Homo sapiens
gacagctgtccctgtc

SEQ ID NO: 2996539 - DNA, 18 bp, Homo sapiens
gacagctgtccctgtcac

SEQ ID NO: 2996540 - DNA, 20 bp, Homo sapiens
gacagcttactgcagcactg

SEQ ID NO: 2996541 - DNA, 12 bp, Homo sapiens
gacagctttgct

SEQ ID NO: 2996542 - DNA, 15 bp, Homo sapiens
gacagctttgctgct

SEQ ID NO: 2996543 - DNA, 16 bp, Homo sapiens
gacagctttgctgctg

SEQ ID NO: 2996544 - DNA, 18 bp, Homo sapiens
gacaggaaaatcctctgg

SEQ ID NO: 2996545 - DNA, 14 bp, Homo sapiens
gacaggaaggtctg

SEQ ID NO: 2996546 - DNA, 21 bp, Homo sapiens
gacaggaaggtctgatttgca

SEQ ID NO: 2996547 - DNA, 11 bp, Homo sapiens
gacaggagaaa

SEQ ID NO: 2996548 - DNA, 17 bp, Homo sapiens
gacaggatgaggacaga

SEQ ID NO: 2996549 - DNA, 16 bp, Homo sapiens
gacaggcaaataaaag

SEQ ID NO: 2996550 - DNA, 16 bp, Homo sapiens
gacaggcggggcccag

SEQ ID NO: 2996551 - DNA, 21 bp, Homo sapiens
gacaggctggaatgagggagg

SEQ ID NO: 2996552 - DNA, 21 bp, Homo sapiens
gacaggctggctccagatgca

SEQ ID NO: 2996553 - DNA, 14 bp, Homo sapiens
gacagggtcttgct

SEQ ID NO: 2996554 - DNA, 12 bp, Homo sapiens
gacagggtttca

SEQ ID NO: 2996555 - DNA, 17 bp, Homo sapiens
gacagggtttcaccatg

SEQ ID NO: 2996556 - DNA, 23 bp, Homo sapiens
gacagggttttttcatttttgtg

SEQ ID NO: 2996557 - DNA, 16 bp, Homo sapiens
gacagtaacacaatta

SEQ ID NO: 2996558 - DNA, 18 bp, Homo sapiens
gacagtagcattgaagtg

SEQ ID NO: 2996559 - DNA, 17 bp, Homo sapiens
gacagtcggtgacccca

SEQ ID NO: 2996560 - DNA, 13 bp, Homo sapiens
gacagtctcactt

SEQ ID NO: 2996561 - DNA, 14 bp, Homo sapiens
gacagtgaaagaaa

SEQ ID NO: 2996562 - DNA, 16 bp, Homo sapiens
gacagtgatgcctgcc

SEQ ID NO: 2996563 - DNA, 20 bp, Homo sapiens
gacagtgtatgtagaagcat

SEQ ID NO: 2996564 - DNA, 20 bp, Homo sapiens
gacagttagcatttaccaac

SEQ ID NO: 2996565 - DNA, 15 bp, Homo sapiens
gacagttctgaagaa

SEQ ID NO: 2996566 - DNA, 22 bp, Homo sapiens
gacagttgctggcatgtcttca

SEQ ID NO: 2996567 - DNA, 17 bp, Homo sapiens
gacagtttgtttcctgt

SEQ ID NO: 2996568 - DNA, 21 bp, Homo sapiens
gacagtttgtttcctgtctga

SEQ ID NO: 2996569 - DNA, 22 bp, Homo sapiens
gacagttttccttctcatctgt

SEQ ID NO: 2996570 - DNA, 14 bp, Homo sapiens
gacagtttttgaca

SEQ ID NO: 2996571 - DNA, 15 bp, Homo sapiens
gacagtttttgacat

SEQ ID NO: 2996572 - DNA, 22 bp, Homo sapiens
gacataatggggtcctggccat

SEQ ID NO: 2996573 - DNA, 21 bp, Homo sapiens
gacatacatagacatttcaaa

SEQ ID NO: 2996574 - DNA, 22 bp, Homo sapiens
gacatactccttccatcaaata

SEQ ID NO: 2996575 - DNA, 17 bp, Homo sapiens
gacatacttgaagggcc

SEQ ID NO: 2996576 - DNA, 19 bp, Homo sapiens
gacatacttgaagggccag

SEQ ID NO: 2996577 - DNA, 20 bp, Homo sapiens
gacatacttgaagggccaga

SEQ ID NO: 2996578 - DNA, 22 bp, Homo sapiens
gacatacttgaagggccagagc

SEQ ID NO: 2996579 - DNA, 13 bp, Homo sapiens
gacatagcctcat

SEQ ID NO: 2996580 - DNA, 21 bp, Homo sapiens
gacatagcctcatgttctgtg

SEQ ID NO: 2996581 - DNA, 15 bp, Homo sapiens
gacatatcatctgtg

SEQ ID NO: 2996582 - DNA, 12 bp, Homo sapiens
gacatatttaat

SEQ ID NO: 2996583 - DNA, 22 bp, Homo sapiens
gacatatttaatgttttaaatg

SEQ ID NO: 2996584 - DNA, 20 bp, Homo sapiens
gacatcagaagtaactccca

SEQ ID NO: 2996585 - DNA, 21 bp, Homo sapiens
gacatcagaagtaactcccac

SEQ ID NO: 2996586 - DNA, 23 bp, Homo sapiens
gacatcagcactttaccagaggc

SEQ ID NO: 2996587 - DNA, 20 bp, Homo sapiens
gacatccctcccccagcaga

SEQ ID NO: 2996588 - DNA, 14 bp, Homo sapiens
gacatccttgcagt

SEQ ID NO: 2996589 - DNA, 20 bp, Homo sapiens
gacatctggaatctggagac

SEQ ID NO: 2996590 - DNA, 17 bp, Homo sapiens
gacatgaaaagttattt

SEQ ID NO: 2996591 - DNA, 20 bp, Homo sapiens
gacatgaagattctttccca

SEQ ID NO: 2996592 - DNA, 13 bp, Homo sapiens
gacatgatgcttt

SEQ ID NO: 2996593 - DNA, 22 bp, Homo sapiens
gacatgatttccttgaatgtgg

SEQ ID NO: 2996594 - DNA, 13 bp, Homo sapiens
gacatgcatgaca

SEQ ID NO: 2996595 - DNA, 17 bp, Homo sapiens
gacatgcggtagccagc

SEQ ID NO: 2996596 - DNA, 19 bp, Homo sapiens
gacatgcggtagccagcac

SEQ ID NO: 2996597 - DNA, 13 bp, Homo sapiens
gacatgctgccag

SEQ ID NO: 2996598 - DNA, 20 bp, Homo sapiens
gacatggctccggcctctgc

SEQ ID NO: 2996599 - DNA, 22 bp, Homo sapiens
gacatgggtattttataatgtt

SEQ ID NO: 2996600 - DNA, 18 bp, Homo sapiens
gacatgtaccccctttcc

SEQ ID NO: 2996601 - DNA, 17 bp, Homo sapiens
gacatgtggcagcaggc

SEQ ID NO: 2996602 - DNA, 23 bp, Homo sapiens
gacatgttttagacaaatactca

SEQ ID NO: 2996603 - DNA, 14 bp, Homo sapiens
gacatgttttgata

SEQ ID NO: 2996604 - DNA, 21 bp, Homo sapiens
gacattaactcattagactgg

SEQ ID NO: 2996605 - DNA, 22 bp, Homo sapiens
gacattaactcattagactgga

SEQ ID NO: 2996606 - DNA, 20 bp, Homo sapiens
gacattatagacattgagga

SEQ ID NO: 2996607 - DNA, 23 bp, Homo sapiens
gacattcaaaaaactctctccca

SEQ ID NO: 2996608 - DNA, 20 bp, Homo sapiens
gacattcaaaacagttactt

SEQ ID NO: 2996609 - DNA, 16 bp, Homo sapiens
gacattccaagacagt

SEQ ID NO: 2996610 - DNA, 23 bp, Homo sapiens
gacattctctattgtaattttgt

SEQ ID NO: 2996611 - DNA, 18 bp, Homo sapiens
gacattgccaaaaaggat

SEQ ID NO: 2996612 - DNA, 21 bp, Homo sapiens
gacatttacaccacactttca

SEQ ID NO: 2996613 - DNA, 15 bp, Homo sapiens
gacattttaacaaga

SEQ ID NO: 2996614 - DNA, 18 bp, Homo sapiens
gacattttctctttaaaa

SEQ ID NO: 2996615 - DNA, 21 bp, Homo sapiens
gacattttctctttaaaagaa

SEQ ID NO: 2996616 - DNA, 15 bp, Homo sapiens
gacattttttcagtc

SEQ ID NO: 2996617 - DNA, 20 bp, Homo sapiens
gaccaaaaggagagattatt

SEQ ID NO: 2996618 - DNA, 19 bp, Homo sapiens
gaccaaaagttacatgttt

SEQ ID NO: 2996619 - DNA, 13 bp, Homo sapiens
gaccaaagtccct

SEQ ID NO: 2996620 - DNA, 15 bp, Homo sapiens
gaccaaattgcttct

SEQ ID NO: 2996621 - DNA, 22 bp, Homo sapiens
gaccaacatggagaaaccctgt

SEQ ID NO: 2996622 - DNA, 14 bp, Homo sapiens
gaccaactgtcact

SEQ ID NO: 2996623 - DNA, 15 bp, Homo sapiens
gaccaagcaggaagc

SEQ ID NO: 2996624 - DNA, 16 bp, Homo sapiens
gaccaagcaggaagct

SEQ ID NO: 2996625 - DNA, 20 bp, Homo sapiens
gaccaaggcctcggcagaac

SEQ ID NO: 2996626 - DNA, 17 bp, Homo sapiens
gaccaagtgctggccca

SEQ ID NO: 2996627 - DNA, 18 bp, Homo sapiens
gaccaatacatttgtatt

SEQ ID NO: 2996628 - DNA, 15 bp, Homo sapiens
gaccacaccagcctc

SEQ ID NO: 2996629 - DNA, 12 bp, Homo sapiens
gaccacagcaca

SEQ ID NO: 2996630 - DNA, 15 bp, Homo sapiens
gaccacagcacagcc

SEQ ID NO: 2996631 - DNA, 16 bp, Homo sapiens
gaccacagcacagcca

SEQ ID NO: 2996632 - DNA, 17 bp, Homo sapiens
gaccacgggaagcatct

SEQ ID NO: 2996633 - DNA, 12 bp, Homo sapiens
gaccactgcatg

SEQ ID NO: 2996634 - DNA, 14 bp, Homo sapiens
gaccactgggcccc

SEQ ID NO: 2996635 - DNA, 16 bp, Homo sapiens
gaccactgggcccctc

SEQ ID NO: 2996636 - DNA, 17 bp, Homo sapiens
gaccactgggcccctca

SEQ ID NO: 2996637 - DNA, 15 bp, Homo sapiens
gaccactgtcttttt

SEQ ID NO: 2996638 - DNA, 19 bp, Homo sapiens
gaccactgtctttttctta

SEQ ID NO: 2996639 - DNA, 16 bp, Homo sapiens
gaccagaaacagggac

SEQ ID NO: 2996640 - DNA, 20 bp, Homo sapiens
gaccagaaacctgggagaga

SEQ ID NO: 2996641 - DNA, 15 bp, Homo sapiens
gaccagagggatggg

SEQ ID NO: 2996642 - DNA, 14 bp, Homo sapiens
gaccagcagcgcct

SEQ ID NO: 2996643 - DNA, 16 bp, Homo sapiens
gaccagcagcgccttt

SEQ ID NO: 2996644 - DNA, 22 bp, Homo sapiens
gaccagccgtgagcatgtttgg

SEQ ID NO: 2996645 - DNA, 14 bp, Homo sapiens
gaccagcctctcca

SEQ ID NO: 2996646 - DNA, 12 bp, Homo sapiens
gaccagcctggc

SEQ ID NO: 2996647 - DNA, 22 bp, Homo sapiens
gaccagctcaggacagatgcca

SEQ ID NO: 2996648 - DNA, 11 bp, Homo sapiens
gaccaggaaag

SEQ ID NO: 2996649 - DNA, 16 bp, Homo sapiens
gaccaggacaggacca

SEQ ID NO: 2996650 - DNA, 18 bp, Homo sapiens
gaccagggaagtgtgtgt

SEQ ID NO: 2996651 - DNA, 16 bp, Homo sapiens
gaccagggcagggcca

SEQ ID NO: 2996652 - DNA, 14 bp, Homo sapiens
gaccagggcctttt

SEQ ID NO: 2996653 - DNA, 17 bp, Homo sapiens
gaccaggggaccagagg

SEQ ID NO: 2996654 - DNA, 14 bp, Homo sapiens
gaccaggtcctgct

SEQ ID NO: 2996655 - DNA, 16 bp, Homo sapiens
gaccaggtcctgctcc

SEQ ID NO: 2996656 - DNA, 13 bp, Homo sapiens
gaccatcctattt

SEQ ID NO: 2996657 - DNA, 13 bp, Homo sapiens
gaccatctgtgac

SEQ ID NO: 2996658 - DNA, 20 bp, Homo sapiens
gctctgcctctaactccctc

SEQ ID NO: 2996659 - DNA, 23 bp, Homo sapiens
gctctgcctctaactccctcctc

SEQ ID NO: 2996660 - DNA, 14 bp, Homo sapiens
gctctgcgccaggc

SEQ ID NO: 2996661 - DNA, 15 bp, Homo sapiens
gctctgcgccaggca

SEQ ID NO: 2996662 - DNA, 17 bp, Homo sapiens
gctctgcgccaggcaga

SEQ ID NO: 2996663 - DNA, 19 bp, Homo sapiens
gctctgcgccaggcagagc

SEQ ID NO: 2996664 - DNA, 17 bp, Homo sapiens
gctctgcgtgtcacctg

SEQ ID NO: 2996665 - DNA, 19 bp, Homo sapiens
gctctggacagccccaccc

SEQ ID NO: 2996666 - DNA, 21 bp, Homo sapiens
gctctggacgtgaaatacttc

SEQ ID NO: 2996667 - DNA, 19 bp, Homo sapiens
gctctggcttcctgctgag

SEQ ID NO: 2996668 - DNA, 13 bp, Homo sapiens
gctctgggggcag

SEQ ID NO: 2996669 - DNA, 15 bp, Homo sapiens
gctctgggggcagat

SEQ ID NO: 2996670 - DNA, 19 bp, Homo sapiens
gctctggtgataaggacat

SEQ ID NO: 2996671 - DNA, 23 bp, Homo sapiens
gctctgtaatctcgtttcaaaaa

SEQ ID NO: 2996672 - DNA, 19 bp, Homo sapiens
gctctgtatcaggacccag

SEQ ID NO: 2996673 - DNA, 22 bp, Homo sapiens
gctctgtatcaggacccagagg

SEQ ID NO: 2996674 - DNA, 16 bp, Homo sapiens
gctctgtcaccctggc

SEQ ID NO: 2996675 - DNA, 20 bp, Homo sapiens
gctctgtcaccctggccacc

SEQ ID NO: 2996676 - DNA, 21 bp, Homo sapiens
gctctgtcaccctggccacca

SEQ ID NO: 2996677 - DNA, 22 bp, Homo sapiens
gctctgtcaccctggccaccac

SEQ ID NO: 2996678 - DNA, 18 bp, Homo sapiens
gctctgtcgcccaggctg

SEQ ID NO: 2996679 - DNA, 12 bp, Homo sapiens
gctctgtgcctt

SEQ ID NO: 2996680 - DNA, 14 bp, Homo sapiens
gctctgtgccttgg

SEQ ID NO: 2996681 - DNA, 16 bp, Homo sapiens
gctctgtggccacatt

SEQ ID NO: 2996682 - DNA, 14 bp, Homo sapiens
gctctgtgggaaaa

SEQ ID NO: 2996683 - DNA, 15 bp, Homo sapiens
gctctgtgggaaaaa

SEQ ID NO: 2996684 - DNA, 17 bp, Homo sapiens
gctctgttacccagggt

SEQ ID NO: 2996685 - DNA, 16 bp, Homo sapiens
gctcttaactgttgct

SEQ ID NO: 2996686 - DNA, 17 bp, Homo sapiens
gctcttacttcccccac

SEQ ID NO: 2996687 - DNA, 12 bp, Homo sapiens
gctcttcacagt

SEQ ID NO: 2996688 - DNA, 22 bp, Homo sapiens
gctcttcacttcctccagaagc

SEQ ID NO: 2996689 - DNA, 21 bp, Homo sapiens
gctcttctgccggccctgggg

SEQ ID NO: 2996690 - DNA, 15 bp, Homo sapiens
gctcttctgggcaga

SEQ ID NO: 2996691 - DNA, 17 bp, Homo sapiens
gctcttctgggcagagc

SEQ ID NO: 2996692 - DNA, 18 bp, Homo sapiens
gctcttctgggcagagcc

SEQ ID NO: 2996693 - DNA, 14 bp, Homo sapiens
gctcttcttgaaaa

SEQ ID NO: 2996694 - DNA, 22 bp, Homo sapiens
gctcttggggttcataggggca

SEQ ID NO: 2996695 - DNA, 24 bp, Homo sapiens
gctcttggggttcataggggcagg

SEQ ID NO: 2996696 - DNA, 16 bp, Homo sapiens
gctcttgtgatgtttg

SEQ ID NO: 2996697 - DNA, 16 bp, Homo sapiens
gctctttcaatgcagc

SEQ ID NO: 2996698 - DNA, 13 bp, Homo sapiens
gctctttcccagg

SEQ ID NO: 2996699 - DNA, 19 bp, Homo sapiens
gctctttgactgtcagcaa

SEQ ID NO: 2996700 - DNA, 21 bp, Homo sapiens
gctctttgactgtcagcaaga

SEQ ID NO: 2996701 - DNA, 18 bp, Homo sapiens
gctcttttactaagacat

SEQ ID NO: 2996702 - DNA, 21 bp, Homo sapiens
gctgaaaaggatcgaggcatg

SEQ ID NO: 2996703 - DNA, 22 bp, Homo sapiens
gctgaaaaggatcgaggcatgg

SEQ ID NO: 2996704 - DNA, 13 bp, Homo sapiens
gctgaaataaact

SEQ ID NO: 2996705 - DNA, 16 bp, Homo sapiens
gctgaacggggagaaa

SEQ ID NO: 2996706 - DNA, 18 bp, Homo sapiens
gctgaagatggcatcctg

SEQ ID NO: 2996707 - DNA, 15 bp, Homo sapiens
gctgaagcggtcaga

SEQ ID NO: 2996708 - DNA, 17 bp, Homo sapiens
gctgaagcggtcagact

SEQ ID NO: 2996709 - DNA, 18 bp, Homo sapiens
gctgaagcggtcagactg

SEQ ID NO: 2996710 - DNA, 14 bp, Homo sapiens
gctgaagctgctgc

SEQ ID NO: 2996711 - DNA, 17 bp, Homo sapiens
gctgaagctgctgcagc

SEQ ID NO: 2996712 - DNA, 13 bp, Homo sapiens
gctgaataaatgt

SEQ ID NO: 2996713 - DNA, 16 bp, Homo sapiens
gctgaataaatgtctt

SEQ ID NO: 2996714 - DNA, 20 bp, Homo sapiens
gctgaatgttgggactgcta

SEQ ID NO: 2996715 - DNA, 23 bp, Homo sapiens
gctgaatgttgggactgctaaat

SEQ ID NO: 2996716 - DNA, 15 bp, Homo sapiens
gctgacaagggacta

SEQ ID NO: 2996717 - DNA, 15 bp, Homo sapiens
gctgacagctgctcc

SEQ ID NO: 2996718 - DNA, 17 bp, Homo sapiens
gctgacagctgctccta

SEQ ID NO: 2996719 - DNA, 13 bp, Homo sapiens
gctgacccagtcc

SEQ ID NO: 2996720 - DNA, 14 bp, Homo sapiens
gctgaccccctccc

SEQ ID NO: 2996721 - DNA, 16 bp, Homo sapiens
gctgaccccctccccc

SEQ ID NO: 2996722 - DNA, 15 bp, Homo sapiens
gctgaccctgggcct

SEQ ID NO: 2996723 - DNA, 13 bp, Homo sapiens
gctgaccctgtgc

SEQ ID NO: 2996724 - DNA, 19 bp, Homo sapiens
gctgacctcacctggtcct

SEQ ID NO: 2996725 - DNA, 19 bp, Homo sapiens
gctgacctttttatcttga

SEQ ID NO: 2996726 - DNA, 15 bp, Homo sapiens
gctgacgaacttcca

SEQ ID NO: 2996727 - DNA, 13 bp, Homo sapiens
gctgacggccagg

SEQ ID NO: 2996728 - DNA, 15 bp, Homo sapiens
gctgacggccaggga

SEQ ID NO: 2996729 - DNA, 14 bp, Homo sapiens
gctgactctctgag

SEQ ID NO: 2996730 - DNA, 19 bp, Homo sapiens
gctgactctctgagctggg

SEQ ID NO: 2996731 - DNA, 20 bp, Homo sapiens
gctgactgatgttgagggaa

SEQ ID NO: 2996732 - DNA, 24 bp, Homo sapiens
gctgacttcatctcccacctagca

SEQ ID NO: 2996733 - DNA, 18 bp, Homo sapiens
gctgactttgctctttct

SEQ ID NO: 2996734 - DNA, 19 bp, Homo sapiens
gctgagacaggagaaacac

SEQ ID NO: 2996735 - DNA, 17 bp, Homo sapiens
gctgagagacccaagga

SEQ ID NO: 2996736 - DNA, 17 bp, Homo sapiens
gctgagaggctgcctcc

SEQ ID NO: 2996737 - DNA, 19 bp, Homo sapiens
gctgagaggctgcctccgc

SEQ ID NO: 2996738 - DNA, 20 bp, Homo sapiens
gctgagatcgtgccactgca

SEQ ID NO: 2996739 - DNA, 11 bp, Homo sapiens
gctgagccagg

SEQ ID NO: 2996740 - DNA, 12 bp, Homo sapiens
gctgagccaggc

SEQ ID NO: 2996741 - DNA, 13 bp, Homo sapiens
gctgagccaggct

SEQ ID NO: 2996742 - DNA, 18 bp, Homo sapiens
gctacaaaacgcgcagat

SEQ ID NO: 2996743 - DNA, 19 bp, Homo sapiens
gctacaaagaagacatgtt

SEQ ID NO: 2996744 - DNA, 22 bp, Homo sapiens
gctacaaagaagacatgtttta

SEQ ID NO: 2996745 - DNA, 15 bp, Homo sapiens
gctacaaaggaggac

SEQ ID NO: 2996746 - DNA, 18 bp, Homo sapiens
gctacaaaggaggacaag

SEQ ID NO: 2996747 - DNA, 15 bp, Homo sapiens
gctacaacagcctca

SEQ ID NO: 2996748 - DNA, 13 bp, Homo sapiens
gctacacctttct

SEQ ID NO: 2996749 - DNA, 13 bp, Homo sapiens
gctacagaaagca

SEQ ID NO: 2996750 - DNA, 16 bp, Homo sapiens
gctacaggttacaaca

SEQ ID NO: 2996751 - DNA, 18 bp, Homo sapiens
gctacaggttacaacaga

SEQ ID NO: 2996752 - DNA, 19 bp, Homo sapiens
gctacaggttacaacagat

SEQ ID NO: 2996753 - DNA, 14 bp, Homo sapiens
gctacagtaccatg

SEQ ID NO: 2996754 - DNA, 15 bp, Homo sapiens
gctacatcagccttc

SEQ ID NO: 2996755 - DNA, 17 bp, Homo sapiens
gctacatcagccttcaa

SEQ ID NO: 2996756 - DNA, 16 bp, Homo sapiens
gctacccgcagagttc

SEQ ID NO: 2996757 - DNA, 16 bp, Homo sapiens
gctaccctgagctgag

SEQ ID NO: 2996758 - DNA, 13 bp, Homo sapiens
gctacctccctcc

SEQ ID NO: 2996759 - DNA, 15 bp, Homo sapiens
gccttcttcagggcc

SEQ ID NO: 2996760 - DNA, 19 bp, Homo sapiens
gccttcttcagggcctggt

SEQ ID NO: 2996761 - DNA, 15 bp, Homo sapiens
gccttcttttgatta

SEQ ID NO: 2996762 - DNA, 22 bp, Homo sapiens
gccttcttttgattatgttttt

SEQ ID NO: 2996763 - DNA, 13 bp, Homo sapiens
gccttgaaaacaa

SEQ ID NO: 2996764 - DNA, 16 bp, Homo sapiens
gccttgaactctgggc

SEQ ID NO: 2996765 - DNA, 17 bp, Homo sapiens
gccttgaagacagagca

SEQ ID NO: 2996766 - DNA, 18 bp, Homo sapiens
gccttgaagactccctga

SEQ ID NO: 2996767 - DNA, 14 bp, Homo sapiens
gccttgaataataa

SEQ ID NO: 2996768 - DNA, 18 bp, Homo sapiens
gccttgagatgcttcact

SEQ ID NO: 2996769 - DNA, 12 bp, Homo sapiens
gccttgcagctg

SEQ ID NO: 2996770 - DNA, 13 bp, Homo sapiens
gccttgcagctgg

SEQ ID NO: 2996771 - DNA, 17 bp, Homo sapiens
gccttgcagctggccca

SEQ ID NO: 2996772 - DNA, 19 bp, Homo sapiens
gccttgcatttgtacctta

SEQ ID NO: 2996773 - DNA, 14 bp, Homo sapiens
gccttgccagagat

SEQ ID NO: 2996774 - DNA, 15 bp, Homo sapiens
gccttgcctggcctg

SEQ ID NO: 2996775 - DNA, 17 bp, Homo sapiens
gccttgctgactctctg

SEQ ID NO: 2996776 - DNA, 21 bp, Homo sapiens
gccttgctgactctctgagct

SEQ ID NO: 2996777 - DNA, 13 bp, Homo sapiens
gccttgctgccaa

SEQ ID NO: 2996778 - DNA, 19 bp, Homo sapiens
gccttggataatgctgttg

SEQ ID NO: 2996779 - DNA, 15 bp, Homo sapiens
gccttggccggctgt

SEQ ID NO: 2996780 - DNA, 15 bp, Homo sapiens
gccttggctcagaca

SEQ ID NO: 2996781 - DNA, 22 bp, Homo sapiens
gccttgggcctttcagtcccaa

SEQ ID NO: 2996782 - DNA, 18 bp, Homo sapiens
gccttgggggggctgcct

SEQ ID NO: 2996783 - DNA, 21 bp, Homo sapiens
gccttggggtgggggccaggc

SEQ ID NO: 2996784 - DNA, 17 bp, Homo sapiens
gccttggtgtccacctg

SEQ ID NO: 2996785 - DNA, 18 bp, Homo sapiens
gccttggtgtccacctgg

SEQ ID NO: 2996786 - DNA, 22 bp, Homo sapiens
gccttggtgtccacctggcccc

SEQ ID NO: 2996787 - DNA, 22 bp, Homo sapiens
gccttggttggacctattgcca

SEQ ID NO: 2996788 - DNA, 17 bp, Homo sapiens
gccttgtcccagaggct

SEQ ID NO: 2996789 - DNA, 22 bp, Homo sapiens
gcctttaccctcctctatttct

SEQ ID NO: 2996790 - DNA, 21 bp, Homo sapiens
gcctttactgaccctggggct

SEQ ID NO: 2996791 - DNA, 23 bp, Homo sapiens
gcctttactgaccctggggctgg

SEQ ID NO: 2996792 - DNA, 18 bp, Homo sapiens
gcctttatctcagccatc

SEQ ID NO: 2996793 - DNA, 14 bp, Homo sapiens
gcctttatggtttc

SEQ ID NO: 2996794 - DNA, 18 bp, Homo sapiens
gcctttcccaactctagc

SEQ ID NO: 2996795 - DNA, 15 bp, Homo sapiens
gcctttgatcttcag

SEQ ID NO: 2996796 - DNA, 22 bp, Homo sapiens
gcctttgctgtttagcttcctc

SEQ ID NO: 2996797 - DNA, 13 bp, Homo sapiens
gcctttgggaaat

SEQ ID NO: 2996798 - DNA, 19 bp, Homo sapiens
gcctttgggtcctgggcag

SEQ ID NO: 2996799 - DNA, 12 bp, Homo sapiens
gccttttctatt

SEQ ID NO: 2996800 - DNA, 22 bp, Homo sapiens
gccttttctggcaccgcagttt

SEQ ID NO: 2996801 - DNA, 17 bp, Homo sapiens
gccttttgctacgtgcc

SEQ ID NO: 2996802 - DNA, 18 bp, Homo sapiens
gcctttttaaaacacatg

SEQ ID NO: 2996803 - DNA, 22 bp, Homo sapiens
gcctttttaaaacacatgtttt

SEQ ID NO: 2996804 - DNA, 18 bp, Homo sapiens
gcctttttcaaccagatt

SEQ ID NO: 2996805 - DNA, 16 bp, Homo sapiens
gcgaagactgagccag

SEQ ID NO: 2996806 - DNA, 17 bp, Homo sapiens
gcgaagcgttgtcctca

SEQ ID NO: 2996807 - DNA, 14 bp, Homo sapiens
gcgaagtcctatgg

SEQ ID NO: 2996808 - DNA, 16 bp, Homo sapiens
gcgaattttaaaagat

SEQ ID NO: 2996809 - DNA, 22 bp, Homo sapiens
gcgacactcagggcagctgcct

SEQ ID NO: 2996810 - DNA, 24 bp, Homo sapiens
gcgacactcagggcagctgcctgg

SEQ ID NO: 2996811 - DNA, 13 bp, Homo sapiens
gcgaccctggggg

SEQ ID NO: 2996812 - DNA, 19 bp, Homo sapiens
gcgaccctgggggcacagg

SEQ ID NO: 2996813 - DNA, 23 bp, Homo sapiens
gcgaccctgggggcacaggaggc

SEQ ID NO: 2996814 - DNA, 23 bp, Homo sapiens
gcgactaatttcaaaatgctttt

SEQ ID NO: 2996815 - DNA, 15 bp, Homo sapiens
gcgagactccatctc

SEQ ID NO: 2996816 - DNA, 17 bp, Homo sapiens
gcgagatactgcatgtt

SEQ ID NO: 2996817 - DNA, 22 bp, Homo sapiens
gcgagccacaggaacggccctg

SEQ ID NO: 2996818 - DNA, 12 bp, Homo sapiens
gcgagcccttag

SEQ ID NO: 2996819 - DNA, 14 bp, Homo sapiens
gcgagcccttagcc

SEQ ID NO: 2996820 - DNA, 19 bp, Homo sapiens
gcgaggagatgctccttgg

SEQ ID NO: 2996821 - DNA, 20 bp, Homo sapiens
gcgaggagatgctccttggg

SEQ ID NO: 2996822 - DNA, 18 bp, Homo sapiens
gcgaggaggcgcggcctc

SEQ ID NO: 2996823 - DNA, 23 bp, Homo sapiens
gcgaggtcaacagagaaggcagg

SEQ ID NO: 2996824 - DNA, 16 bp, Homo sapiens
gcgaggtgcggccacc

SEQ ID NO: 2996825 - DNA, 16 bp, Homo sapiens
gcgatctcggctcagt

SEQ ID NO: 2996826 - DNA, 21 bp, Homo sapiens
gcgatgccctgggggccgtgc

SEQ ID NO: 2996827 - DNA, 22 bp, Homo sapiens
gcgcacttaccgccctgcgggc

SEQ ID NO: 2996828 - DNA, 19 bp, Homo sapiens
gcgcagccccatctgtgca

SEQ ID NO: 2996829 - DNA, 21 bp, Homo sapiens
gcgcaggcctgcgtgcgctgg

SEQ ID NO: 2996830 - DNA, 17 bp, Homo sapiens
gcgccaggcagagctga

SEQ ID NO: 2996831 - DNA, 21 bp, Homo sapiens
gcgccaggcagagctgagggc

SEQ ID NO: 2996832 - DNA, 20 bp, Homo sapiens
gcgccaggctgaccacagca

SEQ ID NO: 2996833 - DNA, 17 bp, Homo sapiens
gcgcccacccaggtccc

SEQ ID NO: 2996834 - DNA, 15 bp, Homo sapiens
gcgcccagcagcctg

SEQ ID NO: 2996835 - DNA, 18 bp, Homo sapiens
gcgcccagcagcctgcca

SEQ ID NO: 2996836 - DNA, 19 bp, Homo sapiens
gcgcccagcagcctgccag

SEQ ID NO: 2996837 - DNA, 17 bp, Homo sapiens
gcgcccagtccttccac

SEQ ID NO: 2996838 - DNA, 22 bp, Homo sapiens
gcgcccagtccttccacctcga

SEQ ID NO: 2996839 - DNA, 15 bp, Homo sapiens
gcgcccccaggcctg

SEQ ID NO: 2996840 - DNA, 18 bp, Homo sapiens
gcgcccccaggcctgccc

SEQ ID NO: 2996841 - DNA, 22 bp, Homo sapiens
gcgcccccaggcctgccctgct

SEQ ID NO: 2996842 - DNA, 14 bp, Homo sapiens
gcgcccccctccca

SEQ ID NO: 2996843 - DNA, 16 bp, Homo sapiens
gcgcccccctcccaga

SEQ ID NO: 2996844 - DNA, 19 bp, Homo sapiens
gcgccctccgacctctctc

SEQ ID NO: 2996845 - DNA, 23 bp, Homo sapiens
gcgccctttccccgacgcccacc

SEQ ID NO: 2996846 - DNA, 13 bp, Homo sapiens
gcgcctagagcgc

SEQ ID NO: 2996847 - DNA, 15 bp, Homo sapiens
gcgcctagagcgcgg

SEQ ID NO: 2996848 - DNA, 20 bp, Homo sapiens
gcgcctcaggctgctggggc

SEQ ID NO: 2996849 - DNA, 16 bp, Homo sapiens
gcgcctgccctgccca

SEQ ID NO: 2996850 - DNA, 16 bp, Homo sapiens
gcgcctgccttttcta

SEQ ID NO: 2996851 - DNA, 12 bp, Homo sapiens
gcgcctggagag

SEQ ID NO: 2996852 - DNA, 15 bp, Homo sapiens
gcgcctggagagcga

SEQ ID NO: 2996853 - DNA, 17 bp, Homo sapiens
gcgcctggagagcgagg

SEQ ID NO: 2996854 - DNA, 21 bp, Homo sapiens
gcgcctggagagcgaggaggc

SEQ ID NO: 2996855 - DNA, 14 bp, Homo sapiens
gcgcctggctgctg

SEQ ID NO: 2996856 - DNA, 21 bp, Homo sapiens
gcgcctgtcccctcacagact

SEQ ID NO: 2996857 - DNA, 22 bp, Homo sapiens
gcgccttctcggagctggccca

SEQ ID NO: 2996858 - DNA, 16 bp, Homo sapiens
gcgcctttcccaactc

SEQ ID NO: 2996859 - DNA, 13 bp, Homo sapiens
gcgcgcaggcctg

SEQ ID NO: 2996860 - DNA, 13 bp, Homo sapiens
gcgcgcctgcctt

SEQ ID NO: 2996861 - DNA, 14 bp, Homo sapiens
gcgcgctctctctc

SEQ ID NO: 2996862 - DNA, 20 bp, Homo sapiens
gcgcgctctctctctttctc

SEQ ID NO: 2996863 - DNA, 21 bp, Homo sapiens
gcgcggcctcccgaggagggg

SEQ ID NO: 2996864 - DNA, 16 bp, Homo sapiens
gcgcggcggctctgcc

SEQ ID NO: 2996865 - DNA, 15 bp, Homo sapiens
gcgcggctggctctg

SEQ ID NO: 2996866 - DNA, 18 bp, Homo sapiens
gcgcggctgggaggaggg

SEQ ID NO: 2996867 - DNA, 20 bp, Homo sapiens
gcgcggtggctcacgcctgt

SEQ ID NO: 2996868 - DNA, 15 bp, Homo sapiens
gcgctaacccccagc

SEQ ID NO: 2996869 - DNA, 19 bp, Homo sapiens
gcgctaacccccagcccac

SEQ ID NO: 2996870 - DNA, 15 bp, Homo sapiens
gcgctagtgccttgc

SEQ ID NO: 2996871 - DNA, 21 bp, Homo sapiens
gcgctagtgccttgcccacag

SEQ ID NO: 2996872 - DNA, 22 bp, Homo sapiens
gcgctcggcaggaaggagcggc

SEQ ID NO: 2996873 - DNA, 12 bp, Homo sapiens
gcgctctcccta

SEQ ID NO: 2996874 - DNA, 16 bp, Homo sapiens
gcgctctccctacctt

SEQ ID NO: 2996875 - DNA, 19 bp, Homo sapiens
gcgctctccctaccttgcc

SEQ ID NO: 2996876 - DNA, 14 bp, Homo sapiens
gcgctctcctggac

SEQ ID NO: 2996877 - DNA, 18 bp, Homo sapiens
gcgctctctctctttctc

SEQ ID NO: 2996878 - DNA, 13 bp, Homo sapiens
gcgctctggacag

SEQ ID NO: 2996879 - DNA, 20 bp, Homo sapiens
gcgctgaggtgtctggcctg

SEQ ID NO: 2996880 - DNA, 21 bp, Homo sapiens
gcgctgccgcaccccagagtg

SEQ ID NO: 2996881 - DNA, 17 bp, Homo sapiens
gcgctgcctcaggcact

SEQ ID NO: 2996882 - DNA, 11 bp, Homo sapiens
gcgctgcctgg

SEQ ID NO: 2996883 - DNA, 13 bp, Homo sapiens
gcgctgcctggcc

SEQ ID NO: 2996884 - DNA, 14 bp, Homo sapiens
gcgctgcctggcca

SEQ ID NO: 2996885 - DNA, 15 bp, Homo sapiens
gcgctgcctggccag

SEQ ID NO: 2996886 - DNA, 19 bp, Homo sapiens
gcgctggccgggaccccga

SEQ ID NO: 2996887 - DNA, 18 bp, Homo sapiens
gcgctgggcacttccctg

SEQ ID NO: 2996888 - DNA, 23 bp, Homo sapiens
gcgctggggaagtacgtcccagc

SEQ ID NO: 2996889 - DNA, 21 bp, Homo sapiens
gcgctggtcccctccctctgt

SEQ ID NO: 2996890 - DNA, 13 bp, Homo sapiens
gcgcttcctgagc

SEQ ID NO: 2996891 - DNA, 12 bp, Homo sapiens
gcgctttgaacg

SEQ ID NO: 2996892 - DNA, 20 bp, Homo sapiens
gcgctttgaacgtgccagca

SEQ ID NO: 2996893 - DNA, 14 bp, Homo sapiens
gcgctttgggaggc

SEQ ID NO: 2996894 - DNA, 21 bp, Homo sapiens
gcggaataaactagagaaggg

SEQ ID NO: 2996895 - DNA, 23 bp, Homo sapiens
gcctgctttgacgggccaggccc

SEQ ID NO: 2996896 - DNA, 18 bp, Homo sapiens
gcctggaacaccagcagc

SEQ ID NO: 2996897 - DNA, 24 bp, Homo sapiens
gcctggaacaccagcagcactgga

SEQ ID NO: 2996898 - DNA, 22 bp, Homo sapiens
gcctggaagctttgtcccctgc

SEQ ID NO: 2996899 - DNA, 15 bp, Homo sapiens
gcctggagcaggggt

SEQ ID NO: 2996900 - DNA, 17 bp, Homo sapiens
gcctggagcatggacag

SEQ ID NO: 2996901 - DNA, 11 bp, Homo sapiens
gcctggagccc

SEQ ID NO: 2996902 - DNA, 14 bp, Homo sapiens
gcctggagccccac

SEQ ID NO: 2996903 - DNA, 14 bp, Homo sapiens
gcctggagccctcc

SEQ ID NO: 2996904 - DNA, 20 bp, Homo sapiens
gcctggagccctccgccttc

SEQ ID NO: 2996905 - DNA, 14 bp, Homo sapiens
gcctggagcgtttg

SEQ ID NO: 2996906 - DNA, 14 bp, Homo sapiens
gcctggaggctcag

SEQ ID NO: 2996907 - DNA, 20 bp, Homo sapiens
gcctggagggggagcaccag

SEQ ID NO: 2996908 - DNA, 19 bp, Homo sapiens
gcctggagtgctgtgctgt

SEQ ID NO: 2996909 - DNA, 13 bp, Homo sapiens
gcctggcacacat

SEQ ID NO: 2996910 - DNA, 16 bp, Homo sapiens
gcctggcacacatcag

SEQ ID NO: 2996911 - DNA, 11 bp, Homo sapiens
gcctggcatct

SEQ ID NO: 2996912 - DNA, 15 bp, Homo sapiens
gcctggcatctgtgc

SEQ ID NO: 2996913 - DNA, 18 bp, Homo sapiens
gcctggcatctgtgcgtg

SEQ ID NO: 2996914 - DNA, 15 bp, Homo sapiens
gcctggcatctgtgt

SEQ ID NO: 2996915 - DNA, 17 bp, Homo sapiens
gcctggcatctgtgtgc

SEQ ID NO: 2996916 - DNA, 16 bp, Homo sapiens
gcctggccagcctaca

SEQ ID NO: 2996917 - DNA, 12 bp, Homo sapiens
gcctggccaggc

SEQ ID NO: 2996918 - DNA, 13 bp, Homo sapiens
gcctggccaggcc

SEQ ID NO: 2996919 - DNA, 14 bp, Homo sapiens
gcctggccaggccc

SEQ ID NO: 2996920 - DNA, 18 bp, Homo sapiens
gcctggccagtcttcctc

SEQ ID NO: 2996921 - DNA, 14 bp, Homo sapiens
gcctggccatgctg

SEQ ID NO: 2996922 - DNA, 16 bp, Homo sapiens
gcctggccggccagcc

SEQ ID NO: 2996923 - DNA, 18 bp, Homo sapiens
gcctggccggccagccag

SEQ ID NO: 2996924 - DNA, 20 bp, Homo sapiens
gcctggccggccagccagcc

SEQ ID NO: 2996925 - DNA, 17 bp, Homo sapiens
gcctggcctccaggccc

SEQ ID NO: 2996926 - DNA, 12 bp, Homo sapiens
gcctggcctgat

SEQ ID NO: 2996927 - DNA, 16 bp, Homo sapiens
gcctggcctggcacac

SEQ ID NO: 2996928 - DNA, 22 bp, Homo sapiens
gcctggccttgtcctcagccag

SEQ ID NO: 2996929 - DNA, 19 bp, Homo sapiens
gcctggctccccgagggct

SEQ ID NO: 2996930 - DNA, 15 bp, Homo sapiens
gcctgggaggcacag

SEQ ID NO: 2996931 - DNA, 15 bp, Homo sapiens
gcctgggcagtgccc

SEQ ID NO: 2996932 - DNA, 15 bp, Homo sapiens
gcctgggccccagct

SEQ ID NO: 2996933 - DNA, 15 bp, Homo sapiens
gcctgggcccctccc

SEQ ID NO: 2996934 - DNA, 18 bp, Homo sapiens
gcctgggcccctcccctc

SEQ ID NO: 2996935 - DNA, 22 bp, Homo sapiens
gcctgggcccctcccctcagag

SEQ ID NO: 2996936 - DNA, 21 bp, Homo sapiens
gcctgggctgaccccggtggc

SEQ ID NO: 2996937 - DNA, 20 bp, Homo sapiens
gcctgggctgggcagccttg

SEQ ID NO: 2996938 - DNA, 15 bp, Homo sapiens
gcctgggcttggccc

SEQ ID NO: 2996939 - DNA, 20 bp, Homo sapiens
gcctgggcttggcccgcggc

SEQ ID NO: 2996940 - DNA, 14 bp, Homo sapiens
gcctggggctggcc

SEQ ID NO: 2996941 - DNA, 14 bp, Homo sapiens
gcctggggcttgaa

SEQ ID NO: 2996942 - DNA, 22 bp, Homo sapiens
gcctgggggacccctggctctg

SEQ ID NO: 2996943 - DNA, 13 bp, Homo sapiens
gcctggggggaac

SEQ ID NO: 2996944 - DNA, 21 bp, Homo sapiens
gcctgggggtgccaggaccag

SEQ ID NO: 2996945 - DNA, 14 bp, Homo sapiens
gcctggggtctgga

SEQ ID NO: 2996946 - DNA, 14 bp, Homo sapiens
gcctggggtggggt

SEQ ID NO: 2996947 - DNA, 16 bp, Homo sapiens
gcctggggtggggtca

SEQ ID NO: 2996948 - DNA, 20 bp, Homo sapiens
gcctgggtcacagagtgaga

SEQ ID NO: 2996949 - DNA, 16 bp, Homo sapiens
gcctgggtgacagagc

SEQ ID NO: 2996950 - DNA, 18 bp, Homo sapiens
gcctgggtgacagagtga

SEQ ID NO: 2996951 - DNA, 18 bp, Homo sapiens
gcctgggtggggctgctc

SEQ ID NO: 2996952 - DNA, 22 bp, Homo sapiens
gcctgggttccccactggtctg

SEQ ID NO: 2996953 - DNA, 17 bp, Homo sapiens
gcctggtccctggtcct

SEQ ID NO: 2996954 - DNA, 10 bp, Homo sapiens
gcctggtctg

SEQ ID NO: 2996955 - DNA, 19 bp, Homo sapiens
gcctggttgaagaagatga

SEQ ID NO: 2996956 - DNA, 16 bp, Homo sapiens
gcctgtaatcccagct

SEQ ID NO: 2996957 - DNA, 20 bp, Homo sapiens
gcctgtaattcagtgtattt

SEQ ID NO: 2996958 - DNA, 11 bp, Homo sapiens
gcctgtacagt

SEQ ID NO: 2996959 - DNA, 12 bp, Homo sapiens
gcctgtacagtc

SEQ ID NO: 2996960 - DNA, 17 bp, Homo sapiens
gcctgtacagtctgtct

SEQ ID NO: 2996961 - DNA, 22 bp, Homo sapiens
gcctgtagcccactctgctcgc

SEQ ID NO: 2996962 - DNA, 23 bp, Homo sapiens
gcctgtatcctccctggcagaca

SEQ ID NO: 2996963 - DNA, 23 bp, Homo sapiens
gcctgtcagccaacattgccttg

SEQ ID NO: 2996964 - DNA, 15 bp, Homo sapiens
gcctgtcccaggact

SEQ ID NO: 2996965 - DNA, 17 bp, Homo sapiens
gcctgtcccaggactca

SEQ ID NO: 2996966 - DNA, 21 bp, Homo sapiens
gcctgtcccaggactcaccct

SEQ ID NO: 2996967 - DNA, 14 bp, Homo sapiens
gcctgtcccctcac

SEQ ID NO: 2996968 - DNA, 17 bp, Homo sapiens
gcctgtcccctcacaga

SEQ ID NO: 2996969 - DNA, 17 bp, Homo sapiens
gcctgtcctagtctcct

SEQ ID NO: 2996970 - DNA, 22 bp, Homo sapiens
gcctgtcctagtctcctttgaa

SEQ ID NO: 2996971 - DNA, 11 bp, Homo sapiens
gcctgtcctca

SEQ ID NO: 2996972 - DNA, 12 bp, Homo sapiens
gcctgtcctcac

SEQ ID NO: 2996973 - DNA, 13 bp, Homo sapiens
gcctgtctcagtg

SEQ ID NO: 2996974 - DNA, 14 bp, Homo sapiens
gcctgtctctttcc

SEQ ID NO: 2996975 - DNA, 13 bp, Homo sapiens
gcctgtctgtcca

SEQ ID NO: 2996976 - DNA, 20 bp, Homo sapiens
gcctgtctgtccaacccctc

SEQ ID NO: 2996977 - DNA, 23 bp, Homo sapiens
gcctgtgaggggcccctggccca

SEQ ID NO: 2996978 - DNA, 19 bp, Homo sapiens
gcctgtgcatgtatgtctt

SEQ ID NO: 2996979 - DNA, 19 bp, Homo sapiens
gcctgtggcggtgcctggg

SEQ ID NO: 2996980 - DNA, 16 bp, Homo sapiens
gcctgtggctgtggag

SEQ ID NO: 2996981 - DNA, 15 bp, Homo sapiens
gcctgtggggagccg

SEQ ID NO: 2996982 - DNA, 23 bp, Homo sapiens
gcctgtggtggctccccctctgc

SEQ ID NO: 2996983 - DNA, 13 bp, Homo sapiens
gcctgttcagtta

SEQ ID NO: 2996984 - DNA, 22 bp, Homo sapiens
gcctgttcagttacagaaagtg

SEQ ID NO: 2996985 - DNA, 19 bp, Homo sapiens
gccttaactaagactcccg

SEQ ID NO: 2996986 - DNA, 13 bp, Homo sapiens
gccttaataaata

SEQ ID NO: 2996987 - DNA, 16 bp, Homo sapiens
gccttacagttatcct

SEQ ID NO: 2996988 - DNA, 20 bp, Homo sapiens
gccttacagttatcctgcaa

SEQ ID NO: 2996989 - DNA, 13 bp, Homo sapiens
gccttacccctgc

SEQ ID NO: 2996990 - DNA, 16 bp, Homo sapiens
gccttacctcctgccc

SEQ ID NO: 2996991 - DNA, 21 bp, Homo sapiens
gccttacctcctgcccaggag

SEQ ID NO: 2996992 - DNA, 22 bp, Homo sapiens
gccttacctcctgcccaggaga

SEQ ID NO: 2996993 - DNA, 16 bp, Homo sapiens
gccttagcatgtgact

SEQ ID NO: 2996994 - DNA, 21 bp, Homo sapiens
gccttagccgcccatgcactg

SEQ ID NO: 2996995 - DNA, 14 bp, Homo sapiens
gccttagcttcagg

SEQ ID NO: 2996996 - DNA, 16 bp, Homo sapiens
gccttagcttcaggaa

SEQ ID NO: 2996997 - DNA, 17 bp, Homo sapiens
gccttagcttcaggaac

SEQ ID NO: 2996998 - DNA, 14 bp, Homo sapiens
gccttaggaatact

SEQ ID NO: 2996999 - DNA, 23 bp, Homo sapiens
gccttatctccaagaccagagat

SEQ ID NO: 2997000 - DNA, 18 bp, Homo sapiens
gccttatgagaacatggt

SEQ ID NO: 2997001 - DNA, 19 bp, Homo sapiens
gccttattagagtgtcttt

SEQ ID NO: 2997002 - DNA, 22 bp, Homo sapiens
gccttattggaaagcagtcccc

SEQ ID NO: 2997003 - DNA, 14 bp, Homo sapiens
gccttcactgtgct

SEQ ID NO: 2997004 - DNA, 19 bp, Homo sapiens
gccttcagcagcagctcac

SEQ ID NO: 2997005 - DNA, 20 bp, Homo sapiens
gccttcagcagcagctcaca

SEQ ID NO: 2997006 - DNA, 13 bp, Homo sapiens
gccttcattacct

SEQ ID NO: 2997007 - DNA, 16 bp, Homo sapiens
gccttcattctgcaag

SEQ ID NO: 2997008 - DNA, 19 bp, Homo sapiens
gccttccacgtcttcctcc

SEQ ID NO: 2997009 - DNA, 17 bp, Homo sapiens
gccttccagcccagacc

SEQ ID NO: 2997010 - DNA, 24 bp, Homo sapiens
gccttccctcactcttcctcatcc

SEQ ID NO: 2997011 - DNA, 15 bp, Homo sapiens
gccttcctaagcctg

SEQ ID NO: 2997012 - DNA, 16 bp, Homo sapiens
gccttcctgcagtctc

SEQ ID NO: 2997013 - DNA, 13 bp, Homo sapiens
gccttcgatttta

SEQ ID NO: 2997014 - DNA, 19 bp, Homo sapiens
gccttcggacaactcagtc

SEQ ID NO: 2997015 - DNA, 14 bp, Homo sapiens
gccttcgtttatat

SEQ ID NO: 2997016 - DNA, 15 bp, Homo sapiens
gccttctcaccagct

SEQ ID NO: 2997017 - DNA, 18 bp, Homo sapiens
gccttctcaccagctgca

SEQ ID NO: 2997018 - DNA, 23 bp, Homo sapiens
gccttctcaccagctgcaaagtg

SEQ ID NO: 2997019 - DNA, 16 bp, Homo sapiens
gccttctccctgggaa

SEQ ID NO: 2997020 - DNA, 16 bp, Homo sapiens
gccttctctcagctcc

SEQ ID NO: 2997021 - DNA, 19 bp, Homo sapiens
gccttctgaggacattcca

SEQ ID NO: 2997022 - DNA, 22 bp, Homo sapiens
gccttctgggaagggagagggc

SEQ ID NO: 2997023 - DNA, 20 bp, Homo sapiens
gccttcttattctcactcca

SEQ ID NO: 2997024 - DNA, 21 bp, Homo sapiens
gccttcttattctcactccac

SEQ ID NO: 2997025 - DNA, 23 bp, Homo sapiens
gcctccgatgcctggcctgccag

SEQ ID NO: 2997026 - DNA, 20 bp, Homo sapiens
gcctcctacagcccacctgg

SEQ ID NO: 2997027 - DNA, 22 bp, Homo sapiens
gcctcctcacccaccctgtggc

SEQ ID NO: 2997028 - DNA, 23 bp, Homo sapiens
gcctcctcacccaccctgtggct

SEQ ID NO: 2997029 - DNA, 18 bp, Homo sapiens
gcctcctccctggctgca

SEQ ID NO: 2997030 - DNA, 23 bp, Homo sapiens
gcctcctccctggctgcagcctc

SEQ ID NO: 2997031 - DNA, 13 bp, Homo sapiens
gcctcctctctcc

SEQ ID NO: 2997032 - DNA, 16 bp, Homo sapiens
gcctcctctctccctg

SEQ ID NO: 2997033 - DNA, 14 bp, Homo sapiens
gcctcctgctctgc

SEQ ID NO: 2997034 - DNA, 17 bp, Homo sapiens
gcctcctggctcaggcc

SEQ ID NO: 2997035 - DNA, 15 bp, Homo sapiens
gcctccttcttccac

SEQ ID NO: 2997036 - DNA, 22 bp, Homo sapiens
gcctccttcttccacttctcca

SEQ ID NO: 2997037 - DNA, 15 bp, Homo sapiens
gcctcgaggtgcctt

SEQ ID NO: 2997038 - DNA, 19 bp, Homo sapiens
gcctcgaggtgccttcttc

SEQ ID NO: 2997039 - DNA, 14 bp, Homo sapiens
gcctcgcacaggcc

SEQ ID NO: 2997040 - DNA, 17 bp, Homo sapiens
gcctcgcacttgcagag

SEQ ID NO: 2997041 - DNA, 13 bp, Homo sapiens
gcctcgcctgccc

SEQ ID NO: 2997042 - DNA, 14 bp, Homo sapiens
gcctcgcctgccct

SEQ ID NO: 2997043 - DNA, 16 bp, Homo sapiens
gcctcgcctgccctcc

SEQ ID NO: 2997044 - DNA, 18 bp, Homo sapiens
gcctcgcctgccctcctc

SEQ ID NO: 2997045 - DNA, 17 bp, Homo sapiens
gcctcgccttgtgttac

SEQ ID NO: 2997046 - DNA, 19 bp, Homo sapiens
gcctcgctctgttacccag

SEQ ID NO: 2997047 - DNA, 20 bp, Homo sapiens
gcctcgctctgttacccagg

SEQ ID NO: 2997048 - DNA, 14 bp, Homo sapiens
gcctcggaggctcc

SEQ ID NO: 2997049 - DNA, 16 bp, Homo sapiens
gcctcggaggctcctc

SEQ ID NO: 2997050 - DNA, 17 bp, Homo sapiens
gcctcggaggctcctcc

SEQ ID NO: 2997051 - DNA, 22 bp, Homo sapiens
gcctcggaggctcctccctctg

SEQ ID NO: 2997052 - DNA, 21 bp, Homo sapiens
gcctcggcagaactctctgtc

SEQ ID NO: 2997053 - DNA, 22 bp, Homo sapiens
gcctcggcagaactctctgtct

SEQ ID NO: 2997054 - DNA, 18 bp, Homo sapiens
gcctcggcccctcccaca

SEQ ID NO: 2997055 - DNA, 17 bp, Homo sapiens
gcctcggcctcccaaag

SEQ ID NO: 2997056 - DNA, 19 bp, Homo sapiens
gcctcggcttttctcagct

SEQ ID NO: 2997057 - DNA, 14 bp, Homo sapiens
gcctcggtggccct

SEQ ID NO: 2997058 - DNA, 12 bp, Homo sapiens
gcctcgtgccag

SEQ ID NO: 2997059 - DNA, 13 bp, Homo sapiens
gcctcgtgccagc

SEQ ID NO: 2997060 - DNA, 18 bp, Homo sapiens
gcctcgtgccagcagcct

SEQ ID NO: 2997061 - DNA, 22 bp, Homo sapiens
gcctcgtgccagcagcctcgca

SEQ ID NO: 2997062 - DNA, 14 bp, Homo sapiens
gcctctaactccct

SEQ ID NO: 2997063 - DNA, 24 bp, Homo sapiens
gcctctccactcatgtgactcttt

SEQ ID NO: 2997064 - DNA, 22 bp, Homo sapiens
gcctctcctccttgggcagggt

SEQ ID NO: 2997065 - DNA, 15 bp, Homo sapiens
gcctctcctttgtat

SEQ ID NO: 2997066 - DNA, 23 bp, Homo sapiens
gcctctcctttgtatattatttc

SEQ ID NO: 2997067 - DNA, 18 bp, Homo sapiens
gcctctcggttgaaacct

SEQ ID NO: 2997068 - DNA, 20 bp, Homo sapiens
gcctctgacagcagcctgtg

SEQ ID NO: 2997069 - DNA, 14 bp, Homo sapiens
gcctctgagcttct

SEQ ID NO: 2997070 - DNA, 17 bp, Homo sapiens
gcctctgcaactgctca

SEQ ID NO: 2997071 - DNA, 22 bp, Homo sapiens
gcctctgcaactgctcagctct

SEQ ID NO: 2997072 - DNA, 20 bp, Homo sapiens
gcctctgcagtcgcttgcca

SEQ ID NO: 2997073 - DNA, 22 bp, Homo sapiens
gcctctgcagtcgcttgccaaa

SEQ ID NO: 2997074 - DNA, 13 bp, Homo sapiens
gcctctgcctggg

SEQ ID NO: 2997075 - DNA, 17 bp, Homo sapiens
gcctctgtctagcatgc

SEQ ID NO: 2997076 - DNA, 18 bp, Homo sapiens
gcctctgtcttctggact

SEQ ID NO: 2997077 - DNA, 12 bp, Homo sapiens
gcctctgtgcct

SEQ ID NO: 2997078 - DNA, 20 bp, Homo sapiens
gcctcttacggtagttagga

SEQ ID NO: 2997079 - DNA, 15 bp, Homo sapiens
gcctcttacttgcca

SEQ ID NO: 2997080 - DNA, 15 bp, Homo sapiens
gcctcttctgggagg

SEQ ID NO: 2997081 - DNA, 14 bp, Homo sapiens
gcctcttggcacct

SEQ ID NO: 2997082 - DNA, 21 bp, Homo sapiens
gcctcttggcacctgcctagc

SEQ ID NO: 2997083 - DNA, 23 bp, Homo sapiens
gcctcttggcacctgcctagctc

SEQ ID NO: 2997084 - DNA, 20 bp, Homo sapiens
gcctgaaacccatttactta

SEQ ID NO: 2997085 - DNA, 14 bp, Homo sapiens
gcctgaacagatgt

SEQ ID NO: 2997086 - DNA, 14 bp, Homo sapiens
gcctgaagacccca

SEQ ID NO: 2997087 - DNA, 16 bp, Homo sapiens
gcctgaagaccccaga

SEQ ID NO: 2997088 - DNA, 20 bp, Homo sapiens
gcctgaagagtcctctgaat

SEQ ID NO: 2997089 - DNA, 22 bp, Homo sapiens
gcctgaaggggcgtctgttccc

SEQ ID NO: 2997090 - DNA, 11 bp, Homo sapiens
gcctgaataaa

SEQ ID NO: 2997091 - DNA, 20 bp, Homo sapiens
gcctgaataaaccaagacaa

SEQ ID NO: 2997092 - DNA, 16 bp, Homo sapiens
gcctgacaagtgaagt

SEQ ID NO: 2997093 - DNA, 17 bp, Homo sapiens
gcctgacctccagtcct

SEQ ID NO: 2997094 - DNA, 22 bp, Homo sapiens
gcctgacctccagtcctgctgg

SEQ ID NO: 2997095 - DNA, 20 bp, Homo sapiens
gcctgactagggagccatgt

SEQ ID NO: 2997096 - DNA, 15 bp, Homo sapiens
gcctgagaaacacta

SEQ ID NO: 2997097 - DNA, 23 bp, Homo sapiens
gcctgagaaacactatttgtgac

SEQ ID NO: 2997098 - DNA, 16 bp, Homo sapiens
gcctgagacccaggac

SEQ ID NO: 2997099 - DNA, 17 bp, Homo sapiens
gcctgagacccaggact

SEQ ID NO: 2997100 - DNA, 12 bp, Homo sapiens
gcctgagcccct

SEQ ID NO: 2997101 - DNA, 14 bp, Homo sapiens
gcctgagcctggcc

SEQ ID NO: 2997102 - DNA, 17 bp, Homo sapiens
gcctgagcctggccagc

SEQ ID NO: 2997103 - DNA, 15 bp, Homo sapiens
gcctgaggcaggaga

SEQ ID NO: 2997104 - DNA, 17 bp, Homo sapiens
gcctgaggcaggagaat

SEQ ID NO: 2997105 - DNA, 13 bp, Homo sapiens
gcctgagtcacct

SEQ ID NO: 2997106 - DNA, 17 bp, Homo sapiens
gcctgagtgacagagcg

SEQ ID NO: 2997107 - DNA, 20 bp, Homo sapiens
gcctgatcaggcttcctggt

SEQ ID NO: 2997108 - DNA, 16 bp, Homo sapiens
gcctgatcctccaaca

SEQ ID NO: 2997109 - DNA, 20 bp, Homo sapiens
gcctgatgagatttttaaaa

SEQ ID NO: 2997110 - DNA, 16 bp, Homo sapiens
gcctgcaaacgctgcc

SEQ ID NO: 2997111 - DNA, 21 bp, Homo sapiens
gcctgcaaacgctgcctgccc

SEQ ID NO: 2997112 - DNA, 20 bp, Homo sapiens
gcctgcaccgacccgaggcc

SEQ ID NO: 2997113 - DNA, 21 bp, Homo sapiens
gcctgcaccgacccgaggccc

SEQ ID NO: 2997114 - DNA, 16 bp, Homo sapiens
gcctgcactccctggc

SEQ ID NO: 2997115 - DNA, 22 bp, Homo sapiens
gcctgcactccctggccttgcc

SEQ ID NO: 2997116 - DNA, 16 bp, Homo sapiens
gcctgcagaatttggg

SEQ ID NO: 2997117 - DNA, 18 bp, Homo sapiens
gcctgcaggacctgcctg

SEQ ID NO: 2997118 - DNA, 20 bp, Homo sapiens
gcctgcaggacctgcctgta

SEQ ID NO: 2997119 - DNA, 12 bp, Homo sapiens
gcctgcagggaa

SEQ ID NO: 2997120 - DNA, 22 bp, Homo sapiens
gcctgcagggaagccccacatg

SEQ ID NO: 2997121 - DNA, 14 bp, Homo sapiens
gcctgcagggccat

SEQ ID NO: 2997122 - DNA, 12 bp, Homo sapiens
gcctgccagcag

SEQ ID NO: 2997123 - DNA, 15 bp, Homo sapiens
gcctgccagctgcac

SEQ ID NO: 2997124 - DNA, 15 bp, Homo sapiens
gcctgccatcttctc

SEQ ID NO: 2997125 - DNA, 16 bp, Homo sapiens
gcctgcccctcccaga

SEQ ID NO: 2997126 - DNA, 15 bp, Homo sapiens
gcctgccctcccgca

SEQ ID NO: 2997127 - DNA, 22 bp, Homo sapiens
gcctgccctcccgcaccttcct

SEQ ID NO: 2997128 - DNA, 22 bp, Homo sapiens
gcctgccctcctctcccgtctc

SEQ ID NO: 2997129 - DNA, 18 bp, Homo sapiens
gcctgccctctgtctgtc

SEQ ID NO: 2997130 - DNA, 15 bp, Homo sapiens
gcctgccctgcccaa

SEQ ID NO: 2997131 - DNA, 16 bp, Homo sapiens
gcctgccctgcccaag

SEQ ID NO: 2997132 - DNA, 17 bp, Homo sapiens
gcctgccctgcccaagt

SEQ ID NO: 2997133 - DNA, 23 bp, Homo sapiens
gcctgcctcctggctcaggccca

SEQ ID NO: 2997134 - DNA, 14 bp, Homo sapiens
gcctgccttctcag

SEQ ID NO: 2997135 - DNA, 14 bp, Homo sapiens
gcctgcgaccctgg

SEQ ID NO: 2997136 - DNA, 16 bp, Homo sapiens
gcctgcgaccctgggg

SEQ ID NO: 2997137 - DNA, 23 bp, Homo sapiens
gcctgcgaccctgggggcacagg

SEQ ID NO: 2997138 - DNA, 15 bp, Homo sapiens
gcctgcgcctccatc

SEQ ID NO: 2997139 - DNA, 20 bp, Homo sapiens
gcctgcgctcggcaggaagg

SEQ ID NO: 2997140 - DNA, 12 bp, Homo sapiens
gcctgctccaga

SEQ ID NO: 2997141 - DNA, 14 bp, Homo sapiens
gcctgctccagacc

SEQ ID NO: 2997142 - DNA, 16 bp, Homo sapiens
gcctgctccagacctg

SEQ ID NO: 2997143 - DNA, 21 bp, Homo sapiens
gcctgctccagacctgatcct

SEQ ID NO: 2997144 - DNA, 17 bp, Homo sapiens
gccggccctgcccctcc

SEQ ID NO: 2997145 - DNA, 13 bp, Homo sapiens
gccggccctgggg

SEQ ID NO: 2997146 - DNA, 14 bp, Homo sapiens
gccggccctggggc

SEQ ID NO: 2997147 - DNA, 13 bp, Homo sapiens
gccggccctgtgt

SEQ ID NO: 2997148 - DNA, 14 bp, Homo sapiens
gccggccctgtgtg

SEQ ID NO: 2997149 - DNA, 17 bp, Homo sapiens
gccggccctgtgtgcag

SEQ ID NO: 2997150 - DNA, 22 bp, Homo sapiens
gccggctggaaatgctgggctg

SEQ ID NO: 2997151 - DNA, 13 bp, Homo sapiens
gccggctggcctg

SEQ ID NO: 2997152 - DNA, 12 bp, Homo sapiens
gccggctttcag

SEQ ID NO: 2997153 - DNA, 18 bp, Homo sapiens
gccgggagaagccacctt

SEQ ID NO: 2997154 - DNA, 21 bp, Homo sapiens
gccgggcacagtggctcacgc

SEQ ID NO: 2997155 - DNA, 13 bp, Homo sapiens
gccgggcaggcgt

SEQ ID NO: 2997156 - DNA, 23 bp, Homo sapiens
gccgggcaggcgtgactcagcag

SEQ ID NO: 2997157 - DNA, 23 bp, Homo sapiens
gccgggcatggtggcgcaagcct

SEQ ID NO: 2997158 - DNA, 15 bp, Homo sapiens
gccgggcctgtacag

SEQ ID NO: 2997159 - DNA, 22 bp, Homo sapiens
gccggggaagagatccaaagac

SEQ ID NO: 2997160 - DNA, 14 bp, Homo sapiens
gccggggtcctggg

SEQ ID NO: 2997161 - DNA, 19 bp, Homo sapiens
gccggggtcctgggaggct

SEQ ID NO: 2997162 - DNA, 14 bp, Homo sapiens
gccgggtctgcctc

SEQ ID NO: 2997163 - DNA, 22 bp, Homo sapiens
gccggttctgctagagcagaca

SEQ ID NO: 2997164 - DNA, 13 bp, Homo sapiens
gccgtcagccatc

SEQ ID NO: 2997165 - DNA, 17 bp, Homo sapiens
gccgtcagtgctgtgct

SEQ ID NO: 2997166 - DNA, 11 bp, Homo sapiens
gccgtctgtcc

SEQ ID NO: 2997167 - DNA, 14 bp, Homo sapiens
gccgtcttctgccc

SEQ ID NO: 2997168 - DNA, 14 bp, Homo sapiens
gccgtgccctgccc

SEQ ID NO: 2997169 - DNA, 16 bp, Homo sapiens
gccgtggtcctttggg

SEQ ID NO: 2997170 - DNA, 22 bp, Homo sapiens
gccgtgtgtctcgtctcctgac

SEQ ID NO: 2997171 - DNA, 18 bp, Homo sapiens
gccgttactctccaacct

SEQ ID NO: 2997172 - DNA, 14 bp, Homo sapiens
gccgttcagcctgt

SEQ ID NO: 2997173 - DNA, 23 bp, Homo sapiens
gccgtttgagaagaaaacatcta

SEQ ID NO: 2997174 - DNA, 15 bp, Homo sapiens
gcctaaacctcagtt

SEQ ID NO: 2997175 - DNA, 18 bp, Homo sapiens
gcctaaatttattaaata

SEQ ID NO: 2997176 - DNA, 14 bp, Homo sapiens
gcctaatccctggg

SEQ ID NO: 2997177 - DNA, 16 bp, Homo sapiens
gcctaatccctgggca

SEQ ID NO: 2997178 - DNA, 22 bp, Homo sapiens
gcctaatccctgggcattgctt

SEQ ID NO: 2997179 - DNA, 23 bp, Homo sapiens
gcctaatccctgggcattgcttt

SEQ ID NO: 2997180 - DNA, 22 bp, Homo sapiens
gcctacagctttgatccctgac

SEQ ID NO: 2997181 - DNA, 23 bp, Homo sapiens
gcctacagctttgatccctgaca

SEQ ID NO: 2997182 - DNA, 16 bp, Homo sapiens
gcctacctcagcctcc

SEQ ID NO: 2997183 - DNA, 19 bp, Homo sapiens
gcctactcgcttgctagaa

SEQ ID NO: 2997184 - DNA, 20 bp, Homo sapiens
gcctactgagtagctttcat

SEQ ID NO: 2997185 - DNA, 18 bp, Homo sapiens
gcctagaatctttattca

SEQ ID NO: 2997186 - DNA, 16 bp, Homo sapiens
gcctagagcactctca

SEQ ID NO: 2997187 - DNA, 16 bp, Homo sapiens
gcctagagcgcggctg

SEQ ID NO: 2997188 - DNA, 17 bp, Homo sapiens
gcctagctcttgggcct

SEQ ID NO: 2997189 - DNA, 18 bp, Homo sapiens
gcctagctcttgggcctg

SEQ ID NO: 2997190 - DNA, 23 bp, Homo sapiens
gcctagctgctacaaagaagaca

SEQ ID NO: 2997191 - DNA, 24 bp, Homo sapiens
gcctagctgctacaaagaagacat

SEQ ID NO: 2997192 - DNA, 15 bp, Homo sapiens
gcctaggaggactgg

SEQ ID NO: 2997193 - DNA, 12 bp, Homo sapiens
gcctaggattct

SEQ ID NO: 2997194 - DNA, 16 bp, Homo sapiens
gcctaggattctaaaa

SEQ ID NO: 2997195 - DNA, 15 bp, Homo sapiens
gcctaggatttcagc

SEQ ID NO: 2997196 - DNA, 20 bp, Homo sapiens
gcctaggatttcagccatgc

SEQ ID NO: 2997197 - DNA, 17 bp, Homo sapiens
gcctaggcctcagccag

SEQ ID NO: 2997198 - DNA, 20 bp, Homo sapiens
gcctaggcctcagccagaga

SEQ ID NO: 2997199 - DNA, 21 bp, Homo sapiens
gcctaggctaggacgttggcc

SEQ ID NO: 2997200 - DNA, 16 bp, Homo sapiens
gcctaggtgcagctcc

SEQ ID NO: 2997201 - DNA, 17 bp, Homo sapiens
gcctataaaatgcccat

SEQ ID NO: 2997202 - DNA, 24 bp, Homo sapiens
gcctataaatttactctgttgaat

SEQ ID NO: 2997203 - DNA, 17 bp, Homo sapiens
gcctataatcccagcta

SEQ ID NO: 2997204 - DNA, 18 bp, Homo sapiens
gcctataatcccagctac

SEQ ID NO: 2997205 - DNA, 19 bp, Homo sapiens
gcctataatcccagctact

SEQ ID NO: 2997206 - DNA, 14 bp, Homo sapiens
gcctatgcacatat

SEQ ID NO: 2997207 - DNA, 14 bp, Homo sapiens
gcctcaaaaacagt

SEQ ID NO: 2997208 - DNA, 20 bp, Homo sapiens
gcctcaactccaccctctgc

SEQ ID NO: 2997209 - DNA, 21 bp, Homo sapiens
gcctcaaggttttaggttcta

SEQ ID NO: 2997210 - DNA, 15 bp, Homo sapiens
gcctcaagtgagcca

SEQ ID NO: 2997211 - DNA, 21 bp, Homo sapiens
gcctcaatgtgaatcagaccc

SEQ ID NO: 2997212 - DNA, 22 bp, Homo sapiens
gcctcaatgtgaatcagaccct

SEQ ID NO: 2997213 - DNA, 22 bp, Homo sapiens
gcctcaatttctgaacaccata

SEQ ID NO: 2997214 - DNA, 15 bp, Homo sapiens
gcctcacagaagaat

SEQ ID NO: 2997215 - DNA, 16 bp, Homo sapiens
gcctcacagaagaata

SEQ ID NO: 2997216 - DNA, 20 bp, Homo sapiens
gcctcacagatgctggcctc

SEQ ID NO: 2997217 - DNA, 23 bp, Homo sapiens
gcctcacagatgctggcctcttg

SEQ ID NO: 2997218 - DNA, 15 bp, Homo sapiens
gcctcacatctccct

SEQ ID NO: 2997219 - DNA, 17 bp, Homo sapiens
gcctcacatctcccttc

SEQ ID NO: 2997220 - DNA, 21 bp, Homo sapiens
gcctcacgtatttcacagagc

SEQ ID NO: 2997221 - DNA, 22 bp, Homo sapiens
gcctcacgtatttcacagagca

SEQ ID NO: 2997222 - DNA, 17 bp, Homo sapiens
gcctcactcagctctga

SEQ ID NO: 2997223 - DNA, 17 bp, Homo sapiens
gcctcactggctcatgc

SEQ ID NO: 2997224 - DNA, 19 bp, Homo sapiens
gcctcactggctcatgccc

SEQ ID NO: 2997225 - DNA, 22 bp, Homo sapiens
gcctcacttggtctgccaggcc

SEQ ID NO: 2997226 - DNA, 15 bp, Homo sapiens
gcctcagactgcacc

SEQ ID NO: 2997227 - DNA, 21 bp, Homo sapiens
gcctcagactgcacccaggag

SEQ ID NO: 2997228 - DNA, 13 bp, Homo sapiens
gcctcagccagag

SEQ ID NO: 2997229 - DNA, 14 bp, Homo sapiens
gcctcagccagaga

SEQ ID NO: 2997230 - DNA, 16 bp, Homo sapiens
gcctcagccagagaag

SEQ ID NO: 2997231 - DNA, 16 bp, Homo sapiens
gcctcagcctcccgag

SEQ ID NO: 2997232 - DNA, 12 bp, Homo sapiens
gcctcagccttc

SEQ ID NO: 2997233 - DNA, 18 bp, Homo sapiens
gcctcagctcagcttcgt

SEQ ID NO: 2997234 - DNA, 21 bp, Homo sapiens
gcctcagctgcatctgataaa

SEQ ID NO: 2997235 - DNA, 12 bp, Homo sapiens
gcctcaggctgc

SEQ ID NO: 2997236 - DNA, 20 bp, Homo sapiens
gcctcagtggctctgggtac

SEQ ID NO: 2997237 - DNA, 16 bp, Homo sapiens
gcctcatcctcctcct

SEQ ID NO: 2997238 - DNA, 19 bp, Homo sapiens
gcctcatcctcctcctcat

SEQ ID NO: 2997239 - DNA, 14 bp, Homo sapiens
gcctcatgctctga

SEQ ID NO: 2997240 - DNA, 21 bp, Homo sapiens
gcctcatttagagaggaaaag

SEQ ID NO: 2997241 - DNA, 19 bp, Homo sapiens
gcctccaagtcaggtgggg

SEQ ID NO: 2997242 - DNA, 21 bp, Homo sapiens
gcctccacactgaccaagtgc

SEQ ID NO: 2997243 - DNA, 18 bp, Homo sapiens
gcctccaccatccccgca

SEQ ID NO: 2997244 - DNA, 12 bp, Homo sapiens
gcctccagaact

SEQ ID NO: 2997245 - DNA, 12 bp, Homo sapiens
gcctccagctgt

SEQ ID NO: 2997246 - DNA, 14 bp, Homo sapiens
gcctccaggcccgt

SEQ ID NO: 2997247 - DNA, 20 bp, Homo sapiens
gcctccaggcccgtctgtcc

SEQ ID NO: 2997248 - DNA, 21 bp, Homo sapiens
gcctccaggcccgtctgtcca

SEQ ID NO: 2997249 - DNA, 15 bp, Homo sapiens
gcctccagtgcagtc

SEQ ID NO: 2997250 - DNA, 20 bp, Homo sapiens
gcctccatccatctgtccgt

SEQ ID NO: 2997251 - DNA, 17 bp, Homo sapiens
gcctcccaaagtgctgg

SEQ ID NO: 2997252 - DNA, 19 bp, Homo sapiens
gcctcccaaagtgctggga

SEQ ID NO: 2997253 - DNA, 16 bp, Homo sapiens
gccctgcccctcccta

SEQ ID NO: 2997254 - DNA, 22 bp, Homo sapiens
gccctgcccctccctagatcca

SEQ ID NO: 2997255 - DNA, 21 bp, Homo sapiens
gccctgccgtggtggcagctg

SEQ ID NO: 2997256 - DNA, 11 bp, Homo sapiens
gccctgcctct

SEQ ID NO: 2997257 - DNA, 13 bp, Homo sapiens
gccctgcgggcca

SEQ ID NO: 2997258 - DNA, 18 bp, Homo sapiens
gccctgcggtagatggga

SEQ ID NO: 2997259 - DNA, 19 bp, Homo sapiens
gccctgctatttcaggccc

SEQ ID NO: 2997260 - DNA, 23 bp, Homo sapiens
gccctgctatttcaggccctcag

SEQ ID NO: 2997261 - DNA, 20 bp, Homo sapiens
gccctgctgcccctccctgc

SEQ ID NO: 2997262 - DNA, 21 bp, Homo sapiens
gccctgctgcccctccctgcc

SEQ ID NO: 2997263 - DNA, 17 bp, Homo sapiens
gccctgctgcttcctaa

SEQ ID NO: 2997264 - DNA, 15 bp, Homo sapiens
gccctggagggcaga

SEQ ID NO: 2997265 - DNA, 17 bp, Homo sapiens
gccctggagggcagaga

SEQ ID NO: 2997266 - DNA, 18 bp, Homo sapiens
gccctggagggcagagac

SEQ ID NO: 2997267 - DNA, 14 bp, Homo sapiens
gccctggcctgctg

SEQ ID NO: 2997268 - DNA, 14 bp, Homo sapiens
gccctggcgggtgg

SEQ ID NO: 2997269 - DNA, 19 bp, Homo sapiens
gccctggcgggtggctgca

SEQ ID NO: 2997270 - DNA, 18 bp, Homo sapiens
gccctgggaaaccccttc

SEQ ID NO: 2997271 - DNA, 18 bp, Homo sapiens
gccctgggccccaccacc

SEQ ID NO: 2997272 - DNA, 15 bp, Homo sapiens
gccctggggcgggca

SEQ ID NO: 2997273 - DNA, 17 bp, Homo sapiens
gccctggggtgtgtctc

SEQ ID NO: 2997274 - DNA, 14 bp, Homo sapiens
gccctgggtcttgc

SEQ ID NO: 2997275 - DNA, 17 bp, Homo sapiens
gccctggtcctggcctc

SEQ ID NO: 2997276 - DNA, 18 bp, Homo sapiens
gccctggtcctggcctcc

SEQ ID NO: 2997277 - DNA, 16 bp, Homo sapiens
gccctggtgctcctgc

SEQ ID NO: 2997278 - DNA, 23 bp, Homo sapiens
gccctggtggtggctcgggaggc

SEQ ID NO: 2997279 - DNA, 16 bp, Homo sapiens
gccctggttcctgctg

SEQ ID NO: 2997280 - DNA, 20 bp, Homo sapiens
gccctggttcctgctgtcct

SEQ ID NO: 2997281 - DNA, 22 bp, Homo sapiens
gccctggttcctgctgtcctgg

SEQ ID NO: 2997282 - DNA, 18 bp, Homo sapiens
gccctgtccagcccccag

SEQ ID NO: 2997283 - DNA, 21 bp, Homo sapiens
gccctgtccagcccccagtgc

SEQ ID NO: 2997284 - DNA, 20 bp, Homo sapiens
gccctgtcgggctttgtgtg

SEQ ID NO: 2997285 - DNA, 21 bp, Homo sapiens
gccctgtgcaacctcttggcc

SEQ ID NO: 2997286 - DNA, 17 bp, Homo sapiens
gccctgtggacaggatg

SEQ ID NO: 2997287 - DNA, 24 bp, Homo sapiens
gccctgtggacaggatgaggacag

SEQ ID NO: 2997288 - DNA, 17 bp, Homo sapiens
gccctgtggagtccagc

SEQ ID NO: 2997289 - DNA, 19 bp, Homo sapiens
gccctgtggagtccagctc

SEQ ID NO: 2997290 - DNA, 21 bp, Homo sapiens
gccctgtggagtccagctcta

SEQ ID NO: 2997291 - DNA, 12 bp, Homo sapiens
gccctgtgtgca

SEQ ID NO: 2997292 - DNA, 13 bp, Homo sapiens
gccctgtgtgcag

SEQ ID NO: 2997293 - DNA, 20 bp, Homo sapiens
gccctgttcagctactccca

SEQ ID NO: 2997294 - DNA, 16 bp, Homo sapiens
gccctgttcttgaggt

SEQ ID NO: 2997295 - DNA, 17 bp, Homo sapiens
gccctgttgtgccacag

SEQ ID NO: 2997296 - DNA, 18 bp, Homo sapiens
gcccttacttcttgccct

SEQ ID NO: 2997297 - DNA, 17 bp, Homo sapiens
gcccttagccttgctgt

SEQ ID NO: 2997298 - DNA, 15 bp, Homo sapiens
gcccttatctgtgct

SEQ ID NO: 2997299 - DNA, 18 bp, Homo sapiens
gcccttcagtccctgagc

SEQ ID NO: 2997300 - DNA, 14 bp, Homo sapiens
gcccttccagtggg

SEQ ID NO: 2997301 - DNA, 17 bp, Homo sapiens
gcccttccagtgggatt

SEQ ID NO: 2997302 - DNA, 23 bp, Homo sapiens
gcccttccgcagtgtggccaggc

SEQ ID NO: 2997303 - DNA, 18 bp, Homo sapiens
gcccttcctcctccacca

SEQ ID NO: 2997304 - DNA, 20 bp, Homo sapiens
gcccttcctcctccaccacc

SEQ ID NO: 2997305 - DNA, 13 bp, Homo sapiens
gcccttcctgacc

SEQ ID NO: 2997306 - DNA, 14 bp, Homo sapiens
gcccttcctgaccc

SEQ ID NO: 2997307 - DNA, 15 bp, Homo sapiens
gcccttccttcccga

SEQ ID NO: 2997308 - DNA, 12 bp, Homo sapiens
gcccttccttgc

SEQ ID NO: 2997309 - DNA, 12 bp, Homo sapiens
gcccttgggcca

SEQ ID NO: 2997310 - DNA, 21 bp, Homo sapiens
gcccttggggtggcgcgcctg

SEQ ID NO: 2997311 - DNA, 22 bp, Homo sapiens
gcccttggtttctgggggctgg

SEQ ID NO: 2997312 - DNA, 24 bp, Homo sapiens
gcccttgtcccactcaagccaagc

SEQ ID NO: 2997313 - DNA, 19 bp, Homo sapiens
gccctttaatatttccaat

SEQ ID NO: 2997314 - DNA, 20 bp, Homo sapiens
gccctttccacgaaatccta

SEQ ID NO: 2997315 - DNA, 15 bp, Homo sapiens
gccctttcctcctca

SEQ ID NO: 2997316 - DNA, 14 bp, Homo sapiens
gccctttcctttgg

SEQ ID NO: 2997317 - DNA, 17 bp, Homo sapiens
gcccttttcctgggcct

SEQ ID NO: 2997318 - DNA, 18 bp, Homo sapiens
gccgaactccaggctggg

SEQ ID NO: 2997319 - DNA, 19 bp, Homo sapiens
gccgaactccaggctgggc

SEQ ID NO: 2997320 - DNA, 15 bp, Homo sapiens
gccgaagctgctgtg

SEQ ID NO: 2997321 - DNA, 18 bp, Homo sapiens
gccgaagctgctgtgact

SEQ ID NO: 2997322 - DNA, 16 bp, Homo sapiens
gccgaagtccagcttt

SEQ ID NO: 2997323 - DNA, 17 bp, Homo sapiens
gccgacaccactcctgc

SEQ ID NO: 2997324 - DNA, 13 bp, Homo sapiens
gccgacagtcggt

SEQ ID NO: 2997325 - DNA, 23 bp, Homo sapiens
gccgacatccctcccccagcaga

SEQ ID NO: 2997326 - DNA, 15 bp, Homo sapiens
gccgaccctgcggcc

SEQ ID NO: 2997327 - DNA, 16 bp, Homo sapiens
gccgaccctgcggcct

SEQ ID NO: 2997328 - DNA, 22 bp, Homo sapiens
gccgaccctgcggcctccacca

SEQ ID NO: 2997329 - DNA, 19 bp, Homo sapiens
gccgacctcgtcctccccc

SEQ ID NO: 2997330 - DNA, 21 bp, Homo sapiens
gccgacctcgtcctccccctg

SEQ ID NO: 2997331 - DNA, 12 bp, Homo sapiens
gccgagagcctg

SEQ ID NO: 2997332 - DNA, 15 bp, Homo sapiens
gccgagagcctgctc

SEQ ID NO: 2997333 - DNA, 16 bp, Homo sapiens
gccgagagcctgctcc

SEQ ID NO: 2997334 - DNA, 21 bp, Homo sapiens
gccgagagtccatcagcctcc

SEQ ID NO: 2997335 - DNA, 13 bp, Homo sapiens
gccgagctggttt

SEQ ID NO: 2997336 - DNA, 13 bp, Homo sapiens
gccgaggtcccat

SEQ ID NO: 2997337 - DNA, 15 bp, Homo sapiens
gccgagtccaagctg

SEQ ID NO: 2997338 - DNA, 17 bp, Homo sapiens
gccgatatactctagat

SEQ ID NO: 2997339 - DNA, 23 bp, Homo sapiens
gccgcaagggcctggacggggtc

SEQ ID NO: 2997340 - DNA, 13 bp, Homo sapiens
gccgcaccccaga

SEQ ID NO: 2997341 - DNA, 23 bp, Homo sapiens
gccgcaccccagagtgtgggaag

SEQ ID NO: 2997342 - DNA, 15 bp, Homo sapiens
gccgcacgcctctcc

SEQ ID NO: 2997343 - DNA, 13 bp, Homo sapiens
gccgcagcggtgg

SEQ ID NO: 2997344 - DNA, 21 bp, Homo sapiens
gccgcaggaaggcagaataaa

SEQ ID NO: 2997345 - DNA, 20 bp, Homo sapiens
gccgcagtggggtcaagctg

SEQ ID NO: 2997346 - DNA, 20 bp, Homo sapiens
gccgcatcttctccatctgg

SEQ ID NO: 2997347 - DNA, 14 bp, Homo sapiens
gccgcattccctga

SEQ ID NO: 2997348 - DNA, 20 bp, Homo sapiens
gccgccatctgcgcagggtg

SEQ ID NO: 2997349 - DNA, 14 bp, Homo sapiens
gccgcccctgaggc

SEQ ID NO: 2997350 - DNA, 13 bp, Homo sapiens
gccgccctgagag

SEQ ID NO: 2997351 - DNA, 14 bp, Homo sapiens
gccgccgcccgctg

SEQ ID NO: 2997352 - DNA, 24 bp, Homo sapiens
gcccctgagtccgcctgcgcctcc

SEQ ID NO: 2997353 - DNA, 20 bp, Homo sapiens
gcccctgcagacgtctggcc

SEQ ID NO: 2997354 - DNA, 16 bp, Homo sapiens
gcccctgccagacccc

SEQ ID NO: 2997355 - DNA, 19 bp, Homo sapiens
gcccctgctgtctctctgg

SEQ ID NO: 2997356 - DNA, 20 bp, Homo sapiens
gcccctgctgtctctctggg

SEQ ID NO: 2997357 - DNA, 18 bp, Homo sapiens
gcccctggcacctgtgtt

SEQ ID NO: 2997358 - DNA, 17 bp, Homo sapiens
gcccctggcactcttgt

SEQ ID NO: 2997359 - DNA, 14 bp, Homo sapiens
gcccctggcccagg

SEQ ID NO: 2997360 - DNA, 15 bp, Homo sapiens
gcccctggcccagga

SEQ ID NO: 2997361 - DNA, 17 bp, Homo sapiens
gcccctggcccaggagg

SEQ ID NO: 2997362 - DNA, 22 bp, Homo sapiens
gcccctggccccgcctgcctgc

SEQ ID NO: 2997363 - DNA, 14 bp, Homo sapiens
gcccctggctggga

SEQ ID NO: 2997364 - DNA, 15 bp, Homo sapiens
gcccctggggtggcc

SEQ ID NO: 2997365 - DNA, 15 bp, Homo sapiens
gcccctgggtttctt

SEQ ID NO: 2997366 - DNA, 17 bp, Homo sapiens
gcccctggtaagcagag

SEQ ID NO: 2997367 - DNA, 19 bp, Homo sapiens
gcccctggtaagcagaggc

SEQ ID NO: 2997368 - DNA, 18 bp, Homo sapiens
gcccctgtctagagaggg

SEQ ID NO: 2997369 - DNA, 15 bp, Homo sapiens
gcccctgtctcgggg

SEQ ID NO: 2997370 - DNA, 15 bp, Homo sapiens
gccccttaggccagt

SEQ ID NO: 2997371 - DNA, 23 bp, Homo sapiens
gccccttcattgatttcctgtgt

SEQ ID NO: 2997372 - DNA, 15 bp, Homo sapiens
gccccttctgctcag

SEQ ID NO: 2997373 - DNA, 18 bp, Homo sapiens
gccccttctgctcagctc

SEQ ID NO: 2997374 - DNA, 17 bp, Homo sapiens
gccccttcttccaagga

SEQ ID NO: 2997375 - DNA, 19 bp, Homo sapiens
gccccttggattactttgt

SEQ ID NO: 2997376 - DNA, 13 bp, Homo sapiens
gcccctttccaaa

SEQ ID NO: 2997377 - DNA, 24 bp, Homo sapiens
gcccgacatggctccggcctctgc

SEQ ID NO: 2997378 - DNA, 22 bp, Homo sapiens
gcccgaggaaggtgtgtggaga

SEQ ID NO: 2997379 - DNA, 18 bp, Homo sapiens
gcccgaggtggctgcctg

SEQ ID NO: 2997380 - DNA, 24 bp, Homo sapiens
gcccgagtgcggcgtggagactgg

SEQ ID NO: 2997381 - DNA, 21 bp, Homo sapiens
gcccgagtggtctcctctcag

SEQ ID NO: 2997382 - DNA, 16 bp, Homo sapiens
gcccgcactgtcccag

SEQ ID NO: 2997383 - DNA, 21 bp, Homo sapiens
gcccgcactgtcccagtagcc

SEQ ID NO: 2997384 - DNA, 18 bp, Homo sapiens
gcccgcagacctctggat

SEQ ID NO: 2997385 - DNA, 17 bp, Homo sapiens
gcccgcagcccagaccc

SEQ ID NO: 2997386 - DNA, 14 bp, Homo sapiens
gcccgcctgcccac

SEQ ID NO: 2997387 - DNA, 16 bp, Homo sapiens
gcccgcctgcccacct

SEQ ID NO: 2997388 - DNA, 23 bp, Homo sapiens
gcccgcctgcccacctgcctggc

SEQ ID NO: 2997389 - DNA, 20 bp, Homo sapiens
gcccgcggcctgcaccgacc

SEQ ID NO: 2997390 - DNA, 19 bp, Homo sapiens
gcccgcgggcacagccagc

SEQ ID NO: 2997391 - DNA, 18 bp, Homo sapiens
gcccgcggggacattggg

SEQ ID NO: 2997392 - DNA, 17 bp, Homo sapiens
gcccggcagggcgggca

SEQ ID NO: 2997393 - DNA, 20 bp, Homo sapiens
gcccggcccacacccgacac

SEQ ID NO: 2997394 - DNA, 22 bp, Homo sapiens
gcccggccccgagagcaggctc

SEQ ID NO: 2997395 - DNA, 15 bp, Homo sapiens
gcccggcccctcacc

SEQ ID NO: 2997396 - DNA, 17 bp, Homo sapiens
gcccggcccctcaccct

SEQ ID NO: 2997397 - DNA, 19 bp, Homo sapiens
gcccggcccctcaccctct

SEQ ID NO: 2997398 - DNA, 14 bp, Homo sapiens
gcccggcgcctgcc

SEQ ID NO: 2997399 - DNA, 15 bp, Homo sapiens
gcccggcgcctgccc

SEQ ID NO: 2997400 - DNA, 16 bp, Homo sapiens
gcccggcgcctgccct

SEQ ID NO: 2997401 - DNA, 17 bp, Homo sapiens
gcccggcgcctgccctg

SEQ ID NO: 2997402 - DNA, 18 bp, Homo sapiens
gcccggcgcctgccctgc

SEQ ID NO: 2997403 - DNA, 20 bp, Homo sapiens
gcccggcgcctggcctccag

SEQ ID NO: 2997404 - DNA, 20 bp, Homo sapiens
gcccggcggggaccttggtc

SEQ ID NO: 2997405 - DNA, 22 bp, Homo sapiens
gcccggcggggaccttggtctg

SEQ ID NO: 2997406 - DNA, 18 bp, Homo sapiens
gcccggctaatttttgta

SEQ ID NO: 2997407 - DNA, 17 bp, Homo sapiens
gcccgggagctcaggaa

SEQ ID NO: 2997408 - DNA, 18 bp, Homo sapiens
gcccgggccgaccctgcg

SEQ ID NO: 2997409 - DNA, 16 bp, Homo sapiens
gcccggtggcggcagg

SEQ ID NO: 2997410 - DNA, 23 bp, Homo sapiens
gcccggtggcggcagggccaggc

SEQ ID NO: 2997411 - DNA, 15 bp, Homo sapiens
gcccggtgggtccgc

SEQ ID NO: 2997412 - DNA, 17 bp, Homo sapiens
gcccgtaaacacgcctg

SEQ ID NO: 2997413 - DNA, 16 bp, Homo sapiens
gcccgtaatcccagct

SEQ ID NO: 2997414 - DNA, 23 bp, Homo sapiens
gcccgtcggagctgcctgcagca

SEQ ID NO: 2997415 - DNA, 19 bp, Homo sapiens
gcccgtctgtccatctgcc

SEQ ID NO: 2997416 - DNA, 23 bp, Homo sapiens
gcccgtctgtgtgtgacccctcc

SEQ ID NO: 2997417 - DNA, 19 bp, Homo sapiens
gcccgtgacagactcctga

SEQ ID NO: 2997418 - DNA, 21 bp, Homo sapiens
gcccgtgccacccccagccct

SEQ ID NO: 2997419 - DNA, 18 bp, Homo sapiens
gcccgtggcttggcatct

SEQ ID NO: 2997420 - DNA, 22 bp, Homo sapiens
gcccgtggcttggcatctgtgt

SEQ ID NO: 2997421 - DNA, 19 bp, Homo sapiens
gcccgtgtacatagtgcat

SEQ ID NO: 2997422 - DNA, 19 bp, Homo sapiens
gccctaattcatcttttaa

SEQ ID NO: 2997423 - DNA, 22 bp, Homo sapiens
gccctagtatgaaagctggggg

SEQ ID NO: 2997424 - DNA, 11 bp, Homo sapiens
gccctatctgt

SEQ ID NO: 2997425 - DNA, 16 bp, Homo sapiens
gccctatgtctcagga

SEQ ID NO: 2997426 - DNA, 18 bp, Homo sapiens
gccctcaagtaaaagaaa

SEQ ID NO: 2997427 - DNA, 21 bp, Homo sapiens
gccctcactcttgaagtccag

SEQ ID NO: 2997428 - DNA, 14 bp, Homo sapiens
gccctcccaccacc

SEQ ID NO: 2997429 - DNA, 16 bp, Homo sapiens
gccctcccaccacccc

SEQ ID NO: 2997430 - DNA, 23 bp, Homo sapiens
gccctcccactttgctgttcctt

SEQ ID NO: 2997431 - DNA, 18 bp, Homo sapiens
gccctccccatggagcca

SEQ ID NO: 2997432 - DNA, 15 bp, Homo sapiens
gccctcccctctctg

SEQ ID NO: 2997433 - DNA, 13 bp, Homo sapiens
gccctccctgcgc

SEQ ID NO: 2997434 - DNA, 21 bp, Homo sapiens
gccctccctgtcctcctcgga

SEQ ID NO: 2997435 - DNA, 21 bp, Homo sapiens
gccctccctgttccccagaga

SEQ ID NO: 2997436 - DNA, 18 bp, Homo sapiens
gccctcctaccctgcgcc

SEQ ID NO: 2997437 - DNA, 19 bp, Homo sapiens
gccctcctaccctgcgccc

SEQ ID NO: 2997438 - DNA, 21 bp, Homo sapiens
gccctcctcaccccgtctggg

SEQ ID NO: 2997439 - DNA, 17 bp, Homo sapiens
gccctcctctcccattg

SEQ ID NO: 2997440 - DNA, 20 bp, Homo sapiens
gcccagtgcatggtggccag

SEQ ID NO: 2997441 - DNA, 16 bp, Homo sapiens
gcccagtgggctgcac

SEQ ID NO: 2997442 - DNA, 15 bp, Homo sapiens
gcccatataaaatgc

SEQ ID NO: 2997443 - DNA, 18 bp, Homo sapiens
gcccatcagtgccagccc

SEQ ID NO: 2997444 - DNA, 20 bp, Homo sapiens
gcccatcagtgccagcccct

SEQ ID NO: 2997445 - DNA, 18 bp, Homo sapiens
gcccatcatctctgcctt

SEQ ID NO: 2997446 - DNA, 20 bp, Homo sapiens
gcccatcatctctgcctttg

SEQ ID NO: 2997447 - DNA, 22 bp, Homo sapiens
gcccatcatctctgcctttgag

SEQ ID NO: 2997448 - DNA, 18 bp, Homo sapiens
gcccatccccaggcacct

SEQ ID NO: 2997449 - DNA, 13 bp, Homo sapiens
gcccatccttccc

SEQ ID NO: 2997450 - DNA, 12 bp, Homo sapiens
gcccatctgtcc

SEQ ID NO: 2997451 - DNA, 14 bp, Homo sapiens
gcccatctgtccat

SEQ ID NO: 2997452 - DNA, 19 bp, Homo sapiens
gcccatggacaggctggct

SEQ ID NO: 2997453 - DNA, 20 bp, Homo sapiens
gcccatggacaggctggctc

SEQ ID NO: 2997454 - DNA, 19 bp, Homo sapiens
gcccattctctctcctgtc

SEQ ID NO: 2997455 - DNA, 20 bp, Homo sapiens
gcccattctgccctgtggga

SEQ ID NO: 2997456 - DNA, 18 bp, Homo sapiens
gcccatttcatattcttt

SEQ ID NO: 2997457 - DNA, 15 bp, Homo sapiens
gcccatttcgtgagc

SEQ ID NO: 2997458 - DNA, 15 bp, Homo sapiens
gcccatttctccaga

SEQ ID NO: 2997459 - DNA, 21 bp, Homo sapiens
gccccaactccaacctctcgg

SEQ ID NO: 2997460 - DNA, 17 bp, Homo sapiens
gccccaactcctggaag

SEQ ID NO: 2997461 - DNA, 17 bp, Homo sapiens
gccccacaaggcctggt

SEQ ID NO: 2997462 - DNA, 18 bp, Homo sapiens
gccccacaaggcctggtc

SEQ ID NO: 2997463 - DNA, 23 bp, Homo sapiens
gccccacaggagttgtgagccct

SEQ ID NO: 2997464 - DNA, 15 bp, Homo sapiens
gccccacatgtccag

SEQ ID NO: 2997465 - DNA, 11 bp, Homo sapiens
gccccaccacc

SEQ ID NO: 2997466 - DNA, 13 bp, Homo sapiens
gccccaccaccta

SEQ ID NO: 2997467 - DNA, 15 bp, Homo sapiens
gccccaccacctagg

SEQ ID NO: 2997468 - DNA, 12 bp, Homo sapiens
gccccagactga

SEQ ID NO: 2997469 - DNA, 16 bp, Homo sapiens
gccccagactgagctc

SEQ ID NO: 2997470 - DNA, 16 bp, Homo sapiens
gccccagactgggccc

SEQ ID NO: 2997471 - DNA, 18 bp, Homo sapiens
gccccagactgggcccag

SEQ ID NO: 2997472 - DNA, 19 bp, Homo sapiens
gccccagactgggcccagg

SEQ ID NO: 2997473 - DNA, 22 bp, Homo sapiens
gccccagactgggcccaggcag

SEQ ID NO: 2997474 - DNA, 23 bp, Homo sapiens
gccccagactgggcccaggcagg

SEQ ID NO: 2997475 - DNA, 12 bp, Homo sapiens
gccccagagatg

SEQ ID NO: 2997476 - DNA, 21 bp, Homo sapiens
gccccagcacctcagcctgca

SEQ ID NO: 2997477 - DNA, 11 bp, Homo sapiens
gccccagccag

SEQ ID NO: 2997478 - DNA, 21 bp, Homo sapiens
gccccagcctccctgaagcct

SEQ ID NO: 2997479 - DNA, 14 bp, Homo sapiens
gccccaggaagccg

SEQ ID NO: 2997480 - DNA, 11 bp, Homo sapiens
gccccaggacc

SEQ ID NO: 2997481 - DNA, 16 bp, Homo sapiens
gccccaggaccagctc

SEQ ID NO: 2997482 - DNA, 18 bp, Homo sapiens
gccccaggaccagctcag

SEQ ID NO: 2997483 - DNA, 22 bp, Homo sapiens
gccccaggaccagctcaggaca

SEQ ID NO: 2997484 - DNA, 22 bp, Homo sapiens
gccccaggacctggctgccata

SEQ ID NO: 2997485 - DNA, 14 bp, Homo sapiens
gccccaggccggag

SEQ ID NO: 2997486 - DNA, 21 bp, Homo sapiens
gccccaggccggagcccagat

SEQ ID NO: 2997487 - DNA, 21 bp, Homo sapiens
gccccaggggacgtgggccct

SEQ ID NO: 2997488 - DNA, 17 bp, Homo sapiens
gccccatcctccagcag

SEQ ID NO: 2997489 - DNA, 15 bp, Homo sapiens
gccccatcttcaccc

SEQ ID NO: 2997490 - DNA, 16 bp, Homo sapiens
gccccatcttcaccca

SEQ ID NO: 2997491 - DNA, 22 bp, Homo sapiens
gccccattcttttgtaatttaa

SEQ ID NO: 2997492 - DNA, 13 bp, Homo sapiens
gcccccaccacac

SEQ ID NO: 2997493 - DNA, 16 bp, Homo sapiens
gcccccaccacacatc

SEQ ID NO: 2997494 - DNA, 17 bp, Homo sapiens
gcccccaccacacatcc

SEQ ID NO: 2997495 - DNA, 14 bp, Homo sapiens
gcccccaccccagc

SEQ ID NO: 2997496 - DNA, 21 bp, Homo sapiens
gcccccaccgccggggtcctg

SEQ ID NO: 2997497 - DNA, 18 bp, Homo sapiens
gcccccaccgggctgcag

SEQ ID NO: 2997498 - DNA, 16 bp, Homo sapiens
gcccccagcccagagc

SEQ ID NO: 2997499 - DNA, 15 bp, Homo sapiens
gcccccagctaagaa

SEQ ID NO: 2997500 - DNA, 21 bp, Homo sapiens
gcccccagctaagaacctgga

SEQ ID NO: 2997501 - DNA, 22 bp, Homo sapiens
gcccccagctaagaacctggaa

SEQ ID NO: 2997502 - DNA, 13 bp, Homo sapiens
gcccccagctggc

SEQ ID NO: 2997503 - DNA, 21 bp, Homo sapiens
gcccccaggcctgccctgcta

SEQ ID NO: 2997504 - DNA, 13 bp, Homo sapiens
gcccccatctcat

SEQ ID NO: 2997505 - DNA, 17 bp, Homo sapiens
gcccccatttcacccat

SEQ ID NO: 2997506 - DNA, 11 bp, Homo sapiens
gccccccaggg

SEQ ID NO: 2997507 - DNA, 15 bp, Homo sapiens
gccccccagggctag

SEQ ID NO: 2997508 - DNA, 14 bp, Homo sapiens
gcccccccttccac

SEQ ID NO: 2997509 - DNA, 15 bp, Homo sapiens
gcccccccttccact

SEQ ID NO: 2997510 - DNA, 15 bp, Homo sapiens
gcccccctcccagag

SEQ ID NO: 2997511 - DNA, 16 bp, Homo sapiens
gcccccctcccagagg

SEQ ID NO: 2997512 - DNA, 17 bp, Homo sapiens
gcccccctcccagaggc

SEQ ID NO: 2997513 - DNA, 15 bp, Homo sapiens
gcccccctgccctgt

SEQ ID NO: 2997514 - DNA, 19 bp, Homo sapiens
gcccccgcccgcacagctc

SEQ ID NO: 2997515 - DNA, 13 bp, Homo sapiens
gcccccgcgccct

SEQ ID NO: 2997516 - DNA, 19 bp, Homo sapiens
gcccccgtcacgtgcgctg

SEQ ID NO: 2997517 - DNA, 11 bp, Homo sapiens
gccccctcagg

SEQ ID NO: 2997518 - DNA, 11 bp, Homo sapiens
gccccctgccc

SEQ ID NO: 2997519 - DNA, 19 bp, Homo sapiens
gccccctgcccgtgtacat

SEQ ID NO: 2997520 - DNA, 13 bp, Homo sapiens
gccagggctctgg

SEQ ID NO: 2997521 - DNA, 19 bp, Homo sapiens
gccagggctctgggggcag

SEQ ID NO: 2997522 - DNA, 15 bp, Homo sapiens
gccagggctgggtca

SEQ ID NO: 2997523 - DNA, 21 bp, Homo sapiens
gccagggctgggtcacaggaa

SEQ ID NO: 2997524 - DNA, 16 bp, Homo sapiens
gccagggcttcctctt

SEQ ID NO: 2997525 - DNA, 20 bp, Homo sapiens
gccaggggggtgaggagctg

SEQ ID NO: 2997526 - DNA, 21 bp, Homo sapiens
gccagggtagagcaaaggaga

SEQ ID NO: 2997527 - DNA, 15 bp, Homo sapiens
gccaggtccccctgc

SEQ ID NO: 2997528 - DNA, 16 bp, Homo sapiens
gccaggtccccctgca

SEQ ID NO: 2997529 - DNA, 17 bp, Homo sapiens
gccaggtccccctgcag

SEQ ID NO: 2997530 - DNA, 14 bp, Homo sapiens
gccaggtgggcgga

SEQ ID NO: 2997531 - DNA, 18 bp, Homo sapiens
gccaggttctatttggaa

SEQ ID NO: 2997532 - DNA, 20 bp, Homo sapiens
gccaggttctatttggaatt

SEQ ID NO: 2997533 - DNA, 23 bp, Homo sapiens
gccaggttctatttggaatttat

SEQ ID NO: 2997534 - DNA, 20 bp, Homo sapiens
gccagtaccagtgagtggcc

SEQ ID NO: 2997535 - DNA, 20 bp, Homo sapiens
gccagtcatcatctcttgat

SEQ ID NO: 2997536 - DNA, 20 bp, Homo sapiens
gccagtcctggtcctggctg

SEQ ID NO: 2997537 - DNA, 19 bp, Homo sapiens
gccagtcgggagagccagg

SEQ ID NO: 2997538 - DNA, 15 bp, Homo sapiens
gccagtcttcctctt

SEQ ID NO: 2997539 - DNA, 15 bp, Homo sapiens
gccagtgagccactc

SEQ ID NO: 2997540 - DNA, 17 bp, Homo sapiens
gccagtgataagagcag

SEQ ID NO: 2997541 - DNA, 17 bp, Homo sapiens
gccagtgatgtgcggtg

SEQ ID NO: 2997542 - DNA, 11 bp, Homo sapiens
gccagtgcctt

SEQ ID NO: 2997543 - DNA, 19 bp, Homo sapiens
gccagtgccttacctcctg

SEQ ID NO: 2997544 - DNA, 21 bp, Homo sapiens
gccagtgccttacctcctgcc

SEQ ID NO: 2997545 - DNA, 13 bp, Homo sapiens
gccagtgtgctga

SEQ ID NO: 2997546 - DNA, 18 bp, Homo sapiens
gccagtgtgctgatgggc

SEQ ID NO: 2997547 - DNA, 19 bp, Homo sapiens
gccagtgtgttactcatct

SEQ ID NO: 2997548 - DNA, 17 bp, Homo sapiens
gccagtgtttctgaatg

SEQ ID NO: 2997549 - DNA, 18 bp, Homo sapiens
gccagtgtttctgaatgt

SEQ ID NO: 2997550 - DNA, 14 bp, Homo sapiens
gccagttttctgtt

SEQ ID NO: 2997551 - DNA, 21 bp, Homo sapiens
gccataatacaaaaggctcca

SEQ ID NO: 2997552 - DNA, 17 bp, Homo sapiens
gccatataagtttgaag

SEQ ID NO: 2997553 - DNA, 23 bp, Homo sapiens
gccatataagtttgaaggaaaca

SEQ ID NO: 2997554 - DNA, 17 bp, Homo sapiens
gccatattttcaccatt

SEQ ID NO: 2997555 - DNA, 14 bp, Homo sapiens
gccatcaaaatgct

SEQ ID NO: 2997556 - DNA, 14 bp, Homo sapiens
gccatcaagcactt

SEQ ID NO: 2997557 - DNA, 21 bp, Homo sapiens
gccatcaagcacttcccagga

SEQ ID NO: 2997558 - DNA, 12 bp, Homo sapiens
gccatcagccat

SEQ ID NO: 2997559 - DNA, 18 bp, Homo sapiens
gccatccccagggggcat

SEQ ID NO: 2997560 - DNA, 15 bp, Homo sapiens
gccatccccctctca

SEQ ID NO: 2997561 - DNA, 16 bp, Homo sapiens
gccatccgcagactgc

SEQ ID NO: 2997562 - DNA, 22 bp, Homo sapiens
gccatccgcagactgcttggcc

SEQ ID NO: 2997563 - DNA, 23 bp, Homo sapiens
gccatctggttaggatggcagga

SEQ ID NO: 2997564 - DNA, 22 bp, Homo sapiens
gccatcttcccgcctcagcctc

SEQ ID NO: 2997565 - DNA, 13 bp, Homo sapiens
gccatcttctccc

SEQ ID NO: 2997566 - DNA, 15 bp, Homo sapiens
gccatcttctccccg

SEQ ID NO: 2997567 - DNA, 19 bp, Homo sapiens
gccatcttctccccgaggc

SEQ ID NO: 2997568 - DNA, 20 bp, Homo sapiens
gccatcttctccccgaggct

SEQ ID NO: 2997569 - DNA, 22 bp, Homo sapiens
gccatcttctccccgaggctgc

SEQ ID NO: 2997570 - DNA, 23 bp, Homo sapiens
gccatgagatgatacatccaaag

SEQ ID NO: 2997571 - DNA, 15 bp, Homo sapiens
gccatgatgcctctg

SEQ ID NO: 2997572 - DNA, 17 bp, Homo sapiens
gccatgatggcaacaga

SEQ ID NO: 2997573 - DNA, 23 bp, Homo sapiens
gccatgatggcaacagatctgga

SEQ ID NO: 2997574 - DNA, 14 bp, Homo sapiens
gccatgcctcagcc

SEQ ID NO: 2997575 - DNA, 23 bp, Homo sapiens
gccatgcgcgcgctctctctctt

SEQ ID NO: 2997576 - DNA, 16 bp, Homo sapiens
gccatgctgtccctgc

SEQ ID NO: 2997577 - DNA, 20 bp, Homo sapiens
gccatgctgtgtgagaccag

SEQ ID NO: 2997578 - DNA, 16 bp, Homo sapiens
gccatggaaggtgcca

SEQ ID NO: 2997579 - DNA, 21 bp, Homo sapiens
gccatggcgagatactgcatg

SEQ ID NO: 2997580 - DNA, 21 bp, Homo sapiens
gccatggctttcatcctgtgt

SEQ ID NO: 2997581 - DNA, 16 bp, Homo sapiens
gccatgggtcctcggc

SEQ ID NO: 2997582 - DNA, 16 bp, Homo sapiens
gccatgtaaaggcctt

SEQ ID NO: 2997583 - DNA, 12 bp, Homo sapiens
gccatgtcttta

SEQ ID NO: 2997584 - DNA, 18 bp, Homo sapiens
gccatgtgactctggctt

SEQ ID NO: 2997585 - DNA, 20 bp, Homo sapiens
gccatgtggcctgcccagcc

SEQ ID NO: 2997586 - DNA, 22 bp, Homo sapiens
gccatgtggcctgcccagcctc

SEQ ID NO: 2997587 - DNA, 23 bp, Homo sapiens
gccatgtggcctgcccagcctca

SEQ ID NO: 2997588 - DNA, 17 bp, Homo sapiens
gccatgttaacatgaca

SEQ ID NO: 2997589 - DNA, 19 bp, Homo sapiens
gccatgttggccaggctgg

SEQ ID NO: 2997590 - DNA, 15 bp, Homo sapiens
gccattatagcgcct

SEQ ID NO: 2997591 - DNA, 16 bp, Homo sapiens
gccattatagcgcctg

SEQ ID NO: 2997592 - DNA, 17 bp, Homo sapiens
gccattctccacagcaa

SEQ ID NO: 2997593 - DNA, 21 bp, Homo sapiens
gccattctcctgcctcagcct

SEQ ID NO: 2997594 - DNA, 19 bp, Homo sapiens
gccattctttcccaacacc

SEQ ID NO: 2997595 - DNA, 20 bp, Homo sapiens
gccattctttttttcttggc

SEQ ID NO: 2997596 - DNA, 21 bp, Homo sapiens
gccattgcacccagcccagat

SEQ ID NO: 2997597 - DNA, 17 bp, Homo sapiens
gccattggtccaccctt

SEQ ID NO: 2997598 - DNA, 18 bp, Homo sapiens
gccattggtccacccttt

SEQ ID NO: 2997599 - DNA, 16 bp, Homo sapiens
gccattgtactccagc

SEQ ID NO: 2997600 - DNA, 20 bp, Homo sapiens
gccattgtactccagcctgg

SEQ ID NO: 2997601 - DNA, 21 bp, Homo sapiens
gccattgtactccagcctggg

SEQ ID NO: 2997602 - DNA, 18 bp, Homo sapiens
gccattgtcgtttcattc

SEQ ID NO: 2997603 - DNA, 21 bp, Homo sapiens
gccattgtcttcggaaacctt

SEQ ID NO: 2997604 - DNA, 23 bp, Homo sapiens
gccattgtcttcggaaaccttgg

SEQ ID NO: 2997605 - DNA, 18 bp, Homo sapiens
gccattgtgcagagaagc

SEQ ID NO: 2997606 - DNA, 22 bp, Homo sapiens
gccatttttagtttaaaatctt

SEQ ID NO: 2997607 - DNA, 14 bp, Homo sapiens
gcccaaatggctct

SEQ ID NO: 2997608 - DNA, 15 bp, Homo sapiens
gcccaactgtgtagc

SEQ ID NO: 2997609 - DNA, 17 bp, Homo sapiens
gcccaactgtgtagcat

SEQ ID NO: 2997610 - DNA, 16 bp, Homo sapiens
gcccaagactgggctg

SEQ ID NO: 2997611 - DNA, 19 bp, Homo sapiens
gcccaagagcccgtgccac

SEQ ID NO: 2997612 - DNA, 15 bp, Homo sapiens
gcccaaggctcccgg

SEQ ID NO: 2997613 - DNA, 16 bp, Homo sapiens
gcccaagtctcctagg

SEQ ID NO: 2997614 - DNA, 15 bp, Homo sapiens
gcccaagtgaccagg

SEQ ID NO: 2997615 - DNA, 20 bp, Homo sapiens
gcccacaacttgtcacccaa

SEQ ID NO: 2997616 - DNA, 18 bp, Homo sapiens
gcccacacacactccttc

SEQ ID NO: 2997617 - DNA, 20 bp, Homo sapiens
gcccacacacactccttccc

SEQ ID NO: 2997618 - DNA, 13 bp, Homo sapiens
gcccacaccccct

SEQ ID NO: 2997619 - DNA, 23 bp, Homo sapiens
gcccacacccgacaccagccctg

SEQ ID NO: 2997620 - DNA, 13 bp, Homo sapiens
gcccacagagcct

SEQ ID NO: 2997621 - DNA, 18 bp, Homo sapiens
gcccacagcccccacccc

SEQ ID NO: 2997622 - DNA, 23 bp, Homo sapiens
gcccacagcccccaccccagcac

SEQ ID NO: 2997623 - DNA, 12 bp, Homo sapiens
gcccacagtctg

SEQ ID NO: 2997624 - DNA, 23 bp, Homo sapiens
gcccacatcccacatgcggctcg

SEQ ID NO: 2997625 - DNA, 20 bp, Homo sapiens
gcccacatttagtctcttta

SEQ ID NO: 2997626 - DNA, 21 bp, Homo sapiens
gcccaccaacatcccattgcc

SEQ ID NO: 2997627 - DNA, 14 bp, Homo sapiens
gcccacccaggtcc

SEQ ID NO: 2997628 - DNA, 14 bp, Homo sapiens
gcccacccagtcca

SEQ ID NO: 2997629 - DNA, 22 bp, Homo sapiens
gcccacccagtccatgctccag

SEQ ID NO: 2997630 - DNA, 23 bp, Homo sapiens
gcccacccccctccccaactccc

SEQ ID NO: 2997631 - DNA, 17 bp, Homo sapiens
gcccaccctgctgctgg

SEQ ID NO: 2997632 - DNA, 20 bp, Homo sapiens
gcccacctcggccctccctg

SEQ ID NO: 2997633 - DNA, 24 bp, Homo sapiens
gcccacctcggccctccctgcgct

SEQ ID NO: 2997634 - DNA, 14 bp, Homo sapiens
gcccacctctcttt

SEQ ID NO: 2997635 - DNA, 21 bp, Homo sapiens
gcccacctgcctggccggcca

SEQ ID NO: 2997636 - DNA, 15 bp, Homo sapiens
gcccacctgggctgg

SEQ ID NO: 2997637 - DNA, 19 bp, Homo sapiens
gcccacctgggctgggcgc

SEQ ID NO: 2997638 - DNA, 22 bp, Homo sapiens
gcccacctgtcaaacaaagcca

SEQ ID NO: 2997639 - DNA, 15 bp, Homo sapiens
gcccacgtcacgtgt

SEQ ID NO: 2997640 - DNA, 14 bp, Homo sapiens
gcccactgcctcct

SEQ ID NO: 2997641 - DNA, 23 bp, Homo sapiens
gcccactgcctcctccctggctg

SEQ ID NO: 2997642 - DNA, 15 bp, Homo sapiens
gcccactgctggctg

SEQ ID NO: 2997643 - DNA, 15 bp, Homo sapiens
gcccactgtcctggg

SEQ ID NO: 2997644 - DNA, 18 bp, Homo sapiens
gcccactgtcctgggcct

SEQ ID NO: 2997645 - DNA, 21 bp, Homo sapiens
gcccactgtcctgggcctgca

SEQ ID NO: 2997646 - DNA, 20 bp, Homo sapiens
gcccagaataagttattgca

SEQ ID NO: 2997647 - DNA, 17 bp, Homo sapiens
gcccagaatgaggctgc

SEQ ID NO: 2997648 - DNA, 16 bp, Homo sapiens
gcccagacccccagtg

SEQ ID NO: 2997649 - DNA, 19 bp, Homo sapiens
gcccagagacccaagctgc

SEQ ID NO: 2997650 - DNA, 16 bp, Homo sapiens
gcccagagatgcctcc

SEQ ID NO: 2997651 - DNA, 18 bp, Homo sapiens
gcccagagatgcctccac

SEQ ID NO: 2997652 - DNA, 19 bp, Homo sapiens
gcccagagatgcctccacc

SEQ ID NO: 2997653 - DNA, 22 bp, Homo sapiens
gcccagagatgcctccaccgct

SEQ ID NO: 2997654 - DNA, 13 bp, Homo sapiens
gcccagagcccag

SEQ ID NO: 2997655 - DNA, 17 bp, Homo sapiens
gcagctgctgccactct

SEQ ID NO: 2997656 - DNA, 12 bp, Homo sapiens
gcagctggccca

SEQ ID NO: 2997657 - DNA, 21 bp, Homo sapiens
gcagctggcccactgctggct

SEQ ID NO: 2997658 - DNA, 12 bp, Homo sapiens
gcagctgggccc

SEQ ID NO: 2997659 - DNA, 19 bp, Homo sapiens
gcagctgggcccacagccc

SEQ ID NO: 2997660 - DNA, 22 bp, Homo sapiens
gcagctgggcccacagccccca

SEQ ID NO: 2997661 - DNA, 15 bp, Homo sapiens
gcagctgtcccttgc

SEQ ID NO: 2997662 - DNA, 20 bp, Homo sapiens
gcagctgtgctgggtgagct

SEQ ID NO: 2997663 - DNA, 18 bp, Homo sapiens
gcaggaaatggctgtgga

SEQ ID NO: 2997664 - DNA, 14 bp, Homo sapiens
gcaggaagctcaga

SEQ ID NO: 2997665 - DNA, 13 bp, Homo sapiens
gcaggaagctgct

SEQ ID NO: 2997666 - DNA, 16 bp, Homo sapiens
gcaggaagctgctccg

SEQ ID NO: 2997667 - DNA, 14 bp, Homo sapiens
gcaggaaggagcgg

SEQ ID NO: 2997668 - DNA, 23 bp, Homo sapiens
gcaggaaggagcggcgccctgga

SEQ ID NO: 2997669 - DNA, 12 bp, Homo sapiens
gcaggaccaagg

SEQ ID NO: 2997670 - DNA, 15 bp, Homo sapiens
gcaggacctgcctgt

SEQ ID NO: 2997671 - DNA, 17 bp, Homo sapiens
gcaggactccaggccca

SEQ ID NO: 2997672 - DNA, 19 bp, Homo sapiens
gcaggactgcacagcgtcc

SEQ ID NO: 2997673 - DNA, 13 bp, Homo sapiens
gcaggagaggaga

SEQ ID NO: 2997674 - DNA, 18 bp, Homo sapiens
gcaggagaggagagccag

SEQ ID NO: 2997675 - DNA, 22 bp, Homo sapiens
gcaggagaggagagccagagaa

SEQ ID NO: 2997676 - DNA, 16 bp, Homo sapiens
gcaggagcacacccag

SEQ ID NO: 2997677 - DNA, 17 bp, Homo sapiens
gcaggagcacacccagc

SEQ ID NO: 2997678 - DNA, 20 bp, Homo sapiens
gcaggagcacacccagcccc

SEQ ID NO: 2997679 - DNA, 12 bp, Homo sapiens
gcaggagcgtga

SEQ ID NO: 2997680 - DNA, 20 bp, Homo sapiens
gcaggagctagttctcagct

SEQ ID NO: 2997681 - DNA, 11 bp, Homo sapiens
gcaggaggaag

SEQ ID NO: 2997682 - DNA, 14 bp, Homo sapiens
gcaggaggccaggc

SEQ ID NO: 2997683 - DNA, 15 bp, Homo sapiens
gcaggaggccaggcc

SEQ ID NO: 2997684 - DNA, 17 bp, Homo sapiens
gcaggaggccaggccgg

SEQ ID NO: 2997685 - DNA, 14 bp, Homo sapiens
gcaggagggcactg

SEQ ID NO: 2997686 - DNA, 23 bp, Homo sapiens
gcaggagggcactggagctggga

SEQ ID NO: 2997687 - DNA, 13 bp, Homo sapiens
gcaggagtggaag

SEQ ID NO: 2997688 - DNA, 24 bp, Homo sapiens
gcaggagtggaaggtgaggcgttc

SEQ ID NO: 2997689 - DNA, 20 bp, Homo sapiens
gcaggagtgtcctggctgtg

SEQ ID NO: 2997690 - DNA, 23 bp, Homo sapiens
gcaggagttgggggcaggtcagg

SEQ ID NO: 2997691 - DNA, 23 bp, Homo sapiens
gcaggatgaccacgcacctccac

SEQ ID NO: 2997692 - DNA, 15 bp, Homo sapiens
gcaggattctagcct

SEQ ID NO: 2997693 - DNA, 21 bp, Homo sapiens
gcaggatttttagagcattaa

SEQ ID NO: 2997694 - DNA, 10 bp, Homo sapiens
gcaggcacca

SEQ ID NO: 2997695 - DNA, 20 bp, Homo sapiens
gcaggcacggcccgcagcct

SEQ ID NO: 2997696 - DNA, 20 bp, Homo sapiens
gcaggcagatcacctgaggt

SEQ ID NO: 2997697 - DNA, 14 bp, Homo sapiens
gcaggcagcgcctg

SEQ ID NO: 2997698 - DNA, 10 bp, Homo sapiens
gcaggcagtg

SEQ ID NO: 2997699 - DNA, 15 bp, Homo sapiens
gcaggccaggccagc

SEQ ID NO: 2997700 - DNA, 13 bp, Homo sapiens
gcaggcccctctc

SEQ ID NO: 2997701 - DNA, 23 bp, Homo sapiens
gcaggcccctctcctccgtggca

SEQ ID NO: 2997702 - DNA, 19 bp, Homo sapiens
gcaggcctccctgcctcag

SEQ ID NO: 2997703 - DNA, 20 bp, Homo sapiens
gcaggcctccctgcctcagc

SEQ ID NO: 2997704 - DNA, 16 bp, Homo sapiens
gcaggcctgaggcaga

SEQ ID NO: 2997705 - DNA, 17 bp, Homo sapiens
gcaggcctgccttctca

SEQ ID NO: 2997706 - DNA, 16 bp, Homo sapiens
gcaggcctttcctaca

SEQ ID NO: 2997707 - DNA, 12 bp, Homo sapiens
gcaggcggccag

SEQ ID NO: 2997708 - DNA, 13 bp, Homo sapiens
gcaggcggccagg

SEQ ID NO: 2997709 - DNA, 15 bp, Homo sapiens
gcaggcggccagggc

SEQ ID NO: 2997710 - DNA, 15 bp, Homo sapiens
gcaggcggccctcag

SEQ ID NO: 2997711 - DNA, 14 bp, Homo sapiens
gcaggcggtgggca

SEQ ID NO: 2997712 - DNA, 23 bp, Homo sapiens
gcaggcggtgggcacccaccctg

SEQ ID NO: 2997713 - DNA, 14 bp, Homo sapiens
gcaggcgtgtggca

SEQ ID NO: 2997714 - DNA, 21 bp, Homo sapiens
gcaggcgtgtggcagccacac

SEQ ID NO: 2997715 - DNA, 22 bp, Homo sapiens
gcaggctcccagggacacctgg

SEQ ID NO: 2997716 - DNA, 14 bp, Homo sapiens
gcaggctcccctga

SEQ ID NO: 2997717 - DNA, 17 bp, Homo sapiens
gcaggctgatttctagg

SEQ ID NO: 2997718 - DNA, 17 bp, Homo sapiens
gcaggctgcaggagggc

SEQ ID NO: 2997719 - DNA, 19 bp, Homo sapiens
gcaggctgcaggagggcac

SEQ ID NO: 2997720 - DNA, 13 bp, Homo sapiens
gcaggctggccag

SEQ ID NO: 2997721 - DNA, 14 bp, Homo sapiens
gcaggctggccagc

SEQ ID NO: 2997722 - DNA, 15 bp, Homo sapiens
gcaggctggccagcc

SEQ ID NO: 2997723 - DNA, 17 bp, Homo sapiens
gcaggctggccagccgc

SEQ ID NO: 2997724 - DNA, 18 bp, Homo sapiens
gcagggaagccccacatg

SEQ ID NO: 2997725 - DNA, 23 bp, Homo sapiens
gcagggaagccccacatgtccag

SEQ ID NO: 2997726 - DNA, 21 bp, Homo sapiens
gcagggacccggggtctcctg

SEQ ID NO: 2997727 - DNA, 19 bp, Homo sapiens
gcagggagcaccacggcca

SEQ ID NO: 2997728 - DNA, 21 bp, Homo sapiens
gcagggagcaccacggccaga

SEQ ID NO: 2997729 - DNA, 19 bp, Homo sapiens
gcagggagcggccggccag

SEQ ID NO: 2997730 - DNA, 23 bp, Homo sapiens
gcagggatgccctggaggtggct

SEQ ID NO: 2997731 - DNA, 15 bp, Homo sapiens
gcagggattgctgcc

SEQ ID NO: 2997732 - DNA, 13 bp, Homo sapiens
gcagggcacagat

SEQ ID NO: 2997733 - DNA, 13 bp, Homo sapiens
gcagggcagtcat

SEQ ID NO: 2997734 - DNA, 19 bp, Homo sapiens
gcagggccaacccttctcc

SEQ ID NO: 2997735 - DNA, 19 bp, Homo sapiens
gcagggccactcaacagag

SEQ ID NO: 2997736 - DNA, 13 bp, Homo sapiens
gcagggccatggc

SEQ ID NO: 2997737 - DNA, 16 bp, Homo sapiens
gcagggccatggctca

SEQ ID NO: 2997738 - DNA, 18 bp, Homo sapiens
gcagggccatggctcagg

SEQ ID NO: 2997739 - DNA, 12 bp, Homo sapiens
gcagggcccctg

SEQ ID NO: 2997740 - DNA, 18 bp, Homo sapiens
gcagggccgcgagaggcc

SEQ ID NO: 2997741 - DNA, 13 bp, Homo sapiens
gcagggcggctgc

SEQ ID NO: 2997742 - DNA, 21 bp, Homo sapiens
gcagggcgggcagagggctgg

SEQ ID NO: 2997743 - DNA, 17 bp, Homo sapiens
gcagggctaccctgagc

SEQ ID NO: 2997744 - DNA, 21 bp, Homo sapiens
gcagggctaccctgagctgag

SEQ ID NO: 2997745 - DNA, 16 bp, Homo sapiens
gcagggctggtttgtt

SEQ ID NO: 2997746 - DNA, 17 bp, Homo sapiens
gcaggggactgggccat

SEQ ID NO: 2997747 - DNA, 20 bp, Homo sapiens
gcaggggagccagggtagag

SEQ ID NO: 2997748 - DNA, 18 bp, Homo sapiens
gcaggggcaggagggagg

SEQ ID NO: 2997749 - DNA, 23 bp, Homo sapiens
gcaggggcgggtggatcacctga

SEQ ID NO: 2997750 - DNA, 14 bp, Homo sapiens
gcaggggctgctgg

SEQ ID NO: 2997751 - DNA, 15 bp, Homo sapiens
gcaggggtgagagca

SEQ ID NO: 2997752 - DNA, 17 bp, Homo sapiens
gcagggtctctgctcca

SEQ ID NO: 2997753 - DNA, 20 bp, Homo sapiens
gcagggtctctgctccagca

SEQ ID NO: 2997754 - DNA, 19 bp, Homo sapiens
gcagggtctgtttggactg

SEQ ID NO: 2997755 - DNA, 21 bp, Homo sapiens
gcagggtcttttcatctggga

SEQ ID NO: 2997756 - DNA, 23 bp, Homo sapiens
gcagggtgggagccgggaccctc

SEQ ID NO: 2997757 - DNA, 21 bp, Homo sapiens
gcagggtggtggtattctgtc

SEQ ID NO: 2997758 - DNA, 18 bp, Homo sapiens
gcagggtttgagcacaat

SEQ ID NO: 2997759 - DNA, 20 bp, Homo sapiens
gcaggtaagagctgatgtga

SEQ ID NO: 2997760 - DNA, 18 bp, Homo sapiens
gcaggtcactgtcactgc

SEQ ID NO: 2997761 - DNA, 21 bp, Homo sapiens
gcaggtcactgtcactgccga

SEQ ID NO: 2997762 - DNA, 22 bp, Homo sapiens
gcaggtctgcaagggcccagag

SEQ ID NO: 2997763 - DNA, 23 bp, Homo sapiens
gcaggtctgcaagggcccagagt

SEQ ID NO: 2997764 - DNA, 20 bp, Homo sapiens
gcaggtggccgcccctgagg

SEQ ID NO: 2997765 - DNA, 21 bp, Homo sapiens
gcaggtggccgcccctgaggc

SEQ ID NO: 2997766 - DNA, 16 bp, Homo sapiens
gcaggtggcctctgct

SEQ ID NO: 2997767 - DNA, 20 bp, Homo sapiens
gcaggtggcctctgctggtc

SEQ ID NO: 2997768 - DNA, 13 bp, Homo sapiens
gcaggttagagaa

SEQ ID NO: 2997769 - DNA, 13 bp, Homo sapiens
gcagaaggacagg

SEQ ID NO: 2997770 - DNA, 22 bp, Homo sapiens
gcagaatcctgggcccccagag

SEQ ID NO: 2997771 - DNA, 15 bp, Homo sapiens
gcagaatgaacccat

SEQ ID NO: 2997772 - DNA, 22 bp, Homo sapiens
gcagaatgaacccatagggagc

SEQ ID NO: 2997773 - DNA, 19 bp, Homo sapiens
gcagaatgtaagtgggccc

SEQ ID NO: 2997774 - DNA, 12 bp, Homo sapiens
gcagaattttaa

SEQ ID NO: 2997775 - DNA, 18 bp, Homo sapiens
gccaaatagccccagact

SEQ ID NO: 2997776 - DNA, 22 bp, Homo sapiens
gccaaatccttggagtcccagg

SEQ ID NO: 2997777 - DNA, 14 bp, Homo sapiens
gccaacaagaatgc

SEQ ID NO: 2997778 - DNA, 15 bp, Homo sapiens
gccaacactgtgggt

SEQ ID NO: 2997779 - DNA, 21 bp, Homo sapiens
gccaacactgtgggtgtgtga

SEQ ID NO: 2997780 - DNA, 20 bp, Homo sapiens
gccaacatgctgaaaccctg

SEQ ID NO: 2997781 - DNA, 18 bp, Homo sapiens
gccaaccccacccagctc

SEQ ID NO: 2997782 - DNA, 20 bp, Homo sapiens
gccaaccccacccagctcca

SEQ ID NO: 2997783 - DNA, 12 bp, Homo sapiens
gccaagaatgta

SEQ ID NO: 2997784 - DNA, 16 bp, Homo sapiens
gccaagacacagcagg

SEQ ID NO: 2997785 - DNA, 13 bp, Homo sapiens
gccaagagtcact

SEQ ID NO: 2997786 - DNA, 18 bp, Homo sapiens
gccaagatcgcaccactg

SEQ ID NO: 2997787 - DNA, 20 bp, Homo sapiens
gccaagatcgcaccactgca

SEQ ID NO: 2997788 - DNA, 21 bp, Homo sapiens
gccaagccccatcctgccgcc

SEQ ID NO: 2997789 - DNA, 14 bp, Homo sapiens
gccaagctgtgttc

SEQ ID NO: 2997790 - DNA, 22 bp, Homo sapiens
gccaaggaaaggcatgtacaaa

SEQ ID NO: 2997791 - DNA, 11 bp, Homo sapiens
gccaaggagct

SEQ ID NO: 2997792 - DNA, 21 bp, Homo sapiens
gccaaggagctgctatagcct

SEQ ID NO: 2997793 - DNA, 23 bp, Homo sapiens
gccaaggagctgctatagcctgg

SEQ ID NO: 2997794 - DNA, 20 bp, Homo sapiens
gccaagggaattatagctgc

SEQ ID NO: 2997795 - DNA, 18 bp, Homo sapiens
gccaaggggcttcaggtc

SEQ ID NO: 2997796 - DNA, 21 bp, Homo sapiens
gccaaggtgcatatagaaaac

SEQ ID NO: 2997797 - DNA, 22 bp, Homo sapiens
gccaaggtgcatatagaaaaca

SEQ ID NO: 2997798 - DNA, 15 bp, Homo sapiens
gccaaggtgggcgga

SEQ ID NO: 2997799 - DNA, 16 bp, Homo sapiens
gccaagtaagaaagtg

SEQ ID NO: 2997800 - DNA, 22 bp, Homo sapiens
gccaagtcctagctcctcctcc

SEQ ID NO: 2997801 - DNA, 13 bp, Homo sapiens
gccaagtcctgcc

SEQ ID NO: 2997802 - DNA, 16 bp, Homo sapiens
gccaagtcctgccttt

SEQ ID NO: 2997803 - DNA, 18 bp, Homo sapiens
gccaatattaaatctgct

SEQ ID NO: 2997804 - DNA, 18 bp, Homo sapiens
gccaatctgcaatttcta

SEQ ID NO: 2997805 - DNA, 15 bp, Homo sapiens
gccaatcttgtttta

SEQ ID NO: 2997806 - DNA, 21 bp, Homo sapiens
gccaatcttgttttaagcaaa

SEQ ID NO: 2997807 - DNA, 20 bp, Homo sapiens
gccaatgtcagcatcaagcc

SEQ ID NO: 2997808 - DNA, 20 bp, Homo sapiens
gccaatgtgaacagcggctg

SEQ ID NO: 2997809 - DNA, 13 bp, Homo sapiens
gccaatgttgtgt

SEQ ID NO: 2997810 - DNA, 19 bp, Homo sapiens
gccaattacggtgtacagt

SEQ ID NO: 2997811 - DNA, 14 bp, Homo sapiens
gccaattagacttg

SEQ ID NO: 2997812 - DNA, 22 bp, Homo sapiens
gccaattagggggtaaggcccc

SEQ ID NO: 2997813 - DNA, 12 bp, Homo sapiens
gccaatttgtct

SEQ ID NO: 2997814 - DNA, 22 bp, Homo sapiens
gccaatttgtctcctactctgt

SEQ ID NO: 2997815 - DNA, 23 bp, Homo sapiens
gccaatttttgccttcattacct

SEQ ID NO: 2997816 - DNA, 11 bp, Homo sapiens
gccacacacac

SEQ ID NO: 2997817 - DNA, 15 bp, Homo sapiens
gccacacacacagaa

SEQ ID NO: 2997818 - DNA, 19 bp, Homo sapiens
gccacacacacagaaaata

SEQ ID NO: 2997819 - DNA, 21 bp, Homo sapiens
gccacacacacagaaaatata

SEQ ID NO: 2997820 - DNA, 12 bp, Homo sapiens
gccacacacctt

SEQ ID NO: 2997821 - DNA, 18 bp, Homo sapiens
gccacacatgggcatcta

SEQ ID NO: 2997822 - DNA, 13 bp, Homo sapiens
gccacaccactgc

SEQ ID NO: 2997823 - DNA, 14 bp, Homo sapiens
gccacaccactgcc

SEQ ID NO: 2997824 - DNA, 19 bp, Homo sapiens
gccacacgcaggcggccag

SEQ ID NO: 2997825 - DNA, 22 bp, Homo sapiens
gcatgaaaaaccatttttgaac

SEQ ID NO: 2997826 - DNA, 18 bp, Homo sapiens
gcatgaaggaaactgaac

SEQ ID NO: 2997827 - DNA, 17 bp, Homo sapiens
gcatgacaaaagtgaca

SEQ ID NO: 2997828 - DNA, 15 bp, Homo sapiens
gcatgacgtttaagg

SEQ ID NO: 2997829 - DNA, 20 bp, Homo sapiens
gcatgagatagctggtgtta

SEQ ID NO: 2997830 - DNA, 14 bp, Homo sapiens
gcatgataaacatt

SEQ ID NO: 2997831 - DNA, 16 bp, Homo sapiens
gcatgatgggaaaata

SEQ ID NO: 2997832 - DNA, 20 bp, Homo sapiens
gcatgatggtgcatgcctgt

SEQ ID NO: 2997833 - DNA, 23 bp, Homo sapiens
gcatgattttaagaggctttggc

SEQ ID NO: 2997834 - DNA, 17 bp, Homo sapiens
gcatgcacacggctggt

SEQ ID NO: 2997835 - DNA, 13 bp, Homo sapiens
gcatgcacgggca

SEQ ID NO: 2997836 - DNA, 24 bp, Homo sapiens
gcatgcacgggcatgcacacggct

SEQ ID NO: 2997837 - DNA, 20 bp, Homo sapiens
gcatgccaacaagaatgcat

SEQ ID NO: 2997838 - DNA, 22 bp, Homo sapiens
gcatgccaggacccgccagccc

SEQ ID NO: 2997839 - DNA, 18 bp, Homo sapiens
gcatgcctgtaatcccag

SEQ ID NO: 2997840 - DNA, 15 bp, Homo sapiens
gcatgccttcaaatc

SEQ ID NO: 2997841 - DNA, 21 bp, Homo sapiens
gcatgctctctgcagccagcc

SEQ ID NO: 2997842 - DNA, 11 bp, Homo sapiens
gcatggaaggg

SEQ ID NO: 2997843 - DNA, 14 bp, Homo sapiens
gcatggaaggggct

SEQ ID NO: 2997844 - DNA, 18 bp, Homo sapiens
gcatggaaggggcttctg

SEQ ID NO: 2997845 - DNA, 22 bp, Homo sapiens
gcatggacagtgtgggcgctct

SEQ ID NO: 2997846 - DNA, 16 bp, Homo sapiens
gcatggagacgcattt

SEQ ID NO: 2997847 - DNA, 21 bp, Homo sapiens
gcatggatgttttagccattg

SEQ ID NO: 2997848 - DNA, 12 bp, Homo sapiens
gcatggcagctg

SEQ ID NO: 2997849 - DNA, 17 bp, Homo sapiens
gcatggcagctgggccc

SEQ ID NO: 2997850 - DNA, 18 bp, Homo sapiens
gcatggcagctgggccca

SEQ ID NO: 2997851 - DNA, 23 bp, Homo sapiens
gcatggcagctgggcccacagcc

SEQ ID NO: 2997852 - DNA, 20 bp, Homo sapiens
gcatggccagactattccct

SEQ ID NO: 2997853 - DNA, 22 bp, Homo sapiens
gcatggccctgctgcccctccc

SEQ ID NO: 2997854 - DNA, 14 bp, Homo sapiens
gcatggccctgggc

SEQ ID NO: 2997855 - DNA, 22 bp, Homo sapiens
gcatggcgtagagggtgctgcc

SEQ ID NO: 2997856 - DNA, 16 bp, Homo sapiens
gcatggctggtgcctg

SEQ ID NO: 2997857 - DNA, 15 bp, Homo sapiens
gcatgggccagcccc

SEQ ID NO: 2997858 - DNA, 20 bp, Homo sapiens
gcatggggcatgtcctttcc

SEQ ID NO: 2997859 - DNA, 16 bp, Homo sapiens
gcatgggtcgggagag

SEQ ID NO: 2997860 - DNA, 20 bp, Homo sapiens
gcatgggtcgggagagggga

SEQ ID NO: 2997861 - DNA, 15 bp, Homo sapiens
gcatggtcacacact

SEQ ID NO: 2997862 - DNA, 19 bp, Homo sapiens
gcatggtgccccaggacca

SEQ ID NO: 2997863 - DNA, 20 bp, Homo sapiens
gcatggtgccccaggaccag

SEQ ID NO: 2997864 - DNA, 23 bp, Homo sapiens
gcatggtgccccaggaccagctc

SEQ ID NO: 2997865 - DNA, 13 bp, Homo sapiens
gaaatgaaagaaa

SEQ ID NO: 2997866 - DNA, 12 bp, Homo sapiens
gaaatgaacttt

SEQ ID NO: 2997867 - DNA, 21 bp, Homo sapiens
gaaatgatagatttgacctcc

SEQ ID NO: 2997868 - DNA, 15 bp, Homo sapiens
gaaatgcaagctctg

SEQ ID NO: 2997869 - DNA, 18 bp, Homo sapiens
gaaatgcaagctctggaa

SEQ ID NO: 2997870 - DNA, 19 bp, Homo sapiens
gaaatgctgggctgacggt

SEQ ID NO: 2997871 - DNA, 23 bp, Homo sapiens
gaaatggcttttcccaaccccca

SEQ ID NO: 2997872 - DNA, 23 bp, Homo sapiens
gaaatggtttcacttgctctttg

SEQ ID NO: 2997873 - DNA, 12 bp, Homo sapiens
gaaatgtagcag

SEQ ID NO: 2997874 - DNA, 17 bp, Homo sapiens
ctttcctcaaaaagcag

SEQ ID NO: 2997875 - DNA, 19 bp, Homo sapiens
ctttcctgcccttttcctg

SEQ ID NO: 2997876 - DNA, 21 bp, Homo sapiens
ctttcctggaagtcaaataaa

SEQ ID NO: 2997877 - DNA, 20 bp, Homo sapiens
ctttcctggataaaaaagaa

SEQ ID NO: 2997878 - DNA, 17 bp, Homo sapiens
ctttcctggttctgtct

SEQ ID NO: 2997879 - DNA, 20 bp, Homo sapiens
ctttccttatgtctcctgac

SEQ ID NO: 2997880 - DNA, 16 bp, Homo sapiens
ctttccttccttccct

SEQ ID NO: 2997881 - DNA, 18 bp, Homo sapiens
ctttcctttacagctgtt

SEQ ID NO: 2997882 - DNA, 15 bp, Homo sapiens
ctttcctttactcct

SEQ ID NO: 2997883 - DNA, 18 bp, Homo sapiens
ctttccttttttaaaaat

SEQ ID NO: 2997884 - DNA, 20 bp, Homo sapiens
ctttcgggccatgttgcccc

SEQ ID NO: 2997885 - DNA, 15 bp, Homo sapiens
ctttcggggagggcg

SEQ ID NO: 2997886 - DNA, 18 bp, Homo sapiens
ctttcgtaatagctcaga

SEQ ID NO: 2997887 - DNA, 21 bp, Homo sapiens
ctttcgtccacagcttcctgt

SEQ ID NO: 2997888 - DNA, 18 bp, Homo sapiens
ctttcgttggttgtttct

SEQ ID NO: 2997889 - DNA, 19 bp, Homo sapiens
ctttcgttggttgtttctc

SEQ ID NO: 2997890 - DNA, 22 bp, Homo sapiens
ctttcgttggttgtttctctga

SEQ ID NO: 2997891 - DNA, 15 bp, Homo sapiens
ctttctagcctgggg

SEQ ID NO: 2997892 - DNA, 18 bp, Homo sapiens
ctttctagttgaaaataa

SEQ ID NO: 2997893 - DNA, 16 bp, Homo sapiens
ctttctatcctctgta

SEQ ID NO: 2997894 - DNA, 17 bp, Homo sapiens
ctttctatgctgctttt

SEQ ID NO: 2997895 - DNA, 22 bp, Homo sapiens
ctttctattacccctcatttaa

SEQ ID NO: 2997896 - DNA, 14 bp, Homo sapiens
ctttctcctgttta

SEQ ID NO: 2997897 - DNA, 14 bp, Homo sapiens
ctttctctgtatat

SEQ ID NO: 2997898 - DNA, 15 bp, Homo sapiens
ctttctcttgtttaa

SEQ ID NO: 2997899 - DNA, 23 bp, Homo sapiens
ctttctcttgtttaaaaaaagaa

SEQ ID NO: 2997900 - DNA, 20 bp, Homo sapiens
ctttctcttttctaaaagac

SEQ ID NO: 2997901 - DNA, 19 bp, Homo sapiens
ctttctgaaactcccttgt

SEQ ID NO: 2997902 - DNA, 15 bp, Homo sapiens
ctttctgaaattcac

SEQ ID NO: 2997903 - DNA, 17 bp, Homo sapiens
ctttctgacatcagcac

SEQ ID NO: 2997904 - DNA, 14 bp, Homo sapiens
ctttctgaccttca

SEQ ID NO: 2997905 - DNA, 15 bp, Homo sapiens
ctttctgatcaaggc

SEQ ID NO: 2997906 - DNA, 13 bp, Homo sapiens
ctttctgcccggc

SEQ ID NO: 2997907 - DNA, 14 bp, Homo sapiens
ctttctgccttagc

SEQ ID NO: 2997908 - DNA, 13 bp, Homo sapiens
ctttctgctcagc

SEQ ID NO: 2997909 - DNA, 13 bp, Homo sapiens
ctttctggctctc

SEQ ID NO: 2997910 - DNA, 16 bp, Homo sapiens
ctttctgtcccatcct

SEQ ID NO: 2997911 - DNA, 14 bp, Homo sapiens
ctttctgttcatct

SEQ ID NO: 2997912 - DNA, 15 bp, Homo sapiens
ctttctgttcatctc

SEQ ID NO: 2997913 - DNA, 21 bp, Homo sapiens
ctttctgttcatctctttgtc

SEQ ID NO: 2997914 - DNA, 22 bp, Homo sapiens
ctttcttatcctagcacatgct

SEQ ID NO: 2997915 - DNA, 20 bp, Homo sapiens
ctttcttcagctgccagtgt

SEQ ID NO: 2997916 - DNA, 17 bp, Homo sapiens
ctttcttcctccagtct

SEQ ID NO: 2997917 - DNA, 15 bp, Homo sapiens
ctttcttctaccaga

SEQ ID NO: 2997918 - DNA, 21 bp, Homo sapiens
ctttcttctcgcctaggattt

SEQ ID NO: 2997919 - DNA, 12 bp, Homo sapiens
ctttcttgtttc

SEQ ID NO: 2997920 - DNA, 14 bp, Homo sapiens
ctttcttgtttctt

SEQ ID NO: 2997921 - DNA, 20 bp, Homo sapiens
ctttcttgtttgtcagcatc

SEQ ID NO: 2997922 - DNA, 14 bp, Homo sapiens
ctttctttgctgct

SEQ ID NO: 2997923 - DNA, 16 bp, Homo sapiens
ctttctttgctgctgt

SEQ ID NO: 2997924 - DNA, 19 bp, Homo sapiens
ctttctttggggaaaaatt

SEQ ID NO: 2997925 - DNA, 19 bp, Homo sapiens
ctttctttggtaggtaaat

SEQ ID NO: 2997926 - DNA, 22 bp, Homo sapiens
ctttgaagtgggaaagcatttt

SEQ ID NO: 2997927 - DNA, 21 bp, Homo sapiens
ctttgaataaagaatacttga

SEQ ID NO: 2997928 - DNA, 22 bp, Homo sapiens
ctttgaataaagaatacttgaa

SEQ ID NO: 2997929 - DNA, 17 bp, Homo sapiens
ctttgaatagtcctaaa

SEQ ID NO: 2997930 - DNA, 17 bp, Homo sapiens
ctttgaattttctgtgt

SEQ ID NO: 2997931 - DNA, 14 bp, Homo sapiens
ctttgacgggccag

SEQ ID NO: 2997932 - DNA, 19 bp, Homo sapiens
ctttgacgggccaggccct

SEQ ID NO: 2997933 - DNA, 19 bp, Homo sapiens
ctttgagaaagggctttta

SEQ ID NO: 2997934 - DNA, 14 bp, Homo sapiens
ctttgagaggctga

SEQ ID NO: 2997935 - DNA, 20 bp, Homo sapiens
ctttgagataatacattccg

SEQ ID NO: 2997936 - DNA, 16 bp, Homo sapiens
ctttgaggtggaagag

SEQ ID NO: 2997937 - DNA, 21 bp, Homo sapiens
ctttgagtgcagtcctgatca

SEQ ID NO: 2997938 - DNA, 23 bp, Homo sapiens
ctttgatcgtatatttctcataa

SEQ ID NO: 2997939 - DNA, 15 bp, Homo sapiens
ctttgatcttcagga

SEQ ID NO: 2997940 - DNA, 19 bp, Homo sapiens
ctttgatgttaacacattt

SEQ ID NO: 2997941 - DNA, 21 bp, Homo sapiens
ctttgatgttaacacattttg

SEQ ID NO: 2997942 - DNA, 19 bp, Homo sapiens
ctttgattagttttcttgt

SEQ ID NO: 2997943 - DNA, 20 bp, Homo sapiens
ctttgattagttttcttgtt

SEQ ID NO: 2997944 - DNA, 19 bp, Homo sapiens
ctttgattcatagtaactt

SEQ ID NO: 2997945 - DNA, 16 bp, Homo sapiens
ctttgattgaagtatt

SEQ ID NO: 2997946 - DNA, 16 bp, Homo sapiens
ctttgcaggcggccct

SEQ ID NO: 2997947 - DNA, 19 bp, Homo sapiens
ctttgcaggcggccctcag

SEQ ID NO: 2997948 - DNA, 20 bp, Homo sapiens
ctttgcaggcggccctcagt

SEQ ID NO: 2997949 - DNA, 16 bp, Homo sapiens
ctttgcagggcacaga

SEQ ID NO: 2997950 - DNA, 21 bp, Homo sapiens
ctttgcagggcacagatgacc

SEQ ID NO: 2997951 - DNA, 19 bp, Homo sapiens
ctttgcatagcagctgcta

SEQ ID NO: 2997952 - DNA, 18 bp, Homo sapiens
ctttgcatcgtcccctcc

SEQ ID NO: 2997953 - DNA, 16 bp, Homo sapiens
ctttgcatttggaatt

SEQ ID NO: 2997954 - DNA, 19 bp, Homo sapiens
ctttgcattttgatattgc

SEQ ID NO: 2997955 - DNA, 18 bp, Homo sapiens
ctttgcccacacacactc

SEQ ID NO: 2997956 - DNA, 22 bp, Homo sapiens
ctttgcccacacacactccttc

SEQ ID NO: 2997957 - DNA, 18 bp, Homo sapiens
ctttgcctcgaaagtgtc

SEQ ID NO: 2997958 - DNA, 15 bp, Homo sapiens
ctttgcctgttcagt

SEQ ID NO: 2997959 - DNA, 20 bp, Homo sapiens
ctttgcgcaaactttaacag

SEQ ID NO: 2997960 - DNA, 16 bp, Homo sapiens
ctttgcggaggctgct

SEQ ID NO: 2997961 - DNA, 14 bp, Homo sapiens
ctttgctatgtaag

SEQ ID NO: 2997962 - DNA, 17 bp, Homo sapiens
ctttgctcttcaagaaa

SEQ ID NO: 2997963 - DNA, 14 bp, Homo sapiens
ctttgctctttctt

SEQ ID NO: 2997964 - DNA, 15 bp, Homo sapiens
ctttgctggaaaatc

SEQ ID NO: 2997965 - DNA, 18 bp, Homo sapiens
ctttgctgtaagatgtct

SEQ ID NO: 2997966 - DNA, 16 bp, Homo sapiens
ctttgcttaccttgtt

SEQ ID NO: 2997967 - DNA, 14 bp, Homo sapiens
ctttgcttcatgtt

SEQ ID NO: 2997968 - DNA, 20 bp, Homo sapiens
ctttgcttccttgcttttat

SEQ ID NO: 2997969 - DNA, 14 bp, Homo sapiens
ctttgcttgcagta

SEQ ID NO: 2997970 - DNA, 19 bp, Homo sapiens
ctttgcttgcagtagattt

SEQ ID NO: 2997971 - DNA, 14 bp, Homo sapiens
ctttgctttctgct

SEQ ID NO: 2997972 - DNA, 17 bp, Homo sapiens
ctttgctttctgctcag

SEQ ID NO: 2997973 - DNA, 18 bp, Homo sapiens
ctttgctttgtctggaag

SEQ ID NO: 2997974 - DNA, 21 bp, Homo sapiens
ctttggaacaagacagccttc

SEQ ID NO: 2997975 - DNA, 18 bp, Homo sapiens
ctttggaagatgcagaag

SEQ ID NO: 2997976 - DNA, 21 bp, Homo sapiens
ctttggaagcactttttctgc

SEQ ID NO: 2997977 - DNA, 17 bp, Homo sapiens
ctttggacaacaggaag

SEQ ID NO: 2997978 - DNA, 18 bp, Homo sapiens
ctttggacaacaggaagt

SEQ ID NO: 2997979 - DNA, 20 bp, Homo sapiens
ctttggagactttctttaaa

SEQ ID NO: 2997980 - DNA, 13 bp, Homo sapiens
ctttggatttgac

SEQ ID NO: 2997981 - DNA, 15 bp, Homo sapiens
ctttggatttgacat

SEQ ID NO: 2997982 - DNA, 21 bp, Homo sapiens
ctttggctgaaattcttcaac

SEQ ID NO: 2997983 - DNA, 15 bp, Homo sapiens
ctttgggaggcaggg

SEQ ID NO: 2997984 - DNA, 21 bp, Homo sapiens
ctttgggaggtgtctgtgaag

SEQ ID NO: 2997985 - DNA, 14 bp, Homo sapiens
ctttttaaaacaca

SEQ ID NO: 2997986 - DNA, 20 bp, Homo sapiens
ctttttaaaatgttggtgca

SEQ ID NO: 2997987 - DNA, 14 bp, Homo sapiens
ctttttaataaaaa

SEQ ID NO: 2997988 - DNA, 15 bp, Homo sapiens
ctttttattgaatct

SEQ ID NO: 2997989 - DNA, 19 bp, Homo sapiens
ctttttattgaatctattt

SEQ ID NO: 2997990 - DNA, 13 bp, Homo sapiens
ctttttattgcct

SEQ ID NO: 2997991 - DNA, 14 bp, Homo sapiens
ctttttattgcctt

SEQ ID NO: 2997992 - DNA, 15 bp, Homo sapiens
ctttttattgccttc

SEQ ID NO: 2997993 - DNA, 16 bp, Homo sapiens
ctttttattgccttct

SEQ ID NO: 2997994 - DNA, 20 bp, Homo sapiens
ctttttatttatatgtactg

SEQ ID NO: 2997995 - DNA, 22 bp, Homo sapiens
ctttttcaaaaattacactaca

SEQ ID NO: 2997996 - DNA, 23 bp, Homo sapiens
ctttttcagaggtgaattaatgg

SEQ ID NO: 2997997 - DNA, 22 bp, Homo sapiens
ctttttcatttttttctctctg

SEQ ID NO: 2997998 - DNA, 15 bp, Homo sapiens
ctttttccttcctga

SEQ ID NO: 2997999 - DNA, 19 bp, Homo sapiens
ctttttccttcctgagaaa

SEQ ID NO: 2998000 - DNA, 20 bp, Homo sapiens
ctttttctaatgaggagaga

SEQ ID NO: 2998001 - DNA, 22 bp, Homo sapiens
ctttttctaatgaggagagaaa

SEQ ID NO: 2998002 - DNA, 11 bp, Homo sapiens
ctttttctacc

SEQ ID NO: 2998003 - DNA, 13 bp, Homo sapiens
ctttttctccacc

SEQ ID NO: 2998004 - DNA, 14 bp, Homo sapiens
ctttttctccaccc

SEQ ID NO: 2998005 - DNA, 16 bp, Homo sapiens
ctttttctctgtatat

SEQ ID NO: 2998006 - DNA, 13 bp, Homo sapiens
ctttttctcttct

SEQ ID NO: 2998007 - DNA, 14 bp, Homo sapiens
ctttttctttttaa

SEQ ID NO: 2998008 - DNA, 18 bp, Homo sapiens
ctttttgaaatcagcata

SEQ ID NO: 2998009 - DNA, 17 bp, Homo sapiens
ctttttgaccagtttct

SEQ ID NO: 2998010 - DNA, 19 bp, Homo sapiens
ctttttgatgtataaaact

SEQ ID NO: 2998011 - DNA, 13 bp, Homo sapiens
ctttttgctttcg

SEQ ID NO: 2998012 - DNA, 19 bp, Homo sapiens
ctttttggaaaagagctgg

SEQ ID NO: 2998013 - DNA, 21 bp, Homo sapiens
ctttttggaaaagagctggga

SEQ ID NO: 2998014 - DNA, 22 bp, Homo sapiens
ctttttggtaatatatatattt

SEQ ID NO: 2998015 - DNA, 18 bp, Homo sapiens
ctttttgtaagtgagtgt

SEQ ID NO: 2998016 - DNA, 24 bp, Homo sapiens
ctttttgtgtgcaggctgtctcat

SEQ ID NO: 2998017 - DNA, 21 bp, Homo sapiens
ctttttgttgtaaaacaaaat

SEQ ID NO: 2998018 - DNA, 13 bp, Homo sapiens
ctttttgtttcac

SEQ ID NO: 2998019 - DNA, 18 bp, Homo sapiens
cttttttaaatattttct

SEQ ID NO: 2998020 - DNA, 16 bp, Homo sapiens
cttttttatcatttct

SEQ ID NO: 2998021 - DNA, 13 bp, Homo sapiens
cttttttcaaaat

SEQ ID NO: 2998022 - DNA, 13 bp, Homo sapiens
cttttttcctcct

SEQ ID NO: 2998023 - DNA, 23 bp, Homo sapiens
cttttttcctcctttctctgtat

SEQ ID NO: 2998024 - DNA, 21 bp, Homo sapiens
cttttttctaaacctgtgcct

SEQ ID NO: 2998025 - DNA, 22 bp, Homo sapiens
cttttttctaaacctgtgcctc

SEQ ID NO: 2998026 - DNA, 20 bp, Homo sapiens
cttttttcttaaagcaaagt

SEQ ID NO: 2998027 - DNA, 17 bp, Homo sapiens
cttttttctttaaattt

SEQ ID NO: 2998028 - DNA, 16 bp, Homo sapiens
cttttttctttttcct

SEQ ID NO: 2998029 - DNA, 19 bp, Homo sapiens
cttttttgataaagtttct

SEQ ID NO: 2998030 - DNA, 13 bp, Homo sapiens
ctttttttaaatt

SEQ ID NO: 2998031 - DNA, 16 bp, Homo sapiens
ctttttttccttttta

SEQ ID NO: 2998032 - DNA, 12 bp, Homo sapiens
cttttttttccg

SEQ ID NO: 2998033 - DNA, 21 bp, Homo sapiens
cttttttttctgggtagaagc

SEQ ID NO: 2998034 - DNA, 18 bp, Homo sapiens
gaaaaaaaaaatgcattt

SEQ ID NO: 2998035 - DNA, 21 bp, Homo sapiens
gaaaaaaaaatgccataatac

SEQ ID NO: 2998036 - DNA, 14 bp, Homo sapiens
gaaaaaaaccaaag

SEQ ID NO: 2998037 - DNA, 21 bp, Homo sapiens
gaaaaaaataaatttactgaa

SEQ ID NO: 2998038 - DNA, 13 bp, Homo sapiens
gaaaaaaatgttg

SEQ ID NO: 2998039 - DNA, 16 bp, Homo sapiens
gaaaaaagatttttaa

SEQ ID NO: 2998040 - DNA, 22 bp, Homo sapiens
gaaaaaatcaaggtacaggaaa

SEQ ID NO: 2998041 - DNA, 11 bp, Homo sapiens
gaaaaacaggt

SEQ ID NO: 2998042 - DNA, 18 bp, Homo sapiens
gaaaaacccaaactgaga

SEQ ID NO: 2998043 - DNA, 21 bp, Homo sapiens
gaaaaactgcagtcatcaaca

SEQ ID NO: 2998044 - DNA, 17 bp, Homo sapiens
gaaaaactggcaacatt

SEQ ID NO: 2998045 - DNA, 17 bp, Homo sapiens
gaaaaagaaaaaagggt

SEQ ID NO: 2998046 - DNA, 19 bp, Homo sapiens
gaaaaagaatcggcagtat

SEQ ID NO: 2998047 - DNA, 20 bp, Homo sapiens
gaaaaagactttaaaagtga

SEQ ID NO: 2998048 - DNA, 22 bp, Homo sapiens
gaaaaagcagtaactgacaact

SEQ ID NO: 2998049 - DNA, 14 bp, Homo sapiens
gaaaaagcatgatg

SEQ ID NO: 2998050 - DNA, 18 bp, Homo sapiens
gaaaaagcgctgtttcct

SEQ ID NO: 2998051 - DNA, 23 bp, Homo sapiens
gaaaaataatcaagattttaggg

SEQ ID NO: 2998052 - DNA, 17 bp, Homo sapiens
gaaaaatagcaacttgt

SEQ ID NO: 2998053 - DNA, 20 bp, Homo sapiens
gaaaaatagtgtctttgtga

SEQ ID NO: 2998054 - DNA, 15 bp, Homo sapiens
gaaaaatatttctga

SEQ ID NO: 2998055 - DNA, 15 bp, Homo sapiens
gaaaaatcacttgat

SEQ ID NO: 2998056 - DNA, 21 bp, Homo sapiens
gaaaaatcacttgattcataa

SEQ ID NO: 2998057 - DNA, 16 bp, Homo sapiens
gaaaaatgaaagatga

SEQ ID NO: 2998058 - DNA, 17 bp, Homo sapiens
gaaaaatgaaagatgat

SEQ ID NO: 2998059 - DNA, 16 bp, Homo sapiens
gaaaacaattgttctg

SEQ ID NO: 2998060 - DNA, 11 bp, Homo sapiens
gaaaacactta

SEQ ID NO: 2998061 - DNA, 18 bp, Homo sapiens
gaaaacattgatgaatga

SEQ ID NO: 2998062 - DNA, 14 bp, Homo sapiens
gaaaacccagagag

SEQ ID NO: 2998063 - DNA, 21 bp, Homo sapiens
gaaaacctaagtcctttatgt

SEQ ID NO: 2998064 - DNA, 16 bp, Homo sapiens
gaaaactaattaatta

SEQ ID NO: 2998065 - DNA, 19 bp, Homo sapiens
gaaaactcaaagaatgtgt

SEQ ID NO: 2998066 - DNA, 14 bp, Homo sapiens
gaaaactccagggt

SEQ ID NO: 2998067 - DNA, 13 bp, Homo sapiens
gaaaacttatttt

SEQ ID NO: 2998068 - DNA, 17 bp, Homo sapiens
gaaaacttttctcagat

SEQ ID NO: 2998069 - DNA, 21 bp, Homo sapiens
gaaaagacggatggcaggatc

SEQ ID NO: 2998070 - DNA, 15 bp, Homo sapiens
gaaaagagaaaaaaa

SEQ ID NO: 2998071 - DNA, 13 bp, Homo sapiens
gaaaagagctggg

SEQ ID NO: 2998072 - DNA, 14 bp, Homo sapiens
gaaaagaggagcca

SEQ ID NO: 2998073 - DNA, 23 bp, Homo sapiens
gaaaagatggagtttacaaagat

SEQ ID NO: 2998074 - DNA, 14 bp, Homo sapiens
gaaaagcacctgcc

SEQ ID NO: 2998075 - DNA, 23 bp, Homo sapiens
gaaaagccgaaagggttaatcat

SEQ ID NO: 2998076 - DNA, 22 bp, Homo sapiens
gaaaaggaggggacgggacaga

SEQ ID NO: 2998077 - DNA, 19 bp, Homo sapiens
gaaaaggatattatctacc

SEQ ID NO: 2998078 - DNA, 19 bp, Homo sapiens
gaaaaggatcgaggcatgg

SEQ ID NO: 2998079 - DNA, 22 bp, Homo sapiens
gaaaagggatgctgtaggttga

SEQ ID NO: 2998080 - DNA, 19 bp, Homo sapiens
gaaaagtgcatatttatcc

SEQ ID NO: 2998081 - DNA, 21 bp, Homo sapiens
gaaaagttatttatgctataa

SEQ ID NO: 2998082 - DNA, 11 bp, Homo sapiens
gaaaataaaaa

SEQ ID NO: 2998083 - DNA, 18 bp, Homo sapiens
gaaaataagaatagaaat

SEQ ID NO: 2998084 - DNA, 12 bp, Homo sapiens
gaaaataatcca

SEQ ID NO: 2998085 - DNA, 23 bp, Homo sapiens
gaaaataatctggtgttcttgct

SEQ ID NO: 2998086 - DNA, 19 bp, Homo sapiens
gaaaataatgtaattgtaa

SEQ ID NO: 2998087 - DNA, 16 bp, Homo sapiens
gaaaatataatgatca

SEQ ID NO: 2998088 - DNA, 13 bp, Homo sapiens
gaaaatatactgt

SEQ ID NO: 2998089 - DNA, 20 bp, Homo sapiens
gaaaatatactgtaaagaaa

SEQ ID NO: 2998090 - DNA, 20 bp, Homo sapiens
gaaaatatatgtatttttat

SEQ ID NO: 2998091 - DNA, 22 bp, Homo sapiens
gaaaatatctgctcaaaacttt

SEQ ID NO: 2998092 - DNA, 20 bp, Homo sapiens
gaaaatattctgattggtct

SEQ ID NO: 2998093 - DNA, 13 bp, Homo sapiens
gaaaatatttaaa

SEQ ID NO: 2998094 - DNA, 19 bp, Homo sapiens
gaaaatatttcctgacttg

SEQ ID NO: 2998095 - DNA, 22 bp, Homo sapiens
gaaaatatttcctgacttgagt

SEQ ID NO: 2998096 - DNA, 20 bp, Homo sapiens
gaaaatctgtaaaaaagaaa

SEQ ID NO: 2998097 - DNA, 17 bp, Homo sapiens
gaaaatgagaaaggaca

SEQ ID NO: 2998098 - DNA, 19 bp, Homo sapiens
gaaaatgagaaaggacaga

SEQ ID NO: 2998099 - DNA, 20 bp, Homo sapiens
gaaaatgagaaaggacagag

SEQ ID NO: 2998100 - DNA, 19 bp, Homo sapiens
gaaaatgagtatttggtcc

SEQ ID NO: 2998101 - DNA, 20 bp, Homo sapiens
gaaaatgagtatttggtcca

SEQ ID NO: 2998102 - DNA, 15 bp, Homo sapiens
gaaaatgcaccaaat

SEQ ID NO: 2998103 - DNA, 21 bp, Homo sapiens
gaaaatgcattgtatcgatgt

SEQ ID NO: 2998104 - DNA, 19 bp, Homo sapiens
gaaaatgctagaagaaaac

SEQ ID NO: 2998105 - DNA, 20 bp, Homo sapiens
gaaaatgctagaagaaaaca

SEQ ID NO: 2998106 - DNA, 18 bp, Homo sapiens
gaaaatggaaccaggctt

SEQ ID NO: 2998107 - DNA, 11 bp, Homo sapiens
gaaaatggaat

SEQ ID NO: 2998108 - DNA, 16 bp, Homo sapiens
gaaaatggaattactc

SEQ ID NO: 2998109 - DNA, 18 bp, Homo sapiens
gaaaatggaattactcca

SEQ ID NO: 2998110 - DNA, 18 bp, Homo sapiens
gaaaatgtatattttgat

SEQ ID NO: 2998111 - DNA, 14 bp, Homo sapiens
gaaaatgtcttgtg

SEQ ID NO: 2998112 - DNA, 21 bp, Homo sapiens
gaaaatgttgagaatcccaaa

SEQ ID NO: 2998113 - DNA, 20 bp, Homo sapiens
gaaaattaggcctcaaatga

SEQ ID NO: 2998114 - DNA, 14 bp, Homo sapiens
gaaaattgtataaa

SEQ ID NO: 2998115 - DNA, 15 bp, Homo sapiens
gaaaatttgccaatc

SEQ ID NO: 2998116 - DNA, 17 bp, Homo sapiens
gaaaatttgttattttg

SEQ ID NO: 2998117 - DNA, 14 bp, Homo sapiens
gaaaatttgtttga

SEQ ID NO: 2998118 - DNA, 20 bp, Homo sapiens
gaaaattttatgtattttaa

SEQ ID NO: 2998119 - DNA, 21 bp, Homo sapiens
gaaacaaaaaacaccaaaaat

SEQ ID NO: 2998120 - DNA, 22 bp, Homo sapiens
gaaacaaaaatgatcctcagtg

SEQ ID NO: 2998121 - DNA, 15 bp, Homo sapiens
ctttgggccctgcat

SEQ ID NO: 2998122 - DNA, 14 bp, Homo sapiens
ctttggggaaaaat

SEQ ID NO: 2998123 - DNA, 19 bp, Homo sapiens
ctttggggaaaaattcttg

SEQ ID NO: 2998124 - DNA, 20 bp, Homo sapiens
ctttggggaaaaattcttgg

SEQ ID NO: 2998125 - DNA, 17 bp, Homo sapiens
ctttggggttttttaat

SEQ ID NO: 2998126 - DNA, 14 bp, Homo sapiens
ctttgggtcatttt

SEQ ID NO: 2998127 - DNA, 17 bp, Homo sapiens
ctttgggtcatttttaa

SEQ ID NO: 2998128 - DNA, 16 bp, Homo sapiens
ctttgggtcctgggca

SEQ ID NO: 2998129 - DNA, 17 bp, Homo sapiens
ctttggtaggtaaatct

SEQ ID NO: 2998130 - DNA, 13 bp, Homo sapiens
ctttggttctaag

SEQ ID NO: 2998131 - DNA, 16 bp, Homo sapiens
ctttggttctaaggac

SEQ ID NO: 2998132 - DNA, 14 bp, Homo sapiens
ctttggttctggcc

SEQ ID NO: 2998133 - DNA, 14 bp, Homo sapiens
ctttggttggaact

SEQ ID NO: 2998134 - DNA, 18 bp, Homo sapiens
ctttgtaagaactaaaga

SEQ ID NO: 2998135 - DNA, 15 bp, Homo sapiens
ctttgtagcactcag

SEQ ID NO: 2998136 - DNA, 16 bp, Homo sapiens
ctttgtagttactcaa

SEQ ID NO: 2998137 - DNA, 12 bp, Homo sapiens
ctttgtatatta

SEQ ID NO: 2998138 - DNA, 13 bp, Homo sapiens
ctttgtatattac

SEQ ID NO: 2998139 - DNA, 14 bp, Homo sapiens
ctttgtatattaca

SEQ ID NO: 2998140 - DNA, 20 bp, Homo sapiens
ctttgtatgtcatttccttc

SEQ ID NO: 2998141 - DNA, 17 bp, Homo sapiens
ctttgtcccaccaactt

SEQ ID NO: 2998142 - DNA, 16 bp, Homo sapiens
ctttgtcccctgcttc

SEQ ID NO: 2998143 - DNA, 21 bp, Homo sapiens
ctttgtcctgaatggctttgt

SEQ ID NO: 2998144 - DNA, 17 bp, Homo sapiens
ctttgtcctttttgtta

SEQ ID NO: 2998145 - DNA, 15 bp, Homo sapiens
ctttgtctaaaacaa

SEQ ID NO: 2998146 - DNA, 16 bp, Homo sapiens
ctttgtgcaaaagcag

SEQ ID NO: 2998147 - DNA, 17 bp, Homo sapiens
ctttgtgcaaaagcagg

SEQ ID NO: 2998148 - DNA, 11 bp, Homo sapiens
ctttgtgctga

SEQ ID NO: 2998149 - DNA, 18 bp, Homo sapiens
ctttgtggccaaggagct

SEQ ID NO: 2998150 - DNA, 20 bp, Homo sapiens
ctttgtggccaaggagctgc

SEQ ID NO: 2998151 - DNA, 21 bp, Homo sapiens
ctttgtggccaaggagctgct

SEQ ID NO: 2998152 - DNA, 22 bp, Homo sapiens
ctttgtggccaaggagctgcta

SEQ ID NO: 2998153 - DNA, 16 bp, Homo sapiens
ctttgtggcttctctt

SEQ ID NO: 2998154 - DNA, 23 bp, Homo sapiens
ctttgtgtttctattgacttcaa

SEQ ID NO: 2998155 - DNA, 21 bp, Homo sapiens
ctttgtgtttgcttggtgctg

SEQ ID NO: 2998156 - DNA, 16 bp, Homo sapiens
ctttgttacaataaaa

SEQ ID NO: 2998157 - DNA, 22 bp, Homo sapiens
ctttgttactgaaatgagcctc

SEQ ID NO: 2998158 - DNA, 13 bp, Homo sapiens
ctttgttcctgct

SEQ ID NO: 2998159 - DNA, 14 bp, Homo sapiens
ctttgttcctgctt

SEQ ID NO: 2998160 - DNA, 18 bp, Homo sapiens
ctttgttcctgctttctc

SEQ ID NO: 2998161 - DNA, 23 bp, Homo sapiens
ctttgttctgagcattcgctgta

SEQ ID NO: 2998162 - DNA, 18 bp, Homo sapiens
ctttgttcttgtcatcag

SEQ ID NO: 2998163 - DNA, 11 bp, Homo sapiens
ctttgttgcac

SEQ ID NO: 2998164 - DNA, 18 bp, Homo sapiens
ctttgttgtctacattaa

SEQ ID NO: 2998165 - DNA, 22 bp, Homo sapiens
ctttgttttaaaaagcatcaga

SEQ ID NO: 2998166 - DNA, 13 bp, Homo sapiens
ctttgtttttcca

SEQ ID NO: 2998167 - DNA, 22 bp, Homo sapiens
ctttgtttttccatgtgttttg

SEQ ID NO: 2998168 - DNA, 16 bp, Homo sapiens
cttttaaaaatacaat

SEQ ID NO: 2998169 - DNA, 22 bp, Homo sapiens
cttttaaaaatacaattattgt

SEQ ID NO: 2998170 - DNA, 20 bp, Homo sapiens
cttttaaaataaattctctc

SEQ ID NO: 2998171 - DNA, 14 bp, Homo sapiens
cttttaaacaaaag

SEQ ID NO: 2998172 - DNA, 18 bp, Homo sapiens
cttttaaagactacctgg

SEQ ID NO: 2998173 - DNA, 17 bp, Homo sapiens
cttttaaataaattatg

SEQ ID NO: 2998174 - DNA, 22 bp, Homo sapiens
cttttaacagagtctgaaccta

SEQ ID NO: 2998175 - DNA, 18 bp, Homo sapiens
cttttaacgtatgtattt

SEQ ID NO: 2998176 - DNA, 22 bp, Homo sapiens
cttttaacgtatgtatttcatt

SEQ ID NO: 2998177 - DNA, 16 bp, Homo sapiens
cttttaagtaaggtcc

SEQ ID NO: 2998178 - DNA, 18 bp, Homo sapiens
cttttaagtttttctctt

SEQ ID NO: 2998179 - DNA, 23 bp, Homo sapiens
cttttaatcatgagcctgtttat

SEQ ID NO: 2998180 - DNA, 15 bp, Homo sapiens
cttttacatacagtg

SEQ ID NO: 2998181 - DNA, 13 bp, Homo sapiens
cttttacattctg

SEQ ID NO: 2998182 - DNA, 19 bp, Homo sapiens
cttttaccagtttctttgt

SEQ ID NO: 2998183 - DNA, 15 bp, Homo sapiens
cttttaccattttat

SEQ ID NO: 2998184 - DNA, 14 bp, Homo sapiens
cttttacttgttca

SEQ ID NO: 2998185 - DNA, 18 bp, Homo sapiens
cttttagacttttagcat

SEQ ID NO: 2998186 - DNA, 18 bp, Homo sapiens
cttttagtaaaaacattt

SEQ ID NO: 2998187 - DNA, 10 bp, Homo sapiens
cttttataaa

SEQ ID NO: 2998188 - DNA, 13 bp, Homo sapiens
cttttataataat

SEQ ID NO: 2998189 - DNA, 12 bp, Homo sapiens
cttttatactct

SEQ ID NO: 2998190 - DNA, 20 bp, Homo sapiens
cttttatactctttctgtat

SEQ ID NO: 2998191 - DNA, 12 bp, Homo sapiens
cttttatagttg

SEQ ID NO: 2998192 - DNA, 17 bp, Homo sapiens
cttttatcaataaagca

SEQ ID NO: 2998193 - DNA, 19 bp, Homo sapiens
cttttatcacgatattatt

SEQ ID NO: 2998194 - DNA, 18 bp, Homo sapiens
cttttatccactggcatt

SEQ ID NO: 2998195 - DNA, 18 bp, Homo sapiens
cttttatgcaaaaggttt

SEQ ID NO: 2998196 - DNA, 22 bp, Homo sapiens
cttttatgtagtaattgacatg

SEQ ID NO: 2998197 - DNA, 14 bp, Homo sapiens
cttttattaatgca

SEQ ID NO: 2998198 - DNA, 19 bp, Homo sapiens
cttttattaatgcactttc

SEQ ID NO: 2998199 - DNA, 14 bp, Homo sapiens
cttttattagccag

SEQ ID NO: 2998200 - DNA, 18 bp, Homo sapiens
cttttattgacacagaaa

SEQ ID NO: 2998201 - DNA, 15 bp, Homo sapiens
cttttatttcagtgc

SEQ ID NO: 2998202 - DNA, 23 bp, Homo sapiens
cttttatttcattcatatcctcc

SEQ ID NO: 2998203 - DNA, 21 bp, Homo sapiens
cttttattttacacagaaaca

SEQ ID NO: 2998204 - DNA, 22 bp, Homo sapiens
cttttattttacacagaaacac

SEQ ID NO: 2998205 - DNA, 15 bp, Homo sapiens
cttttcaatgacatt

SEQ ID NO: 2998206 - DNA, 21 bp, Homo sapiens
cttttcacatgctaatgtgca

SEQ ID NO: 2998207 - DNA, 14 bp, Homo sapiens
cttttcacattctt

SEQ ID NO: 2998208 - DNA, 21 bp, Homo sapiens
cttttcacttcctctccacag

SEQ ID NO: 2998209 - DNA, 23 bp, Homo sapiens
cttttcagcgatgtatgcagcta

SEQ ID NO: 2998210 - DNA, 17 bp, Homo sapiens
cttttcatctgggaaag

SEQ ID NO: 2998211 - DNA, 16 bp, Homo sapiens
cttttcattgcaaagt

SEQ ID NO: 2998212 - DNA, 19 bp, Homo sapiens
cttttcccatttgtaattt

SEQ ID NO: 2998213 - DNA, 14 bp, Homo sapiens
cttttccccggtcc

SEQ ID NO: 2998214 - DNA, 15 bp, Homo sapiens
cttttcccttgcttc

SEQ ID NO: 2998215 - DNA, 22 bp, Homo sapiens
cttttcctctctctccctcttt

SEQ ID NO: 2998216 - DNA, 15 bp, Homo sapiens
cttttcctctctgtc

SEQ ID NO: 2998217 - DNA, 12 bp, Homo sapiens
cttttcctgaag

SEQ ID NO: 2998218 - DNA, 14 bp, Homo sapiens
cttttcctgggcct

SEQ ID NO: 2998219 - DNA, 13 bp, Homo sapiens
cttttcctgtgtt

SEQ ID NO: 2998220 - DNA, 23 bp, Homo sapiens
cttttcgagcatgcggagccagc

SEQ ID NO: 2998221 - DNA, 14 bp, Homo sapiens
cttttctaaatcct

SEQ ID NO: 2998222 - DNA, 21 bp, Homo sapiens
cttttctaagtggcgtgtgca

SEQ ID NO: 2998223 - DNA, 23 bp, Homo sapiens
cttttctatgttgctattgtaag

SEQ ID NO: 2998224 - DNA, 16 bp, Homo sapiens
cttttctattaatcat

SEQ ID NO: 2998225 - DNA, 13 bp, Homo sapiens
cttttctcagctg

SEQ ID NO: 2998226 - DNA, 10 bp, Homo sapiens
cttttctctc

SEQ ID NO: 2998227 - DNA, 12 bp, Homo sapiens
cttttctggcac

SEQ ID NO: 2998228 - DNA, 15 bp, Homo sapiens
cttttctggcaccgc

SEQ ID NO: 2998229 - DNA, 17 bp, Homo sapiens
cttttctgggtatgtgc

SEQ ID NO: 2998230 - DNA, 23 bp, Homo sapiens
cttttctgtgaagccctttgcct

SEQ ID NO: 2998231 - DNA, 14 bp, Homo sapiens
cttttcttctatgt

SEQ ID NO: 2998232 - DNA, 23 bp, Homo sapiens
cttttcttggaactgtcccagct

SEQ ID NO: 2998233 - DNA, 13 bp, Homo sapiens
cttttgaaacaat

SEQ ID NO: 2998234 - DNA, 16 bp, Homo sapiens
cttttgaaacaatact

SEQ ID NO: 2998235 - DNA, 14 bp, Homo sapiens
cttttgaacccagg

SEQ ID NO: 2998236 - DNA, 18 bp, Homo sapiens
cttttgaacccaggagtt

SEQ ID NO: 2998237 - DNA, 15 bp, Homo sapiens
cttttgaagaacaaa

SEQ ID NO: 2998238 - DNA, 15 bp, Homo sapiens
cttttgacattttat

SEQ ID NO: 2998239 - DNA, 16 bp, Homo sapiens
cttttgataaaatgtt

SEQ ID NO: 2998240 - DNA, 17 bp, Homo sapiens
cttttgataaaatgttc

SEQ ID NO: 2998241 - DNA, 18 bp, Homo sapiens
cttttgcaaggttccaca

SEQ ID NO: 2998242 - DNA, 19 bp, Homo sapiens
cttttgcaaggttccacag

SEQ ID NO: 2998243 - DNA, 14 bp, Homo sapiens
cttttgcagaaaaa

SEQ ID NO: 2998244 - DNA, 15 bp, Homo sapiens
cttttgccctttgat

SEQ ID NO: 2998245 - DNA, 14 bp, Homo sapiens
cttttgctttattc

SEQ ID NO: 2998246 - DNA, 14 bp, Homo sapiens
cttttggcctcctg

SEQ ID NO: 2998247 - DNA, 22 bp, Homo sapiens
cttttggcctcctgcaaagtct

SEQ ID NO: 2998248 - DNA, 19 bp, Homo sapiens
cttttggtgtgttggacag

SEQ ID NO: 2998249 - DNA, 16 bp, Homo sapiens
cttttgtaattgtgta

SEQ ID NO: 2998250 - DNA, 19 bp, Homo sapiens
cttttgtccttcctgtgcc

SEQ ID NO: 2998251 - DNA, 20 bp, Homo sapiens
cttttgtccttcctgtgccc

SEQ ID NO: 2998252 - DNA, 16 bp, Homo sapiens
cttttgtctaattaaa

SEQ ID NO: 2998253 - DNA, 12 bp, Homo sapiens
cttttgttctga

SEQ ID NO: 2998254 - DNA, 11 bp, Homo sapiens
cttttgtttca

SEQ ID NO: 2998255 - DNA, 13 bp, Homo sapiens
cttttgttttggt

SEQ ID NO: 2998256 - DNA, 21 bp, Homo sapiens
cttttgtttttccagttccag

SEQ ID NO: 2998257 - DNA, 23 bp, Homo sapiens
cttttgtttttggctttcctggt

SEQ ID NO: 2998258 - DNA, 13 bp, Homo sapiens
ctttttaaaaata

SEQ ID NO: 2998259 - DNA, 21 bp, Homo sapiens
cttcaggcatggggggtgggg

SEQ ID NO: 2998260 - DNA, 17 bp, Homo sapiens
cttcaggctctgcccag

SEQ ID NO: 2998261 - DNA, 13 bp, Homo sapiens
ctgttttaaaaga

SEQ ID NO: 2998262 - DNA, 14 bp, Homo sapiens
ctgttttaaattgc

SEQ ID NO: 2998263 - DNA, 17 bp, Homo sapiens
ctgttttagtgccaggc

SEQ ID NO: 2998264 - DNA, 20 bp, Homo sapiens
ctgttttatctccatacttt

SEQ ID NO: 2998265 - DNA, 15 bp, Homo sapiens
ctgttttcctccctt

SEQ ID NO: 2998266 - DNA, 16 bp, Homo sapiens
ctgttttcctcccttc

SEQ ID NO: 2998267 - DNA, 17 bp, Homo sapiens
ctgttttcctcccttct

SEQ ID NO: 2998268 - DNA, 20 bp, Homo sapiens
ctgttttcctcccttctgct

SEQ ID NO: 2998269 - DNA, 20 bp, Homo sapiens
ctgttttcgtaccttcccac

SEQ ID NO: 2998270 - DNA, 20 bp, Homo sapiens
ctgttttctgtgcactgtag

SEQ ID NO: 2998271 - DNA, 14 bp, Homo sapiens
ctgtttttccatag

SEQ ID NO: 2998272 - DNA, 22 bp, Homo sapiens
cttaaaaatgttttttcatgtg

SEQ ID NO: 2998273 - DNA, 23 bp, Homo sapiens
cttaaaaatgttttttcatgtgt

SEQ ID NO: 2998274 - DNA, 20 bp, Homo sapiens
cttaaaaccttgaaggtctg

SEQ ID NO: 2998275 - DNA, 24 bp, Homo sapiens
cttaaaatgttcacttttgacaaa

SEQ ID NO: 2998276 - DNA, 13 bp, Homo sapiens
cttaaacaaaaat

SEQ ID NO: 2998277 - DNA, 19 bp, Homo sapiens
cttaaacaaaaattaaaat

SEQ ID NO: 2998278 - DNA, 15 bp, Homo sapiens
cttaaacacccctca

SEQ ID NO: 2998279 - DNA, 16 bp, Homo sapiens
cttaaaccaggaaaaa

SEQ ID NO: 2998280 - DNA, 19 bp, Homo sapiens
cttaaactctcttcttcca

SEQ ID NO: 2998281 - DNA, 14 bp, Homo sapiens
cttaaacttgaccc

SEQ ID NO: 2998282 - DNA, 14 bp, Homo sapiens
cttaaagtcaggag

SEQ ID NO: 2998283 - DNA, 16 bp, Homo sapiens
cttagtaactttttat

SEQ ID NO: 2998284 - DNA, 19 bp, Homo sapiens
cttagtaactttttatgta

SEQ ID NO: 2998285 - DNA, 21 bp, Homo sapiens
cttagtaatgctacgtgtgat

SEQ ID NO: 2998286 - DNA, 21 bp, Homo sapiens
cttagtagattaaaaattata

SEQ ID NO: 2998287 - DNA, 20 bp, Homo sapiens
cttagtcaataaacttgtag

SEQ ID NO: 2998288 - DNA, 20 bp, Homo sapiens
cttagtgtcacctttcttct

SEQ ID NO: 2998289 - DNA, 13 bp, Homo sapiens
cttagtgtttctg

SEQ ID NO: 2998290 - DNA, 17 bp, Homo sapiens
cttagtgtttctgtgca

SEQ ID NO: 2998291 - DNA, 18 bp, Homo sapiens
cttagtgtttctgtgcat

SEQ ID NO: 2998292 - DNA, 21 bp, Homo sapiens
cttagtgttttaaaacacctc

SEQ ID NO: 2998293 - DNA, 23 bp, Homo sapiens
cttagtttctaaccaaagagtct

SEQ ID NO: 2998294 - DNA, 20 bp, Homo sapiens
cttataaaccttgtcaataa

SEQ ID NO: 2998295 - DNA, 17 bp, Homo sapiens
cttataaatatgaagct

SEQ ID NO: 2998296 - DNA, 13 bp, Homo sapiens
cttataatttaaa

SEQ ID NO: 2998297 - DNA, 16 bp, Homo sapiens
cttatacatcacttcc

SEQ ID NO: 2998298 - DNA, 17 bp, Homo sapiens
cttatacatcacttcct

SEQ ID NO: 2998299 - DNA, 21 bp, Homo sapiens
cttatacatcacttcctgttt

SEQ ID NO: 2998300 - DNA, 18 bp, Homo sapiens
cttatactgtacaataaa

SEQ ID NO: 2998301 - DNA, 19 bp, Homo sapiens
cttatactgtacaataaaa

SEQ ID NO: 2998302 - DNA, 14 bp, Homo sapiens
cttatagaataaaa

SEQ ID NO: 2998303 - DNA, 17 bp, Homo sapiens
cttatagaataaaagct

SEQ ID NO: 2998304 - DNA, 20 bp, Homo sapiens
cttatagaataaaagctgtg

SEQ ID NO: 2998305 - DNA, 21 bp, Homo sapiens
cttatagaataaaagctgtgg

SEQ ID NO: 2998306 - DNA, 23 bp, Homo sapiens
cttatagaataaaagctgtggaa

SEQ ID NO: 2998307 - DNA, 21 bp, Homo sapiens
cttatagattttttaaaaaaa

SEQ ID NO: 2998308 - DNA, 23 bp, Homo sapiens
cttatagtcaatgtttcttttat

SEQ ID NO: 2998309 - DNA, 16 bp, Homo sapiens
cttatagtttgggctt

SEQ ID NO: 2998310 - DNA, 17 bp, Homo sapiens
cttatagtttgggcttc

SEQ ID NO: 2998311 - DNA, 20 bp, Homo sapiens
cttatagtttgggcttcagc

SEQ ID NO: 2998312 - DNA, 23 bp, Homo sapiens
cttatagtttgggcttcagccta

SEQ ID NO: 2998313 - DNA, 14 bp, Homo sapiens
cttatatctgaaga

SEQ ID NO: 2998314 - DNA, 15 bp, Homo sapiens
cttatcaattgcaaa

SEQ ID NO: 2998315 - DNA, 15 bp, Homo sapiens
cttatcatccacatt

SEQ ID NO: 2998316 - DNA, 19 bp, Homo sapiens
cttatcatccacattgttt

SEQ ID NO: 2998317 - DNA, 15 bp, Homo sapiens
cttatccctgcccat

SEQ ID NO: 2998318 - DNA, 21 bp, Homo sapiens
cttatcctgctagcaggcccc

SEQ ID NO: 2998319 - DNA, 23 bp, Homo sapiens
cttatcctgctagcaggccccct

SEQ ID NO: 2998320 - DNA, 22 bp, Homo sapiens
cttatccttcatcttttaaaga

SEQ ID NO: 2998321 - DNA, 13 bp, Homo sapiens
cttatccttcctc

SEQ ID NO: 2998322 - DNA, 16 bp, Homo sapiens
cttatctccctgcttc

SEQ ID NO: 2998323 - DNA, 18 bp, Homo sapiens
cttatctccctgcttcat

SEQ ID NO: 2998324 - DNA, 20 bp, Homo sapiens
cttatctgaaacttcccaac

SEQ ID NO: 2998325 - DNA, 18 bp, Homo sapiens
cttatctgagctgagcca

SEQ ID NO: 2998326 - DNA, 22 bp, Homo sapiens
cttatctgagctgagccaggct

SEQ ID NO: 2998327 - DNA, 14 bp, Homo sapiens
cttatctgtgctca

SEQ ID NO: 2998328 - DNA, 14 bp, Homo sapiens
cttatgaatgtttc

SEQ ID NO: 2998329 - DNA, 20 bp, Homo sapiens
cttatgagaacatggtgtgt

SEQ ID NO: 2998330 - DNA, 23 bp, Homo sapiens
cttatgagaacatggtgtgtgtc

SEQ ID NO: 2998331 - DNA, 20 bp, Homo sapiens
cttatgagggtcctctactt

SEQ ID NO: 2998332 - DNA, 23 bp, Homo sapiens
cttatgagtataatgaacactca

SEQ ID NO: 2998333 - DNA, 16 bp, Homo sapiens
cttatgcaaaactttt

SEQ ID NO: 2998334 - DNA, 21 bp, Homo sapiens
cttatgccatgttaatttcat

SEQ ID NO: 2998335 - DNA, 16 bp, Homo sapiens
cttatggaattgattt

SEQ ID NO: 2998336 - DNA, 17 bp, Homo sapiens
cttatggaattgatttg

SEQ ID NO: 2998337 - DNA, 21 bp, Homo sapiens
cttatggaattgatttgcatt

SEQ ID NO: 2998338 - DNA, 18 bp, Homo sapiens
cttatggattcatttata

SEQ ID NO: 2998339 - DNA, 15 bp, Homo sapiens
cttatggccacagcc

SEQ ID NO: 2998340 - DNA, 13 bp, Homo sapiens
cttatggtaccag

SEQ ID NO: 2998341 - DNA, 14 bp, Homo sapiens
cttattacataact

SEQ ID NO: 2998342 - DNA, 20 bp, Homo sapiens
cttattacataactgatcta

SEQ ID NO: 2998343 - DNA, 18 bp, Homo sapiens
cttattaggcctcagaaa

SEQ ID NO: 2998344 - DNA, 22 bp, Homo sapiens
cttattcaaagatgataattta

SEQ ID NO: 2998345 - DNA, 12 bp, Homo sapiens
cttattccacag

SEQ ID NO: 2998346 - DNA, 15 bp, Homo sapiens
cttattctctgtttg

SEQ ID NO: 2998347 - DNA, 12 bp, Homo sapiens
cttattctgtag

SEQ ID NO: 2998348 - DNA, 17 bp, Homo sapiens
cttattctttccttctt

SEQ ID NO: 2998349 - DNA, 17 bp, Homo sapiens
cttattcttttataata

SEQ ID NO: 2998350 - DNA, 20 bp, Homo sapiens
cttattgcctagcctataaa

SEQ ID NO: 2998351 - DNA, 16 bp, Homo sapiens
cttatttatatgaagc

SEQ ID NO: 2998352 - DNA, 20 bp, Homo sapiens
cttatttatatgaagcaagc

SEQ ID NO: 2998353 - DNA, 21 bp, Homo sapiens
cttatttatatgaagcaagct

SEQ ID NO: 2998354 - DNA, 22 bp, Homo sapiens
cttatttatatgaagcaagctg

SEQ ID NO: 2998355 - DNA, 18 bp, Homo sapiens
cttatttatattcatcaa

SEQ ID NO: 2998356 - DNA, 20 bp, Homo sapiens
cttatttggaattgacattc

SEQ ID NO: 2998357 - DNA, 20 bp, Homo sapiens
cttattttaagcattgtgag

SEQ ID NO: 2998358 - DNA, 22 bp, Homo sapiens
cttattttgttggtgctttgca

SEQ ID NO: 2998359 - DNA, 16 bp, Homo sapiens
cttatttttctaaacg

SEQ ID NO: 2998360 - DNA, 15 bp, Homo sapiens
cttatttttctgtga

SEQ ID NO: 2998361 - DNA, 21 bp, Homo sapiens
cttcaaaagtaatgcctctgt

SEQ ID NO: 2998362 - DNA, 17 bp, Homo sapiens
cttcaaaagtattttcc

SEQ ID NO: 2998363 - DNA, 23 bp, Homo sapiens
cttcaaaatgttatcttctcaag

SEQ ID NO: 2998364 - DNA, 23 bp, Homo sapiens
cttcaaagccatatggacactgt

SEQ ID NO: 2998365 - DNA, 13 bp, Homo sapiens
cttcaaatgcctg

SEQ ID NO: 2998366 - DNA, 20 bp, Homo sapiens
cttcaaattaaagtgctgtt

SEQ ID NO: 2998367 - DNA, 23 bp, Homo sapiens
cttcaacagaccccctctagaaa

SEQ ID NO: 2998368 - DNA, 21 bp, Homo sapiens
cttcaaccccctcgcctccta

SEQ ID NO: 2998369 - DNA, 21 bp, Homo sapiens
cttcaacgtttcttcactttt

SEQ ID NO: 2998370 - DNA, 22 bp, Homo sapiens
cttcaactcctcgacatcactg

SEQ ID NO: 2998371 - DNA, 15 bp, Homo sapiens
cttcaacttggaaat

SEQ ID NO: 2998372 - DNA, 18 bp, Homo sapiens
cttcaacttgtgcctggg

SEQ ID NO: 2998373 - DNA, 17 bp, Homo sapiens
cttcaagaatcagaaga

SEQ ID NO: 2998374 - DNA, 18 bp, Homo sapiens
cttcaaggacattggtga

SEQ ID NO: 2998375 - DNA, 13 bp, Homo sapiens
cttcaaggcttca

SEQ ID NO: 2998376 - DNA, 22 bp, Homo sapiens
cttcaagtgcatgctctctgca

SEQ ID NO: 2998377 - DNA, 17 bp, Homo sapiens
cttcaatcggcttgtgg

SEQ ID NO: 2998378 - DNA, 21 bp, Homo sapiens
cttcaatcggcttgtgggtga

SEQ ID NO: 2998379 - DNA, 22 bp, Homo sapiens
cttcaatctcgtttagtgccaa

SEQ ID NO: 2998380 - DNA, 16 bp, Homo sapiens
cttcaatgaaaaaatc

SEQ ID NO: 2998381 - DNA, 14 bp, Homo sapiens
cttcaattaaaatt

SEQ ID NO: 2998382 - DNA, 22 bp, Homo sapiens
cttcaattaaaattacaaaaga

SEQ ID NO: 2998383 - DNA, 19 bp, Homo sapiens
cttcaatttgttaacagag

SEQ ID NO: 2998384 - DNA, 14 bp, Homo sapiens
cttcacaaagccca

SEQ ID NO: 2998385 - DNA, 15 bp, Homo sapiens
cttcacaaagcccaa

SEQ ID NO: 2998386 - DNA, 12 bp, Homo sapiens
cttcacactgca

SEQ ID NO: 2998387 - DNA, 20 bp, Homo sapiens
cttcacactgcaagagcctt

SEQ ID NO: 2998388 - DNA, 22 bp, Homo sapiens
cttcacagtgacactggaccag

SEQ ID NO: 2998389 - DNA, 12 bp, Homo sapiens
cttcacatctcc

SEQ ID NO: 2998390 - DNA, 19 bp, Homo sapiens
cttcaccacctcatgtcat

SEQ ID NO: 2998391 - DNA, 23 bp, Homo sapiens
cttcaccacctcatgtcatttct

SEQ ID NO: 2998392 - DNA, 17 bp, Homo sapiens
cttcaccatttggcaat

SEQ ID NO: 2998393 - DNA, 18 bp, Homo sapiens
cttcaccccaatcccagc

SEQ ID NO: 2998394 - DNA, 15 bp, Homo sapiens
cttcaccctgagttt

SEQ ID NO: 2998395 - DNA, 21 bp, Homo sapiens
cttcacctgattcaactaaaa

SEQ ID NO: 2998396 - DNA, 20 bp, Homo sapiens
cttcacgaagtgttgcatgg

SEQ ID NO: 2998397 - DNA, 13 bp, Homo sapiens
cttcacggcagga

SEQ ID NO: 2998398 - DNA, 16 bp, Homo sapiens
cttcacggcaggacaa

SEQ ID NO: 2998399 - DNA, 19 bp, Homo sapiens
cttcactcttcaaatgcct

SEQ ID NO: 2998400 - DNA, 18 bp, Homo sapiens
cttcactggcgccttctc

SEQ ID NO: 2998401 - DNA, 21 bp, Homo sapiens
cttcactggcgccttctcgga

SEQ ID NO: 2998402 - DNA, 22 bp, Homo sapiens
cttcactggcgccttctcggag

SEQ ID NO: 2998403 - DNA, 16 bp, Homo sapiens
cttcacttacaagaaa

SEQ ID NO: 2998404 - DNA, 15 bp, Homo sapiens
cttcacttcctccag

SEQ ID NO: 2998405 - DNA, 21 bp, Homo sapiens
cttcacttttgcaaggttcca

SEQ ID NO: 2998406 - DNA, 19 bp, Homo sapiens
cttcagaacagaggcattt

SEQ ID NO: 2998407 - DNA, 20 bp, Homo sapiens
cttcagatcagtgcttgagt

SEQ ID NO: 2998408 - DNA, 15 bp, Homo sapiens
cttcagcattgtaat

SEQ ID NO: 2998409 - DNA, 23 bp, Homo sapiens
cttcagctccagcccctttccaa

SEQ ID NO: 2998410 - DNA, 14 bp, Homo sapiens
cttcagctggtgga

SEQ ID NO: 2998411 - DNA, 18 bp, Homo sapiens
cttcagcttcttcatctt

SEQ ID NO: 2998412 - DNA, 16 bp, Homo sapiens
cttcagctttgtgtat

SEQ ID NO: 2998413 - DNA, 23 bp, Homo sapiens
cttcaggaacacccccatgacat

SEQ ID NO: 2998414 - DNA, 16 bp, Homo sapiens
cttcaggagtttcatg

SEQ ID NO: 2998415 - DNA, 19 bp, Homo sapiens
cttcaggagtttcatgttg

SEQ ID NO: 2998416 - DNA, 22 bp, Homo sapiens
cttcaggatgcacggtttctgt

SEQ ID NO: 2998417 - DNA, 18 bp, Homo sapiens
ctgtatttaaaaatagaa

SEQ ID NO: 2998418 - DNA, 19 bp, Homo sapiens
ctgtatttaaaaatagaaa

SEQ ID NO: 2998419 - DNA, 14 bp, Homo sapiens
ctgtatttaaggaa

SEQ ID NO: 2998420 - DNA, 23 bp, Homo sapiens
ctgtatttacagacacacccagt

SEQ ID NO: 2998421 - DNA, 22 bp, Homo sapiens
ctgtatttcactctttctccct

SEQ ID NO: 2998422 - DNA, 12 bp, Homo sapiens
ctgtatttgtga

SEQ ID NO: 2998423 - DNA, 20 bp, Homo sapiens
ctgtatttgtgactaattgt

SEQ ID NO: 2998424 - DNA, 15 bp, Homo sapiens
ctgtattttgagttt

SEQ ID NO: 2998425 - DNA, 21 bp, Homo sapiens
ctgtattttgagtttcagctg

SEQ ID NO: 2998426 - DNA, 20 bp, Homo sapiens
ctgtattttgtattgtttca

SEQ ID NO: 2998427 - DNA, 20 bp, Homo sapiens
ctgtattttgttttcctttt

SEQ ID NO: 2998428 - DNA, 21 bp, Homo sapiens
ctgtattttttcttgcattga

SEQ ID NO: 2998429 - DNA, 18 bp, Homo sapiens
ctgtcaaacaaagccaga

SEQ ID NO: 2998430 - DNA, 22 bp, Homo sapiens
ctgtcaaacaaagccagaagct

SEQ ID NO: 2998431 - DNA, 22 bp, Homo sapiens
ctgtcaagagtagttatataat

SEQ ID NO: 2998432 - DNA, 14 bp, Homo sapiens
ctgtcacatagttt

SEQ ID NO: 2998433 - DNA, 19 bp, Homo sapiens
ctgtcaccacatcttgtct

SEQ ID NO: 2998434 - DNA, 15 bp, Homo sapiens
ctgtcacccagtctg

SEQ ID NO: 2998435 - DNA, 19 bp, Homo sapiens
ctgtcactcaggctggagt

SEQ ID NO: 2998436 - DNA, 12 bp, Homo sapiens
ctgtcactgccg

SEQ ID NO: 2998437 - DNA, 15 bp, Homo sapiens
ctgtcagatgtcaca

SEQ ID NO: 2998438 - DNA, 17 bp, Homo sapiens
ctgtcagggagggccag

SEQ ID NO: 2998439 - DNA, 18 bp, Homo sapiens
ctgtcagggagggccagg

SEQ ID NO: 2998440 - DNA, 23 bp, Homo sapiens
ctgtcagggagggccagggaggc

SEQ ID NO: 2998441 - DNA, 14 bp, Homo sapiens
ctgtcagtcacagc

SEQ ID NO: 2998442 - DNA, 15 bp, Homo sapiens
ctgtcagtcacagcc

SEQ ID NO: 2998443 - DNA, 18 bp, Homo sapiens
ctgtcataagcattactt

SEQ ID NO: 2998444 - DNA, 13 bp, Homo sapiens
ctgtcatctgctg

SEQ ID NO: 2998445 - DNA, 14 bp, Homo sapiens
ctgtcatctgtgca

SEQ ID NO: 2998446 - DNA, 16 bp, Homo sapiens
ctgtcattcagaaaaa

SEQ ID NO: 2998447 - DNA, 21 bp, Homo sapiens
ctgtcattttggcatctgcaa

SEQ ID NO: 2998448 - DNA, 16 bp, Homo sapiens
ctgtcattttttttct

SEQ ID NO: 2998449 - DNA, 16 bp, Homo sapiens
ctgtccaacccctccc

SEQ ID NO: 2998450 - DNA, 18 bp, Homo sapiens
ctgtccaacccctccccc

SEQ ID NO: 2998451 - DNA, 23 bp, Homo sapiens
ctgtccaacccctcccccacgtc

SEQ ID NO: 2998452 - DNA, 23 bp, Homo sapiens
ctgtccaacctaacccctttcct

SEQ ID NO: 2998453 - DNA, 12 bp, Homo sapiens
ctgtccacatcc

SEQ ID NO: 2998454 - DNA, 23 bp, Homo sapiens
ctgtccacatccccagagcccag

SEQ ID NO: 2998455 - DNA, 14 bp, Homo sapiens
ctgtccacttgtgg

SEQ ID NO: 2998456 - DNA, 18 bp, Homo sapiens
ctgtccacttgtgggtcc

SEQ ID NO: 2998457 - DNA, 17 bp, Homo sapiens
ctgtccagcagtcactt

SEQ ID NO: 2998458 - DNA, 19 bp, Homo sapiens
ctgtccagcagtcacttcg

SEQ ID NO: 2998459 - DNA, 15 bp, Homo sapiens
ctgtccagcccccag

SEQ ID NO: 2998460 - DNA, 19 bp, Homo sapiens
ctgtccaggcactgagata

SEQ ID NO: 2998461 - DNA, 22 bp, Homo sapiens
ctgtccatatttataggtaccc

SEQ ID NO: 2998462 - DNA, 12 bp, Homo sapiens
ctgtccatcctc

SEQ ID NO: 2998463 - DNA, 18 bp, Homo sapiens
ctgtccatcctcctctcc

SEQ ID NO: 2998464 - DNA, 13 bp, Homo sapiens
ctgtccatctgcc

SEQ ID NO: 2998465 - DNA, 17 bp, Homo sapiens
ctgtgaccaatgtcttg

SEQ ID NO: 2998466 - DNA, 22 bp, Homo sapiens
ctgtgacccacttctcatcaca

SEQ ID NO: 2998467 - DNA, 18 bp, Homo sapiens
ctgtgacccccagctccg

SEQ ID NO: 2998468 - DNA, 14 bp, Homo sapiens
ctgtgacctgcatc

SEQ ID NO: 2998469 - DNA, 17 bp, Homo sapiens
ctgtgactataaagctg

SEQ ID NO: 2998470 - DNA, 16 bp, Homo sapiens
ctgtgactctgggcag

SEQ ID NO: 2998471 - DNA, 19 bp, Homo sapiens
ctgtgagacagtgggaaat

SEQ ID NO: 2998472 - DNA, 16 bp, Homo sapiens
ctgtgaggagccccat

SEQ ID NO: 2998473 - DNA, 14 bp, Homo sapiens
ctgtgaggcagggg

SEQ ID NO: 2998474 - DNA, 18 bp, Homo sapiens
ctgtgaggcaggggcgga

SEQ ID NO: 2998475 - DNA, 17 bp, Homo sapiens
ctgtgagggagtgcaga

SEQ ID NO: 2998476 - DNA, 17 bp, Homo sapiens
ctgtgaggggcccctgg

SEQ ID NO: 2998477 - DNA, 20 bp, Homo sapiens
ctgtgaggggcccctggccc

SEQ ID NO: 2998478 - DNA, 23 bp, Homo sapiens
ctgtgaggggcccctggcccagg

SEQ ID NO: 2998479 - DNA, 22 bp, Homo sapiens
ctgtgaggtttcccaatggtgt

SEQ ID NO: 2998480 - DNA, 14 bp, Homo sapiens
ctgtgatcttattt

SEQ ID NO: 2998481 - DNA, 18 bp, Homo sapiens
ctgtgatcttatttttct

SEQ ID NO: 2998482 - DNA, 14 bp, Homo sapiens
ctgtgatgccctgc

SEQ ID NO: 2998483 - DNA, 19 bp, Homo sapiens
ctgtgattactctttgctt

SEQ ID NO: 2998484 - DNA, 15 bp, Homo sapiens
ctgtgcaaacagtgt

SEQ ID NO: 2998485 - DNA, 16 bp, Homo sapiens
ctgtgcaaacagtgta

SEQ ID NO: 2998486 - DNA, 22 bp, Homo sapiens
ctgtgcaaacagtgtaagctta

SEQ ID NO: 2998487 - DNA, 18 bp, Homo sapiens
ctgtgcaacgccgtgggc

SEQ ID NO: 2998488 - DNA, 19 bp, Homo sapiens
ctgtgcaattactgcctgc

SEQ ID NO: 2998489 - DNA, 22 bp, Homo sapiens
ctgtgcaattactgcctgcaga

SEQ ID NO: 2998490 - DNA, 14 bp, Homo sapiens
ctgtgcactgccca

SEQ ID NO: 2998491 - DNA, 18 bp, Homo sapiens
ctgtgcagaccttactca

SEQ ID NO: 2998492 - DNA, 17 bp, Homo sapiens
ctgtgcagataaacaga

SEQ ID NO: 2998493 - DNA, 15 bp, Homo sapiens
ctgtgcaggagctag

SEQ ID NO: 2998494 - DNA, 17 bp, Homo sapiens
ctgtgcatgtatgtctt

SEQ ID NO: 2998495 - DNA, 14 bp, Homo sapiens
ctgtgcattctcct

SEQ ID NO: 2998496 - DNA, 21 bp, Homo sapiens
ctgtgcccatcatctctgcct

SEQ ID NO: 2998497 - DNA, 22 bp, Homo sapiens
ctgtgccccgcgggctttgttg

SEQ ID NO: 2998498 - DNA, 16 bp, Homo sapiens
ctgtgccgcactctgg

SEQ ID NO: 2998499 - DNA, 23 bp, Homo sapiens
ctgtgccgcactctggcggtggc

SEQ ID NO: 2998500 - DNA, 22 bp, Homo sapiens
ctgtgcctcggcttttctcagc

SEQ ID NO: 2998501 - DNA, 17 bp, Homo sapiens
ctgtgcctgagaattta

SEQ ID NO: 2998502 - DNA, 14 bp, Homo sapiens
ctgtgcctgtctgt

SEQ ID NO: 2998503 - DNA, 23 bp, Homo sapiens
ctgtgccttggtctctccttcct

SEQ ID NO: 2998504 - DNA, 17 bp, Homo sapiens
ctgtgcctttcctatca

SEQ ID NO: 2998505 - DNA, 17 bp, Homo sapiens
ctgtgcgtggaaaaaga

SEQ ID NO: 2998506 - DNA, 18 bp, Homo sapiens
ctgtgcgtggaaaaagac

SEQ ID NO: 2998507 - DNA, 20 bp, Homo sapiens
ctgtgcgtgtggcgtggccc

SEQ ID NO: 2998508 - DNA, 18 bp, Homo sapiens
ctgtgcgttcccttcagt

SEQ ID NO: 2998509 - DNA, 15 bp, Homo sapiens
ctgtgctacagagaa

SEQ ID NO: 2998510 - DNA, 19 bp, Homo sapiens
ctgtgctacagagaaaatc

SEQ ID NO: 2998511 - DNA, 13 bp, Homo sapiens
ctgtgctacgtgt

SEQ ID NO: 2998512 - DNA, 21 bp, Homo sapiens
ctgtgctatcggcagatgatg

SEQ ID NO: 2998513 - DNA, 19 bp, Homo sapiens
ctgtgctcaggactcagaa

SEQ ID NO: 2998514 - DNA, 14 bp, Homo sapiens
ctgtgctccaacct

SEQ ID NO: 2998515 - DNA, 22 bp, Homo sapiens
ctgtgctcccacggggaccact

SEQ ID NO: 2998516 - DNA, 11 bp, Homo sapiens
ctgtgctgaac

SEQ ID NO: 2998517 - DNA, 18 bp, Homo sapiens
ctgtgctgccctgaagaa

SEQ ID NO: 2998518 - DNA, 17 bp, Homo sapiens
ctgtgctggttctgttt

SEQ ID NO: 2998519 - DNA, 13 bp, Homo sapiens
ctgtgctgtgttt

SEQ ID NO: 2998520 - DNA, 20 bp, Homo sapiens
ctgtgcttcgggcccttccc

SEQ ID NO: 2998521 - DNA, 19 bp, Homo sapiens
ctgtggaaaagaaacacgc

SEQ ID NO: 2998522 - DNA, 16 bp, Homo sapiens
ctgtggaaaagccatc

SEQ ID NO: 2998523 - DNA, 18 bp, Homo sapiens
ctgtggaaaagccatctc

SEQ ID NO: 2998524 - DNA, 13 bp, Homo sapiens
ctgtggaaagtgt

SEQ ID NO: 2998525 - DNA, 21 bp, Homo sapiens
ctgtggaaagtgtaaagcatt

SEQ ID NO: 2998526 - DNA, 23 bp, Homo sapiens
ctgtggaaagtgtaaagcattcc

SEQ ID NO: 2998527 - DNA, 17 bp, Homo sapiens
ctgtggaagtccctcag

SEQ ID NO: 2998528 - DNA, 18 bp, Homo sapiens
ctgtggaagtccctcaga

SEQ ID NO: 2998529 - DNA, 15 bp, Homo sapiens
ctgtggacaccactg

SEQ ID NO: 2998530 - DNA, 20 bp, Homo sapiens
ctgtggacaccactgagctc

SEQ ID NO: 2998531 - DNA, 18 bp, Homo sapiens
ctgtggacaggatgagga

SEQ ID NO: 2998532 - DNA, 23 bp, Homo sapiens
ctgtggacaggatgaggacagag

SEQ ID NO: 2998533 - DNA, 22 bp, Homo sapiens
ctgtggactgaccttgtaaaag

SEQ ID NO: 2998534 - DNA, 18 bp, Homo sapiens
ctgtggagactttctgtt

SEQ ID NO: 2998535 - DNA, 20 bp, Homo sapiens
ctgtggagactttctgttac

SEQ ID NO: 2998536 - DNA, 20 bp, Homo sapiens
ctgtggaggggccctccgag

SEQ ID NO: 2998537 - DNA, 16 bp, Homo sapiens
ctgtggagttcctgct

SEQ ID NO: 2998538 - DNA, 17 bp, Homo sapiens
ctgtggagttcctgctc

SEQ ID NO: 2998539 - DNA, 21 bp, Homo sapiens
ctgtggagttcctgctccgtg

SEQ ID NO: 2998540 - DNA, 13 bp, Homo sapiens
ctgtggcagctgc

SEQ ID NO: 2998541 - DNA, 21 bp, Homo sapiens
ctgtggcagctgcccctggca

SEQ ID NO: 2998542 - DNA, 18 bp, Homo sapiens
ctgtggccgcacgcctct

SEQ ID NO: 2998543 - DNA, 21 bp, Homo sapiens
ctgtggccgccatctgcgcag

SEQ ID NO: 2998544 - DNA, 20 bp, Homo sapiens
ctgtggccgttatctggaag

SEQ ID NO: 2998545 - DNA, 18 bp, Homo sapiens
ctgtggcctaacctgccg

SEQ ID NO: 2998546 - DNA, 14 bp, Homo sapiens
ctgtggcggtgcct

SEQ ID NO: 2998547 - DNA, 19 bp, Homo sapiens
ctgtggctccctctctcct

SEQ ID NO: 2998548 - DNA, 21 bp, Homo sapiens
ctgtggctccctctctcctgg

SEQ ID NO: 2998549 - DNA, 22 bp, Homo sapiens
ctgtggctccctctctcctgga

SEQ ID NO: 2998550 - DNA, 23 bp, Homo sapiens
ctgtggctgtctggatccttccc

SEQ ID NO: 2998551 - DNA, 18 bp, Homo sapiens
ctgtgggaaaaaagaaaa

SEQ ID NO: 2998552 - DNA, 18 bp, Homo sapiens
ctgtgggaaggccagctg

SEQ ID NO: 2998553 - DNA, 18 bp, Homo sapiens
ctgtgggaccccaggccc

SEQ ID NO: 2998554 - DNA, 18 bp, Homo sapiens
ctgtgggcaatttagaaa

SEQ ID NO: 2998555 - DNA, 16 bp, Homo sapiens
ctgtgggcgggcccag

SEQ ID NO: 2998556 - DNA, 18 bp, Homo sapiens
ctgtgggcgggcccagca

SEQ ID NO: 2998557 - DNA, 14 bp, Homo sapiens
ctgtggggagccga

SEQ ID NO: 2998558 - DNA, 18 bp, Homo sapiens
ctgtggggagccgagggc

SEQ ID NO: 2998559 - DNA, 23 bp, Homo sapiens
ctgggggacccctggctctgggc

SEQ ID NO: 2998560 - DNA, 16 bp, Homo sapiens
ctgggggagggactgc

SEQ ID NO: 2998561 - DNA, 19 bp, Homo sapiens
ctgggggagggactgctga

SEQ ID NO: 2998562 - DNA, 20 bp, Homo sapiens
ctgggggagggactgctgac

SEQ ID NO: 2998563 - DNA, 13 bp, Homo sapiens
ctgggggcacagg

SEQ ID NO: 2998564 - DNA, 14 bp, Homo sapiens
ctgggggcacagga

SEQ ID NO: 2998565 - DNA, 19 bp, Homo sapiens
ctgggggcacaggaggcag

SEQ ID NO: 2998566 - DNA, 12 bp, Homo sapiens
ctgggggcagat

SEQ ID NO: 2998567 - DNA, 14 bp, Homo sapiens
ctggggggacccag

SEQ ID NO: 2998568 - DNA, 20 bp, Homo sapiens
ctggggggacccagtgcaga

SEQ ID NO: 2998569 - DNA, 14 bp, Homo sapiens
ctgggggtgccagg

SEQ ID NO: 2998570 - DNA, 19 bp, Homo sapiens
ctgggggtgccaggaccag

SEQ ID NO: 2998571 - DNA, 15 bp, Homo sapiens
ctggggtccagggag

SEQ ID NO: 2998572 - DNA, 13 bp, Homo sapiens
ctggggtccccag

SEQ ID NO: 2998573 - DNA, 17 bp, Homo sapiens
ctggggtccccagggct

SEQ ID NO: 2998574 - DNA, 13 bp, Homo sapiens
ctggggtctggag

SEQ ID NO: 2998575 - DNA, 16 bp, Homo sapiens
ctggggtggccaccag

SEQ ID NO: 2998576 - DNA, 17 bp, Homo sapiens
ctggggtggcctgtgtg

SEQ ID NO: 2998577 - DNA, 13 bp, Homo sapiens
ctggggtggggtc

SEQ ID NO: 2998578 - DNA, 14 bp, Homo sapiens
ctggggtggggtca

SEQ ID NO: 2998579 - DNA, 23 bp, Homo sapiens
ctggggttcagcccctcctctgc

SEQ ID NO: 2998580 - DNA, 15 bp, Homo sapiens
ctggggttgtcagct

SEQ ID NO: 2998581 - DNA, 19 bp, Homo sapiens
ctgggtacctgcaagcaga

SEQ ID NO: 2998582 - DNA, 20 bp, Homo sapiens
ctgggtacctgcaagcagaa

SEQ ID NO: 2998583 - DNA, 12 bp, Homo sapiens
ctgggtaggccc

SEQ ID NO: 2998584 - DNA, 20 bp, Homo sapiens
ctgggtaggccccacaaggc

SEQ ID NO: 2998585 - DNA, 19 bp, Homo sapiens
ctgggtcagacccatctct

SEQ ID NO: 2998586 - DNA, 12 bp, Homo sapiens
ctgggtcagtgg

SEQ ID NO: 2998587 - DNA, 16 bp, Homo sapiens
ctgggtcctgcctgca

SEQ ID NO: 2998588 - DNA, 18 bp, Homo sapiens
ctgggtccttgggcctgg

SEQ ID NO: 2998589 - DNA, 14 bp, Homo sapiens
ctgggtctgacctg

SEQ ID NO: 2998590 - DNA, 12 bp, Homo sapiens
ctgggtgccctg

SEQ ID NO: 2998591 - DNA, 16 bp, Homo sapiens
ctgggtgccctgaaag

SEQ ID NO: 2998592 - DNA, 17 bp, Homo sapiens
ctgggtggggctgctcc

SEQ ID NO: 2998593 - DNA, 19 bp, Homo sapiens
ctgggtggtctgcaggcag

SEQ ID NO: 2998594 - DNA, 21 bp, Homo sapiens
ctgggtgtccccgctgctgtg

SEQ ID NO: 2998595 - DNA, 18 bp, Homo sapiens
ctgggttaattcatttgg

SEQ ID NO: 2998596 - DNA, 22 bp, Homo sapiens
ctgggttcaagcaatcctccta

SEQ ID NO: 2998597 - DNA, 18 bp, Homo sapiens
ctgggttgcagacaggaa

SEQ ID NO: 2998598 - DNA, 20 bp, Homo sapiens
ctgggttgccatggcaatgg

SEQ ID NO: 2998599 - DNA, 16 bp, Homo sapiens
ctgggtttacaacaaa

SEQ ID NO: 2998600 - DNA, 22 bp, Homo sapiens
ctgggtttacaacaaacactgt

SEQ ID NO: 2998601 - DNA, 23 bp, Homo sapiens
ctgggtttacaacaaacactgtg

SEQ ID NO: 2998602 - DNA, 16 bp, Homo sapiens
ctgggtttcttttttc

SEQ ID NO: 2998603 - DNA, 16 bp, Homo sapiens
ctgggtttgctgtctt

SEQ ID NO: 2998604 - DNA, 15 bp, Homo sapiens
ctgggtttggcccct

SEQ ID NO: 2998605 - DNA, 16 bp, Homo sapiens
ctgggtttggcccctg

SEQ ID NO: 2998606 - DNA, 22 bp, Homo sapiens
ctgggtttggcccctggaacct

SEQ ID NO: 2998607 - DNA, 22 bp, Homo sapiens
ctgggttttgtattctctgagc

SEQ ID NO: 2998608 - DNA, 22 bp, Homo sapiens
ctggtaaagaaaagcctcagct

SEQ ID NO: 2998609 - DNA, 14 bp, Homo sapiens
ctggtaagcagagg

SEQ ID NO: 2998610 - DNA, 15 bp, Homo sapiens
ctggtaagcagaggc

SEQ ID NO: 2998611 - DNA, 15 bp, Homo sapiens
ctggtaatcttgctc

SEQ ID NO: 2998612 - DNA, 18 bp, Homo sapiens
ctggtacaacggaggcct

SEQ ID NO: 2998613 - DNA, 19 bp, Homo sapiens
ctggtacctggacggtgcg

SEQ ID NO: 2998614 - DNA, 18 bp, Homo sapiens
ctggtactccctctcagg

SEQ ID NO: 2998615 - DNA, 19 bp, Homo sapiens
ctggtactccctctcagga

SEQ ID NO: 2998616 - DNA, 20 bp, Homo sapiens
ctggtactccctctcaggat

SEQ ID NO: 2998617 - DNA, 14 bp, Homo sapiens
ctggtagctgaggg

SEQ ID NO: 2998618 - DNA, 23 bp, Homo sapiens
ctggtatctgcatgtaaaatctt

SEQ ID NO: 2998619 - DNA, 17 bp, Homo sapiens
ctggtatgaataattgc

SEQ ID NO: 2998620 - DNA, 21 bp, Homo sapiens
ctggtatggtgctaatatttt

SEQ ID NO: 2998621 - DNA, 17 bp, Homo sapiens
ctggtcaaacaaactct

SEQ ID NO: 2998622 - DNA, 18 bp, Homo sapiens
ctggtcaaacaaactctc

SEQ ID NO: 2998623 - DNA, 17 bp, Homo sapiens
ctggtcaacctcctgga

SEQ ID NO: 2998624 - DNA, 19 bp, Homo sapiens
ctggtcaatcaacactacc

SEQ ID NO: 2998625 - DNA, 16 bp, Homo sapiens
ctggtcacacacaggt

SEQ ID NO: 2998626 - DNA, 14 bp, Homo sapiens
ctggtcactctgcc

SEQ ID NO: 2998627 - DNA, 15 bp, Homo sapiens
ctggtcactctgccc

SEQ ID NO: 2998628 - DNA, 18 bp, Homo sapiens
ctggtcactctgccctct

SEQ ID NO: 2998629 - DNA, 19 bp, Homo sapiens
ctggtcactctgccctctg

SEQ ID NO: 2998630 - DNA, 24 bp, Homo sapiens
ctggtcactctgccctctgctgct

SEQ ID NO: 2998631 - DNA, 21 bp, Homo sapiens
ctggtcatccttggtgctctt

SEQ ID NO: 2998632 - DNA, 22 bp, Homo sapiens
ctggtccacagggcacctgcca

SEQ ID NO: 2998633 - DNA, 21 bp, Homo sapiens
ctggtcccctccctctgtctt

SEQ ID NO: 2998634 - DNA, 14 bp, Homo sapiens
ctggtcccctgtgg

SEQ ID NO: 2998635 - DNA, 14 bp, Homo sapiens
ctggtccctggtcc

SEQ ID NO: 2998636 - DNA, 16 bp, Homo sapiens
ctggtccctggtcctt

SEQ ID NO: 2998637 - DNA, 23 bp, Homo sapiens
ctggtccctgttttcccacgagg

SEQ ID NO: 2998638 - DNA, 17 bp, Homo sapiens
ctggtccgagctgagga

SEQ ID NO: 2998639 - DNA, 13 bp, Homo sapiens
ctggtcctaccca

SEQ ID NO: 2998640 - DNA, 14 bp, Homo sapiens
ctggtcctggctgc

SEQ ID NO: 2998641 - DNA, 16 bp, Homo sapiens
ctggtcctggctgcac

SEQ ID NO: 2998642 - DNA, 18 bp, Homo sapiens
ctggtcctggctgcactc

SEQ ID NO: 2998643 - DNA, 11 bp, Homo sapiens
ctggtcctgtt

SEQ ID NO: 2998644 - DNA, 14 bp, Homo sapiens
ctggtcctgttttc

SEQ ID NO: 2998645 - DNA, 22 bp, Homo sapiens
ctggtcctgttttctaaaaaaa

SEQ ID NO: 2998646 - DNA, 15 bp, Homo sapiens
ctggtccttcactgg

SEQ ID NO: 2998647 - DNA, 20 bp, Homo sapiens
ctggtctcgaactcctgacc

SEQ ID NO: 2998648 - DNA, 14 bp, Homo sapiens
ctggtctctggctc

SEQ ID NO: 2998649 - DNA, 16 bp, Homo sapiens
ctggtctctggctcta

SEQ ID NO: 2998650 - DNA, 13 bp, Homo sapiens
ctggtctgggagt

SEQ ID NO: 2998651 - DNA, 19 bp, Homo sapiens
ctggtcttgaactgggctc

SEQ ID NO: 2998652 - DNA, 16 bp, Homo sapiens
ctggtcttgaagtcct

SEQ ID NO: 2998653 - DNA, 23 bp, Homo sapiens
ctggtgaacttcaaaagcttttt

SEQ ID NO: 2998654 - DNA, 23 bp, Homo sapiens
ctggtgaccttccaagagcctga

SEQ ID NO: 2998655 - DNA, 13 bp, Homo sapiens
ctggtgagaactg

SEQ ID NO: 2998656 - DNA, 19 bp, Homo sapiens
ctggtgagaactgaggagc

SEQ ID NO: 2998657 - DNA, 21 bp, Homo sapiens
ctggtgaggccggccctgccc

SEQ ID NO: 2998658 - DNA, 22 bp, Homo sapiens
ctggtgaggccggccctgcccc

SEQ ID NO: 2998659 - DNA, 17 bp, Homo sapiens
ctggtgcactttgtaaa

SEQ ID NO: 2998660 - DNA, 21 bp, Homo sapiens
ctggtgccaaatagccccaga

SEQ ID NO: 2998661 - DNA, 22 bp, Homo sapiens
ctggtgccaaatagccccagac

SEQ ID NO: 2998662 - DNA, 14 bp, Homo sapiens
ctggtgcccccaga

SEQ ID NO: 2998663 - DNA, 20 bp, Homo sapiens
ctggtgcccccagacagctg

SEQ ID NO: 2998664 - DNA, 14 bp, Homo sapiens
ctggtgcctccaga

SEQ ID NO: 2998665 - DNA, 20 bp, Homo sapiens
ctggtgcctgagcccctcag

SEQ ID NO: 2998666 - DNA, 17 bp, Homo sapiens
ctggtgctcctgcccag

SEQ ID NO: 2998667 - DNA, 21 bp, Homo sapiens
ctggtgctcgggaagggaggg

SEQ ID NO: 2998668 - DNA, 22 bp, Homo sapiens
ctggtgctcgggaagggagggg

SEQ ID NO: 2998669 - DNA, 15 bp, Homo sapiens
ctggtggacccaggg

SEQ ID NO: 2998670 - DNA, 23 bp, Homo sapiens
ctggtggaggagctgagggaggg

SEQ ID NO: 2998671 - DNA, 16 bp, Homo sapiens
ctggtggatggtgact

SEQ ID NO: 2998672 - DNA, 13 bp, Homo sapiens
ctggtgggccaac

SEQ ID NO: 2998673 - DNA, 14 bp, Homo sapiens
ctggtggtggctcg

SEQ ID NO: 2998674 - DNA, 12 bp, Homo sapiens
ctggtggttcac

SEQ ID NO: 2998675 - DNA, 15 bp, Homo sapiens
ctggtggttgctgtt

SEQ ID NO: 2998676 - DNA, 20 bp, Homo sapiens
ctggtggttgctgttttcct

SEQ ID NO: 2998677 - DNA, 17 bp, Homo sapiens
ctggtggtttttgctct

SEQ ID NO: 2998678 - DNA, 16 bp, Homo sapiens
ctggtgtaatctcaat

SEQ ID NO: 2998679 - DNA, 17 bp, Homo sapiens
ctggtgtaatctcaatg

SEQ ID NO: 2998680 - DNA, 18 bp, Homo sapiens
ctggtgtcaccccagagc

SEQ ID NO: 2998681 - DNA, 17 bp, Homo sapiens
ctggtgtctgctttctc

SEQ ID NO: 2998682 - DNA, 20 bp, Homo sapiens
ctggttatcctgtgctacag

SEQ ID NO: 2998683 - DNA, 19 bp, Homo sapiens
ctggttccgccaggcgctg

SEQ ID NO: 2998684 - DNA, 15 bp, Homo sapiens
ctggttcctgctgtc

SEQ ID NO: 2998685 - DNA, 16 bp, Homo sapiens
ctggttctcaatgaaa

SEQ ID NO: 2998686 - DNA, 22 bp, Homo sapiens
ctggttctgtctagactggcct

SEQ ID NO: 2998687 - DNA, 24 bp, Homo sapiens
ctggttctgtctagactggcctag

SEQ ID NO: 2998688 - DNA, 15 bp, Homo sapiens
ctggttcttgccttc

SEQ ID NO: 2998689 - DNA, 21 bp, Homo sapiens
ctggttcttttaaaattaatt

SEQ ID NO: 2998690 - DNA, 13 bp, Homo sapiens
ctggttgaagaag

SEQ ID NO: 2998691 - DNA, 17 bp, Homo sapiens
cttcctggcccaggcct

SEQ ID NO: 2998692 - DNA, 21 bp, Homo sapiens
cttcctggcccaggccttgct

SEQ ID NO: 2998693 - DNA, 18 bp, Homo sapiens
cttcctggtgagaactga

SEQ ID NO: 2998694 - DNA, 18 bp, Homo sapiens
cttcctgtccagctccaa

SEQ ID NO: 2998695 - DNA, 19 bp, Homo sapiens
cttcctgtccccatctgtc

SEQ ID NO: 2998696 - DNA, 17 bp, Homo sapiens
cttcctgtctgaacaaa

SEQ ID NO: 2998697 - DNA, 17 bp, Homo sapiens
cttcctgtggctccctc

SEQ ID NO: 2998698 - DNA, 18 bp, Homo sapiens
cttcctgtggctccctct

SEQ ID NO: 2998699 - DNA, 15 bp, Homo sapiens
cttcctgtgtgtcca

SEQ ID NO: 2998700 - DNA, 16 bp, Homo sapiens
cttcctgttttaagca

SEQ ID NO: 2998701 - DNA, 15 bp, Homo sapiens
cttccttccctggct

SEQ ID NO: 2998702 - DNA, 20 bp, Homo sapiens
cttccttctcattgctgccc

SEQ ID NO: 2998703 - DNA, 21 bp, Homo sapiens
cttcctttgaccactgtcttt

SEQ ID NO: 2998704 - DNA, 15 bp, Homo sapiens
cttccttttgaggga

SEQ ID NO: 2998705 - DNA, 21 bp, Homo sapiens
cttcctttttttaaattttct

SEQ ID NO: 2998706 - DNA, 23 bp, Homo sapiens
cttcctttttttaaattttctcc

SEQ ID NO: 2998707 - DNA, 15 bp, Homo sapiens
cttcgaaacctggga

SEQ ID NO: 2998708 - DNA, 19 bp, Homo sapiens
cttcgacatgctgccagga

SEQ ID NO: 2998709 - DNA, 15 bp, Homo sapiens
cttcgcatcaaaaga

SEQ ID NO: 2998710 - DNA, 22 bp, Homo sapiens
cttcgcatcaaaagacaattct

SEQ ID NO: 2998711 - DNA, 23 bp, Homo sapiens
cttcgcatcaaaagacaattctt

SEQ ID NO: 2998712 - DNA, 12 bp, Homo sapiens
cttcgctctgct

SEQ ID NO: 2998713 - DNA, 15 bp, Homo sapiens
cttcgctctgctgga

SEQ ID NO: 2998714 - DNA, 19 bp, Homo sapiens
cttcggaaaccttggtgta

SEQ ID NO: 2998715 - DNA, 16 bp, Homo sapiens
cttcggccgagctggt

SEQ ID NO: 2998716 - DNA, 12 bp, Homo sapiens
cttcgggaccag

SEQ ID NO: 2998717 - DNA, 16 bp, Homo sapiens
cttcgggcccttccca

SEQ ID NO: 2998718 - DNA, 19 bp, Homo sapiens
cttcgggctggccatctgg

SEQ ID NO: 2998719 - DNA, 14 bp, Homo sapiens
cttcgggctgtgcc

SEQ ID NO: 2998720 - DNA, 14 bp, Homo sapiens
cttcgtaacttcat

SEQ ID NO: 2998721 - DNA, 21 bp, Homo sapiens
cttcgtgcggaatcagcttct

SEQ ID NO: 2998722 - DNA, 13 bp, Homo sapiens
cttcgttcttttt

SEQ ID NO: 2998723 - DNA, 19 bp, Homo sapiens
cttcgtttactatgcctgt

SEQ ID NO: 2998724 - DNA, 15 bp, Homo sapiens
cttcgtttatatttt

SEQ ID NO: 2998725 - DNA, 16 bp, Homo sapiens
cttctaaactgaagct

SEQ ID NO: 2998726 - DNA, 19 bp, Homo sapiens
cttctaaacttccccatct

SEQ ID NO: 2998727 - DNA, 15 bp, Homo sapiens
cttctaaaggtgttg

SEQ ID NO: 2998728 - DNA, 12 bp, Homo sapiens
cttctaatctta

SEQ ID NO: 2998729 - DNA, 17 bp, Homo sapiens
cttctaatcttaaatca

SEQ ID NO: 2998730 - DNA, 17 bp, Homo sapiens
cttctaattttgtgctc

SEQ ID NO: 2998731 - DNA, 22 bp, Homo sapiens
cttctaattttgtgctctttcc

SEQ ID NO: 2998732 - DNA, 19 bp, Homo sapiens
cttctacggccatgagact

SEQ ID NO: 2998733 - DNA, 13 bp, Homo sapiens
cttctacttctgc

SEQ ID NO: 2998734 - DNA, 13 bp, Homo sapiens
cttctagagttca

SEQ ID NO: 2998735 - DNA, 15 bp, Homo sapiens
cttctagagttttat

SEQ ID NO: 2998736 - DNA, 18 bp, Homo sapiens
cttctagatggaccccag

SEQ ID NO: 2998737 - DNA, 19 bp, Homo sapiens
cttctagggttattgcatt

SEQ ID NO: 2998738 - DNA, 17 bp, Homo sapiens
cttctagttctgccagg

SEQ ID NO: 2998739 - DNA, 18 bp, Homo sapiens
cttctagttctgccagga

SEQ ID NO: 2998740 - DNA, 19 bp, Homo sapiens
cttctagttctgccaggag

SEQ ID NO: 2998741 - DNA, 18 bp, Homo sapiens
cttctatgtaggaaaaaa

SEQ ID NO: 2998742 - DNA, 19 bp, Homo sapiens
cttctatttttatcatgaa

SEQ ID NO: 2998743 - DNA, 20 bp, Homo sapiens
cttctatttttatcatgaat

SEQ ID NO: 2998744 - DNA, 16 bp, Homo sapiens
cttctcaaaagaactt

SEQ ID NO: 2998745 - DNA, 15 bp, Homo sapiens
cttctcaccagctgc

SEQ ID NO: 2998746 - DNA, 17 bp, Homo sapiens
cttctcaccagctgcaa

SEQ ID NO: 2998747 - DNA, 22 bp, Homo sapiens
cttctcaccagctgcaaagtgt

SEQ ID NO: 2998748 - DNA, 17 bp, Homo sapiens
cttctcagctctccacc

SEQ ID NO: 2998749 - DNA, 19 bp, Homo sapiens
cttctcaggaaatggcttt

SEQ ID NO: 2998750 - DNA, 23 bp, Homo sapiens
cttctcagtccagcagtttccag

SEQ ID NO: 2998751 - DNA, 15 bp, Homo sapiens
cttctcatcacacac

SEQ ID NO: 2998752 - DNA, 19 bp, Homo sapiens
cttctcatcacacacatgg

SEQ ID NO: 2998753 - DNA, 12 bp, Homo sapiens
cttctcatctgt

SEQ ID NO: 2998754 - DNA, 17 bp, Homo sapiens
cttctcattgctgcccg

SEQ ID NO: 2998755 - DNA, 23 bp, Homo sapiens
cttgagagtgttcctgagacaga

SEQ ID NO: 2998756 - DNA, 21 bp, Homo sapiens
cttgagcaagttccttctggt

SEQ ID NO: 2998757 - DNA, 16 bp, Homo sapiens
cttgagccctccccag

SEQ ID NO: 2998758 - DNA, 16 bp, Homo sapiens
cttgagctcaggagtt

SEQ ID NO: 2998759 - DNA, 20 bp, Homo sapiens
cttgaggaaacaacagcttt

SEQ ID NO: 2998760 - DNA, 13 bp, Homo sapiens
cttgaggagaagt

SEQ ID NO: 2998761 - DNA, 14 bp, Homo sapiens
cttgaggtctcttt

SEQ ID NO: 2998762 - DNA, 19 bp, Homo sapiens
cttgaggtctcttttctct

SEQ ID NO: 2998763 - DNA, 16 bp, Homo sapiens
cttgagtaggccctgc

SEQ ID NO: 2998764 - DNA, 18 bp, Homo sapiens
cttgagtcatggatttct

SEQ ID NO: 2998765 - DNA, 18 bp, Homo sapiens
cttgagtgttatgtgaat

SEQ ID NO: 2998766 - DNA, 13 bp, Homo sapiens
cttgagtgttcct

SEQ ID NO: 2998767 - DNA, 14 bp, Homo sapiens
cttgagtgttcctt

SEQ ID NO: 2998768 - DNA, 19 bp, Homo sapiens
cttgagtgttcctttttaa

SEQ ID NO: 2998769 - DNA, 23 bp, Homo sapiens
cttgagtgttcctttttaaatgt

SEQ ID NO: 2998770 - DNA, 13 bp, Homo sapiens
cttgatcttaaag

SEQ ID NO: 2998771 - DNA, 21 bp, Homo sapiens
cttgatggaagaaaatggaat

SEQ ID NO: 2998772 - DNA, 16 bp, Homo sapiens
cttgatgtttcctgga

SEQ ID NO: 2998773 - DNA, 14 bp, Homo sapiens
cttgattataaatg

SEQ ID NO: 2998774 - DNA, 21 bp, Homo sapiens
cttgatttgggtggaaaacag

SEQ ID NO: 2998775 - DNA, 14 bp, Homo sapiens
cttgattttcttct

SEQ ID NO: 2998776 - DNA, 23 bp, Homo sapiens
cttgcaaatacctcctccctaat

SEQ ID NO: 2998777 - DNA, 21 bp, Homo sapiens
cttgcaattgttaatcaaaga

SEQ ID NO: 2998778 - DNA, 22 bp, Homo sapiens
cttgcaattgttaatcaaagat

SEQ ID NO: 2998779 - DNA, 12 bp, Homo sapiens
cttgcacctgca

SEQ ID NO: 2998780 - DNA, 13 bp, Homo sapiens
cttgcacctgcat

SEQ ID NO: 2998781 - DNA, 14 bp, Homo sapiens
cttgcacctgcatc

SEQ ID NO: 2998782 - DNA, 13 bp, Homo sapiens
cttgcagaggagc

SEQ ID NO: 2998783 - DNA, 17 bp, Homo sapiens
cttgcagaggagcccag

SEQ ID NO: 2998784 - DNA, 18 bp, Homo sapiens
cttgcagaggagcccagt

SEQ ID NO: 2998785 - DNA, 21 bp, Homo sapiens
cttgcagaggagcccagtggg

SEQ ID NO: 2998786 - DNA, 22 bp, Homo sapiens
cttgcagaggagcccagtgggc

SEQ ID NO: 2998787 - DNA, 18 bp, Homo sapiens
cttgcagctaaggagggg

SEQ ID NO: 2998788 - DNA, 13 bp, Homo sapiens
cttgcagctggcc

SEQ ID NO: 2998789 - DNA, 15 bp, Homo sapiens
cttgcagctggccca

SEQ ID NO: 2998790 - DNA, 17 bp, Homo sapiens
cttgcagctggcccact

SEQ ID NO: 2998791 - DNA, 20 bp, Homo sapiens
cttgcagctggcccactgct

SEQ ID NO: 2998792 - DNA, 17 bp, Homo sapiens
cttgcagtgaagtgttc

SEQ ID NO: 2998793 - DNA, 16 bp, Homo sapiens
cttgcagttcttgagt

SEQ ID NO: 2998794 - DNA, 21 bp, Homo sapiens
cttgcagtttaagatgacact

SEQ ID NO: 2998795 - DNA, 16 bp, Homo sapiens
cttgcagttttgtaag

SEQ ID NO: 2998796 - DNA, 15 bp, Homo sapiens
cttgcatccaactcc

SEQ ID NO: 2998797 - DNA, 19 bp, Homo sapiens
cttgcatccaactccagga

SEQ ID NO: 2998798 - DNA, 20 bp, Homo sapiens
cttgcattcatggttatgaa

SEQ ID NO: 2998799 - DNA, 22 bp, Homo sapiens
cttgcattccagagttaaaatg

SEQ ID NO: 2998800 - DNA, 23 bp, Homo sapiens
cttgcattccagagttaaaatgt

SEQ ID NO: 2998801 - DNA, 14 bp, Homo sapiens
cttgccaaagcaga

SEQ ID NO: 2998802 - DNA, 22 bp, Homo sapiens
cttgccaaagcagattttccta

SEQ ID NO: 2998803 - DNA, 14 bp, Homo sapiens
cttgccaagaaatc

SEQ ID NO: 2998804 - DNA, 21 bp, Homo sapiens
cttgccaagggtccctgtgtg

SEQ ID NO: 2998805 - DNA, 21 bp, Homo sapiens
cttgccagaaccaaattaact

SEQ ID NO: 2998806 - DNA, 12 bp, Homo sapiens
cttgccagagat

SEQ ID NO: 2998807 - DNA, 19 bp, Homo sapiens
cttgccagggctctggggg

SEQ ID NO: 2998808 - DNA, 23 bp, Homo sapiens
cttgccagggctctgggggcaga

SEQ ID NO: 2998809 - DNA, 16 bp, Homo sapiens
cttgccattttaaggt

SEQ ID NO: 2998810 - DNA, 16 bp, Homo sapiens
cttgcccacaggtgcg

SEQ ID NO: 2998811 - DNA, 21 bp, Homo sapiens
cttgcccacaggtgcgggacc

SEQ ID NO: 2998812 - DNA, 23 bp, Homo sapiens
cttgcccagagatgcctccaccg

SEQ ID NO: 2998813 - DNA, 19 bp, Homo sapiens
cttgcccagggtgcagtgt

SEQ ID NO: 2998814 - DNA, 22 bp, Homo sapiens
cttgcccatcgggaccagaaac

SEQ ID NO: 2998815 - DNA, 23 bp, Homo sapiens
cttgcccccatttcacccatggg

SEQ ID NO: 2998816 - DNA, 23 bp, Homo sapiens
cttgccccctgcccgtgtacata

SEQ ID NO: 2998817 - DNA, 19 bp, Homo sapiens
cttgcccctccagagacag

SEQ ID NO: 2998818 - DNA, 23 bp, Homo sapiens
cttgcccctccagagacaggaaa

SEQ ID NO: 2998819 - DNA, 15 bp, Homo sapiens
cttgcccttcctgac

SEQ ID NO: 2998820 - DNA, 18 bp, Homo sapiens
cttgccgcgtcgccctcc

SEQ ID NO: 2998821 - DNA, 13 bp, Homo sapiens
cttgcctgcaggg

SEQ ID NO: 2998822 - DNA, 14 bp, Homo sapiens
cttgcctgcagggc

SEQ ID NO: 2998823 - DNA, 10 bp, Homo sapiens
cttgcctggg

SEQ ID NO: 2998824 - DNA, 12 bp, Homo sapiens
cttgcctgggct

SEQ ID NO: 2998825 - DNA, 16 bp, Homo sapiens
cttgcctgggctgggc

SEQ ID NO: 2998826 - DNA, 16 bp, Homo sapiens
cttgcctgtctaaagc

SEQ ID NO: 2998827 - DNA, 20 bp, Homo sapiens
cttgccttattagagtgtct

SEQ ID NO: 2998828 - DNA, 15 bp, Homo sapiens
cttgccttcctaagc

SEQ ID NO: 2998829 - DNA, 20 bp, Homo sapiens
cttgccttcctaagcctgtg

SEQ ID NO: 2998830 - DNA, 12 bp, Homo sapiens
cttgctagctag

SEQ ID NO: 2998831 - DNA, 17 bp, Homo sapiens
cttgctatattgcccag

SEQ ID NO: 2998832 - DNA, 23 bp, Homo sapiens
cttgctatattgcccaggctggt

SEQ ID NO: 2998833 - DNA, 15 bp, Homo sapiens
cttgctcctggggag

SEQ ID NO: 2998834 - DNA, 15 bp, Homo sapiens
cttgctctcttgtga

SEQ ID NO: 2998835 - DNA, 14 bp, Homo sapiens
cttgctctgtaatc

SEQ ID NO: 2998836 - DNA, 18 bp, Homo sapiens
cttgctcttctccttgat

SEQ ID NO: 2998837 - DNA, 12 bp, Homo sapiens
ctctctaacata

SEQ ID NO: 2998838 - DNA, 21 bp, Homo sapiens
ctctctatgcaaaatgtctgt

SEQ ID NO: 2998839 - DNA, 14 bp, Homo sapiens
ctctctattgtcat

SEQ ID NO: 2998840 - DNA, 14 bp, Homo sapiens
ctctctcagcccca

SEQ ID NO: 2998841 - DNA, 19 bp, Homo sapiens
ctctctcatatcactgaag

SEQ ID NO: 2998842 - DNA, 20 bp, Homo sapiens
ctctctcatatcactgaagg

SEQ ID NO: 2998843 - DNA, 12 bp, Homo sapiens
ctctctccagat

SEQ ID NO: 2998844 - DNA, 17 bp, Homo sapiens
ctctctccagatgtttc

SEQ ID NO: 2998845 - DNA, 14 bp, Homo sapiens
ctctctcccaccct

SEQ ID NO: 2998846 - DNA, 13 bp, Homo sapiens
ctctctcccagga

SEQ ID NO: 2998847 - DNA, 12 bp, Homo sapiens
ctctctccctct

SEQ ID NO: 2998848 - DNA, 20 bp, Homo sapiens
ctctctccctctttctagcc

SEQ ID NO: 2998849 - DNA, 16 bp, Homo sapiens
ctctctccctgcctca

SEQ ID NO: 2998850 - DNA, 17 bp, Homo sapiens
ctctctccctgcctcac

SEQ ID NO: 2998851 - DNA, 9 bp, Homo sapiens
ctctctctc

SEQ ID NO: 2998852 - DNA, 14 bp, Homo sapiens
ctctctcttttcct

SEQ ID NO: 2998853 - DNA, 14 bp, Homo sapiens
ctctctgagtacat

SEQ ID NO: 2998854 - DNA, 20 bp, Homo sapiens
ctctctgcagccagcccagc

SEQ ID NO: 2998855 - DNA, 21 bp, Homo sapiens
ctctctgcagccagcccagcc

SEQ ID NO: 2998856 - DNA, 12 bp, Homo sapiens
ctctctgctctg

SEQ ID NO: 2998857 - DNA, 14 bp, Homo sapiens
ctctctgctctgcg

SEQ ID NO: 2998858 - DNA, 13 bp, Homo sapiens
ctctctggagccc

SEQ ID NO: 2998859 - DNA, 23 bp, Homo sapiens
ctctaccagataactgaggaggg

SEQ ID NO: 2998860 - DNA, 20 bp, Homo sapiens
ctctaccagtgcaggctggc

SEQ ID NO: 2998861 - DNA, 12 bp, Homo sapiens
ctctaccccttt

SEQ ID NO: 2998862 - DNA, 15 bp, Homo sapiens
ctctacccctttctg

SEQ ID NO: 2998863 - DNA, 13 bp, Homo sapiens
ctctacctctctc

SEQ ID NO: 2998864 - DNA, 20 bp, Homo sapiens
ctctacctctctcctctccg

SEQ ID NO: 2998865 - DNA, 22 bp, Homo sapiens
ctctacctgacactcccttggg

SEQ ID NO: 2998866 - DNA, 20 bp, Homo sapiens
ctctactaaaaatacaaaaa

SEQ ID NO: 2998867 - DNA, 16 bp, Homo sapiens
ctctagaagctgtctg

SEQ ID NO: 2998868 - DNA, 20 bp, Homo sapiens
ctctagaggatgaaggctgt

SEQ ID NO: 2998869 - DNA, 13 bp, Homo sapiens
ctctagagtccaa

SEQ ID NO: 2998870 - DNA, 19 bp, Homo sapiens
ctctagatacctaaaacat

SEQ ID NO: 2998871 - DNA, 21 bp, Homo sapiens
ctctagatacctaaaacataa

SEQ ID NO: 2998872 - DNA, 14 bp, Homo sapiens
ctctagatcataag

SEQ ID NO: 2998873 - DNA, 12 bp, Homo sapiens
ctctagattcca

SEQ ID NO: 2998874 - DNA, 15 bp, Homo sapiens
ctctagcaaggctca

SEQ ID NO: 2998875 - DNA, 12 bp, Homo sapiens
ctctaggctctg

SEQ ID NO: 2998876 - DNA, 22 bp, Homo sapiens
ctctagggcagggtgggagccg

SEQ ID NO: 2998877 - DNA, 21 bp, Homo sapiens
ctctaggtaaccagtttaaat

SEQ ID NO: 2998878 - DNA, 17 bp, Homo sapiens
ctctagtagttaaaaaa

SEQ ID NO: 2998879 - DNA, 18 bp, Homo sapiens
ctctatactgccctgagt

SEQ ID NO: 2998880 - DNA, 17 bp, Homo sapiens
ctctatataaaaacaaa

SEQ ID NO: 2998881 - DNA, 14 bp, Homo sapiens
ctctatatgtaata

SEQ ID NO: 2998882 - DNA, 17 bp, Homo sapiens
ctctatcaaatgtgatg

SEQ ID NO: 2998883 - DNA, 23 bp, Homo sapiens
ctctatcggggtcacttgcaatt

SEQ ID NO: 2998884 - DNA, 15 bp, Homo sapiens
ctctatcttgctctg

SEQ ID NO: 2998885 - DNA, 18 bp, Homo sapiens
ctctatcttgctctgtaa

SEQ ID NO: 2998886 - DNA, 14 bp, Homo sapiens
ctctatgagtctag

SEQ ID NO: 2998887 - DNA, 17 bp, Homo sapiens
ctctatgtatattctat

SEQ ID NO: 2998888 - DNA, 21 bp, Homo sapiens
ctctatgtatattctatttta

SEQ ID NO: 2998889 - DNA, 15 bp, Homo sapiens
ctctatgtttacaaa

SEQ ID NO: 2998890 - DNA, 20 bp, Homo sapiens
ctctattatgttatcatcct

SEQ ID NO: 2998891 - DNA, 21 bp, Homo sapiens
ctctattgtaattttgttcct

SEQ ID NO: 2998892 - DNA, 24 bp, Homo sapiens
ctctatttacttctaatcttaaat

SEQ ID NO: 2998893 - DNA, 14 bp, Homo sapiens
ctctatttgagaat

SEQ ID NO: 2998894 - DNA, 20 bp, Homo sapiens
ctctcaaacggcaacattcc

SEQ ID NO: 2998895 - DNA, 21 bp, Homo sapiens
ctctcaaagccatgtgtggag

SEQ ID NO: 2998896 - DNA, 16 bp, Homo sapiens
ctctcaaatccctctc

SEQ ID NO: 2998897 - DNA, 18 bp, Homo sapiens
ctctcaaatccctctcca

SEQ ID NO: 2998898 - DNA, 14 bp, Homo sapiens
ctctcaagtaatat

SEQ ID NO: 2998899 - DNA, 19 bp, Homo sapiens
ctctcacactggttctcaa

SEQ ID NO: 2998900 - DNA, 20 bp, Homo sapiens
ctctcacactggttctcaat

SEQ ID NO: 2998901 - DNA, 14 bp, Homo sapiens
ctctcacattactg

SEQ ID NO: 2998902 - DNA, 16 bp, Homo sapiens
ctctcagcagatttca

SEQ ID NO: 2998903 - DNA, 23 bp, Homo sapiens
ctctcagcataggtatgcttact

SEQ ID NO: 2998904 - DNA, 14 bp, Homo sapiens
ctctcagctcccag

SEQ ID NO: 2998905 - DNA, 17 bp, Homo sapiens
ctctcaggaccaaagct

SEQ ID NO: 2998906 - DNA, 14 bp, Homo sapiens
ctctcaggatccaa

SEQ ID NO: 2998907 - DNA, 16 bp, Homo sapiens
ctctcaggatccaagc

SEQ ID NO: 2998908 - DNA, 13 bp, Homo sapiens
ctctcagtaagaa

SEQ ID NO: 2998909 - DNA, 14 bp, Homo sapiens
ctctcagtgccttc

SEQ ID NO: 2998910 - DNA, 22 bp, Homo sapiens
ctctcagtgccttctctcagct

SEQ ID NO: 2998911 - DNA, 12 bp, Homo sapiens
ctctcagttttt

SEQ ID NO: 2998912 - DNA, 19 bp, Homo sapiens
ctctcatatcactgaagga

SEQ ID NO: 2998913 - DNA, 20 bp, Homo sapiens
ctctcatatcactgaaggat

SEQ ID NO: 2998914 - DNA, 11 bp, Homo sapiens
ctctcatctga

SEQ ID NO: 2998915 - DNA, 17 bp, Homo sapiens
ctctccaatgttctatt

SEQ ID NO: 2998916 - DNA, 15 bp, Homo sapiens
ctctccacaggagcc

SEQ ID NO: 2998917 - DNA, 10 bp, Homo sapiens
ctctccacct

SEQ ID NO: 2998918 - DNA, 17 bp, Homo sapiens
ctctccacctcagcctt

SEQ ID NO: 2998919 - DNA, 18 bp, Homo sapiens
ctctccacctcagccttg

SEQ ID NO: 2998920 - DNA, 19 bp, Homo sapiens
ctctccactcatgtgactc

SEQ ID NO: 2998921 - DNA, 21 bp, Homo sapiens
ctctccactcatgtgactctt

SEQ ID NO: 2998922 - DNA, 14 bp, Homo sapiens
ctctccacttctgg

SEQ ID NO: 2998923 - DNA, 20 bp, Homo sapiens
ctctccagatgtttccagac

SEQ ID NO: 2998924 - DNA, 11 bp, Homo sapiens
ctctccagcct

SEQ ID NO: 2998925 - DNA, 22 bp, Homo sapiens
ctctccagcctcacagatgctg

SEQ ID NO: 2998926 - DNA, 14 bp, Homo sapiens
ctctccatgcaagt

SEQ ID NO: 2998927 - DNA, 22 bp, Homo sapiens
ctctccatgcaagtgctgtttg

SEQ ID NO: 2998928 - DNA, 17 bp, Homo sapiens
ctctcccacatcccact

SEQ ID NO: 2998929 - DNA, 17 bp, Homo sapiens
ctctcccaccctaaggg

SEQ ID NO: 2998930 - DNA, 20 bp, Homo sapiens
ctctcccaccctaagggcag

SEQ ID NO: 2998931 - DNA, 21 bp, Homo sapiens
ctctcccacgggacctggggc

SEQ ID NO: 2998932 - DNA, 16 bp, Homo sapiens
ctctcccattgtccct

SEQ ID NO: 2998933 - DNA, 14 bp, Homo sapiens
ctctcccatttcct

SEQ ID NO: 2998934 - DNA, 13 bp, Homo sapiens
ctctccccagccc

SEQ ID NO: 2998935 - DNA, 15 bp, Homo sapiens
ctctccccctctgtc

SEQ ID NO: 2998936 - DNA, 16 bp, Homo sapiens
ctctccccctctgtct

SEQ ID NO: 2998937 - DNA, 18 bp, Homo sapiens
ctctcccccttaccccac

SEQ ID NO: 2998938 - DNA, 15 bp, Homo sapiens
ctctcccctccccat

SEQ ID NO: 2998939 - DNA, 21 bp, Homo sapiens
ctctcccctccccatctgtgt

SEQ ID NO: 2998940 - DNA, 22 bp, Homo sapiens
ctctcccctccccatctgtgtt

SEQ ID NO: 2998941 - DNA, 15 bp, Homo sapiens
ctctcccctgacctg

SEQ ID NO: 2998942 - DNA, 17 bp, Homo sapiens
ctctcccctgacctgtg

SEQ ID NO: 2998943 - DNA, 17 bp, Homo sapiens
ctctcccgtctcgcctg

SEQ ID NO: 2998944 - DNA, 15 bp, Homo sapiens
ctctccctctaggct

SEQ ID NO: 2998945 - DNA, 23 bp, Homo sapiens
ctctccctctaggctctgccttc

SEQ ID NO: 2998946 - DNA, 12 bp, Homo sapiens
ctctccctctgg

SEQ ID NO: 2998947 - DNA, 18 bp, Homo sapiens
ctctccctctggccctgc

SEQ ID NO: 2998948 - DNA, 15 bp, Homo sapiens
ctctccctctttcta

SEQ ID NO: 2998949 - DNA, 21 bp, Homo sapiens
ctctccctctttctagcctgg

SEQ ID NO: 2998950 - DNA, 12 bp, Homo sapiens
ctctccctgacc

SEQ ID NO: 2998951 - DNA, 22 bp, Homo sapiens
ctctccctgcactccctcctgg

SEQ ID NO: 2998952 - DNA, 22 bp, Homo sapiens
ctctcccttacccatcttgctt

SEQ ID NO: 2998953 - DNA, 16 bp, Homo sapiens
ctctccgaaagaagac

SEQ ID NO: 2998954 - DNA, 20 bp, Homo sapiens
ctctcctcatgttctgcttt

SEQ ID NO: 2998955 - DNA, 13 bp, Homo sapiens
ctctcctccgtgg

SEQ ID NO: 2998956 - DNA, 19 bp, Homo sapiens
ctctcctcctgcccacctg

SEQ ID NO: 2998957 - DNA, 21 bp, Homo sapiens
ctctcctgtccaacctaaccc

SEQ ID NO: 2998958 - DNA, 15 bp, Homo sapiens
ctctcctgtctgaac

SEQ ID NO: 2998959 - DNA, 18 bp, Homo sapiens
ctctccttcctcttggct

SEQ ID NO: 2998960 - DNA, 14 bp, Homo sapiens
ctctccttccttgt

SEQ ID NO: 2998961 - DNA, 12 bp, Homo sapiens
ctctcctttgat

SEQ ID NO: 2998962 - DNA, 14 bp, Homo sapiens
ctctcctttgtata

SEQ ID NO: 2998963 - DNA, 20 bp, Homo sapiens
ctctcctttttctcttcaca

SEQ ID NO: 2998964 - DNA, 17 bp, Homo sapiens
ctctcgcatcttcccaa

SEQ ID NO: 2998965 - DNA, 11 bp, Homo sapiens
ctcattaaatt

SEQ ID NO: 2998966 - DNA, 16 bp, Homo sapiens
ctcattaatgacactt

SEQ ID NO: 2998967 - DNA, 12 bp, Homo sapiens
ctcattagactg

SEQ ID NO: 2998968 - DNA, 18 bp, Homo sapiens
ctcattcagggaagctca

SEQ ID NO: 2998969 - DNA, 13 bp, Homo sapiens
ctcattcatttta

SEQ ID NO: 2998970 - DNA, 13 bp, Homo sapiens
ctcattccccagg

SEQ ID NO: 2998971 - DNA, 14 bp, Homo sapiens
ctcattccccaggt

SEQ ID NO: 2998972 - DNA, 12 bp, Homo sapiens
ctcattcctgtt

SEQ ID NO: 2998973 - DNA, 21 bp, Homo sapiens
ctcattctactaatgtgatgc

SEQ ID NO: 2998974 - DNA, 23 bp, Homo sapiens
ctcattgaaatgtaatttcagtt

SEQ ID NO: 2998975 - DNA, 13 bp, Homo sapiens
ctcattggaccct

SEQ ID NO: 2998976 - DNA, 17 bp, Homo sapiens
ctcattggacccttcca

SEQ ID NO: 2998977 - DNA, 19 bp, Homo sapiens
ctcattgtctgtgtagagt

SEQ ID NO: 2998978 - DNA, 20 bp, Homo sapiens
ctcatttggggtagctagag

SEQ ID NO: 2998979 - DNA, 19 bp, Homo sapiens
ctccaaaaagacaagtgct

SEQ ID NO: 2998980 - DNA, 16 bp, Homo sapiens
ctccaaaatctggctt

SEQ ID NO: 2998981 - DNA, 15 bp, Homo sapiens
ctccaaaccctcgag

SEQ ID NO: 2998982 - DNA, 17 bp, Homo sapiens
ctccaaaccctcgaggc

SEQ ID NO: 2998983 - DNA, 14 bp, Homo sapiens
ctccaaaggaaatc

SEQ ID NO: 2998984 - DNA, 13 bp, Homo sapiens
ctccaacctgcaa

SEQ ID NO: 2998985 - DNA, 16 bp, Homo sapiens
ctccaactcagaaggg

SEQ ID NO: 2998986 - DNA, 21 bp, Homo sapiens
ctccaactcctttcagccaca

SEQ ID NO: 2998987 - DNA, 19 bp, Homo sapiens
ctccaactgcctaaggccc

SEQ ID NO: 2998988 - DNA, 20 bp, Homo sapiens
ctccaagatgttctcctgat

SEQ ID NO: 2998989 - DNA, 12 bp, Homo sapiens
ctccaagattct

SEQ ID NO: 2998990 - DNA, 13 bp, Homo sapiens
ctccaagattcta

SEQ ID NO: 2998991 - DNA, 14 bp, Homo sapiens
ctccaagattctag

SEQ ID NO: 2998992 - DNA, 15 bp, Homo sapiens
ctccaagattctaga

SEQ ID NO: 2998993 - DNA, 17 bp, Homo sapiens
ctccaagattctagatg

SEQ ID NO: 2998994 - DNA, 18 bp, Homo sapiens
ctccaagattctagatga

SEQ ID NO: 2998995 - DNA, 21 bp, Homo sapiens
ctccaagccccctggcagctg

SEQ ID NO: 2998996 - DNA, 15 bp, Homo sapiens
ctccaagctgttaaa

SEQ ID NO: 2998997 - DNA, 20 bp, Homo sapiens
ctccaaggggaatcagaact

SEQ ID NO: 2998998 - DNA, 15 bp, Homo sapiens
ctccaaggtggggtc

SEQ ID NO: 2998999 - DNA, 18 bp, Homo sapiens
ctccacaaagcaaaggca

SEQ ID NO: 2999000 - DNA, 21 bp, Homo sapiens
ctccacacaagggaaggacag

SEQ ID NO: 2999001 - DNA, 16 bp, Homo sapiens
ctccacagcaacccca

SEQ ID NO: 2999002 - DNA, 19 bp, Homo sapiens
ctccacagcaaccccaggc

SEQ ID NO: 2999003 - DNA, 13 bp, Homo sapiens
ctccacatcctcc

SEQ ID NO: 2999004 - DNA, 20 bp, Homo sapiens
ctccaccaaccccgcggccc

SEQ ID NO: 2999005 - DNA, 12 bp, Homo sapiens
ctccaccaccca

SEQ ID NO: 2999006 - DNA, 13 bp, Homo sapiens
ctccaccacccaa

SEQ ID NO: 2999007 - DNA, 12 bp, Homo sapiens
ctccaccaccgc

SEQ ID NO: 2999008 - DNA, 20 bp, Homo sapiens
ctccaccagcatcacctgcc

SEQ ID NO: 2999009 - DNA, 21 bp, Homo sapiens
ctccacccaaaccccttccca

SEQ ID NO: 2999010 - DNA, 14 bp, Homo sapiens
ctccaccctggccg

SEQ ID NO: 2999011 - DNA, 15 bp, Homo sapiens
ctccaccctggccga

SEQ ID NO: 2999012 - DNA, 15 bp, Homo sapiens
ctccaccgctgccta

SEQ ID NO: 2999013 - DNA, 16 bp, Homo sapiens
ctccaccgctgcctaa

SEQ ID NO: 2999014 - DNA, 15 bp, Homo sapiens
ctccacctcagcctt

SEQ ID NO: 2999015 - DNA, 18 bp, Homo sapiens
ctccacctcagccttgga

SEQ ID NO: 2999016 - DNA, 12 bp, Homo sapiens
ctccaccttccc

SEQ ID NO: 2999017 - DNA, 18 bp, Homo sapiens
ctccacggtccgcggcct

SEQ ID NO: 2999018 - DNA, 15 bp, Homo sapiens
ctccactcaggtgca

SEQ ID NO: 2999019 - DNA, 20 bp, Homo sapiens
ctccactcctctcaactgcc

SEQ ID NO: 2999020 - DNA, 22 bp, Homo sapiens
ctccactcctctcaactgcctc

SEQ ID NO: 2999021 - DNA, 21 bp, Homo sapiens
ctccacttctggtcccctgtg

SEQ ID NO: 2999022 - DNA, 22 bp, Homo sapiens
ctccacttctggtcccctgtgg

SEQ ID NO: 2999023 - DNA, 21 bp, Homo sapiens
ctccactttctcaatgcttag

SEQ ID NO: 2999024 - DNA, 14 bp, Homo sapiens
ctccagaacccatt

SEQ ID NO: 2999025 - DNA, 15 bp, Homo sapiens
ctccagaatgtgctg

SEQ ID NO: 2999026 - DNA, 16 bp, Homo sapiens
ctccagaatgtgctgc

SEQ ID NO: 2999027 - DNA, 17 bp, Homo sapiens
ctccagaatgtgctgcc

SEQ ID NO: 2999028 - DNA, 18 bp, Homo sapiens
ctccagaattacccttcc

SEQ ID NO: 2999029 - DNA, 14 bp, Homo sapiens
ctccagagaaagca

SEQ ID NO: 2999030 - DNA, 23 bp, Homo sapiens
ctccagagaaagcacaatttaaa

SEQ ID NO: 2999031 - DNA, 18 bp, Homo sapiens
ctccagagaagtttcgag

SEQ ID NO: 2999032 - DNA, 16 bp, Homo sapiens
ctccagagacaggaaa

SEQ ID NO: 2999033 - DNA, 20 bp, Homo sapiens
ctccagatatgaacagggcc

SEQ ID NO: 2999034 - DNA, 21 bp, Homo sapiens
ctccagatgcagggcagtcat

SEQ ID NO: 2999035 - DNA, 11 bp, Homo sapiens
ctccagcacaa

SEQ ID NO: 2999036 - DNA, 19 bp, Homo sapiens
ctccagcacaaacacaagg

SEQ ID NO: 2999037 - DNA, 13 bp, Homo sapiens
ctcctggtgtcac

SEQ ID NO: 2999038 - DNA, 17 bp, Homo sapiens
ctcctgtactttttcca

SEQ ID NO: 2999039 - DNA, 23 bp, Homo sapiens
ctcctgtctcgccagaagactcc

SEQ ID NO: 2999040 - DNA, 23 bp, Homo sapiens
ctcctgttagctcctcactgtgg

SEQ ID NO: 2999041 - DNA, 13 bp, Homo sapiens
ctccttaaggctc

SEQ ID NO: 2999042 - DNA, 15 bp, Homo sapiens
ctccttacattaaaa

SEQ ID NO: 2999043 - DNA, 19 bp, Homo sapiens
ctccttagacctgagggac

SEQ ID NO: 2999044 - DNA, 14 bp, Homo sapiens
ctccttagctgcca

SEQ ID NO: 2999045 - DNA, 22 bp, Homo sapiens
ctccttagctgccaagccccat

SEQ ID NO: 2999046 - DNA, 14 bp, Homo sapiens
ctccttccaacagg

SEQ ID NO: 2999047 - DNA, 13 bp, Homo sapiens
ctccttccatcct

SEQ ID NO: 2999048 - DNA, 15 bp, Homo sapiens
ctccttccccacttc

SEQ ID NO: 2999049 - DNA, 21 bp, Homo sapiens
ctccttccccttgtccctggg

SEQ ID NO: 2999050 - DNA, 16 bp, Homo sapiens
ctccttcctcttggct

SEQ ID NO: 2999051 - DNA, 12 bp, Homo sapiens
ctccttctcttc

SEQ ID NO: 2999052 - DNA, 17 bp, Homo sapiens
ctccttctcttctcttc

SEQ ID NO: 2999053 - DNA, 14 bp, Homo sapiens
ctccttcttccact

SEQ ID NO: 2999054 - DNA, 12 bp, Homo sapiens
ctccttgcagtt

SEQ ID NO: 2999055 - DNA, 13 bp, Homo sapiens
ctccttggaaatc

SEQ ID NO: 2999056 - DNA, 18 bp, Homo sapiens
ctccttggaggacagtgg

SEQ ID NO: 2999057 - DNA, 22 bp, Homo sapiens
ctccttgggaggccccactggg

SEQ ID NO: 2999058 - DNA, 20 bp, Homo sapiens
ctccttgggcagggtctctg

SEQ ID NO: 2999059 - DNA, 18 bp, Homo sapiens
ctccttgggccctttgag

SEQ ID NO: 2999060 - DNA, 17 bp, Homo sapiens
ctcctttaagagctctg

SEQ ID NO: 2999061 - DNA, 19 bp, Homo sapiens
ctcctttcaccccagggcc

SEQ ID NO: 2999062 - DNA, 16 bp, Homo sapiens
ctcctttcagccacat

SEQ ID NO: 2999063 - DNA, 18 bp, Homo sapiens
ctcctttccccttccttt

SEQ ID NO: 2999064 - DNA, 12 bp, Homo sapiens
ctcctttctctg

SEQ ID NO: 2999065 - DNA, 13 bp, Homo sapiens
ctcctttctctgt

SEQ ID NO: 2999066 - DNA, 14 bp, Homo sapiens
ctcctttctctgta

SEQ ID NO: 2999067 - DNA, 17 bp, Homo sapiens
ctcctttggcatgttta

SEQ ID NO: 2999068 - DNA, 18 bp, Homo sapiens
ctcctttggcatgtttaa

SEQ ID NO: 2999069 - DNA, 14 bp, Homo sapiens
ctcctttgtacttt

SEQ ID NO: 2999070 - DNA, 20 bp, Homo sapiens
ctcctttgtcttttttttca

SEQ ID NO: 2999071 - DNA, 15 bp, Homo sapiens
ctcgaaacacagaaa

SEQ ID NO: 2999072 - DNA, 20 bp, Homo sapiens
ctcgaaacacagaaaccttt

SEQ ID NO: 2999073 - DNA, 15 bp, Homo sapiens
ctcgaactcctgacc

SEQ ID NO: 2999074 - DNA, 22 bp, Homo sapiens
ctcgagatcccaacactgccag

SEQ ID NO: 2999075 - DNA, 15 bp, Homo sapiens
ctcgagcttggggca

SEQ ID NO: 2999076 - DNA, 22 bp, Homo sapiens
ctcgaggactgtatttgtgact

SEQ ID NO: 2999077 - DNA, 14 bp, Homo sapiens
ctcgagggccgcct

SEQ ID NO: 2999078 - DNA, 15 bp, Homo sapiens
ctcgagggccgcctg

SEQ ID NO: 2999079 - DNA, 16 bp, Homo sapiens
ctcgagggccgcctgc

SEQ ID NO: 2999080 - DNA, 21 bp, Homo sapiens
ctcgaggtgccttcttcaggg

SEQ ID NO: 2999081 - DNA, 14 bp, Homo sapiens
ctcgagtactgtgg

SEQ ID NO: 2999082 - DNA, 17 bp, Homo sapiens
ctcgagtactgtgggca

SEQ ID NO: 2999083 - DNA, 14 bp, Homo sapiens
ctcgatgctgctgg

SEQ ID NO: 2999084 - DNA, 15 bp, Homo sapiens
ctcgatgctgctggc

SEQ ID NO: 2999085 - DNA, 17 bp, Homo sapiens
ctcgatgctgctggcct

SEQ ID NO: 2999086 - DNA, 19 bp, Homo sapiens
ctcgatgtgtactctaact

SEQ ID NO: 2999087 - DNA, 14 bp, Homo sapiens
ctcgcacctgtgct

SEQ ID NO: 2999088 - DNA, 15 bp, Homo sapiens
ctcgcacctttccaa

SEQ ID NO: 2999089 - DNA, 17 bp, Homo sapiens
ctcgcacggccccgaag

SEQ ID NO: 2999090 - DNA, 14 bp, Homo sapiens
ctcgcacttgcaga

SEQ ID NO: 2999091 - DNA, 18 bp, Homo sapiens
ctcgcacttgcagaggag

SEQ ID NO: 2999092 - DNA, 17 bp, Homo sapiens
ctcgcatcattgcagat

SEQ ID NO: 2999093 - DNA, 16 bp, Homo sapiens
ctcgcatccagacagt

SEQ ID NO: 2999094 - DNA, 14 bp, Homo sapiens
ctcgcatcttccca

SEQ ID NO: 2999095 - DNA, 15 bp, Homo sapiens
ctcgcatcttcccaa

SEQ ID NO: 2999096 - DNA, 21 bp, Homo sapiens
ctcgcatttgtcaatgacagt

SEQ ID NO: 2999097 - DNA, 23 bp, Homo sapiens
ctcgccagaagactcctaggccc

SEQ ID NO: 2999098 - DNA, 20 bp, Homo sapiens
ctcgccatttcctcacgtgc

SEQ ID NO: 2999099 - DNA, 15 bp, Homo sapiens
ctcgcccaggaaggc

SEQ ID NO: 2999100 - DNA, 19 bp, Homo sapiens
ctcgcccatacccgtgaca

SEQ ID NO: 2999101 - DNA, 14 bp, Homo sapiens
ctcgcccccacttt

SEQ ID NO: 2999102 - DNA, 18 bp, Homo sapiens
ctcgcccccacttttcta

SEQ ID NO: 2999103 - DNA, 12 bp, Homo sapiens
ctcgccctgggt

SEQ ID NO: 2999104 - DNA, 16 bp, Homo sapiens
ctcgccgtctgtgaat

SEQ ID NO: 2999105 - DNA, 11 bp, Homo sapiens
ctcgcctcagc

SEQ ID NO: 2999106 - DNA, 19 bp, Homo sapiens
ctcgcctcagcctgatcag

SEQ ID NO: 2999107 - DNA, 18 bp, Homo sapiens
ctcgcctcctactctgag

SEQ ID NO: 2999108 - DNA, 11 bp, Homo sapiens
ctcgcctgccc

SEQ ID NO: 2999109 - DNA, 17 bp, Homo sapiens
ctcgcctggaaacagag

SEQ ID NO: 2999110 - DNA, 12 bp, Homo sapiens
ctcgctgccagc

SEQ ID NO: 2999111 - DNA, 16 bp, Homo sapiens
ctcgctgccagctctg

SEQ ID NO: 2999112 - DNA, 15 bp, Homo sapiens
ctcgctggactctca

SEQ ID NO: 2999113 - DNA, 21 bp, Homo sapiens
ctcgctgtaggtcaggcccgc

SEQ ID NO: 2999114 - DNA, 18 bp, Homo sapiens
ctcggacacccagggtct

SEQ ID NO: 2999115 - DNA, 19 bp, Homo sapiens
ctcggagctggttcctctc

SEQ ID NO: 2999116 - DNA, 13 bp, Homo sapiens
ctcggaggaagcc

SEQ ID NO: 2999117 - DNA, 19 bp, Homo sapiens
ctcggaggctcctccctct

SEQ ID NO: 2999118 - DNA, 23 bp, Homo sapiens
ctcggaggctcctccctctgcct

SEQ ID NO: 2999119 - DNA, 20 bp, Homo sapiens
ctcggatcaccgagagtagc

SEQ ID NO: 2999120 - DNA, 20 bp, Homo sapiens
ctcggatgaccatactcaga

SEQ ID NO: 2999121 - DNA, 14 bp, Homo sapiens
ctcggcccagggcc

SEQ ID NO: 2999122 - DNA, 13 bp, Homo sapiens
ctcggcccatctg

SEQ ID NO: 2999123 - DNA, 18 bp, Homo sapiens
ctcggcccatctgtccat

SEQ ID NO: 2999124 - DNA, 23 bp, Homo sapiens
ctcggccccctcaccccagctcc

SEQ ID NO: 2999125 - DNA, 13 bp, Homo sapiens
ctcggccctccct

SEQ ID NO: 2999126 - DNA, 20 bp, Homo sapiens
ctcggcctcccaaagtgctg

SEQ ID NO: 2999127 - DNA, 22 bp, Homo sapiens
ctcggcctcctaaagtgctggg

SEQ ID NO: 2999128 - DNA, 20 bp, Homo sapiens
ctcggcttggatcctgggct

SEQ ID NO: 2999129 - DNA, 15 bp, Homo sapiens
ctcgggaagggaggg

SEQ ID NO: 2999130 - DNA, 16 bp, Homo sapiens
ctcgggaagggagggg

SEQ ID NO: 2999131 - DNA, 19 bp, Homo sapiens
ctcgggaagggaggggaag

SEQ ID NO: 2999132 - DNA, 19 bp, Homo sapiens
ctcgggaggctgaggcaca

SEQ ID NO: 2999133 - DNA, 13 bp, Homo sapiens
ctcggggagcctt

SEQ ID NO: 2999134 - DNA, 17 bp, Homo sapiens
ctctggattaggtctct

SEQ ID NO: 2999135 - DNA, 13 bp, Homo sapiens
ctctggccctgcc

SEQ ID NO: 2999136 - DNA, 15 bp, Homo sapiens
ctctggccctgcctt

SEQ ID NO: 2999137 - DNA, 21 bp, Homo sapiens
ctctggccctggggtgtgtct

SEQ ID NO: 2999138 - DNA, 18 bp, Homo sapiens
ctctggcggtggccacag

SEQ ID NO: 2999139 - DNA, 19 bp, Homo sapiens
ctctggcggtggccacagc

SEQ ID NO: 2999140 - DNA, 19 bp, Homo sapiens
ctctggctcagctgtggtc

SEQ ID NO: 2999141 - DNA, 17 bp, Homo sapiens
ctctggcttggcctatc

SEQ ID NO: 2999142 - DNA, 21 bp, Homo sapiens
ctctgggtacctgcaagcaga

SEQ ID NO: 2999143 - DNA, 17 bp, Homo sapiens
ctctgggtcagtggtcc

SEQ ID NO: 2999144 - DNA, 14 bp, Homo sapiens
ctctgggtcccggg

SEQ ID NO: 2999145 - DNA, 21 bp, Homo sapiens
ctctgggtttacaacaaacac

SEQ ID NO: 2999146 - DNA, 18 bp, Homo sapiens
ctctggtcctcggagctg

SEQ ID NO: 2999147 - DNA, 17 bp, Homo sapiens
ctctggtgataaggaca

SEQ ID NO: 2999148 - DNA, 17 bp, Homo sapiens
ctctggtggcacaggag

SEQ ID NO: 2999149 - DNA, 15 bp, Homo sapiens
ctctgtaaaagtgtc

SEQ ID NO: 2999150 - DNA, 16 bp, Homo sapiens
ctctgtaaccacctct

SEQ ID NO: 2999151 - DNA, 22 bp, Homo sapiens
ctctgtaaccacctctctgtct

SEQ ID NO: 2999152 - DNA, 18 bp, Homo sapiens
ctctgtaatctcgtttca

SEQ ID NO: 2999153 - DNA, 20 bp, Homo sapiens
ctctgtacttttcattctct

SEQ ID NO: 2999154 - DNA, 14 bp, Homo sapiens
ctctgtagtttatg

SEQ ID NO: 2999155 - DNA, 17 bp, Homo sapiens
ctctgtagtttatggca

SEQ ID NO: 2999156 - DNA, 18 bp, Homo sapiens
ctctgtagtttatggcag

SEQ ID NO: 2999157 - DNA, 14 bp, Homo sapiens
ctctgtatattggg

SEQ ID NO: 2999158 - DNA, 16 bp, Homo sapiens
ctctgtatatttatga

SEQ ID NO: 2999159 - DNA, 20 bp, Homo sapiens
ctctgtattttttcttgcat

SEQ ID NO: 2999160 - DNA, 19 bp, Homo sapiens
ctctgtcaccctggccacc

SEQ ID NO: 2999161 - DNA, 19 bp, Homo sapiens
ctctgtcagtcacagccac

SEQ ID NO: 2999162 - DNA, 14 bp, Homo sapiens
ctctgtccaggcac

SEQ ID NO: 2999163 - DNA, 14 bp, Homo sapiens
ctctgtccccacga

SEQ ID NO: 2999164 - DNA, 16 bp, Homo sapiens
ctctgtccccacgagg

SEQ ID NO: 2999165 - DNA, 20 bp, Homo sapiens
ctctgtccccacgaggggac

SEQ ID NO: 2999166 - DNA, 14 bp, Homo sapiens
ctctgtccccaggc

SEQ ID NO: 2999167 - DNA, 15 bp, Homo sapiens
ctctgtccccaggcc

SEQ ID NO: 2999168 - DNA, 18 bp, Homo sapiens
ctctgtccccaggcctgg

SEQ ID NO: 2999169 - DNA, 19 bp, Homo sapiens
ctctgtctacttgctcagg

SEQ ID NO: 2999170 - DNA, 18 bp, Homo sapiens
ctctgtctagcatgccaa

SEQ ID NO: 2999171 - DNA, 14 bp, Homo sapiens
ctctgtctctgtgg

SEQ ID NO: 2999172 - DNA, 17 bp, Homo sapiens
ctctgtctgtctctccc

SEQ ID NO: 2999173 - DNA, 19 bp, Homo sapiens
ctctgtctgtctctccccc

SEQ ID NO: 2999174 - DNA, 18 bp, Homo sapiens
ctctgtcttcaggctctg

SEQ ID NO: 2999175 - DNA, 22 bp, Homo sapiens
ctctgtcttcaggctctgccca

SEQ ID NO: 2999176 - DNA, 16 bp, Homo sapiens
ctctgtcttctctcca

SEQ ID NO: 2999177 - DNA, 13 bp, Homo sapiens
ctctgtcttctgg

SEQ ID NO: 2999178 - DNA, 17 bp, Homo sapiens
ctctgtcttctggactg

SEQ ID NO: 2999179 - DNA, 15 bp, Homo sapiens
ctctgtctttttcct

SEQ ID NO: 2999180 - DNA, 16 bp, Homo sapiens
ctctgtctttttcctt

SEQ ID NO: 2999181 - DNA, 21 bp, Homo sapiens
ctctgtctttttccttcctga

SEQ ID NO: 2999182 - DNA, 18 bp, Homo sapiens
ctctgtgaccaatgtctt

SEQ ID NO: 2999183 - DNA, 19 bp, Homo sapiens
ctctgtgaccaatgtcttg

SEQ ID NO: 2999184 - DNA, 12 bp, Homo sapiens
ctctgtgaccca

SEQ ID NO: 2999185 - DNA, 24 bp, Homo sapiens
ctctgtgacccacttctcatcaca

SEQ ID NO: 2999186 - DNA, 20 bp, Homo sapiens
ctctgtgcacttatttatga

SEQ ID NO: 2999187 - DNA, 16 bp, Homo sapiens
ctctgtgccttctttt

SEQ ID NO: 2999188 - DNA, 15 bp, Homo sapiens
ctctgtggaggggcc

SEQ ID NO: 2999189 - DNA, 18 bp, Homo sapiens
ctctgtgggaaaaaagaa

SEQ ID NO: 2999190 - DNA, 22 bp, Homo sapiens
ctctgtggtggttcattccaca

SEQ ID NO: 2999191 - DNA, 23 bp, Homo sapiens
ctctgtggtggttcattccacag

SEQ ID NO: 2999192 - DNA, 16 bp, Homo sapiens
ctctgtggtgtctgcc

SEQ ID NO: 2999193 - DNA, 20 bp, Homo sapiens
ctctgtggttttttttgaat

SEQ ID NO: 2999194 - DNA, 13 bp, Homo sapiens
ctctgtgtaacca

SEQ ID NO: 2999195 - DNA, 21 bp, Homo sapiens
ctctgtgtaaccagctcagtg

SEQ ID NO: 2999196 - DNA, 21 bp, Homo sapiens
ctctgtgtagccgccctgaga

SEQ ID NO: 2999197 - DNA, 22 bp, Homo sapiens
ctctgtgtatttatataaaaat

SEQ ID NO: 2999198 - DNA, 21 bp, Homo sapiens
ctctgtgtctaagattctaga

SEQ ID NO: 2999199 - DNA, 13 bp, Homo sapiens
ctctgtgtgctcc

SEQ ID NO: 2999200 - DNA, 15 bp, Homo sapiens
ctctgttacccaggc

SEQ ID NO: 2999201 - DNA, 17 bp, Homo sapiens
ctctgttcagtgtaaat

SEQ ID NO: 2999202 - DNA, 18 bp, Homo sapiens
ctctgttcagtgtaaata

SEQ ID NO: 2999203 - DNA, 13 bp, Homo sapiens
ctctgttgactgg

SEQ ID NO: 2999204 - DNA, 20 bp, Homo sapiens
ctctgttgcaagtgcaataa

SEQ ID NO: 2999205 - DNA, 12 bp, Homo sapiens
ctctgttgcctc

SEQ ID NO: 2999206 - DNA, 20 bp, Homo sapiens
ctctgttgcctcctctctcc

SEQ ID NO: 2999207 - DNA, 18 bp, Homo sapiens
ctctgtttgcttttgaac

SEQ ID NO: 2999208 - DNA, 17 bp, Homo sapiens
ctcttaatgatgttatc

SEQ ID NO: 2999209 - DNA, 13 bp, Homo sapiens
ctcttacttcccc

SEQ ID NO: 2999210 - DNA, 16 bp, Homo sapiens
ctcttactttcagttt

SEQ ID NO: 2999211 - DNA, 18 bp, Homo sapiens
ctcttagacacttttata

SEQ ID NO: 2999212 - DNA, 16 bp, Homo sapiens
ctcttagattgggcca

SEQ ID NO: 2999213 - DNA, 22 bp, Homo sapiens
ctcttataaagtggacttctga

SEQ ID NO: 2999214 - DNA, 15 bp, Homo sapiens
ctcttattactgttg

SEQ ID NO: 2999215 - DNA, 16 bp, Homo sapiens
ctcttattcctttaaa

SEQ ID NO: 2999216 - DNA, 12 bp, Homo sapiens
ctcttcaatgaa

SEQ ID NO: 2999217 - DNA, 21 bp, Homo sapiens
ctcttcacatctcccccatag

SEQ ID NO: 2999218 - DNA, 12 bp, Homo sapiens
ctcttcacttcc

SEQ ID NO: 2999219 - DNA, 15 bp, Homo sapiens
ctcttccaccagagc

SEQ ID NO: 2999220 - DNA, 21 bp, Homo sapiens
ctcttccaggactctctgctt

SEQ ID NO: 2999221 - DNA, 15 bp, Homo sapiens
ctcttccagtttctg

SEQ ID NO: 2999222 - DNA, 15 bp, Homo sapiens
ctcttccctcagtcc

SEQ ID NO: 2999223 - DNA, 15 bp, Homo sapiens
ctcttcctcatcctg

SEQ ID NO: 2999224 - DNA, 18 bp, Homo sapiens
ctcttcctcatcctgctt

SEQ ID NO: 2999225 - DNA, 22 bp, Homo sapiens
ctcttcctcatcctgcttctct

SEQ ID NO: 2999226 - DNA, 20 bp, Homo sapiens
ctcttctagatggaccccag

SEQ ID NO: 2999227 - DNA, 22 bp, Homo sapiens
ctcttctagatggaccccagca

SEQ ID NO: 2999228 - DNA, 19 bp, Homo sapiens
ctcttctcctctggcttcc

SEQ ID NO: 2999229 - DNA, 17 bp, Homo sapiens
ctcttctcttgacagtc

SEQ ID NO: 2999230 - DNA, 20 bp, Homo sapiens
ctcttctcttgacagtctga

SEQ ID NO: 2999231 - DNA, 21 bp, Homo sapiens
ctcttctgccggccctggggc

SEQ ID NO: 2999232 - DNA, 14 bp, Homo sapiens
ctcttctggctcaa

SEQ ID NO: 2999233 - DNA, 21 bp, Homo sapiens
ctcttctgggagggcagcagg

SEQ ID NO: 2999234 - DNA, 20 bp, Homo sapiens
ctcttctgggcagagcctgt

SEQ ID NO: 2999235 - DNA, 21 bp, Homo sapiens
ctcttctgggcagagcctgtc

SEQ ID NO: 2999236 - DNA, 13 bp, Homo sapiens
ctcttctgtccat

SEQ ID NO: 2999237 - DNA, 22 bp, Homo sapiens
ctcttctgtccatcagtgcatg

SEQ ID NO: 2999238 - DNA, 21 bp, Homo sapiens
ctcttctgtgccctggctcca

SEQ ID NO: 2999239 - DNA, 17 bp, Homo sapiens
ctcttctttagaacagg

SEQ ID NO: 2999240 - DNA, 12 bp, Homo sapiens
ctcttctttggg

SEQ ID NO: 2999241 - DNA, 16 bp, Homo sapiens
ctcttcttttggcttc

SEQ ID NO: 2999242 - DNA, 19 bp, Homo sapiens
ctcttcttttggcttccat

SEQ ID NO: 2999243 - DNA, 16 bp, Homo sapiens
ctcttgaaacctgatg

SEQ ID NO: 2999244 - DNA, 18 bp, Homo sapiens
ctcttgaagtccaggact

SEQ ID NO: 2999245 - DNA, 20 bp, Homo sapiens
ctcttgaagtccaggactgg

SEQ ID NO: 2999246 - DNA, 16 bp, Homo sapiens
ctcttgaccttgtaga

SEQ ID NO: 2999247 - DNA, 14 bp, Homo sapiens
ctcttgactcaggt

SEQ ID NO: 2999248 - DNA, 17 bp, Homo sapiens
ctcttgcaggctgagtc

SEQ ID NO: 2999249 - DNA, 14 bp, Homo sapiens
ctcttgctctcttg

SEQ ID NO: 2999250 - DNA, 16 bp, Homo sapiens
ctcttgctctcttgtg

SEQ ID NO: 2999251 - DNA, 17 bp, Homo sapiens
ctcttgctctcttgtga

SEQ ID NO: 2999252 - DNA, 15 bp, Homo sapiens
ctcttggagcctgca

SEQ ID NO: 2999253 - DNA, 22 bp, Homo sapiens
ctcttggagcctgcagagctgc

SEQ ID NO: 2999254 - DNA, 15 bp, Homo sapiens
ctcttggcacctgcc

SEQ ID NO: 2999255 - DNA, 16 bp, Homo sapiens
ctcttggcacctgcct

SEQ ID NO: 2999256 - DNA, 21 bp, Homo sapiens
ctcttgggaactgaactcact

SEQ ID NO: 2999257 - DNA, 16 bp, Homo sapiens
ctcttgggtcagagaa

SEQ ID NO: 2999258 - DNA, 17 bp, Homo sapiens
ctcttggtgttaaaaca

SEQ ID NO: 2999259 - DNA, 12 bp, Homo sapiens
ctcttgtaaata

SEQ ID NO: 2999260 - DNA, 14 bp, Homo sapiens
ctcttgtaaataaa

SEQ ID NO: 2999261 - DNA, 18 bp, Homo sapiens
ctcttgtaaataaagccc

SEQ ID NO: 2999262 - DNA, 21 bp, Homo sapiens
ctcttgtaatccgaatctctt

SEQ ID NO: 2999263 - DNA, 20 bp, Homo sapiens
ctcttgtagcccaggctgga

SEQ ID NO: 2999264 - DNA, 21 bp, Homo sapiens
ctcttgtataagatcctagat

SEQ ID NO: 2999265 - DNA, 22 bp, Homo sapiens
ctcttgtattgctccattttct

SEQ ID NO: 2999266 - DNA, 22 bp, Homo sapiens
ctcttgtctggcaaaagaaaaa

SEQ ID NO: 2999267 - DNA, 13 bp, Homo sapiens
ctcttgtttctgt

SEQ ID NO: 2999268 - DNA, 14 bp, Homo sapiens
ctcttgtttctgtt

SEQ ID NO: 2999269 - DNA, 22 bp, Homo sapiens
ctcttgtttggagggatcattt

SEQ ID NO: 2999270 - DNA, 19 bp, Homo sapiens
ctatccacccagcccattc

SEQ ID NO: 2999271 - DNA, 18 bp, Homo sapiens
ctatcctctctctctcta

SEQ ID NO: 2999272 - DNA, 12 bp, Homo sapiens
ctatcctctgta

SEQ ID NO: 2999273 - DNA, 13 bp, Homo sapiens
ctatcctctgtaa

SEQ ID NO: 2999274 - DNA, 15 bp, Homo sapiens
ctatcctgctgttct

SEQ ID NO: 2999275 - DNA, 20 bp, Homo sapiens
ctatcgttattataaatgtt

SEQ ID NO: 2999276 - DNA, 21 bp, Homo sapiens
ctatcgttattataaatgtta

SEQ ID NO: 2999277 - DNA, 13 bp, Homo sapiens
ctatctcagccat

SEQ ID NO: 2999278 - DNA, 14 bp, Homo sapiens
ctatctgtgattcc

SEQ ID NO: 2999279 - DNA, 21 bp, Homo sapiens
ctatctgtttacagtgttccg

SEQ ID NO: 2999280 - DNA, 13 bp, Homo sapiens
ctatcttccaaac

SEQ ID NO: 2999281 - DNA, 15 bp, Homo sapiens
ctatcttctttggac

SEQ ID NO: 2999282 - DNA, 17 bp, Homo sapiens
ctatcttgctctgtaat

SEQ ID NO: 2999283 - DNA, 18 bp, Homo sapiens
ctatgacatggaggcact

SEQ ID NO: 2999284 - DNA, 15 bp, Homo sapiens
ctatgagggccttga

SEQ ID NO: 2999285 - DNA, 20 bp, Homo sapiens
ctatgagtggaaaaagccaa

SEQ ID NO: 2999286 - DNA, 13 bp, Homo sapiens
ctatgataagatt

SEQ ID NO: 2999287 - DNA, 20 bp, Homo sapiens
ctatgatagataataaacaa

SEQ ID NO: 2999288 - DNA, 17 bp, Homo sapiens
ctatgcaaaatgtctgt

SEQ ID NO: 2999289 - DNA, 20 bp, Homo sapiens
ctatgcacatatggactctg

SEQ ID NO: 2999290 - DNA, 20 bp, Homo sapiens
ctatgcatatcagttgagct

SEQ ID NO: 2999291 - DNA, 20 bp, Homo sapiens
ctatgcatggtgccccagga

SEQ ID NO: 2999292 - DNA, 22 bp, Homo sapiens
ctatgcatggtgccccaggacc

SEQ ID NO: 2999293 - DNA, 16 bp, Homo sapiens
ctatgctgcttttata

SEQ ID NO: 2999294 - DNA, 18 bp, Homo sapiens
ctatgctggggtacacag

SEQ ID NO: 2999295 - DNA, 19 bp, Homo sapiens
ctatgctttgaaacagaaa

SEQ ID NO: 2999296 - DNA, 22 bp, Homo sapiens
ctatggaatttataattcagta

SEQ ID NO: 2999297 - DNA, 16 bp, Homo sapiens
ctatggatggcttcta

SEQ ID NO: 2999298 - DNA, 16 bp, Homo sapiens
ctatggcagaaaaaat

SEQ ID NO: 2999299 - DNA, 23 bp, Homo sapiens
ctatggcagaaaaaatgtctgta

SEQ ID NO: 2999300 - DNA, 21 bp, Homo sapiens
ctatgggagagtgtcaaccag

SEQ ID NO: 2999301 - DNA, 20 bp, Homo sapiens
ctatggtgagatgcagctgg

SEQ ID NO: 2999302 - DNA, 14 bp, Homo sapiens
ctatggtgctctgt

SEQ ID NO: 2999303 - DNA, 17 bp, Homo sapiens
ctatggtgctctgtcta

SEQ ID NO: 2999304 - DNA, 23 bp, Homo sapiens
ctatggtgctctgtctacttgct

SEQ ID NO: 2999305 - DNA, 18 bp, Homo sapiens
ctatgtaacaaacctgca

SEQ ID NO: 2999306 - DNA, 22 bp, Homo sapiens
ctatgtaacatgtaggaagtag

SEQ ID NO: 2999307 - DNA, 21 bp, Homo sapiens
ctatgtaagaattcagaagac

SEQ ID NO: 2999308 - DNA, 15 bp, Homo sapiens
ctatgtaggaaaaaa

SEQ ID NO: 2999309 - DNA, 13 bp, Homo sapiens
ctatgtatttgca

SEQ ID NO: 2999310 - DNA, 22 bp, Homo sapiens
ctatgtatttgcagttcacctg

SEQ ID NO: 2999311 - DNA, 12 bp, Homo sapiens
ctatgtgacaat

SEQ ID NO: 2999312 - DNA, 16 bp, Homo sapiens
ctatgtgattttaact

SEQ ID NO: 2999313 - DNA, 22 bp, Homo sapiens
ctatgtgattttaactctgtct

SEQ ID NO: 2999314 - DNA, 13 bp, Homo sapiens
ctatgtgcacagc

SEQ ID NO: 2999315 - DNA, 19 bp, Homo sapiens
ctatgtgtgttgtttccat

SEQ ID NO: 2999316 - DNA, 21 bp, Homo sapiens
ctatgtgtgttgtttccatag

SEQ ID NO: 2999317 - DNA, 22 bp, Homo sapiens
ctatgtgtttggtttataattt

SEQ ID NO: 2999318 - DNA, 11 bp, Homo sapiens
ctatgtttact

SEQ ID NO: 2999319 - DNA, 21 bp, Homo sapiens
ctattaaagtgctaaggttct

SEQ ID NO: 2999320 - DNA, 23 bp, Homo sapiens
ctattaaagtggagaagcacact

SEQ ID NO: 2999321 - DNA, 23 bp, Homo sapiens
ctattaagaggcagaaaattgca

SEQ ID NO: 2999322 - DNA, 19 bp, Homo sapiens
ctattatactgttatccat

SEQ ID NO: 2999323 - DNA, 19 bp, Homo sapiens
ctattcagtggcgagaaat

SEQ ID NO: 2999324 - DNA, 11 bp, Homo sapiens
ctattcagttg

SEQ ID NO: 2999325 - DNA, 17 bp, Homo sapiens
ctattccagctcattca

SEQ ID NO: 2999326 - DNA, 23 bp, Homo sapiens
ctattccagctcattcattttat

SEQ ID NO: 2999327 - DNA, 15 bp, Homo sapiens
ctattccatgtttta

SEQ ID NO: 2999328 - DNA, 16 bp, Homo sapiens
ctattccatgttttaa

SEQ ID NO: 2999329 - DNA, 18 bp, Homo sapiens
ctattccttttctgtata

SEQ ID NO: 2999330 - DNA, 17 bp, Homo sapiens
ctattctgagaaaacaa

SEQ ID NO: 2999331 - DNA, 13 bp, Homo sapiens
ctattgacttcaa

SEQ ID NO: 2999332 - DNA, 14 bp, Homo sapiens
ctattgacttcaat

SEQ ID NO: 2999333 - DNA, 20 bp, Homo sapiens
ctattgccaggaatgtttca

SEQ ID NO: 2999334 - DNA, 16 bp, Homo sapiens
ctattggaaaaaccac

SEQ ID NO: 2999335 - DNA, 19 bp, Homo sapiens
ctattggatttgtccaaac

SEQ ID NO: 2999336 - DNA, 23 bp, Homo sapiens
ctattgtgttttttttttttggt

SEQ ID NO: 2999337 - DNA, 20 bp, Homo sapiens
ctatttaaatccttggcttc

SEQ ID NO: 2999338 - DNA, 22 bp, Homo sapiens
ctatttaactggcttcagcctc

SEQ ID NO: 2999339 - DNA, 9 bp, Homo sapiens
ctatttaag

SEQ ID NO: 2999340 - DNA, 15 bp, Homo sapiens
ctatttagtgatata

SEQ ID NO: 2999341 - DNA, 19 bp, Homo sapiens
ctatttatctgtgtttttg

SEQ ID NO: 2999342 - DNA, 22 bp, Homo sapiens
ctatttatctgtgtttttgaaa

SEQ ID NO: 2999343 - DNA, 21 bp, Homo sapiens
ctatttattatcgcatacaga

SEQ ID NO: 2999344 - DNA, 14 bp, Homo sapiens
ctatttcaggccct

SEQ ID NO: 2999345 - DNA, 17 bp, Homo sapiens
ctatttcaggccctcag

SEQ ID NO: 2999346 - DNA, 19 bp, Homo sapiens
ctatttcagtacttcagca

SEQ ID NO: 2999347 - DNA, 17 bp, Homo sapiens
ctatttctatgtatgtg

SEQ ID NO: 2999348 - DNA, 16 bp, Homo sapiens
ctatttctcctccatg

SEQ ID NO: 2999349 - DNA, 15 bp, Homo sapiens
ctatttctctgtgta

SEQ ID NO: 2999350 - DNA, 16 bp, Homo sapiens
ctatttcttaaacact

SEQ ID NO: 2999351 - DNA, 18 bp, Homo sapiens
ctatttcttaaacacttg

SEQ ID NO: 2999352 - DNA, 12 bp, Homo sapiens
ctatttggaatt

SEQ ID NO: 2999353 - DNA, 16 bp, Homo sapiens
ctatttggaatttata

SEQ ID NO: 2999354 - DNA, 23 bp, Homo sapiens
ctatttgtatttctcttgtcctt

SEQ ID NO: 2999355 - DNA, 11 bp, Homo sapiens
ctattttaaga

SEQ ID NO: 2999356 - DNA, 23 bp, Homo sapiens
ctattttaagactgattttaata

SEQ ID NO: 2999357 - DNA, 14 bp, Homo sapiens
ctatttttaaataa

SEQ ID NO: 2999358 - DNA, 17 bp, Homo sapiens
ctatttttaaataattt

SEQ ID NO: 2999359 - DNA, 17 bp, Homo sapiens
ctatttttatcatgaat

SEQ ID NO: 2999360 - DNA, 15 bp, Homo sapiens
ctatttttatgatga

SEQ ID NO: 2999361 - DNA, 16 bp, Homo sapiens
ctatttttatgatgac

SEQ ID NO: 2999362 - DNA, 22 bp, Homo sapiens
ctcaaaaaaaaaaaagagagag

SEQ ID NO: 2999363 - DNA, 23 bp, Homo sapiens
ctcaaaaaaaaaaaagagagaga

SEQ ID NO: 2999364 - DNA, 20 bp, Homo sapiens
ctcaaaacacttccagtctg

SEQ ID NO: 2999365 - DNA, 13 bp, Homo sapiens
ctcaaactcctga

SEQ ID NO: 2999366 - DNA, 15 bp, Homo sapiens
ctcaaagatctttcg

SEQ ID NO: 2999367 - DNA, 11 bp, Homo sapiens
ctcaaaggcac

SEQ ID NO: 2999368 - DNA, 22 bp, Homo sapiens
ctcaaatacatacctactgact

SEQ ID NO: 2999369 - DNA, 14 bp, Homo sapiens
ctcaaatccctctc

SEQ ID NO: 2999370 - DNA, 15 bp, Homo sapiens
ctcaaatggggccag

SEQ ID NO: 2999371 - DNA, 21 bp, Homo sapiens
ctcaaatgttctaagtttcta

SEQ ID NO: 2999372 - DNA, 14 bp, Homo sapiens
ctcaaatgttttct

SEQ ID NO: 2999373 - DNA, 15 bp, Homo sapiens
ctcaaatgttttctg

SEQ ID NO: 2999374 - DNA, 20 bp, Homo sapiens
ctcaacacccaactgtctcg

SEQ ID NO: 2999375 - DNA, 14 bp, Homo sapiens
ctcaacagagagga

SEQ ID NO: 2999376 - DNA, 15 bp, Homo sapiens
ctcaaccatcccctc

SEQ ID NO: 2999377 - DNA, 20 bp, Homo sapiens
ctcaaccatcccctccgtgg

SEQ ID NO: 2999378 - DNA, 14 bp, Homo sapiens
ctcaacctcctggg

SEQ ID NO: 2999379 - DNA, 15 bp, Homo sapiens
ctcaacctcctgggt

SEQ ID NO: 2999380 - DNA, 17 bp, Homo sapiens
ctcaacctcctgggttc

SEQ ID NO: 2999381 - DNA, 20 bp, Homo sapiens
ctcaacctcttctggctcaa

SEQ ID NO: 2999382 - DNA, 21 bp, Homo sapiens
ctcaacctcttctggctcaaa

SEQ ID NO: 2999383 - DNA, 19 bp, Homo sapiens
ctcaactccaccctctgcg

SEQ ID NO: 2999384 - DNA, 22 bp, Homo sapiens
ctcaagaaataaaaggaagcca

SEQ ID NO: 2999385 - DNA, 18 bp, Homo sapiens
ctcaagaagaaagtgttc

SEQ ID NO: 2999386 - DNA, 19 bp, Homo sapiens
ctcaagaagaagaggggca

SEQ ID NO: 2999387 - DNA, 18 bp, Homo sapiens
ctcaagatcaatgaaatg

SEQ ID NO: 2999388 - DNA, 23 bp, Homo sapiens
ctcaagcagcaaaatccttactt

SEQ ID NO: 2999389 - DNA, 17 bp, Homo sapiens
ctcaagcattctgttta

SEQ ID NO: 2999390 - DNA, 18 bp, Homo sapiens
ctcaagccatcttcccgc

SEQ ID NO: 2999391 - DNA, 22 bp, Homo sapiens
ctcaaggcaccgcagcctgtca

SEQ ID NO: 2999392 - DNA, 22 bp, Homo sapiens
ctcaaggttttaggttctaaag

SEQ ID NO: 2999393 - DNA, 23 bp, Homo sapiens
ctcaaggttttaggttctaaagt

SEQ ID NO: 2999394 - DNA, 13 bp, Homo sapiens
ctcaagtaaaaga

SEQ ID NO: 2999395 - DNA, 16 bp, Homo sapiens
ctcaagtaaaagaaaa

SEQ ID NO: 2999396 - DNA, 16 bp, Homo sapiens
ctcaagtgatcctcac

SEQ ID NO: 2999397 - DNA, 20 bp, Homo sapiens
ctcaagtgttcacaacctgg

SEQ ID NO: 2999398 - DNA, 20 bp, Homo sapiens
ctcaagttctaagattctaa

SEQ ID NO: 2999399 - DNA, 16 bp, Homo sapiens
ctcaagttgtttaact

SEQ ID NO: 2999400 - DNA, 14 bp, Homo sapiens
ctcaagtttttaca

SEQ ID NO: 2999401 - DNA, 15 bp, Homo sapiens
ctcaatactctctga

SEQ ID NO: 2999402 - DNA, 18 bp, Homo sapiens
ctcaatagctccaagctg

SEQ ID NO: 2999403 - DNA, 20 bp, Homo sapiens
ctcaatagctccaagctgtt

SEQ ID NO: 2999404 - DNA, 21 bp, Homo sapiens
ctcaatgcaagccccaacttt

SEQ ID NO: 2999405 - DNA, 16 bp, Homo sapiens
ctcaatgcttaggaga

SEQ ID NO: 2999406 - DNA, 21 bp, Homo sapiens
ctatcaagaggctgagacagg

SEQ ID NO: 2999407 - DNA, 17 bp, Homo sapiens
ctatcacctatttccat

SEQ ID NO: 2999408 - DNA, 19 bp, Homo sapiens
ctatcagacgtgctccctc

SEQ ID NO: 2999409 - DNA, 21 bp, Homo sapiens
ctatcaggcagaagaatcttt

SEQ ID NO: 2999410 - DNA, 13 bp, Homo sapiens
ctatcatggcata

SEQ ID NO: 2999411 - DNA, 18 bp, Homo sapiens
ctatcattgcttcctcct

SEQ ID NO: 2999412 - DNA, 14 bp, Homo sapiens
ctatccaaaggaat

SEQ ID NO: 2999413 - DNA, 13 bp, Homo sapiens
ctatccacactgt

SEQ ID NO: 2999414 - DNA, 17 bp, Homo sapiens
ctatccacactgtcaaa

SEQ ID NO: 2999415 - DNA, 16 bp, Homo sapiens
ctatccacccagccca

SEQ ID NO: 2999416 - DNA, 22 bp, Homo sapiens
ctcagccttgccagagatccaa

SEQ ID NO: 2999417 - DNA, 11 bp, Homo sapiens
ctcagccttgg

SEQ ID NO: 2999418 - DNA, 13 bp, Homo sapiens
ctcagcgggggcc

SEQ ID NO: 2999419 - DNA, 23 bp, Homo sapiens
ctcagctagttggggagctaagg

SEQ ID NO: 2999420 - DNA, 22 bp, Homo sapiens
ctcagctcatagtgaacacagc

SEQ ID NO: 2999421 - DNA, 13 bp, Homo sapiens
ctcagctcccagg

SEQ ID NO: 2999422 - DNA, 23 bp, Homo sapiens
ctcagctctgacattctgattcg

SEQ ID NO: 2999423 - DNA, 14 bp, Homo sapiens
ctcagctctgggcc

SEQ ID NO: 2999424 - DNA, 23 bp, Homo sapiens
ctcagctctgggccattctccac

SEQ ID NO: 2999425 - DNA, 12 bp, Homo sapiens
ctcagctctgtc

SEQ ID NO: 2999426 - DNA, 13 bp, Homo sapiens
ctcagctctgtcc

SEQ ID NO: 2999427 - DNA, 13 bp, Homo sapiens
ctcagctctgtct

SEQ ID NO: 2999428 - DNA, 18 bp, Homo sapiens
ctcagctcttggctccac

SEQ ID NO: 2999429 - DNA, 17 bp, Homo sapiens
ctcagctgcatctgata

SEQ ID NO: 2999430 - DNA, 14 bp, Homo sapiens
ctcagctgtggtcc

SEQ ID NO: 2999431 - DNA, 22 bp, Homo sapiens
ctcagcttccccaacacgcagg

SEQ ID NO: 2999432 - DNA, 18 bp, Homo sapiens
ctcagcttctaattttgt

SEQ ID NO: 2999433 - DNA, 16 bp, Homo sapiens
ctcagcttgcagctgg

SEQ ID NO: 2999434 - DNA, 18 bp, Homo sapiens
ctcaggaaccgaggcagg

SEQ ID NO: 2999435 - DNA, 14 bp, Homo sapiens
ctcaggaagaacac

SEQ ID NO: 2999436 - DNA, 19 bp, Homo sapiens
ctcaggaagcccccaagtt

SEQ ID NO: 2999437 - DNA, 17 bp, Homo sapiens
ctcaggaattccaatta

SEQ ID NO: 2999438 - DNA, 19 bp, Homo sapiens
ctcaggacagatgccacac

SEQ ID NO: 2999439 - DNA, 20 bp, Homo sapiens
ctcaggaccaaagctttcat

SEQ ID NO: 2999440 - DNA, 22 bp, Homo sapiens
ctcaggaccaaagctttcatgt

SEQ ID NO: 2999441 - DNA, 12 bp, Homo sapiens
ctcaggagccat

SEQ ID NO: 2999442 - DNA, 12 bp, Homo sapiens
ctcaggaggagg

SEQ ID NO: 2999443 - DNA, 24 bp, Homo sapiens
ctcaggaggaggctgccctgaggg

SEQ ID NO: 2999444 - DNA, 17 bp, Homo sapiens
ctcaggaggctgagaca

SEQ ID NO: 2999445 - DNA, 15 bp, Homo sapiens
ctcaggaggctgagg

SEQ ID NO: 2999446 - DNA, 13 bp, Homo sapiens
ctcaggcacacag

SEQ ID NO: 2999447 - DNA, 20 bp, Homo sapiens
ctcaggccaagaaacgtctt

SEQ ID NO: 2999448 - DNA, 17 bp, Homo sapiens
ctcaggccagagccaag

SEQ ID NO: 2999449 - DNA, 14 bp, Homo sapiens
ctcaggctgtccca

SEQ ID NO: 2999450 - DNA, 17 bp, Homo sapiens
ctcagggaaaagcagct

SEQ ID NO: 2999451 - DNA, 14 bp, Homo sapiens
ctcagggacagaga

SEQ ID NO: 2999452 - DNA, 21 bp, Homo sapiens
ctcagggacagagacacctgc

SEQ ID NO: 2999453 - DNA, 22 bp, Homo sapiens
ctcagggacagagacacctgca

SEQ ID NO: 2999454 - DNA, 23 bp, Homo sapiens
ctcagggacagagacacctgcac

SEQ ID NO: 2999455 - DNA, 14 bp, Homo sapiens
ctcagggcagcctc

SEQ ID NO: 2999456 - DNA, 15 bp, Homo sapiens
ctcagggcagctgcc

SEQ ID NO: 2999457 - DNA, 19 bp, Homo sapiens
ctcagggcagctgcctggc

SEQ ID NO: 2999458 - DNA, 22 bp, Homo sapiens
ctcagggcagctgcctggccat

SEQ ID NO: 2999459 - DNA, 17 bp, Homo sapiens
ctcagggcagctgtgct

SEQ ID NO: 2999460 - DNA, 13 bp, Homo sapiens
ctcagggccagga

SEQ ID NO: 2999461 - DNA, 16 bp, Homo sapiens
ctcagggccaggaagg

SEQ ID NO: 2999462 - DNA, 14 bp, Homo sapiens
ctcagggctcctgg

SEQ ID NO: 2999463 - DNA, 20 bp, Homo sapiens
ctcaggggaagctgctaggg

SEQ ID NO: 2999464 - DNA, 17 bp, Homo sapiens
ctcaggggacactggcc

SEQ ID NO: 2999465 - DNA, 20 bp, Homo sapiens
ctcaggggatgtttacctgg

SEQ ID NO: 2999466 - DNA, 19 bp, Homo sapiens
ctcaggggtcactgaggcc

SEQ ID NO: 2999467 - DNA, 16 bp, Homo sapiens
ctcaggggtgtgcctg

SEQ ID NO: 2999468 - DNA, 14 bp, Homo sapiens
ctcaggtaaatctt

SEQ ID NO: 2999469 - DNA, 23 bp, Homo sapiens
ctcaggtagaaggttgacacagt

SEQ ID NO: 2999470 - DNA, 20 bp, Homo sapiens
ctcaggtccctggggctagg

SEQ ID NO: 2999471 - DNA, 13 bp, Homo sapiens
ctcaggtgcacac

SEQ ID NO: 2999472 - DNA, 19 bp, Homo sapiens
ctcaggtggccatgcctca

SEQ ID NO: 2999473 - DNA, 17 bp, Homo sapiens
ctcaggtgtagctgagc

SEQ ID NO: 2999474 - DNA, 20 bp, Homo sapiens
ctcaggttcacagcagcttt

SEQ ID NO: 2999475 - DNA, 13 bp, Homo sapiens
ctcagtacctgtg

SEQ ID NO: 2999476 - DNA, 18 bp, Homo sapiens
ctcagtactttggaggcc

SEQ ID NO: 2999477 - DNA, 20 bp, Homo sapiens
ctcagtactttggaggcccc

SEQ ID NO: 2999478 - DNA, 21 bp, Homo sapiens
ctcagtactttggaggcccct

SEQ ID NO: 2999479 - DNA, 18 bp, Homo sapiens
ctcagtagcatctcagtg

SEQ ID NO: 2999480 - DNA, 14 bp, Homo sapiens
ctcagtctgttcac

SEQ ID NO: 2999481 - DNA, 15 bp, Homo sapiens
ctcagtgattcgctt

SEQ ID NO: 2999482 - DNA, 18 bp, Homo sapiens
ctcagtgcaaaatgtctt

SEQ ID NO: 2999483 - DNA, 15 bp, Homo sapiens
ctcagtgcaacctct

SEQ ID NO: 2999484 - DNA, 16 bp, Homo sapiens
ctcagtgcaacctctg

SEQ ID NO: 2999485 - DNA, 17 bp, Homo sapiens
ctcagtgcatttgtgct

SEQ ID NO: 2999486 - DNA, 16 bp, Homo sapiens
ctcagtgccaactgtg

SEQ ID NO: 2999487 - DNA, 21 bp, Homo sapiens
ctcagtgccggaggccttggg

SEQ ID NO: 2999488 - DNA, 13 bp, Homo sapiens
ctcagtgccttct

SEQ ID NO: 2999489 - DNA, 16 bp, Homo sapiens
ctcagtgccttctctc

SEQ ID NO: 2999490 - DNA, 18 bp, Homo sapiens
ctcagtgccttctctcag

SEQ ID NO: 2999491 - DNA, 18 bp, Homo sapiens
ctcagtggtgtgtgaagt

SEQ ID NO: 2999492 - DNA, 22 bp, Homo sapiens
ctcagtgtctggctgcagagca

SEQ ID NO: 2999493 - DNA, 17 bp, Homo sapiens
ctcagtgttttggactc

SEQ ID NO: 2999494 - DNA, 22 bp, Homo sapiens
ctcagtgttttggactccatct

SEQ ID NO: 2999495 - DNA, 23 bp, Homo sapiens
ctcagtgttttggactccatctc

SEQ ID NO: 2999496 - DNA, 18 bp, Homo sapiens
ctcagttaagtgtttcct

SEQ ID NO: 2999497 - DNA, 12 bp, Homo sapiens
ctcagttctcaa

SEQ ID NO: 2999498 - DNA, 13 bp, Homo sapiens
ctcagttctcaaa

SEQ ID NO: 2999499 - DNA, 18 bp, Homo sapiens
ctcagttgattttctgga

SEQ ID NO: 2999500 - DNA, 20 bp, Homo sapiens
ctcagttgattttctggatt

SEQ ID NO: 2999501 - DNA, 17 bp, Homo sapiens
ctcagttgctaaacact

SEQ ID NO: 2999502 - DNA, 14 bp, Homo sapiens
ctcagttgtagaat

SEQ ID NO: 2999503 - DNA, 20 bp, Homo sapiens
ctcagttgtgactaactaga

SEQ ID NO: 2999504 - DNA, 14 bp, Homo sapiens
ctcagttgtgcagc

SEQ ID NO: 2999505 - DNA, 12 bp, Homo sapiens
ctcagtttcata

SEQ ID NO: 2999506 - DNA, 14 bp, Homo sapiens
ctcataaattaatg

SEQ ID NO: 2999507 - DNA, 22 bp, Homo sapiens
ctcataactctgtgatcttgct

SEQ ID NO: 2999508 - DNA, 16 bp, Homo sapiens
ctcataatgtgaaata

SEQ ID NO: 2999509 - DNA, 17 bp, Homo sapiens
ctcataatgtgaagtgt

SEQ ID NO: 2999510 - DNA, 19 bp, Homo sapiens
ctcatagcaggaaatgtag

SEQ ID NO: 2999511 - DNA, 16 bp, Homo sapiens
ctcatcacacacatgg

SEQ ID NO: 2999512 - DNA, 16 bp, Homo sapiens
ctcatcactgtggctg

SEQ ID NO: 2999513 - DNA, 21 bp, Homo sapiens
ctcatcactgtggctgtctgg

SEQ ID NO: 2999514 - DNA, 20 bp, Homo sapiens
ctcatcaggagttccagtgc

SEQ ID NO: 2999515 - DNA, 21 bp, Homo sapiens
ctcatcaggagttccagtgct

SEQ ID NO: 2999516 - DNA, 22 bp, Homo sapiens
ctcatcaggagttccagtgctg

SEQ ID NO: 2999517 - DNA, 13 bp, Homo sapiens
ctcatcattctct

SEQ ID NO: 2999518 - DNA, 14 bp, Homo sapiens
ctcatcattctctg

SEQ ID NO: 2999519 - DNA, 17 bp, Homo sapiens
ctcatcattctctgtct

SEQ ID NO: 2999520 - DNA, 19 bp, Homo sapiens
ctcatcattctctgtctca

SEQ ID NO: 2999521 - DNA, 20 bp, Homo sapiens
ctcatccaaacaatttaaaa

SEQ ID NO: 2999522 - DNA, 14 bp, Homo sapiens
ctcatcctcctcct

SEQ ID NO: 2999523 - DNA, 16 bp, Homo sapiens
ctcatcctcctcctca

SEQ ID NO: 2999524 - DNA, 14 bp, Homo sapiens
ctcatcctgaacag

SEQ ID NO: 2999525 - DNA, 16 bp, Homo sapiens
ctcatcctgcttctct

SEQ ID NO: 2999526 - DNA, 12 bp, Homo sapiens
ctcatccttaat

SEQ ID NO: 2999527 - DNA, 14 bp, Homo sapiens
ctcatcgggcccag

SEQ ID NO: 2999528 - DNA, 15 bp, Homo sapiens
ctcatcgtcttttag

SEQ ID NO: 2999529 - DNA, 19 bp, Homo sapiens
ctcatctgagccagcaccg

SEQ ID NO: 2999530 - DNA, 20 bp, Homo sapiens
ctcatctgagccagcaccgc

SEQ ID NO: 2999531 - DNA, 16 bp, Homo sapiens
ctcatctgcctggaaa

SEQ ID NO: 2999532 - DNA, 18 bp, Homo sapiens
ctcatctgcctggaaagt

SEQ ID NO: 2999533 - DNA, 17 bp, Homo sapiens
ctcatctgtccctccgg

SEQ ID NO: 2999534 - DNA, 12 bp, Homo sapiens
ctcatctgtgcc

SEQ ID NO: 2999535 - DNA, 21 bp, Homo sapiens
ctcatctgtgcctgtctgtcc

SEQ ID NO: 2999536 - DNA, 12 bp, Homo sapiens
ctcatcttaaaa

SEQ ID NO: 2999537 - DNA, 13 bp, Homo sapiens
ctcatcttagttc

SEQ ID NO: 2999538 - DNA, 17 bp, Homo sapiens
ctcatcttcttcaccat

SEQ ID NO: 2999539 - DNA, 15 bp, Homo sapiens
ctcatctttaaaatg

SEQ ID NO: 2999540 - DNA, 15 bp, Homo sapiens
ctcatgaggaccagg

SEQ ID NO: 2999541 - DNA, 20 bp, Homo sapiens
ctcatgaggaccagggtgga

SEQ ID NO: 2999542 - DNA, 23 bp, Homo sapiens
ctcatgaggaggggcccccctgc

SEQ ID NO: 2999543 - DNA, 21 bp, Homo sapiens
ctcatgagtctacctgagcat

SEQ ID NO: 2999544 - DNA, 14 bp, Homo sapiens
ctcatggcaagatt

SEQ ID NO: 2999545 - DNA, 16 bp, Homo sapiens
ctcatgggaaggggag

SEQ ID NO: 2999546 - DNA, 15 bp, Homo sapiens
ctcatgggacctgcc

SEQ ID NO: 2999547 - DNA, 15 bp, Homo sapiens
ctcatgtcatttctc

SEQ ID NO: 2999548 - DNA, 17 bp, Homo sapiens
ctcatgtcatttctcat

SEQ ID NO: 2999549 - DNA, 12 bp, Homo sapiens
ctcatgtgtccc

SEQ ID NO: 2999550 - DNA, 13 bp, Homo sapiens
ctcatgttttcca

SEQ ID NO: 2999551 - DNA, 23 bp, Homo sapiens
ctcattaaatattctgtacattt

SEQ ID NO: 2999552 - DNA, 20 bp, Homo sapiens
ctcattaaatggtgatttct

SEQ ID NO: 2999553 - DNA, 17 bp, Homo sapiens
ctcagagtcggaacgga

SEQ ID NO: 2999554 - DNA, 18 bp, Homo sapiens
ctcagagttctatactgt

SEQ ID NO: 2999555 - DNA, 17 bp, Homo sapiens
ctcagatcactgcaacc

SEQ ID NO: 2999556 - DNA, 13 bp, Homo sapiens
ctcagatccaggg

SEQ ID NO: 2999557 - DNA, 16 bp, Homo sapiens
ctcagatccagggaca

SEQ ID NO: 2999558 - DNA, 17 bp, Homo sapiens
ctcagatccttgtttca

SEQ ID NO: 2999559 - DNA, 13 bp, Homo sapiens
ctcagcagaggca

SEQ ID NO: 2999560 - DNA, 15 bp, Homo sapiens
ctcagcagaggcagt

SEQ ID NO: 2999561 - DNA, 20 bp, Homo sapiens
ctcagcagatttcaggtgta

SEQ ID NO: 2999562 - DNA, 12 bp, Homo sapiens
ctcagcagccct

SEQ ID NO: 2999563 - DNA, 22 bp, Homo sapiens
ctcagcaggagcccccagctgc

SEQ ID NO: 2999564 - DNA, 21 bp, Homo sapiens
ctcagcataggtatgcttact

SEQ ID NO: 2999565 - DNA, 14 bp, Homo sapiens
ctcagcatttgatt

SEQ ID NO: 2999566 - DNA, 20 bp, Homo sapiens
ctcagcatttgattaacatt

SEQ ID NO: 2999567 - DNA, 16 bp, Homo sapiens
ctcagccaagcacagt

SEQ ID NO: 2999568 - DNA, 17 bp, Homo sapiens
ctcagccaagcacagtg

SEQ ID NO: 2999569 - DNA, 14 bp, Homo sapiens
ctcagccagagaag

SEQ ID NO: 2999570 - DNA, 11 bp, Homo sapiens
ctcagccagca

SEQ ID NO: 2999571 - DNA, 19 bp, Homo sapiens
ctcagccataggtgcagtt

SEQ ID NO: 2999572 - DNA, 12 bp, Homo sapiens
ctcagcccagct

SEQ ID NO: 2999573 - DNA, 17 bp, Homo sapiens
ctcagccccgcgtggaa

SEQ ID NO: 2999574 - DNA, 21 bp, Homo sapiens
ctcagcccctacccctgccct

SEQ ID NO: 2999575 - DNA, 15 bp, Homo sapiens
ctcagccctgaccct

SEQ ID NO: 2999576 - DNA, 14 bp, Homo sapiens
ctcagccctgggcc

SEQ ID NO: 2999577 - DNA, 15 bp, Homo sapiens
ctcagcctcccaaag

SEQ ID NO: 2999578 - DNA, 17 bp, Homo sapiens
ctcagcctcccaaagtg

SEQ ID NO: 2999579 - DNA, 14 bp, Homo sapiens
ctcagcctcctgag

SEQ ID NO: 2999580 - DNA, 14 bp, Homo sapiens
ctcagcctcctggg

SEQ ID NO: 2999581 - DNA, 23 bp, Homo sapiens
ctcagcctgatcaggcttcctgg

SEQ ID NO: 2999582 - DNA, 17 bp, Homo sapiens
ctcagccttgccagaga

SEQ ID NO: 2999583 - DNA, 19 bp, Homo sapiens
caatgagacttgccttcct

SEQ ID NO: 2999584 - DNA, 12 bp, Homo sapiens
caatgcactgag

SEQ ID NO: 2999585 - DNA, 16 bp, Homo sapiens
caatgcattctggaga

SEQ ID NO: 2999586 - DNA, 20 bp, Homo sapiens
caatgcattctggagacaga

SEQ ID NO: 2999587 - DNA, 22 bp, Homo sapiens
caatgccaaaaaaagacagggc

SEQ ID NO: 2999588 - DNA, 13 bp, Homo sapiens
caatgccatcatc

SEQ ID NO: 2999589 - DNA, 16 bp, Homo sapiens
caatgcctataaaatg

SEQ ID NO: 2999590 - DNA, 15 bp, Homo sapiens
caatgcctcagtagc

SEQ ID NO: 2999591 - DNA, 19 bp, Homo sapiens
caatgctgatgaatcactg

SEQ ID NO: 2999592 - DNA, 15 bp, Homo sapiens
ccttcacatctccca

SEQ ID NO: 2999593 - DNA, 15 bp, Homo sapiens
ccttcaccacctcat

SEQ ID NO: 2999594 - DNA, 22 bp, Homo sapiens
ccttcactggcgccttctcgga

SEQ ID NO: 2999595 - DNA, 18 bp, Homo sapiens
ccttcagaaccatccata

SEQ ID NO: 2999596 - DNA, 10 bp, Homo sapiens
ccttcagaca

SEQ ID NO: 2999597 - DNA, 11 bp, Homo sapiens
ccttcagacac

SEQ ID NO: 2999598 - DNA, 20 bp, Homo sapiens
ccttcagacaccctcaacct

SEQ ID NO: 2999599 - DNA, 19 bp, Homo sapiens
ccttcagagccagccggct

SEQ ID NO: 2999600 - DNA, 21 bp, Homo sapiens
ccttcagcagcagctcacacc

SEQ ID NO: 2999601 - DNA, 18 bp, Homo sapiens
ccttcagctcacgcttca

SEQ ID NO: 2999602 - DNA, 16 bp, Homo sapiens
ccttcagctttatttt

SEQ ID NO: 2999603 - DNA, 19 bp, Homo sapiens
ccttcagggtgatgccagg

SEQ ID NO: 2999604 - DNA, 20 bp, Homo sapiens
ccttcagggtgatgccaggt

SEQ ID NO: 2999605 - DNA, 16 bp, Homo sapiens
ccttcagtaaccccca

SEQ ID NO: 2999606 - DNA, 22 bp, Homo sapiens
ccttcagtaacccccactggac

SEQ ID NO: 2999607 - DNA, 21 bp, Homo sapiens
ccttcagtcttaatactttat

SEQ ID NO: 2999608 - DNA, 16 bp, Homo sapiens
ccttcagtgcccacca

SEQ ID NO: 2999609 - DNA, 19 bp, Homo sapiens
ccttcatctagttaaccaa

SEQ ID NO: 2999610 - DNA, 15 bp, Homo sapiens
ccttcattaaatgtt

SEQ ID NO: 2999611 - DNA, 20 bp, Homo sapiens
ccttcattgatttcctgtgt

SEQ ID NO: 2999612 - DNA, 16 bp, Homo sapiens
ccttccaacaggagct

SEQ ID NO: 2999613 - DNA, 12 bp, Homo sapiens
ccttccacctca

SEQ ID NO: 2999614 - DNA, 13 bp, Homo sapiens
ccttccacctcac

SEQ ID NO: 2999615 - DNA, 20 bp, Homo sapiens
ccttccacggatccatgtag

SEQ ID NO: 2999616 - DNA, 19 bp, Homo sapiens
ccttccacgtgtatgcaag

SEQ ID NO: 2999617 - DNA, 15 bp, Homo sapiens
ccttccactgagggc

SEQ ID NO: 2999618 - DNA, 14 bp, Homo sapiens
ccttccagaaaaca

SEQ ID NO: 2999619 - DNA, 22 bp, Homo sapiens
ccttccagcccagacccccagt

SEQ ID NO: 2999620 - DNA, 11 bp, Homo sapiens
ccttcccaagg

SEQ ID NO: 2999621 - DNA, 14 bp, Homo sapiens
ccttcccagctctc

SEQ ID NO: 2999622 - DNA, 17 bp, Homo sapiens
ccttcccagctctccct

SEQ ID NO: 2999623 - DNA, 17 bp, Homo sapiens
ccttcccagtgggctgt

SEQ ID NO: 2999624 - DNA, 13 bp, Homo sapiens
ccttccccagact

SEQ ID NO: 2999625 - DNA, 16 bp, Homo sapiens
ccttccccagacttgc

SEQ ID NO: 2999626 - DNA, 17 bp, Homo sapiens
cctccccaccagagctg

SEQ ID NO: 2999627 - DNA, 19 bp, Homo sapiens
cctccccaccagagctgcc

SEQ ID NO: 2999628 - DNA, 22 bp, Homo sapiens
cctccccaccagagctgcctcc

SEQ ID NO: 2999629 - DNA, 23 bp, Homo sapiens
cctccccaccagagctgcctccc

SEQ ID NO: 2999630 - DNA, 13 bp, Homo sapiens
cctccccacccaa

SEQ ID NO: 2999631 - DNA, 22 bp, Homo sapiens
cctccccaggggagagggtctg

SEQ ID NO: 2999632 - DNA, 19 bp, Homo sapiens
cctcccccacgtctctctg

SEQ ID NO: 2999633 - DNA, 21 bp, Homo sapiens
cctcccccacgtctctctgcc

SEQ ID NO: 2999634 - DNA, 13 bp, Homo sapiens
cctccccccactg

SEQ ID NO: 2999635 - DNA, 18 bp, Homo sapiens
cctccccccactgcaggc

SEQ ID NO: 2999636 - DNA, 18 bp, Homo sapiens
cctcccccggctgggcct

SEQ ID NO: 2999637 - DNA, 20 bp, Homo sapiens
cctccccctgccagtgcctt

SEQ ID NO: 2999638 - DNA, 14 bp, Homo sapiens
cctccccctgtccc

SEQ ID NO: 2999639 - DNA, 20 bp, Homo sapiens
cctccccgctccgtctctgt

SEQ ID NO: 2999640 - DNA, 21 bp, Homo sapiens
cctccccgctccgtctctgtc

SEQ ID NO: 2999641 - DNA, 23 bp, Homo sapiens
cctccccgctccgtctctgtcct

SEQ ID NO: 2999642 - DNA, 15 bp, Homo sapiens
cctcccctatccacc

SEQ ID NO: 2999643 - DNA, 22 bp, Homo sapiens
cctcccctatccacccagccca

SEQ ID NO: 2999644 - DNA, 16 bp, Homo sapiens
cctcccctctctgcac

SEQ ID NO: 2999645 - DNA, 20 bp, Homo sapiens
cctcccctgaggatcccctg

SEQ ID NO: 2999646 - DNA, 12 bp, Homo sapiens
cctcccctgccg

SEQ ID NO: 2999647 - DNA, 15 bp, Homo sapiens
cctcccctgccgcct

SEQ ID NO: 2999648 - DNA, 14 bp, Homo sapiens
cctcccgaggaggg

SEQ ID NO: 2999649 - DNA, 14 bp, Homo sapiens
cctcccgcaccttc

SEQ ID NO: 2999650 - DNA, 18 bp, Homo sapiens
cctcccgggaagcatcct

SEQ ID NO: 2999651 - DNA, 22 bp, Homo sapiens
cctccctcagccgtcagccatc

SEQ ID NO: 2999652 - DNA, 13 bp, Homo sapiens
cctccctcccaca

SEQ ID NO: 2999653 - DNA, 15 bp, Homo sapiens
cctccctccgcctcc

SEQ ID NO: 2999654 - DNA, 13 bp, Homo sapiens
cctccctcctcac

SEQ ID NO: 2999655 - DNA, 15 bp, Homo sapiens
cctccctcctcactc

SEQ ID NO: 2999656 - DNA, 16 bp, Homo sapiens
cctccctctgcctcat

SEQ ID NO: 2999657 - DNA, 21 bp, Homo sapiens
cctccctgaaacactgcttct

SEQ ID NO: 2999658 - DNA, 22 bp, Homo sapiens
cctccctgcatctgaccagcag

SEQ ID NO: 2999659 - DNA, 13 bp, Homo sapiens
cctccctgcctca

SEQ ID NO: 2999660 - DNA, 17 bp, Homo sapiens
cctccctgcgcttcctg

SEQ ID NO: 2999661 - DNA, 17 bp, Homo sapiens
cctccctggcagacaca

SEQ ID NO: 2999662 - DNA, 12 bp, Homo sapiens
cctccctgtcct

SEQ ID NO: 2999663 - DNA, 20 bp, Homo sapiens
cctccctgttccccagagaa

SEQ ID NO: 2999664 - DNA, 13 bp, Homo sapiens
cctcccttcccag

SEQ ID NO: 2999665 - DNA, 16 bp, Homo sapiens
cctcccttcccagtgg

SEQ ID NO: 2999666 - DNA, 19 bp, Homo sapiens
cctcccttccttgggcaga

SEQ ID NO: 2999667 - DNA, 10 bp, Homo sapiens
cctcccttct

SEQ ID NO: 2999668 - DNA, 17 bp, Homo sapiens
cctcccttctgctactg

SEQ ID NO: 2999669 - DNA, 21 bp, Homo sapiens
cctcccttgagtaggccctgc

SEQ ID NO: 2999670 - DNA, 16 bp, Homo sapiens
cctccgacctctctcg

SEQ ID NO: 2999671 - DNA, 14 bp, Homo sapiens
cctccgactccaga

SEQ ID NO: 2999672 - DNA, 15 bp, Homo sapiens
cctccgactccagat

SEQ ID NO: 2999673 - DNA, 13 bp, Homo sapiens
cctccgcacctga

SEQ ID NO: 2999674 - DNA, 14 bp, Homo sapiens
cctccgccaggcga

SEQ ID NO: 2999675 - DNA, 13 bp, Homo sapiens
cctccgcctactg

SEQ ID NO: 2999676 - DNA, 18 bp, Homo sapiens
cctccgcctactgtccct

SEQ ID NO: 2999677 - DNA, 21 bp, Homo sapiens
cctccgccttcccagcagcgg

SEQ ID NO: 2999678 - DNA, 18 bp, Homo sapiens
cctccgggacctggtgct

SEQ ID NO: 2999679 - DNA, 21 bp, Homo sapiens
cctccgggcaggggagccagg

SEQ ID NO: 2999680 - DNA, 13 bp, Homo sapiens
cctcctaaagctg

SEQ ID NO: 2999681 - DNA, 14 bp, Homo sapiens
cctcctaaagctga

SEQ ID NO: 2999682 - DNA, 14 bp, Homo sapiens
cctcctacctcagc

SEQ ID NO: 2999683 - DNA, 14 bp, Homo sapiens
cctcctcacactcc

SEQ ID NO: 2999684 - DNA, 16 bp, Homo sapiens
cctcctcacactccag

SEQ ID NO: 2999685 - DNA, 15 bp, Homo sapiens
cctcctcattcagac

SEQ ID NO: 2999686 - DNA, 16 bp, Homo sapiens
cctcctcattcagacc

SEQ ID NO: 2999687 - DNA, 14 bp, Homo sapiens
cctcctccaccacc

SEQ ID NO: 2999688 - DNA, 21 bp, Homo sapiens
cctcctcccccggctgggcct

SEQ ID NO: 2999689 - DNA, 17 bp, Homo sapiens
cctcctccctcctcact

SEQ ID NO: 2999690 - DNA, 18 bp, Homo sapiens
cctcctccctggctgcag

SEQ ID NO: 2999691 - DNA, 15 bp, Homo sapiens
cctcctccctgttat

SEQ ID NO: 2999692 - DNA, 16 bp, Homo sapiens
cctcctccgcatgcca

SEQ ID NO: 2999693 - DNA, 14 bp, Homo sapiens
cctcctcctccctc

SEQ ID NO: 2999694 - DNA, 14 bp, Homo sapiens
cctcctctcagtgt

SEQ ID NO: 2999695 - DNA, 16 bp, Homo sapiens
cctcctctcccgtctc

SEQ ID NO: 2999696 - DNA, 19 bp, Homo sapiens
cctcctctctccctgcctc

SEQ ID NO: 2999697 - DNA, 20 bp, Homo sapiens
cctcctctctccctgcctca

SEQ ID NO: 2999698 - DNA, 22 bp, Homo sapiens
cctcctctctccctgcctcaca

SEQ ID NO: 2999699 - DNA, 17 bp, Homo sapiens
cctcctctgaaacagct

SEQ ID NO: 2999700 - DNA, 18 bp, Homo sapiens
cctcctctgaaacagctg

SEQ ID NO: 2999701 - DNA, 23 bp, Homo sapiens
cctcctctgaaacagctgcctta

SEQ ID NO: 2999702 - DNA, 12 bp, Homo sapiens
cctcctctgcca

SEQ ID NO: 2999703 - DNA, 13 bp, Homo sapiens
cctcctctgccac

SEQ ID NO: 2999704 - DNA, 20 bp, Homo sapiens
cctcctctgccacctcccct

SEQ ID NO: 2999705 - DNA, 21 bp, Homo sapiens
cctcctctgccacctccccta

SEQ ID NO: 2999706 - DNA, 15 bp, Homo sapiens
cctcctctgcccggg

SEQ ID NO: 2999707 - DNA, 13 bp, Homo sapiens
cctcctctgtgaa

SEQ ID NO: 2999708 - DNA, 22 bp, Homo sapiens
cctcctctgtgaccaatgtctt

SEQ ID NO: 2999709 - DNA, 19 bp, Homo sapiens
cctcctgatgtttgtatca

SEQ ID NO: 2999710 - DNA, 12 bp, Homo sapiens
cctcctgccagc

SEQ ID NO: 2999711 - DNA, 16 bp, Homo sapiens
cctcctgccagctctg

SEQ ID NO: 2999712 - DNA, 17 bp, Homo sapiens
cctcctgcccacctgtc

SEQ ID NO: 2999713 - DNA, 14 bp, Homo sapiens
cctcctgcccagga

SEQ ID NO: 2999714 - DNA, 15 bp, Homo sapiens
cctcctgctactctg

SEQ ID NO: 2999715 - DNA, 21 bp, Homo sapiens
cctcctggacattttttcagt

SEQ ID NO: 2999716 - DNA, 23 bp, Homo sapiens
cctcctggagctctgtgggtctc

SEQ ID NO: 2999717 - DNA, 19 bp, Homo sapiens
cctcctggcctcagactgc

SEQ ID NO: 2999718 - DNA, 15 bp, Homo sapiens
cctcctggctcaggc

SEQ ID NO: 2999719 - DNA, 19 bp, Homo sapiens
cctcctggtgtcaccccag

SEQ ID NO: 2999720 - DNA, 22 bp, Homo sapiens
cctcctggtgtcaccccagagc

SEQ ID NO: 2999721 - DNA, 15 bp, Homo sapiens
cctcctgttccgtgt

SEQ ID NO: 2999722 - DNA, 14 bp, Homo sapiens
cctcctgttctgaa

SEQ ID NO: 2999723 - DNA, 13 bp, Homo sapiens
cctccttacatta

SEQ ID NO: 2999724 - DNA, 22 bp, Homo sapiens
cctccttcagacaccctcaacc

SEQ ID NO: 2999725 - DNA, 15 bp, Homo sapiens
cctccttgccagccc

SEQ ID NO: 2999726 - DNA, 15 bp, Homo sapiens
cctccttgggcaggg

SEQ ID NO: 2999727 - DNA, 17 bp, Homo sapiens
cctccttgggcagggtc

SEQ ID NO: 2999728 - DNA, 17 bp, Homo sapiens
cctccttggtgcctggc

SEQ ID NO: 2999729 - DNA, 13 bp, Homo sapiens
cctcctttctctg

SEQ ID NO: 2999730 - DNA, 23 bp, Homo sapiens
cctcctttgtcttttttttcatc

SEQ ID NO: 2999731 - DNA, 20 bp, Homo sapiens
cctcgaaacacagaaacctt

SEQ ID NO: 2999732 - DNA, 17 bp, Homo sapiens
cctcgaattttatctgt

SEQ ID NO: 2999733 - DNA, 14 bp, Homo sapiens
cctcgaccctgtgc

SEQ ID NO: 2999734 - DNA, 21 bp, Homo sapiens
cctcgaccctgtgcaggagct

SEQ ID NO: 2999735 - DNA, 22 bp, Homo sapiens
cctcgaggaaggggggccgccg

SEQ ID NO: 2999736 - DNA, 21 bp, Homo sapiens
cctcgagggccgcctgcctta

SEQ ID NO: 2999737 - DNA, 23 bp, Homo sapiens
cctcgaggtgccttcttcagggc

SEQ ID NO: 2999738 - DNA, 13 bp, Homo sapiens
cctcgagtactgt

SEQ ID NO: 2999739 - DNA, 13 bp, Homo sapiens
cctcgcacacact

SEQ ID NO: 2999740 - DNA, 19 bp, Homo sapiens
cctcgcacaggccctagct

SEQ ID NO: 2999741 - DNA, 12 bp, Homo sapiens
cctcgccctggg

SEQ ID NO: 2999742 - DNA, 13 bp, Homo sapiens
cctcgccctgggt

SEQ ID NO: 2999743 - DNA, 14 bp, Homo sapiens
cctcgcctgccctc

SEQ ID NO: 2999744 - DNA, 18 bp, Homo sapiens
cctcgcctgccctcctct

SEQ ID NO: 2999745 - DNA, 20 bp, Homo sapiens
cctcgcctgccctcctctcc

SEQ ID NO: 2999746 - DNA, 21 bp, Homo sapiens
cctcgcctgccctcctctccc

SEQ ID NO: 2999747 - DNA, 21 bp, Homo sapiens
cctcgctctgttacccagggt

SEQ ID NO: 2999748 - DNA, 17 bp, Homo sapiens
cctcggacacccagggt

SEQ ID NO: 2999749 - DNA, 14 bp, Homo sapiens
cctcggaggctcct

SEQ ID NO: 2999750 - DNA, 16 bp, Homo sapiens
cctcggaggctcctcc

SEQ ID NO: 2999751 - DNA, 17 bp, Homo sapiens
cctcggaggctcctccc

SEQ ID NO: 2999752 - DNA, 17 bp, Homo sapiens
cctcggatcaccgagag

SEQ ID NO: 2999753 - DNA, 23 bp, Homo sapiens
cctcggcagaactctctgtcttc

SEQ ID NO: 2999754 - DNA, 19 bp, Homo sapiens
cctcggcccatctgtccat

SEQ ID NO: 2999755 - DNA, 21 bp, Homo sapiens
cctcggcccatctgtccatcc

SEQ ID NO: 2999756 - DNA, 22 bp, Homo sapiens
cctcggcccatctgtccatcct

SEQ ID NO: 2999757 - DNA, 14 bp, Homo sapiens
cctcggccctccct

SEQ ID NO: 2999758 - DNA, 15 bp, Homo sapiens
cctcggctctggagg

SEQ ID NO: 2999759 - DNA, 16 bp, Homo sapiens
cctgcagagtttggat

SEQ ID NO: 2999760 - DNA, 15 bp, Homo sapiens
cctgcaggacctgcc

SEQ ID NO: 2999761 - DNA, 19 bp, Homo sapiens
cctgcaggacctgcctgta

SEQ ID NO: 2999762 - DNA, 20 bp, Homo sapiens
cctgcaggacctgcctgtag

SEQ ID NO: 2999763 - DNA, 14 bp, Homo sapiens
cctgcaggagcagg

SEQ ID NO: 2999764 - DNA, 20 bp, Homo sapiens
cctgcaggctgcaggagggc

SEQ ID NO: 2999765 - DNA, 13 bp, Homo sapiens
cctgcagtgccag

SEQ ID NO: 2999766 - DNA, 20 bp, Homo sapiens
cctgcagttaattagcattc

SEQ ID NO: 2999767 - DNA, 19 bp, Homo sapiens
cctgcatccgtagttccct

SEQ ID NO: 2999768 - DNA, 22 bp, Homo sapiens
cctgcatccgtagttccctgaa

SEQ ID NO: 2999769 - DNA, 13 bp, Homo sapiens
cctgcatggacag

SEQ ID NO: 2999770 - DNA, 20 bp, Homo sapiens
cctgcatgtaaacacgcctg

SEQ ID NO: 2999771 - DNA, 19 bp, Homo sapiens
cctgcatttttaaaggaca

SEQ ID NO: 2999772 - DNA, 14 bp, Homo sapiens
cctgccaccagcat

SEQ ID NO: 2999773 - DNA, 21 bp, Homo sapiens
cctgccaccctgggcctggca

SEQ ID NO: 2999774 - DNA, 15 bp, Homo sapiens
cctgccaccgactgc

SEQ ID NO: 2999775 - DNA, 19 bp, Homo sapiens
cctgccaccgactgcccag

SEQ ID NO: 2999776 - DNA, 16 bp, Homo sapiens
cctgccactcaccctt

SEQ ID NO: 2999777 - DNA, 17 bp, Homo sapiens
cctgccactcacccttc

SEQ ID NO: 2999778 - DNA, 15 bp, Homo sapiens
cctgccagaggatgc

SEQ ID NO: 2999779 - DNA, 14 bp, Homo sapiens
cctgccagcccggc

SEQ ID NO: 2999780 - DNA, 12 bp, Homo sapiens
cctgccagctct

SEQ ID NO: 2999781 - DNA, 15 bp, Homo sapiens
cctgccagctctgtc

SEQ ID NO: 2999782 - DNA, 12 bp, Homo sapiens
cctgccagctgc

SEQ ID NO: 2999783 - DNA, 23 bp, Homo sapiens
cctgccagctgcactgatgctgc

SEQ ID NO: 2999784 - DNA, 13 bp, Homo sapiens
cctgccagtgcct

SEQ ID NO: 2999785 - DNA, 22 bp, Homo sapiens
cctgccagtgccttacctcctg

SEQ ID NO: 2999786 - DNA, 23 bp, Homo sapiens
cctgccagtgccttacctcctgc

SEQ ID NO: 2999787 - DNA, 16 bp, Homo sapiens
cctgccatcatgcctg

SEQ ID NO: 2999788 - DNA, 19 bp, Homo sapiens
cctgccatcttctccccga

SEQ ID NO: 2999789 - DNA, 20 bp, Homo sapiens
cctgcccaagtgaccaggga

SEQ ID NO: 2999790 - DNA, 17 bp, Homo sapiens
cctgcccacccccggga

SEQ ID NO: 2999791 - DNA, 12 bp, Homo sapiens
cctgcccacctg

SEQ ID NO: 2999792 - DNA, 18 bp, Homo sapiens
cctgcccacctgcctggc

SEQ ID NO: 2999793 - DNA, 15 bp, Homo sapiens
cctgcccagcctcaa

SEQ ID NO: 2999794 - DNA, 14 bp, Homo sapiens
cctgcccagcctgg

SEQ ID NO: 2999795 - DNA, 14 bp, Homo sapiens
cctgcccatttcat

SEQ ID NO: 2999796 - DNA, 13 bp, Homo sapiens
cctgcccccaagt

SEQ ID NO: 2999797 - DNA, 15 bp, Homo sapiens
cctgcccccaagtca

SEQ ID NO: 2999798 - DNA, 22 bp, Homo sapiens
cctgcccccagaccttttatcc

SEQ ID NO: 2999799 - DNA, 22 bp, Homo sapiens
cctgccccctcgggggcctgtg

SEQ ID NO: 2999800 - DNA, 16 bp, Homo sapiens
cctgcccctcagagac

SEQ ID NO: 2999801 - DNA, 15 bp, Homo sapiens
cctgcccctccccct

SEQ ID NO: 2999802 - DNA, 14 bp, Homo sapiens
cctgcccctgtgcc

SEQ ID NO: 2999803 - DNA, 18 bp, Homo sapiens
cctgcccctgtgcctctg

SEQ ID NO: 2999804 - DNA, 16 bp, Homo sapiens
cctgcccgcaccctgg

SEQ ID NO: 2999805 - DNA, 20 bp, Homo sapiens
cctgcccgcaccctggcctg

SEQ ID NO: 2999806 - DNA, 19 bp, Homo sapiens
cctgcccgcagacctctgg

SEQ ID NO: 2999807 - DNA, 15 bp, Homo sapiens
cctgcccgtgtacat

SEQ ID NO: 2999808 - DNA, 14 bp, Homo sapiens
cctgccctcatggg

SEQ ID NO: 2999809 - DNA, 19 bp, Homo sapiens
cctgccctcccgcaccttc

SEQ ID NO: 2999810 - DNA, 16 bp, Homo sapiens
cctgccctcctctccc

SEQ ID NO: 2999811 - DNA, 17 bp, Homo sapiens
cctgccctcctctcccg

SEQ ID NO: 2999812 - DNA, 18 bp, Homo sapiens
cctgccctcctctcccgt

SEQ ID NO: 2999813 - DNA, 21 bp, Homo sapiens
cctgccctcctctcccgtctc

SEQ ID NO: 2999814 - DNA, 13 bp, Homo sapiens
cctgccctgccca

SEQ ID NO: 2999815 - DNA, 16 bp, Homo sapiens
cctgccctgcccaagt

SEQ ID NO: 2999816 - DNA, 18 bp, Homo sapiens
cctgccctgcccaagtga

SEQ ID NO: 2999817 - DNA, 15 bp, Homo sapiens
cctgccctgccccct

SEQ ID NO: 2999818 - DNA, 23 bp, Homo sapiens
cctgccctgctatttcaggccct

SEQ ID NO: 2999819 - DNA, 14 bp, Homo sapiens
cctgccctgtgccg

SEQ ID NO: 2999820 - DNA, 23 bp, Homo sapiens
cctgccctgtgccgcactctggc

SEQ ID NO: 2999821 - DNA, 14 bp, Homo sapiens
cctgcccttttcct

SEQ ID NO: 2999822 - DNA, 18 bp, Homo sapiens
cctgccgacctcgtcctc

SEQ ID NO: 2999823 - DNA, 15 bp, Homo sapiens
cctgccggacacagc

SEQ ID NO: 2999824 - DNA, 21 bp, Homo sapiens
cctgccggagaggaagagaca

SEQ ID NO: 2999825 - DNA, 20 bp, Homo sapiens
cctgccggtaaacacgcctg

SEQ ID NO: 2999826 - DNA, 19 bp, Homo sapiens
cctgccgtggtggcagctg

SEQ ID NO: 2999827 - DNA, 16 bp, Homo sapiens
cctgcctagctcttgg

SEQ ID NO: 2999828 - DNA, 19 bp, Homo sapiens
cctgcctagctcttgggcc

SEQ ID NO: 2999829 - DNA, 20 bp, Homo sapiens
cctgcctagctcttgggcct

SEQ ID NO: 2999830 - DNA, 9 bp, Homo sapiens
cctgcctca

SEQ ID NO: 2999831 - DNA, 11 bp, Homo sapiens
cctgcctcagc

SEQ ID NO: 2999832 - DNA, 12 bp, Homo sapiens
cctgcctcagcc

SEQ ID NO: 2999833 - DNA, 16 bp, Homo sapiens
cctgcctcagcctccc

SEQ ID NO: 2999834 - DNA, 14 bp, Homo sapiens
cctgcctcagctac

SEQ ID NO: 2999835 - DNA, 14 bp, Homo sapiens
cctgcctccaggaa

SEQ ID NO: 2999836 - DNA, 20 bp, Homo sapiens
cctgcctcctggctcaggcc

SEQ ID NO: 2999837 - DNA, 14 bp, Homo sapiens
cctgcctcgagggc

SEQ ID NO: 2999838 - DNA, 19 bp, Homo sapiens
cctgcctcgagggccgcct

SEQ ID NO: 2999839 - DNA, 23 bp, Homo sapiens
cctgcctcgagggccgcctgcct

SEQ ID NO: 2999840 - DNA, 23 bp, Homo sapiens
cctgcctgctgtggagcccattg

SEQ ID NO: 2999841 - DNA, 14 bp, Homo sapiens
cctgcctggcaggc

SEQ ID NO: 2999842 - DNA, 16 bp, Homo sapiens
cctgcctggccggcca

SEQ ID NO: 2999843 - DNA, 20 bp, Homo sapiens
cctgccttagcaatgggggc

SEQ ID NO: 2999844 - DNA, 14 bp, Homo sapiens
cctgccttcctcct

SEQ ID NO: 2999845 - DNA, 17 bp, Homo sapiens
cctgccttcctcctggg

SEQ ID NO: 2999846 - DNA, 14 bp, Homo sapiens
cctgcctttgcctc

SEQ ID NO: 2999847 - DNA, 13 bp, Homo sapiens
cctgccttttcta

SEQ ID NO: 2999848 - DNA, 17 bp, Homo sapiens
cctgcgaccctgggggc

SEQ ID NO: 2999849 - DNA, 13 bp, Homo sapiens
cctgcgcacaggt

SEQ ID NO: 2999850 - DNA, 20 bp, Homo sapiens
cctgcgcccagtccttccac

SEQ ID NO: 2999851 - DNA, 14 bp, Homo sapiens
cctgcgcctccatc

SEQ ID NO: 2999852 - DNA, 15 bp, Homo sapiens
cctgcgcctccatcc

SEQ ID NO: 2999853 - DNA, 16 bp, Homo sapiens
cctgcgcctccatcca

SEQ ID NO: 2999854 - DNA, 21 bp, Homo sapiens
cctgcgctttgaacgtgccag

SEQ ID NO: 2999855 - DNA, 14 bp, Homo sapiens
cctgcgggccacag

SEQ ID NO: 2999856 - DNA, 15 bp, Homo sapiens
cctgcgggccacagg

SEQ ID NO: 2999857 - DNA, 19 bp, Homo sapiens
cctgcgggcttttccccgg

SEQ ID NO: 2999858 - DNA, 20 bp, Homo sapiens
cctgcgggtcctcagctgct

SEQ ID NO: 2999859 - DNA, 22 bp, Homo sapiens
cctgcgggtcctcagctgctcc

SEQ ID NO: 2999860 - DNA, 16 bp, Homo sapiens
cctgcggtacaggagt

SEQ ID NO: 2999861 - DNA, 19 bp, Homo sapiens
cctgcgtgcgctggttccg

SEQ ID NO: 2999862 - DNA, 13 bp, Homo sapiens
cctgctactctgt

SEQ ID NO: 2999863 - DNA, 17 bp, Homo sapiens
cctgctagcaggccccc

SEQ ID NO: 2999864 - DNA, 19 bp, Homo sapiens
cctgctagcaggcccccta

SEQ ID NO: 2999865 - DNA, 21 bp, Homo sapiens
cctgctagcaggccccctagg

SEQ ID NO: 2999866 - DNA, 19 bp, Homo sapiens
cctgctatttcaggccctc

SEQ ID NO: 2999867 - DNA, 21 bp, Homo sapiens
cctgctatttcaggccctcag

SEQ ID NO: 2999868 - DNA, 15 bp, Homo sapiens
cctgctatttgaagt

SEQ ID NO: 2999869 - DNA, 12 bp, Homo sapiens
cctgctccagac

SEQ ID NO: 2999870 - DNA, 16 bp, Homo sapiens
cctgctccagacctga

SEQ ID NO: 2999871 - DNA, 20 bp, Homo sapiens
cctgctcccttcgctctgct

SEQ ID NO: 2999872 - DNA, 21 bp, Homo sapiens
cctgctcccttcgctctgctg

SEQ ID NO: 2999873 - DNA, 15 bp, Homo sapiens
cctgctccgctgcct

SEQ ID NO: 2999874 - DNA, 17 bp, Homo sapiens
cctgctccgtggactgc

SEQ ID NO: 2999875 - DNA, 20 bp, Homo sapiens
cctgctccgtggactgcagt

SEQ ID NO: 2999876 - DNA, 23 bp, Homo sapiens
cctgctgaatgatttccaaagag

SEQ ID NO: 2999877 - DNA, 19 bp, Homo sapiens
cctgctgcccctccctgcc

SEQ ID NO: 2999878 - DNA, 13 bp, Homo sapiens
cctgctgcctggg

SEQ ID NO: 2999879 - DNA, 15 bp, Homo sapiens
cctgctgcctgggta

SEQ ID NO: 2999880 - DNA, 20 bp, Homo sapiens
cctgctgcctgggtaggccc

SEQ ID NO: 2999881 - DNA, 14 bp, Homo sapiens
cctgctgctggtgc

SEQ ID NO: 2999882 - DNA, 19 bp, Homo sapiens
ccctctaggctctgccttc

SEQ ID NO: 2999883 - DNA, 13 bp, Homo sapiens
ccctctagggcag

SEQ ID NO: 2999884 - DNA, 20 bp, Homo sapiens
ccctctcacgccacccccgc

SEQ ID NO: 2999885 - DNA, 11 bp, Homo sapiens
ccctctcaggc

SEQ ID NO: 2999886 - DNA, 18 bp, Homo sapiens
ccctctcaggctgtccca

SEQ ID NO: 2999887 - DNA, 15 bp, Homo sapiens
ccctctcatctcagg

SEQ ID NO: 2999888 - DNA, 17 bp, Homo sapiens
ccctctccctctaggct

SEQ ID NO: 2999889 - DNA, 21 bp, Homo sapiens
ccctctccgcacacctctggc

SEQ ID NO: 2999890 - DNA, 12 bp, Homo sapiens
ccctctcctccg

SEQ ID NO: 2999891 - DNA, 14 bp, Homo sapiens
ccctctccttcctg

SEQ ID NO: 2999892 - DNA, 12 bp, Homo sapiens
ccctctctcata

SEQ ID NO: 2999893 - DNA, 19 bp, Homo sapiens
ccctctctcccatttcagg

SEQ ID NO: 2999894 - DNA, 13 bp, Homo sapiens
ccctctctcctcc

SEQ ID NO: 2999895 - DNA, 13 bp, Homo sapiens
ccctctctgcacc

SEQ ID NO: 2999896 - DNA, 14 bp, Homo sapiens
ccctctctgctctg

SEQ ID NO: 2999897 - DNA, 12 bp, Homo sapiens
ccctctgccggc

SEQ ID NO: 2999898 - DNA, 14 bp, Homo sapiens
ccctctgcctcatc

SEQ ID NO: 2999899 - DNA, 16 bp, Homo sapiens
ccctctgcctcatcct

SEQ ID NO: 2999900 - DNA, 12 bp, Homo sapiens
ccctctgcctcc

SEQ ID NO: 2999901 - DNA, 11 bp, Homo sapiens
ccctctgcctg

SEQ ID NO: 2999902 - DNA, 13 bp, Homo sapiens
ccctctgcctgca

SEQ ID NO: 2999903 - DNA, 16 bp, Homo sapiens
ccctctgcctgcactc

SEQ ID NO: 2999904 - DNA, 19 bp, Homo sapiens
ccctctgctgaagacttgc

SEQ ID NO: 2999905 - DNA, 21 bp, Homo sapiens
ccctctgctgaagacttgccc

SEQ ID NO: 2999906 - DNA, 16 bp, Homo sapiens
ccctctgctgctgccc

SEQ ID NO: 2999907 - DNA, 16 bp, Homo sapiens
ccctctggccctgcct

SEQ ID NO: 2999908 - DNA, 12 bp, Homo sapiens
ccctctgtcccc

SEQ ID NO: 2999909 - DNA, 14 bp, Homo sapiens
ccctctgtccccag

SEQ ID NO: 2999910 - DNA, 17 bp, Homo sapiens
ccctctgtccccaggcc

SEQ ID NO: 2999911 - DNA, 10 bp, Homo sapiens
ccctctgtct

SEQ ID NO: 2999912 - DNA, 20 bp, Homo sapiens
ccctcttctcctctggcttc

SEQ ID NO: 2999913 - DNA, 20 bp, Homo sapiens
ccctcttctttcagacttgc

SEQ ID NO: 2999914 - DNA, 24 bp, Homo sapiens
ccctcttctttcagacttgccatg

SEQ ID NO: 2999915 - DNA, 14 bp, Homo sapiens
ccctctttgggcag

SEQ ID NO: 2999916 - DNA, 18 bp, Homo sapiens
ccctgaaaacccagagag

SEQ ID NO: 2999917 - DNA, 15 bp, Homo sapiens
ccctgaagtcttgca

SEQ ID NO: 2999918 - DNA, 22 bp, Homo sapiens
ccctgaatttcttcttttcctg

SEQ ID NO: 2999919 - DNA, 16 bp, Homo sapiens
ccctgaccctgtatat

SEQ ID NO: 2999920 - DNA, 21 bp, Homo sapiens
ccctgactcattctgaaggag

SEQ ID NO: 2999921 - DNA, 16 bp, Homo sapiens
ccctgactgtcaggga

SEQ ID NO: 2999922 - DNA, 22 bp, Homo sapiens
ccctgactgtcagggagggcca

SEQ ID NO: 2999923 - DNA, 15 bp, Homo sapiens
ccctgacttgcttta

SEQ ID NO: 2999924 - DNA, 22 bp, Homo sapiens
ccctgagatctgcacagtcaga

SEQ ID NO: 2999925 - DNA, 11 bp, Homo sapiens
ccctgagctga

SEQ ID NO: 2999926 - DNA, 16 bp, Homo sapiens
ccctgaggatcccctg

SEQ ID NO: 2999927 - DNA, 19 bp, Homo sapiens
ccctgaggatcccctgtcc

SEQ ID NO: 2999928 - DNA, 21 bp, Homo sapiens
ccctgaggatcccctgtcccc

SEQ ID NO: 2999929 - DNA, 13 bp, Homo sapiens
ccctgaggcttca

SEQ ID NO: 2999930 - DNA, 23 bp, Homo sapiens
ccctgaggggctggggagggggt

SEQ ID NO: 2999931 - DNA, 16 bp, Homo sapiens
ccctgagtcaccagga

SEQ ID NO: 2999932 - DNA, 16 bp, Homo sapiens
ccctgagtctgggcag

SEQ ID NO: 2999933 - DNA, 18 bp, Homo sapiens
ccctgattgtgccagtgc

SEQ ID NO: 2999934 - DNA, 18 bp, Homo sapiens
ccctgcaaaaggactctc

SEQ ID NO: 2999935 - DNA, 13 bp, Homo sapiens
ccctgcacagttg

SEQ ID NO: 2999936 - DNA, 14 bp, Homo sapiens
ccctgcactgtgcc

SEQ ID NO: 2999937 - DNA, 15 bp, Homo sapiens
ccctgcactgtgccc

SEQ ID NO: 2999938 - DNA, 13 bp, Homo sapiens
ccctgcaggagca

SEQ ID NO: 2999939 - DNA, 20 bp, Homo sapiens
ccctgcaggagcagggcggc

SEQ ID NO: 2999940 - DNA, 22 bp, Homo sapiens
ccctgcaggagcagggcggctg

SEQ ID NO: 2999941 - DNA, 20 bp, Homo sapiens
ccctgcaggctgcaggaggg

SEQ ID NO: 2999942 - DNA, 21 bp, Homo sapiens
ccctgcaggctgcaggagggc

SEQ ID NO: 2999943 - DNA, 21 bp, Homo sapiens
ccagggccttttctggcaccg

SEQ ID NO: 2999944 - DNA, 16 bp, Homo sapiens
ccagggcggccaggga

SEQ ID NO: 2999945 - DNA, 17 bp, Homo sapiens
ccagggcggccagggac

SEQ ID NO: 2999946 - DNA, 20 bp, Homo sapiens
ccagggcggccagggaccca

SEQ ID NO: 2999947 - DNA, 21 bp, Homo sapiens
ccagggctagtgaagtggcct

SEQ ID NO: 2999948 - DNA, 22 bp, Homo sapiens
ccagggctcctgtggcagctgc

SEQ ID NO: 2999949 - DNA, 23 bp, Homo sapiens
ccagggctcctgtggcagctgcc

SEQ ID NO: 2999950 - DNA, 19 bp, Homo sapiens
ccagggctctgggggcaga

SEQ ID NO: 2999951 - DNA, 13 bp, Homo sapiens
ccagggctgggtc

SEQ ID NO: 2999952 - DNA, 22 bp, Homo sapiens
ccaggggaccagagggatggga

SEQ ID NO: 2999953 - DNA, 20 bp, Homo sapiens
ccaggggacgtgggccctgc

SEQ ID NO: 2999954 - DNA, 18 bp, Homo sapiens
ccaggggatgagtggagg

SEQ ID NO: 2999955 - DNA, 17 bp, Homo sapiens
ccagggggcctggagca

SEQ ID NO: 2999956 - DNA, 15 bp, Homo sapiens
ccagggggctgaaac

SEQ ID NO: 2999957 - DNA, 17 bp, Homo sapiens
ccaggggggtgaggagc

SEQ ID NO: 2999958 - DNA, 12 bp, Homo sapiens
ccccggctgggc

SEQ ID NO: 2999959 - DNA, 13 bp, Homo sapiens
ccccggctgggcc

SEQ ID NO: 2999960 - DNA, 18 bp, Homo sapiens
ccccgggctggccctgtg

SEQ ID NO: 2999961 - DNA, 23 bp, Homo sapiens
ccccgggctggccctgtgcagac

SEQ ID NO: 2999962 - DNA, 24 bp, Homo sapiens
ccccggtcccttgagacctcagcc

SEQ ID NO: 2999963 - DNA, 20 bp, Homo sapiens
ccccggtggcggccccagca

SEQ ID NO: 2999964 - DNA, 20 bp, Homo sapiens
ccccgtctggggttcagccc

SEQ ID NO: 2999965 - DNA, 17 bp, Homo sapiens
cccctaccaatattagg

SEQ ID NO: 2999966 - DNA, 16 bp, Homo sapiens
cccctacccctgccct

SEQ ID NO: 2999967 - DNA, 18 bp, Homo sapiens
cccctaccgcatggcagc

SEQ ID NO: 2999968 - DNA, 19 bp, Homo sapiens
cccctaccgcatggcagct

SEQ ID NO: 2999969 - DNA, 16 bp, Homo sapiens
cccctatccacccagc

SEQ ID NO: 2999970 - DNA, 20 bp, Homo sapiens
cccctatccacccagcccat

SEQ ID NO: 2999971 - DNA, 15 bp, Homo sapiens
cccctcacagactct

SEQ ID NO: 2999972 - DNA, 15 bp, Homo sapiens
cccctcaccccagct

SEQ ID NO: 2999973 - DNA, 18 bp, Homo sapiens
cccctcaccccagctccg

SEQ ID NO: 2999974 - DNA, 11 bp, Homo sapiens
cccctcaccct

SEQ ID NO: 2999975 - DNA, 12 bp, Homo sapiens
cccctcacctgg

SEQ ID NO: 2999976 - DNA, 17 bp, Homo sapiens
cccctcagacagccccc

SEQ ID NO: 2999977 - DNA, 13 bp, Homo sapiens
cccctcagctctg

SEQ ID NO: 2999978 - DNA, 16 bp, Homo sapiens
cccctcagttgtgcag

SEQ ID NO: 2999979 - DNA, 18 bp, Homo sapiens
cccctcagttgtgcagct

SEQ ID NO: 2999980 - DNA, 11 bp, Homo sapiens
cccctccagga

SEQ ID NO: 2999981 - DNA, 11 bp, Homo sapiens
cccctcccaga

SEQ ID NO: 2999982 - DNA, 12 bp, Homo sapiens
cccctcccagag

SEQ ID NO: 2999983 - DNA, 15 bp, Homo sapiens
cccctccccagggga

SEQ ID NO: 2999984 - DNA, 15 bp, Homo sapiens
cccctccccatctgt

SEQ ID NO: 2999985 - DNA, 20 bp, Homo sapiens
cccctccccattagctttca

SEQ ID NO: 2999986 - DNA, 14 bp, Homo sapiens
cccctcccccactc

SEQ ID NO: 2999987 - DNA, 13 bp, Homo sapiens
cccctcccctcag

SEQ ID NO: 2999988 - DNA, 17 bp, Homo sapiens
cccctcccctcagagcc

SEQ ID NO: 2999989 - DNA, 13 bp, Homo sapiens
cccctccttcaga

SEQ ID NO: 2999990 - DNA, 17 bp, Homo sapiens
cccctcgaccctgtgca

SEQ ID NO: 2999991 - DNA, 16 bp, Homo sapiens
cccctcggctctggag

SEQ ID NO: 2999992 - DNA, 23 bp, Homo sapiens
cccctctcctggagggcgcccag

SEQ ID NO: 2999993 - DNA, 17 bp, Homo sapiens
cccctctgcacccagaa

SEQ ID NO: 2999994 - DNA, 22 bp, Homo sapiens
cccctctgtccaggcactgaga

SEQ ID NO: 2999995 - DNA, 15 bp, Homo sapiens
cccctgacctgtcca

SEQ ID NO: 2999996 - DNA, 14 bp, Homo sapiens
cccctgactcatca

SEQ ID NO: 2999997 - DNA, 18 bp, Homo sapiens
cccctgaggatcccctgt

SEQ ID NO: 2999998 - DNA, 20 bp, Homo sapiens
ccagcattctcaggcaccag

SEQ ID NO: 2999999 - DNA, 18 bp, Homo sapiens
ccagcatttaagtgacct

SEQ ID NO: 3000000 - DNA, 20 bp, Homo sapiens
ccagcatttaagtgaccttc

SEQ ID NO: 3000001 - DNA, 22 bp, Homo sapiens
ccagcatttaagtgaccttctg

SEQ ID NO: 3000002 - DNA, 18 bp, Homo sapiens
ccagcatttagctggcca

SEQ ID NO: 3000003 - DNA, 19 bp, Homo sapiens
ccagcatttagctggccac

SEQ ID NO: 3000004 - DNA, 16 bp, Homo sapiens
ccagcatttcccttcc

SEQ ID NO: 3000005 - DNA, 21 bp, Homo sapiens
ccagcatttcccttccttcct

SEQ ID NO: 3000006 - DNA, 14 bp, Homo sapiens
ccagcatttgggta

SEQ ID NO: 3000007 - DNA, 12 bp, Homo sapiens
ccagccacctag

SEQ ID NO: 3000008 - DNA, 21 bp, Homo sapiens
ccagccactccaagccccctg

SEQ ID NO: 3000009 - DNA, 21 bp, Homo sapiens
ccagccagatggactccagcc

SEQ ID NO: 3000010 - DNA, 11 bp, Homo sapiens
ccagccagcca

SEQ ID NO: 3000011 - DNA, 13 bp, Homo sapiens
ccagccagccact

SEQ ID NO: 3000012 - DNA, 15 bp, Homo sapiens
ccagccagccactct

SEQ ID NO: 3000013 - DNA, 17 bp, Homo sapiens
ccagccaggccccaggc

SEQ ID NO: 3000014 - DNA, 19 bp, Homo sapiens
ccagccagtgacctgagga

SEQ ID NO: 3000015 - DNA, 18 bp, Homo sapiens
ccagccatcaaaatgctt

SEQ ID NO: 3000016 - DNA, 20 bp, Homo sapiens
ccagccatcaagagactgag

SEQ ID NO: 3000017 - DNA, 14 bp, Homo sapiens
ccagccatgtctgc

SEQ ID NO: 3000018 - DNA, 18 bp, Homo sapiens
ccagccatgtctgcattt

SEQ ID NO: 3000019 - DNA, 19 bp, Homo sapiens
ccagcccaaaccttgggcc

SEQ ID NO: 3000020 - DNA, 15 bp, Homo sapiens
ccagcccacagagcc

SEQ ID NO: 3000021 - DNA, 17 bp, Homo sapiens
ccagcccacagagcctg

SEQ ID NO: 3000022 - DNA, 20 bp, Homo sapiens
ccagcccagacccccagtgt

SEQ ID NO: 3000023 - DNA, 11 bp, Homo sapiens
ccagcccagag

SEQ ID NO: 3000024 - DNA, 13 bp, Homo sapiens
ccagcccagagac

SEQ ID NO: 3000025 - DNA, 14 bp, Homo sapiens
ccagcccagagaca

SEQ ID NO: 3000026 - DNA, 14 bp, Homo sapiens
ccagcccagatgtt

SEQ ID NO: 3000027 - DNA, 15 bp, Homo sapiens
ccagcccagatgttt

SEQ ID NO: 3000028 - DNA, 17 bp, Homo sapiens
ccagcccagattgtctt

SEQ ID NO: 3000029 - DNA, 16 bp, Homo sapiens
ccagcccagcccagct

SEQ ID NO: 3000030 - DNA, 18 bp, Homo sapiens
ccagcccagcccagctgg

SEQ ID NO: 3000031 - DNA, 22 bp, Homo sapiens
ccagcccaggagtttgaggctg

SEQ ID NO: 3000032 - DNA, 14 bp, Homo sapiens
ccagcccccagtgc

SEQ ID NO: 3000033 - DNA, 18 bp, Homo sapiens
ccagcccccagtgcgctc

SEQ ID NO: 3000034 - DNA, 15 bp, Homo sapiens
ccagccccgctccca

SEQ ID NO: 3000035 - DNA, 18 bp, Homo sapiens
ccagcccctgctggctgg

SEQ ID NO: 3000036 - DNA, 15 bp, Homo sapiens
ccagcccctttccaa

SEQ ID NO: 3000037 - DNA, 17 bp, Homo sapiens
ccagcccctttccaaaa

SEQ ID NO: 3000038 - DNA, 19 bp, Homo sapiens
ccagcccgagtggtctcct

SEQ ID NO: 3000039 - DNA, 17 bp, Homo sapiens
ccagcccgcggcctgga

SEQ ID NO: 3000040 - DNA, 17 bp, Homo sapiens
ccagcccggacctctgg

SEQ ID NO: 3000041 - DNA, 16 bp, Homo sapiens
ccagcccggctcggcc

SEQ ID NO: 3000042 - DNA, 14 bp, Homo sapiens
ccagccctcatccc

SEQ ID NO: 3000043 - DNA, 20 bp, Homo sapiens
ccagccctccccatggagcc

SEQ ID NO: 3000044 - DNA, 15 bp, Homo sapiens
ccagccctccctgtc

SEQ ID NO: 3000045 - DNA, 20 bp, Homo sapiens
ccagccctccctgtcctcct

SEQ ID NO: 3000046 - DNA, 21 bp, Homo sapiens
ccagccctccctgtcctcctc

SEQ ID NO: 3000047 - DNA, 22 bp, Homo sapiens
ccagccctccctgtcctcctcg

SEQ ID NO: 3000048 - DNA, 18 bp, Homo sapiens
ccagccctgagttcctag

SEQ ID NO: 3000049 - DNA, 21 bp, Homo sapiens
ccagccctgctgcttcctaac

SEQ ID NO: 3000050 - DNA, 18 bp, Homo sapiens
ccagccgctctcctgcca

SEQ ID NO: 3000051 - DNA, 18 bp, Homo sapiens
ccagcctcaatgtcactt

SEQ ID NO: 3000052 - DNA, 16 bp, Homo sapiens
ccagcctcacagatgc

SEQ ID NO: 3000053 - DNA, 19 bp, Homo sapiens
ccagcctcacagatgctgg

SEQ ID NO: 3000054 - DNA, 13 bp, Homo sapiens
ccagcctccctga

SEQ ID NO: 3000055 - DNA, 12 bp, Homo sapiens
ccagcctcctgg

SEQ ID NO: 3000056 - DNA, 16 bp, Homo sapiens
ccagcctgagtgacag

SEQ ID NO: 3000057 - DNA, 17 bp, Homo sapiens
ccagcctgagtgacaga

SEQ ID NO: 3000058 - DNA, 21 bp, Homo sapiens
ccagcctgagtgacagagcga

SEQ ID NO: 3000059 - DNA, 16 bp, Homo sapiens
ccagcctgcctggcag

SEQ ID NO: 3000060 - DNA, 20 bp, Homo sapiens
ccagcctgggaggcacagca

SEQ ID NO: 3000061 - DNA, 13 bp, Homo sapiens
ccagcctggggtc

SEQ ID NO: 3000062 - DNA, 19 bp, Homo sapiens
ccagcctgggtgacagagc

SEQ ID NO: 3000063 - DNA, 20 bp, Homo sapiens
ccagcctttgatcaggtggg

SEQ ID NO: 3000064 - DNA, 14 bp, Homo sapiens
ccagcgagccacag

SEQ ID NO: 3000065 - DNA, 12 bp, Homo sapiens
ccagcgccaggg

SEQ ID NO: 3000066 - DNA, 17 bp, Homo sapiens
ccagcgccagggcccag

SEQ ID NO: 3000067 - DNA, 20 bp, Homo sapiens
ccagcgccagggcccaggcc

SEQ ID NO: 3000068 - DNA, 23 bp, Homo sapiens
ccagcgccagggcccaggccatg

SEQ ID NO: 3000069 - DNA, 13 bp, Homo sapiens
ccagcgctctcct

SEQ ID NO: 3000070 - DNA, 19 bp, Homo sapiens
ccagcgctctcctggacgc

SEQ ID NO: 3000071 - DNA, 20 bp, Homo sapiens
ccagcgctctcctggacgcc

SEQ ID NO: 3000072 - DNA, 16 bp, Homo sapiens
ccagcggcccaagagc

SEQ ID NO: 3000073 - DNA, 14 bp, Homo sapiens
ccagcggcctcagg

SEQ ID NO: 3000074 - DNA, 15 bp, Homo sapiens
ccagcggcctcaggg

SEQ ID NO: 3000075 - DNA, 17 bp, Homo sapiens
ccagcggctccaactcc

SEQ ID NO: 3000076 - DNA, 23 bp, Homo sapiens
ccagcgggaatggcagctgccac

SEQ ID NO: 3000077 - DNA, 21 bp, Homo sapiens
ccagcggtccaacgccgcctt

SEQ ID NO: 3000078 - DNA, 14 bp, Homo sapiens
ccagctaagaacct

SEQ ID NO: 3000079 - DNA, 19 bp, Homo sapiens
ccagctaagaacctggaac

SEQ ID NO: 3000080 - DNA, 21 bp, Homo sapiens
ccagctaaggacatttcccag

SEQ ID NO: 3000081 - DNA, 15 bp, Homo sapiens
ccagctactcaggag

SEQ ID NO: 3000082 - DNA, 20 bp, Homo sapiens
ccagctacttagctggccaa

SEQ ID NO: 3000083 - DNA, 16 bp, Homo sapiens
ccagctacttgggagc

SEQ ID NO: 3000084 - DNA, 20 bp, Homo sapiens
ccagctacttgggagcctga

SEQ ID NO: 3000085 - DNA, 18 bp, Homo sapiens
ccagctatacctgtgcct

SEQ ID NO: 3000086 - DNA, 19 bp, Homo sapiens
ccagctatacctgtgcctc

SEQ ID NO: 3000087 - DNA, 13 bp, Homo sapiens
ccagctcaggaca

SEQ ID NO: 3000088 - DNA, 22 bp, Homo sapiens
ccagctcatatgctgacagctc

SEQ ID NO: 3000089 - DNA, 12 bp, Homo sapiens
ccagctcattca

SEQ ID NO: 3000090 - DNA, 15 bp, Homo sapiens
ccagctccaacctgc

SEQ ID NO: 3000091 - DNA, 14 bp, Homo sapiens
ccagctccaggccc

SEQ ID NO: 3000092 - DNA, 16 bp, Homo sapiens
ccagctccctctattt

SEQ ID NO: 3000093 - DNA, 20 bp, Homo sapiens
ccagctccgacctctctcag

SEQ ID NO: 3000094 - DNA, 18 bp, Homo sapiens
ccagctccggcctgtcct

SEQ ID NO: 3000095 - DNA, 20 bp, Homo sapiens
ccagctccggcctgtcctcc

SEQ ID NO: 3000096 - DNA, 14 bp, Homo sapiens
ccagctccttcgct

SEQ ID NO: 3000097 - DNA, 18 bp, Homo sapiens
ccagctctaagcagccag

SEQ ID NO: 3000098 - DNA, 20 bp, Homo sapiens
ccagctctaagcagccagga

SEQ ID NO: 3000099 - DNA, 21 bp, Homo sapiens
ccagctctaagcagccaggag

SEQ ID NO: 3000100 - DNA, 13 bp, Homo sapiens
ccagctctaagtc

SEQ ID NO: 3000101 - DNA, 12 bp, Homo sapiens
ccagctctccca

SEQ ID NO: 3000102 - DNA, 22 bp, Homo sapiens
ccagctctcccacatcccactg

SEQ ID NO: 3000103 - DNA, 14 bp, Homo sapiens
ccagctctccctct

SEQ ID NO: 3000104 - DNA, 22 bp, Homo sapiens
ccagctctgccgtctctggagc

SEQ ID NO: 3000105 - DNA, 17 bp, Homo sapiens
ccagctctgtcaccctg

SEQ ID NO: 3000106 - DNA, 21 bp, Homo sapiens
ccagctctgtcaccctggcca

SEQ ID NO: 3000107 - DNA, 17 bp, Homo sapiens
ccagctcttgctctctt

SEQ ID NO: 3000108 - DNA, 15 bp, Homo sapiens
ccagctgagcgccag

SEQ ID NO: 3000109 - DNA, 17 bp, Homo sapiens
ccagctgagcgccagga

SEQ ID NO: 3000110 - DNA, 17 bp, Homo sapiens
ccagctgcaaagtgttt

SEQ ID NO: 3000111 - DNA, 18 bp, Homo sapiens
ccagctgcactgatgctg

SEQ ID NO: 3000112 - DNA, 20 bp, Homo sapiens
ccagctgcccttccgcagtg

SEQ ID NO: 3000113 - DNA, 21 bp, Homo sapiens
ccagctgcccttccgcagtgt

SEQ ID NO: 3000114 - DNA, 13 bp, Homo sapiens
ccagctggcagca

SEQ ID NO: 3000115 - DNA, 20 bp, Homo sapiens
ccagctggcagcagagtgtg

SEQ ID NO: 3000116 - DNA, 19 bp, Homo sapiens
ccagctggcccgtgacaga

SEQ ID NO: 3000117 - DNA, 14 bp, Homo sapiens
ccagctggtgcccc

SEQ ID NO: 3000118 - DNA, 14 bp, Homo sapiens
ccagctgtgcttat

SEQ ID NO: 3000119 - DNA, 21 bp, Homo sapiens
ccagctgtgcttatggtacca

SEQ ID NO: 3000120 - DNA, 23 bp, Homo sapiens
ccagcttattgtgtgcgctgcct

SEQ ID NO: 3000121 - DNA, 13 bp, Homo sapiens
ccagcttcacgat

SEQ ID NO: 3000122 - DNA, 22 bp, Homo sapiens
ccagcttgccagatgctgcaga

SEQ ID NO: 3000123 - DNA, 14 bp, Homo sapiens
ccagcttgctcttc

SEQ ID NO: 3000124 - DNA, 17 bp, Homo sapiens
ccagctttaaaaagaaa

SEQ ID NO: 3000125 - DNA, 20 bp, Homo sapiens
ccagctttaaaaagaaaaaa

SEQ ID NO: 3000126 - DNA, 22 bp, Homo sapiens
ccagctttaagggttgtgagcc

SEQ ID NO: 3000127 - DNA, 16 bp, Homo sapiens
ccagctttactgtggc

SEQ ID NO: 3000128 - DNA, 15 bp, Homo sapiens
ccaggaaaagcacaa

SEQ ID NO: 3000129 - DNA, 17 bp, Homo sapiens
ccaggaaacaagggaag

SEQ ID NO: 3000130 - DNA, 13 bp, Homo sapiens
ccaggaaacatga

SEQ ID NO: 3000131 - DNA, 15 bp, Homo sapiens
ccaggaaactcttgc

SEQ ID NO: 3000132 - DNA, 24 bp, Homo sapiens
ccaggaaccacaccacatctaagc

SEQ ID NO: 3000133 - DNA, 20 bp, Homo sapiens
ccaggaactcgcacctgtgc

SEQ ID NO: 3000134 - DNA, 22 bp, Homo sapiens
ccaggaactcgcacctgtgctg

SEQ ID NO: 3000135 - DNA, 15 bp, Homo sapiens
ccacacatctgtgga

SEQ ID NO: 3000136 - DNA, 13 bp, Homo sapiens
ccacaccacatct

SEQ ID NO: 3000137 - DNA, 13 bp, Homo sapiens
ccacaccactgcc

SEQ ID NO: 3000138 - DNA, 22 bp, Homo sapiens
ccacacccaattccactctgat

SEQ ID NO: 3000139 - DNA, 21 bp, Homo sapiens
ccacaccccaacacttccagc

SEQ ID NO: 3000140 - DNA, 15 bp, Homo sapiens
ccacaccctgcctgc

SEQ ID NO: 3000141 - DNA, 16 bp, Homo sapiens
ccacaccctgcctgct

SEQ ID NO: 3000142 - DNA, 13 bp, Homo sapiens
ccacacctgcagt

SEQ ID NO: 3000143 - DNA, 14 bp, Homo sapiens
ccacacctgcctgc

SEQ ID NO: 3000144 - DNA, 12 bp, Homo sapiens
ccacacctggtc

SEQ ID NO: 3000145 - DNA, 13 bp, Homo sapiens
ccacactatgtgt

SEQ ID NO: 3000146 - DNA, 22 bp, Homo sapiens
ccacactatgtgtgttgtttcc

SEQ ID NO: 3000147 - DNA, 13 bp, Homo sapiens
ccacactggactc

SEQ ID NO: 3000148 - DNA, 19 bp, Homo sapiens
ccacactgtgacacactac

SEQ ID NO: 3000149 - DNA, 16 bp, Homo sapiens
ccacacttgtgccagc

SEQ ID NO: 3000150 - DNA, 18 bp, Homo sapiens
ccacacttgtgccagccc

SEQ ID NO: 3000151 - DNA, 13 bp, Homo sapiens
ccacagactgccc

SEQ ID NO: 3000152 - DNA, 21 bp, Homo sapiens
ccacagactgccccagccaac

SEQ ID NO: 3000153 - DNA, 16 bp, Homo sapiens
ccacagagtaagacat

SEQ ID NO: 3000154 - DNA, 16 bp, Homo sapiens
ccacagagtgtagcca

SEQ ID NO: 3000155 - DNA, 23 bp, Homo sapiens
ccacagagtgtagccaggtcccc

SEQ ID NO: 3000156 - DNA, 14 bp, Homo sapiens
ccacagatatcttt

SEQ ID NO: 3000157 - DNA, 22 bp, Homo sapiens
ccacagattgtttctatacaaa

SEQ ID NO: 3000158 - DNA, 14 bp, Homo sapiens
ccacagcacagcca

SEQ ID NO: 3000159 - DNA, 13 bp, Homo sapiens
ccacagcccaggc

SEQ ID NO: 3000160 - DNA, 11 bp, Homo sapiens
ccacagcccta

SEQ ID NO: 3000161 - DNA, 19 bp, Homo sapiens
ccacagcctcccctgccag

SEQ ID NO: 3000162 - DNA, 20 bp, Homo sapiens
ccacagcctcccctgccagg

SEQ ID NO: 3000163 - DNA, 11 bp, Homo sapiens
ccacagcctgt

SEQ ID NO: 3000164 - DNA, 14 bp, Homo sapiens
ccacagcctgtctt

SEQ ID NO: 3000165 - DNA, 23 bp, Homo sapiens
ccacagcgctggccgggaccccg

SEQ ID NO: 3000166 - DNA, 15 bp, Homo sapiens
ccacagctcccaccc

SEQ ID NO: 3000167 - DNA, 17 bp, Homo sapiens
ccacagctcccacccca

SEQ ID NO: 3000168 - DNA, 17 bp, Homo sapiens
ccacagcttcccctctc

SEQ ID NO: 3000169 - DNA, 15 bp, Homo sapiens
ccacaggaacggccc

SEQ ID NO: 3000170 - DNA, 17 bp, Homo sapiens
ccacaggatcatcattt

SEQ ID NO: 3000171 - DNA, 19 bp, Homo sapiens
ccacaggcaggggtgagag

SEQ ID NO: 3000172 - DNA, 16 bp, Homo sapiens
ccacaggccgccctgc

SEQ ID NO: 3000173 - DNA, 17 bp, Homo sapiens
ccacaggccgccctgcg

SEQ ID NO: 3000174 - DNA, 14 bp, Homo sapiens
ccacagggctaaga

SEQ ID NO: 3000175 - DNA, 20 bp, Homo sapiens
ccacagggctaagagctagc

SEQ ID NO: 3000176 - DNA, 15 bp, Homo sapiens
ccacagtagtcttga

SEQ ID NO: 3000177 - DNA, 14 bp, Homo sapiens
ccacagtggagagg

SEQ ID NO: 3000178 - DNA, 20 bp, Homo sapiens
ccacatcccactggatctgg

SEQ ID NO: 3000179 - DNA, 14 bp, Homo sapiens
ccacatccccagag

SEQ ID NO: 3000180 - DNA, 21 bp, Homo sapiens
ccacatccccagagcccagct

SEQ ID NO: 3000181 - DNA, 23 bp, Homo sapiens
ccacatccccagagcccagctct

SEQ ID NO: 3000182 - DNA, 24 bp, Homo sapiens
ccacatccccagagcccagctctt

SEQ ID NO: 3000183 - DNA, 15 bp, Homo sapiens
ccacatctaagcctg

SEQ ID NO: 3000184 - DNA, 23 bp, Homo sapiens
ccacatctaagcctgaaggggcg

SEQ ID NO: 3000185 - DNA, 18 bp, Homo sapiens
ccacatcttccatttcca

SEQ ID NO: 3000186 - DNA, 13 bp, Homo sapiens
ccacatcttgtct

SEQ ID NO: 3000187 - DNA, 19 bp, Homo sapiens
ccacatcttgtcttttccc

SEQ ID NO: 3000188 - DNA, 13 bp, Homo sapiens
ccacatgccccag

SEQ ID NO: 3000189 - DNA, 14 bp, Homo sapiens
ccacatgccccagg

SEQ ID NO: 3000190 - DNA, 15 bp, Homo sapiens
ccacatgccccaggc

SEQ ID NO: 3000191 - DNA, 17 bp, Homo sapiens
ccacatgcggctcgggc

SEQ ID NO: 3000192 - DNA, 14 bp, Homo sapiens
ccacattgttttaa

SEQ ID NO: 3000193 - DNA, 16 bp, Homo sapiens
ccacattgttttaaaa

SEQ ID NO: 3000194 - DNA, 19 bp, Homo sapiens
ccacatttagtctctttat

SEQ ID NO: 3000195 - DNA, 20 bp, Homo sapiens
ccacatttagtctctttatt

SEQ ID NO: 3000196 - DNA, 13 bp, Homo sapiens
ccacatttggaat

SEQ ID NO: 3000197 - DNA, 17 bp, Homo sapiens
ccacatttgtgccgaca

SEQ ID NO: 3000198 - DNA, 13 bp, Homo sapiens
ccacattttaaca

SEQ ID NO: 3000199 - DNA, 14 bp, Homo sapiens
ccacattttaacag

SEQ ID NO: 3000200 - DNA, 12 bp, Homo sapiens
ccaccaacccat

SEQ ID NO: 3000201 - DNA, 20 bp, Homo sapiens
ccaccaaggtctcacactcc

SEQ ID NO: 3000202 - DNA, 23 bp, Homo sapiens
ccaccaaggtctcacactcctcc

SEQ ID NO: 3000203 - DNA, 15 bp, Homo sapiens
ccaccacacatccca

SEQ ID NO: 3000204 - DNA, 12 bp, Homo sapiens
ccaccaccccat

SEQ ID NO: 3000205 - DNA, 21 bp, Homo sapiens
ccaccacctaggccactcctc

SEQ ID NO: 3000206 - DNA, 17 bp, Homo sapiens
ccaccaccttatacatc

SEQ ID NO: 3000207 - DNA, 13 bp, Homo sapiens
ccaccactataaa

SEQ ID NO: 3000208 - DNA, 14 bp, Homo sapiens
ccaccagagcaggg

SEQ ID NO: 3000209 - DNA, 20 bp, Homo sapiens
ccaccagagcaggggctgct

SEQ ID NO: 3000210 - DNA, 12 bp, Homo sapiens
ccaccagagctg

SEQ ID NO: 3000211 - DNA, 15 bp, Homo sapiens
ccaccagagctgcct

SEQ ID NO: 3000212 - DNA, 18 bp, Homo sapiens
ccaccagcatcacctgcc

SEQ ID NO: 3000213 - DNA, 17 bp, Homo sapiens
ccaccaggagcacctgg

SEQ ID NO: 3000214 - DNA, 22 bp, Homo sapiens
catgactgagtctggcaaacat

SEQ ID NO: 3000215 - DNA, 18 bp, Homo sapiens
catgagaaagggagagga

SEQ ID NO: 3000216 - DNA, 21 bp, Homo sapiens
catgagaaagggagaggaaga

SEQ ID NO: 3000217 - DNA, 16 bp, Homo sapiens
catgagaagccataca

SEQ ID NO: 3000218 - DNA, 17 bp, Homo sapiens
catgagactcagtgcag

SEQ ID NO: 3000219 - DNA, 19 bp, Homo sapiens
catgagactcagtgcagat

SEQ ID NO: 3000220 - DNA, 14 bp, Homo sapiens
catgagatgtgtgg

SEQ ID NO: 3000221 - DNA, 17 bp, Homo sapiens
catgagatgtgtggact

SEQ ID NO: 3000222 - DNA, 16 bp, Homo sapiens
catgagcaagcctagg

SEQ ID NO: 3000223 - DNA, 22 bp, Homo sapiens
catgagcattggatacagcagt

SEQ ID NO: 3000224 - DNA, 13 bp, Homo sapiens
catgagcctgttt

SEQ ID NO: 3000225 - DNA, 19 bp, Homo sapiens
catgagcctgtttattgcc

SEQ ID NO: 3000226 - DNA, 21 bp, Homo sapiens
catgagcctgtttattgccat

SEQ ID NO: 3000227 - DNA, 17 bp, Homo sapiens
catctaatgcttgttta

SEQ ID NO: 3000228 - DNA, 19 bp, Homo sapiens
catctaatgcttgtttatg

SEQ ID NO: 3000229 - DNA, 16 bp, Homo sapiens
catctaattcttattt

SEQ ID NO: 3000230 - DNA, 20 bp, Homo sapiens
catctaattcttatttttaa

SEQ ID NO: 3000231 - DNA, 20 bp, Homo sapiens
catctactctggaccaagga

SEQ ID NO: 3000232 - DNA, 16 bp, Homo sapiens
catctatccacactgt

SEQ ID NO: 3000233 - DNA, 13 bp, Homo sapiens
catctattctctc

SEQ ID NO: 3000234 - DNA, 13 bp, Homo sapiens
catctcaaaaaaa

SEQ ID NO: 3000235 - DNA, 16 bp, Homo sapiens
catctcaaatgttttc

SEQ ID NO: 3000236 - DNA, 17 bp, Homo sapiens
catctcaaatgttttct

SEQ ID NO: 3000237 - DNA, 14 bp, Homo sapiens
catctcaggccaga

SEQ ID NO: 3000238 - DNA, 21 bp, Homo sapiens
catctcaggttggcggcagac

SEQ ID NO: 3000239 - DNA, 22 bp, Homo sapiens
catctcatcctattacttttca

SEQ ID NO: 3000240 - DNA, 22 bp, Homo sapiens
catctcatgcccctggctggga

SEQ ID NO: 3000241 - DNA, 21 bp, Homo sapiens
catctccagcattctcagcca

SEQ ID NO: 3000242 - DNA, 15 bp, Homo sapiens
catctccctgccatc

SEQ ID NO: 3000243 - DNA, 16 bp, Homo sapiens
catctccctgccatcc

SEQ ID NO: 3000244 - DNA, 17 bp, Homo sapiens
catctcccttccacctc

SEQ ID NO: 3000245 - DNA, 17 bp, Homo sapiens
catctccgcctccacac

SEQ ID NO: 3000246 - DNA, 19 bp, Homo sapiens
catctcctgccttcctcct

SEQ ID NO: 3000247 - DNA, 14 bp, Homo sapiens
catctcgctccctc

SEQ ID NO: 3000248 - DNA, 20 bp, Homo sapiens
catctcgctccctcccagga

SEQ ID NO: 3000249 - DNA, 16 bp, Homo sapiens
catctcggggctgctg

SEQ ID NO: 3000250 - DNA, 18 bp, Homo sapiens
cagtgtcttaaggagact

SEQ ID NO: 3000251 - DNA, 15 bp, Homo sapiens
cagtgtgaagttaga

SEQ ID NO: 3000252 - DNA, 20 bp, Homo sapiens
cagtgtgaagttagaattcc

SEQ ID NO: 3000253 - DNA, 16 bp, Homo sapiens
cagtgtgaggccaggg

SEQ ID NO: 3000254 - DNA, 23 bp, Homo sapiens
cagtgtgcactaaggggcccggc

SEQ ID NO: 3000255 - DNA, 15 bp, Homo sapiens
cagtgtggccaggct

SEQ ID NO: 3000256 - DNA, 18 bp, Homo sapiens
cagtgtggtttgggaaag

SEQ ID NO: 3000257 - DNA, 23 bp, Homo sapiens
cagtgttacaatcagtgtgaatg

SEQ ID NO: 3000258 - DNA, 24 bp, Homo sapiens
cagtgttcagccaaacagtatgat

SEQ ID NO: 3000259 - DNA, 23 bp, Homo sapiens
cagtgttccaagtctctgtgtaa

SEQ ID NO: 3000260 - DNA, 20 bp, Homo sapiens
cagtgttgattctagatgat

SEQ ID NO: 3000261 - DNA, 16 bp, Homo sapiens
cagtgtttctgaatgt

SEQ ID NO: 3000262 - DNA, 17 bp, Homo sapiens
cagtgtttgatttttat

SEQ ID NO: 3000263 - DNA, 12 bp, Homo sapiens
cagtgtttgtat

SEQ ID NO: 3000264 - DNA, 20 bp, Homo sapiens
cagtgttttggactccatct

SEQ ID NO: 3000265 - DNA, 19 bp, Homo sapiens
cagtgttttggtggaaaaa

SEQ ID NO: 3000266 - DNA, 21 bp, Homo sapiens
cagtgttttggtggaaaaaac

SEQ ID NO: 3000267 - DNA, 23 bp, Homo sapiens
cagtgttttggtggaaaaaacat

SEQ ID NO: 3000268 - DNA, 21 bp, Homo sapiens
cagtgttttttaggaaaagca

SEQ ID NO: 3000269 - DNA, 22 bp, Homo sapiens
cagtgttttttaggaaaagcat

SEQ ID NO: 3000270 - DNA, 23 bp, Homo sapiens
cagttaacacaatgtgaatttct

SEQ ID NO: 3000271 - DNA, 14 bp, Homo sapiens
cagttaaggaaaga

SEQ ID NO: 3000272 - DNA, 17 bp, Homo sapiens
cagttaaggaatataat

SEQ ID NO: 3000273 - DNA, 15 bp, Homo sapiens
cagttaattagcatt

SEQ ID NO: 3000274 - DNA, 17 bp, Homo sapiens
cagttacagaaagtggt

SEQ ID NO: 3000275 - DNA, 15 bp, Homo sapiens
cagttactcagccct

SEQ ID NO: 3000276 - DNA, 17 bp, Homo sapiens
cagttactcagccctgg

SEQ ID NO: 3000277 - DNA, 21 bp, Homo sapiens
cagttactccctacactgatg

SEQ ID NO: 3000278 - DNA, 16 bp, Homo sapiens
cagttactgaaatctt

SEQ ID NO: 3000279 - DNA, 13 bp, Homo sapiens
cagttactgtgaa

SEQ ID NO: 3000280 - DNA, 15 bp, Homo sapiens
cagttacttaagatt

SEQ ID NO: 3000281 - DNA, 15 bp, Homo sapiens
cagttagcaaacttt

SEQ ID NO: 3000282 - DNA, 14 bp, Homo sapiens
cagttatcctgcaa

SEQ ID NO: 3000283 - DNA, 22 bp, Homo sapiens
cagttatctaagttaatttaaa

SEQ ID NO: 3000284 - DNA, 15 bp, Homo sapiens
cagttattacatgta

SEQ ID NO: 3000285 - DNA, 17 bp, Homo sapiens
cagttattatatttaca

SEQ ID NO: 3000286 - DNA, 22 bp, Homo sapiens
cagttattatatttacaaatgg

SEQ ID NO: 3000287 - DNA, 13 bp, Homo sapiens
cagttcagtttgt

SEQ ID NO: 3000288 - DNA, 19 bp, Homo sapiens
cagttcccgtgacgaggct

SEQ ID NO: 3000289 - DNA, 21 bp, Homo sapiens
cagttccctttgcttgtcttc

SEQ ID NO: 3000290 - DNA, 17 bp, Homo sapiens
cagttcgcctggagccc

SEQ ID NO: 3000291 - DNA, 17 bp, Homo sapiens
cagttctagtttgcatt

SEQ ID NO: 3000292 - DNA, 19 bp, Homo sapiens
cagttctgattcatttgaa

SEQ ID NO: 3000293 - DNA, 17 bp, Homo sapiens
cagttctgggtgctccc

SEQ ID NO: 3000294 - DNA, 22 bp, Homo sapiens
cagttctgtccttggcaacttt

SEQ ID NO: 3000295 - DNA, 14 bp, Homo sapiens
cagttcttgagttg

SEQ ID NO: 3000296 - DNA, 21 bp, Homo sapiens
cagttctttgggccagacatg

SEQ ID NO: 3000297 - DNA, 19 bp, Homo sapiens
cagttgaagggaggggctg

SEQ ID NO: 3000298 - DNA, 13 bp, Homo sapiens
cagttgactcaga

SEQ ID NO: 3000299 - DNA, 15 bp, Homo sapiens
cagttgactcagagt

SEQ ID NO: 3000300 - DNA, 23 bp, Homo sapiens
cagttgattgtacgtagccacag

SEQ ID NO: 3000301 - DNA, 17 bp, Homo sapiens
cagttgattttctggat

SEQ ID NO: 3000302 - DNA, 20 bp, Homo sapiens
cagttgcagcccttgtgatg

SEQ ID NO: 3000303 - DNA, 18 bp, Homo sapiens
catagcgtcctgccctgc

SEQ ID NO: 3000304 - DNA, 19 bp, Homo sapiens
catagcgtcctgccctgcc

SEQ ID NO: 3000305 - DNA, 22 bp, Homo sapiens
catagcttacaagccagctgga

SEQ ID NO: 3000306 - DNA, 13 bp, Homo sapiens
cataggactgtgg

SEQ ID NO: 3000307 - DNA, 21 bp, Homo sapiens
cataggcccacacacaggtgg

SEQ ID NO: 3000308 - DNA, 11 bp, Homo sapiens
cataggggcag

SEQ ID NO: 3000309 - DNA, 17 bp, Homo sapiens
cataggtagaatgtaaa

SEQ ID NO: 3000310 - DNA, 16 bp, Homo sapiens
cataggtttaataatt

SEQ ID NO: 3000311 - DNA, 16 bp, Homo sapiens
catagtaaagtatttt

SEQ ID NO: 3000312 - DNA, 24 bp, Homo sapiens
catagtaacttcttatggaattga

SEQ ID NO: 3000313 - DNA, 21 bp, Homo sapiens
catagtaagtgcgaagactga

SEQ ID NO: 3000314 - DNA, 20 bp, Homo sapiens
catagtagtatgatgataca

SEQ ID NO: 3000315 - DNA, 14 bp, Homo sapiens
catagtgaacacag

SEQ ID NO: 3000316 - DNA, 17 bp, Homo sapiens
catagtgaacacagcag

SEQ ID NO: 3000317 - DNA, 19 bp, Homo sapiens
catagtgcattgtttctgt

SEQ ID NO: 3000318 - DNA, 20 bp, Homo sapiens
catagttctgagctgccagt

SEQ ID NO: 3000319 - DNA, 13 bp, Homo sapiens
catagttgaaaaa

SEQ ID NO: 3000320 - DNA, 21 bp, Homo sapiens
catagttgaaaaaagaagttt

SEQ ID NO: 3000321 - DNA, 15 bp, Homo sapiens
catagtttggcattt

SEQ ID NO: 3000322 - DNA, 18 bp, Homo sapiens
catagtttggcatttgca

SEQ ID NO: 3000323 - DNA, 20 bp, Homo sapiens
catagttttgatgactggca

SEQ ID NO: 3000324 - DNA, 15 bp, Homo sapiens
catataaaataatgc

SEQ ID NO: 3000325 - DNA, 24 bp, Homo sapiens
catataaaatgctgatatttactg

SEQ ID NO: 3000326 - DNA, 14 bp, Homo sapiens
catataagtttgaa

SEQ ID NO: 3000327 - DNA, 22 bp, Homo sapiens
catataagtttgaaggaaacag

SEQ ID NO: 3000328 - DNA, 23 bp, Homo sapiens
catataagtttgaaggaaacagt

SEQ ID NO: 3000329 - DNA, 13 bp, Homo sapiens
catatagaaaaca

SEQ ID NO: 3000330 - DNA, 21 bp, Homo sapiens
catatatagacagctttgact

SEQ ID NO: 3000331 - DNA, 22 bp, Homo sapiens
catatatagacagctttgactg

SEQ ID NO: 3000332 - DNA, 12 bp, Homo sapiens
catatatattac

SEQ ID NO: 3000333 - DNA, 23 bp, Homo sapiens
catatatccttttcttctatgta

SEQ ID NO: 3000334 - DNA, 17 bp, Homo sapiens
catatattatatataga

SEQ ID NO: 3000335 - DNA, 21 bp, Homo sapiens
catatattatatatagaaaag

SEQ ID NO: 3000336 - DNA, 15 bp, Homo sapiens
catatcaaaatagga

SEQ ID NO: 3000337 - DNA, 23 bp, Homo sapiens
catatcactgaaggatattttca

SEQ ID NO: 3000338 - DNA, 13 bp, Homo sapiens
catatcagttgag

SEQ ID NO: 3000339 - DNA, 16 bp, Homo sapiens
catatcatgctaaaat

SEQ ID NO: 3000340 - DNA, 20 bp, Homo sapiens
catatcatgctaaaattcta

SEQ ID NO: 3000341 - DNA, 15 bp, Homo sapiens
catatcatgtacagt

SEQ ID NO: 3000342 - DNA, 17 bp, Homo sapiens
catatccttctggctgt

SEQ ID NO: 3000343 - DNA, 16 bp, Homo sapiens
catatctagatttcta

SEQ ID NO: 3000344 - DNA, 20 bp, Homo sapiens
catatctagatttctagaaa

SEQ ID NO: 3000345 - DNA, 15 bp, Homo sapiens
catatctctcccttc

SEQ ID NO: 3000346 - DNA, 19 bp, Homo sapiens
catatctctcccttcttta

SEQ ID NO: 3000347 - DNA, 18 bp, Homo sapiens
catatgaaaatacaactt

SEQ ID NO: 3000348 - DNA, 19 bp, Homo sapiens
catatgcaccttgtgtctg

SEQ ID NO: 3000349 - DNA, 18 bp, Homo sapiens
catatgcagtgttctaca

SEQ ID NO: 3000350 - DNA, 23 bp, Homo sapiens
catatgcccacatttagtctctt

SEQ ID NO: 3000351 - DNA, 13 bp, Homo sapiens
catatggacactg

SEQ ID NO: 3000352 - DNA, 18 bp, Homo sapiens
catatggactctgcacat

SEQ ID NO: 3000353 - DNA, 18 bp, Homo sapiens
catatgggttagatgttg

SEQ ID NO: 3000354 - DNA, 19 bp, Homo sapiens
catatgtagaaacatttag

SEQ ID NO: 3000355 - DNA, 20 bp, Homo sapiens
catatgtagaaacatttaga

SEQ ID NO: 3000356 - DNA, 21 bp, Homo sapiens
catattaatataagtttcttt

SEQ ID NO: 3000357 - DNA, 22 bp, Homo sapiens
catattacgttgtttcttatag

SEQ ID NO: 3000358 - DNA, 16 bp, Homo sapiens
catattcaacacactg

SEQ ID NO: 3000359 - DNA, 17 bp, Homo sapiens
catattctttcaattct

SEQ ID NO: 3000360 - DNA, 16 bp, Homo sapiens
catattggaaagtgat

SEQ ID NO: 3000361 - DNA, 13 bp, Homo sapiens
catattgtaatct

SEQ ID NO: 3000362 - DNA, 11 bp, Homo sapiens
catattgtaca

SEQ ID NO: 3000363 - DNA, 14 bp, Homo sapiens
catattgtacactt

SEQ ID NO: 3000364 - DNA, 20 bp, Homo sapiens
catattgtacacttttttgg

SEQ ID NO: 3000365 - DNA, 14 bp, Homo sapiens
catatttaactggt

SEQ ID NO: 3000366 - DNA, 12 bp, Homo sapiens
catatttaagaa

SEQ ID NO: 3000367 - DNA, 18 bp, Homo sapiens
catatttaatgttttaaa

SEQ ID NO: 3000368 - DNA, 22 bp, Homo sapiens
catatttatccaaaatgtgtat

SEQ ID NO: 3000369 - DNA, 14 bp, Homo sapiens
catatttcatgttg

SEQ ID NO: 3000370 - DNA, 12 bp, Homo sapiens
catatttgtgtt

SEQ ID NO: 3000371 - DNA, 14 bp, Homo sapiens
catatttgtgttca

SEQ ID NO: 3000372 - DNA, 23 bp, Homo sapiens
catattttattgtattttgatga

SEQ ID NO: 3000373 - DNA, 18 bp, Homo sapiens
catattttcaccatttga

SEQ ID NO: 3000374 - DNA, 16 bp, Homo sapiens
catatttttccttata

SEQ ID NO: 3000375 - DNA, 15 bp, Homo sapiens
catcaaaagacaatt

SEQ ID NO: 3000376 - DNA, 19 bp, Homo sapiens
catcaaaagacaattcttt

SEQ ID NO: 3000377 - DNA, 22 bp, Homo sapiens
catcaaaagacaattctttata

SEQ ID NO: 3000378 - DNA, 22 bp, Homo sapiens
catcaaacatgaaaacattgat

SEQ ID NO: 3000379 - DNA, 14 bp, Homo sapiens
catcaaactgtaaa

SEQ ID NO: 3000380 - DNA, 16 bp, Homo sapiens
catcaaataaaccttg

SEQ ID NO: 3000381 - DNA, 17 bp, Homo sapiens
catcaaataaaccttgt

SEQ ID NO: 3000382 - DNA, 13 bp, Homo sapiens
catcaacaatgat

SEQ ID NO: 3000383 - DNA, 21 bp, Homo sapiens
catcaacattcttgtgtctgt

SEQ ID NO: 3000384 - DNA, 15 bp, Homo sapiens
catcaacttaaaagt

SEQ ID NO: 3000385 - DNA, 13 bp, Homo sapiens
catcaagcacttc

SEQ ID NO: 3000386 - DNA, 19 bp, Homo sapiens
catcaagcacttcccagga

SEQ ID NO: 3000387 - DNA, 22 bp, Homo sapiens
catcaagtctttcacatttaaa

SEQ ID NO: 3000388 - DNA, 19 bp, Homo sapiens
catcaataggcaaaagtgt

SEQ ID NO: 3000389 - DNA, 14 bp, Homo sapiens
catcaatatgtata

SEQ ID NO: 3000390 - DNA, 16 bp, Homo sapiens
catcaatatgtatata

SEQ ID NO: 3000391 - DNA, 17 bp, Homo sapiens
catcaatgggattttct

SEQ ID NO: 3000392 - DNA, 19 bp, Homo sapiens
catcaatgggattttctag

SEQ ID NO: 3000393 - DNA, 15 bp, Homo sapiens
catcaatgtgacatt

SEQ ID NO: 3000394 - DNA, 11 bp, Homo sapiens
catcaatttgt

SEQ ID NO: 3000395 - DNA, 14 bp, Homo sapiens
catcacactgggtg

SEQ ID NO: 3000396 - DNA, 12 bp, Homo sapiens
ccaagaatgtac

SEQ ID NO: 3000397 - DNA, 17 bp, Homo sapiens
ccaagaatgtacgtcca

SEQ ID NO: 3000398 - DNA, 18 bp, Homo sapiens
ccaagaatgtacgtccag

SEQ ID NO: 3000399 - DNA, 13 bp, Homo sapiens
ccaagactctaga

SEQ ID NO: 3000400 - DNA, 11 bp, Homo sapiens
ccaagagaagg

SEQ ID NO: 3000401 - DNA, 12 bp, Homo sapiens
ccaagagaaggg

SEQ ID NO: 3000402 - DNA, 13 bp, Homo sapiens
ccaagagaggaag

SEQ ID NO: 3000403 - DNA, 15 bp, Homo sapiens
ccaagagaggaagga

SEQ ID NO: 3000404 - DNA, 18 bp, Homo sapiens
ccaagagaggaaggaccc

SEQ ID NO: 3000405 - DNA, 16 bp, Homo sapiens
ccaagagattgctaat

SEQ ID NO: 3000406 - DNA, 21 bp, Homo sapiens
ccaagagattgctaattgctg

SEQ ID NO: 3000407 - DNA, 22 bp, Homo sapiens
ccaagagcccgtgccaccccca

SEQ ID NO: 3000408 - DNA, 21 bp, Homo sapiens
ccaagagcttccagagctctg

SEQ ID NO: 3000409 - DNA, 13 bp, Homo sapiens
ccaagaggctgca

SEQ ID NO: 3000410 - DNA, 16 bp, Homo sapiens
ccaagaggctgcagcc

SEQ ID NO: 3000411 - DNA, 18 bp, Homo sapiens
ccaagagtccaggaggcc

SEQ ID NO: 3000412 - DNA, 13 bp, Homo sapiens
ccaagattctaga

SEQ ID NO: 3000413 - DNA, 14 bp, Homo sapiens
ccaagattctagat

SEQ ID NO: 3000414 - DNA, 15 bp, Homo sapiens
ccaagcaagactgag

SEQ ID NO: 3000415 - DNA, 16 bp, Homo sapiens
ccaagcacagtggtgg

SEQ ID NO: 3000416 - DNA, 21 bp, Homo sapiens
ccaagcacagtggtggcaggg

SEQ ID NO: 3000417 - DNA, 16 bp, Homo sapiens
ccaagcagccaagctc

SEQ ID NO: 3000418 - DNA, 12 bp, Homo sapiens
ccaagcaggaag

SEQ ID NO: 3000419 - DNA, 17 bp, Homo sapiens
ccaagcaggaagctcag

SEQ ID NO: 3000420 - DNA, 18 bp, Homo sapiens
ccaagcaggaagctcaga

SEQ ID NO: 3000421 - DNA, 13 bp, Homo sapiens
ccaagccaccgca

SEQ ID NO: 3000422 - DNA, 17 bp, Homo sapiens
ccaagccaccgcagctg

SEQ ID NO: 3000423 - DNA, 20 bp, Homo sapiens
ccaagccaccgcagctgctg

SEQ ID NO: 3000424 - DNA, 21 bp, Homo sapiens
ccaagccaccgcagctgctgc

SEQ ID NO: 3000425 - DNA, 14 bp, Homo sapiens
ccaagccccctggc

SEQ ID NO: 3000426 - DNA, 15 bp, Homo sapiens
ccaagccccctggca

SEQ ID NO: 3000427 - DNA, 22 bp, Homo sapiens
ccaagccccctggcagctgccc

SEQ ID NO: 3000428 - DNA, 17 bp, Homo sapiens
ccaagctaagcactgcc

SEQ ID NO: 3000429 - DNA, 20 bp, Homo sapiens
ccaagctaagcactgccact

SEQ ID NO: 3000430 - DNA, 14 bp, Homo sapiens
ccaagctccttggg

SEQ ID NO: 3000431 - DNA, 15 bp, Homo sapiens
ccaagctccttggga

SEQ ID NO: 3000432 - DNA, 18 bp, Homo sapiens
ccaagctctagtgggaag

SEQ ID NO: 3000433 - DNA, 23 bp, Homo sapiens
ccaagctgcctcccctctccttc

SEQ ID NO: 3000434 - DNA, 17 bp, Homo sapiens
ccaagctggctggggtg

SEQ ID NO: 3000435 - DNA, 23 bp, Homo sapiens
ccaagctggctggggtggcctgt

SEQ ID NO: 3000436 - DNA, 13 bp, Homo sapiens
ccaagctgtgttc

SEQ ID NO: 3000437 - DNA, 15 bp, Homo sapiens
ccaagctgtgttcat

SEQ ID NO: 3000438 - DNA, 16 bp, Homo sapiens
ccaagctgtgttcatc

SEQ ID NO: 3000439 - DNA, 22 bp, Homo sapiens
ccaaggaaacgctacctctctg

SEQ ID NO: 3000440 - DNA, 21 bp, Homo sapiens
ccaaggaaaggcatgtacaaa

SEQ ID NO: 3000441 - DNA, 15 bp, Homo sapiens
ccaaggaaggagccc

SEQ ID NO: 3000442 - DNA, 18 bp, Homo sapiens
ccaaggaaggagcccctg

SEQ ID NO: 3000443 - DNA, 21 bp, Homo sapiens
ccaaggaaggagcccctgagt

SEQ ID NO: 3000444 - DNA, 16 bp, Homo sapiens
ccaaggacttccacat

SEQ ID NO: 3000445 - DNA, 22 bp, Homo sapiens
ccaaggacttccacatttttgc

SEQ ID NO: 3000446 - DNA, 23 bp, Homo sapiens
ccaaggagcagagaggtggccac

SEQ ID NO: 3000447 - DNA, 16 bp, Homo sapiens
ccaaggagctgctata

SEQ ID NO: 3000448 - DNA, 18 bp, Homo sapiens
ccaaggatgccttagcat

SEQ ID NO: 3000449 - DNA, 16 bp, Homo sapiens
ccaaggcctcggcaga

SEQ ID NO: 3000450 - DNA, 22 bp, Homo sapiens
ccaaggcttctccaattctgcc

SEQ ID NO: 3000451 - DNA, 13 bp, Homo sapiens
ccaagggatctgg

SEQ ID NO: 3000452 - DNA, 21 bp, Homo sapiens
ccaagggctttgttttgcaca

SEQ ID NO: 3000453 - DNA, 22 bp, Homo sapiens
ccaagggggcggggactgctgg

SEQ ID NO: 3000454 - DNA, 15 bp, Homo sapiens
ccaaggtacagctgt

SEQ ID NO: 3000455 - DNA, 16 bp, Homo sapiens
ccaaggtctcacactc

SEQ ID NO: 3000456 - DNA, 18 bp, Homo sapiens
ccaaggtctcacactcct

SEQ ID NO: 3000457 - DNA, 19 bp, Homo sapiens
ccaaggtctcacactcctc

SEQ ID NO: 3000458 - DNA, 23 bp, Homo sapiens
ccaaggtttaaagagtctagatt

SEQ ID NO: 3000459 - DNA, 16 bp, Homo sapiens
ccaagtaagaggctgg

SEQ ID NO: 3000460 - DNA, 21 bp, Homo sapiens
ccaagtaagaggctggagttg

SEQ ID NO: 3000461 - DNA, 14 bp, Homo sapiens
ccaagtagctgcta

SEQ ID NO: 3000462 - DNA, 20 bp, Homo sapiens
ccaagtagctgggattacag

SEQ ID NO: 3000463 - DNA, 16 bp, Homo sapiens
ccaagtcactcttttt

SEQ ID NO: 3000464 - DNA, 17 bp, Homo sapiens
ccaagtcagacaccaag

SEQ ID NO: 3000465 - DNA, 15 bp, Homo sapiens
ccaagtcaggccagg

SEQ ID NO: 3000466 - DNA, 17 bp, Homo sapiens
ccaagtcggcacccttt

SEQ ID NO: 3000467 - DNA, 15 bp, Homo sapiens
ccaagtctctgtgta

SEQ ID NO: 3000468 - DNA, 13 bp, Homo sapiens
ccaagtgaccagg

SEQ ID NO: 3000469 - DNA, 14 bp, Homo sapiens
ccaagtgggctggt

SEQ ID NO: 3000470 - DNA, 10 bp, Homo sapiens
ccaagtgtgc

SEQ ID NO: 3000471 - DNA, 14 bp, Homo sapiens
ccaataacattctt

SEQ ID NO: 3000472 - DNA, 22 bp, Homo sapiens
ccaataataaaaaacaagaaac

SEQ ID NO: 3000473 - DNA, 17 bp, Homo sapiens
ccaatacaaaatgtatt

SEQ ID NO: 3000474 - DNA, 16 bp, Homo sapiens
ccaatacatttgtatt

SEQ ID NO: 3000475 - DNA, 20 bp, Homo sapiens
ccaatacatttgtattttgt

SEQ ID NO: 3000476 - DNA, 15 bp, Homo sapiens
ccaatattaaatctg

SEQ ID NO: 3000477 - DNA, 20 bp, Homo sapiens
ccaatcaatttaaatgttta

SEQ ID NO: 3000478 - DNA, 22 bp, Homo sapiens
ccaatcagagaccaggccctgg

SEQ ID NO: 3000479 - DNA, 19 bp, Homo sapiens
ccaatccatcgtattaaaa

SEQ ID NO: 3000480 - DNA, 16 bp, Homo sapiens
ccaatcctccccgctc

SEQ ID NO: 3000481 - DNA, 17 bp, Homo sapiens
ccaatcggtgtgttctt

SEQ ID NO: 3000482 - DNA, 11 bp, Homo sapiens
ccaatctgtac

SEQ ID NO: 3000483 - DNA, 14 bp, Homo sapiens
ccaatctgtacaaa

SEQ ID NO: 3000484 - DNA, 13 bp, Homo sapiens
cattgaaatgtaa

SEQ ID NO: 3000485 - DNA, 22 bp, Homo sapiens
cattgaacacaaactgtaaata

SEQ ID NO: 3000486 - DNA, 18 bp, Homo sapiens
cattgaagtaatgaattt

SEQ ID NO: 3000487 - DNA, 22 bp, Homo sapiens
cattgacttcttggtgctgttg

SEQ ID NO: 3000488 - DNA, 16 bp, Homo sapiens
cattgatattgtgaac

SEQ ID NO: 3000489 - DNA, 20 bp, Homo sapiens
cattgatattgtgaacattt

SEQ ID NO: 3000490 - DNA, 15 bp, Homo sapiens
cattgatcttaaact

SEQ ID NO: 3000491 - DNA, 13 bp, Homo sapiens
cattgatgaatga

SEQ ID NO: 3000492 - DNA, 20 bp, Homo sapiens
cattgatgagcactcctgat

SEQ ID NO: 3000493 - DNA, 21 bp, Homo sapiens
cattgatgtaatttaaaactt

SEQ ID NO: 3000494 - DNA, 16 bp, Homo sapiens
cattgcacccagccca

SEQ ID NO: 3000495 - DNA, 12 bp, Homo sapiens
cattgcactcca

SEQ ID NO: 3000496 - DNA, 17 bp, Homo sapiens
cattgcactccagcctg

SEQ ID NO: 3000497 - DNA, 16 bp, Homo sapiens
cattgcatttattgca

SEQ ID NO: 3000498 - DNA, 15 bp, Homo sapiens
cattgccaagggctt

SEQ ID NO: 3000499 - DNA, 18 bp, Homo sapiens
cattgcccagtctttcat

SEQ ID NO: 3000500 - DNA, 14 bp, Homo sapiens
cattgcctttgaat

SEQ ID NO: 3000501 - DNA, 17 bp, Homo sapiens
cattgcctttgaatgtt

SEQ ID NO: 3000502 - DNA, 18 bp, Homo sapiens
cattgctgagcctctgct

SEQ ID NO: 3000503 - DNA, 22 bp, Homo sapiens
cattgctgcccgtttgtacatg

SEQ ID NO: 3000504 - DNA, 11 bp, Homo sapiens
cagcagactga

SEQ ID NO: 3000505 - DNA, 16 bp, Homo sapiens
cagcagattggaagga

SEQ ID NO: 3000506 - DNA, 20 bp, Homo sapiens
cagcagattggaaggagaca

SEQ ID NO: 3000507 - DNA, 15 bp, Homo sapiens
cagcagcaagaaaaa

SEQ ID NO: 3000508 - DNA, 22 bp, Homo sapiens
cagcagcaagaaaaaaaaatgc

SEQ ID NO: 3000509 - DNA, 19 bp, Homo sapiens
cagagcaaaatgctcttgt

SEQ ID NO: 3000510 - DNA, 21 bp, Homo sapiens
cagagcaaaatgctcttgtcc

SEQ ID NO: 3000511 - DNA, 15 bp, Homo sapiens
cagagcacgcctgcc

SEQ ID NO: 3000512 - DNA, 14 bp, Homo sapiens
cagagcaggactgc

SEQ ID NO: 3000513 - DNA, 13 bp, Homo sapiens
cagagcaggggct

SEQ ID NO: 3000514 - DNA, 15 bp, Homo sapiens
cagagcagtgggcct

SEQ ID NO: 3000515 - DNA, 22 bp, Homo sapiens
cagagcagtgggcctggccagc

SEQ ID NO: 3000516 - DNA, 15 bp, Homo sapiens
cagagcatttaagag

SEQ ID NO: 3000517 - DNA, 21 bp, Homo sapiens
cagagccaaggggcttcaggt

SEQ ID NO: 3000518 - DNA, 17 bp, Homo sapiens
cagagccaagggggcag

SEQ ID NO: 3000519 - DNA, 15 bp, Homo sapiens
cagagccacacatgg

SEQ ID NO: 3000520 - DNA, 12 bp, Homo sapiens
cagagcccagct

SEQ ID NO: 3000521 - DNA, 17 bp, Homo sapiens
cagagcccagctcttgc

SEQ ID NO: 3000522 - DNA, 19 bp, Homo sapiens
cagagcccagctcttgctc

SEQ ID NO: 3000523 - DNA, 21 bp, Homo sapiens
cagagcccagctcttgctctc

SEQ ID NO: 3000524 - DNA, 12 bp, Homo sapiens
cagagcccaggg

SEQ ID NO: 3000525 - DNA, 14 bp, Homo sapiens
cagagcccagggga

SEQ ID NO: 3000526 - DNA, 19 bp, Homo sapiens
cagagcccggtgggtccgc

SEQ ID NO: 3000527 - DNA, 20 bp, Homo sapiens
cagagccgtggtcctttggg

SEQ ID NO: 3000528 - DNA, 14 bp, Homo sapiens
cagagcctcgctct

SEQ ID NO: 3000529 - DNA, 16 bp, Homo sapiens
cagagcgagactccat

SEQ ID NO: 3000530 - DNA, 20 bp, Homo sapiens
cagagcgagattccgtctca

SEQ ID NO: 3000531 - DNA, 16 bp, Homo sapiens
cagagcgggagggagt

SEQ ID NO: 3000532 - DNA, 15 bp, Homo sapiens
cagagctctgaccca

SEQ ID NO: 3000533 - DNA, 18 bp, Homo sapiens
cagaatgctgtacatcta

SEQ ID NO: 3000534 - DNA, 21 bp, Homo sapiens
cagaatgctgtacatctattt

SEQ ID NO: 3000535 - DNA, 17 bp, Homo sapiens
cagaatgggggctttcg

SEQ ID NO: 3000536 - DNA, 20 bp, Homo sapiens
cagaatgtaagtgggcccac

SEQ ID NO: 3000537 - DNA, 22 bp, Homo sapiens
cagaatgtaagtgggcccaccc

SEQ ID NO: 3000538 - DNA, 14 bp, Homo sapiens
cagaatgtatatta

SEQ ID NO: 3000539 - DNA, 13 bp, Homo sapiens
cagaatgtgctgc

SEQ ID NO: 3000540 - DNA, 15 bp, Homo sapiens
cagaatgtgctgcct

SEQ ID NO: 3000541 - DNA, 22 bp, Homo sapiens
cagaatgttgattacagtgcag

SEQ ID NO: 3000542 - DNA, 16 bp, Homo sapiens
cagaattacccttcct

SEQ ID NO: 3000543 - DNA, 18 bp, Homo sapiens
cagaattacccttcctca

SEQ ID NO: 3000544 - DNA, 19 bp, Homo sapiens
cagaattacccttcctcat

SEQ ID NO: 3000545 - DNA, 23 bp, Homo sapiens
cagaattactgtaactgattaca

SEQ ID NO: 3000546 - DNA, 19 bp, Homo sapiens
cagaatttgggttctgcct

SEQ ID NO: 3000547 - DNA, 17 bp, Homo sapiens
cagaattttaatgtgaa

SEQ ID NO: 3000548 - DNA, 17 bp, Homo sapiens
cagaatttttaactgta

SEQ ID NO: 3000549 - DNA, 15 bp, Homo sapiens
cagaattttttttgt

SEQ ID NO: 3000550 - DNA, 18 bp, Homo sapiens
cagaattttttttgttgt

SEQ ID NO: 3000551 - DNA, 19 bp, Homo sapiens
cagacaaaaacagcctcac

SEQ ID NO: 3000552 - DNA, 15 bp, Homo sapiens
cagacaaaatgaaag

SEQ ID NO: 3000553 - DNA, 11 bp, Homo sapiens
cagacaaatta

SEQ ID NO: 3000554 - DNA, 16 bp, Homo sapiens
cagacaaggagagcgg

SEQ ID NO: 3000555 - DNA, 16 bp, Homo sapiens
cagacaagtaatcact

SEQ ID NO: 3000556 - DNA, 17 bp, Homo sapiens
cagacaatatgtgagtg

SEQ ID NO: 3000557 - DNA, 22 bp, Homo sapiens
cagacaatatgtgagtgccttt

SEQ ID NO: 3000558 - DNA, 14 bp, Homo sapiens
cagacacccaggac

SEQ ID NO: 3000559 - DNA, 19 bp, Homo sapiens
cagacacctgttcacagaa

SEQ ID NO: 3000560 - DNA, 21 bp, Homo sapiens
cagacagagaatatgtctgct

SEQ ID NO: 3000561 - DNA, 11 bp, Homo sapiens
cagacagatga

SEQ ID NO: 3000562 - DNA, 15 bp, Homo sapiens
cagacagccccctgc

SEQ ID NO: 3000563 - DNA, 21 bp, Homo sapiens
cagacagccccctgccccgca

SEQ ID NO: 3000564 - DNA, 18 bp, Homo sapiens
cagacaggcaaataaaag

SEQ ID NO: 3000565 - DNA, 15 bp, Homo sapiens
cagacaggccccgtg

SEQ ID NO: 3000566 - DNA, 21 bp, Homo sapiens
cactcttggagcctgcagagc

SEQ ID NO: 3000567 - DNA, 23 bp, Homo sapiens
cactcttggagcctgcagagctg

SEQ ID NO: 3000568 - DNA, 15 bp, Homo sapiens
cactcttttatacaa

SEQ ID NO: 3000569 - DNA, 12 bp, Homo sapiens
cactgaaaaaat

SEQ ID NO: 3000570 - DNA, 16 bp, Homo sapiens
cactgaaaacatctgg

SEQ ID NO: 3000571 - DNA, 14 bp, Homo sapiens
cactgaaaccttta

SEQ ID NO: 3000572 - DNA, 20 bp, Homo sapiens
cactgaaacctttaagaaaa

SEQ ID NO: 3000573 - DNA, 19 bp, Homo sapiens
cactgaagtagtgtgcagt

SEQ ID NO: 3000574 - DNA, 23 bp, Homo sapiens
cactgacacatcagcatgttttc

SEQ ID NO: 3000575 - DNA, 15 bp, Homo sapiens
cactgaccagaacta

SEQ ID NO: 3000576 - DNA, 13 bp, Homo sapiens
cactgacccaaat

SEQ ID NO: 3000577 - DNA, 13 bp, Homo sapiens
cactgactattac

SEQ ID NO: 3000578 - DNA, 19 bp, Homo sapiens
cactgactatttgacaata

SEQ ID NO: 3000579 - DNA, 22 bp, Homo sapiens
cactgacttaggtttcaggaag

SEQ ID NO: 3000580 - DNA, 17 bp, Homo sapiens
cactgagaatgatagta

SEQ ID NO: 3000581 - DNA, 19 bp, Homo sapiens
cactgagataccagcgagg

SEQ ID NO: 3000582 - DNA, 13 bp, Homo sapiens
cactgagcatcac

SEQ ID NO: 3000583 - DNA, 16 bp, Homo sapiens
cactgagctctgcctc

SEQ ID NO: 3000584 - DNA, 17 bp, Homo sapiens
cactgaggcagggaagt

SEQ ID NO: 3000585 - DNA, 21 bp, Homo sapiens
cactgaggcctgagacccagg

SEQ ID NO: 3000586 - DNA, 16 bp, Homo sapiens
cactgagtttctattt

SEQ ID NO: 3000587 - DNA, 22 bp, Homo sapiens
cactgagttttccatggcagga

SEQ ID NO: 3000588 - DNA, 15 bp, Homo sapiens
cactgatccagccct

SEQ ID NO: 3000589 - DNA, 17 bp, Homo sapiens
cactgatctttgcaaag

SEQ ID NO: 3000590 - DNA, 16 bp, Homo sapiens
cactgatttggagata

SEQ ID NO: 3000591 - DNA, 14 bp, Homo sapiens
cactgcaacctctg

SEQ ID NO: 3000592 - DNA, 16 bp, Homo sapiens
cactgcaacttctgcc

SEQ ID NO: 3000593 - DNA, 17 bp, Homo sapiens
cactgcaagagccttgg

SEQ ID NO: 3000594 - DNA, 16 bp, Homo sapiens
cactgcaatcctgtct

SEQ ID NO: 3000595 - DNA, 21 bp, Homo sapiens
cactgcactcaaccttaagac

SEQ ID NO: 3000596 - DNA, 19 bp, Homo sapiens
cactgcactccagcctgag

SEQ ID NO: 3000597 - DNA, 20 bp, Homo sapiens
cactgcagcctcaacctcct

SEQ ID NO: 3000598 - DNA, 13 bp, Homo sapiens
cactgcaggcccc

SEQ ID NO: 3000599 - DNA, 16 bp, Homo sapiens
cactgcataccaacct

SEQ ID NO: 3000600 - DNA, 18 bp, Homo sapiens
cactgcatgagcttttat

SEQ ID NO: 3000601 - DNA, 18 bp, Homo sapiens
cactgccagcatttccct

SEQ ID NO: 3000602 - DNA, 20 bp, Homo sapiens
cactgccatcttagtttgga

SEQ ID NO: 3000603 - DNA, 12 bp, Homo sapiens
cactgccgctgc

SEQ ID NO: 3000604 - DNA, 14 bp, Homo sapiens
cactgccggcagga

SEQ ID NO: 3000605 - DNA, 15 bp, Homo sapiens
cactgcctcctccct

SEQ ID NO: 3000606 - DNA, 17 bp, Homo sapiens
cactgcctcctccctgg

SEQ ID NO: 3000607 - DNA, 18 bp, Homo sapiens
cactgccttcgtttatat

SEQ ID NO: 3000608 - DNA, 19 bp, Homo sapiens
cactgccttcgtttatatt

SEQ ID NO: 3000609 - DNA, 22 bp, Homo sapiens
cactgccttcgtttatattttt

SEQ ID NO: 3000610 - DNA, 18 bp, Homo sapiens
cactgctaagaatatttg

SEQ ID NO: 3000611 - DNA, 14 bp, Homo sapiens
cactgctacatgtg

SEQ ID NO: 3000612 - DNA, 22 bp, Homo sapiens
cactgctcgaaatggcccctgt

SEQ ID NO: 3000613 - DNA, 16 bp, Homo sapiens
cactgctgcctcagct

SEQ ID NO: 3000614 - DNA, 13 bp, Homo sapiens
cactgctgctcct

SEQ ID NO: 3000615 - DNA, 21 bp, Homo sapiens
cactgctgctcctctttcccc

SEQ ID NO: 3000616 - DNA, 23 bp, Homo sapiens
cactgctgcttctccatggccac

SEQ ID NO: 3000617 - DNA, 18 bp, Homo sapiens
cactgcttttggcctgga

SEQ ID NO: 3000618 - DNA, 16 bp, Homo sapiens
cacacacaacagccaa

SEQ ID NO: 3000619 - DNA, 20 bp, Homo sapiens
cacacacaacagccaacagc

SEQ ID NO: 3000620 - DNA, 12 bp, Homo sapiens
cacacacacaag

SEQ ID NO: 3000621 - DNA, 14 bp, Homo sapiens
cacacacacacaag

SEQ ID NO: 3000622 - DNA, 13 bp, Homo sapiens
cacacacacacac

SEQ ID NO: 3000623 - DNA, 15 bp, Homo sapiens
cacacacacacacaa

SEQ ID NO: 3000624 - DNA, 13 bp, Homo sapiens
cacacacacacat

SEQ ID NO: 3000625 - DNA, 15 bp, Homo sapiens
cacacacacacatgc

SEQ ID NO: 3000626 - DNA, 14 bp, Homo sapiens
cacacacacagaaa

SEQ ID NO: 3000627 - DNA, 11 bp, Homo sapiens
cacacacagaa

SEQ ID NO: 3000628 - DNA, 21 bp, Homo sapiens
cacacacagaaaatatactgt

SEQ ID NO: 3000629 - DNA, 23 bp, Homo sapiens
cacacacagaaaatatactgtaa

SEQ ID NO: 3000630 - DNA, 11 bp, Homo sapiens
cacacacagcc

SEQ ID NO: 3000631 - DNA, 12 bp, Homo sapiens
cacacacatgca

SEQ ID NO: 3000632 - DNA, 18 bp, Homo sapiens
cacacacatgcatacaca

SEQ ID NO: 3000633 - DNA, 20 bp, Homo sapiens
cacacaccagtttacaggaa

SEQ ID NO: 3000634 - DNA, 14 bp, Homo sapiens
cacacacgcacata

SEQ ID NO: 3000635 - DNA, 15 bp, Homo sapiens
cacacactccttccc

SEQ ID NO: 3000636 - DNA, 17 bp, Homo sapiens
cacacactccttcccct

SEQ ID NO: 3000637 - DNA, 14 bp, Homo sapiens
cacacactgatgct

SEQ ID NO: 3000638 - DNA, 13 bp, Homo sapiens
cacacagaaaata

SEQ ID NO: 3000639 - DNA, 18 bp, Homo sapiens
cacacagaaaatatactg

SEQ ID NO: 3000640 - DNA, 20 bp, Homo sapiens
cacacagaaaatatactgta

SEQ ID NO: 3000641 - DNA, 22 bp, Homo sapiens
cacacagaaaatatactgtaaa

SEQ ID NO: 3000642 - DNA, 14 bp, Homo sapiens
cacacagccacaca

SEQ ID NO: 3000643 - DNA, 19 bp, Homo sapiens
cacacagccacacacacag

SEQ ID NO: 3000644 - DNA, 12 bp, Homo sapiens
cacacagcccag

SEQ ID NO: 3000645 - DNA, 12 bp, Homo sapiens
cacacagggcag

SEQ ID NO: 3000646 - DNA, 18 bp, Homo sapiens
cacacaggtggtgtcact

SEQ ID NO: 3000647 - DNA, 20 bp, Homo sapiens
cacacaggtggtgtcactgt

SEQ ID NO: 3000648 - DNA, 16 bp, Homo sapiens
cacacatcccagccca

SEQ ID NO: 3000649 - DNA, 17 bp, Homo sapiens
cacacatcccagcccaa

SEQ ID NO: 3000650 - DNA, 15 bp, Homo sapiens
cacacatgcatacac

SEQ ID NO: 3000651 - DNA, 18 bp, Homo sapiens
cacacatgcatacacaca

SEQ ID NO: 3000652 - DNA, 20 bp, Homo sapiens
cacacatgtatattcttcct

SEQ ID NO: 3000653 - DNA, 20 bp, Homo sapiens
cacacattgtgcttggcccc

SEQ ID NO: 3000654 - DNA, 16 bp, Homo sapiens
cacaccacaattctcc

SEQ ID NO: 3000655 - DNA, 18 bp, Homo sapiens
cacaccacaattctccct

SEQ ID NO: 3000656 - DNA, 17 bp, Homo sapiens
cacaccagcctcctggg

SEQ ID NO: 3000657 - DNA, 13 bp, Homo sapiens
cacaccagtttac

SEQ ID NO: 3000658 - DNA, 22 bp, Homo sapiens
cacacccaaagctgagcctgca

SEQ ID NO: 3000659 - DNA, 16 bp, Homo sapiens
cacacccactcagctc

SEQ ID NO: 3000660 - DNA, 14 bp, Homo sapiens
cacacctgcctgcg

SEQ ID NO: 3000661 - DNA, 21 bp, Homo sapiens
cacacctggtctgttttctgt

SEQ ID NO: 3000662 - DNA, 20 bp, Homo sapiens
cacacgcctcccactggggt

SEQ ID NO: 3000663 - DNA, 22 bp, Homo sapiens
cacacggctggtcactctgccc

SEQ ID NO: 3000664 - DNA, 19 bp, Homo sapiens
cacacgtttaatcccagca

SEQ ID NO: 3000665 - DNA, 19 bp, Homo sapiens
cacactacaccacacacaa

SEQ ID NO: 3000666 - DNA, 20 bp, Homo sapiens
cacactatgtgtgttgtttc

SEQ ID NO: 3000667 - DNA, 13 bp, Homo sapiens
cacactccagaat

SEQ ID NO: 3000668 - DNA, 14 bp, Homo sapiens
cacactccagaatt

SEQ ID NO: 3000669 - DNA, 10 bp, Homo sapiens
cacactccta

SEQ ID NO: 3000670 - DNA, 14 bp, Homo sapiens
cacactcctcctgc

SEQ ID NO: 3000671 - DNA, 18 bp, Homo sapiens
cacactcctcctgccagc

SEQ ID NO: 3000672 - DNA, 13 bp, Homo sapiens
cacactgaggcag

SEQ ID NO: 3000673 - DNA, 14 bp, Homo sapiens
cacactgaggcagg

SEQ ID NO: 3000674 - DNA, 17 bp, Homo sapiens
cacactgaggcagggaa

SEQ ID NO: 3000675 - DNA, 14 bp, Homo sapiens
cacactgatgctta

SEQ ID NO: 3000676 - DNA, 16 bp, Homo sapiens
cacactgcaagagcct

SEQ ID NO: 3000677 - DNA, 17 bp, Homo sapiens
cacactgcaagagcctt

SEQ ID NO: 3000678 - DNA, 20 bp, Homo sapiens
cacactgcaagagccttggt

SEQ ID NO: 3000679 - DNA, 21 bp, Homo sapiens
cacactgccttattacataac

SEQ ID NO: 3000680 - DNA, 16 bp, Homo sapiens
cacactggttctcaat

SEQ ID NO: 3000681 - DNA, 15 bp, Homo sapiens
cacactgtaaatatg

SEQ ID NO: 3000682 - DNA, 14 bp, Homo sapiens
cacactgtgacaca

SEQ ID NO: 3000683 - DNA, 14 bp, Homo sapiens
cacagaaaaagcat

SEQ ID NO: 3000684 - DNA, 15 bp, Homo sapiens
cacagaaaatatact

SEQ ID NO: 3000685 - DNA, 19 bp, Homo sapiens
cacagaaacactgcctttt

SEQ ID NO: 3000686 - DNA, 13 bp, Homo sapiens
cacagaagtcctg

SEQ ID NO: 3000687 - DNA, 22 bp, Homo sapiens
cacagaagtcctgtatgtctgt

SEQ ID NO: 3000688 - DNA, 21 bp, Homo sapiens
cacagactcatcctgaacagc

SEQ ID NO: 3000689 - DNA, 23 bp, Homo sapiens
cacagactcatcctgaacagcat

SEQ ID NO: 3000690 - DNA, 17 bp, Homo sapiens
cacagactcttccacca

SEQ ID NO: 3000691 - DNA, 21 bp, Homo sapiens
cacagactcttccaccagagc

SEQ ID NO: 3000692 - DNA, 12 bp, Homo sapiens
cacagactgccc

SEQ ID NO: 3000693 - DNA, 13 bp, Homo sapiens
cacagactgcccc

SEQ ID NO: 3000694 - DNA, 18 bp, Homo sapiens
cacagactgccccagcca

SEQ ID NO: 3000695 - DNA, 14 bp, Homo sapiens
cacagagaagacaa

SEQ ID NO: 3000696 - DNA, 13 bp, Homo sapiens
cacagagcacgcc

SEQ ID NO: 3000697 - DNA, 15 bp, Homo sapiens
cacagagcacgcctg

SEQ ID NO: 3000698 - DNA, 17 bp, Homo sapiens
cacagagcacgcctgcc

SEQ ID NO: 3000699 - DNA, 14 bp, Homo sapiens
cacagagcaggact

SEQ ID NO: 3000700 - DNA, 21 bp, Homo sapiens
cacagagcaggactgcacagc

SEQ ID NO: 3000701 - DNA, 19 bp, Homo sapiens
cacagagcctgaatttgta

SEQ ID NO: 3000702 - DNA, 17 bp, Homo sapiens
cacagagggcgctcctg

SEQ ID NO: 3000703 - DNA, 15 bp, Homo sapiens
cacagagtgagactc

SEQ ID NO: 3000704 - DNA, 17 bp, Homo sapiens
cacagagtgagactcca

SEQ ID NO: 3000705 - DNA, 21 bp, Homo sapiens
cacagagtgtagccaggtccc

SEQ ID NO: 3000706 - DNA, 17 bp, Homo sapiens
cacagagtgtgtttttg

SEQ ID NO: 3000707 - DNA, 21 bp, Homo sapiens
cacagagtgtgtttttgcact

SEQ ID NO: 3000708 - DNA, 19 bp, Homo sapiens
cacagataccttgaaagga

SEQ ID NO: 3000709 - DNA, 17 bp, Homo sapiens
cacagatgaccaaagtc

SEQ ID NO: 3000710 - DNA, 16 bp, Homo sapiens
cacagatgctggcctc

SEQ ID NO: 3000711 - DNA, 20 bp, Homo sapiens
cacagatgctggcctcttgg

SEQ ID NO: 3000712 - DNA, 17 bp, Homo sapiens
cacagattcccaggcca

SEQ ID NO: 3000713 - DNA, 22 bp, Homo sapiens
cacagattgtttctatacaaat

SEQ ID NO: 3000714 - DNA, 14 bp, Homo sapiens
cacagcaaccccag

SEQ ID NO: 3000715 - DNA, 16 bp, Homo sapiens
cacagcaattcctcag

SEQ ID NO: 3000716 - DNA, 18 bp, Homo sapiens
cacagcaattcctcaggc

SEQ ID NO: 3000717 - DNA, 15 bp, Homo sapiens
cacagcacagccaac

SEQ ID NO: 3000718 - DNA, 18 bp, Homo sapiens
cacagcaccgtgccaacc

SEQ ID NO: 3000719 - DNA, 12 bp, Homo sapiens
cacagcagcctg

SEQ ID NO: 3000720 - DNA, 22 bp, Homo sapiens
cacagccaacacgcacctgcct

SEQ ID NO: 3000721 - DNA, 12 bp, Homo sapiens
cacagccacaca

SEQ ID NO: 3000722 - DNA, 17 bp, Homo sapiens
cacagccacacacacag

SEQ ID NO: 3000723 - DNA, 18 bp, Homo sapiens
cacagccacacacacaga

SEQ ID NO: 3000724 - DNA, 20 bp, Homo sapiens
cacagccacacacacagaaa

SEQ ID NO: 3000725 - DNA, 21 bp, Homo sapiens
cacagccacacacacagaaaa

SEQ ID NO: 3000726 - DNA, 23 bp, Homo sapiens
cacagccacacacacagaaaata

SEQ ID NO: 3000727 - DNA, 16 bp, Homo sapiens
cacagcccaggcctcc

SEQ ID NO: 3000728 - DNA, 20 bp, Homo sapiens
cacatttttgcacagattat

SEQ ID NO: 3000729 - DNA, 17 bp, Homo sapiens
caccaaaattatagctt

SEQ ID NO: 3000730 - DNA, 18 bp, Homo sapiens
caccaaaattatagcttt

SEQ ID NO: 3000731 - DNA, 12 bp, Homo sapiens
caccaaagttct

SEQ ID NO: 3000732 - DNA, 17 bp, Homo sapiens
caccaaagttctaataa

SEQ ID NO: 3000733 - DNA, 19 bp, Homo sapiens
caccaacccatcagaagga

SEQ ID NO: 3000734 - DNA, 14 bp, Homo sapiens
caccaactttttcc

SEQ ID NO: 3000735 - DNA, 18 bp, Homo sapiens
caccaactttttccaagt

SEQ ID NO: 3000736 - DNA, 13 bp, Homo sapiens
caccaagcacagc

SEQ ID NO: 3000737 - DNA, 15 bp, Homo sapiens
caccaagcacagcag

SEQ ID NO: 3000738 - DNA, 19 bp, Homo sapiens
caccaagctcacagttcct

SEQ ID NO: 3000739 - DNA, 20 bp, Homo sapiens
caccaagctcacagttcctc

SEQ ID NO: 3000740 - DNA, 16 bp, Homo sapiens
caccaaggtctcacac

SEQ ID NO: 3000741 - DNA, 21 bp, Homo sapiens
caccaaggtctcacactcctc

SEQ ID NO: 3000742 - DNA, 22 bp, Homo sapiens
caccaagttggaacatccttgg

SEQ ID NO: 3000743 - DNA, 15 bp, Homo sapiens
caccaattaagtgtt

SEQ ID NO: 3000744 - DNA, 13 bp, Homo sapiens
caccacacacaac

SEQ ID NO: 3000745 - DNA, 15 bp, Homo sapiens
caccacacatcccag

SEQ ID NO: 3000746 - DNA, 15 bp, Homo sapiens
caccacactcagccc

SEQ ID NO: 3000747 - DNA, 16 bp, Homo sapiens
caccacactttcaaag

SEQ ID NO: 3000748 - DNA, 20 bp, Homo sapiens
caccacagcttatggcatct

SEQ ID NO: 3000749 - DNA, 14 bp, Homo sapiens
caccacatctaagc

SEQ ID NO: 3000750 - DNA, 16 bp, Homo sapiens
caccacatcttgtctt

SEQ ID NO: 3000751 - DNA, 13 bp, Homo sapiens
caccaccaggtct

SEQ ID NO: 3000752 - DNA, 13 bp, Homo sapiens
caccaccatgccc

SEQ ID NO: 3000753 - DNA, 14 bp, Homo sapiens
caccacccaacctg

SEQ ID NO: 3000754 - DNA, 23 bp, Homo sapiens
caccacctaggccactcctccaa

SEQ ID NO: 3000755 - DNA, 19 bp, Homo sapiens
caccaccttatacatcact

SEQ ID NO: 3000756 - DNA, 23 bp, Homo sapiens
caccaccttatacatcacttcct

SEQ ID NO: 3000757 - DNA, 19 bp, Homo sapiens
caccaccttcccagctctc

SEQ ID NO: 3000758 - DNA, 19 bp, Homo sapiens
caccacgatgtggccctgg

SEQ ID NO: 3000759 - DNA, 21 bp, Homo sapiens
caccacgatgtggccctggcc

SEQ ID NO: 3000760 - DNA, 22 bp, Homo sapiens
caccacgatgtggccctggcct

SEQ ID NO: 3000761 - DNA, 15 bp, Homo sapiens
caccacgtcacttca

SEQ ID NO: 3000762 - DNA, 14 bp, Homo sapiens
caccactataaaat

SEQ ID NO: 3000763 - DNA, 17 bp, Homo sapiens
caccactcctgccagcc

SEQ ID NO: 3000764 - DNA, 20 bp, Homo sapiens
caccactcctgccagcccgg

SEQ ID NO: 3000765 - DNA, 13 bp, Homo sapiens
caccactgcactc

SEQ ID NO: 3000766 - DNA, 13 bp, Homo sapiens
caaagccagaagc

SEQ ID NO: 3000767 - DNA, 14 bp, Homo sapiens
caaagccagaagct

SEQ ID NO: 3000768 - DNA, 16 bp, Homo sapiens
caaagccagaagctga

SEQ ID NO: 3000769 - DNA, 13 bp, Homo sapiens
caaagccagagtg

SEQ ID NO: 3000770 - DNA, 14 bp, Homo sapiens
caaagcccaaggga

SEQ ID NO: 3000771 - DNA, 11 bp, Homo sapiens
caaagccctgc

SEQ ID NO: 3000772 - DNA, 15 bp, Homo sapiens
caaagccctgcctct

SEQ ID NO: 3000773 - DNA, 18 bp, Homo sapiens
caaagccctgcctctgtg

SEQ ID NO: 3000774 - DNA, 16 bp, Homo sapiens
caaagccggcctgaga

SEQ ID NO: 3000775 - DNA, 17 bp, Homo sapiens
caaagcctgtcccagga

SEQ ID NO: 3000776 - DNA, 18 bp, Homo sapiens
caaagcctgtcccaggac

SEQ ID NO: 3000777 - DNA, 19 bp, Homo sapiens
caaagcgcccacccaggtc

SEQ ID NO: 3000778 - DNA, 12 bp, Homo sapiens
caaagctgagcc

SEQ ID NO: 3000779 - DNA, 22 bp, Homo sapiens
caaagctgagcctgcagggaag

SEQ ID NO: 3000780 - DNA, 23 bp, Homo sapiens
caaagctgagcctgcagggaagc

SEQ ID NO: 3000781 - DNA, 16 bp, Homo sapiens
caaagctggctcacct

SEQ ID NO: 3000782 - DNA, 14 bp, Homo sapiens
caaagcttagcagg

SEQ ID NO: 3000783 - DNA, 19 bp, Homo sapiens
caaaggaagtctaaatatt

SEQ ID NO: 3000784 - DNA, 17 bp, Homo sapiens
caaaggagcattaagcc

SEQ ID NO: 3000785 - DNA, 23 bp, Homo sapiens
caaaggagcattaagcccaatct

SEQ ID NO: 3000786 - DNA, 14 bp, Homo sapiens
caaaggatgtgttt

SEQ ID NO: 3000787 - DNA, 19 bp, Homo sapiens
caaaggattaattgctgca

SEQ ID NO: 3000788 - DNA, 14 bp, Homo sapiens
caaaggcagaggaa

SEQ ID NO: 3000789 - DNA, 16 bp, Homo sapiens
caaaggcagaggaatt

SEQ ID NO: 3000790 - DNA, 22 bp, Homo sapiens
caaagggacttttgtaaaatca

SEQ ID NO: 3000791 - DNA, 22 bp, Homo sapiens
caaagggatggtattgagaaga

SEQ ID NO: 3000792 - DNA, 23 bp, Homo sapiens
caaagggcacagcatctgtagtc

SEQ ID NO: 3000793 - DNA, 21 bp, Homo sapiens
caaagggtccagaaggagaca

SEQ ID NO: 3000794 - DNA, 19 bp, Homo sapiens
caaagggtgaagctattta

SEQ ID NO: 3000795 - DNA, 21 bp, Homo sapiens
caaagggtgaagctatttatc

SEQ ID NO: 3000796 - DNA, 14 bp, Homo sapiens
caaaggttctaggt

SEQ ID NO: 3000797 - DNA, 19 bp, Homo sapiens
caaaggttctaggtttcaa

SEQ ID NO: 3000798 - DNA, 15 bp, Homo sapiens
caaagtaaaagaaac

SEQ ID NO: 3000799 - DNA, 18 bp, Homo sapiens
caaagtaaaagtagtgtt

SEQ ID NO: 3000800 - DNA, 17 bp, Homo sapiens
caaagtactgtaagaat

SEQ ID NO: 3000801 - DNA, 22 bp, Homo sapiens
caaagtactgtaagaataattt

SEQ ID NO: 3000802 - DNA, 14 bp, Homo sapiens
caaagtattgtaaa

SEQ ID NO: 3000803 - DNA, 18 bp, Homo sapiens
caaagtattgtaaattat

SEQ ID NO: 3000804 - DNA, 19 bp, Homo sapiens
caaagtattgtaaattata

SEQ ID NO: 3000805 - DNA, 22 bp, Homo sapiens
caaagtattgtaaattatattt

SEQ ID NO: 3000806 - DNA, 16 bp, Homo sapiens
caaagtcccttcctgc

SEQ ID NO: 3000807 - DNA, 21 bp, Homo sapiens
caaagtcccttcctgcttcct

SEQ ID NO: 3000808 - DNA, 22 bp, Homo sapiens
caaagtcccttcctgcttcctg

SEQ ID NO: 3000809 - DNA, 14 bp, Homo sapiens
caaagtcctttttt

SEQ ID NO: 3000810 - DNA, 17 bp, Homo sapiens
caaagtcctttttttcc

SEQ ID NO: 3000811 - DNA, 18 bp, Homo sapiens
caaagtctccagaagaaa

SEQ ID NO: 3000812 - DNA, 13 bp, Homo sapiens
caaagtctctaat

SEQ ID NO: 3000813 - DNA, 15 bp, Homo sapiens
caaagtgccaaagaa

SEQ ID NO: 3000814 - DNA, 15 bp, Homo sapiens
caaagtgctgagatt

SEQ ID NO: 3000815 - DNA, 15 bp, Homo sapiens
caaagtggaattaaa

SEQ ID NO: 3000816 - DNA, 22 bp, Homo sapiens
caaagtggtaggtactttttgt

SEQ ID NO: 3000817 - DNA, 17 bp, Homo sapiens
caaagtgttttgtacca

SEQ ID NO: 3000818 - DNA, 19 bp, Homo sapiens
caaagtgttttgtaccagt

SEQ ID NO: 3000819 - DNA, 15 bp, Homo sapiens
caaagttaacagatt

SEQ ID NO: 3000820 - DNA, 21 bp, Homo sapiens
caaagttccagttttgttttg

SEQ ID NO: 3000821 - DNA, 22 bp, Homo sapiens
caaagttctaataatttctaat

SEQ ID NO: 3000822 - DNA, 17 bp, Homo sapiens
caaataaacagtttgac

SEQ ID NO: 3000823 - DNA, 14 bp, Homo sapiens
caaataaaccttgt

SEQ ID NO: 3000824 - DNA, 13 bp, Homo sapiens
caaataaatgttt

SEQ ID NO: 3000825 - DNA, 15 bp, Homo sapiens
caaataaatgtttcc

SEQ ID NO: 3000826 - DNA, 15 bp, Homo sapiens
caaataatttaagtt

SEQ ID NO: 3000827 - DNA, 16 bp, Homo sapiens
caaataatttgaactt

SEQ ID NO: 3000828 - DNA, 18 bp, Homo sapiens
caaataatttgaactttg

SEQ ID NO: 3000829 - DNA, 16 bp, Homo sapiens
caaatactcatgtgta

SEQ ID NO: 3000830 - DNA, 16 bp, Homo sapiens
caaatagcaaatgaaa

SEQ ID NO: 3000831 - DNA, 19 bp, Homo sapiens
caaatagccaccttgattt

SEQ ID NO: 3000832 - DNA, 20 bp, Homo sapiens
caaatagccaccttgatttt

SEQ ID NO: 3000833 - DNA, 21 bp, Homo sapiens
caaatagccaccttgattttc

SEQ ID NO: 3000834 - DNA, 22 bp, Homo sapiens
caaatagccaccttgattttct

SEQ ID NO: 3000835 - DNA, 16 bp, Homo sapiens
caaatattagatgtga

SEQ ID NO: 3000836 - DNA, 12 bp, Homo sapiens
caaatattagca

SEQ ID NO: 3000837 - DNA, 19 bp, Homo sapiens
caaatattagcaaagaagc

SEQ ID NO: 3000838 - DNA, 21 bp, Homo sapiens
caaatattagcaaagaagctt

SEQ ID NO: 3000839 - DNA, 18 bp, Homo sapiens
caaatatttattggatga

SEQ ID NO: 3000840 - DNA, 16 bp, Homo sapiens
caaatcaaacacaaca

SEQ ID NO: 3000841 - DNA, 20 bp, Homo sapiens
caaatcaccacaaactgtaa

SEQ ID NO: 3000842 - DNA, 23 bp, Homo sapiens
caaatcactctgcaatggaaact

SEQ ID NO: 3000843 - DNA, 20 bp, Homo sapiens
caaatcatgttttttctgca

SEQ ID NO: 3000844 - DNA, 22 bp, Homo sapiens
caaatcatgttttttctgcaat

SEQ ID NO: 3000845 - DNA, 21 bp, Homo sapiens
caaatcatttttgagactggt

SEQ ID NO: 3000846 - DNA, 13 bp, Homo sapiens
caaatcctatgtg

SEQ ID NO: 3000847 - DNA, 15 bp, Homo sapiens
caaatcctatgtgat

SEQ ID NO: 3000848 - DNA, 18 bp, Homo sapiens
caaatcctatgtgatttt

SEQ ID NO: 3000849 - DNA, 23 bp, Homo sapiens
caaatcctatgtgattttaactc

SEQ ID NO: 3000850 - DNA, 17 bp, Homo sapiens
caaatcctttctgcccc

SEQ ID NO: 3000851 - DNA, 14 bp, Homo sapiens
caaatctcttgctt

SEQ ID NO: 3000852 - DNA, 13 bp, Homo sapiens
caaatctgtaatt

SEQ ID NO: 3000853 - DNA, 14 bp, Homo sapiens
caaatctgtaatta

SEQ ID NO: 3000854 - DNA, 16 bp, Homo sapiens
caaatctgtcctctgt

SEQ ID NO: 3000855 - DNA, 18 bp, Homo sapiens
caaatctgtcctctgtag

SEQ ID NO: 3000856 - DNA, 15 bp, Homo sapiens
caaatcttacaaaat

SEQ ID NO: 3000857 - DNA, 20 bp, Homo sapiens
caaatcttccttactgtctc

SEQ ID NO: 3000858 - DNA, 19 bp, Homo sapiens
caaatcttgaaattaagaa

SEQ ID NO: 3000859 - DNA, 22 bp, Homo sapiens
caaatgagcatctcaaatgttt

SEQ ID NO: 3000860 - DNA, 12 bp, Homo sapiens
caaatgagccat

SEQ ID NO: 3000861 - DNA, 23 bp, Homo sapiens
caaatgcagggattgctgccact

SEQ ID NO: 3000862 - DNA, 16 bp, Homo sapiens
caaatgcagtatattt

SEQ ID NO: 3000863 - DNA, 19 bp, Homo sapiens
caaatgcattcatgtttta

SEQ ID NO: 3000864 - DNA, 20 bp, Homo sapiens
caaatgccaactgttggaat

SEQ ID NO: 3000865 - DNA, 21 bp, Homo sapiens
caaatgccaactgttggaatt

SEQ ID NO: 3000866 - DNA, 20 bp, Homo sapiens
caatgctgatgaatcactgt

SEQ ID NO: 3000867 - DNA, 23 bp, Homo sapiens
caatgctgatgaatcactgtttt

SEQ ID NO: 3000868 - DNA, 16 bp, Homo sapiens
caatgctgatttggtg

SEQ ID NO: 3000869 - DNA, 14 bp, Homo sapiens
caatgctgtgaata

SEQ ID NO: 3000870 - DNA, 16 bp, Homo sapiens
caatgctgtgaataaa

SEQ ID NO: 3000871 - DNA, 20 bp, Homo sapiens
caatgctgtgaataaaaaga

SEQ ID NO: 3000872 - DNA, 18 bp, Homo sapiens
caatggatcagccaaggc

SEQ ID NO: 3000873 - DNA, 23 bp, Homo sapiens
caatgggatgtatgaatacagca

SEQ ID NO: 3000874 - DNA, 15 bp, Homo sapiens
caatgggattttcta

SEQ ID NO: 3000875 - DNA, 22 bp, Homo sapiens
caatggggatgttgtgtttctg

SEQ ID NO: 3000876 - DNA, 20 bp, Homo sapiens
caatgggtcttagctctttc

SEQ ID NO: 3000877 - DNA, 23 bp, Homo sapiens
caatggtagattcgctgtcccct

SEQ ID NO: 3000878 - DNA, 14 bp, Homo sapiens
caatggtgactgat

SEQ ID NO: 3000879 - DNA, 20 bp, Homo sapiens
caatggtgttatttgaaact

SEQ ID NO: 3000880 - DNA, 19 bp, Homo sapiens
caatggtgtttttcttgta

SEQ ID NO: 3000881 - DNA, 22 bp, Homo sapiens
caatggtgtttttcttgtaaat

SEQ ID NO: 3000882 - DNA, 18 bp, Homo sapiens
caatggtttttaaatttt

SEQ ID NO: 3000883 - DNA, 23 bp, Homo sapiens
caatggtttttaaattttgtaat

SEQ ID NO: 3000884 - DNA, 17 bp, Homo sapiens
caatgtaagcatacttt

SEQ ID NO: 3000885 - DNA, 22 bp, Homo sapiens
caatgtagaggcataaacctgt

SEQ ID NO: 3000886 - DNA, 20 bp, Homo sapiens
caatgtatttatttaaaaga

SEQ ID NO: 3000887 - DNA, 22 bp, Homo sapiens
caatgtatttatttaaaagatt

SEQ ID NO: 3000888 - DNA, 12 bp, Homo sapiens
caatgtatttta

SEQ ID NO: 3000889 - DNA, 18 bp, Homo sapiens
caatgtcagcatcaagcc

SEQ ID NO: 3000890 - DNA, 15 bp, Homo sapiens
caatgtctgcagccc

SEQ ID NO: 3000891 - DNA, 16 bp, Homo sapiens
caatgtctgcagccct

SEQ ID NO: 3000892 - DNA, 22 bp, Homo sapiens
caatgtctgcagccctgagaaa

SEQ ID NO: 3000893 - DNA, 17 bp, Homo sapiens
caatgtgaaagattatt

SEQ ID NO: 3000894 - DNA, 15 bp, Homo sapiens
caatgtgacatttac

SEQ ID NO: 3000895 - DNA, 15 bp, Homo sapiens
caatgttagcctcaa

SEQ ID NO: 3000896 - DNA, 15 bp, Homo sapiens
caatgttctttatat

SEQ ID NO: 3000897 - DNA, 18 bp, Homo sapiens
caatgttctttatataca

SEQ ID NO: 3000898 - DNA, 19 bp, Homo sapiens
caatgttgcactgaaaacc

SEQ ID NO: 3000899 - DNA, 23 bp, Homo sapiens
caattaaaaaaaaagatctgttt

SEQ ID NO: 3000900 - DNA, 22 bp, Homo sapiens
caattaaaaattgtcttcatgt

SEQ ID NO: 3000901 - DNA, 11 bp, Homo sapiens
caattaactgc

SEQ ID NO: 3000902 - DNA, 20 bp, Homo sapiens
caattaagtgttgaaaaata

SEQ ID NO: 3000903 - DNA, 21 bp, Homo sapiens
caattaagtgttgaaaaatat

SEQ ID NO: 3000904 - DNA, 22 bp, Homo sapiens
caattaattgctattgtgttat

SEQ ID NO: 3000905 - DNA, 14 bp, Homo sapiens
caattagacttgaa

SEQ ID NO: 3000906 - DNA, 15 bp, Homo sapiens
caattatagtttctg

SEQ ID NO: 3000907 - DNA, 14 bp, Homo sapiens
caattattgtatat

SEQ ID NO: 3000908 - DNA, 13 bp, Homo sapiens
caattatttttac

SEQ ID NO: 3000909 - DNA, 13 bp, Homo sapiens
caattcaaaagtt

SEQ ID NO: 3000910 - DNA, 20 bp, Homo sapiens
caattcacatctaacctcat

SEQ ID NO: 3000911 - DNA, 15 bp, Homo sapiens
caattcagacaggca

SEQ ID NO: 3000912 - DNA, 22 bp, Homo sapiens
caattccactctgatagaatta

SEQ ID NO: 3000913 - DNA, 18 bp, Homo sapiens
caattcctcatcctcaga

SEQ ID NO: 3000914 - DNA, 22 bp, Homo sapiens
caattcctcatcctcagatgct

SEQ ID NO: 3000915 - DNA, 16 bp, Homo sapiens
caattctcctgcctca

SEQ ID NO: 3000916 - DNA, 19 bp, Homo sapiens
caattctgtaggttaaaaa

SEQ ID NO: 3000917 - DNA, 14 bp, Homo sapiens
caattctgttttag

SEQ ID NO: 3000918 - DNA, 22 bp, Homo sapiens
caattctgttttaggttaaaaa

SEQ ID NO: 3000919 - DNA, 21 bp, Homo sapiens
caattgaattaaattaggaat

SEQ ID NO: 3000920 - DNA, 21 bp, Homo sapiens
caattgacaacagttacataa

SEQ ID NO: 3000921 - DNA, 17 bp, Homo sapiens
caattgcatctcccaga

SEQ ID NO: 3000922 - DNA, 19 bp, Homo sapiens
caattggttgtatataaag

SEQ ID NO: 3000923 - DNA, 19 bp, Homo sapiens
caattgttctgggtgattt

SEQ ID NO: 3000924 - DNA, 23 bp, Homo sapiens
caattgttgacagttctgaagaa

SEQ ID NO: 3000925 - DNA, 16 bp, Homo sapiens
caatttaaacccattt

SEQ ID NO: 3000926 - DNA, 22 bp, Homo sapiens
caatttaaacccattttagtca

SEQ ID NO: 3000927 - DNA, 14 bp, Homo sapiens
caatttaaatgttt

SEQ ID NO: 3000928 - DNA, 19 bp, Homo sapiens
caatttactttttaaacag

SEQ ID NO: 3000929 - DNA, 11 bp, Homo sapiens
caatttagaaa

SEQ ID NO: 3000930 - DNA, 21 bp, Homo sapiens
caatttccaagaatgatgcct

SEQ ID NO: 3000931 - DNA, 13 bp, Homo sapiens
caatttctgaaca

SEQ ID NO: 3000932 - DNA, 19 bp, Homo sapiens
caatttctttaaaaaagaa

SEQ ID NO: 3000933 - DNA, 17 bp, Homo sapiens
caatttgacaaaaccca

SEQ ID NO: 3000934 - DNA, 21 bp, Homo sapiens
caatttggatatttggaggag

SEQ ID NO: 3000935 - DNA, 21 bp, Homo sapiens
caatttgggcttcctgtttgt

SEQ ID NO: 3000936 - DNA, 19 bp, Homo sapiens
caatttgggggacatgcta

SEQ ID NO: 3000937 - DNA, 22 bp, Homo sapiens
caatttgggtttgttggtcaca

SEQ ID NO: 3000938 - DNA, 17 bp, Homo sapiens
caatttgtctcctactc

SEQ ID NO: 3000939 - DNA, 18 bp, Homo sapiens
caatttgttaacagagca

SEQ ID NO: 3000940 - DNA, 22 bp, Homo sapiens
caatttgttggagatgcagcct

SEQ ID NO: 3000941 - DNA, 23 bp, Homo sapiens
caatttgttggagatgcagcctt

SEQ ID NO: 3000942 - DNA, 21 bp, Homo sapiens
caattttaatttagtaaatgt

SEQ ID NO: 3000943 - DNA, 18 bp, Homo sapiens
caattttcattaaacttg

SEQ ID NO: 3000944 - DNA, 16 bp, Homo sapiens
caattttgtatttaat

SEQ ID NO: 3000945 - DNA, 17 bp, Homo sapiens
caattttttgttcttca

SEQ ID NO: 3000946 - DNA, 18 bp, Homo sapiens
caattttttgttcttcag

SEQ ID NO: 3000947 - DNA, 21 bp, Homo sapiens
caatttttttaattttgtatt

SEQ ID NO: 3000948 - DNA, 15 bp, Homo sapiens
cacaaaaatgttcac

SEQ ID NO: 3000949 - DNA, 16 bp, Homo sapiens
cacaaaaatgttcact

SEQ ID NO: 3000950 - DNA, 17 bp, Homo sapiens
cacaaaacctgtcctat

SEQ ID NO: 3000951 - DNA, 20 bp, Homo sapiens
cacaaaagctgtgtctctgt

SEQ ID NO: 3000952 - DNA, 15 bp, Homo sapiens
cacaaactgtaaata

SEQ ID NO: 3000953 - DNA, 19 bp, Homo sapiens
cacaaacttttatactctt

SEQ ID NO: 3000954 - DNA, 22 bp, Homo sapiens
cacaaagatgggtgaaggctgg

SEQ ID NO: 3000955 - DNA, 11 bp, Homo sapiens
cacaaagccca

SEQ ID NO: 3000956 - DNA, 13 bp, Homo sapiens
cacaaaggatttg

SEQ ID NO: 3000957 - DNA, 15 bp, Homo sapiens
cacaaagggcccaga

SEQ ID NO: 3000958 - DNA, 20 bp, Homo sapiens
cacaaatgtgtcccagtgaa

SEQ ID NO: 3000959 - DNA, 17 bp, Homo sapiens
cacaaattattaatgaa

SEQ ID NO: 3000960 - DNA, 11 bp, Homo sapiens
cacaacaaaag

SEQ ID NO: 3000961 - DNA, 15 bp, Homo sapiens
cacaacaaaaggaag

SEQ ID NO: 3000962 - DNA, 17 bp, Homo sapiens
cacaacacaagaaaact

SEQ ID NO: 3000963 - DNA, 21 bp, Homo sapiens
cacaacacaagaaaactcaaa

SEQ ID NO: 3000964 - DNA, 20 bp, Homo sapiens
cacaaccctctggaagtggc

SEQ ID NO: 3000965 - DNA, 14 bp, Homo sapiens
cacaacctgaacct

SEQ ID NO: 3000966 - DNA, 16 bp, Homo sapiens
cacaacgtgcaactga

SEQ ID NO: 3000967 - DNA, 20 bp, Homo sapiens
cacaacttgtttttggtttt

SEQ ID NO: 3000968 - DNA, 15 bp, Homo sapiens
cacaacttttaacca

SEQ ID NO: 3000969 - DNA, 14 bp, Homo sapiens
cacaagaaaaagat

SEQ ID NO: 3000970 - DNA, 22 bp, Homo sapiens
cacaagaaaactcaaagaatgt

SEQ ID NO: 3000971 - DNA, 11 bp, Homo sapiens
cacaagaaatc

SEQ ID NO: 3000972 - DNA, 22 bp, Homo sapiens
cacaagaaatcaaaatccaaaa

SEQ ID NO: 3000973 - DNA, 14 bp, Homo sapiens
cacaagattcccag

SEQ ID NO: 3000974 - DNA, 14 bp, Homo sapiens
cacaagctgcctct

SEQ ID NO: 3000975 - DNA, 22 bp, Homo sapiens
cacaagctgtagataacagcaa

SEQ ID NO: 3000976 - DNA, 18 bp, Homo sapiens
cacaaggactgccgcctt

SEQ ID NO: 3000977 - DNA, 23 bp, Homo sapiens
cacaaggactgccgccttctcgc

SEQ ID NO: 3000978 - DNA, 12 bp, Homo sapiens
cacaaggacttc

SEQ ID NO: 3000979 - DNA, 14 bp, Homo sapiens
cacaaggacttcct

SEQ ID NO: 3000980 - DNA, 22 bp, Homo sapiens
cacaaggacttcctgtccagct

SEQ ID NO: 3000981 - DNA, 20 bp, Homo sapiens
cacaaggtataataaggaaa

SEQ ID NO: 3000982 - DNA, 17 bp, Homo sapiens
cacaaggtcatggccac

SEQ ID NO: 3000983 - DNA, 16 bp, Homo sapiens
caaaaatcagccagac

SEQ ID NO: 3000984 - DNA, 13 bp, Homo sapiens
caaaaatctacag

SEQ ID NO: 3000985 - DNA, 17 bp, Homo sapiens
caaaaatgatcctcagt

SEQ ID NO: 3000986 - DNA, 19 bp, Homo sapiens
caaaaatgatcctcagtgc

SEQ ID NO: 3000987 - DNA, 15 bp, Homo sapiens
caaaaatgctaatat

SEQ ID NO: 3000988 - DNA, 14 bp, Homo sapiens
caaaaatgtaaaaa

SEQ ID NO: 3000989 - DNA, 19 bp, Homo sapiens
caaaaatgtaaaaaacaaa

SEQ ID NO: 3000990 - DNA, 20 bp, Homo sapiens
caaaaatgtaaaaaacaaaa

SEQ ID NO: 3000991 - DNA, 12 bp, Homo sapiens
caaaaatgttca

SEQ ID NO: 3000992 - DNA, 14 bp, Homo sapiens
caaaaatgttccct

SEQ ID NO: 3000993 - DNA, 21 bp, Homo sapiens
caaaaatgttcccttgaccat

SEQ ID NO: 3000994 - DNA, 17 bp, Homo sapiens
caaaaattacactacaa

SEQ ID NO: 3000995 - DNA, 21 bp, Homo sapiens
caaaaattacactacaagttt

SEQ ID NO: 3000996 - DNA, 17 bp, Homo sapiens
caaaaattgacttagat

SEQ ID NO: 3000997 - DNA, 22 bp, Homo sapiens
caaaaattgcgagcctttaccc

SEQ ID NO: 3000998 - DNA, 16 bp, Homo sapiens
caaaacaaaacaacat

SEQ ID NO: 3000999 - DNA, 16 bp, Homo sapiens
caaaacaagcctggta

SEQ ID NO: 3001000 - DNA, 18 bp, Homo sapiens
caaaacatattttacatc

SEQ ID NO: 3001001 - DNA, 18 bp, Homo sapiens
caaaacatttatgacaag

SEQ ID NO: 3001002 - DNA, 13 bp, Homo sapiens
caaaacccagacc

SEQ ID NO: 3001003 - DNA, 15 bp, Homo sapiens
caaaacccagacctg

SEQ ID NO: 3001004 - DNA, 17 bp, Homo sapiens
caaaactagtaaaactt

SEQ ID NO: 3001005 - DNA, 22 bp, Homo sapiens
caaaactgcctcaggaggcagg

SEQ ID NO: 3001006 - DNA, 15 bp, Homo sapiens
caaaacttttaaact

SEQ ID NO: 3001007 - DNA, 16 bp, Homo sapiens
caaaagaagcccccag

SEQ ID NO: 3001008 - DNA, 17 bp, Homo sapiens
caaaagaagcccccagc

SEQ ID NO: 3001009 - DNA, 22 bp, Homo sapiens
caaaagacaattctttatacaa

SEQ ID NO: 3001010 - DNA, 23 bp, Homo sapiens
caaaagacaattctttatacaac

SEQ ID NO: 3001011 - DNA, 18 bp, Homo sapiens
caaaagagctactcagaa

SEQ ID NO: 3001012 - DNA, 17 bp, Homo sapiens
caaaagcaatcatagag

SEQ ID NO: 3001013 - DNA, 11 bp, Homo sapiens
caaaagcaggc

SEQ ID NO: 3001014 - DNA, 15 bp, Homo sapiens
caaaaggaacaaaaa

SEQ ID NO: 3001015 - DNA, 20 bp, Homo sapiens
caaaaggaagactggagaaa

SEQ ID NO: 3001016 - DNA, 21 bp, Homo sapiens
caaaaggaagactggagaaat

SEQ ID NO: 3001017 - DNA, 23 bp, Homo sapiens
caaaaggaagactggagaaatgc

SEQ ID NO: 3001018 - DNA, 21 bp, Homo sapiens
caaaaggagagattattaaat

SEQ ID NO: 3001019 - DNA, 20 bp, Homo sapiens
caaaaggatctttgtggcca

SEQ ID NO: 3001020 - DNA, 24 bp, Homo sapiens
caaaaggatctttgtggccaagga

SEQ ID NO: 3001021 - DNA, 14 bp, Homo sapiens
caaaagggaaaaaa

SEQ ID NO: 3001022 - DNA, 14 bp, Homo sapiens
caaaagggccaggt

SEQ ID NO: 3001023 - DNA, 20 bp, Homo sapiens
caaaagggtttaaactgatt

SEQ ID NO: 3001024 - DNA, 22 bp, Homo sapiens
caaaagggtttaaactgattca

SEQ ID NO: 3001025 - DNA, 22 bp, Homo sapiens
caaaaggtgcctgtgaggcagg

SEQ ID NO: 3001026 - DNA, 17 bp, Homo sapiens
caaaagtaatgcctctg

SEQ ID NO: 3001027 - DNA, 20 bp, Homo sapiens
caaaagtattttcctgtaaa

SEQ ID NO: 3001028 - DNA, 11 bp, Homo sapiens
caaaagtctga

SEQ ID NO: 3001029 - DNA, 16 bp, Homo sapiens
caaaagtggcctcttt

SEQ ID NO: 3001030 - DNA, 17 bp, Homo sapiens
caaaagtggcctctttg

SEQ ID NO: 3001031 - DNA, 20 bp, Homo sapiens
caaaagtggcctctttgtct

SEQ ID NO: 3001032 - DNA, 16 bp, Homo sapiens
caaaagttaatgaata

SEQ ID NO: 3001033 - DNA, 13 bp, Homo sapiens
caaaataaaacaa

SEQ ID NO: 3001034 - DNA, 14 bp, Homo sapiens
caaaataagttttt

SEQ ID NO: 3001035 - DNA, 20 bp, Homo sapiens
caaaataagtttttctttaa

SEQ ID NO: 3001036 - DNA, 19 bp, Homo sapiens
caaaatacgcaatttcaga

SEQ ID NO: 3001037 - DNA, 14 bp, Homo sapiens
caaaatagaaaagt

SEQ ID NO: 3001038 - DNA, 17 bp, Homo sapiens
caaaatagaaaagttat

SEQ ID NO: 3001039 - DNA, 20 bp, Homo sapiens
caaaataggatttcttaaat

SEQ ID NO: 3001040 - DNA, 22 bp, Homo sapiens
caaaataggatttcttaaattt

SEQ ID NO: 3001041 - DNA, 16 bp, Homo sapiens
caaaatatttttaaaa

SEQ ID NO: 3001042 - DNA, 17 bp, Homo sapiens
caaaatcaagcaagcct

SEQ ID NO: 3001043 - DNA, 16 bp, Homo sapiens
caaaatccaaaaagaa

SEQ ID NO: 3001044 - DNA, 15 bp, Homo sapiens
caaaatccaaactgc

SEQ ID NO: 3001045 - DNA, 19 bp, Homo sapiens
caaaatccaaactgctgtc

SEQ ID NO: 3001046 - DNA, 18 bp, Homo sapiens
caaaatcctgactattat

SEQ ID NO: 3001047 - DNA, 16 bp, Homo sapiens
caaaatctgttctaac

SEQ ID NO: 3001048 - DNA, 11 bp, Homo sapiens
caaaatgaaag

SEQ ID NO: 3001049 - DNA, 21 bp, Homo sapiens
caaaatggattttagtcaaat

SEQ ID NO: 3001050 - DNA, 19 bp, Homo sapiens
caaaatggtcctatttttg

SEQ ID NO: 3001051 - DNA, 19 bp, Homo sapiens
caaaattctagctgtatga

SEQ ID NO: 3001052 - DNA, 16 bp, Homo sapiens
caaaattgcaaatctt

SEQ ID NO: 3001053 - DNA, 13 bp, Homo sapiens
caaaatttatatt

SEQ ID NO: 3001054 - DNA, 18 bp, Homo sapiens
caaaatttatattttaga

SEQ ID NO: 3001055 - DNA, 23 bp, Homo sapiens
caaaatttgactaattttacatg

SEQ ID NO: 3001056 - DNA, 23 bp, Homo sapiens
caaaatttgtttgtcactgccaa

SEQ ID NO: 3001057 - DNA, 14 bp, Homo sapiens
caaacaaaactctt

SEQ ID NO: 3001058 - DNA, 17 bp, Homo sapiens
caaacaaaagcagccct

SEQ ID NO: 3001059 - DNA, 21 bp, Homo sapiens
caaacaaaagcagccctctgc

SEQ ID NO: 3001060 - DNA, 13 bp, Homo sapiens
caaacaaagccag

SEQ ID NO: 3001061 - DNA, 14 bp, Homo sapiens
caaacaaagccaga

SEQ ID NO: 3001062 - DNA, 14 bp, Homo sapiens
caaacacaaatgca

SEQ ID NO: 3001063 - DNA, 15 bp, Homo sapiens
caaacacaaatgcag

SEQ ID NO: 3001064 - DNA, 20 bp, Homo sapiens
caaacacaaggtcatggcca

SEQ ID NO: 3001065 - DNA, 21 bp, Homo sapiens
caaacacaataagagtctcct

SEQ ID NO: 3001066 - DNA, 17 bp, Homo sapiens
caaacacattgttattt

SEQ ID NO: 3001067 - DNA, 14 bp, Homo sapiens
caaacactgtgatt

SEQ ID NO: 3001068 - DNA, 17 bp, Homo sapiens
caaacagcaaaccaaga

SEQ ID NO: 3001069 - DNA, 14 bp, Homo sapiens
caaacaggctcaga

SEQ ID NO: 3001070 - DNA, 14 bp, Homo sapiens
caaacagggtggcc

SEQ ID NO: 3001071 - DNA, 16 bp, Homo sapiens
caaacaggtgctggcc

SEQ ID NO: 3001072 - DNA, 17 bp, Homo sapiens
caaacaggtgctggccc

SEQ ID NO: 3001073 - DNA, 24 bp, Homo sapiens
caaacaggtgctggcccagcatgg

SEQ ID NO: 3001074 - DNA, 13 bp, Homo sapiens
caaacagtgaatt

SEQ ID NO: 3001075 - DNA, 15 bp, Homo sapiens
caaacatgaaaacat

SEQ ID NO: 3001076 - DNA, 12 bp, Homo sapiens
caaacatgaagt

SEQ ID NO: 3001077 - DNA, 14 bp, Homo sapiens
caaacatgaagtgt

SEQ ID NO: 3001078 - DNA, 22 bp, Homo sapiens
caaacatgaagtgtgtttcctt

SEQ ID NO: 3001079 - DNA, 15 bp, Homo sapiens
caaacatgagatgtg

SEQ ID NO: 3001080 - DNA, 18 bp, Homo sapiens
caaaccaacaccccatat

SEQ ID NO: 3001081 - DNA, 15 bp, Homo sapiens
caaaccaacatcttt

SEQ ID NO: 3001082 - DNA, 16 bp, Homo sapiens
caaaccaacatctttg

SEQ ID NO: 3001083 - DNA, 17 bp, Homo sapiens
caaaccaacctttctga

SEQ ID NO: 3001084 - DNA, 21 bp, Homo sapiens
caaaccaagagattgctaatt

SEQ ID NO: 3001085 - DNA, 23 bp, Homo sapiens
caaaccaggacactaccctgaga

SEQ ID NO: 3001086 - DNA, 21 bp, Homo sapiens
caaaccaggggtaccaggcac

SEQ ID NO: 3001087 - DNA, 20 bp, Homo sapiens
caaacccagacggctccact

SEQ ID NO: 3001088 - DNA, 18 bp, Homo sapiens
caaaccccttcccacgac

SEQ ID NO: 3001089 - DNA, 17 bp, Homo sapiens
caaaccctgttcaggct

SEQ ID NO: 3001090 - DNA, 23 bp, Homo sapiens
caaaccctgttcaggctggctcg

SEQ ID NO: 3001091 - DNA, 18 bp, Homo sapiens
caaacccttagcagccca

SEQ ID NO: 3001092 - DNA, 19 bp, Homo sapiens
caaacccttagcagcccag

SEQ ID NO: 3001093 - DNA, 11 bp, Homo sapiens
caaacctctgt

SEQ ID NO: 3001094 - DNA, 19 bp, Homo sapiens
caaacctctgttcagtgta

SEQ ID NO: 3001095 - DNA, 16 bp, Homo sapiens
caaacctgtagatgca

SEQ ID NO: 3001096 - DNA, 22 bp, Homo sapiens
caaacgccctttcctcctcagg

SEQ ID NO: 3001097 - DNA, 12 bp, Homo sapiens
caaacgctgcct

SEQ ID NO: 3001098 - DNA, 16 bp, Homo sapiens
caaacgctgcctgccc

SEQ ID NO: 3001099 - DNA, 13 bp, Homo sapiens
caaacggagcccc

SEQ ID NO: 3001100 - DNA, 15 bp, Homo sapiens
caaacggagcccctg

SEQ ID NO: 3001101 - DNA, 16 bp, Homo sapiens
caaacggagcccctga

SEQ ID NO: 3001102 - DNA, 15 bp, Homo sapiens
caaactacctatatt

SEQ ID NO: 3001103 - DNA, 20 bp, Homo sapiens
caaactacctatattccttg

SEQ ID NO: 3001104 - DNA, 22 bp, Homo sapiens
caaactacgcgatagtctctgt

SEQ ID NO: 3001105 - DNA, 18 bp, Homo sapiens
caaactctatcggagaac

SEQ ID NO: 3001106 - DNA, 12 bp, Homo sapiens
caaactcttcag

SEQ ID NO: 3001107 - DNA, 22 bp, Homo sapiens
caaactcttcagttaattctta

SEQ ID NO: 3001108 - DNA, 21 bp, Homo sapiens
caaactgaatgaaacccccac

SEQ ID NO: 3001109 - DNA, 22 bp, Homo sapiens
caaactgaatgaaacccccaca

SEQ ID NO: 3001110 - DNA, 19 bp, Homo sapiens
caaactgggatgaaactaa

SEQ ID NO: 3001111 - DNA, 16 bp, Homo sapiens
caaactggggcctcca

SEQ ID NO: 3001112 - DNA, 21 bp, Homo sapiens
caaactggggcctccagaact

SEQ ID NO: 3001113 - DNA, 21 bp, Homo sapiens
caaactgtaaataaaaagaaa

SEQ ID NO: 3001114 - DNA, 13 bp, Homo sapiens
caaactgttgatt

SEQ ID NO: 3001115 - DNA, 23 bp, Homo sapiens
caaacttgggtagagtttacagc

SEQ ID NO: 3001116 - DNA, 18 bp, Homo sapiens
caaacttttatactcttt

SEQ ID NO: 3001117 - DNA, 13 bp, Homo sapiens
caaagaaacccaa

SEQ ID NO: 3001118 - DNA, 14 bp, Homo sapiens
caaagaagacatgt

SEQ ID NO: 3001119 - DNA, 14 bp, Homo sapiens
atttgccaatcttt

SEQ ID NO: 3001120 - DNA, 21 bp, Homo sapiens
atttgccattggtttctgaaa

SEQ ID NO: 3001121 - DNA, 16 bp, Homo sapiens
atttgcctccagtgca

SEQ ID NO: 3001122 - DNA, 21 bp, Homo sapiens
atttgcctgcagagtttggat

SEQ ID NO: 3001123 - DNA, 11 bp, Homo sapiens
atttgcctgta

SEQ ID NO: 3001124 - DNA, 15 bp, Homo sapiens
atttgcctgtaacaa

SEQ ID NO: 3001125 - DNA, 17 bp, Homo sapiens
atttgctaaatatttct

SEQ ID NO: 3001126 - DNA, 18 bp, Homo sapiens
atttgctaaatatttctt

SEQ ID NO: 3001127 - DNA, 21 bp, Homo sapiens
atttgctgagtttcccttcct

SEQ ID NO: 3001128 - DNA, 14 bp, Homo sapiens
atttgctggagaaa

SEQ ID NO: 3001129 - DNA, 18 bp, Homo sapiens
atttgcttttgaaaagat

SEQ ID NO: 3001130 - DNA, 15 bp, Homo sapiens
atttggaaccaaagt

SEQ ID NO: 3001131 - DNA, 17 bp, Homo sapiens
atttggaaccaaagtct

SEQ ID NO: 3001132 - DNA, 19 bp, Homo sapiens
atttggaagcaacgtgtta

SEQ ID NO: 3001133 - DNA, 14 bp, Homo sapiens
atttggaatacttt

SEQ ID NO: 3001134 - DNA, 15 bp, Homo sapiens
atttggaatactttt

SEQ ID NO: 3001135 - DNA, 19 bp, Homo sapiens
atttggaattgacattctc

SEQ ID NO: 3001136 - DNA, 21 bp, Homo sapiens
atttggcagaactgctggggc

SEQ ID NO: 3001137 - DNA, 18 bp, Homo sapiens
atttggcattgatcttaa

SEQ ID NO: 3001138 - DNA, 18 bp, Homo sapiens
atttggccccaggggacg

SEQ ID NO: 3001139 - DNA, 14 bp, Homo sapiens
atttggctgcttct

SEQ ID NO: 3001140 - DNA, 21 bp, Homo sapiens
atttggcttgttttattttgg

SEQ ID NO: 3001141 - DNA, 14 bp, Homo sapiens
atttgggaagtgaa

SEQ ID NO: 3001142 - DNA, 23 bp, Homo sapiens
atttggggtagctagaggaacca

SEQ ID NO: 3001143 - DNA, 20 bp, Homo sapiens
atttggtccaaaaaaaggaa

SEQ ID NO: 3001144 - DNA, 16 bp, Homo sapiens
atttggttcattaatt

SEQ ID NO: 3001145 - DNA, 22 bp, Homo sapiens
atttgtaaaaacagcattgctt

SEQ ID NO: 3001146 - DNA, 20 bp, Homo sapiens
atttgtaaaaataatgaatg

SEQ ID NO: 3001147 - DNA, 19 bp, Homo sapiens
atttgtaagcaacttgctt

SEQ ID NO: 3001148 - DNA, 14 bp, Homo sapiens
atttgtaattttag

SEQ ID NO: 3001149 - DNA, 15 bp, Homo sapiens
atttgtagacttaag

SEQ ID NO: 3001150 - DNA, 14 bp, Homo sapiens
atttgtaggagaaa

SEQ ID NO: 3001151 - DNA, 19 bp, Homo sapiens
atttgtatttctcttgtcc

SEQ ID NO: 3001152 - DNA, 20 bp, Homo sapiens
atttgtatttctcttgtcct

SEQ ID NO: 3001153 - DNA, 16 bp, Homo sapiens
atttgtattttgtgat

SEQ ID NO: 3001154 - DNA, 20 bp, Homo sapiens
atttgtattttgtgatgaat

SEQ ID NO: 3001155 - DNA, 17 bp, Homo sapiens
atttgtcaatgacagtt

SEQ ID NO: 3001156 - DNA, 19 bp, Homo sapiens
atttgtccaaacaggtgct

SEQ ID NO: 3001157 - DNA, 23 bp, Homo sapiens
atttgtccaaacaggtgctggcc

SEQ ID NO: 3001158 - DNA, 19 bp, Homo sapiens
atttgtcggggaagatgaa

SEQ ID NO: 3001159 - DNA, 20 bp, Homo sapiens
atttgtctcctactctgtgt

SEQ ID NO: 3001160 - DNA, 23 bp, Homo sapiens
atttgtcttcagattattaaaat

SEQ ID NO: 3001161 - DNA, 15 bp, Homo sapiens
atttgtcttgcctta

SEQ ID NO: 3001162 - DNA, 21 bp, Homo sapiens
atttgtctttttgttgtaaaa

SEQ ID NO: 3001163 - DNA, 23 bp, Homo sapiens
atttgtctttttgttgtaaaaca

SEQ ID NO: 3001164 - DNA, 20 bp, Homo sapiens
atttgtgaactcagccaagc

SEQ ID NO: 3001165 - DNA, 15 bp, Homo sapiens
atttgtgacttttta

SEQ ID NO: 3001166 - DNA, 18 bp, Homo sapiens
atttgtgctatagtattt

SEQ ID NO: 3001167 - DNA, 22 bp, Homo sapiens
atttgtgtatttaacagggagg

SEQ ID NO: 3001168 - DNA, 19 bp, Homo sapiens
atttgtgtttttctttttc

SEQ ID NO: 3001169 - DNA, 17 bp, Homo sapiens
atttgttaacagagcaa

SEQ ID NO: 3001170 - DNA, 13 bp, Homo sapiens
atttgttaattaa

SEQ ID NO: 3001171 - DNA, 13 bp, Homo sapiens
atttgttcttata

SEQ ID NO: 3001172 - DNA, 22 bp, Homo sapiens
atttgttgcaccaattaagtgt

SEQ ID NO: 3001173 - DNA, 13 bp, Homo sapiens
atttgttgctgct

SEQ ID NO: 3001174 - DNA, 16 bp, Homo sapiens
atttgttgctgctgct

SEQ ID NO: 3001175 - DNA, 14 bp, Homo sapiens
atttgttgtcatgt

SEQ ID NO: 3001176 - DNA, 17 bp, Homo sapiens
atttgttgtcatgtgta

SEQ ID NO: 3001177 - DNA, 13 bp, Homo sapiens
atttgtttaaaag

SEQ ID NO: 3001178 - DNA, 14 bp, Homo sapiens
atttgtttaaaatt

SEQ ID NO: 3001179 - DNA, 15 bp, Homo sapiens
atttgtttaaaattc

SEQ ID NO: 3001180 - DNA, 16 bp, Homo sapiens
atttgtttaaaattct

SEQ ID NO: 3001181 - DNA, 20 bp, Homo sapiens
atttgtttaaaattctcttt

SEQ ID NO: 3001182 - DNA, 13 bp, Homo sapiens
atttgtttgtatt

SEQ ID NO: 3001183 - DNA, 16 bp, Homo sapiens
atttgtttgtattcat

SEQ ID NO: 3001184 - DNA, 19 bp, Homo sapiens
atttgtttgtattcatgtt

SEQ ID NO: 3001185 - DNA, 18 bp, Homo sapiens
atttgttttgaattttgt

SEQ ID NO: 3001186 - DNA, 15 bp, Homo sapiens
atttgtttttctcac

SEQ ID NO: 3001187 - DNA, 13 bp, Homo sapiens
attttaaaaatga

SEQ ID NO: 3001188 - DNA, 23 bp, Homo sapiens
attttaaaaatgtaaatgaattt

SEQ ID NO: 3001189 - DNA, 18 bp, Homo sapiens
attttaaaacatgctgtt

SEQ ID NO: 3001190 - DNA, 20 bp, Homo sapiens
attttaaaaggttgactcaa

SEQ ID NO: 3001191 - DNA, 13 bp, Homo sapiens
attttaaaatatt

SEQ ID NO: 3001192 - DNA, 20 bp, Homo sapiens
attttaaactagatgacctc

SEQ ID NO: 3001193 - DNA, 23 bp, Homo sapiens
attttaaactagatgacctcatt

SEQ ID NO: 3001194 - DNA, 18 bp, Homo sapiens
attttaaatattgtcatt

SEQ ID NO: 3001195 - DNA, 13 bp, Homo sapiens
attttaacaagaa

SEQ ID NO: 3001196 - DNA, 20 bp, Homo sapiens
attttaacaagaagatgaat

SEQ ID NO: 3001197 - DNA, 21 bp, Homo sapiens
attttaacaagaagatgaatg

SEQ ID NO: 3001198 - DNA, 22 bp, Homo sapiens
attttaacaagaagatgaatgg

SEQ ID NO: 3001199 - DNA, 18 bp, Homo sapiens
attttaacagtacctgtg

SEQ ID NO: 3001200 - DNA, 13 bp, Homo sapiens
attttaactctgt

SEQ ID NO: 3001201 - DNA, 15 bp, Homo sapiens
attttaactctgtct

SEQ ID NO: 3001202 - DNA, 19 bp, Homo sapiens
attttaagacgtgtttgtg

SEQ ID NO: 3001203 - DNA, 13 bp, Homo sapiens
attttaatagaaa

SEQ ID NO: 3001204 - DNA, 20 bp, Homo sapiens
attttaatagggaatatatc

SEQ ID NO: 3001205 - DNA, 23 bp, Homo sapiens
attttaatgaagaaagtggaaaa

SEQ ID NO: 3001206 - DNA, 19 bp, Homo sapiens
attttaatttagtaaatgt

SEQ ID NO: 3001207 - DNA, 17 bp, Homo sapiens
attttacaattgaaatg

SEQ ID NO: 3001208 - DNA, 14 bp, Homo sapiens
attttacacagaaa

SEQ ID NO: 3001209 - DNA, 22 bp, Homo sapiens
attttacacagaaacactgcct

SEQ ID NO: 3001210 - DNA, 22 bp, Homo sapiens
attttacacagcaattttgtat

SEQ ID NO: 3001211 - DNA, 23 bp, Homo sapiens
attttacacagcaattttgtatc

SEQ ID NO: 3001212 - DNA, 16 bp, Homo sapiens
attttacgttttagaa

SEQ ID NO: 3001213 - DNA, 21 bp, Homo sapiens
attttagaaataataaaaaga

SEQ ID NO: 3001214 - DNA, 19 bp, Homo sapiens
attttagaacaattttctt

SEQ ID NO: 3001215 - DNA, 18 bp, Homo sapiens
attttagagaaactttga

SEQ ID NO: 3001216 - DNA, 16 bp, Homo sapiens
attttagctgcagaac

SEQ ID NO: 3001217 - DNA, 21 bp, Homo sapiens
attttaggagctaaggctcta

SEQ ID NO: 3001218 - DNA, 17 bp, Homo sapiens
attttagtattaactct

SEQ ID NO: 3001219 - DNA, 17 bp, Homo sapiens
attttagtcaaatattt

SEQ ID NO: 3001220 - DNA, 14 bp, Homo sapiens
attttagtcacttt

SEQ ID NO: 3001221 - DNA, 15 bp, Homo sapiens
attttagtcactttt

SEQ ID NO: 3001222 - DNA, 15 bp, Homo sapiens
attttagtttctgtt

SEQ ID NO: 3001223 - DNA, 13 bp, Homo sapiens
attttataaacaa

SEQ ID NO: 3001224 - DNA, 18 bp, Homo sapiens
attttataaatttaagca

SEQ ID NO: 3001225 - DNA, 18 bp, Homo sapiens
attttatactgcacttta

SEQ ID NO: 3001226 - DNA, 14 bp, Homo sapiens
attttatattgaaa

SEQ ID NO: 3001227 - DNA, 15 bp, Homo sapiens
attttatattgaaaa

SEQ ID NO: 3001228 - DNA, 18 bp, Homo sapiens
attttatattttctattt

SEQ ID NO: 3001229 - DNA, 20 bp, Homo sapiens
attttatctacccagtcatg

SEQ ID NO: 3001230 - DNA, 22 bp, Homo sapiens
attttatctgtttcctgacatt

SEQ ID NO: 3001231 - DNA, 23 bp, Homo sapiens
attttatgacatgaaaagttatt

SEQ ID NO: 3001232 - DNA, 21 bp, Homo sapiens
attttatgagaaatgtaatgc

SEQ ID NO: 3001233 - DNA, 18 bp, Homo sapiens
attttatgatcagtgttg

SEQ ID NO: 3001234 - DNA, 13 bp, Homo sapiens
attttattgtata

SEQ ID NO: 3001235 - DNA, 15 bp, Homo sapiens
attttatttgaaaaa

SEQ ID NO: 3001236 - DNA, 16 bp, Homo sapiens
attttatttttgcaaa

SEQ ID NO: 3001237 - DNA, 17 bp, Homo sapiens
attttatttttgtatct

SEQ ID NO: 3001238 - DNA, 15 bp, Homo sapiens
attttcaaacaaaat

SEQ ID NO: 3001239 - DNA, 16 bp, Homo sapiens
attttcaacaattaga

SEQ ID NO: 3001240 - DNA, 15 bp, Homo sapiens
attttcaagtagctg

SEQ ID NO: 3001241 - DNA, 15 bp, Homo sapiens
attttcactgctgct

SEQ ID NO: 3001242 - DNA, 18 bp, Homo sapiens
attttcactgctgctcct

SEQ ID NO: 3001243 - DNA, 14 bp, Homo sapiens
attttcacttttaa

SEQ ID NO: 3001244 - DNA, 16 bp, Homo sapiens
attttcagcaaagaat

SEQ ID NO: 3001245 - DNA, 19 bp, Homo sapiens
attttcagcatcaaacatg

SEQ ID NO: 3001246 - DNA, 22 bp, Homo sapiens
attttcagttattatatttaca

SEQ ID NO: 3001247 - DNA, 22 bp, Homo sapiens
attttcataagtatttcaaatt

SEQ ID NO: 3001248 - DNA, 16 bp, Homo sapiens
attttcatattgtaat

SEQ ID NO: 3001249 - DNA, 18 bp, Homo sapiens
attttcatattgtaatct

SEQ ID NO: 3001250 - DNA, 11 bp, Homo sapiens
attttcatcta

SEQ ID NO: 3001251 - DNA, 15 bp, Homo sapiens
attttcattaaactt

SEQ ID NO: 3001252 - DNA, 15 bp, Homo sapiens
attttccaagtgtgc

SEQ ID NO: 3001253 - DNA, 20 bp, Homo sapiens
attttccacaagattcccag

SEQ ID NO: 3001254 - DNA, 15 bp, Homo sapiens
attttcccatcatcc

SEQ ID NO: 3001255 - DNA, 14 bp, Homo sapiens
atttatttttaata

SEQ ID NO: 3001256 - DNA, 14 bp, Homo sapiens
atttcaaaatgctt

SEQ ID NO: 3001257 - DNA, 16 bp, Homo sapiens
atttcaaaatgctttt

SEQ ID NO: 3001258 - DNA, 21 bp, Homo sapiens
atttcaaaatgctttttatta

SEQ ID NO: 3001259 - DNA, 14 bp, Homo sapiens
atttcaaacatttg

SEQ ID NO: 3001260 - DNA, 16 bp, Homo sapiens
atttcaaacatttgtc

SEQ ID NO: 3001261 - DNA, 18 bp, Homo sapiens
atttcaaagccctgcctc

SEQ ID NO: 3001262 - DNA, 22 bp, Homo sapiens
atttcaaagccctgcctctgtg

SEQ ID NO: 3001263 - DNA, 12 bp, Homo sapiens
atttcaaatcat

SEQ ID NO: 3001264 - DNA, 16 bp, Homo sapiens
atttcaagatccaaat

SEQ ID NO: 3001265 - DNA, 13 bp, Homo sapiens
atttcaaggttct

SEQ ID NO: 3001266 - DNA, 15 bp, Homo sapiens
atttcaataaatgat

SEQ ID NO: 3001267 - DNA, 17 bp, Homo sapiens
atttcaataaatgatat

SEQ ID NO: 3001268 - DNA, 10 bp, Homo sapiens
atttcacaag

SEQ ID NO: 3001269 - DNA, 20 bp, Homo sapiens
atttcacagatgctgtgtaa

SEQ ID NO: 3001270 - DNA, 16 bp, Homo sapiens
atttcacatgccttgc

SEQ ID NO: 3001271 - DNA, 11 bp, Homo sapiens
atttcacattg

SEQ ID NO: 3001272 - DNA, 18 bp, Homo sapiens
atttcagactcccattcc

SEQ ID NO: 3001273 - DNA, 15 bp, Homo sapiens
atttcagatgtaatg

SEQ ID NO: 3001274 - DNA, 20 bp, Homo sapiens
atttcagatgtaatgttttc

SEQ ID NO: 3001275 - DNA, 15 bp, Homo sapiens
atttcagccaaagtc

SEQ ID NO: 3001276 - DNA, 19 bp, Homo sapiens
atttcagccaatctggaca

SEQ ID NO: 3001277 - DNA, 13 bp, Homo sapiens
atttcaggaattt

SEQ ID NO: 3001278 - DNA, 14 bp, Homo sapiens
atttcaggaattta

SEQ ID NO: 3001279 - DNA, 15 bp, Homo sapiens
atttcaggccctcag

SEQ ID NO: 3001280 - DNA, 17 bp, Homo sapiens
atttcagggaaattaat

SEQ ID NO: 3001281 - DNA, 19 bp, Homo sapiens
atttcagtaagctgtgtgg

SEQ ID NO: 3001282 - DNA, 16 bp, Homo sapiens
atttcagtaatgtctt

SEQ ID NO: 3001283 - DNA, 17 bp, Homo sapiens
atttcagtaatgtcttc

SEQ ID NO: 3001284 - DNA, 12 bp, Homo sapiens
atttcagtgcca

SEQ ID NO: 3001285 - DNA, 24 bp, Homo sapiens
atttcagttctaaaaagatgtaat

SEQ ID NO: 3001286 - DNA, 18 bp, Homo sapiens
atttcatatctacagata

SEQ ID NO: 3001287 - DNA, 20 bp, Homo sapiens
atttcatatctacagataga

SEQ ID NO: 3001288 - DNA, 14 bp, Homo sapiens
atttccacaccaag

SEQ ID NO: 3001289 - DNA, 22 bp, Homo sapiens
atttccagaaggatttcttgta

SEQ ID NO: 3001290 - DNA, 20 bp, Homo sapiens
atttccatgtcccctcccag

SEQ ID NO: 3001291 - DNA, 15 bp, Homo sapiens
atttcccacatcttt

SEQ ID NO: 3001292 - DNA, 13 bp, Homo sapiens
atttcccaggacc

SEQ ID NO: 3001293 - DNA, 16 bp, Homo sapiens
atttccccaacagtgt

SEQ ID NO: 3001294 - DNA, 12 bp, Homo sapiens
atttccccagcc

SEQ ID NO: 3001295 - DNA, 14 bp, Homo sapiens
atttccccagccac

SEQ ID NO: 3001296 - DNA, 15 bp, Homo sapiens
atttccccagccaca

SEQ ID NO: 3001297 - DNA, 20 bp, Homo sapiens
atttccgtccccccccaggc

SEQ ID NO: 3001298 - DNA, 15 bp, Homo sapiens
atttccgttttgcct

SEQ ID NO: 3001299 - DNA, 22 bp, Homo sapiens
atttcctaatgagatatatctt

SEQ ID NO: 3001300 - DNA, 18 bp, Homo sapiens
atttcctatcacctattt

SEQ ID NO: 3001301 - DNA, 19 bp, Homo sapiens
atttcctcagcttatctct

SEQ ID NO: 3001302 - DNA, 20 bp, Homo sapiens
atttcctcctcccagtgcct

SEQ ID NO: 3001303 - DNA, 23 bp, Homo sapiens
atttcctcctcccagtgccttct

SEQ ID NO: 3001304 - DNA, 15 bp, Homo sapiens
atttcctggatgttt

SEQ ID NO: 3001305 - DNA, 21 bp, Homo sapiens
atttcctggtgtgaaggtcct

SEQ ID NO: 3001306 - DNA, 16 bp, Homo sapiens
atttcctgtgtcaatc

SEQ ID NO: 3001307 - DNA, 14 bp, Homo sapiens
atttccttgaatgt

SEQ ID NO: 3001308 - DNA, 23 bp, Homo sapiens
atttccttgaatgtggcttgaga

SEQ ID NO: 3001309 - DNA, 15 bp, Homo sapiens
atttcctttatactg

SEQ ID NO: 3001310 - DNA, 16 bp, Homo sapiens
atttcctttatactgt

SEQ ID NO: 3001311 - DNA, 14 bp, Homo sapiens
atttcgaagatata

SEQ ID NO: 3001312 - DNA, 21 bp, Homo sapiens
atttcgtttggtcttaggtct

SEQ ID NO: 3001313 - DNA, 15 bp, Homo sapiens
atttctaaataaaag

SEQ ID NO: 3001314 - DNA, 14 bp, Homo sapiens
atttctaaattaag

SEQ ID NO: 3001315 - DNA, 13 bp, Homo sapiens
atttctactgaag

SEQ ID NO: 3001316 - DNA, 18 bp, Homo sapiens
atttctactttgaagtca

SEQ ID NO: 3001317 - DNA, 15 bp, Homo sapiens
atttctaggaagaat

SEQ ID NO: 3001318 - DNA, 16 bp, Homo sapiens
atttctaggaagaatt

SEQ ID NO: 3001319 - DNA, 17 bp, Homo sapiens
atttctaggaagaattt

SEQ ID NO: 3001320 - DNA, 22 bp, Homo sapiens
atttctaggaagaattttaaaa

SEQ ID NO: 3001321 - DNA, 20 bp, Homo sapiens
atttctaggtaggaaatgtg

SEQ ID NO: 3001322 - DNA, 13 bp, Homo sapiens
atttctagttttt

SEQ ID NO: 3001323 - DNA, 21 bp, Homo sapiens
atttctataaatagatgctgt

SEQ ID NO: 3001324 - DNA, 22 bp, Homo sapiens
atttctatatagacttggagaa

SEQ ID NO: 3001325 - DNA, 19 bp, Homo sapiens
atttctatcttgttccaag

SEQ ID NO: 3001326 - DNA, 18 bp, Homo sapiens
atttctatttctcctcca

SEQ ID NO: 3001327 - DNA, 16 bp, Homo sapiens
atttctcagactttgg

SEQ ID NO: 3001328 - DNA, 17 bp, Homo sapiens
atttctccagaacccat

SEQ ID NO: 3001329 - DNA, 13 bp, Homo sapiens
atttctctgtgaa

SEQ ID NO: 3001330 - DNA, 15 bp, Homo sapiens
atttctctgtgaatc

SEQ ID NO: 3001331 - DNA, 16 bp, Homo sapiens
attgtaaggtctttgt

SEQ ID NO: 3001332 - DNA, 18 bp, Homo sapiens
attgtaaggtctttgtaa

SEQ ID NO: 3001333 - DNA, 12 bp, Homo sapiens
attgtaattttg

SEQ ID NO: 3001334 - DNA, 22 bp, Homo sapiens
attgtaattttgttcctgttta

SEQ ID NO: 3001335 - DNA, 12 bp, Homo sapiens
attgtacacttt

SEQ ID NO: 3001336 - DNA, 14 bp, Homo sapiens
attgtaccttttaa

SEQ ID NO: 3001337 - DNA, 17 bp, Homo sapiens
attgtaccttttaacac

SEQ ID NO: 3001338 - DNA, 17 bp, Homo sapiens
attgtacgtagccacag

SEQ ID NO: 3001339 - DNA, 15 bp, Homo sapiens
attgtactaaagcca

SEQ ID NO: 3001340 - DNA, 22 bp, Homo sapiens
attgtactcaatggatttgatg

SEQ ID NO: 3001341 - DNA, 16 bp, Homo sapiens
attgtagtcctgtaat

SEQ ID NO: 3001342 - DNA, 21 bp, Homo sapiens
attgtataaaaagtttcacag

SEQ ID NO: 3001343 - DNA, 14 bp, Homo sapiens
attgtataacaggt

SEQ ID NO: 3001344 - DNA, 15 bp, Homo sapiens
attgtataacaggtt

SEQ ID NO: 3001345 - DNA, 20 bp, Homo sapiens
attgtatattgattatagca

SEQ ID NO: 3001346 - DNA, 15 bp, Homo sapiens
attgtatcgatgtta

SEQ ID NO: 3001347 - DNA, 16 bp, Homo sapiens
attgtatcgtatagct

SEQ ID NO: 3001348 - DNA, 21 bp, Homo sapiens
attgtattagtattgtgaata

SEQ ID NO: 3001349 - DNA, 14 bp, Homo sapiens
attgtattgctgct

SEQ ID NO: 3001350 - DNA, 17 bp, Homo sapiens
attgtatttatgtatgt

SEQ ID NO: 3001351 - DNA, 15 bp, Homo sapiens
attgtatttgtttct

SEQ ID NO: 3001352 - DNA, 16 bp, Homo sapiens
attgtattttgatgag

SEQ ID NO: 3001353 - DNA, 14 bp, Homo sapiens
attgtcaaagagta

SEQ ID NO: 3001354 - DNA, 19 bp, Homo sapiens
attgtcacatcaagcatca

SEQ ID NO: 3001355 - DNA, 15 bp, Homo sapiens
attgtcagccacctc

SEQ ID NO: 3001356 - DNA, 20 bp, Homo sapiens
attgtcagccacctccctct

SEQ ID NO: 3001357 - DNA, 20 bp, Homo sapiens
attgtcatggggatcaattt

SEQ ID NO: 3001358 - DNA, 17 bp, Homo sapiens
attgtcattacaaatct

SEQ ID NO: 3001359 - DNA, 18 bp, Homo sapiens
attgtcattacaaatctt

SEQ ID NO: 3001360 - DNA, 23 bp, Homo sapiens
attgtccctctgccccatcctcc

SEQ ID NO: 3001361 - DNA, 22 bp, Homo sapiens
attgtcgtataggcatgtaaac

SEQ ID NO: 3001362 - DNA, 20 bp, Homo sapiens
attgtctcctatatatttct

SEQ ID NO: 3001363 - DNA, 23 bp, Homo sapiens
attgtctcctatatatttctatt

SEQ ID NO: 3001364 - DNA, 13 bp, Homo sapiens
attgtctgtaaaa

SEQ ID NO: 3001365 - DNA, 14 bp, Homo sapiens
attgtcttcatgta

SEQ ID NO: 3001366 - DNA, 18 bp, Homo sapiens
attgtcttcggaaacctt

SEQ ID NO: 3001367 - DNA, 20 bp, Homo sapiens
attgtcttcggaaaccttgg

SEQ ID NO: 3001368 - DNA, 21 bp, Homo sapiens
attgtgaccaatacatttgta

SEQ ID NO: 3001369 - DNA, 23 bp, Homo sapiens
attgtgaccaatacatttgtatt

SEQ ID NO: 3001370 - DNA, 12 bp, Homo sapiens
attgtgagaaat

SEQ ID NO: 3001371 - DNA, 17 bp, Homo sapiens
attgtgagatgatttgt

SEQ ID NO: 3001372 - DNA, 20 bp, Homo sapiens
attgtgagatgatttgtact

SEQ ID NO: 3001373 - DNA, 13 bp, Homo sapiens
attcttcagcttg

SEQ ID NO: 3001374 - DNA, 14 bp, Homo sapiens
attcttctagagtt

SEQ ID NO: 3001375 - DNA, 15 bp, Homo sapiens
attcttctgtgttta

SEQ ID NO: 3001376 - DNA, 19 bp, Homo sapiens
attcttctgtgtttataaa

SEQ ID NO: 3001377 - DNA, 16 bp, Homo sapiens
attcttgattgtttta

SEQ ID NO: 3001378 - DNA, 17 bp, Homo sapiens
attcttgccaaatataa

SEQ ID NO: 3001379 - DNA, 19 bp, Homo sapiens
attcttggcatctactctg

SEQ ID NO: 3001380 - DNA, 13 bp, Homo sapiens
attcttggttatt

SEQ ID NO: 3001381 - DNA, 14 bp, Homo sapiens
attcttgtgtctgt

SEQ ID NO: 3001382 - DNA, 19 bp, Homo sapiens
attctttcccaacacctct

SEQ ID NO: 3001383 - DNA, 21 bp, Homo sapiens
attctttcccaattcacatct

SEQ ID NO: 3001384 - DNA, 13 bp, Homo sapiens
attctttcttcct

SEQ ID NO: 3001385 - DNA, 19 bp, Homo sapiens
attctttcttcctccagtc

SEQ ID NO: 3001386 - DNA, 17 bp, Homo sapiens
attctttgatgttaaca

SEQ ID NO: 3001387 - DNA, 16 bp, Homo sapiens
attctttgcaatactg

SEQ ID NO: 3001388 - DNA, 17 bp, Homo sapiens
attctttgcaatactgc

SEQ ID NO: 3001389 - DNA, 18 bp, Homo sapiens
attcttttataataatga

SEQ ID NO: 3001390 - DNA, 21 bp, Homo sapiens
attcttttccagaaagaaaat

SEQ ID NO: 3001391 - DNA, 19 bp, Homo sapiens
attgaaaaaatagagcctg

SEQ ID NO: 3001392 - DNA, 23 bp, Homo sapiens
attgaaaagacgctaataaaaat

SEQ ID NO: 3001393 - DNA, 15 bp, Homo sapiens
attgaaattccagtt

SEQ ID NO: 3001394 - DNA, 21 bp, Homo sapiens
attgaaattccagttgcaatt

SEQ ID NO: 3001395 - DNA, 16 bp, Homo sapiens
attgaacattctagaa

SEQ ID NO: 3001396 - DNA, 20 bp, Homo sapiens
attgaagaggatattcttct

SEQ ID NO: 3001397 - DNA, 15 bp, Homo sapiens
attgaatacttacat

SEQ ID NO: 3001398 - DNA, 13 bp, Homo sapiens
attgaatcatgta

SEQ ID NO: 3001399 - DNA, 14 bp, Homo sapiens
attgaatcatgtag

SEQ ID NO: 3001400 - DNA, 21 bp, Homo sapiens
attgaatcatgtaggatcttg

SEQ ID NO: 3001401 - DNA, 10 bp, Homo sapiens
attgaatcta

SEQ ID NO: 3001402 - DNA, 23 bp, Homo sapiens
attgaattcttggttgaggaaac

SEQ ID NO: 3001403 - DNA, 19 bp, Homo sapiens
attgacaaccgagaaggtt

SEQ ID NO: 3001404 - DNA, 12 bp, Homo sapiens
attgacacagaa

SEQ ID NO: 3001405 - DNA, 22 bp, Homo sapiens
attccaagaatagcatctgtac

SEQ ID NO: 3001406 - DNA, 14 bp, Homo sapiens
attccaagacagta

SEQ ID NO: 3001407 - DNA, 17 bp, Homo sapiens
attccaagtgattgaaa

SEQ ID NO: 3001408 - DNA, 17 bp, Homo sapiens
attccaagtgtatttta

SEQ ID NO: 3001409 - DNA, 16 bp, Homo sapiens
attccaattaaattta

SEQ ID NO: 3001410 - DNA, 17 bp, Homo sapiens
attccacagatatcttt

SEQ ID NO: 3001411 - DNA, 12 bp, Homo sapiens
attccacaggac

SEQ ID NO: 3001412 - DNA, 18 bp, Homo sapiens
attccacaggacgaatgc

SEQ ID NO: 3001413 - DNA, 12 bp, Homo sapiens
attccacaggat

SEQ ID NO: 3001414 - DNA, 23 bp, Homo sapiens
attccagaatgctgtacatctat

SEQ ID NO: 3001415 - DNA, 12 bp, Homo sapiens
attccaggctcc

SEQ ID NO: 3001416 - DNA, 14 bp, Homo sapiens
attccagttgcaat

SEQ ID NO: 3001417 - DNA, 14 bp, Homo sapiens
attccatcaggcag

SEQ ID NO: 3001418 - DNA, 16 bp, Homo sapiens
attccatcctgtgtcc

SEQ ID NO: 3001419 - DNA, 15 bp, Homo sapiens
attccatgaatcgct

SEQ ID NO: 3001420 - DNA, 18 bp, Homo sapiens
attccatgaatcgcttct

SEQ ID NO: 3001421 - DNA, 21 bp, Homo sapiens
attccatgaatcgcttctctt

SEQ ID NO: 3001422 - DNA, 11 bp, Homo sapiens
attccatgttt

SEQ ID NO: 3001423 - DNA, 13 bp, Homo sapiens
attccatgtttta

SEQ ID NO: 3001424 - DNA, 17 bp, Homo sapiens
attccattggtccaaga

SEQ ID NO: 3001425 - DNA, 22 bp, Homo sapiens
attcccaagctctagtgggaag

SEQ ID NO: 3001426 - DNA, 19 bp, Homo sapiens
attcccagagacaggaaaa

SEQ ID NO: 3001427 - DNA, 22 bp, Homo sapiens
acctcctttcatcacactgggt

SEQ ID NO: 3001428 - DNA, 14 bp, Homo sapiens
acctcgctggactc

SEQ ID NO: 3001429 - DNA, 16 bp, Homo sapiens
acctcgctggactctc

SEQ ID NO: 3001430 - DNA, 18 bp, Homo sapiens
acctcggccctccctgcg

SEQ ID NO: 3001431 - DNA, 21 bp, Homo sapiens
acctcggccctccctgcgctt

SEQ ID NO: 3001432 - DNA, 14 bp, Homo sapiens
acctcggggtgggg

SEQ ID NO: 3001433 - DNA, 15 bp, Homo sapiens
acctcgtcctccccc

SEQ ID NO: 3001434 - DNA, 21 bp, Homo sapiens
acctcgtcctccccctgccag

SEQ ID NO: 3001435 - DNA, 16 bp, Homo sapiens
acctctagagaaaaga

SEQ ID NO: 3001436 - DNA, 22 bp, Homo sapiens
acctctccagctctggcttcct

SEQ ID NO: 3001437 - DNA, 23 bp, Homo sapiens
acctctccatcttcagcttcttc

SEQ ID NO: 3001438 - DNA, 11 bp, Homo sapiens
acctctcccac

SEQ ID NO: 3001439 - DNA, 12 bp, Homo sapiens
acctctcccacg

SEQ ID NO: 3001440 - DNA, 23 bp, Homo sapiens
acctctccctgaccctgtatata

SEQ ID NO: 3001441 - DNA, 22 bp, Homo sapiens
acctctctcagccccatcgccc

SEQ ID NO: 3001442 - DNA, 18 bp, Homo sapiens
acctctctcggccccctc

SEQ ID NO: 3001443 - DNA, 20 bp, Homo sapiens
acctctctgtagtttatggc

SEQ ID NO: 3001444 - DNA, 14 bp, Homo sapiens
acctctctgtcttt

SEQ ID NO: 3001445 - DNA, 22 bp, Homo sapiens
acctctcttttcctctctgtct

SEQ ID NO: 3001446 - DNA, 14 bp, Homo sapiens
acctctctttttca

SEQ ID NO: 3001447 - DNA, 15 bp, Homo sapiens
acctctgcttcccag

SEQ ID NO: 3001448 - DNA, 16 bp, Homo sapiens
acctctgtgcctctgt

SEQ ID NO: 3001449 - DNA, 15 bp, Homo sapiens
acctcttcagaggcc

SEQ ID NO: 3001450 - DNA, 16 bp, Homo sapiens
acctcttctggctcaa

SEQ ID NO: 3001451 - DNA, 19 bp, Homo sapiens
acctgaaaacactgtgcac

SEQ ID NO: 3001452 - DNA, 13 bp, Homo sapiens
acctgaaagcctg

SEQ ID NO: 3001453 - DNA, 14 bp, Homo sapiens
acctgaaagcctgt

SEQ ID NO: 3001454 - DNA, 15 bp, Homo sapiens
acctgaaagcctgtc

SEQ ID NO: 3001455 - DNA, 16 bp, Homo sapiens
acctgaaccccagagg

SEQ ID NO: 3001456 - DNA, 19 bp, Homo sapiens
acctgaaccccagaggcag

SEQ ID NO: 3001457 - DNA, 13 bp, Homo sapiens
acctgaagttcac

SEQ ID NO: 3001458 - DNA, 20 bp, Homo sapiens
acctgaatttgtatatgact

SEQ ID NO: 3001459 - DNA, 22 bp, Homo sapiens
acctgaatttgtatatgactgc

SEQ ID NO: 3001460 - DNA, 17 bp, Homo sapiens
acctgaccaacatggag

SEQ ID NO: 3001461 - DNA, 20 bp, Homo sapiens
acctgactaggttctgtaga

SEQ ID NO: 3001462 - DNA, 14 bp, Homo sapiens
acctgagcattcag

SEQ ID NO: 3001463 - DNA, 22 bp, Homo sapiens
acctgaggtcgggagttggaga

SEQ ID NO: 3001464 - DNA, 23 bp, Homo sapiens
acctgaggtcgggagttggagac

SEQ ID NO: 3001465 - DNA, 14 bp, Homo sapiens
acctgatcaatgac

SEQ ID NO: 3001466 - DNA, 20 bp, Homo sapiens
acctgatcctggaggcccag

SEQ ID NO: 3001467 - DNA, 21 bp, Homo sapiens
acctgatgtcagctgctgttg

SEQ ID NO: 3001468 - DNA, 22 bp, Homo sapiens
acctgatgtcagctgctgttga

SEQ ID NO: 3001469 - DNA, 22 bp, Homo sapiens
acctgatgtgtacatcccatgt

SEQ ID NO: 3001470 - DNA, 18 bp, Homo sapiens
acctgatttattgaaatt

SEQ ID NO: 3001471 - DNA, 13 bp, Homo sapiens
acctgcaaaaaat

SEQ ID NO: 3001472 - DNA, 17 bp, Homo sapiens
acctgcaatcccagcta

SEQ ID NO: 3001473 - DNA, 14 bp, Homo sapiens
acctgcacctcccc

SEQ ID NO: 3001474 - DNA, 15 bp, Homo sapiens
acctgcacctccccc

SEQ ID NO: 3001475 - DNA, 18 bp, Homo sapiens
acctgcacttcatatcta

SEQ ID NO: 3001476 - DNA, 11 bp, Homo sapiens
acctgcagtgc

SEQ ID NO: 3001477 - DNA, 16 bp, Homo sapiens
acctgcagtgccagct

SEQ ID NO: 3001478 - DNA, 22 bp, Homo sapiens
acctgcatccgtagttccctga

SEQ ID NO: 3001479 - DNA, 17 bp, Homo sapiens
acctgccccaactctcc

SEQ ID NO: 3001480 - DNA, 16 bp, Homo sapiens
acctgcccccaatcca

SEQ ID NO: 3001481 - DNA, 13 bp, Homo sapiens
acctgccgacctc

SEQ ID NO: 3001482 - DNA, 17 bp, Homo sapiens
acctgccgacctcgtcc

SEQ ID NO: 3001483 - DNA, 22 bp, Homo sapiens
attatcatgtgtaatcaataaa

SEQ ID NO: 3001484 - DNA, 17 bp, Homo sapiens
attatccaggtaatcca

SEQ ID NO: 3001485 - DNA, 14 bp, Homo sapiens
attatccatattga

SEQ ID NO: 3001486 - DNA, 18 bp, Homo sapiens
attatcctcctgttctga

SEQ ID NO: 3001487 - DNA, 19 bp, Homo sapiens
attatctatttgtgtgtgt

SEQ ID NO: 3001488 - DNA, 22 bp, Homo sapiens
attatctttagttgaattccaa

SEQ ID NO: 3001489 - DNA, 15 bp, Homo sapiens
attatgactaaagta

SEQ ID NO: 3001490 - DNA, 20 bp, Homo sapiens
attatgcggaaaggtatttg

SEQ ID NO: 3001491 - DNA, 22 bp, Homo sapiens
attatggacatcgatatgaaaa

SEQ ID NO: 3001492 - DNA, 17 bp, Homo sapiens
attatgggaatcaagat

SEQ ID NO: 3001493 - DNA, 18 bp, Homo sapiens
attatgggaatcaagatt

SEQ ID NO: 3001494 - DNA, 17 bp, Homo sapiens
attatgtaaataactct

SEQ ID NO: 3001495 - DNA, 17 bp, Homo sapiens
acaacctactctgcaaa

SEQ ID NO: 3001496 - DNA, 12 bp, Homo sapiens
acaaccttcagc

SEQ ID NO: 3001497 - DNA, 18 bp, Homo sapiens
acaaccttcagctttatt

SEQ ID NO: 3001498 - DNA, 15 bp, Homo sapiens
acaacgaggaagccc

SEQ ID NO: 3001499 - DNA, 22 bp, Homo sapiens
acaactaagtgatttgtatgtc

SEQ ID NO: 3001500 - DNA, 17 bp, Homo sapiens
acaactatggatcagaa

SEQ ID NO: 3001501 - DNA, 19 bp, Homo sapiens
acaactatttcggcctttt

SEQ ID NO: 3001502 - DNA, 15 bp, Homo sapiens
acaactattttcaga

SEQ ID NO: 3001503 - DNA, 19 bp, Homo sapiens
acaactcagaatgggggct

SEQ ID NO: 3001504 - DNA, 17 bp, Homo sapiens
acaactcagtttcatat

SEQ ID NO: 3001505 - DNA, 22 bp, Homo sapiens
acaactgcctcgaaacacagaa

SEQ ID NO: 3001506 - DNA, 20 bp, Homo sapiens
acaactggatgcatcaagaa

SEQ ID NO: 3001507 - DNA, 16 bp, Homo sapiens
acaacttatttaaaaa

SEQ ID NO: 3001508 - DNA, 18 bp, Homo sapiens
acaacttatttaaaaata

SEQ ID NO: 3001509 - DNA, 20 bp, Homo sapiens
acaacttatttaaaaatatt

SEQ ID NO: 3001510 - DNA, 21 bp, Homo sapiens
acaacttatttaaaaatattt

SEQ ID NO: 3001511 - DNA, 23 bp, Homo sapiens
acaacttatttaaaaatatttca

SEQ ID NO: 3001512 - DNA, 17 bp, Homo sapiens
acaacttcaagtgcatg

SEQ ID NO: 3001513 - DNA, 19 bp, Homo sapiens
acaactttatgtagagaaa

SEQ ID NO: 3001514 - DNA, 22 bp, Homo sapiens
acaactttatgtagagaaaagg

SEQ ID NO: 3001515 - DNA, 22 bp, Homo sapiens
acaagaaaccaagtgggctggt

SEQ ID NO: 3001516 - DNA, 18 bp, Homo sapiens
acaagaaactttggaagc

SEQ ID NO: 3001517 - DNA, 13 bp, Homo sapiens
acaagaagatgaa

SEQ ID NO: 3001518 - DNA, 18 bp, Homo sapiens
acaagacccaagtagctg

SEQ ID NO: 3001519 - DNA, 16 bp, Homo sapiens
acaagaccctctcagg

SEQ ID NO: 3001520 - DNA, 23 bp, Homo sapiens
acaagactgcctccctctcttcc

SEQ ID NO: 3001521 - DNA, 20 bp, Homo sapiens
acaagagcaaaactccgtct

SEQ ID NO: 3001522 - DNA, 13 bp, Homo sapiens
acaagatgggaca

SEQ ID NO: 3001523 - DNA, 17 bp, Homo sapiens
acaagattcccagagac

SEQ ID NO: 3001524 - DNA, 20 bp, Homo sapiens
acaagcacaccacaattctc

SEQ ID NO: 3001525 - DNA, 22 bp, Homo sapiens
acaagccagaacttgaccctga

SEQ ID NO: 3001526 - DNA, 14 bp, Homo sapiens
acaagctcttgttt

SEQ ID NO: 3001527 - DNA, 17 bp, Homo sapiens
acaagctcttgtttctg

SEQ ID NO: 3001528 - DNA, 19 bp, Homo sapiens
acaagctcttgtttctgtt

SEQ ID NO: 3001529 - DNA, 24 bp, Homo sapiens
acaagctgcctctgacagcagcct

SEQ ID NO: 3001530 - DNA, 18 bp, Homo sapiens
acaagcttcaaagccata

SEQ ID NO: 3001531 - DNA, 15 bp, Homo sapiens
acaaggacttcctgt

SEQ ID NO: 3001532 - DNA, 22 bp, Homo sapiens
acaaggcaggaggagctgataa

SEQ ID NO: 3001533 - DNA, 13 bp, Homo sapiens
acaaggcaggcct

SEQ ID NO: 3001534 - DNA, 19 bp, Homo sapiens
acaaggcaggcctttccta

SEQ ID NO: 3001535 - DNA, 14 bp, Homo sapiens
acaaggcctggtct

SEQ ID NO: 3001536 - DNA, 15 bp, Homo sapiens
acaagggaggcagtg

SEQ ID NO: 3001537 - DNA, 17 bp, Homo sapiens
acaagggtctagggaga

SEQ ID NO: 3001538 - DNA, 15 bp, Homo sapiens
acaaggtcatggcca

SEQ ID NO: 3001539 - DNA, 17 bp, Homo sapiens
acaaggtcatggccaca

SEQ ID NO: 3001540 - DNA, 20 bp, Homo sapiens
acaaggtcatggccacactg

SEQ ID NO: 3001541 - DNA, 21 bp, Homo sapiens
acaaggtcatggccacactgt

SEQ ID NO: 3001542 - DNA, 23 bp, Homo sapiens
acaaggtcatggccacactgtga

SEQ ID NO: 3001543 - DNA, 19 bp, Homo sapiens
acaagtatatacttttaaa

SEQ ID NO: 3001544 - DNA, 22 bp, Homo sapiens
acaagtatatacttttaaatta

SEQ ID NO: 3001545 - DNA, 15 bp, Homo sapiens
acaagtattttatat

SEQ ID NO: 3001546 - DNA, 18 bp, Homo sapiens
acaagtggactcagggca

SEQ ID NO: 3001547 - DNA, 19 bp, Homo sapiens
acaagtggactcagggcag

SEQ ID NO: 3001548 - DNA, 16 bp, Homo sapiens
acaagttatttaaatc

SEQ ID NO: 3001549 - DNA, 17 bp, Homo sapiens
acaagttctttttaaaa

SEQ ID NO: 3001550 - DNA, 21 bp, Homo sapiens
acaataaaattttttttcatg

SEQ ID NO: 3001551 - DNA, 13 bp, Homo sapiens
acaataaagactg

SEQ ID NO: 3001552 - DNA, 21 bp, Homo sapiens
acaataagagtctccttctct

SEQ ID NO: 3001553 - DNA, 22 bp, Homo sapiens
acaataagagtctccttctctt

SEQ ID NO: 3001554 - DNA, 23 bp, Homo sapiens
acaataagagtctccttctcttc

SEQ ID NO: 3001555 - DNA, 10 bp, Homo sapiens
acaataataa

SEQ ID NO: 3001556 - DNA, 12 bp, Homo sapiens
acaataatttta

SEQ ID NO: 3001557 - DNA, 20 bp, Homo sapiens
acacaatgacacatttgttg

SEQ ID NO: 3001558 - DNA, 22 bp, Homo sapiens
acacaatgacacatttgttgca

SEQ ID NO: 3001559 - DNA, 23 bp, Homo sapiens
acacaatgacacatttgttgcac

SEQ ID NO: 3001560 - DNA, 22 bp, Homo sapiens
acacaatgttgcactgaaaacc

SEQ ID NO: 3001561 - DNA, 23 bp, Homo sapiens
acacaatttaattcctcttttta

SEQ ID NO: 3001562 - DNA, 19 bp, Homo sapiens
acacacaaaaaggagcggg

SEQ ID NO: 3001563 - DNA, 14 bp, Homo sapiens
acacacaacagcca

SEQ ID NO: 3001564 - DNA, 14 bp, Homo sapiens
acacacaagtaaga

SEQ ID NO: 3001565 - DNA, 15 bp, Homo sapiens
acacacacacacaag

SEQ ID NO: 3001566 - DNA, 16 bp, Homo sapiens
acacacacacacagcc

SEQ ID NO: 3001567 - DNA, 14 bp, Homo sapiens
acacacacacacat

SEQ ID NO: 3001568 - DNA, 12 bp, Homo sapiens
acacacacacag

SEQ ID NO: 3001569 - DNA, 14 bp, Homo sapiens
acacacacacagcc

SEQ ID NO: 3001570 - DNA, 15 bp, Homo sapiens
acacacacagaaaat

SEQ ID NO: 3001571 - DNA, 16 bp, Homo sapiens
acacacacagccacac

SEQ ID NO: 3001572 - DNA, 11 bp, Homo sapiens
acacacacatg

SEQ ID NO: 3001573 - DNA, 17 bp, Homo sapiens
acacacagaaaatatac

SEQ ID NO: 3001574 - DNA, 19 bp, Homo sapiens
acacacagaaaatatactg

SEQ ID NO: 3001575 - DNA, 11 bp, Homo sapiens
acacacagcca

SEQ ID NO: 3001576 - DNA, 12 bp, Homo sapiens
acacacagccac

SEQ ID NO: 3001577 - DNA, 17 bp, Homo sapiens
acacacagccacacaca

SEQ ID NO: 3001578 - DNA, 14 bp, Homo sapiens
acacacatgcatac

SEQ ID NO: 3001579 - DNA, 18 bp, Homo sapiens
acacacatgcatacacac

SEQ ID NO: 3001580 - DNA, 14 bp, Homo sapiens
acacaccagtttac

SEQ ID NO: 3001581 - DNA, 17 bp, Homo sapiens
acacaccagtttacagg

SEQ ID NO: 3001582 - DNA, 21 bp, Homo sapiens
acacacctaagggacatgttt

SEQ ID NO: 3001583 - DNA, 12 bp, Homo sapiens
acacacctctgc

SEQ ID NO: 3001584 - DNA, 18 bp, Homo sapiens
acacactacaccacacac

SEQ ID NO: 3001585 - DNA, 16 bp, Homo sapiens
acacactccttcccct

SEQ ID NO: 3001586 - DNA, 16 bp, Homo sapiens
acacactgaggcaggg

SEQ ID NO: 3001587 - DNA, 19 bp, Homo sapiens
acacactgtcatgcttcat

SEQ ID NO: 3001588 - DNA, 17 bp, Homo sapiens
acacagaaaaaggatgt

SEQ ID NO: 3001589 - DNA, 11 bp, Homo sapiens
acacagaaaat

SEQ ID NO: 3001590 - DNA, 14 bp, Homo sapiens
acacagaaaatata

SEQ ID NO: 3001591 - DNA, 16 bp, Homo sapiens
acacagaaaatatact

SEQ ID NO: 3001592 - DNA, 22 bp, Homo sapiens
acacagaaaatatactgtaaag

SEQ ID NO: 3001593 - DNA, 23 bp, Homo sapiens
acacagaaaatatactgtaaaga

SEQ ID NO: 3001594 - DNA, 18 bp, Homo sapiens
acacagaaaatgttgaga

SEQ ID NO: 3001595 - DNA, 19 bp, Homo sapiens
acacagaaaatgttgagaa

SEQ ID NO: 3001596 - DNA, 12 bp, Homo sapiens
acacagaaacac

SEQ ID NO: 3001597 - DNA, 14 bp, Homo sapiens
acacagaaacactg

SEQ ID NO: 3001598 - DNA, 16 bp, Homo sapiens
acacagaaacactgcc

SEQ ID NO: 3001599 - DNA, 21 bp, Homo sapiens
acacagaaacactgccttttt

SEQ ID NO: 3001600 - DNA, 13 bp, Homo sapiens
acacagaaacctt

SEQ ID NO: 3001601 - DNA, 23 bp, Homo sapiens
acacagacattctgccaggcccc

SEQ ID NO: 3001602 - DNA, 15 bp, Homo sapiens
acacagagtgtgttt

SEQ ID NO: 3001603 - DNA, 16 bp, Homo sapiens
acacagagtgtgtttt

SEQ ID NO: 3001604 - DNA, 16 bp, Homo sapiens
acacagcaattttgta

SEQ ID NO: 3001605 - DNA, 15 bp, Homo sapiens
acacagcagacctag

SEQ ID NO: 3001606 - DNA, 23 bp, Homo sapiens
acacagccacacacacagaaaat

SEQ ID NO: 3001607 - DNA, 13 bp, Homo sapiens
acacaggccctcc

SEQ ID NO: 3001608 - DNA, 16 bp, Homo sapiens
acacaggccctccctg

SEQ ID NO: 3001609 - DNA, 17 bp, Homo sapiens
acacaggtggtgtcact

SEQ ID NO: 3001610 - DNA, 19 bp, Homo sapiens
acacaggtggtgtcactgt

SEQ ID NO: 3001611 - DNA, 22 bp, Homo sapiens
acacaggtggtgtcactgtccc

SEQ ID NO: 3001612 - DNA, 14 bp, Homo sapiens
acacataaattatg

SEQ ID NO: 3001613 - DNA, 15 bp, Homo sapiens
acacataccctcttc

SEQ ID NO: 3001614 - DNA, 21 bp, Homo sapiens
aatgatattgctctatatgta

SEQ ID NO: 3001615 - DNA, 20 bp, Homo sapiens
aatgatccccaagtgtgaac

SEQ ID NO: 3001616 - DNA, 22 bp, Homo sapiens
aatgatcctcagtgcaaaatgt

SEQ ID NO: 3001617 - DNA, 21 bp, Homo sapiens
aatgatcctgtattcagacag

SEQ ID NO: 3001618 - DNA, 20 bp, Homo sapiens
aatgatctggtggttattta

SEQ ID NO: 3001619 - DNA, 17 bp, Homo sapiens
aatgatgaggatctgaa

SEQ ID NO: 3001620 - DNA, 21 bp, Homo sapiens
aatgatgatcaattatagttt

SEQ ID NO: 3001621 - DNA, 21 bp, Homo sapiens
aatgatgatgtggaagaactt

SEQ ID NO: 3001622 - DNA, 14 bp, Homo sapiens
aatgatgcaaccaa

SEQ ID NO: 3001623 - DNA, 22 bp, Homo sapiens
aatgatgcaaccaaaagggaaa

SEQ ID NO: 3001624 - DNA, 21 bp, Homo sapiens
aatgatggcagtggtttgaaa

SEQ ID NO: 3001625 - DNA, 12 bp, Homo sapiens
aatgatgttata

SEQ ID NO: 3001626 - DNA, 22 bp, Homo sapiens
aatgatgttatcttaacactga

SEQ ID NO: 3001627 - DNA, 23 bp, Homo sapiens
aatgatgttatcttaacactgaa

SEQ ID NO: 3001628 - DNA, 14 bp, Homo sapiens
aatgatgttgataa

SEQ ID NO: 3001629 - DNA, 17 bp, Homo sapiens
aatgattaatcagctgt

SEQ ID NO: 3001630 - DNA, 18 bp, Homo sapiens
aatgatttccaaagagaa

SEQ ID NO: 3001631 - DNA, 17 bp, Homo sapiens
aatgatttttgtgtatc

SEQ ID NO: 3001632 - DNA, 15 bp, Homo sapiens
aatgcaaaaaagaaa

SEQ ID NO: 3001633 - DNA, 21 bp, Homo sapiens
aatgcaaactgggatgaaact

SEQ ID NO: 3001634 - DNA, 16 bp, Homo sapiens
aatgcaatagaagtgc

SEQ ID NO: 3001635 - DNA, 21 bp, Homo sapiens
aatgcaatgtaagcatacttt

SEQ ID NO: 3001636 - DNA, 13 bp, Homo sapiens
aatgcacagggca

SEQ ID NO: 3001637 - DNA, 22 bp, Homo sapiens
aatgcactttctatcctctgta

SEQ ID NO: 3001638 - DNA, 18 bp, Homo sapiens
aatgcagaagtattcttt

SEQ ID NO: 3001639 - DNA, 23 bp, Homo sapiens
aatgcagcactgctgcctcagct

SEQ ID NO: 3001640 - DNA, 17 bp, Homo sapiens
aatgcagcccatttctc

SEQ ID NO: 3001641 - DNA, 20 bp, Homo sapiens
aatgcagcccatttctccag

SEQ ID NO: 3001642 - DNA, 15 bp, Homo sapiens
aatgcagtatggtac

SEQ ID NO: 3001643 - DNA, 19 bp, Homo sapiens
aatgcagtatggtacattt

SEQ ID NO: 3001644 - DNA, 19 bp, Homo sapiens
aatgcagtctgtccaggct

SEQ ID NO: 3001645 - DNA, 22 bp, Homo sapiens
aatgcagttgtggtgtgccatg

SEQ ID NO: 3001646 - DNA, 18 bp, Homo sapiens
aatgcatattcaacacac

SEQ ID NO: 3001647 - DNA, 19 bp, Homo sapiens
aatgcatccattcctcagg

SEQ ID NO: 3001648 - DNA, 16 bp, Homo sapiens
aatgcattgatattgt

SEQ ID NO: 3001649 - DNA, 12 bp, Homo sapiens
aatgcattgtat

SEQ ID NO: 3001650 - DNA, 18 bp, Homo sapiens
aatgcattgtatcgatgt

SEQ ID NO: 3001651 - DNA, 22 bp, Homo sapiens
aatgcattgtatcgatgttatg

SEQ ID NO: 3001652 - DNA, 11 bp, Homo sapiens
aatgccaaaac

SEQ ID NO: 3001653 - DNA, 15 bp, Homo sapiens
aatgccaaagccatt

SEQ ID NO: 3001654 - DNA, 19 bp, Homo sapiens
aatgccaactgttggaatt

SEQ ID NO: 3001655 - DNA, 19 bp, Homo sapiens
aatgccaagcacttctttt

SEQ ID NO: 3001656 - DNA, 17 bp, Homo sapiens
aatgccaagtgcctgct

SEQ ID NO: 3001657 - DNA, 19 bp, Homo sapiens
aatgccacacattgtgctt

SEQ ID NO: 3001658 - DNA, 13 bp, Homo sapiens
aatgccataatac

SEQ ID NO: 3001659 - DNA, 16 bp, Homo sapiens
aatgccataatacaaa

SEQ ID NO: 3001660 - DNA, 13 bp, Homo sapiens
aatgccattgtgc

SEQ ID NO: 3001661 - DNA, 16 bp, Homo sapiens
aatgcccagccagcca

SEQ ID NO: 3001662 - DNA, 13 bp, Homo sapiens
aatgcccagttca

SEQ ID NO: 3001663 - DNA, 15 bp, Homo sapiens
aatgcccccagctgg

SEQ ID NO: 3001664 - DNA, 19 bp, Homo sapiens
aatgcccctgttcatgttt

SEQ ID NO: 3001665 - DNA, 22 bp, Homo sapiens
aatgcctataactttttttcaa

SEQ ID NO: 3001666 - DNA, 16 bp, Homo sapiens
aatgcctcataaatta

SEQ ID NO: 3001667 - DNA, 18 bp, Homo sapiens
aatgcctcataaattaat

SEQ ID NO: 3001668 - DNA, 17 bp, Homo sapiens
aatgcctttttgtttac

SEQ ID NO: 3001669 - DNA, 22 bp, Homo sapiens
aatgcgattttattactggcgt

SEQ ID NO: 3001670 - DNA, 16 bp, Homo sapiens
aatgcgtatttgcatt

SEQ ID NO: 3001671 - DNA, 15 bp, Homo sapiens
aatgctaaatgtgta

SEQ ID NO: 3001672 - DNA, 23 bp, Homo sapiens
aatgctacgtgtgatttttctgg

SEQ ID NO: 3001673 - DNA, 16 bp, Homo sapiens
aatgctattatactgt

SEQ ID NO: 3001674 - DNA, 22 bp, Homo sapiens
aatgctattatactgttatcca

SEQ ID NO: 3001675 - DNA, 23 bp, Homo sapiens
aatgctattatactgttatccat

SEQ ID NO: 3001676 - DNA, 17 bp, Homo sapiens
aatgctcccacctgaat

SEQ ID NO: 3001677 - DNA, 21 bp, Homo sapiens
aatgctcccacctgaatttgt

SEQ ID NO: 3001678 - DNA, 12 bp, Homo sapiens
aatgctctgaaa

SEQ ID NO: 3001679 - DNA, 23 bp, Homo sapiens
aatgctctgaaaggatgtagaaa

SEQ ID NO: 3001680 - DNA, 14 bp, Homo sapiens
aatgctgatattta

SEQ ID NO: 3001681 - DNA, 21 bp, Homo sapiens
aatgctgcccagggtcagtgt

SEQ ID NO: 3001682 - DNA, 16 bp, Homo sapiens
aatgctgcctgccttt

SEQ ID NO: 3001683 - DNA, 18 bp, Homo sapiens
aatgctggagaaaaatga

SEQ ID NO: 3001684 - DNA, 12 bp, Homo sapiens
aatgcttaagag

SEQ ID NO: 3001685 - DNA, 14 bp, Homo sapiens
aatgcttatggaaa

SEQ ID NO: 3001686 - DNA, 13 bp, Homo sapiens
aatgcttctgatt

SEQ ID NO: 3001687 - DNA, 18 bp, Homo sapiens
aatgcttgccaagaaatc

SEQ ID NO: 3001688 - DNA, 18 bp, Homo sapiens
aatgctttgatatttcaa

SEQ ID NO: 3001689 - DNA, 18 bp, Homo sapiens
aatggaaaaaaaaaaaag

SEQ ID NO: 3001690 - DNA, 17 bp, Homo sapiens
aatggaaaccacaactt

SEQ ID NO: 3001691 - DNA, 19 bp, Homo sapiens
aatggaaaccacaactttt

SEQ ID NO: 3001692 - DNA, 15 bp, Homo sapiens
aatggaaattttgct

SEQ ID NO: 3001693 - DNA, 17 bp, Homo sapiens
aatggaaccaggcttgg

SEQ ID NO: 3001694 - DNA, 13 bp, Homo sapiens
aatggaagaaacc

SEQ ID NO: 3001695 - DNA, 22 bp, Homo sapiens
aatggaagcctgaactgaggcc

SEQ ID NO: 3001696 - DNA, 15 bp, Homo sapiens
aatggaattactcca

SEQ ID NO: 3001697 - DNA, 16 bp, Homo sapiens
aatggacaaagaaaac

SEQ ID NO: 3001698 - DNA, 17 bp, Homo sapiens
aatggactcagctctgt

SEQ ID NO: 3001699 - DNA, 17 bp, Homo sapiens
aatggagctttctgtat

SEQ ID NO: 3001700 - DNA, 22 bp, Homo sapiens
aatggagtcatttgagtctctt

SEQ ID NO: 3001701 - DNA, 22 bp, Homo sapiens
aatggctttgtcttgaaaaaaa

SEQ ID NO: 3001702 - DNA, 15 bp, Homo sapiens
aatgggaacatttat

SEQ ID NO: 3001703 - DNA, 17 bp, Homo sapiens
aatgggacttcttttca

SEQ ID NO: 3001704 - DNA, 18 bp, Homo sapiens
aatgggacttcttttcac

SEQ ID NO: 3001705 - DNA, 20 bp, Homo sapiens
aatgggacttcttttcacat

SEQ ID NO: 3001706 - DNA, 18 bp, Homo sapiens
aatgggagacagcctctt

SEQ ID NO: 3001707 - DNA, 23 bp, Homo sapiens
aatgtcaccaccttcccagctct

SEQ ID NO: 3001708 - DNA, 15 bp, Homo sapiens
aatgtcagatacaat

SEQ ID NO: 3001709 - DNA, 18 bp, Homo sapiens
aatgtcagatacaatgta

SEQ ID NO: 3001710 - DNA, 12 bp, Homo sapiens
aatgtcagtgtt

SEQ ID NO: 3001711 - DNA, 13 bp, Homo sapiens
aatgtccaaaatt

SEQ ID NO: 3001712 - DNA, 16 bp, Homo sapiens
aatgtctattattatg

SEQ ID NO: 3001713 - DNA, 20 bp, Homo sapiens
aatgtcttgatgcatgcact

SEQ ID NO: 3001714 - DNA, 19 bp, Homo sapiens
aatgtcttgctgttgacat

SEQ ID NO: 3001715 - DNA, 23 bp, Homo sapiens
aatgtcttgctgttgacatattt

SEQ ID NO: 3001716 - DNA, 21 bp, Homo sapiens
aatgtcttgtgtatttctctg

SEQ ID NO: 3001717 - DNA, 22 bp, Homo sapiens
aatgtcttgtgtatttctctgt

SEQ ID NO: 3001718 - DNA, 24 bp, Homo sapiens
aatgtcttgtgtatttctctgtga

SEQ ID NO: 3001719 - DNA, 16 bp, Homo sapiens
aatgtgaaagattatt

SEQ ID NO: 3001720 - DNA, 18 bp, Homo sapiens
aatgtgaaagattattta

SEQ ID NO: 3001721 - DNA, 19 bp, Homo sapiens
aatgtgaaatttttccaca

SEQ ID NO: 3001722 - DNA, 15 bp, Homo sapiens
aatgtgaactctccc

SEQ ID NO: 3001723 - DNA, 21 bp, Homo sapiens
aatgtgaactctcccctcccc

SEQ ID NO: 3001724 - DNA, 16 bp, Homo sapiens
aatgtgaagatgcatt

SEQ ID NO: 3001725 - DNA, 22 bp, Homo sapiens
aatgtgaagatgcattgtagtt

SEQ ID NO: 3001726 - DNA, 20 bp, Homo sapiens
aatgtgacatgttgctcttt

SEQ ID NO: 3001727 - DNA, 12 bp, Homo sapiens
aatgtgacattt

SEQ ID NO: 3001728 - DNA, 18 bp, Homo sapiens
aatgtgatcatctttgct

SEQ ID NO: 3001729 - DNA, 19 bp, Homo sapiens
aatgtgatgttctaaggct

SEQ ID NO: 3001730 - DNA, 23 bp, Homo sapiens
aatgtgattttgtaggttatttt

SEQ ID NO: 3001731 - DNA, 22 bp, Homo sapiens
aatgtggtctgccaatctgtac

SEQ ID NO: 3001732 - DNA, 19 bp, Homo sapiens
aatgtgtatggtatcatgt

SEQ ID NO: 3001733 - DNA, 18 bp, Homo sapiens
aatgtgtgagaaaaacta

SEQ ID NO: 3001734 - DNA, 16 bp, Homo sapiens
aatgtgtggcctgcac

SEQ ID NO: 3001735 - DNA, 19 bp, Homo sapiens
aatgtgttctcggagtgtg

SEQ ID NO: 3001736 - DNA, 22 bp, Homo sapiens
aatgtgttctcggagtgtgtat

SEQ ID NO: 3001737 - DNA, 13 bp, Homo sapiens
aatgtgtttcaaa

SEQ ID NO: 3001738 - DNA, 18 bp, Homo sapiens
aatgtgtttcaaactgta

SEQ ID NO: 3001739 - DNA, 22 bp, Homo sapiens
aatgtgttttagagtaagaaat

SEQ ID NO: 3001740 - DNA, 13 bp, Homo sapiens
aatgttaattttt

SEQ ID NO: 3001741 - DNA, 20 bp, Homo sapiens
aatgttaattttttggtaca

SEQ ID NO: 3001742 - DNA, 21 bp, Homo sapiens
aatgttaattttttggtacaa

SEQ ID NO: 3001743 - DNA, 18 bp, Homo sapiens
aatgttagaattgatttc

SEQ ID NO: 3001744 - DNA, 19 bp, Homo sapiens
aatgttatcttatactgta

SEQ ID NO: 3001745 - DNA, 22 bp, Homo sapiens
aatgttatcttatactgtacaa

SEQ ID NO: 3001746 - DNA, 23 bp, Homo sapiens
aatgttatcttatactgtacaat

SEQ ID NO: 3001747 - DNA, 16 bp, Homo sapiens
aatgttatcttctcaa

SEQ ID NO: 3001748 - DNA, 22 bp, Homo sapiens
aatgttatcttctcaagttcta

SEQ ID NO: 3001749 - DNA, 16 bp, Homo sapiens
aatgttcacttcgaaa

SEQ ID NO: 3001750 - DNA, 16 bp, Homo sapiens
aatgttccccaccgct

SEQ ID NO: 3001751 - DNA, 23 bp, Homo sapiens
aatgttctaagtttctaagattc

SEQ ID NO: 3001752 - DNA, 12 bp, Homo sapiens
aatgttctttat

SEQ ID NO: 3001753 - DNA, 19 bp, Homo sapiens
aatgttgattacagtgcag

SEQ ID NO: 3001754 - DNA, 17 bp, Homo sapiens
aatgttgtatttaattt

SEQ ID NO: 3001755 - DNA, 23 bp, Homo sapiens
aatgttgtttcctaatatcaaat

SEQ ID NO: 3001756 - DNA, 19 bp, Homo sapiens
aatgtttactatagaccaa

SEQ ID NO: 3001757 - DNA, 21 bp, Homo sapiens
aatgtttactatagaccaaaa

SEQ ID NO: 3001758 - DNA, 15 bp, Homo sapiens
aatgtttactgtaaa

SEQ ID NO: 3001759 - DNA, 17 bp, Homo sapiens
aatgtttactgtaaatt

SEQ ID NO: 3001760 - DNA, 15 bp, Homo sapiens
aatgtttatacagag

SEQ ID NO: 3001761 - DNA, 17 bp, Homo sapiens
aatgtttatacagagta

SEQ ID NO: 3001762 - DNA, 13 bp, Homo sapiens
aatgtttgaattt

SEQ ID NO: 3001763 - DNA, 14 bp, Homo sapiens
aatgtttgaattta

SEQ ID NO: 3001764 - DNA, 13 bp, Homo sapiens
aatgtttggaaag

SEQ ID NO: 3001765 - DNA, 18 bp, Homo sapiens
aatgtttgttaaaaataa

SEQ ID NO: 3001766 - DNA, 14 bp, Homo sapiens
aatgttttaaatgt

SEQ ID NO: 3001767 - DNA, 15 bp, Homo sapiens
aatgttttaaatgta

SEQ ID NO: 3001768 - DNA, 19 bp, Homo sapiens
aatgttttaaatgtacaga

SEQ ID NO: 3001769 - DNA, 22 bp, Homo sapiens
aatgttttgccagccacttacc

SEQ ID NO: 3001770 - DNA, 19 bp, Homo sapiens
aatgttttttcatgtgttt

SEQ ID NO: 3001771 - DNA, 20 bp, Homo sapiens
aattaaaaaaaaaaaacttt

SEQ ID NO: 3001772 - DNA, 20 bp, Homo sapiens
aattaaaaacgaaaacctga

SEQ ID NO: 3001773 - DNA, 12 bp, Homo sapiens
aattaaaaacta

SEQ ID NO: 3001774 - DNA, 21 bp, Homo sapiens
aattaaaaactagtagttctc

SEQ ID NO: 3001775 - DNA, 13 bp, Homo sapiens
aattaaaacactt

SEQ ID NO: 3001776 - DNA, 13 bp, Homo sapiens
aattaaaatggat

SEQ ID NO: 3001777 - DNA, 11 bp, Homo sapiens
aattaaaattt

SEQ ID NO: 3001778 - DNA, 13 bp, Homo sapiens
aattaaaatttat

SEQ ID NO: 3001779 - DNA, 23 bp, Homo sapiens
aattaaacccacaagctgcctct

SEQ ID NO: 3001780 - DNA, 19 bp, Homo sapiens
aattaaagtgctgtttaga

SEQ ID NO: 3001781 - DNA, 20 bp, Homo sapiens
aattaaatgccactttttca

SEQ ID NO: 3001782 - DNA, 13 bp, Homo sapiens
aattaagaaggca

SEQ ID NO: 3001783 - DNA, 19 bp, Homo sapiens
aattaagaaggcaaaaatg

SEQ ID NO: 3001784 - DNA, 19 bp, Homo sapiens
aattaagattctctgccca

SEQ ID NO: 3001785 - DNA, 12 bp, Homo sapiens
aattaagtagaa

SEQ ID NO: 3001786 - DNA, 13 bp, Homo sapiens
aattaagtagaac

SEQ ID NO: 3001787 - DNA, 14 bp, Homo sapiens
aattaagtagaaca

SEQ ID NO: 3001788 - DNA, 17 bp, Homo sapiens
aattaatagcttttgat

SEQ ID NO: 3001789 - DNA, 19 bp, Homo sapiens
aattaatagcttttgatta

SEQ ID NO: 3001790 - DNA, 13 bp, Homo sapiens
aattaatatttgt

SEQ ID NO: 3001791 - DNA, 15 bp, Homo sapiens
aattaatatttgtgc

SEQ ID NO: 3001792 - DNA, 16 bp, Homo sapiens
acagatctggaacctc

SEQ ID NO: 3001793 - DNA, 14 bp, Homo sapiens
acagatgaatgtat

SEQ ID NO: 3001794 - DNA, 16 bp, Homo sapiens
acagatgcaatgtgct

SEQ ID NO: 3001795 - DNA, 20 bp, Homo sapiens
acagatgcaatgtgctactg

SEQ ID NO: 3001796 - DNA, 19 bp, Homo sapiens
acagatggacgcaggccct

SEQ ID NO: 3001797 - DNA, 22 bp, Homo sapiens
acagatggacgcaggccctgtc

SEQ ID NO: 3001798 - DNA, 20 bp, Homo sapiens
acagatgtaaatcgggaagg

SEQ ID NO: 3001799 - DNA, 13 bp, Homo sapiens
acagatgttattt

SEQ ID NO: 3001800 - DNA, 21 bp, Homo sapiens
acagatgttatttttgtattt

SEQ ID NO: 3001801 - DNA, 23 bp, Homo sapiens
acagatgttatttttgtattttt

SEQ ID NO: 3001802 - DNA, 13 bp, Homo sapiens
acagattaatatt

SEQ ID NO: 3001803 - DNA, 13 bp, Homo sapiens
acagattcccagg

SEQ ID NO: 3001804 - DNA, 14 bp, Homo sapiens
acagattcccaggc

SEQ ID NO: 3001805 - DNA, 16 bp, Homo sapiens
acagattgtttctata

SEQ ID NO: 3001806 - DNA, 18 bp, Homo sapiens
acagattgtttctataca

SEQ ID NO: 3001807 - DNA, 21 bp, Homo sapiens
acagattgtttctatacaaat

SEQ ID NO: 3001808 - DNA, 23 bp, Homo sapiens
acagattgtttctatacaaatat

SEQ ID NO: 3001809 - DNA, 12 bp, Homo sapiens
acagatttgtga

SEQ ID NO: 3001810 - DNA, 21 bp, Homo sapiens
acagatttgtgaactcagcca

SEQ ID NO: 3001811 - DNA, 15 bp, Homo sapiens
acagattttcggaac

SEQ ID NO: 3001812 - DNA, 20 bp, Homo sapiens
acagatttttggtagtttct

SEQ ID NO: 3001813 - DNA, 21 bp, Homo sapiens
acagcaaaagccctaacttct

SEQ ID NO: 3001814 - DNA, 18 bp, Homo sapiens
acagcaaaccaagagatt

SEQ ID NO: 3001815 - DNA, 17 bp, Homo sapiens
acagcaattcctcaggc

SEQ ID NO: 3001816 - DNA, 19 bp, Homo sapiens
acagcaattcctcaggcta

SEQ ID NO: 3001817 - DNA, 15 bp, Homo sapiens
acagcaattttgtat

SEQ ID NO: 3001818 - DNA, 19 bp, Homo sapiens
acagcacaatgttattacc

SEQ ID NO: 3001819 - DNA, 13 bp, Homo sapiens
acagcacagagaa

SEQ ID NO: 3001820 - DNA, 17 bp, Homo sapiens
acagcacatcacctctt

SEQ ID NO: 3001821 - DNA, 14 bp, Homo sapiens
acagcagacctaga

SEQ ID NO: 3001822 - DNA, 19 bp, Homo sapiens
acagcagactcagctctga

SEQ ID NO: 3001823 - DNA, 17 bp, Homo sapiens
acagcagcaagaaaaaa

SEQ ID NO: 3001824 - DNA, 12 bp, Homo sapiens
acagcagcctgt

SEQ ID NO: 3001825 - DNA, 20 bp, Homo sapiens
acagcagggtacctgaaaga

SEQ ID NO: 3001826 - DNA, 15 bp, Homo sapiens
acagcagtagacatt

SEQ ID NO: 3001827 - DNA, 20 bp, Homo sapiens
acagcagtagacattttaac

SEQ ID NO: 3001828 - DNA, 16 bp, Homo sapiens
acagcatggcactccc

SEQ ID NO: 3001829 - DNA, 23 bp, Homo sapiens
acagcatggcactccctccagca

SEQ ID NO: 3001830 - DNA, 11 bp, Homo sapiens
acagcattgct

SEQ ID NO: 3001831 - DNA, 15 bp, Homo sapiens
acagcattgctttct

SEQ ID NO: 3001832 - DNA, 21 bp, Homo sapiens
acagccaacacgcacctgcct

SEQ ID NO: 3001833 - DNA, 24 bp, Homo sapiens
acagccaacacgcacctgcctcag

SEQ ID NO: 3001834 - DNA, 16 bp, Homo sapiens
acagccaactagcccc

SEQ ID NO: 3001835 - DNA, 21 bp, Homo sapiens
acagccaactagcccctgggg

SEQ ID NO: 3001836 - DNA, 21 bp, Homo sapiens
acagtgacgtgactcagagct

SEQ ID NO: 3001837 - DNA, 20 bp, Homo sapiens
acagtgagagtactcacttt

SEQ ID NO: 3001838 - DNA, 21 bp, Homo sapiens
acagtgatgcctgcccgcacc

SEQ ID NO: 3001839 - DNA, 11 bp, Homo sapiens
acagtgcctgc

SEQ ID NO: 3001840 - DNA, 14 bp, Homo sapiens
acagtgcctgctga

SEQ ID NO: 3001841 - DNA, 20 bp, Homo sapiens
acagtgctgaccagacagcc

SEQ ID NO: 3001842 - DNA, 16 bp, Homo sapiens
acagtggaactacatt

SEQ ID NO: 3001843 - DNA, 18 bp, Homo sapiens
acagtggaatataaggaa

SEQ ID NO: 3001844 - DNA, 16 bp, Homo sapiens
acagtggagagggcta

SEQ ID NO: 3001845 - DNA, 16 bp, Homo sapiens
acagtggcgcatgcct

SEQ ID NO: 3001846 - DNA, 14 bp, Homo sapiens
acagtgggaaatat

SEQ ID NO: 3001847 - DNA, 16 bp, Homo sapiens
acagtggtggcagggc

SEQ ID NO: 3001848 - DNA, 23 bp, Homo sapiens
acagtgtaagcttagattttctg

SEQ ID NO: 3001849 - DNA, 12 bp, Homo sapiens
acagtgtacatg

SEQ ID NO: 3001850 - DNA, 19 bp, Homo sapiens
acagtgtacatgtacatag

SEQ ID NO: 3001851 - DNA, 19 bp, Homo sapiens
acagtgtatgtagaagcat

SEQ ID NO: 3001852 - DNA, 16 bp, Homo sapiens
acagtgtcccccaggt

SEQ ID NO: 3001853 - DNA, 13 bp, Homo sapiens
acagtgtgaagtt

SEQ ID NO: 3001854 - DNA, 15 bp, Homo sapiens
acagtgtgaagttag

SEQ ID NO: 3001855 - DNA, 21 bp, Homo sapiens
acagtgtgggcgctctcccta

SEQ ID NO: 3001856 - DNA, 22 bp, Homo sapiens
acagtgtggtttgggaaagatg

SEQ ID NO: 3001857 - DNA, 20 bp, Homo sapiens
acagtgtttacactttggac

SEQ ID NO: 3001858 - DNA, 14 bp, Homo sapiens
acagtgttttgcac

SEQ ID NO: 3001859 - DNA, 11 bp, Homo sapiens
acagtgttttt

SEQ ID NO: 3001860 - DNA, 22 bp, Homo sapiens
acagtgttttttaggaaaagca

SEQ ID NO: 3001861 - DNA, 13 bp, Homo sapiens
acagttagcattt

SEQ ID NO: 3001862 - DNA, 14 bp, Homo sapiens
acagttagcattta

SEQ ID NO: 3001863 - DNA, 14 bp, Homo sapiens
acagttatcctgca

SEQ ID NO: 3001864 - DNA, 16 bp, Homo sapiens
acagttatcctgcaag

SEQ ID NO: 3001865 - DNA, 17 bp, Homo sapiens
acagttatcctgcaagg

SEQ ID NO: 3001866 - DNA, 16 bp, Homo sapiens
acagttatctaagtta

SEQ ID NO: 3001867 - DNA, 23 bp, Homo sapiens
acagttatctaagttaatttaaa

SEQ ID NO: 3001868 - DNA, 21 bp, Homo sapiens
acagttcaaaattctaaatgt

SEQ ID NO: 3001869 - DNA, 12 bp, Homo sapiens
acagttcctcgc

SEQ ID NO: 3001870 - DNA, 16 bp, Homo sapiens
acagttcctcgccctg

SEQ ID NO: 3001871 - DNA, 18 bp, Homo sapiens
acagttcctcgccctggg

SEQ ID NO: 3001872 - DNA, 19 bp, Homo sapiens
acagttcctcgccctgggt

SEQ ID NO: 3001873 - DNA, 19 bp, Homo sapiens
acagttcggtgagctacaa

SEQ ID NO: 3001874 - DNA, 20 bp, Homo sapiens
acagttctttgggccagaca

SEQ ID NO: 3001875 - DNA, 22 bp, Homo sapiens
acagttctttgggccagacatg

SEQ ID NO: 3001876 - DNA, 14 bp, Homo sapiens
acagttgcaggagc

SEQ ID NO: 3001877 - DNA, 16 bp, Homo sapiens
acagtttataaagcca

SEQ ID NO: 3001878 - DNA, 15 bp, Homo sapiens
acagtttatttgttg

SEQ ID NO: 3001879 - DNA, 15 bp, Homo sapiens
acagtttcattattc

SEQ ID NO: 3001880 - DNA, 14 bp, Homo sapiens
acagtttcttccat

SEQ ID NO: 3001881 - DNA, 20 bp, Homo sapiens
acagttttcctatgctttga

SEQ ID NO: 3001882 - DNA, 20 bp, Homo sapiens
acagtttttgacatttatat

SEQ ID NO: 3001883 - DNA, 21 bp, Homo sapiens
acagtttttgacatttatatt

SEQ ID NO: 3001884 - DNA, 18 bp, Homo sapiens
acataaaggtaaaacaaa

SEQ ID NO: 3001885 - DNA, 17 bp, Homo sapiens
acataaatgcagcccat

SEQ ID NO: 3001886 - DNA, 17 bp, Homo sapiens
acataaattatgagatt

SEQ ID NO: 3001887 - DNA, 20 bp, Homo sapiens
acataacaacctttcccatt

SEQ ID NO: 3001888 - DNA, 20 bp, Homo sapiens
acataactgatctatttatt

SEQ ID NO: 3001889 - DNA, 17 bp, Homo sapiens
acataacttctcatgta

SEQ ID NO: 3001890 - DNA, 18 bp, Homo sapiens
acataacttctcatgtat

SEQ ID NO: 3001891 - DNA, 17 bp, Homo sapiens
acataagatcactgcca

SEQ ID NO: 3001892 - DNA, 16 bp, Homo sapiens
acataagttagaacaa

SEQ ID NO: 3001893 - DNA, 21 bp, Homo sapiens
acataatacacttgccctgct

SEQ ID NO: 3001894 - DNA, 22 bp, Homo sapiens
acataatacacttgccctgctc

SEQ ID NO: 3001895 - DNA, 18 bp, Homo sapiens
acataatagaatttccta

SEQ ID NO: 3001896 - DNA, 19 bp, Homo sapiens
acataatgggccactgaaa

SEQ ID NO: 3001897 - DNA, 20 bp, Homo sapiens
acataattcactctgagtgt

SEQ ID NO: 3001898 - DNA, 16 bp, Homo sapiens
acataattgattaaaa

SEQ ID NO: 3001899 - DNA, 16 bp, Homo sapiens
acatacaattattttt

SEQ ID NO: 3001900 - DNA, 19 bp, Homo sapiens
acatacagagattgtagta

SEQ ID NO: 3001901 - DNA, 10 bp, Homo sapiens
acatacattg

SEQ ID NO: 3001902 - DNA, 17 bp, Homo sapiens
acatacctcatctcttg

SEQ ID NO: 3001903 - DNA, 20 bp, Homo sapiens
acatactacctagaagtaag

SEQ ID NO: 3001904 - DNA, 17 bp, Homo sapiens
acatacttcaaaaatgt

SEQ ID NO: 3001905 - DNA, 17 bp, Homo sapiens
acatacttgaagggcca

SEQ ID NO: 3001906 - DNA, 23 bp, Homo sapiens
acatacttgaagggccagagcca

SEQ ID NO: 3001907 - DNA, 12 bp, Homo sapiens
acatacttttgc

SEQ ID NO: 3001908 - DNA, 17 bp, Homo sapiens
acatagaaagttcatgg

SEQ ID NO: 3001909 - DNA, 20 bp, Homo sapiens
acatagactgaagatttatt

SEQ ID NO: 3001910 - DNA, 23 bp, Homo sapiens
acatagagagggagaagaagtca

SEQ ID NO: 3001911 - DNA, 12 bp, Homo sapiens
acatagcagact

SEQ ID NO: 3001912 - DNA, 16 bp, Homo sapiens
acatagcatgacattt

SEQ ID NO: 3001913 - DNA, 21 bp, Homo sapiens
acatagcttacaagccagctg

SEQ ID NO: 3001914 - DNA, 14 bp, Homo sapiens
acatagtattcatg

SEQ ID NO: 3001915 - DNA, 22 bp, Homo sapiens
acatataaaataatgcaaagaa

SEQ ID NO: 3001916 - DNA, 14 bp, Homo sapiens
acatatattatata

SEQ ID NO: 3001917 - DNA, 19 bp, Homo sapiens
acatatattatatatagaa

SEQ ID NO: 3001918 - DNA, 22 bp, Homo sapiens
acatatcaaaataggatttctt

SEQ ID NO: 3001919 - DNA, 16 bp, Homo sapiens
acatatcatctgtgga

SEQ ID NO: 3001920 - DNA, 14 bp, Homo sapiens
acatatctaaagtc

SEQ ID NO: 3001921 - DNA, 15 bp, Homo sapiens
acatatgaaaataca

SEQ ID NO: 3001922 - DNA, 22 bp, Homo sapiens
acatatgaatgcagcactgctg

SEQ ID NO: 3001923 - DNA, 14 bp, Homo sapiens
acatatgaggggga

SEQ ID NO: 3001924 - DNA, 15 bp, Homo sapiens
acatatgattctctt

SEQ ID NO: 3001925 - DNA, 19 bp, Homo sapiens
acatatggtctccatttta

SEQ ID NO: 3001926 - DNA, 23 bp, Homo sapiens
acatatggtctccattttacagt

SEQ ID NO: 3001927 - DNA, 18 bp, Homo sapiens
acatatgtagaaacattt

SEQ ID NO: 3001928 - DNA, 22 bp, Homo sapiens
acatattgcaggagacattttc

SEQ ID NO: 3001929 - DNA, 18 bp, Homo sapiens
acatatttaactggtgca

SEQ ID NO: 3001930 - DNA, 12 bp, Homo sapiens
acatatttaatg

SEQ ID NO: 3001931 - DNA, 13 bp, Homo sapiens
acatatttaatgt

SEQ ID NO: 3001932 - DNA, 14 bp, Homo sapiens
acatatttaatgtt

SEQ ID NO: 3001933 - DNA, 15 bp, Homo sapiens
acatatttaatgttt

SEQ ID NO: 3001934 - DNA, 15 bp, Homo sapiens
acattgggaagggga

SEQ ID NO: 3001935 - DNA, 21 bp, Homo sapiens
acattgggtctattccagctc

SEQ ID NO: 3001936 - DNA, 23 bp, Homo sapiens
acattgggtctattccagctcat

SEQ ID NO: 3001937 - DNA, 17 bp, Homo sapiens
acattgtcatcagaggg

SEQ ID NO: 3001938 - DNA, 22 bp, Homo sapiens
acattgtgatgtatattccttt

SEQ ID NO: 3001939 - DNA, 23 bp, Homo sapiens
acattgtgcccttgatttttatc

SEQ ID NO: 3001940 - DNA, 17 bp, Homo sapiens
acattgttattttcagt

SEQ ID NO: 3001941 - DNA, 13 bp, Homo sapiens
acattgttcacct

SEQ ID NO: 3001942 - DNA, 21 bp, Homo sapiens
acattgttcacctttgtagca

SEQ ID NO: 3001943 - DNA, 16 bp, Homo sapiens
acattgttttaaaaag

SEQ ID NO: 3001944 - DNA, 17 bp, Homo sapiens
acattgttttaaaaaga

SEQ ID NO: 3001945 - DNA, 14 bp, Homo sapiens
acatttaaatcctt

SEQ ID NO: 3001946 - DNA, 23 bp, Homo sapiens
acatttaaattttaccctttaga

SEQ ID NO: 3001947 - DNA, 21 bp, Homo sapiens
acatttagagaactgtggccg

SEQ ID NO: 3001948 - DNA, 14 bp, Homo sapiens
acatttaggagaag

SEQ ID NO: 3001949 - DNA, 17 bp, Homo sapiens
acatttagtctctttat

SEQ ID NO: 3001950 - DNA, 17 bp, Homo sapiens
acatttatagaagaaat

SEQ ID NO: 3001951 - DNA, 20 bp, Homo sapiens
acatttatgacaagctgtat

SEQ ID NO: 3001952 - DNA, 16 bp, Homo sapiens
acatttattttatgag

SEQ ID NO: 3001953 - DNA, 17 bp, Homo sapiens
acatttattttatgaga

SEQ ID NO: 3001954 - DNA, 18 bp, Homo sapiens
acatttattttatgagaa

SEQ ID NO: 3001955 - DNA, 22 bp, Homo sapiens
acatttattttatgagaaatgt

SEQ ID NO: 3001956 - DNA, 18 bp, Homo sapiens
acatttcacattgaatca

SEQ ID NO: 3001957 - DNA, 23 bp, Homo sapiens
acatttcatagtttcaaatctgt

SEQ ID NO: 3001958 - DNA, 13 bp, Homo sapiens
acatttcccaggg

SEQ ID NO: 3001959 - DNA, 16 bp, Homo sapiens
acatttcctctgttct

SEQ ID NO: 3001960 - DNA, 15 bp, Homo sapiens
acatttctataaata

SEQ ID NO: 3001961 - DNA, 18 bp, Homo sapiens
acatttctattttgcaaa

SEQ ID NO: 3001962 - DNA, 23 bp, Homo sapiens
acatttctctaagagaacaatgt

SEQ ID NO: 3001963 - DNA, 23 bp, Homo sapiens
acatttcttagactacatttaga

SEQ ID NO: 3001964 - DNA, 21 bp, Homo sapiens
acatttggaactaacacgtga

SEQ ID NO: 3001965 - DNA, 12 bp, Homo sapiens
acatttggaata

SEQ ID NO: 3001966 - DNA, 17 bp, Homo sapiens
acatttggaatactttt

SEQ ID NO: 3001967 - DNA, 18 bp, Homo sapiens
acatttggaatacttttt

SEQ ID NO: 3001968 - DNA, 19 bp, Homo sapiens
acatttgtattttgtgatg

SEQ ID NO: 3001969 - DNA, 20 bp, Homo sapiens
acatttgtattttgtgatga

SEQ ID NO: 3001970 - DNA, 23 bp, Homo sapiens
acatttgtgtcactgtacagttt

SEQ ID NO: 3001971 - DNA, 17 bp, Homo sapiens
acatttgtttgtattca

SEQ ID NO: 3001972 - DNA, 18 bp, Homo sapiens
acatttgtttgtattcat

SEQ ID NO: 3001973 - DNA, 12 bp, Homo sapiens
acattttaacaa

SEQ ID NO: 3001974 - DNA, 14 bp, Homo sapiens
acattttaacaaga

SEQ ID NO: 3001975 - DNA, 15 bp, Homo sapiens
acattttaacaagaa

SEQ ID NO: 3001976 - DNA, 18 bp, Homo sapiens
acattttactttttcctg

SEQ ID NO: 3001977 - DNA, 17 bp, Homo sapiens
acattttctctttaaaa

SEQ ID NO: 3001978 - DNA, 20 bp, Homo sapiens
acattttcttttgttcttga

SEQ ID NO: 3001979 - DNA, 15 bp, Homo sapiens
acattttgctctgtg

SEQ ID NO: 3001980 - DNA, 17 bp, Homo sapiens
acattttggatttcttt

SEQ ID NO: 3001981 - DNA, 19 bp, Homo sapiens
acattttggatttctttat

SEQ ID NO: 3001982 - DNA, 16 bp, Homo sapiens
acatttttaaattctt

SEQ ID NO: 3001983 - DNA, 15 bp, Homo sapiens
acatttttcaacttt

SEQ ID NO: 3001984 - DNA, 22 bp, Homo sapiens
acatttttcaactttgaataaa

SEQ ID NO: 3001985 - DNA, 13 bp, Homo sapiens
acatttttcctct

SEQ ID NO: 3001986 - DNA, 14 bp, Homo sapiens
acattttttgctat

SEQ ID NO: 3001987 - DNA, 21 bp, Homo sapiens
acattttttgctataatcatt

SEQ ID NO: 3001988 - DNA, 20 bp, Homo sapiens
accaaaaattgcgagccttt

SEQ ID NO: 3001989 - DNA, 21 bp, Homo sapiens
accaaaaggagagattattaa

SEQ ID NO: 3001990 - DNA, 14 bp, Homo sapiens
accaaaagttacat

SEQ ID NO: 3001991 - DNA, 21 bp, Homo sapiens
accaaaagttacatgtttgca

SEQ ID NO: 3001992 - DNA, 14 bp, Homo sapiens
accaaacaattatt

SEQ ID NO: 3001993 - DNA, 19 bp, Homo sapiens
accaaagagtctctggctc

SEQ ID NO: 3001994 - DNA, 22 bp, Homo sapiens
accaaagagtctctggctcagc

SEQ ID NO: 3001995 - DNA, 19 bp, Homo sapiens
accaaagtgtcttttgaca

SEQ ID NO: 3001996 - DNA, 21 bp, Homo sapiens
accaaagtgtcttttgacatt

SEQ ID NO: 3001997 - DNA, 19 bp, Homo sapiens
accaaatatgttaaagttt

SEQ ID NO: 3001998 - DNA, 14 bp, Homo sapiens
accaaatctgtcta

SEQ ID NO: 3001999 - DNA, 23 bp, Homo sapiens
accaaattaaaaatttttttaag

SEQ ID NO: 3002000 - DNA, 15 bp, Homo sapiens
accaaattgcactga

SEQ ID NO: 3002001 - DNA, 17 bp, Homo sapiens
accaaattgcactgaag

SEQ ID NO: 3002002 - DNA, 13 bp, Homo sapiens
accaaattgcttc

SEQ ID NO: 3002003 - DNA, 19 bp, Homo sapiens
accaaattttgaggtcttt

SEQ ID NO: 3002004 - DNA, 15 bp, Homo sapiens
accaacagcttttcc

SEQ ID NO: 3002005 - DNA, 13 bp, Homo sapiens
accaacatctttg

SEQ ID NO: 3002006 - DNA, 22 bp, Homo sapiens
accaacatctttgcgaaaagat

SEQ ID NO: 3002007 - DNA, 16 bp, Homo sapiens
accaacatggagaaac

SEQ ID NO: 3002008 - DNA, 23 bp, Homo sapiens
accaacatggagaaaccctgtct

SEQ ID NO: 3002009 - DNA, 24 bp, Homo sapiens
accaacatggagaaaccctgtctc

SEQ ID NO: 3002010 - DNA, 15 bp, Homo sapiens
accaacatgtatctg

SEQ ID NO: 3002011 - DNA, 19 bp, Homo sapiens
accaacatgtatctgtcta

SEQ ID NO: 3002012 - DNA, 20 bp, Homo sapiens
accaaccccgcggcccagac

SEQ ID NO: 3002013 - DNA, 13 bp, Homo sapiens
accaacctgacca

SEQ ID NO: 3002014 - DNA, 19 bp, Homo sapiens
accaacctttctgacatca

SEQ ID NO: 3002015 - DNA, 21 bp, Homo sapiens
accaacctttctgacatcagc

SEQ ID NO: 3002016 - DNA, 16 bp, Homo sapiens
accaagaagatgtctt

SEQ ID NO: 3002017 - DNA, 20 bp, Homo sapiens
accaagaagcctttcctgta

SEQ ID NO: 3002018 - DNA, 24 bp, Homo sapiens
accaagaagcctttcctgtagcct

SEQ ID NO: 3002019 - DNA, 18 bp, Homo sapiens
accaagagattgctaatt

SEQ ID NO: 3002020 - DNA, 13 bp, Homo sapiens
accaagcaggaag

SEQ ID NO: 3002021 - DNA, 12 bp, Homo sapiens
accaagcctctg

SEQ ID NO: 3002022 - DNA, 13 bp, Homo sapiens
accaagcctctgg

SEQ ID NO: 3002023 - DNA, 21 bp, Homo sapiens
accaagcttcaatatttttct

SEQ ID NO: 3002024 - DNA, 14 bp, Homo sapiens
accaaggaaggagc

SEQ ID NO: 3002025 - DNA, 17 bp, Homo sapiens
accaaggaaggagcccc

SEQ ID NO: 3002026 - DNA, 13 bp, Homo sapiens
accaagggggcgg

SEQ ID NO: 3002027 - DNA, 19 bp, Homo sapiens
accaaggggtggccgggca

SEQ ID NO: 3002028 - DNA, 20 bp, Homo sapiens
accaaggtctcacactcctc

SEQ ID NO: 3002029 - DNA, 22 bp, Homo sapiens
accaaggtctcacactcctcct

SEQ ID NO: 3002030 - DNA, 14 bp, Homo sapiens
accaagtcaggcca

SEQ ID NO: 3002031 - DNA, 15 bp, Homo sapiens
accaagtcaggccag

SEQ ID NO: 3002032 - DNA, 23 bp, Homo sapiens
accaagtgggctggtattctctc

SEQ ID NO: 3002033 - DNA, 23 bp, Homo sapiens
accaagttggaacatccttggaa

SEQ ID NO: 3002034 - DNA, 19 bp, Homo sapiens
accaagttgtttattccaa

SEQ ID NO: 3002035 - DNA, 11 bp, Homo sapiens
accaatacaaa

SEQ ID NO: 3002036 - DNA, 17 bp, Homo sapiens
accaatgaaaaaatgta

SEQ ID NO: 3002037 - DNA, 22 bp, Homo sapiens
accaatgcactgagtgaaggaa

SEQ ID NO: 3002038 - DNA, 13 bp, Homo sapiens
accaatgtcttga

SEQ ID NO: 3002039 - DNA, 15 bp, Homo sapiens
accaatgttgtacag

SEQ ID NO: 3002040 - DNA, 17 bp, Homo sapiens
accaattaagtgttgaa

SEQ ID NO: 3002041 - DNA, 22 bp, Homo sapiens
accaattaagtgttgaaaaata

SEQ ID NO: 3002042 - DNA, 22 bp, Homo sapiens
accatatttgaattggcctgaa

SEQ ID NO: 3002043 - DNA, 12 bp, Homo sapiens
accatattttat

SEQ ID NO: 3002044 - DNA, 20 bp, Homo sapiens
accatattttattgtatttt

SEQ ID NO: 3002045 - DNA, 21 bp, Homo sapiens
accatattttattgtattttg

SEQ ID NO: 3002046 - DNA, 13 bp, Homo sapiens
accatcactgagt

SEQ ID NO: 3002047 - DNA, 15 bp, Homo sapiens
accatcatgtaccaa

SEQ ID NO: 3002048 - DNA, 15 bp, Homo sapiens
accatccaaatttat

SEQ ID NO: 3002049 - DNA, 17 bp, Homo sapiens
accatccccgcacaaag

SEQ ID NO: 3002050 - DNA, 13 bp, Homo sapiens
accatcctattta

SEQ ID NO: 3002051 - DNA, 16 bp, Homo sapiens
accatcctatttaact

SEQ ID NO: 3002052 - DNA, 18 bp, Homo sapiens
accatctatgtgaatatt

SEQ ID NO: 3002053 - DNA, 21 bp, Homo sapiens
accatctatgtgaatatttgt

SEQ ID NO: 3002054 - DNA, 23 bp, Homo sapiens
accatctcctatcttttatttca

SEQ ID NO: 3002055 - DNA, 14 bp, Homo sapiens
accatctgtgacta

SEQ ID NO: 3002056 - DNA, 15 bp, Homo sapiens
accatctgtgactat

SEQ ID NO: 3002057 - DNA, 19 bp, Homo sapiens
acccccctccccaactccc

SEQ ID NO: 3002058 - DNA, 15 bp, Homo sapiens
acccccctgggctga

SEQ ID NO: 3002059 - DNA, 13 bp, Homo sapiens
acccccgcagagg

SEQ ID NO: 3002060 - DNA, 16 bp, Homo sapiens
acccccgcccccaccg

SEQ ID NO: 3002061 - DNA, 14 bp, Homo sapiens
acccccgccccctg

SEQ ID NO: 3002062 - DNA, 15 bp, Homo sapiens
acccccgccccctgc

SEQ ID NO: 3002063 - DNA, 18 bp, Homo sapiens
acccccgggatcctgccc

SEQ ID NO: 3002064 - DNA, 12 bp, Homo sapiens
accccctccttc

SEQ ID NO: 3002065 - DNA, 16 bp, Homo sapiens
accccctccttcagac

SEQ ID NO: 3002066 - DNA, 19 bp, Homo sapiens
accccctccttcagacacc

SEQ ID NO: 3002067 - DNA, 21 bp, Homo sapiens
accccctcttctgagcacaga

SEQ ID NO: 3002068 - DNA, 13 bp, Homo sapiens
accccctgcccgc

SEQ ID NO: 3002069 - DNA, 14 bp, Homo sapiens
accccctgcccgcc

SEQ ID NO: 3002070 - DNA, 15 bp, Homo sapiens
accccctgcccgcca

SEQ ID NO: 3002071 - DNA, 18 bp, Homo sapiens
accccctgtcctgtgctg

SEQ ID NO: 3002072 - DNA, 16 bp, Homo sapiens
acccccttcagtgccc

SEQ ID NO: 3002073 - DNA, 20 bp, Homo sapiens
acccccttcagtgcccacca

SEQ ID NO: 3002074 - DNA, 18 bp, Homo sapiens
acccccttctccatccac

SEQ ID NO: 3002075 - DNA, 12 bp, Homo sapiens
accccgactttt

SEQ ID NO: 3002076 - DNA, 15 bp, Homo sapiens
accccgaggccctgc

SEQ ID NO: 3002077 - DNA, 20 bp, Homo sapiens
accccgaggccctgcatggg

SEQ ID NO: 3002078 - DNA, 19 bp, Homo sapiens
accccgcctgcctcctggc

SEQ ID NO: 3002079 - DNA, 13 bp, Homo sapiens
accccgcggccca

SEQ ID NO: 3002080 - DNA, 14 bp, Homo sapiens
accccgcggcccag

SEQ ID NO: 3002081 - DNA, 16 bp, Homo sapiens
accccgcggcccagac

SEQ ID NO: 3002082 - DNA, 22 bp, Homo sapiens
accccgtctggggttcagcccc

SEQ ID NO: 3002083 - DNA, 19 bp, Homo sapiens
acccctaccgatggtccca

SEQ ID NO: 3002084 - DNA, 17 bp, Homo sapiens
acccctagaaaggagag

SEQ ID NO: 3002085 - DNA, 16 bp, Homo sapiens
acccctcaccaccccc

SEQ ID NO: 3002086 - DNA, 11 bp, Homo sapiens
acccctcctgg

SEQ ID NO: 3002087 - DNA, 12 bp, Homo sapiens
acccctcctggg

SEQ ID NO: 3002088 - DNA, 14 bp, Homo sapiens
acccctcctggggc

SEQ ID NO: 3002089 - DNA, 12 bp, Homo sapiens
acccctgccact

SEQ ID NO: 3002090 - DNA, 22 bp, Homo sapiens
acccctgccactcacccttcct

SEQ ID NO: 3002091 - DNA, 17 bp, Homo sapiens
acccctgccctgctcct

SEQ ID NO: 3002092 - DNA, 15 bp, Homo sapiens
acccctgcctcgagg

SEQ ID NO: 3002093 - DNA, 16 bp, Homo sapiens
acccctgcctcgaggg

SEQ ID NO: 3002094 - DNA, 20 bp, Homo sapiens
acccctgcctttgggagcag

SEQ ID NO: 3002095 - DNA, 15 bp, Homo sapiens
acccctggctctggg

SEQ ID NO: 3002096 - DNA, 23 bp, Homo sapiens
acccctggctgaacagtgctctg

SEQ ID NO: 3002097 - DNA, 16 bp, Homo sapiens
acccctgggggctctc

SEQ ID NO: 3002098 - DNA, 19 bp, Homo sapiens
accccttaagccctggccc

SEQ ID NO: 3002099 - DNA, 23 bp, Homo sapiens
accccttaccccaaagagaaaga

SEQ ID NO: 3002100 - DNA, 16 bp, Homo sapiens
accccttccagaagca

SEQ ID NO: 3002101 - DNA, 19 bp, Homo sapiens
accccttcgacatgctgcc

SEQ ID NO: 3002102 - DNA, 13 bp, Homo sapiens
accccttctctgt

SEQ ID NO: 3002103 - DNA, 17 bp, Homo sapiens
accccttctctgtgacc

SEQ ID NO: 3002104 - DNA, 21 bp, Homo sapiens
accccttctctgtgacccact

SEQ ID NO: 3002105 - DNA, 17 bp, Homo sapiens
acccgacataagtcgag

SEQ ID NO: 3002106 - DNA, 17 bp, Homo sapiens
acccgagggttgattaa

SEQ ID NO: 3002107 - DNA, 21 bp, Homo sapiens
acccgagtcattcgttctgtg

SEQ ID NO: 3002108 - DNA, 19 bp, Homo sapiens
acccggattggccctgccc

SEQ ID NO: 3002109 - DNA, 16 bp, Homo sapiens
acccggcggccctgct

SEQ ID NO: 3002110 - DNA, 16 bp, Homo sapiens
acccggggtctcctgg

SEQ ID NO: 3002111 - DNA, 17 bp, Homo sapiens
acccggtgctccctctg

SEQ ID NO: 3002112 - DNA, 22 bp, Homo sapiens
acccgtgcctgggcccctcccc

SEQ ID NO: 3002113 - DNA, 23 bp, Homo sapiens
acccgtgcctgggcccctcccct

SEQ ID NO: 3002114 - DNA, 16 bp, Homo sapiens
accctaaatcttgact

SEQ ID NO: 3002115 - DNA, 18 bp, Homo sapiens
accctaagggcagccctc

SEQ ID NO: 3002116 - DNA, 19 bp, Homo sapiens
accctaagggcagccctcc

SEQ ID NO: 3002117 - DNA, 14 bp, Homo sapiens
accctaccccacca

SEQ ID NO: 3002118 - DNA, 19 bp, Homo sapiens
accctaccttccccagact

SEQ ID NO: 3002119 - DNA, 18 bp, Homo sapiens
accctagccctctccctc

SEQ ID NO: 3002120 - DNA, 22 bp, Homo sapiens
accctatctgtgattcccccaa

SEQ ID NO: 3002121 - DNA, 20 bp, Homo sapiens
accctcaggtgtagctgagc

SEQ ID NO: 3002122 - DNA, 13 bp, Homo sapiens
accctcatctttc

SEQ ID NO: 3002123 - DNA, 14 bp, Homo sapiens
accctcatctttct

SEQ ID NO: 3002124 - DNA, 17 bp, Homo sapiens
accctcattctactgaa

SEQ ID NO: 3002125 - DNA, 20 bp, Homo sapiens
accctccacaaagcaaaggc

SEQ ID NO: 3002126 - DNA, 15 bp, Homo sapiens
accctcccggcctgg

SEQ ID NO: 3002127 - DNA, 20 bp, Homo sapiens
accctcctctatttctttaa

SEQ ID NO: 3002128 - DNA, 15 bp, Homo sapiens
accctcctggcctca

SEQ ID NO: 3002129 - DNA, 22 bp, Homo sapiens
accctcctggcctcagactgca

SEQ ID NO: 3002130 - DNA, 19 bp, Homo sapiens
accctcgaggcggatcttt

SEQ ID NO: 3002131 - DNA, 13 bp, Homo sapiens
accctctcacttt

SEQ ID NO: 3002132 - DNA, 19 bp, Homo sapiens
accctctccgcacacctct

SEQ ID NO: 3002133 - DNA, 15 bp, Homo sapiens
accctctgctgaaga

SEQ ID NO: 3002134 - DNA, 16 bp, Homo sapiens
accctctgctgaagac

SEQ ID NO: 3002135 - DNA, 17 bp, Homo sapiens
accctctgctgaagact

SEQ ID NO: 3002136 - DNA, 22 bp, Homo sapiens
accctctgtaccccatgacctt

SEQ ID NO: 3002137 - DNA, 20 bp, Homo sapiens
accctctgtccccaggcctg

SEQ ID NO: 3002138 - DNA, 23 bp, Homo sapiens
accctctttcttgtttgtcagca

SEQ ID NO: 3002139 - DNA, 18 bp, Homo sapiens
accctgaaggggccatga

SEQ ID NO: 3002140 - DNA, 17 bp, Homo sapiens
accctgagctgaggcag

SEQ ID NO: 3002141 - DNA, 20 bp, Homo sapiens
accctgatttaggagaagcc

SEQ ID NO: 3002142 - DNA, 23 bp, Homo sapiens
accctgatttaggagaagccagg

SEQ ID NO: 3002143 - DNA, 17 bp, Homo sapiens
accctgccccttgccat

SEQ ID NO: 3002144 - DNA, 22 bp, Homo sapiens
accctgcctcgcccccactttt

SEQ ID NO: 3002145 - DNA, 12 bp, Homo sapiens
accctgcctgct

SEQ ID NO: 3002146 - DNA, 15 bp, Homo sapiens
accctgcctgctgtg

SEQ ID NO: 3002147 - DNA, 16 bp, Homo sapiens
accctgcctgctgtgg

SEQ ID NO: 3002148 - DNA, 22 bp, Homo sapiens
accctgcgcccagtccttccac

SEQ ID NO: 3002149 - DNA, 19 bp, Homo sapiens
accctgctgctggtgcaca

SEQ ID NO: 3002150 - DNA, 17 bp, Homo sapiens
accctggaaaatgaatc

SEQ ID NO: 3002151 - DNA, 17 bp, Homo sapiens
accctggaccagtggtc

SEQ ID NO: 3002152 - DNA, 19 bp, Homo sapiens
accctggagtatttggaag

SEQ ID NO: 3002153 - DNA, 22 bp, Homo sapiens
accctggccaccacccaacctg

SEQ ID NO: 3002154 - DNA, 22 bp, Homo sapiens
accctggccgagtccaagctgg

SEQ ID NO: 3002155 - DNA, 23 bp, Homo sapiens
accctgggacctaggggcgccgc

SEQ ID NO: 3002156 - DNA, 22 bp, Homo sapiens
accctggggctggcttttctgt

SEQ ID NO: 3002157 - DNA, 16 bp, Homo sapiens
accctgggggcacagg

SEQ ID NO: 3002158 - DNA, 18 bp, Homo sapiens
accctgggggcacaggag

SEQ ID NO: 3002159 - DNA, 17 bp, Homo sapiens
accctgggtttggcccc

SEQ ID NO: 3002160 - DNA, 18 bp, Homo sapiens
accctgggtttggcccct

SEQ ID NO: 3002161 - DNA, 15 bp, Homo sapiens
accctggtgggccaa

SEQ ID NO: 3002162 - DNA, 18 bp, Homo sapiens
accctggtggttgctgtt

SEQ ID NO: 3002163 - DNA, 19 bp, Homo sapiens
accctggtggttgctgttt

SEQ ID NO: 3002164 - DNA, 15 bp, Homo sapiens
accctgttcaggctg

SEQ ID NO: 3002165 - DNA, 20 bp, Homo sapiens
accctgttcaggctggctcg

SEQ ID NO: 3002166 - DNA, 20 bp, Homo sapiens
accctgttctgtagttattc

SEQ ID NO: 3002167 - DNA, 19 bp, Homo sapiens
acccttacagcctctgact

SEQ ID NO: 3002168 - DNA, 13 bp, Homo sapiens
acccttagaatcc

SEQ ID NO: 3002169 - DNA, 16 bp, Homo sapiens
acccttagaatccacg

SEQ ID NO: 3002170 - DNA, 17 bp, Homo sapiens
acccttagcagcccagc

SEQ ID NO: 3002171 - DNA, 14 bp, Homo sapiens
acccttaggccttt

SEQ ID NO: 3002172 - DNA, 22 bp, Homo sapiens
acccttcaacgtttcttcactt

SEQ ID NO: 3002173 - DNA, 12 bp, Homo sapiens
acccttccctgc

SEQ ID NO: 3002174 - DNA, 14 bp, Homo sapiens
acccttccctgcct

SEQ ID NO: 3002175 - DNA, 15 bp, Homo sapiens
acccttccctgcctc

SEQ ID NO: 3002176 - DNA, 13 bp, Homo sapiens
acccttcctaagt

SEQ ID NO: 3002177 - DNA, 13 bp, Homo sapiens
acccttcctggcc

SEQ ID NO: 3002178 - DNA, 15 bp, Homo sapiens
acccttcctggccca

SEQ ID NO: 3002179 - DNA, 20 bp, Homo sapiens
acccttcctggcccaggcct

SEQ ID NO: 3002180 - DNA, 20 bp, Homo sapiens
acccttctccaaaggctctg

SEQ ID NO: 3002181 - DNA, 21 bp, Homo sapiens
acccttctcctcttgtaaata

SEQ ID NO: 3002182 - DNA, 16 bp, Homo sapiens
acccttctgctttcta

SEQ ID NO: 3002183 - DNA, 22 bp, Homo sapiens
accttctggcctcccacagact

SEQ ID NO: 3002184 - DNA, 20 bp, Homo sapiens
accttcttcagccacctctc

SEQ ID NO: 3002185 - DNA, 11 bp, Homo sapiens
accttgaaggt

SEQ ID NO: 3002186 - DNA, 17 bp, Homo sapiens
accttgacctttgtaca

SEQ ID NO: 3002187 - DNA, 18 bp, Homo sapiens
accttgacctttgtacag

SEQ ID NO: 3002188 - DNA, 10 bp, Homo sapiens
accttgagca

SEQ ID NO: 3002189 - DNA, 12 bp, Homo sapiens
accttgagcaga

SEQ ID NO: 3002190 - DNA, 14 bp, Homo sapiens
accttgaggagaag

SEQ ID NO: 3002191 - DNA, 15 bp, Homo sapiens
accttgattttcttc

SEQ ID NO: 3002192 - DNA, 19 bp, Homo sapiens
accttgccacccattcttc

SEQ ID NO: 3002193 - DNA, 22 bp, Homo sapiens
accttgccacccattcttcccg

SEQ ID NO: 3002194 - DNA, 19 bp, Homo sapiens
accttgctagctagccagc

SEQ ID NO: 3002195 - DNA, 14 bp, Homo sapiens
accttgctgcagtg

SEQ ID NO: 3002196 - DNA, 15 bp, Homo sapiens
accttggagcattta

SEQ ID NO: 3002197 - DNA, 14 bp, Homo sapiens
accttggcaccaga

SEQ ID NO: 3002198 - DNA, 22 bp, Homo sapiens
accttggcaccagacacccagg

SEQ ID NO: 3002199 - DNA, 13 bp, Homo sapiens
accttggcccagg

SEQ ID NO: 3002200 - DNA, 20 bp, Homo sapiens
accttggcccaggagctctg

SEQ ID NO: 3002201 - DNA, 12 bp, Homo sapiens
accttgggacca

SEQ ID NO: 3002202 - DNA, 13 bp, Homo sapiens
accttgggccctg

SEQ ID NO: 3002203 - DNA, 16 bp, Homo sapiens
accttgggtggcccct

SEQ ID NO: 3002204 - DNA, 13 bp, Homo sapiens
accttgtaaaaga

SEQ ID NO: 3002205 - DNA, 14 bp, Homo sapiens
accttgtggtctcg

SEQ ID NO: 3002206 - DNA, 15 bp, Homo sapiens
accttgtgtctgtac

SEQ ID NO: 3002207 - DNA, 18 bp, Homo sapiens
accttgtgtctgtacacg

SEQ ID NO: 3002208 - DNA, 12 bp, Homo sapiens
accttgtttgtt

SEQ ID NO: 3002209 - DNA, 13 bp, Homo sapiens
accttgttttgcc

SEQ ID NO: 3002210 - DNA, 20 bp, Homo sapiens
acctttaaaaatgtataatg

SEQ ID NO: 3002211 - DNA, 21 bp, Homo sapiens
acctttaagtagataagcaga

SEQ ID NO: 3002212 - DNA, 13 bp, Homo sapiens
acctttactttag

SEQ ID NO: 3002213 - DNA, 14 bp, Homo sapiens
acctttaggttctt

SEQ ID NO: 3002214 - DNA, 20 bp, Homo sapiens
acctttcataatctttgctt

SEQ ID NO: 3002215 - DNA, 15 bp, Homo sapiens
acctttccactccca

SEQ ID NO: 3002216 - DNA, 22 bp, Homo sapiens
acctttccactcccactgccag

SEQ ID NO: 3002217 - DNA, 23 bp, Homo sapiens
acctttccattttacgttttaga

SEQ ID NO: 3002218 - DNA, 16 bp, Homo sapiens
acctttcccatttcgt

SEQ ID NO: 3002219 - DNA, 16 bp, Homo sapiens
acctttctcctttgta

SEQ ID NO: 3002220 - DNA, 20 bp, Homo sapiens
acctttctcctttgtacttt

SEQ ID NO: 3002221 - DNA, 15 bp, Homo sapiens
acctttctgacatca

SEQ ID NO: 3002222 - DNA, 21 bp, Homo sapiens
acctttctgacatcagcactt

SEQ ID NO: 3002223 - DNA, 17 bp, Homo sapiens
acctttcttcttgtgtc

SEQ ID NO: 3002224 - DNA, 11 bp, Homo sapiens
acctttgctat

SEQ ID NO: 3002225 - DNA, 15 bp, Homo sapiens
acctttgctatgtaa

SEQ ID NO: 3002226 - DNA, 17 bp, Homo sapiens
acctttgtacagcccag

SEQ ID NO: 3002227 - DNA, 19 bp, Homo sapiens
acctttgtagttactcaag

SEQ ID NO: 3002228 - DNA, 19 bp, Homo sapiens
accttttatcaataaagca

SEQ ID NO: 3002229 - DNA, 21 bp, Homo sapiens
accttttatcaataaagcact

SEQ ID NO: 3002230 - DNA, 15 bp, Homo sapiens
accttttatgtagta

SEQ ID NO: 3002231 - DNA, 18 bp, Homo sapiens
accttttgataaaatgtt

SEQ ID NO: 3002232 - DNA, 14 bp, Homo sapiens
accttttgttttct

SEQ ID NO: 3002233 - DNA, 17 bp, Homo sapiens
accttttgtttttccag

SEQ ID NO: 3002234 - DNA, 23 bp, Homo sapiens
accttttttcaacagtgaagaca

SEQ ID NO: 3002235 - DNA, 20 bp, Homo sapiens
accttttttgttttttcaaa

SEQ ID NO: 3002236 - DNA, 16 bp, Homo sapiens
acgaacccacctgctg

SEQ ID NO: 3002237 - DNA, 20 bp, Homo sapiens
acgaacccctagaaaggaga

SEQ ID NO: 3002238 - DNA, 14 bp, Homo sapiens
acgaacttccatgg

SEQ ID NO: 3002239 - DNA, 15 bp, Homo sapiens
acgaagaagagccac

SEQ ID NO: 3002240 - DNA, 17 bp, Homo sapiens
acgaagaagagccacag

SEQ ID NO: 3002241 - DNA, 18 bp, Homo sapiens
acgaagaagagccacagt

SEQ ID NO: 3002242 - DNA, 20 bp, Homo sapiens
acgaataaacgcagaagagg

SEQ ID NO: 3002243 - DNA, 18 bp, Homo sapiens
acgaatatggacatatca

SEQ ID NO: 3002244 - DNA, 17 bp, Homo sapiens
acgaatgcatattcaac

SEQ ID NO: 3002245 - DNA, 20 bp, Homo sapiens
acgaatgcatattcaacaca

SEQ ID NO: 3002246 - DNA, 15 bp, Homo sapiens
acgacaaagaaacat

SEQ ID NO: 3002247 - DNA, 14 bp, Homo sapiens
acgagaaaacaata

SEQ ID NO: 3002248 - DNA, 15 bp, Homo sapiens
acgagagtgcctccc

SEQ ID NO: 3002249 - DNA, 22 bp, Homo sapiens
acgagagtgcctccccttcttg

SEQ ID NO: 3002250 - DNA, 11 bp, Homo sapiens
acgagggctgg

SEQ ID NO: 3002251 - DNA, 17 bp, Homo sapiens
acgaggggacccatggg

SEQ ID NO: 3002252 - DNA, 21 bp, Homo sapiens
acgaggggacccatgggggct

SEQ ID NO: 3002253 - DNA, 16 bp, Homo sapiens
acgagtgttcctgtgc

SEQ ID NO: 3002254 - DNA, 14 bp, Homo sapiens
acgatatttcgttt

SEQ ID NO: 3002255 - DNA, 13 bp, Homo sapiens
acgatctcagctc

SEQ ID NO: 3002256 - DNA, 17 bp, Homo sapiens
acgattgacctgtcctc

SEQ ID NO: 3002257 - DNA, 23 bp, Homo sapiens
acgcaaaccaacctttctgacat

SEQ ID NO: 3002258 - DNA, 16 bp, Homo sapiens
acgcaattaaaaataa

SEQ ID NO: 3002259 - DNA, 21 bp, Homo sapiens
acgcacagacaggttttcaca

SEQ ID NO: 3002260 - DNA, 15 bp, Homo sapiens
acgcacctcccatcc

SEQ ID NO: 3002261 - DNA, 16 bp, Homo sapiens
acgcagagattttcat

SEQ ID NO: 3002262 - DNA, 19 bp, Homo sapiens
acgcagcaacgtttttaat

SEQ ID NO: 3002263 - DNA, 14 bp, Homo sapiens
acgcagccggaggg

SEQ ID NO: 3002264 - DNA, 19 bp, Homo sapiens
acgcagccggagggaggca

SEQ ID NO: 3002265 - DNA, 14 bp, Homo sapiens
acgcagcctccagt

SEQ ID NO: 3002266 - DNA, 15 bp, Homo sapiens
acgcaggcccctctc

SEQ ID NO: 3002267 - DNA, 16 bp, Homo sapiens
acgcaggcccctctcc

SEQ ID NO: 3002268 - DNA, 20 bp, Homo sapiens
acgcaggcccctctcctccg

SEQ ID NO: 3002269 - DNA, 23 bp, Homo sapiens
acgcaggcccctctcctccgtgg

SEQ ID NO: 3002270 - DNA, 12 bp, Homo sapiens
acgcaggccctg

SEQ ID NO: 3002271 - DNA, 19 bp, Homo sapiens
acgcagttactgaaatctt

SEQ ID NO: 3002272 - DNA, 20 bp, Homo sapiens
acgccaataataaaaaacaa

SEQ ID NO: 3002273 - DNA, 18 bp, Homo sapiens
acgccacccccgccccca

SEQ ID NO: 3002274 - DNA, 21 bp, Homo sapiens
acgccacccccgcccccaccg

SEQ ID NO: 3002275 - DNA, 23 bp, Homo sapiens
acgccattctcctgcctcagcct

SEQ ID NO: 3002276 - DNA, 20 bp, Homo sapiens
acgcccacccaaccccaagc

SEQ ID NO: 3002277 - DNA, 15 bp, Homo sapiens
acgcctcccactggg

SEQ ID NO: 3002278 - DNA, 18 bp, Homo sapiens
acgcctgcaaacgctgcc

SEQ ID NO: 3002279 - DNA, 21 bp, Homo sapiens
acgcctgcaaacgctgcctgc

SEQ ID NO: 3002280 - DNA, 23 bp, Homo sapiens
acgcctgcaaacgctgcctgccc

SEQ ID NO: 3002281 - DNA, 16 bp, Homo sapiens
acgcctgtaatcccag

SEQ ID NO: 3002282 - DNA, 17 bp, Homo sapiens
acgcctgtaatcccagc

SEQ ID NO: 3002283 - DNA, 13 bp, Homo sapiens
acgcgaaaccaat

SEQ ID NO: 3002284 - DNA, 20 bp, Homo sapiens
acgcgcagatgtgcagcaga

SEQ ID NO: 3002285 - DNA, 15 bp, Homo sapiens
acgctacctctctgt

SEQ ID NO: 3002286 - DNA, 20 bp, Homo sapiens
acgctacctctctgtccctt

SEQ ID NO: 3002287 - DNA, 14 bp, Homo sapiens
acgctccagctgcc

SEQ ID NO: 3002288 - DNA, 16 bp, Homo sapiens
acgctccagctgcccc

SEQ ID NO: 3002289 - DNA, 20 bp, Homo sapiens
acgctccgctgccgtgccgc

SEQ ID NO: 3002290 - DNA, 19 bp, Homo sapiens
acgctgaagcggtcagact

SEQ ID NO: 3002291 - DNA, 12 bp, Homo sapiens
acgctgaataaa

SEQ ID NO: 3002292 - DNA, 15 bp, Homo sapiens
acgctgcctgcccac

SEQ ID NO: 3002293 - DNA, 14 bp, Homo sapiens
acgctgcctgcccg

SEQ ID NO: 3002294 - DNA, 11 bp, Homo sapiens
acgctgtgctg

SEQ ID NO: 3002295 - DNA, 13 bp, Homo sapiens
acgctgtgctggt

SEQ ID NO: 3002296 - DNA, 14 bp, Homo sapiens
acgctttgattcat

SEQ ID NO: 3002297 - DNA, 16 bp, Homo sapiens
acgctttgattcatag

SEQ ID NO: 3002298 - DNA, 16 bp, Homo sapiens
acggacactgtggaga

SEQ ID NO: 3002299 - DNA, 19 bp, Homo sapiens
acggagagcgcctgcccct

SEQ ID NO: 3002300 - DNA, 19 bp, Homo sapiens
acggagcagttcagagtgg

SEQ ID NO: 3002301 - DNA, 21 bp, Homo sapiens
acggaggcctgcgaccctggg

SEQ ID NO: 3002302 - DNA, 19 bp, Homo sapiens
acggatgctccgaggactg

SEQ ID NO: 3002303 - DNA, 16 bp, Homo sapiens
acggcaacattcctca

SEQ ID NO: 3002304 - DNA, 13 bp, Homo sapiens
acggcaggcgtgt

SEQ ID NO: 3002305 - DNA, 16 bp, Homo sapiens
acggccaagaatgtac

SEQ ID NO: 3002306 - DNA, 18 bp, Homo sapiens
acggccacatcaaagagg

SEQ ID NO: 3002307 - DNA, 18 bp, Homo sapiens
acggccagggagaagctc

SEQ ID NO: 3002308 - DNA, 15 bp, Homo sapiens
acggccatgagactg

SEQ ID NO: 3002309 - DNA, 15 bp, Homo sapiens
actagaaatctgtcc

SEQ ID NO: 3002310 - DNA, 15 bp, Homo sapiens
actagaaattcttaa

SEQ ID NO: 3002311 - DNA, 17 bp, Homo sapiens
actagacaagccagaac

SEQ ID NO: 3002312 - DNA, 21 bp, Homo sapiens
actagactgaggagccctctc

SEQ ID NO: 3002313 - DNA, 21 bp, Homo sapiens
actagagggacctctcccagg

SEQ ID NO: 3002314 - DNA, 14 bp, Homo sapiens
actagagtgctctg

SEQ ID NO: 3002315 - DNA, 17 bp, Homo sapiens
actagatgacctcatta

SEQ ID NO: 3002316 - DNA, 16 bp, Homo sapiens
actagcctggccaaca

SEQ ID NO: 3002317 - DNA, 18 bp, Homo sapiens
actaggaaatccattcac

SEQ ID NO: 3002318 - DNA, 22 bp, Homo sapiens
actagggagccatgtttcacaa

SEQ ID NO: 3002319 - DNA, 20 bp, Homo sapiens
actagggatccctcatctgt

SEQ ID NO: 3002320 - DNA, 12 bp, Homo sapiens
actagggcctcg

SEQ ID NO: 3002321 - DNA, 17 bp, Homo sapiens
actagtagttctcttgg

SEQ ID NO: 3002322 - DNA, 16 bp, Homo sapiens
actagtcccttggata

SEQ ID NO: 3002323 - DNA, 18 bp, Homo sapiens
actagtgagtcagcacct

SEQ ID NO: 3002324 - DNA, 22 bp, Homo sapiens
actagtgtccgcataagaaaaa

SEQ ID NO: 3002325 - DNA, 13 bp, Homo sapiens
actagttacacat

SEQ ID NO: 3002326 - DNA, 21 bp, Homo sapiens
actagttgtgaccttagtgtt

SEQ ID NO: 3002327 - DNA, 19 bp, Homo sapiens
actcattttcatattgtaa

SEQ ID NO: 3002328 - DNA, 18 bp, Homo sapiens
actccaacctaacctgtg

SEQ ID NO: 3002329 - DNA, 21 bp, Homo sapiens
actccaagccccctggcagct

SEQ ID NO: 3002330 - DNA, 13 bp, Homo sapiens
actccaccaccca

SEQ ID NO: 3002331 - DNA, 16 bp, Homo sapiens
actccaccctctgcga

SEQ ID NO: 3002332 - DNA, 19 bp, Homo sapiens
actccagaattacccttcc

SEQ ID NO: 3002333 - DNA, 21 bp, Homo sapiens
actccagaattacccttcctc

SEQ ID NO: 3002334 - DNA, 16 bp, Homo sapiens
actccagcctgggtca

SEQ ID NO: 3002335 - DNA, 16 bp, Homo sapiens
actccagcctgggtga

SEQ ID NO: 3002336 - DNA, 16 bp, Homo sapiens
actccagctggtgccc

SEQ ID NO: 3002337 - DNA, 21 bp, Homo sapiens
actccagctggtgcccccaga

SEQ ID NO: 3002338 - DNA, 22 bp, Homo sapiens
actccagctggtgcccccagac

SEQ ID NO: 3002339 - DNA, 13 bp, Homo sapiens
actccaggcccaa

SEQ ID NO: 3002340 - DNA, 16 bp, Homo sapiens
actccaggcccaaggc

SEQ ID NO: 3002341 - DNA, 17 bp, Homo sapiens
actccaggcccaaggct

SEQ ID NO: 3002342 - DNA, 13 bp, Homo sapiens
actccaggctggg

SEQ ID NO: 3002343 - DNA, 14 bp, Homo sapiens
actccaggctgggc

SEQ ID NO: 3002344 - DNA, 20 bp, Homo sapiens
actccaggctgggctgagcc

SEQ ID NO: 3002345 - DNA, 16 bp, Homo sapiens
actccagggtcccctg

SEQ ID NO: 3002346 - DNA, 18 bp, Homo sapiens
actccagggtcccctgcc

SEQ ID NO: 3002347 - DNA, 20 bp, Homo sapiens
actccagggtcccctgccac

SEQ ID NO: 3002348 - DNA, 21 bp, Homo sapiens
actccagtgccaacaatccta

SEQ ID NO: 3002349 - DNA, 15 bp, Homo sapiens
actccatggttctca

SEQ ID NO: 3002350 - DNA, 17 bp, Homo sapiens
actccatggttctcaat

SEQ ID NO: 3002351 - DNA, 18 bp, Homo sapiens
actgtaaataaaaagaaa

SEQ ID NO: 3002352 - DNA, 19 bp, Homo sapiens
actgtaagaataatttata

SEQ ID NO: 3002353 - DNA, 11 bp, Homo sapiens
actgtacaata

SEQ ID NO: 3002354 - DNA, 18 bp, Homo sapiens
actgtacaataaaaacat

SEQ ID NO: 3002355 - DNA, 12 bp, Homo sapiens
actgtacagttt

SEQ ID NO: 3002356 - DNA, 13 bp, Homo sapiens
actgtacagtttt

SEQ ID NO: 3002357 - DNA, 17 bp, Homo sapiens
actgtagaactgatttt

SEQ ID NO: 3002358 - DNA, 20 bp, Homo sapiens
actgtagaactgattttaca

SEQ ID NO: 3002359 - DNA, 13 bp, Homo sapiens
actgtagttctaa

SEQ ID NO: 3002360 - DNA, 15 bp, Homo sapiens
actgtagttctaaga

SEQ ID NO: 3002361 - DNA, 16 bp, Homo sapiens
actgtagttctaagac

SEQ ID NO: 3002362 - DNA, 18 bp, Homo sapiens
actgtatattttaagaag

SEQ ID NO: 3002363 - DNA, 15 bp, Homo sapiens
actgtatctaggcaa

SEQ ID NO: 3002364 - DNA, 22 bp, Homo sapiens
actgtatttaaggaatcaaatc

SEQ ID NO: 3002365 - DNA, 15 bp, Homo sapiens
actgtatttgtgact

SEQ ID NO: 3002366 - DNA, 23 bp, Homo sapiens
actgtcactcattgctgagcctc

SEQ ID NO: 3002367 - DNA, 15 bp, Homo sapiens
actgtcatgcttcat

SEQ ID NO: 3002368 - DNA, 24 bp, Homo sapiens
actgtcatgcttcatcattccctc

SEQ ID NO: 3002369 - DNA, 21 bp, Homo sapiens
actgtcccagctaccaagtca

SEQ ID NO: 3002370 - DNA, 14 bp, Homo sapiens
actgtccctcctgg

SEQ ID NO: 3002371 - DNA, 15 bp, Homo sapiens
actgtccctcctggt

SEQ ID NO: 3002372 - DNA, 22 bp, Homo sapiens
actgtccctctcagtgccttct

SEQ ID NO: 3002373 - DNA, 18 bp, Homo sapiens
actgtcctccaagccagc

SEQ ID NO: 3002374 - DNA, 14 bp, Homo sapiens
actgtcctgggcct

SEQ ID NO: 3002375 - DNA, 17 bp, Homo sapiens
actgtctaagcagtttt

SEQ ID NO: 3002376 - DNA, 18 bp, Homo sapiens
actgtctctcttgtcaca

SEQ ID NO: 3002377 - DNA, 22 bp, Homo sapiens
actgtctctcttgtcacatgga

SEQ ID NO: 3002378 - DNA, 22 bp, Homo sapiens
actgtctgctgatataatatca

SEQ ID NO: 3002379 - DNA, 16 bp, Homo sapiens
actgtctgtacctaaa

SEQ ID NO: 3002380 - DNA, 20 bp, Homo sapiens
actgtctgtacctaaagcaa

SEQ ID NO: 3002381 - DNA, 12 bp, Homo sapiens
actgtcttaaat

SEQ ID NO: 3002382 - DNA, 14 bp, Homo sapiens
actgtcttaaatca

SEQ ID NO: 3002383 - DNA, 13 bp, Homo sapiens
actgtcttttaaa

SEQ ID NO: 3002384 - DNA, 19 bp, Homo sapiens
actgtgaaccaacccccat

SEQ ID NO: 3002385 - DNA, 15 bp, Homo sapiens
actgtgaaggaccct

SEQ ID NO: 3002386 - DNA, 21 bp, Homo sapiens
actgtgaagttacatgcataa

SEQ ID NO: 3002387 - DNA, 16 bp, Homo sapiens
actgtgaatgcttctg

SEQ ID NO: 3002388 - DNA, 20 bp, Homo sapiens
actgtgacaatgactaagcc

SEQ ID NO: 3002389 - DNA, 21 bp, Homo sapiens
actgtgacaatgactaagcca

SEQ ID NO: 3002390 - DNA, 22 bp, Homo sapiens
actgtgacaatgactaagccaa

SEQ ID NO: 3002391 - DNA, 13 bp, Homo sapiens
actgtgacacact

SEQ ID NO: 3002392 - DNA, 17 bp, Homo sapiens
actgtgacatcagaagt

SEQ ID NO: 3002393 - DNA, 21 bp, Homo sapiens
actgtgacccccagctccggc

SEQ ID NO: 3002394 - DNA, 20 bp, Homo sapiens
actgtgattactctttgctt

SEQ ID NO: 3002395 - DNA, 19 bp, Homo sapiens
actgtgcacatctgtgtct

SEQ ID NO: 3002396 - DNA, 20 bp, Homo sapiens
actgtgcacatctgtgtctt

SEQ ID NO: 3002397 - DNA, 12 bp, Homo sapiens
actgtgctccca

SEQ ID NO: 3002398 - DNA, 13 bp, Homo sapiens
actgtgctcccac

SEQ ID NO: 3002399 - DNA, 14 bp, Homo sapiens
actgtgctcccacg

SEQ ID NO: 3002400 - DNA, 20 bp, Homo sapiens
actgtgctcccacggggacc

SEQ ID NO: 3002401 - DNA, 15 bp, Homo sapiens
actgtgggcaattta

SEQ ID NO: 3002402 - DNA, 20 bp, Homo sapiens
actgtgggtgtgtgactctt

SEQ ID NO: 3002403 - DNA, 17 bp, Homo sapiens
actgtggtaaatgccac

SEQ ID NO: 3002404 - DNA, 13 bp, Homo sapiens
actgtgtctctat

SEQ ID NO: 3002405 - DNA, 18 bp, Homo sapiens
actgtgtctctatgtgaa

SEQ ID NO: 3002406 - DNA, 16 bp, Homo sapiens
actgtgtgtaattgtt

SEQ ID NO: 3002407 - DNA, 17 bp, Homo sapiens
actgtgtgtaattgttc

SEQ ID NO: 3002408 - DNA, 22 bp, Homo sapiens
actgtgtgtgtgaatgaacact

SEQ ID NO: 3002409 - DNA, 22 bp, Homo sapiens
actgtgtttctgtgctccaagt

SEQ ID NO: 3002410 - DNA, 18 bp, Homo sapiens
actgtgttttataaaata

SEQ ID NO: 3002411 - DNA, 19 bp, Homo sapiens
actgttaagaaatctgttt

SEQ ID NO: 3002412 - DNA, 15 bp, Homo sapiens
actgttaagaataat

SEQ ID NO: 3002413 - DNA, 22 bp, Homo sapiens
actgttaagaataataaaatac

SEQ ID NO: 3002414 - DNA, 16 bp, Homo sapiens
actgttactgggccct

SEQ ID NO: 3002415 - DNA, 19 bp, Homo sapiens
actgttccctgaggtggga

SEQ ID NO: 3002416 - DNA, 21 bp, Homo sapiens
actgttctaaagctctgacat

SEQ ID NO: 3002417 - DNA, 16 bp, Homo sapiens
actgttgataattctt

SEQ ID NO: 3002418 - DNA, 17 bp, Homo sapiens
actgttgataattctta

SEQ ID NO: 3002419 - DNA, 18 bp, Homo sapiens
actgttgataattcttat

SEQ ID NO: 3002420 - DNA, 19 bp, Homo sapiens
actgttgataattcttatt

SEQ ID NO: 3002421 - DNA, 23 bp, Homo sapiens
actgttgataattcttattttgt

SEQ ID NO: 3002422 - DNA, 13 bp, Homo sapiens
actgttgcagtgg

SEQ ID NO: 3002423 - DNA, 15 bp, Homo sapiens
actgttgcatagaat

SEQ ID NO: 3002424 - DNA, 21 bp, Homo sapiens
actgttggaattcactttatt

SEQ ID NO: 3002425 - DNA, 20 bp, Homo sapiens
actgttgtagaaattcttaa

SEQ ID NO: 3002426 - DNA, 21 bp, Homo sapiens
actgttgtagaaattcttaat

SEQ ID NO: 3002427 - DNA, 15 bp, Homo sapiens
actgttgtatctatg

SEQ ID NO: 3002428 - DNA, 13 bp, Homo sapiens
actgttgtgctcc

SEQ ID NO: 3002429 - DNA, 19 bp, Homo sapiens
actgttgtgctccatagag

SEQ ID NO: 3002430 - DNA, 20 bp, Homo sapiens
actgtttaatgttctgtgat

SEQ ID NO: 3002431 - DNA, 15 bp, Homo sapiens
actgtttcactgaaa

SEQ ID NO: 3002432 - DNA, 21 bp, Homo sapiens
actgtttgtttttatttaaat

SEQ ID NO: 3002433 - DNA, 14 bp, Homo sapiens
actgttttaaaaga

SEQ ID NO: 3002434 - DNA, 12 bp, Homo sapiens
actgtttttcca

SEQ ID NO: 3002435 - DNA, 19 bp, Homo sapiens
actgtttttccatagtttt

SEQ ID NO: 3002436 - DNA, 18 bp, Homo sapiens
actgtttttcggacagtt

SEQ ID NO: 3002437 - DNA, 19 bp, Homo sapiens
actgtttttcggacagttt

SEQ ID NO: 3002438 - DNA, 23 bp, Homo sapiens
acttaaaacaaaaggaaagaaac

SEQ ID NO: 3002439 - DNA, 16 bp, Homo sapiens
acttaaaatgtgcagt

SEQ ID NO: 3002440 - DNA, 20 bp, Homo sapiens
acttaaacagaagcagaggc

SEQ ID NO: 3002441 - DNA, 18 bp, Homo sapiens
acttaaacatcattggat

SEQ ID NO: 3002442 - DNA, 15 bp, Homo sapiens
acttaaacttcctta

SEQ ID NO: 3002443 - DNA, 18 bp, Homo sapiens
acttaataaaacatttta

SEQ ID NO: 3002444 - DNA, 21 bp, Homo sapiens
acttaatattagcttgcttaa

SEQ ID NO: 3002445 - DNA, 18 bp, Homo sapiens
acttaatcctttaactct

SEQ ID NO: 3002446 - DNA, 12 bp, Homo sapiens
acttacaaaaat

SEQ ID NO: 3002447 - DNA, 18 bp, Homo sapiens
acttacatactaggtgcc

SEQ ID NO: 3002448 - DNA, 21 bp, Homo sapiens
acttacattctctaataagaa

SEQ ID NO: 3002449 - DNA, 15 bp, Homo sapiens
acttacctgagaacc

SEQ ID NO: 3002450 - DNA, 16 bp, Homo sapiens
acttactgtaagacat

SEQ ID NO: 3002451 - DNA, 17 bp, Homo sapiens
acttactgtaagacatt

SEQ ID NO: 3002452 - DNA, 19 bp, Homo sapiens
acttagaacctttctgtgt

SEQ ID NO: 3002453 - DNA, 12 bp, Homo sapiens
acttagaaggat

SEQ ID NO: 3002454 - DNA, 17 bp, Homo sapiens
acttagatattaaaatt

SEQ ID NO: 3002455 - DNA, 21 bp, Homo sapiens
acttagatattaaaatttggt

SEQ ID NO: 3002456 - DNA, 19 bp, Homo sapiens
acttagatatttcatgtgc

SEQ ID NO: 3002457 - DNA, 16 bp, Homo sapiens
acttagctagttttat

SEQ ID NO: 3002458 - DNA, 20 bp, Homo sapiens
acttaggactacattttgct

SEQ ID NO: 3002459 - DNA, 16 bp, Homo sapiens
acttaggctttgtagc

SEQ ID NO: 3002460 - DNA, 17 bp, Homo sapiens
acttagtagattaaaaa

SEQ ID NO: 3002461 - DNA, 13 bp, Homo sapiens
acttataaggtgt

SEQ ID NO: 3002462 - DNA, 18 bp, Homo sapiens
acttatcatgtaaatgta

SEQ ID NO: 3002463 - DNA, 13 bp, Homo sapiens
acttatgatttca

SEQ ID NO: 3002464 - DNA, 17 bp, Homo sapiens
acttatgatttcatgtg

SEQ ID NO: 3002465 - DNA, 19 bp, Homo sapiens
acttattcttttataataa

SEQ ID NO: 3002466 - DNA, 19 bp, Homo sapiens
acttattgcctgggcagtg

SEQ ID NO: 3002467 - DNA, 20 bp, Homo sapiens
acttattgtggataacaaag

SEQ ID NO: 3002468 - DNA, 15 bp, Homo sapiens
acttatttaaaaata

SEQ ID NO: 3002469 - DNA, 16 bp, Homo sapiens
acttatttataaaaag

SEQ ID NO: 3002470 - DNA, 16 bp, Homo sapiens
acttatttatatgaag

SEQ ID NO: 3002471 - DNA, 19 bp, Homo sapiens
acttattttacacagcaat

SEQ ID NO: 3002472 - DNA, 18 bp, Homo sapiens
acttcaaaagtattttcc

SEQ ID NO: 3002473 - DNA, 13 bp, Homo sapiens
acttcacactgca

SEQ ID NO: 3002474 - DNA, 15 bp, Homo sapiens
acttcacactgcaag

SEQ ID NO: 3002475 - DNA, 23 bp, Homo sapiens
acttcacactgcaagagccttgg

SEQ ID NO: 3002476 - DNA, 14 bp, Homo sapiens
acttcagcaagaga

SEQ ID NO: 3002477 - DNA, 16 bp, Homo sapiens
acttcagcaagagaga

SEQ ID NO: 3002478 - DNA, 17 bp, Homo sapiens
acttcagcaagagagaa

SEQ ID NO: 3002479 - DNA, 19 bp, Homo sapiens
acttcagcaagctagaact

SEQ ID NO: 3002480 - DNA, 18 bp, Homo sapiens
acttcagcattgtaatta

SEQ ID NO: 3002481 - DNA, 21 bp, Homo sapiens
acttcaggtgtgactctagca

SEQ ID NO: 3002482 - DNA, 16 bp, Homo sapiens
acttcagtcctggtct

SEQ ID NO: 3002483 - DNA, 13 bp, Homo sapiens
agaataaaagttc

SEQ ID NO: 3002484 - DNA, 17 bp, Homo sapiens
agaataaaagttcctct

SEQ ID NO: 3002485 - DNA, 13 bp, Homo sapiens
agaataagttatt

SEQ ID NO: 3002486 - DNA, 14 bp, Homo sapiens
agaataagttattg

SEQ ID NO: 3002487 - DNA, 17 bp, Homo sapiens
agaataagttattgcag

SEQ ID NO: 3002488 - DNA, 21 bp, Homo sapiens
agaataagttattgcagttta

SEQ ID NO: 3002489 - DNA, 20 bp, Homo sapiens
agaatacaatgggaaaagag

SEQ ID NO: 3002490 - DNA, 17 bp, Homo sapiens
agaatactgccaaaaca

SEQ ID NO: 3002491 - DNA, 14 bp, Homo sapiens
agaatacttgaact

SEQ ID NO: 3002492 - DNA, 15 bp, Homo sapiens
agaatagagctgcca

SEQ ID NO: 3002493 - DNA, 20 bp, Homo sapiens
agaatagagctgccactggg

SEQ ID NO: 3002494 - DNA, 13 bp, Homo sapiens
agaatagcatctg

SEQ ID NO: 3002495 - DNA, 20 bp, Homo sapiens
agaatagccacatttggaat

SEQ ID NO: 3002496 - DNA, 21 bp, Homo sapiens
agaatataatatttgaagcag

SEQ ID NO: 3002497 - DNA, 23 bp, Homo sapiens
agaatataatatttgaagcagct

SEQ ID NO: 3002498 - DNA, 13 bp, Homo sapiens
agaatatgtctgc

SEQ ID NO: 3002499 - DNA, 13 bp, Homo sapiens
agaatcacaatag

SEQ ID NO: 3002500 - DNA, 15 bp, Homo sapiens
agaatcacagctcaa

SEQ ID NO: 3002501 - DNA, 17 bp, Homo sapiens
agaatccacatttctaa

SEQ ID NO: 3002502 - DNA, 18 bp, Homo sapiens
agaatccacatttctaaa

SEQ ID NO: 3002503 - DNA, 19 bp, Homo sapiens
agaatccacatttctaaaa

SEQ ID NO: 3002504 - DNA, 22 bp, Homo sapiens
agaatccacatttctaaaatct

SEQ ID NO: 3002505 - DNA, 20 bp, Homo sapiens
agaatccagcaccggcccca

SEQ ID NO: 3002506 - DNA, 14 bp, Homo sapiens
agaatcctgggccc

SEQ ID NO: 3002507 - DNA, 19 bp, Homo sapiens
agaatcctgggcccccaga

SEQ ID NO: 3002508 - DNA, 17 bp, Homo sapiens
agaatcggcagtatttt

SEQ ID NO: 3002509 - DNA, 20 bp, Homo sapiens
agaatcggcagtattttctg

SEQ ID NO: 3002510 - DNA, 22 bp, Homo sapiens
agaatcggcagtattttctgtt

SEQ ID NO: 3002511 - DNA, 21 bp, Homo sapiens
agaatcggcatgtatacttaa

SEQ ID NO: 3002512 - DNA, 14 bp, Homo sapiens
agaatctatagtga

SEQ ID NO: 3002513 - DNA, 20 bp, Homo sapiens
agaatctctatgtatattct

SEQ ID NO: 3002514 - DNA, 14 bp, Homo sapiens
agaatgaaaaatga

SEQ ID NO: 3002515 - DNA, 15 bp, Homo sapiens
agaatgaaaaatgaa

SEQ ID NO: 3002516 - DNA, 22 bp, Homo sapiens
agaatgaaaaatgaaagatgat

SEQ ID NO: 3002517 - DNA, 19 bp, Homo sapiens
agaatgaaagagtaaagga

SEQ ID NO: 3002518 - DNA, 16 bp, Homo sapiens
agaatgaaatgtatgt

SEQ ID NO: 3002519 - DNA, 19 bp, Homo sapiens
agaatgaagaactgcatgt

SEQ ID NO: 3002520 - DNA, 22 bp, Homo sapiens
agaatgacggaataagagacct

SEQ ID NO: 3002521 - DNA, 14 bp, Homo sapiens
agaatgagagtgtg

SEQ ID NO: 3002522 - DNA, 21 bp, Homo sapiens
agaatgagcctacgctgaaga

SEQ ID NO: 3002523 - DNA, 17 bp, Homo sapiens
agaatgaggaatagttt

SEQ ID NO: 3002524 - DNA, 14 bp, Homo sapiens
agaatgaggctgct

SEQ ID NO: 3002525 - DNA, 23 bp, Homo sapiens
agaatgcagcccaccaggagcac

SEQ ID NO: 3002526 - DNA, 12 bp, Homo sapiens
agaatgcattga

SEQ ID NO: 3002527 - DNA, 21 bp, Homo sapiens
agaatgcattgatattgtgaa

SEQ ID NO: 3002528 - DNA, 20 bp, Homo sapiens
agaatgctgtacatctattt

SEQ ID NO: 3002529 - DNA, 15 bp, Homo sapiens
agaatggaggcaggg

SEQ ID NO: 3002530 - DNA, 12 bp, Homo sapiens
agaatgtaaagc

SEQ ID NO: 3002531 - DNA, 21 bp, Homo sapiens
agaatgtacgtccagcctgcc

SEQ ID NO: 3002532 - DNA, 12 bp, Homo sapiens
agaatgtattgt

SEQ ID NO: 3002533 - DNA, 14 bp, Homo sapiens
agaatgtattgtac

SEQ ID NO: 3002534 - DNA, 15 bp, Homo sapiens
agaatgtattgtacc

SEQ ID NO: 3002535 - DNA, 21 bp, Homo sapiens
agaatgtattgtaccttttaa

SEQ ID NO: 3002536 - DNA, 22 bp, Homo sapiens
agaatgtattgtaccttttaac

SEQ ID NO: 3002537 - DNA, 16 bp, Homo sapiens
agaatgtgtttcaaac

SEQ ID NO: 3002538 - DNA, 21 bp, Homo sapiens
agaatgttaagacttgacagt

SEQ ID NO: 3002539 - DNA, 16 bp, Homo sapiens
agaatgttttgcactg

SEQ ID NO: 3002540 - DNA, 15 bp, Homo sapiens
agaattaatggtcat

SEQ ID NO: 3002541 - DNA, 15 bp, Homo sapiens
agaattacccttcct

SEQ ID NO: 3002542 - DNA, 20 bp, Homo sapiens
agaattactgtaactgatta

SEQ ID NO: 3002543 - DNA, 22 bp, Homo sapiens
agaattagctttttcatcccct

SEQ ID NO: 3002544 - DNA, 20 bp, Homo sapiens
agaattcaaactggggcctc

SEQ ID NO: 3002545 - DNA, 19 bp, Homo sapiens
agaattccatagtggacca

SEQ ID NO: 3002546 - DNA, 20 bp, Homo sapiens
agaattccttcagggtgatg

SEQ ID NO: 3002547 - DNA, 15 bp, Homo sapiens
agaattctagctttt

SEQ ID NO: 3002548 - DNA, 19 bp, Homo sapiens
agaattctgggaaccctgt

SEQ ID NO: 3002549 - DNA, 17 bp, Homo sapiens
agaattcttcaggtgga

SEQ ID NO: 3002550 - DNA, 21 bp, Homo sapiens
acttgaagaatattcccaata

SEQ ID NO: 3002551 - DNA, 14 bp, Homo sapiens
acttgaagggccag

SEQ ID NO: 3002552 - DNA, 17 bp, Homo sapiens
acttgaagggccagagc

SEQ ID NO: 3002553 - DNA, 18 bp, Homo sapiens
acttgaagggccagagcc

SEQ ID NO: 3002554 - DNA, 20 bp, Homo sapiens
acttgaagggccagagccag

SEQ ID NO: 3002555 - DNA, 21 bp, Homo sapiens
acttgaagggccagagccagg

SEQ ID NO: 3002556 - DNA, 14 bp, Homo sapiens
acttgaatccattg

SEQ ID NO: 3002557 - DNA, 22 bp, Homo sapiens
acttgaatttggtctgtatagt

SEQ ID NO: 3002558 - DNA, 12 bp, Homo sapiens
acttgacagtgg

SEQ ID NO: 3002559 - DNA, 14 bp, Homo sapiens
acttgaccctgagc

SEQ ID NO: 3002560 - DNA, 15 bp, Homo sapiens
acttgaccctgagct

SEQ ID NO: 3002561 - DNA, 17 bp, Homo sapiens
acttgacttttaaggct

SEQ ID NO: 3002562 - DNA, 11 bp, Homo sapiens
acttgagcctg

SEQ ID NO: 3002563 - DNA, 21 bp, Homo sapiens
acttgaggtggcctccttgct

SEQ ID NO: 3002564 - DNA, 20 bp, Homo sapiens
acttgagtgttcctttttaa

SEQ ID NO: 3002565 - DNA, 22 bp, Homo sapiens
acttgagtgttcctttttaaat

SEQ ID NO: 3002566 - DNA, 17 bp, Homo sapiens
acttgatcacatgcttg

SEQ ID NO: 3002567 - DNA, 20 bp, Homo sapiens
acttgatcacatgcttgaat

SEQ ID NO: 3002568 - DNA, 19 bp, Homo sapiens
acttgatgtttcctggaag

SEQ ID NO: 3002569 - DNA, 23 bp, Homo sapiens
acttgatgtttcctggaagcaga

SEQ ID NO: 3002570 - DNA, 13 bp, Homo sapiens
acttgatttcttc

SEQ ID NO: 3002571 - DNA, 21 bp, Homo sapiens
acttgcagaggagcccagtgg

SEQ ID NO: 3002572 - DNA, 22 bp, Homo sapiens
acttgccaagcagtgcacattt

SEQ ID NO: 3002573 - DNA, 13 bp, Homo sapiens
acttgccagggct

SEQ ID NO: 3002574 - DNA, 16 bp, Homo sapiens
acttgccctgctccct

SEQ ID NO: 3002575 - DNA, 22 bp, Homo sapiens
acttgccgcgtcgccctcccag

SEQ ID NO: 3002576 - DNA, 23 bp, Homo sapiens
acttgccgcgtcgccctcccagg

SEQ ID NO: 3002577 - DNA, 24 bp, Homo sapiens
acttgccttcctaagcctgtggct

SEQ ID NO: 3002578 - DNA, 22 bp, Homo sapiens
acttgctcaggtacttgtaaat

SEQ ID NO: 3002579 - DNA, 16 bp, Homo sapiens
acttggaaataaacca

SEQ ID NO: 3002580 - DNA, 14 bp, Homo sapiens
acttggaaatgaca

SEQ ID NO: 3002581 - DNA, 21 bp, Homo sapiens
acttggacttgtcctcagcag

SEQ ID NO: 3002582 - DNA, 16 bp, Homo sapiens
acttggagaatactgc

SEQ ID NO: 3002583 - DNA, 17 bp, Homo sapiens
acttggagatctttgct

SEQ ID NO: 3002584 - DNA, 19 bp, Homo sapiens
acttggagatctttgcttc

SEQ ID NO: 3002585 - DNA, 17 bp, Homo sapiens
acttggatcccaaagca

SEQ ID NO: 3002586 - DNA, 13 bp, Homo sapiens
acttgggaatata

SEQ ID NO: 3002587 - DNA, 20 bp, Homo sapiens
acttggggagatggagttct

SEQ ID NO: 3002588 - DNA, 18 bp, Homo sapiens
acttggggagatttgcca

SEQ ID NO: 3002589 - DNA, 21 bp, Homo sapiens
acttggggagttaagacctgg

SEQ ID NO: 3002590 - DNA, 23 bp, Homo sapiens
acttggggagttaagacctggca

SEQ ID NO: 3002591 - DNA, 20 bp, Homo sapiens
acttgggggttcaggcccgg

SEQ ID NO: 3002592 - DNA, 19 bp, Homo sapiens
acttggttgggtcagattt

SEQ ID NO: 3002593 - DNA, 20 bp, Homo sapiens
acttgtaaaggaatttaaaa

SEQ ID NO: 3002594 - DNA, 17 bp, Homo sapiens
acttgtaaataaagtct

SEQ ID NO: 3002595 - DNA, 19 bp, Homo sapiens
acttgtaggaatctgcctt

SEQ ID NO: 3002596 - DNA, 20 bp, Homo sapiens
acttgtaggacttttaaaca

SEQ ID NO: 3002597 - DNA, 22 bp, Homo sapiens
acttgtaggacttttaaacaaa

SEQ ID NO: 3002598 - DNA, 14 bp, Homo sapiens
acttgtcaaagaag

SEQ ID NO: 3002599 - DNA, 18 bp, Homo sapiens
acttgtcaaagaaggttt

SEQ ID NO: 3002600 - DNA, 14 bp, Homo sapiens
acttgtcacttgca

SEQ ID NO: 3002601 - DNA, 15 bp, Homo sapiens
acttgtcacttgcat

SEQ ID NO: 3002602 - DNA, 18 bp, Homo sapiens
acttgtcccactatctgg

SEQ ID NO: 3002603 - DNA, 15 bp, Homo sapiens
acttgtgagcatcag

SEQ ID NO: 3002604 - DNA, 13 bp, Homo sapiens
acttgtgccagcc

SEQ ID NO: 3002605 - DNA, 14 bp, Homo sapiens
acttgtgccagccc

SEQ ID NO: 3002606 - DNA, 13 bp, Homo sapiens
acttgtgggtcct

SEQ ID NO: 3002607 - DNA, 17 bp, Homo sapiens
acttgtgggtcctgggg

SEQ ID NO: 3002608 - DNA, 13 bp, Homo sapiens
acttgtgttactt

SEQ ID NO: 3002609 - DNA, 19 bp, Homo sapiens
acttgttctcagagcactg

SEQ ID NO: 3002610 - DNA, 18 bp, Homo sapiens
actttaaaactgtattta

SEQ ID NO: 3002611 - DNA, 12 bp, Homo sapiens
actttaaaagtg

SEQ ID NO: 3002612 - DNA, 14 bp, Homo sapiens
actttaatttatgt

SEQ ID NO: 3002613 - DNA, 22 bp, Homo sapiens
actttaatttatgtaacttgaa

SEQ ID NO: 3002614 - DNA, 20 bp, Homo sapiens
actttacactcggctttgga

SEQ ID NO: 3002615 - DNA, 15 bp, Homo sapiens
actttactaagatga

SEQ ID NO: 3002616 - DNA, 16 bp, Homo sapiens
actttactaagatgac

SEQ ID NO: 3002617 - DNA, 22 bp, Homo sapiens
actttactaagatgacattgct

SEQ ID NO: 3002618 - DNA, 18 bp, Homo sapiens
actttagaaagctgacat

SEQ ID NO: 3002619 - DNA, 20 bp, Homo sapiens
actttagggggtgggagggg

SEQ ID NO: 3002620 - DNA, 17 bp, Homo sapiens
actttagtgattgcttt

SEQ ID NO: 3002621 - DNA, 14 bp, Homo sapiens
actttatcaaagat

SEQ ID NO: 3002622 - DNA, 16 bp, Homo sapiens
actttatgaagtgcta

SEQ ID NO: 3002623 - DNA, 22 bp, Homo sapiens
actttatgtagagaaaaggagg

SEQ ID NO: 3002624 - DNA, 21 bp, Homo sapiens
actttatgtgtaaatacataa

SEQ ID NO: 3002625 - DNA, 14 bp, Homo sapiens
actttatgttctaa

SEQ ID NO: 3002626 - DNA, 13 bp, Homo sapiens
actttatttctga

SEQ ID NO: 3002627 - DNA, 22 bp, Homo sapiens
actttattttctataatttaaa

SEQ ID NO: 3002628 - DNA, 15 bp, Homo sapiens
actttatttttctga

SEQ ID NO: 3002629 - DNA, 17 bp, Homo sapiens
actttatttttctgata

SEQ ID NO: 3002630 - DNA, 17 bp, Homo sapiens
actttcaaaagagtaga

SEQ ID NO: 3002631 - DNA, 11 bp, Homo sapiens
actttcagttt

SEQ ID NO: 3002632 - DNA, 14 bp, Homo sapiens
agaaagatgtatat

SEQ ID NO: 3002633 - DNA, 13 bp, Homo sapiens
agaaagattttat

SEQ ID NO: 3002634 - DNA, 11 bp, Homo sapiens
agaaagcactt

SEQ ID NO: 3002635 - DNA, 14 bp, Homo sapiens
agaaagcccacctg

SEQ ID NO: 3002636 - DNA, 21 bp, Homo sapiens
agaaagcccacctgggctggg

SEQ ID NO: 3002637 - DNA, 14 bp, Homo sapiens
agaaagctgacatt

SEQ ID NO: 3002638 - DNA, 14 bp, Homo sapiens
agaaaggaacattt

SEQ ID NO: 3002639 - DNA, 13 bp, Homo sapiens
agaaaggagagaa

SEQ ID NO: 3002640 - DNA, 16 bp, Homo sapiens
agaaagggaaactggc

SEQ ID NO: 3002641 - DNA, 17 bp, Homo sapiens
agaaagggagaggaaga

SEQ ID NO: 3002642 - DNA, 15 bp, Homo sapiens
agaaagggaggccca

SEQ ID NO: 3002643 - DNA, 16 bp, Homo sapiens
agaaagggaggcccag

SEQ ID NO: 3002644 - DNA, 15 bp, Homo sapiens
agaaagtgaagcaaa

SEQ ID NO: 3002645 - DNA, 19 bp, Homo sapiens
agaaagtggaaaacaagga

SEQ ID NO: 3002646 - DNA, 19 bp, Homo sapiens
agaaagtggtcttaagaaa

SEQ ID NO: 3002647 - DNA, 21 bp, Homo sapiens
agaaagtggtcttaagaaatg

SEQ ID NO: 3002648 - DNA, 14 bp, Homo sapiens
agaaagtggtgctc

SEQ ID NO: 3002649 - DNA, 18 bp, Homo sapiens
agaaataaagtttgctta

SEQ ID NO: 3002650 - DNA, 23 bp, Homo sapiens
agaaataaattcctaaactccct

SEQ ID NO: 3002651 - DNA, 17 bp, Homo sapiens
agaaataaatttatttc

SEQ ID NO: 3002652 - DNA, 17 bp, Homo sapiens
agaaataataaaaagaa

SEQ ID NO: 3002653 - DNA, 13 bp, Homo sapiens
agaaatataaaca

SEQ ID NO: 3002654 - DNA, 17 bp, Homo sapiens
agaaatatggacactta

SEQ ID NO: 3002655 - DNA, 21 bp, Homo sapiens
agaaatcaattttttaaacca

SEQ ID NO: 3002656 - DNA, 20 bp, Homo sapiens
agaaatccccccttcagaac

SEQ ID NO: 3002657 - DNA, 23 bp, Homo sapiens
agaaatctagtatttcatgctgg

SEQ ID NO: 3002658 - DNA, 20 bp, Homo sapiens
agaaatctcccatgtgcata

SEQ ID NO: 3002659 - DNA, 13 bp, Homo sapiens
agaaatctgtttt

SEQ ID NO: 3002660 - DNA, 22 bp, Homo sapiens
agaaatgaggaggatgctaaaa

SEQ ID NO: 3002661 - DNA, 23 bp, Homo sapiens
agaaatgaggtagctgacacaga

SEQ ID NO: 3002662 - DNA, 18 bp, Homo sapiens
agaaatgatgttggagaa

SEQ ID NO: 3002663 - DNA, 16 bp, Homo sapiens
agaaatggaaattttg

SEQ ID NO: 3002664 - DNA, 22 bp, Homo sapiens
agaaatggctaataaactttgt

SEQ ID NO: 3002665 - DNA, 19 bp, Homo sapiens
agaaatggtgagattgttt

SEQ ID NO: 3002666 - DNA, 18 bp, Homo sapiens
agaaatggtttcctctgg

SEQ ID NO: 3002667 - DNA, 12 bp, Homo sapiens
agaaatgtaatg

SEQ ID NO: 3002668 - DNA, 21 bp, Homo sapiens
agaaatgtaatgcgattttat

SEQ ID NO: 3002669 - DNA, 22 bp, Homo sapiens
agaaatgtaatgcgattttatt

SEQ ID NO: 3002670 - DNA, 17 bp, Homo sapiens
agaaatgtagcagcagc

SEQ ID NO: 3002671 - DNA, 23 bp, Homo sapiens
agaaatgtattttgaaaacactt

SEQ ID NO: 3002672 - DNA, 16 bp, Homo sapiens
agaaattatctttagt

SEQ ID NO: 3002673 - DNA, 13 bp, Homo sapiens
agaaattctcttt

SEQ ID NO: 3002674 - DNA, 18 bp, Homo sapiens
agaaattctgaagagagt

SEQ ID NO: 3002675 - DNA, 20 bp, Homo sapiens
agaaattgcctatcctgctg

SEQ ID NO: 3002676 - DNA, 21 bp, Homo sapiens
agaaatttttcagatgcttct

SEQ ID NO: 3002677 - DNA, 22 bp, Homo sapiens
agaaatttttcagatgcttctg

SEQ ID NO: 3002678 - DNA, 23 bp, Homo sapiens
agaaatttttcagatgcttctgg

SEQ ID NO: 3002679 - DNA, 12 bp, Homo sapiens
agaacaaaaact

SEQ ID NO: 3002680 - DNA, 13 bp, Homo sapiens
agaacaaaaacta

SEQ ID NO: 3002681 - DNA, 17 bp, Homo sapiens
agaacaaagagtgaaat

SEQ ID NO: 3002682 - DNA, 18 bp, Homo sapiens
agaacaaagagtgaaata

SEQ ID NO: 3002683 - DNA, 20 bp, Homo sapiens
agaacaaagagtgaaatatt

SEQ ID NO: 3002684 - DNA, 21 bp, Homo sapiens
agaacaaaggacagagtatga

SEQ ID NO: 3002685 - DNA, 22 bp, Homo sapiens
agaacaaaggacagagtatgaa

SEQ ID NO: 3002686 - DNA, 17 bp, Homo sapiens
agaacaacaaggacaac

SEQ ID NO: 3002687 - DNA, 19 bp, Homo sapiens
agaacaataggtaaagcta

SEQ ID NO: 3002688 - DNA, 19 bp, Homo sapiens
agaacaatattgactttgt

SEQ ID NO: 3002689 - DNA, 15 bp, Homo sapiens
agaacaatgtgctat

SEQ ID NO: 3002690 - DNA, 11 bp, Homo sapiens
agaacacctgg

SEQ ID NO: 3002691 - DNA, 11 bp, Homo sapiens
agaacagaaat

SEQ ID NO: 3002692 - DNA, 21 bp, Homo sapiens
agaacagaaatatataaaaat

SEQ ID NO: 3002693 - DNA, 14 bp, Homo sapiens
agaacagaggcatt

SEQ ID NO: 3002694 - DNA, 18 bp, Homo sapiens
agaacagatgctgagcca

SEQ ID NO: 3002695 - DNA, 20 bp, Homo sapiens
agaacagggaaaataggcag

SEQ ID NO: 3002696 - DNA, 22 bp, Homo sapiens
agaacagggaaaataggcagga

SEQ ID NO: 3002697 - DNA, 15 bp, Homo sapiens
agaacagtgtttgat

SEQ ID NO: 3002698 - DNA, 16 bp, Homo sapiens
agaacagtgtttgatt

SEQ ID NO: 3002699 - DNA, 21 bp, Homo sapiens
agaacagtgtttgatttttat

SEQ ID NO: 3002700 - DNA, 16 bp, Homo sapiens
agaacatccctgccag

SEQ ID NO: 3002701 - DNA, 17 bp, Homo sapiens
agaacatccctgccagc

SEQ ID NO: 3002702 - DNA, 16 bp, Homo sapiens
agaacatgcagtttga

SEQ ID NO: 3002703 - DNA, 17 bp, Homo sapiens
agaacatgcagtttgaa

SEQ ID NO: 3002704 - DNA, 23 bp, Homo sapiens
agaacatgcagtttgaaattctg

SEQ ID NO: 3002705 - DNA, 22 bp, Homo sapiens
agaacatggtgtgtgtctctga

SEQ ID NO: 3002706 - DNA, 22 bp, Homo sapiens
agaacatgtgagaggtttgact

SEQ ID NO: 3002707 - DNA, 17 bp, Homo sapiens
agaaccaaagctcaaat

SEQ ID NO: 3002708 - DNA, 16 bp, Homo sapiens
agaaccaccaaaatta

SEQ ID NO: 3002709 - DNA, 23 bp, Homo sapiens
agaaccaccccggccccctgccc

SEQ ID NO: 3002710 - DNA, 13 bp, Homo sapiens
agaaccactatga

SEQ ID NO: 3002711 - DNA, 16 bp, Homo sapiens
agaaccagcagaacag

SEQ ID NO: 3002712 - DNA, 16 bp, Homo sapiens
agaaccagtcccccca

SEQ ID NO: 3002713 - DNA, 19 bp, Homo sapiens
agaaccagtccccccaccc

SEQ ID NO: 3002714 - DNA, 20 bp, Homo sapiens
agaaccagtccccccaccct

SEQ ID NO: 3002715 - DNA, 15 bp, Homo sapiens
agaaccatgcaggaa

SEQ ID NO: 3002716 - DNA, 18 bp, Homo sapiens
agaaccatgcaggaagga

SEQ ID NO: 3002717 - DNA, 17 bp, Homo sapiens
agaacccttctgctttc

SEQ ID NO: 3002718 - DNA, 20 bp, Homo sapiens
agaacccttggcttgcccac

SEQ ID NO: 3002719 - DNA, 22 bp, Homo sapiens
agaacctcacgcacctcccatc

SEQ ID NO: 3002720 - DNA, 21 bp, Homo sapiens
agaacctggaacttggggagt

SEQ ID NO: 3002721 - DNA, 22 bp, Homo sapiens
agaacgaacacaagaaaaagat

SEQ ID NO: 3002722 - DNA, 16 bp, Homo sapiens
agaacgagcctggaag

SEQ ID NO: 3002723 - DNA, 17 bp, Homo sapiens
agaacgagcctggaagc

SEQ ID NO: 3002724 - DNA, 18 bp, Homo sapiens
agaacgaggattttaatt

SEQ ID NO: 3002725 - DNA, 16 bp, Homo sapiens
agaacgttttttcctc

SEQ ID NO: 3002726 - DNA, 20 bp, Homo sapiens
agaacgttttttcctcagtg

SEQ ID NO: 3002727 - DNA, 18 bp, Homo sapiens
agaactaaaggtggccac

SEQ ID NO: 3002728 - DNA, 20 bp, Homo sapiens
agaactaaaggtggccacaa

SEQ ID NO: 3002729 - DNA, 17 bp, Homo sapiens
agaactagaatttgatt

SEQ ID NO: 3002730 - DNA, 17 bp, Homo sapiens
agaactattgtgttttt

SEQ ID NO: 3002731 - DNA, 19 bp, Homo sapiens
agaactcactggggcctac

SEQ ID NO: 3002732 - DNA, 15 bp, Homo sapiens
agaactcatcactgt

SEQ ID NO: 3002733 - DNA, 22 bp, Homo sapiens
agaactccagctggtgccccca

SEQ ID NO: 3002734 - DNA, 23 bp, Homo sapiens
agaactccagctggtgcccccag

SEQ ID NO: 3002735 - DNA, 11 bp, Homo sapiens
agaactcctag

SEQ ID NO: 3002736 - DNA, 14 bp, Homo sapiens
agaactcctagggt

SEQ ID NO: 3002737 - DNA, 13 bp, Homo sapiens
agaactctctgtc

SEQ ID NO: 3002738 - DNA, 20 bp, Homo sapiens
agaactctctgtcttctctc

SEQ ID NO: 3002739 - DNA, 21 bp, Homo sapiens
agaactctctgtcttctctcc

SEQ ID NO: 3002740 - DNA, 12 bp, Homo sapiens
agaactgaaaag

SEQ ID NO: 3002741 - DNA, 21 bp, Homo sapiens
agaactgaaataaaaaattat

SEQ ID NO: 3002742 - DNA, 15 bp, Homo sapiens
agaactgaatgagaa

SEQ ID NO: 3002743 - DNA, 16 bp, Homo sapiens
agaactgagcatctcc

SEQ ID NO: 3002744 - DNA, 19 bp, Homo sapiens
agaactgcatatgtttcgc

SEQ ID NO: 3002745 - DNA, 20 bp, Homo sapiens
agaactgcatatgtttcgct

SEQ ID NO: 3002746 - DNA, 19 bp, Homo sapiens
agaactgcatgtggcttct

SEQ ID NO: 3002747 - DNA, 20 bp, Homo sapiens
agaactggttcttgccttcc

SEQ ID NO: 3002748 - DNA, 16 bp, Homo sapiens
agaacttcagcattgt

SEQ ID NO: 3002749 - DNA, 18 bp, Homo sapiens
agaagaaaacaaagttct

SEQ ID NO: 3002750 - DNA, 15 bp, Homo sapiens
agaagaaaacatcta

SEQ ID NO: 3002751 - DNA, 13 bp, Homo sapiens
agaagaaaacatt

SEQ ID NO: 3002752 - DNA, 17 bp, Homo sapiens
agaagaaccgacccacc

SEQ ID NO: 3002753 - DNA, 16 bp, Homo sapiens
agaagaagtgaacact

SEQ ID NO: 3002754 - DNA, 18 bp, Homo sapiens
agaagaagtgaacactta

SEQ ID NO: 3002755 - DNA, 14 bp, Homo sapiens
agaagaagtgcttg

SEQ ID NO: 3002756 - DNA, 19 bp, Homo sapiens
agaagaattaagctgtgca

SEQ ID NO: 3002757 - DNA, 19 bp, Homo sapiens
agaagaattgaacccagga

SEQ ID NO: 3002758 - DNA, 13 bp, Homo sapiens
agaagacaaaatt

SEQ ID NO: 3002759 - DNA, 19 bp, Homo sapiens
agaagagatgagaaatgat

SEQ ID NO: 3002760 - DNA, 11 bp, Homo sapiens
agaagagccac

SEQ ID NO: 3002761 - DNA, 14 bp, Homo sapiens
agaagagccatctt

SEQ ID NO: 3002762 - DNA, 20 bp, Homo sapiens
agaagagccggagcctccag

SEQ ID NO: 3002763 - DNA, 13 bp, Homo sapiens
agaagaggaggag

SEQ ID NO: 3002764 - DNA, 14 bp, Homo sapiens
aaattaaagtgctg

SEQ ID NO: 3002765 - DNA, 17 bp, Homo sapiens
aaattaaagtgctgttt

SEQ ID NO: 3002766 - DNA, 16 bp, Homo sapiens
aaattaaagtttgctt

SEQ ID NO: 3002767 - DNA, 18 bp, Homo sapiens
aaattaacagaaaaacag

SEQ ID NO: 3002768 - DNA, 21 bp, Homo sapiens
aaattaacagtattaaatgac

SEQ ID NO: 3002769 - DNA, 20 bp, Homo sapiens
aaattaaccatagatgtaga

SEQ ID NO: 3002770 - DNA, 15 bp, Homo sapiens
aaattaagaaggcaa

SEQ ID NO: 3002771 - DNA, 14 bp, Homo sapiens
aaattaatagcttt

SEQ ID NO: 3002772 - DNA, 14 bp, Homo sapiens
aaattaatattgta

SEQ ID NO: 3002773 - DNA, 13 bp, Homo sapiens
aaattaatgattc

SEQ ID NO: 3002774 - DNA, 13 bp, Homo sapiens
aaattacaactaa

SEQ ID NO: 3002775 - DNA, 21 bp, Homo sapiens
aaattacttatcatccacatt

SEQ ID NO: 3002776 - DNA, 20 bp, Homo sapiens
aaattactttgattccattt

SEQ ID NO: 3002777 - DNA, 22 bp, Homo sapiens
aaattactttgattccatttta

SEQ ID NO: 3002778 - DNA, 15 bp, Homo sapiens
aaattataaagataa

SEQ ID NO: 3002779 - DNA, 17 bp, Homo sapiens
aaattatagatgggaat

SEQ ID NO: 3002780 - DNA, 15 bp, Homo sapiens
aaattatatagcaaa

SEQ ID NO: 3002781 - DNA, 23 bp, Homo sapiens
aaattatctttagttgaattcca

SEQ ID NO: 3002782 - DNA, 14 bp, Homo sapiens
aaattatgagattt

SEQ ID NO: 3002783 - DNA, 12 bp, Homo sapiens
aaattatgtttt

SEQ ID NO: 3002784 - DNA, 14 bp, Homo sapiens
aaattatgttttta

SEQ ID NO: 3002785 - DNA, 16 bp, Homo sapiens
aaattatgtttttatt

SEQ ID NO: 3002786 - DNA, 19 bp, Homo sapiens
aaattatgtttttattaag

SEQ ID NO: 3002787 - DNA, 13 bp, Homo sapiens
aaattatttgcat

SEQ ID NO: 3002788 - DNA, 23 bp, Homo sapiens
aaattatttttaaaagaaaaaaa

SEQ ID NO: 3002789 - DNA, 19 bp, Homo sapiens
aaattcacaagttgtgttt

SEQ ID NO: 3002790 - DNA, 17 bp, Homo sapiens
aaattcacagaagccta

SEQ ID NO: 3002791 - DNA, 19 bp, Homo sapiens
aaattcactgtttcactga

SEQ ID NO: 3002792 - DNA, 12 bp, Homo sapiens
aaattcagtctt

SEQ ID NO: 3002793 - DNA, 22 bp, Homo sapiens
aaattcagtcttttctctgaaa

SEQ ID NO: 3002794 - DNA, 17 bp, Homo sapiens
aaattcatattctttta

SEQ ID NO: 3002795 - DNA, 12 bp, Homo sapiens
aaattcatttct

SEQ ID NO: 3002796 - DNA, 12 bp, Homo sapiens
aaattcccatga

SEQ ID NO: 3002797 - DNA, 22 bp, Homo sapiens
aaattccccatatttgtgttca

SEQ ID NO: 3002798 - DNA, 20 bp, Homo sapiens
aaattcctctttgctttgct

SEQ ID NO: 3002799 - DNA, 22 bp, Homo sapiens
aaattctactaagttattttat

SEQ ID NO: 3002800 - DNA, 19 bp, Homo sapiens
aaattctataggaacatat

SEQ ID NO: 3002801 - DNA, 16 bp, Homo sapiens
aaattctcaaagtttt

SEQ ID NO: 3002802 - DNA, 18 bp, Homo sapiens
aaattctcaaagttttat

SEQ ID NO: 3002803 - DNA, 12 bp, Homo sapiens
aaattctctcct

SEQ ID NO: 3002804 - DNA, 16 bp, Homo sapiens
aaattctgaatatttt

SEQ ID NO: 3002805 - DNA, 17 bp, Homo sapiens
aaattctgaatttgcaa

SEQ ID NO: 3002806 - DNA, 19 bp, Homo sapiens
aaattctgaatttgcaaag

SEQ ID NO: 3002807 - DNA, 22 bp, Homo sapiens
aaattctgaatttgcaaagtac

SEQ ID NO: 3002808 - DNA, 14 bp, Homo sapiens
aaattctgctgtta

SEQ ID NO: 3002809 - DNA, 18 bp, Homo sapiens
aaattcttggttattctg

SEQ ID NO: 3002810 - DNA, 14 bp, Homo sapiens
aaattgaagccaga

SEQ ID NO: 3002811 - DNA, 22 bp, Homo sapiens
aaattgacagatcaagctgtga

SEQ ID NO: 3002812 - DNA, 16 bp, Homo sapiens
aaattgacttagatat

SEQ ID NO: 3002813 - DNA, 22 bp, Homo sapiens
aaattgacttagatattaaaat

SEQ ID NO: 3002814 - DNA, 14 bp, Homo sapiens
aaattgatcattca

SEQ ID NO: 3002815 - DNA, 19 bp, Homo sapiens
aaattgattaaggctttct

SEQ ID NO: 3002816 - DNA, 13 bp, Homo sapiens
aaattgcaaatct

SEQ ID NO: 3002817 - DNA, 19 bp, Homo sapiens
aaattgcaaatcttgaaat

SEQ ID NO: 3002818 - DNA, 19 bp, Homo sapiens
aaattgcacagaagtcctg

SEQ ID NO: 3002819 - DNA, 16 bp, Homo sapiens
aaattgcactgaagtt

SEQ ID NO: 3002820 - DNA, 18 bp, Homo sapiens
aaattgcactgaagtttt

SEQ ID NO: 3002821 - DNA, 21 bp, Homo sapiens
aaattgcactgaagtttttga

SEQ ID NO: 3002822 - DNA, 22 bp, Homo sapiens
aaattgcactgaagtttttgaa

SEQ ID NO: 3002823 - DNA, 17 bp, Homo sapiens
aaattgcctgaaaccca

SEQ ID NO: 3002824 - DNA, 17 bp, Homo sapiens
aaattgtattacaaatc

SEQ ID NO: 3002825 - DNA, 14 bp, Homo sapiens
aaattgtcttcatg

SEQ ID NO: 3002826 - DNA, 19 bp, Homo sapiens
aaatttacatttaatacag

SEQ ID NO: 3002827 - DNA, 23 bp, Homo sapiens
aaatttacatttaatacagataa

SEQ ID NO: 3002828 - DNA, 19 bp, Homo sapiens
aaatttactctgttgaata

SEQ ID NO: 3002829 - DNA, 16 bp, Homo sapiens
aaatttatattgtaaa

SEQ ID NO: 3002830 - DNA, 18 bp, Homo sapiens
aaatttcagcagctgcag

SEQ ID NO: 3002831 - DNA, 14 bp, Homo sapiens
aaatttccatatcc

SEQ ID NO: 3002832 - DNA, 16 bp, Homo sapiens
aaatttccccaacagt

SEQ ID NO: 3002833 - DNA, 12 bp, Homo sapiens
aaatttgaacta

SEQ ID NO: 3002834 - DNA, 22 bp, Homo sapiens
aaatttgcatgaaagcacaagg

SEQ ID NO: 3002835 - DNA, 20 bp, Homo sapiens
aaatttgccaatctttccta

SEQ ID NO: 3002836 - DNA, 20 bp, Homo sapiens
aaatttggatttacgactga

SEQ ID NO: 3002837 - DNA, 17 bp, Homo sapiens
aaatttggcattgatct

SEQ ID NO: 3002838 - DNA, 13 bp, Homo sapiens
aaatttgttgcat

SEQ ID NO: 3002839 - DNA, 23 bp, Homo sapiens
aaattttagcgtgctcactgacc

SEQ ID NO: 3002840 - DNA, 10 bp, Homo sapiens
aaattttctc

SEQ ID NO: 3002841 - DNA, 14 bp, Homo sapiens
aaattttgtaatga

SEQ ID NO: 3002842 - DNA, 15 bp, Homo sapiens
aaattttgtaatgaa

SEQ ID NO: 3002843 - DNA, 18 bp, Homo sapiens
aaattttgtaatgaattc

SEQ ID NO: 3002844 - DNA, 13 bp, Homo sapiens
aaattttgtgcaa

SEQ ID NO: 3002845 - DNA, 14 bp, Homo sapiens
aaattttgtgcaaa

SEQ ID NO: 3002846 - DNA, 17 bp, Homo sapiens
aaatttttcagatgctt

SEQ ID NO: 3002847 - DNA, 23 bp, Homo sapiens
aaatttttccacactatgtgtgt

SEQ ID NO: 3002848 - DNA, 23 bp, Homo sapiens
aaatttttttggtctttttgtaa

SEQ ID NO: 3002849 - DNA, 15 bp, Homo sapiens
aaattttttttcatg

SEQ ID NO: 3002850 - DNA, 23 bp, Homo sapiens
aaattttttttcatgttttaaca

SEQ ID NO: 3002851 - DNA, 23 bp, Homo sapiens
aaatttttttttttaacaatgac

SEQ ID NO: 3002852 - DNA, 14 bp, Homo sapiens
aacaaaaactatta

SEQ ID NO: 3002853 - DNA, 13 bp, Homo sapiens
aacaaaaattgtc

SEQ ID NO: 3002854 - DNA, 14 bp, Homo sapiens
aacaaaactcttaa

SEQ ID NO: 3002855 - DNA, 11 bp, Homo sapiens
aacaaaatttg

SEQ ID NO: 3002856 - DNA, 16 bp, Homo sapiens
aacaaacaaaactctt

SEQ ID NO: 3002857 - DNA, 16 bp, Homo sapiens
aacaaactctctgaac

SEQ ID NO: 3002858 - DNA, 14 bp, Homo sapiens
aacaaactcttcag

SEQ ID NO: 3002859 - DNA, 13 bp, Homo sapiens
aacaaagaaggtt

SEQ ID NO: 3002860 - DNA, 13 bp, Homo sapiens
aacaaagagtgaa

SEQ ID NO: 3002861 - DNA, 18 bp, Homo sapiens
aacaaagagtgaaatatt

SEQ ID NO: 3002862 - DNA, 14 bp, Homo sapiens
aacaaagccagaag

SEQ ID NO: 3002863 - DNA, 17 bp, Homo sapiens
aacaaagcttagcagga

SEQ ID NO: 3002864 - DNA, 22 bp, Homo sapiens
aacaaaggattaattgctgcaa

SEQ ID NO: 3002865 - DNA, 20 bp, Homo sapiens
aacaaataatttgaactttg

SEQ ID NO: 3002866 - DNA, 21 bp, Homo sapiens
aacaaatcaaacacaacacaa

SEQ ID NO: 3002867 - DNA, 22 bp, Homo sapiens
aacaaatggagctttctgtata

SEQ ID NO: 3002868 - DNA, 14 bp, Homo sapiens
aacaacataaaact

SEQ ID NO: 3002869 - DNA, 16 bp, Homo sapiens
aacaacattttcttga

SEQ ID NO: 3002870 - DNA, 21 bp, Homo sapiens
aacaacattttgagaacaaag

SEQ ID NO: 3002871 - DNA, 15 bp, Homo sapiens
aacaaccctgaagca

SEQ ID NO: 3002872 - DNA, 18 bp, Homo sapiens
aacaactggatgcatcaa

SEQ ID NO: 3002873 - DNA, 13 bp, Homo sapiens
aacaagaaaccaa

SEQ ID NO: 3002874 - DNA, 22 bp, Homo sapiens
aacaagaaaccaagtgggctgg

SEQ ID NO: 3002875 - DNA, 23 bp, Homo sapiens
aacaagaaaccaagtgggctggt

SEQ ID NO: 3002876 - DNA, 17 bp, Homo sapiens
aacaagaatgcattgat

SEQ ID NO: 3002877 - DNA, 16 bp, Homo sapiens
aacaagactgcctccc

SEQ ID NO: 3002878 - DNA, 19 bp, Homo sapiens
aacaagagcactacattca

SEQ ID NO: 3002879 - DNA, 22 bp, Homo sapiens
aacaagcaaggatatcagagct

SEQ ID NO: 3002880 - DNA, 18 bp, Homo sapiens
aacaagccaagaaagatg

SEQ ID NO: 3002881 - DNA, 21 bp, Homo sapiens
aacaagcctccttttaaagta

SEQ ID NO: 3002882 - DNA, 22 bp, Homo sapiens
aacaagcctgaccctgtaaaat

SEQ ID NO: 3002883 - DNA, 22 bp, Homo sapiens
aacaagggaaggggcctccctc

SEQ ID NO: 3002884 - DNA, 17 bp, Homo sapiens
aacaagtataattacat

SEQ ID NO: 3002885 - DNA, 13 bp, Homo sapiens
aacaagtttgcta

SEQ ID NO: 3002886 - DNA, 21 bp, Homo sapiens
aacaagtttgctagtgactaa

SEQ ID NO: 3002887 - DNA, 16 bp, Homo sapiens
aacaataaaatttttt

SEQ ID NO: 3002888 - DNA, 23 bp, Homo sapiens
aacaataaaattttttttcatgt

SEQ ID NO: 3002889 - DNA, 13 bp, Homo sapiens
aacaataataaag

SEQ ID NO: 3002890 - DNA, 15 bp, Homo sapiens
aacaataataaagat

SEQ ID NO: 3002891 - DNA, 21 bp, Homo sapiens
aacaatactcataatgtgaag

SEQ ID NO: 3002892 - DNA, 18 bp, Homo sapiens
aacaatccaaatgcattc

SEQ ID NO: 3002893 - DNA, 16 bp, Homo sapiens
aacagatttgtgaact

SEQ ID NO: 3002894 - DNA, 22 bp, Homo sapiens
aacagatttgtgaactcagcca

SEQ ID NO: 3002895 - DNA, 17 bp, Homo sapiens
aacagcaaacagtgggg

SEQ ID NO: 3002896 - DNA, 16 bp, Homo sapiens
aacagcaaaccaagag

SEQ ID NO: 3002897 - DNA, 17 bp, Homo sapiens
aacagcaaaccaagaga

SEQ ID NO: 3002898 - DNA, 19 bp, Homo sapiens
aacagcaaaccaagagatt

SEQ ID NO: 3002899 - DNA, 20 bp, Homo sapiens
aacagcagggtttgagcaca

SEQ ID NO: 3002900 - DNA, 15 bp, Homo sapiens
aacagccaacagcta

SEQ ID NO: 3002901 - DNA, 19 bp, Homo sapiens
aacagccaactagcccctg

SEQ ID NO: 3002902 - DNA, 17 bp, Homo sapiens
aacagcctattcctgaa

SEQ ID NO: 3002903 - DNA, 22 bp, Homo sapiens
aacagcgtgtcaactttcattt

SEQ ID NO: 3002904 - DNA, 14 bp, Homo sapiens
aacagctacaacag

SEQ ID NO: 3002905 - DNA, 15 bp, Homo sapiens
aacagctacaacagc

SEQ ID NO: 3002906 - DNA, 20 bp, Homo sapiens
aacagctacaacagcctcac

SEQ ID NO: 3002907 - DNA, 10 bp, Homo sapiens
aacagctgcc

SEQ ID NO: 3002908 - DNA, 13 bp, Homo sapiens
aacagctgcctta

SEQ ID NO: 3002909 - DNA, 14 bp, Homo sapiens
aacagctgccttag

SEQ ID NO: 3002910 - DNA, 15 bp, Homo sapiens
aacagctgccttagc

SEQ ID NO: 3002911 - DNA, 18 bp, Homo sapiens
aacagctggacttattta

SEQ ID NO: 3002912 - DNA, 17 bp, Homo sapiens
aacagctgttcctgtgt

SEQ ID NO: 3002913 - DNA, 15 bp, Homo sapiens
aacagcttgccaggg

SEQ ID NO: 3002914 - DNA, 17 bp, Homo sapiens
aacaggaccgggtggaa

SEQ ID NO: 3002915 - DNA, 19 bp, Homo sapiens
aacaggagctgggatccta

SEQ ID NO: 3002916 - DNA, 19 bp, Homo sapiens
aacagggcccaggcctgga

SEQ ID NO: 3002917 - DNA, 13 bp, Homo sapiens
aacaggtattttc

SEQ ID NO: 3002918 - DNA, 18 bp, Homo sapiens
aacaggtgttggtgacaa

SEQ ID NO: 3002919 - DNA, 17 bp, Homo sapiens
aacaggttaagtagcag

SEQ ID NO: 3002920 - DNA, 23 bp, Homo sapiens
aacagtaccagtgtaaattcagt

SEQ ID NO: 3002921 - DNA, 21 bp, Homo sapiens
aacagtatgatggaacagtga

SEQ ID NO: 3002922 - DNA, 12 bp, Homo sapiens
aacagtcatgtt

SEQ ID NO: 3002923 - DNA, 14 bp, Homo sapiens
aacagtcatgtttt

SEQ ID NO: 3002924 - DNA, 23 bp, Homo sapiens
aacagtccagacatttgtttcat

SEQ ID NO: 3002925 - DNA, 12 bp, Homo sapiens
aacagtctgatc

SEQ ID NO: 3002926 - DNA, 24 bp, Homo sapiens
aacagtgaaagtcaattcagtgat

SEQ ID NO: 3002927 - DNA, 15 bp, Homo sapiens
aacagtgcctgctga

SEQ ID NO: 3002928 - DNA, 16 bp, Homo sapiens
aacagtgctctgcctc

SEQ ID NO: 3002929 - DNA, 17 bp, Homo sapiens
aacagtgctctgcctct

SEQ ID NO: 3002930 - DNA, 22 bp, Homo sapiens
aacagtgtgaagttagaattcc

SEQ ID NO: 3002931 - DNA, 22 bp, Homo sapiens
aacagtgtggtttgggaaagat

SEQ ID NO: 3002932 - DNA, 19 bp, Homo sapiens
aacagttaataccattttt

SEQ ID NO: 3002933 - DNA, 14 bp, Homo sapiens
aacagttccttcag

SEQ ID NO: 3002934 - DNA, 18 bp, Homo sapiens
aacataaaatgaggcagt

SEQ ID NO: 3002935 - DNA, 19 bp, Homo sapiens
aacataaaggtaaaacaaa

SEQ ID NO: 3002936 - DNA, 15 bp, Homo sapiens
aacataacaaccttt

SEQ ID NO: 3002937 - DNA, 15 bp, Homo sapiens
aacataccaacatgt

SEQ ID NO: 3002938 - DNA, 17 bp, Homo sapiens
aacatagaaaaatgatg

SEQ ID NO: 3002939 - DNA, 23 bp, Homo sapiens
aacatagaaatggaaattttgct

SEQ ID NO: 3002940 - DNA, 15 bp, Homo sapiens
aacatataaaataat

SEQ ID NO: 3002941 - DNA, 17 bp, Homo sapiens
aacatataaaataatgc

SEQ ID NO: 3002942 - DNA, 12 bp, Homo sapiens
aacatatatgga

SEQ ID NO: 3002943 - DNA, 14 bp, Homo sapiens
aacatatctaaagt

SEQ ID NO: 3002944 - DNA, 13 bp, Homo sapiens
aacatatgatact

SEQ ID NO: 3002945 - DNA, 13 bp, Homo sapiens
aacatattttaca

SEQ ID NO: 3002946 - DNA, 22 bp, Homo sapiens
aacatcatgaatttattgcaca

SEQ ID NO: 3002947 - DNA, 18 bp, Homo sapiens
aacatcattttgttttcc

SEQ ID NO: 3002948 - DNA, 11 bp, Homo sapiens
aacatccaaaa

SEQ ID NO: 3002949 - DNA, 16 bp, Homo sapiens
aacatcccattgccct

SEQ ID NO: 3002950 - DNA, 19 bp, Homo sapiens
aacatcccattgccctggt

SEQ ID NO: 3002951 - DNA, 16 bp, Homo sapiens
aacatctgaaagccac

SEQ ID NO: 3002952 - DNA, 16 bp, Homo sapiens
aacatcttcaacatgt

SEQ ID NO: 3002953 - DNA, 20 bp, Homo sapiens
aacatgaaaacattgatgaa

SEQ ID NO: 3002954 - DNA, 18 bp, Homo sapiens
aacatgaagcataatttg

SEQ ID NO: 3002955 - DNA, 22 bp, Homo sapiens
aaccatattttattgtattttg

SEQ ID NO: 3002956 - DNA, 19 bp, Homo sapiens
aaccatcccctccgtggca

SEQ ID NO: 3002957 - DNA, 13 bp, Homo sapiens
aaccatctttaat

SEQ ID NO: 3002958 - DNA, 20 bp, Homo sapiens
aaccatgcagaggaatatta

SEQ ID NO: 3002959 - DNA, 16 bp, Homo sapiens
aaccatgcaggaagga

SEQ ID NO: 3002960 - DNA, 18 bp, Homo sapiens
aaccatgcaggaaggaaa

SEQ ID NO: 3002961 - DNA, 17 bp, Homo sapiens
aaccatttgttaactgt

SEQ ID NO: 3002962 - DNA, 23 bp, Homo sapiens
aaccatttgttaactgtactgaa

SEQ ID NO: 3002963 - DNA, 14 bp, Homo sapiens
aaccattttataaa

SEQ ID NO: 3002964 - DNA, 21 bp, Homo sapiens
aaccattttcccatcatcctt

SEQ ID NO: 3002965 - DNA, 17 bp, Homo sapiens
aacccacaagctgcctc

SEQ ID NO: 3002966 - DNA, 21 bp, Homo sapiens
aacccagacggctccactagg

SEQ ID NO: 3002967 - DNA, 12 bp, Homo sapiens
aacccagactca

SEQ ID NO: 3002968 - DNA, 16 bp, Homo sapiens
aacccagactcagaca

SEQ ID NO: 3002969 - DNA, 11 bp, Homo sapiens
aacccagagag

SEQ ID NO: 3002970 - DNA, 18 bp, Homo sapiens
aacccataggcccacaca

SEQ ID NO: 3002971 - DNA, 14 bp, Homo sapiens
aacccatagggagc

SEQ ID NO: 3002972 - DNA, 15 bp, Homo sapiens
aacccattgtcttta

SEQ ID NO: 3002973 - DNA, 17 bp, Homo sapiens
aacccatttacttagga

SEQ ID NO: 3002974 - DNA, 18 bp, Homo sapiens
aacccatttacttaggac

SEQ ID NO: 3002975 - DNA, 15 bp, Homo sapiens
aaccccaccctgttt

SEQ ID NO: 3002976 - DNA, 12 bp, Homo sapiens
aacccccacaca

SEQ ID NO: 3002977 - DNA, 20 bp, Homo sapiens
aacccccactggactgacct

SEQ ID NO: 3002978 - DNA, 19 bp, Homo sapiens
aacccccagcccacagagc

SEQ ID NO: 3002979 - DNA, 16 bp, Homo sapiens
aaccccgcggcccaga

SEQ ID NO: 3002980 - DNA, 20 bp, Homo sapiens
aaccccggggtgcccacagg

SEQ ID NO: 3002981 - DNA, 20 bp, Homo sapiens
aaccccttaagccctggccc

SEQ ID NO: 3002982 - DNA, 11 bp, Homo sapiens
aacccctttcc

SEQ ID NO: 3002983 - DNA, 23 bp, Homo sapiens
aacccgagtcattcgttctgtgg

SEQ ID NO: 3002984 - DNA, 15 bp, Homo sapiens
aacccgggggacaga

SEQ ID NO: 3002985 - DNA, 14 bp, Homo sapiens
aaccctctggaagt

SEQ ID NO: 3002986 - DNA, 14 bp, Homo sapiens
aaccctctgtcacc

SEQ ID NO: 3002987 - DNA, 19 bp, Homo sapiens
aacccttagcagcccagca

SEQ ID NO: 3002988 - DNA, 23 bp, Homo sapiens
aacccttctcctcttgtaaataa

SEQ ID NO: 3002989 - DNA, 21 bp, Homo sapiens
aaccgagagaatgctgacctg

SEQ ID NO: 3002990 - DNA, 18 bp, Homo sapiens
aaccgatgctttaccaaa

SEQ ID NO: 3002991 - DNA, 21 bp, Homo sapiens
aaccgcaggaagctgctccgt

SEQ ID NO: 3002992 - DNA, 17 bp, Homo sapiens
aaccgttttgaagctac

SEQ ID NO: 3002993 - DNA, 14 bp, Homo sapiens
aaccgtttttcaag

SEQ ID NO: 3002994 - DNA, 16 bp, Homo sapiens
aaccgtttttcaagaa

SEQ ID NO: 3002995 - DNA, 15 bp, Homo sapiens
aacctacacacaagg

SEQ ID NO: 3002996 - DNA, 16 bp, Homo sapiens
aacctactgtctaagc

SEQ ID NO: 3002997 - DNA, 21 bp, Homo sapiens
aacctatgaagcaatggatat

SEQ ID NO: 3002998 - DNA, 22 bp, Homo sapiens
aacctatttcttaaacacttgc

SEQ ID NO: 3002999 - DNA, 12 bp, Homo sapiens
aacctcaccccg

SEQ ID NO: 3003000 - DNA, 22 bp, Homo sapiens
aacctcacgcacctcccatcct

SEQ ID NO: 3003001 - DNA, 13 bp, Homo sapiens
aacctcagcctgg

SEQ ID NO: 3003002 - DNA, 16 bp, Homo sapiens
aacctcatcttcttca

SEQ ID NO: 3003003 - DNA, 11 bp, Homo sapiens
aacctcattaa

SEQ ID NO: 3003004 - DNA, 14 bp, Homo sapiens
aacctcgagtactg

SEQ ID NO: 3003005 - DNA, 19 bp, Homo sapiens
aacctcgagtactgtgggc

SEQ ID NO: 3003006 - DNA, 19 bp, Homo sapiens
aacctcgctggactctcag

SEQ ID NO: 3003007 - DNA, 21 bp, Homo sapiens
aacctctcctcatgttctgct

SEQ ID NO: 3003008 - DNA, 16 bp, Homo sapiens
aacctcttctgtattt

SEQ ID NO: 3003009 - DNA, 19 bp, Homo sapiens
aactagggttttggcctgc

SEQ ID NO: 3003010 - DNA, 14 bp, Homo sapiens
aactagtgtacatt

SEQ ID NO: 3003011 - DNA, 15 bp, Homo sapiens
aactataaatacaaa

SEQ ID NO: 3003012 - DNA, 17 bp, Homo sapiens
aactatataagacatta

SEQ ID NO: 3003013 - DNA, 20 bp, Homo sapiens
aactatataagacattaaga

SEQ ID NO: 3003014 - DNA, 13 bp, Homo sapiens
aactatcaaaatt

SEQ ID NO: 3003015 - DNA, 13 bp, Homo sapiens
aactatcaggcag

SEQ ID NO: 3003016 - DNA, 20 bp, Homo sapiens
aactatcccctgcgctttga

SEQ ID NO: 3003017 - DNA, 17 bp, Homo sapiens
aactatgcatggtgccc

SEQ ID NO: 3003018 - DNA, 21 bp, Homo sapiens
aactatgtaatgcttatgtgt

SEQ ID NO: 3003019 - DNA, 21 bp, Homo sapiens
aactattcagttgtgtttgtt

SEQ ID NO: 3003020 - DNA, 17 bp, Homo sapiens
aactattccatgtttta

SEQ ID NO: 3003021 - DNA, 13 bp, Homo sapiens
aactattttcaga

SEQ ID NO: 3003022 - DNA, 20 bp, Homo sapiens
aactattttcagatgtgaac

SEQ ID NO: 3003023 - DNA, 18 bp, Homo sapiens
aactcaaatggggccaga

SEQ ID NO: 3003024 - DNA, 21 bp, Homo sapiens
aactcaaatggggccagatcc

SEQ ID NO: 3003025 - DNA, 12 bp, Homo sapiens
aactcagaaggg

SEQ ID NO: 3003026 - DNA, 21 bp, Homo sapiens
aactcagaatatattcacttt

SEQ ID NO: 3003027 - DNA, 16 bp, Homo sapiens
aactcagccaagcaca

SEQ ID NO: 3003028 - DNA, 14 bp, Homo sapiens
aactcagtatttta

SEQ ID NO: 3003029 - DNA, 21 bp, Homo sapiens
aactcataatctataaacaat

SEQ ID NO: 3003030 - DNA, 18 bp, Homo sapiens
aactcatcactgtggctg

SEQ ID NO: 3003031 - DNA, 15 bp, Homo sapiens
aactcattagactgg

SEQ ID NO: 3003032 - DNA, 23 bp, Homo sapiens
aactccaacctctcggccccatc

SEQ ID NO: 3003033 - DNA, 17 bp, Homo sapiens
aactccaccctctgcga

SEQ ID NO: 3003034 - DNA, 15 bp, Homo sapiens
aactccaccttccca

SEQ ID NO: 3003035 - DNA, 18 bp, Homo sapiens
aactccaggctgggctga

SEQ ID NO: 3003036 - DNA, 23 bp, Homo sapiens
aactccatgggattttatctgtg

SEQ ID NO: 3003037 - DNA, 22 bp, Homo sapiens
aactcccctgtttcaatcactg

SEQ ID NO: 3003038 - DNA, 14 bp, Homo sapiens
aactccctcctcac

SEQ ID NO: 3003039 - DNA, 17 bp, Homo sapiens
aactcccttgtgttcct

SEQ ID NO: 3003040 - DNA, 19 bp, Homo sapiens
aactcccttgtgttccttc

SEQ ID NO: 3003041 - DNA, 22 bp, Homo sapiens
aactcctcgacatcactgttca

SEQ ID NO: 3003042 - DNA, 19 bp, Homo sapiens
aactcctgacgtcaagtga

SEQ ID NO: 3003043 - DNA, 17 bp, Homo sapiens
aactcctttcagccaca

SEQ ID NO: 3003044 - DNA, 18 bp, Homo sapiens
aactcctttcagccacat

SEQ ID NO: 3003045 - DNA, 19 bp, Homo sapiens
aactcctttctgcagacgt

SEQ ID NO: 3003046 - DNA, 14 bp, Homo sapiens
aactcgaggactgt

SEQ ID NO: 3003047 - DNA, 20 bp, Homo sapiens
aactcgaggactgtatttgt

SEQ ID NO: 3003048 - DNA, 19 bp, Homo sapiens
aactcgcacctgtgctgga

SEQ ID NO: 3003049 - DNA, 19 bp, Homo sapiens
aactcgccctgtttggcat

SEQ ID NO: 3003050 - DNA, 15 bp, Homo sapiens
aactcgtatagcatg

SEQ ID NO: 3003051 - DNA, 22 bp, Homo sapiens
aactctacatgtaactatttct

SEQ ID NO: 3003052 - DNA, 23 bp, Homo sapiens
aactctagctgggggtgggccag

SEQ ID NO: 3003053 - DNA, 14 bp, Homo sapiens
aactctctcccagg

SEQ ID NO: 3003054 - DNA, 19 bp, Homo sapiens
aacttggaaatgacacaga

SEQ ID NO: 3003055 - DNA, 19 bp, Homo sapiens
aacttggctgcaggaatct

SEQ ID NO: 3003056 - DNA, 11 bp, Homo sapiens
aacttgtcact

SEQ ID NO: 3003057 - DNA, 17 bp, Homo sapiens
aacttgtgagcatcaga

SEQ ID NO: 3003058 - DNA, 13 bp, Homo sapiens
aactttaagagga

SEQ ID NO: 3003059 - DNA, 15 bp, Homo sapiens
aactttaagaggaca

SEQ ID NO: 3003060 - DNA, 19 bp, Homo sapiens
aactttactaagatgacat

SEQ ID NO: 3003061 - DNA, 15 bp, Homo sapiens
aactttatgaagtgc

SEQ ID NO: 3003062 - DNA, 17 bp, Homo sapiens
aactttatgtgtaaata

SEQ ID NO: 3003063 - DNA, 20 bp, Homo sapiens
aactttccagtcttagctga

SEQ ID NO: 3003064 - DNA, 19 bp, Homo sapiens
aactttcctggatgtctga

SEQ ID NO: 3003065 - DNA, 23 bp, Homo sapiens
aactttctgagtttttcagatgt

SEQ ID NO: 3003066 - DNA, 15 bp, Homo sapiens
aactttcttatccta

SEQ ID NO: 3003067 - DNA, 22 bp, Homo sapiens
aacttttctcctgcatgtgtat

SEQ ID NO: 3003068 - DNA, 14 bp, Homo sapiens
aacttttgtaaata

SEQ ID NO: 3003069 - DNA, 23 bp, Homo sapiens
aacttttgtggactgagcggccg

SEQ ID NO: 3003070 - DNA, 23 bp, Homo sapiens
aactttttaaccaagttgtttat

SEQ ID NO: 3003071 - DNA, 20 bp, Homo sapiens
aactttttatgtaatacttt

SEQ ID NO: 3003072 - DNA, 13 bp, Homo sapiens
aactttttccaag

SEQ ID NO: 3003073 - DNA, 20 bp, Homo sapiens
aagaaaaaaactataaatac

SEQ ID NO: 3003074 - DNA, 16 bp, Homo sapiens
aagaaaaagataagaa

SEQ ID NO: 3003075 - DNA, 11 bp, Homo sapiens
aagaaaaagga

SEQ ID NO: 3003076 - DNA, 16 bp, Homo sapiens
aagaaaacatctattc

SEQ ID NO: 3003077 - DNA, 14 bp, Homo sapiens
aagaaaactggaaa

SEQ ID NO: 3003078 - DNA, 19 bp, Homo sapiens
aagaaaagcctcagctcat

SEQ ID NO: 3003079 - DNA, 16 bp, Homo sapiens
aagaaaatgaagggat

SEQ ID NO: 3003080 - DNA, 13 bp, Homo sapiens
aagaaaatggaat

SEQ ID NO: 3003081 - DNA, 13 bp, Homo sapiens
aagaaaattgcct

SEQ ID NO: 3003082 - DNA, 18 bp, Homo sapiens
aagaaaatttgccaatct

SEQ ID NO: 3003083 - DNA, 23 bp, Homo sapiens
aagaaaatttgccaatctttcct

SEQ ID NO: 3003084 - DNA, 14 bp, Homo sapiens
aagaaacaacagaa

SEQ ID NO: 3003085 - DNA, 19 bp, Homo sapiens
aagaaaccaagtgggctgg

SEQ ID NO: 3003086 - DNA, 16 bp, Homo sapiens
aagaaacccgacagag

SEQ ID NO: 3003087 - DNA, 18 bp, Homo sapiens
aagaaacccgacagaggg

SEQ ID NO: 3003088 - DNA, 17 bp, Homo sapiens
aagaaacgtctacgtat

SEQ ID NO: 3003089 - DNA, 17 bp, Homo sapiens
aagaaacttgtccttcc

SEQ ID NO: 3003090 - DNA, 12 bp, Homo sapiens
aagaaagacatc

SEQ ID NO: 3003091 - DNA, 17 bp, Homo sapiens
aagaaagagaagtcaca

SEQ ID NO: 3003092 - DNA, 19 bp, Homo sapiens
aagacggcacggtcttccc

SEQ ID NO: 3003093 - DNA, 18 bp, Homo sapiens
aagacgtcccttttttct

SEQ ID NO: 3003094 - DNA, 16 bp, Homo sapiens
aagacgtgtttgtgtt

SEQ ID NO: 3003095 - DNA, 12 bp, Homo sapiens
aagactacctgg

SEQ ID NO: 3003096 - DNA, 15 bp, Homo sapiens
aagactatttaccag

SEQ ID NO: 3003097 - DNA, 14 bp, Homo sapiens
aagactcaaatgtt

SEQ ID NO: 3003098 - DNA, 17 bp, Homo sapiens
aagactcaaatgttcta

SEQ ID NO: 3003099 - DNA, 18 bp, Homo sapiens
aagactccctgatcccag

SEQ ID NO: 3003100 - DNA, 19 bp, Homo sapiens
aagactcttacctacaaaa

SEQ ID NO: 3003101 - DNA, 22 bp, Homo sapiens
aagactcttgggagggagttac

SEQ ID NO: 3003102 - DNA, 14 bp, Homo sapiens
aagactggatttgc

SEQ ID NO: 3003103 - DNA, 22 bp, Homo sapiens
aagactggcttttattaatgca

SEQ ID NO: 3003104 - DNA, 22 bp, Homo sapiens
aagactgtgcggcacaggaaac

SEQ ID NO: 3003105 - DNA, 17 bp, Homo sapiens
aagactgttgtgctcca

SEQ ID NO: 3003106 - DNA, 15 bp, Homo sapiens
aagacttactctaag

SEQ ID NO: 3003107 - DNA, 20 bp, Homo sapiens
aagacttactctaagatctt

SEQ ID NO: 3003108 - DNA, 16 bp, Homo sapiens
aagacttagttatttc

SEQ ID NO: 3003109 - DNA, 13 bp, Homo sapiens
aagacttgacagt

SEQ ID NO: 3003110 - DNA, 23 bp, Homo sapiens
aagactttgatgtgtttttgtat

SEQ ID NO: 3003111 - DNA, 22 bp, Homo sapiens
aagagaaaaaaagtttgccaga

SEQ ID NO: 3003112 - DNA, 13 bp, Homo sapiens
aagagaaagagac

SEQ ID NO: 3003113 - DNA, 21 bp, Homo sapiens
aagagaaagagacagagactg

SEQ ID NO: 3003114 - DNA, 20 bp, Homo sapiens
aagagaactccagtgttgct

SEQ ID NO: 3003115 - DNA, 21 bp, Homo sapiens
aagagaaggtggacctggcag

SEQ ID NO: 3003116 - DNA, 17 bp, Homo sapiens
aagagaatgtatttcct

SEQ ID NO: 3003117 - DNA, 17 bp, Homo sapiens
aagagacatgagaaagg

SEQ ID NO: 3003118 - DNA, 16 bp, Homo sapiens
aagagactcagcctgc

SEQ ID NO: 3003119 - DNA, 13 bp, Homo sapiens
aagagagaaaata

SEQ ID NO: 3003120 - DNA, 14 bp, Homo sapiens
aagagagaaaataa

SEQ ID NO: 3003121 - DNA, 17 bp, Homo sapiens
aagagagaaaataaaaa

SEQ ID NO: 3003122 - DNA, 20 bp, Homo sapiens
aagagagaaaataaaaagtt

SEQ ID NO: 3003123 - DNA, 13 bp, Homo sapiens
aagagagaaacaa

SEQ ID NO: 3003124 - DNA, 16 bp, Homo sapiens
aagagagaattctgtt

SEQ ID NO: 3003125 - DNA, 21 bp, Homo sapiens
aagagagagagagagaaagaa

SEQ ID NO: 3003126 - DNA, 15 bp, Homo sapiens
aagagagcagagaat

SEQ ID NO: 3003127 - DNA, 15 bp, Homo sapiens
aagagatccaaagac

SEQ ID NO: 3003128 - DNA, 17 bp, Homo sapiens
aagagatccaaagactc

SEQ ID NO: 3003129 - DNA, 19 bp, Homo sapiens
aagagattgctaattgctg

SEQ ID NO: 3003130 - DNA, 23 bp, Homo sapiens
aagagcaaggtttcgtggcagca

SEQ ID NO: 3003131 - DNA, 22 bp, Homo sapiens
aagagcagcttcggtgtgcaga

SEQ ID NO: 3003132 - DNA, 11 bp, Homo sapiens
aagagccacag

SEQ ID NO: 3003133 - DNA, 23 bp, Homo sapiens
aagagcccgtgccacccccagcc

SEQ ID NO: 3003134 - DNA, 20 bp, Homo sapiens
aagagccttggtgtccacct

SEQ ID NO: 3003135 - DNA, 19 bp, Homo sapiens
aagagctagcgctgccgca

SEQ ID NO: 3003136 - DNA, 21 bp, Homo sapiens
aagagctgatgtgagtgtgtg

SEQ ID NO: 3003137 - DNA, 14 bp, Homo sapiens
aagagctgggatcc

SEQ ID NO: 3003138 - DNA, 22 bp, Homo sapiens
aagagctgggatcccacagccc

SEQ ID NO: 3003139 - DNA, 16 bp, Homo sapiens
aagagctgtcctggta

SEQ ID NO: 3003140 - DNA, 18 bp, Homo sapiens
aagagcttccagagctct

SEQ ID NO: 3003141 - DNA, 13 bp, Homo sapiens
aagaggaacagtg

SEQ ID NO: 3003142 - DNA, 22 bp, Homo sapiens
aagaggacataatggggtcctg

SEQ ID NO: 3003143 - DNA, 15 bp, Homo sapiens
aagaggatattcttc

SEQ ID NO: 3003144 - DNA, 23 bp, Homo sapiens
aagaggccacttagggaaagatg

SEQ ID NO: 3003145 - DNA, 23 bp, Homo sapiens
aagaggccagacatggtgtctca

SEQ ID NO: 3003146 - DNA, 11 bp, Homo sapiens
aagaggcctgt

SEQ ID NO: 3003147 - DNA, 17 bp, Homo sapiens
aagaggcgttgctttca

SEQ ID NO: 3003148 - DNA, 19 bp, Homo sapiens
aagagggacataagataaa

SEQ ID NO: 3003149 - DNA, 17 bp, Homo sapiens
aagagggacgcctgggg

SEQ ID NO: 3003150 - DNA, 21 bp, Homo sapiens
aagagggttcacacagcccag

SEQ ID NO: 3003151 - DNA, 19 bp, Homo sapiens
aagaggtgaaaatgaagaa

SEQ ID NO: 3003152 - DNA, 21 bp, Homo sapiens
aagaggtgggtggtgggcttc

SEQ ID NO: 3003153 - DNA, 16 bp, Homo sapiens
aagaggtgtgcaagag

SEQ ID NO: 3003154 - DNA, 18 bp, Homo sapiens
aagaggtgtgcaagagag

SEQ ID NO: 3003155 - DNA, 14 bp, Homo sapiens
aagagtctagattc

SEQ ID NO: 3003156 - DNA, 13 bp, Homo sapiens
aagagtctccagt

SEQ ID NO: 3003157 - DNA, 16 bp, Homo sapiens
aagagtctctggctca

SEQ ID NO: 3003158 - DNA, 22 bp, Homo sapiens
aagagtctctggctcagctgtg

SEQ ID NO: 3003159 - DNA, 20 bp, Homo sapiens
aagagtgaaatattgtaaat

SEQ ID NO: 3003160 - DNA, 17 bp, Homo sapiens
aagagttattcaaatga

SEQ ID NO: 3003161 - DNA, 19 bp, Homo sapiens
aagagttgagtgatagagc

SEQ ID NO: 3003162 - DNA, 20 bp, Homo sapiens
aagataaaatgatgttatac

SEQ ID NO: 3003163 - DNA, 20 bp, Homo sapiens
aagatacagaactctttcaa

SEQ ID NO: 3003164 - DNA, 22 bp, Homo sapiens
aagatacagaactctttcaaaa

SEQ ID NO: 3003165 - DNA, 16 bp, Homo sapiens
aagatacttacatgtt

SEQ ID NO: 3003166 - DNA, 12 bp, Homo sapiens
aagatatatatt

SEQ ID NO: 3003167 - DNA, 14 bp, Homo sapiens
aagatatatattca

SEQ ID NO: 3003168 - DNA, 15 bp, Homo sapiens
aagatatccatcttt

SEQ ID NO: 3003169 - DNA, 19 bp, Homo sapiens
aagatatcccagctttaaa

SEQ ID NO: 3003170 - DNA, 19 bp, Homo sapiens
aagatattttaaaatctgt

SEQ ID NO: 3003171 - DNA, 23 bp, Homo sapiens
aagatatttttattcaaactacc

SEQ ID NO: 3003172 - DNA, 20 bp, Homo sapiens
aagatcactgccagagataa

SEQ ID NO: 3003173 - DNA, 14 bp, Homo sapiens
aagatctacatgaa

SEQ ID NO: 3003174 - DNA, 14 bp, Homo sapiens
aagatctacctgca

SEQ ID NO: 3003175 - DNA, 18 bp, Homo sapiens
aagatctcagtggttaag

SEQ ID NO: 3003176 - DNA, 18 bp, Homo sapiens
aagatctctgcagggccg

SEQ ID NO: 3003177 - DNA, 17 bp, Homo sapiens
aagatctgtcctcagcc

SEQ ID NO: 3003178 - DNA, 18 bp, Homo sapiens
aagatctgtcctcagcct

SEQ ID NO: 3003179 - DNA, 20 bp, Homo sapiens
aagatctgttttgaaggcaa

SEQ ID NO: 3003180 - DNA, 21 bp, Homo sapiens
aagatctgttttgaaggcaaa

SEQ ID NO: 3003181 - DNA, 16 bp, Homo sapiens
aagatcttagattctc

SEQ ID NO: 3003182 - DNA, 22 bp, Homo sapiens
aagatcttcaaaagtaatgcct

SEQ ID NO: 3003183 - DNA, 21 bp, Homo sapiens
aagatcttgatggtgtttctt

SEQ ID NO: 3003184 - DNA, 13 bp, Homo sapiens
aagatctttatat

SEQ ID NO: 3003185 - DNA, 22 bp, Homo sapiens
aagatctttatatttcaataaa

SEQ ID NO: 3003186 - DNA, 23 bp, Homo sapiens
aagatgaaggagaggcaacatcc

SEQ ID NO: 3003187 - DNA, 16 bp, Homo sapiens
aagatgacattgctaa

SEQ ID NO: 3003188 - DNA, 22 bp, Homo sapiens
aagatgatcgctgtattttgag

SEQ ID NO: 3003189 - DNA, 14 bp, Homo sapiens
aagatgattgttct

SEQ ID NO: 3003190 - DNA, 20 bp, Homo sapiens
aagatgattgttcttttgtt

SEQ ID NO: 3003191 - DNA, 15 bp, Homo sapiens
aagatgatttgcaat

SEQ ID NO: 3003192 - DNA, 15 bp, Homo sapiens
aagatgcaatgtaga

SEQ ID NO: 3003193 - DNA, 12 bp, Homo sapiens
aagatgcagaag

SEQ ID NO: 3003194 - DNA, 16 bp, Homo sapiens
aagatgcagaagcaat

SEQ ID NO: 3003195 - DNA, 22 bp, Homo sapiens
aagatgctacttcccactgtat

SEQ ID NO: 3003196 - DNA, 23 bp, Homo sapiens
aagatgctccagcaacacagcct

SEQ ID NO: 3003197 - DNA, 22 bp, Homo sapiens
aagatgctggatgtctgccaat

SEQ ID NO: 3003198 - DNA, 18 bp, Homo sapiens
aagatggcatcctgtgaa

SEQ ID NO: 3003199 - DNA, 17 bp, Homo sapiens
aagatggctgactttgc

SEQ ID NO: 3003200 - DNA, 12 bp, Homo sapiens
aagatgggacag

SEQ ID NO: 3003201 - DNA, 13 bp, Homo sapiens
aagatgggacagc

SEQ ID NO: 3003202 - DNA, 12 bp, Homo sapiens
aagatgggagga

SEQ ID NO: 3003203 - DNA, 13 bp, Homo sapiens
aagatggttttca

SEQ ID NO: 3003204 - DNA, 20 bp, Homo sapiens
aagatgtaataatcatttta

SEQ ID NO: 3003205 - DNA, 14 bp, Homo sapiens
aagatgtagcacct

SEQ ID NO: 3003206 - DNA, 12 bp, Homo sapiens
aagatgtctgtt

SEQ ID NO: 3003207 - DNA, 16 bp, Homo sapiens
aagatgtctgtttgct

SEQ ID NO: 3003208 - DNA, 18 bp, Homo sapiens
aagatgtctgtttgctga

SEQ ID NO: 3003209 - DNA, 16 bp, Homo sapiens
aagatgtgatattcta

SEQ ID NO: 3003210 - DNA, 19 bp, Homo sapiens
aagatgtgatattctaaga

SEQ ID NO: 3003211 - DNA, 20 bp, Homo sapiens
aagatgtgatattctaagac

SEQ ID NO: 3003212 - DNA, 21 bp, Homo sapiens
aagatgtgatattctaagact

SEQ ID NO: 3003213 - DNA, 18 bp, Homo sapiens
aagatgtgggttcttttt

SEQ ID NO: 3003214 - DNA, 16 bp, Homo sapiens
aagatgttctcctgat

SEQ ID NO: 3003215 - DNA, 13 bp, Homo sapiens
aagattagaagct

SEQ ID NO: 3003216 - DNA, 13 bp, Homo sapiens
aagattagtgatt

SEQ ID NO: 3003217 - DNA, 18 bp, Homo sapiens
aagattatttaaatgctt

SEQ ID NO: 3003218 - DNA, 19 bp, Homo sapiens
aagattattttattatgcg

SEQ ID NO: 3003219 - DNA, 21 bp, Homo sapiens
aagattcacctaagagattct

SEQ ID NO: 3003220 - DNA, 15 bp, Homo sapiens
aagattcaggtatgt

SEQ ID NO: 3003221 - DNA, 19 bp, Homo sapiens
aagattcatttttaatcat

SEQ ID NO: 3003222 - DNA, 12 bp, Homo sapiens
aagattcccaga

SEQ ID NO: 3003223 - DNA, 14 bp, Homo sapiens
aagattcccagaga

SEQ ID NO: 3003224 - DNA, 12 bp, Homo sapiens
aagattctaaag

SEQ ID NO: 3003225 - DNA, 12 bp, Homo sapiens
aagattctagat

SEQ ID NO: 3003226 - DNA, 14 bp, Homo sapiens
aagattctagatga

SEQ ID NO: 3003227 - DNA, 19 bp, Homo sapiens
aagattctatagttctaga

SEQ ID NO: 3003228 - DNA, 20 bp, Homo sapiens
aagattctatagttctagac

SEQ ID NO: 3003229 - DNA, 17 bp, Homo sapiens
aagattctctgcccagc

SEQ ID NO: 3003230 - DNA, 20 bp, Homo sapiens
aagattcttctgtgtttata

SEQ ID NO: 3003231 - DNA, 12 bp, Homo sapiens
aagattgaaatt

SEQ ID NO: 3003232 - DNA, 15 bp, Homo sapiens
aagattgaaattcca

SEQ ID NO: 3003233 - DNA, 19 bp, Homo sapiens
aagattggaaagacaggaa

SEQ ID NO: 3003234 - DNA, 20 bp, Homo sapiens
aagattggaaagacaggaag

SEQ ID NO: 3003235 - DNA, 14 bp, Homo sapiens
aagatttatcaaat

SEQ ID NO: 3003236 - DNA, 18 bp, Homo sapiens
aagatttatcaaatcagt

SEQ ID NO: 3003237 - DNA, 21 bp, Homo sapiens
aagatttatttttaatatgtt

SEQ ID NO: 3003238 - DNA, 16 bp, Homo sapiens
aagattttgaaggaaa

SEQ ID NO: 3003239 - DNA, 12 bp, Homo sapiens
aagcaaaaatgc

SEQ ID NO: 3003240 - DNA, 17 bp, Homo sapiens
aagcaaaaatgctaata

SEQ ID NO: 3003241 - DNA, 19 bp, Homo sapiens
aagcaaacccagacggctc

SEQ ID NO: 3003242 - DNA, 14 bp, Homo sapiens
aagcaaaggcagtc

SEQ ID NO: 3003243 - DNA, 14 bp, Homo sapiens
aagcaaagtcactt

SEQ ID NO: 3003244 - DNA, 17 bp, Homo sapiens
aagcaaatcagaaactt

SEQ ID NO: 3003245 - DNA, 16 bp, Homo sapiens
aagcaaatgcattcta

SEQ ID NO: 3003246 - DNA, 17 bp, Homo sapiens
aagcaaatgcattctat

SEQ ID NO: 3003247 - DNA, 23 bp, Homo sapiens
aagcaaattatttttaaaagaaa

SEQ ID NO: 3003248 - DNA, 15 bp, Homo sapiens
aagcaacttgcttct

SEQ ID NO: 3003249 - DNA, 16 bp, Homo sapiens
aagcaacttgcttcta

SEQ ID NO: 3003250 - DNA, 18 bp, Homo sapiens
aagcaacttgcttctaaa

SEQ ID NO: 3003251 - DNA, 22 bp, Homo sapiens
aagcaacttgcttctaaatgcc

SEQ ID NO: 3003252 - DNA, 15 bp, Homo sapiens
aagcaagaaagaaac

SEQ ID NO: 3003253 - DNA, 13 bp, Homo sapiens
aagcaagactgag

SEQ ID NO: 3003254 - DNA, 15 bp, Homo sapiens
aagcaagattgaaat

SEQ ID NO: 3003255 - DNA, 15 bp, Homo sapiens
aagcaagctgtgtta

SEQ ID NO: 3003256 - DNA, 17 bp, Homo sapiens
aagcaagctgtgttact

SEQ ID NO: 3003257 - DNA, 19 bp, Homo sapiens
aagcaagctgtgttacttg

SEQ ID NO: 3003258 - DNA, 22 bp, Homo sapiens
aagcaagctgtgttacttgaag

SEQ ID NO: 3003259 - DNA, 24 bp, Homo sapiens
aagcaagggggaaggctgcaaagt

SEQ ID NO: 3003260 - DNA, 15 bp, Homo sapiens
aagcaagggggtgat

SEQ ID NO: 3003261 - DNA, 18 bp, Homo sapiens
aagcaaggtgtccctgcc

SEQ ID NO: 3003262 - DNA, 20 bp, Homo sapiens
aagcaataaaatttttttgg

SEQ ID NO: 3003263 - DNA, 21 bp, Homo sapiens
aagcaatacgtttgtgcagaa

SEQ ID NO: 3003264 - DNA, 12 bp, Homo sapiens
aagcaatagaaa

SEQ ID NO: 3003265 - DNA, 13 bp, Homo sapiens
aagcaatagaaac

SEQ ID NO: 3003266 - DNA, 17 bp, Homo sapiens
aagcaatagaaacaaca

SEQ ID NO: 3003267 - DNA, 13 bp, Homo sapiens
aagcaatatgcat

SEQ ID NO: 3003268 - DNA, 18 bp, Homo sapiens
aagcaatcatagagaaac

SEQ ID NO: 3003269 - DNA, 17 bp, Homo sapiens
aagcacaccacaattct

SEQ ID NO: 3003270 - DNA, 11 bp, Homo sapiens
aagcacagcag

SEQ ID NO: 3003271 - DNA, 13 bp, Homo sapiens
aagcacagtggtg

SEQ ID NO: 3003272 - DNA, 16 bp, Homo sapiens
aagcacttcccaggat

SEQ ID NO: 3003273 - DNA, 15 bp, Homo sapiens
aagcagaattttaat

SEQ ID NO: 3003274 - DNA, 16 bp, Homo sapiens
aagcagaattttaatg

SEQ ID NO: 3003275 - DNA, 12 bp, Homo sapiens
aagcagacagct

SEQ ID NO: 3003276 - DNA, 19 bp, Homo sapiens
aagcagagagtccaattta

SEQ ID NO: 3003277 - DNA, 13 bp, Homo sapiens
aagcagagcaaaa

SEQ ID NO: 3003278 - DNA, 18 bp, Homo sapiens
aagcagaggaccagggcc

SEQ ID NO: 3003279 - DNA, 14 bp, Homo sapiens
aagcagaggagggg

SEQ ID NO: 3003280 - DNA, 21 bp, Homo sapiens
aagcagaggctttggggtcct

SEQ ID NO: 3003281 - DNA, 16 bp, Homo sapiens
aagcagagttctttgc

SEQ ID NO: 3003282 - DNA, 21 bp, Homo sapiens
aagcagattttcctaaggcca

SEQ ID NO: 3003283 - DNA, 23 bp, Homo sapiens
aagcagattttcctaaggccact

SEQ ID NO: 3003284 - DNA, 17 bp, Homo sapiens
aagcagcaaaatcctta

SEQ ID NO: 3003285 - DNA, 21 bp, Homo sapiens
aagcagcaaaatccttacttc

SEQ ID NO: 3003286 - DNA, 11 bp, Homo sapiens
aagcagccagg

SEQ ID NO: 3003287 - DNA, 15 bp, Homo sapiens
aagcagccaggaggg

SEQ ID NO: 3003288 - DNA, 15 bp, Homo sapiens
aagcagccctctgcc

SEQ ID NO: 3003289 - DNA, 21 bp, Homo sapiens
aagcagcgctagtggagggtt

SEQ ID NO: 3003290 - DNA, 19 bp, Homo sapiens
aagcagctcaaaggcacag

SEQ ID NO: 3003291 - DNA, 10 bp, Homo sapiens
aagcagctct

SEQ ID NO: 3003292 - DNA, 13 bp, Homo sapiens
aagcagctctgcc

SEQ ID NO: 3003293 - DNA, 11 bp, Homo sapiens
aagcaggaagc

SEQ ID NO: 3003294 - DNA, 12 bp, Homo sapiens
aagcaggaagct

SEQ ID NO: 3003295 - DNA, 13 bp, Homo sapiens
aagcaggaagctc

SEQ ID NO: 3003296 - DNA, 16 bp, Homo sapiens
aagcaggaagctcaga

SEQ ID NO: 3003297 - DNA, 16 bp, Homo sapiens
aagcaggcttgtgctt

SEQ ID NO: 3003298 - DNA, 17 bp, Homo sapiens
aagcaggtttcttgctt

SEQ ID NO: 3003299 - DNA, 20 bp, Homo sapiens
aagcaggtttcttgcttctg

SEQ ID NO: 3003300 - DNA, 13 bp, Homo sapiens
aagcagtaactga

SEQ ID NO: 3003301 - DNA, 13 bp, Homo sapiens
aagcagtcataag

SEQ ID NO: 3003302 - DNA, 22 bp, Homo sapiens
aagcagttgaaatgaggcatga

SEQ ID NO: 3003303 - DNA, 14 bp, Homo sapiens
aagcataagaccaa

SEQ ID NO: 3003304 - DNA, 15 bp, Homo sapiens
aagcataatttgttt

SEQ ID NO: 3003305 - DNA, 14 bp, Homo sapiens
aagcatactttgta

SEQ ID NO: 3003306 - DNA, 18 bp, Homo sapiens
aagcatactttgtaaata

SEQ ID NO: 3003307 - DNA, 12 bp, Homo sapiens
aagcatcattgt

SEQ ID NO: 3003308 - DNA, 22 bp, Homo sapiens
aagcatcattgtccccatgcaa

SEQ ID NO: 3003309 - DNA, 12 bp, Homo sapiens
aagcatcctccc

SEQ ID NO: 3003310 - DNA, 14 bp, Homo sapiens
aagcatcctcccca

SEQ ID NO: 3003311 - DNA, 17 bp, Homo sapiens
aagcatcggtcatgtgt

SEQ ID NO: 3003312 - DNA, 12 bp, Homo sapiens
aagcatctactt

SEQ ID NO: 3003313 - DNA, 20 bp, Homo sapiens
aagcatctgccacaaaaatg

SEQ ID NO: 3003314 - DNA, 22 bp, Homo sapiens
aagcatctgccacaaaaatgtt

SEQ ID NO: 3003315 - DNA, 17 bp, Homo sapiens
aagcatgatgggaaaat

SEQ ID NO: 3003316 - DNA, 19 bp, Homo sapiens
aagcatgatgggaaaatat

SEQ ID NO: 3003317 - DNA, 20 bp, Homo sapiens
aagcatgatgggaaaatatt

SEQ ID NO: 3003318 - DNA, 22 bp, Homo sapiens
aagcatgatgggaaaatatttc

SEQ ID NO: 3003319 - DNA, 22 bp, Homo sapiens
aagcatgcttgtgaaaatgtgt

SEQ ID NO: 3003320 - DNA, 16 bp, Homo sapiens
aagcatggccctgctg

SEQ ID NO: 3003321 - DNA, 17 bp, Homo sapiens
aagcatggccctgctgc

SEQ ID NO: 3003322 - DNA, 15 bp, Homo sapiens
aagcatgtctctgct

SEQ ID NO: 3003323 - DNA, 16 bp, Homo sapiens
aagcatgtctctgctt

SEQ ID NO: 3003324 - DNA, 17 bp, Homo sapiens
aagcatgtgtcatgcat

SEQ ID NO: 3003325 - DNA, 13 bp, Homo sapiens
aagcattgtgagt

SEQ ID NO: 3003326 - DNA, 16 bp, Homo sapiens
aagcatttcaaagccc

SEQ ID NO: 3003327 - DNA, 19 bp, Homo sapiens
aagcatttcaaagccctgc

SEQ ID NO: 3003328 - DNA, 24 bp, Homo sapiens
aagcatttcaaagccctgcctctg

SEQ ID NO: 3003329 - DNA, 15 bp, Homo sapiens
aagcattttcagcat

SEQ ID NO: 3003330 - DNA, 16 bp, Homo sapiens
aagcattttcagcatc

SEQ ID NO: 3003331 - DNA, 21 bp, Homo sapiens
aagcattttcagcatcaaaca

SEQ ID NO: 3003332 - DNA, 14 bp, Homo sapiens
aagccaactggtat

SEQ ID NO: 3003333 - DNA, 11 bp, Homo sapiens
aagccaagaat

SEQ ID NO: 3003334 - DNA, 16 bp, Homo sapiens
aagccaagcagccaag

SEQ ID NO: 3003335 - DNA, 17 bp, Homo sapiens
aagccaagcagccaagc

SEQ ID NO: 3003336 - DNA, 12 bp, Homo sapiens
aagccaagctgt

SEQ ID NO: 3003337 - DNA, 13 bp, Homo sapiens
aagccaagctgtg

SEQ ID NO: 3003338 - DNA, 12 bp, Homo sapiens
aagccacagaaa

SEQ ID NO: 3003339 - DNA, 13 bp, Homo sapiens
aagccacagcctg

SEQ ID NO: 3003340 - DNA, 14 bp, Homo sapiens
aagccacagcctgt

SEQ ID NO: 3003341 - DNA, 11 bp, Homo sapiens
aagccaccctc

SEQ ID NO: 3003342 - DNA, 16 bp, Homo sapiens
aagccaccctcccagc

SEQ ID NO: 3003343 - DNA, 24 bp, Homo sapiens
aagccacccttccctgcctccagc

SEQ ID NO: 3003344 - DNA, 18 bp, Homo sapiens
aagccaccgcagctgctg

SEQ ID NO: 3003345 - DNA, 21 bp, Homo sapiens
aagccaccgcagctgctgcca

SEQ ID NO: 3003346 - DNA, 14 bp, Homo sapiens
aagccactggaagg

SEQ ID NO: 3003347 - DNA, 20 bp, Homo sapiens
aagccactggaaggagcaca

SEQ ID NO: 3003348 - DNA, 21 bp, Homo sapiens
aagccactggaaggagcacat

SEQ ID NO: 3003349 - DNA, 18 bp, Homo sapiens
aagccacttaaaatgttc

SEQ ID NO: 3003350 - DNA, 14 bp, Homo sapiens
aagccagaagctga

SEQ ID NO: 3003351 - DNA, 16 bp, Homo sapiens
aagccagcccggccgc

SEQ ID NO: 3003352 - DNA, 20 bp, Homo sapiens
aagccaggaatttcccagga

SEQ ID NO: 3003353 - DNA, 24 bp, Homo sapiens
aagccaggaatttcccaggaccct

SEQ ID NO: 3003354 - DNA, 17 bp, Homo sapiens
aagccaggattggggac

SEQ ID NO: 3003355 - DNA, 15 bp, Homo sapiens
aagccatatggacac

SEQ ID NO: 3003356 - DNA, 12 bp, Homo sapiens
aagccatctcag

SEQ ID NO: 3003357 - DNA, 23 bp, Homo sapiens
aagccatcttcccgcctcagcct

SEQ ID NO: 3003358 - DNA, 13 bp, Homo sapiens
aagccattgtctt

SEQ ID NO: 3003359 - DNA, 17 bp, Homo sapiens
aagcccaaatggctctg

SEQ ID NO: 3003360 - DNA, 18 bp, Homo sapiens
aagcccacctgggctggg

SEQ ID NO: 3003361 - DNA, 15 bp, Homo sapiens
aagcccactgcctcc

SEQ ID NO: 3003362 - DNA, 13 bp, Homo sapiens
aagccccacatgt

SEQ ID NO: 3003363 - DNA, 21 bp, Homo sapiens
aagcccccagctaagaacctg

SEQ ID NO: 3003364 - DNA, 23 bp, Homo sapiens
aagccccctggcagctgcccctc

SEQ ID NO: 3003365 - DNA, 20 bp, Homo sapiens
aagccccgcatatgtgagtg

SEQ ID NO: 3003366 - DNA, 20 bp, Homo sapiens
aaggagcccttatctgtgct

SEQ ID NO: 3003367 - DNA, 14 bp, Homo sapiens
aaggagctgctata

SEQ ID NO: 3003368 - DNA, 20 bp, Homo sapiens
aaggagctgctatagcctgg

SEQ ID NO: 3003369 - DNA, 19 bp, Homo sapiens
aaggagctttcttgtttct

SEQ ID NO: 3003370 - DNA, 20 bp, Homo sapiens
aaggaggacaagaccctctc

SEQ ID NO: 3003371 - DNA, 15 bp, Homo sapiens
aaggagggagaaagg

SEQ ID NO: 3003372 - DNA, 18 bp, Homo sapiens
aaggagggagaaaggaga

SEQ ID NO: 3003373 - DNA, 21 bp, Homo sapiens
aaggaggggaaaaaaatgttg

SEQ ID NO: 3003374 - DNA, 20 bp, Homo sapiens
aaggtggactggaaggggcc

SEQ ID NO: 3003375 - DNA, 14 bp, Homo sapiens
aaggtggattttgt

SEQ ID NO: 3003376 - DNA, 15 bp, Homo sapiens
aaggtgtccctgcct

SEQ ID NO: 3003377 - DNA, 14 bp, Homo sapiens
aaggtgtgctattt

SEQ ID NO: 3003378 - DNA, 22 bp, Homo sapiens
aaggtgtgtcctcaagaagaaa

SEQ ID NO: 3003379 - DNA, 17 bp, Homo sapiens
aaggtgttttctgtgta

SEQ ID NO: 3003380 - DNA, 15 bp, Homo sapiens
aaggttaaaggaaaa

SEQ ID NO: 3003381 - DNA, 19 bp, Homo sapiens
aaggttactcagcagcaga

SEQ ID NO: 3003382 - DNA, 13 bp, Homo sapiens
aaggttcagactt

SEQ ID NO: 3003383 - DNA, 21 bp, Homo sapiens
aaggttccaactgtatatatt

SEQ ID NO: 3003384 - DNA, 15 bp, Homo sapiens
aaggttccacagagt

SEQ ID NO: 3003385 - DNA, 15 bp, Homo sapiens
aaggttggccttact

SEQ ID NO: 3003386 - DNA, 19 bp, Homo sapiens
aaggttttaggttctaaag

SEQ ID NO: 3003387 - DNA, 15 bp, Homo sapiens
aaggttttcatttgc

SEQ ID NO: 3003388 - DNA, 13 bp, Homo sapiens
aagtaaatctctt

SEQ ID NO: 3003389 - DNA, 16 bp, Homo sapiens
aagtaacttattttgt

SEQ ID NO: 3003390 - DNA, 15 bp, Homo sapiens
aagtaagtgtctgtg

SEQ ID NO: 3003391 - DNA, 14 bp, Homo sapiens
aagtaatgcatttg

SEQ ID NO: 3003392 - DNA, 15 bp, Homo sapiens
aagtaatgcctctgt

SEQ ID NO: 3003393 - DNA, 17 bp, Homo sapiens
aagtacaattcattgtt

SEQ ID NO: 3003394 - DNA, 19 bp, Homo sapiens
aagtacctatattgattta

SEQ ID NO: 3003395 - DNA, 15 bp, Homo sapiens
aagtacctcagcatt

SEQ ID NO: 3003396 - DNA, 13 bp, Homo sapiens
aagtactgagcag

SEQ ID NO: 3003397 - DNA, 17 bp, Homo sapiens
aagtactgctgtaaata

SEQ ID NO: 3003398 - DNA, 20 bp, Homo sapiens
aagtactgctgtaaataaat

SEQ ID NO: 3003399 - DNA, 15 bp, Homo sapiens
aagtactgtaagaat

SEQ ID NO: 3003400 - DNA, 19 bp, Homo sapiens
aagtactgtaagaataatt

SEQ ID NO: 3003401 - DNA, 17 bp, Homo sapiens
aagtacttccctcaggc

SEQ ID NO: 3003402 - DNA, 19 bp, Homo sapiens
aagtacttgactacctact

SEQ ID NO: 3003403 - DNA, 14 bp, Homo sapiens
aagtacttttaacg

SEQ ID NO: 3003404 - DNA, 13 bp, Homo sapiens
aagtagaaatggt

SEQ ID NO: 3003405 - DNA, 16 bp, Homo sapiens
aagtagaacaaaaaac

SEQ ID NO: 3003406 - DNA, 16 bp, Homo sapiens
aagtagaacaaaaact

SEQ ID NO: 3003407 - DNA, 18 bp, Homo sapiens
aagtagacagttttgaga

SEQ ID NO: 3003408 - DNA, 14 bp, Homo sapiens
aagtagatctgctt

SEQ ID NO: 3003409 - DNA, 21 bp, Homo sapiens
aagtagatctgctttctgttc

SEQ ID NO: 3003410 - DNA, 19 bp, Homo sapiens
aagtagctgggattttaaa

SEQ ID NO: 3003411 - DNA, 18 bp, Homo sapiens
aagtagtaaaaattaaaa

SEQ ID NO: 3003412 - DNA, 17 bp, Homo sapiens
aagtagtgttgtccagg

SEQ ID NO: 3003413 - DNA, 18 bp, Homo sapiens
aagtatactgtattttta

SEQ ID NO: 3003414 - DNA, 20 bp, Homo sapiens
aagtatcaggaatataaata

SEQ ID NO: 3003415 - DNA, 23 bp, Homo sapiens
aagtatcttctatttttatcatg

SEQ ID NO: 3003416 - DNA, 18 bp, Homo sapiens
aagtatggtaatagcttt

SEQ ID NO: 3003417 - DNA, 14 bp, Homo sapiens
aagtatgttgtata

SEQ ID NO: 3003418 - DNA, 13 bp, Homo sapiens
aagtattatcaga

SEQ ID NO: 3003419 - DNA, 17 bp, Homo sapiens
aagtattcttttcaatt

SEQ ID NO: 3003420 - DNA, 14 bp, Homo sapiens
aagtattgtaaatt

SEQ ID NO: 3003421 - DNA, 15 bp, Homo sapiens
aagtattgtaaatta

SEQ ID NO: 3003422 - DNA, 22 bp, Homo sapiens
aagtattgtaaattatatttgt

SEQ ID NO: 3003423 - DNA, 14 bp, Homo sapiens
aagtattttcctcc

SEQ ID NO: 3003424 - DNA, 15 bp, Homo sapiens
aagtattttcctgta

SEQ ID NO: 3003425 - DNA, 21 bp, Homo sapiens
aagtcaaaatatttttaaaag

SEQ ID NO: 3003426 - DNA, 22 bp, Homo sapiens
aagtcaaccaatgtagaaagct

SEQ ID NO: 3003427 - DNA, 19 bp, Homo sapiens
aagtcacaacaaaaggaag

SEQ ID NO: 3003428 - DNA, 18 bp, Homo sapiens
aagtcacaatgttcttta

SEQ ID NO: 3003429 - DNA, 20 bp, Homo sapiens
aagtcaccctagccctctcc

SEQ ID NO: 3003430 - DNA, 22 bp, Homo sapiens
aagtcaccctagccctctccct

SEQ ID NO: 3003431 - DNA, 19 bp, Homo sapiens
aagtcagaatttttaactg

SEQ ID NO: 3003432 - DNA, 17 bp, Homo sapiens
aagtcagagaaaacact

SEQ ID NO: 3003433 - DNA, 19 bp, Homo sapiens
aagtcagagaaaacacttt

SEQ ID NO: 3003434 - DNA, 17 bp, Homo sapiens
aagtcaggacctggctt

SEQ ID NO: 3003435 - DNA, 17 bp, Homo sapiens
aagtcagttaacgtcac

SEQ ID NO: 3003436 - DNA, 17 bp, Homo sapiens
aagtcattaaactggtt

SEQ ID NO: 3003437 - DNA, 18 bp, Homo sapiens
aagtccccaggccccagg

SEQ ID NO: 3003438 - DNA, 15 bp, Homo sapiens
aagtcccttcctgct

SEQ ID NO: 3003439 - DNA, 16 bp, Homo sapiens
aagtcctaacttcctg

SEQ ID NO: 3003440 - DNA, 20 bp, Homo sapiens
aagtcctaacttcctgtgcc

SEQ ID NO: 3003441 - DNA, 16 bp, Homo sapiens
aagtcctatggaaacc

SEQ ID NO: 3003442 - DNA, 19 bp, Homo sapiens
aagtcctgactgggctggg

SEQ ID NO: 3003443 - DNA, 22 bp, Homo sapiens
aagtcctgactgggctgggttt

SEQ ID NO: 3003444 - DNA, 14 bp, Homo sapiens
aagtcctgcctttg

SEQ ID NO: 3003445 - DNA, 17 bp, Homo sapiens
aagtcctgtatgtctgt

SEQ ID NO: 3003446 - DNA, 19 bp, Homo sapiens
aagtcctgtatgtctgtca

SEQ ID NO: 3003447 - DNA, 16 bp, Homo sapiens
aagtcctttatgtgga

SEQ ID NO: 3003448 - DNA, 16 bp, Homo sapiens
aagtccttttgtaaag

SEQ ID NO: 3003449 - DNA, 22 bp, Homo sapiens
aagtctaggagctgggaggaaa

SEQ ID NO: 3003450 - DNA, 14 bp, Homo sapiens
aagtctctgtgtaa

SEQ ID NO: 3003451 - DNA, 18 bp, Homo sapiens
aagtctcttaattctgat

SEQ ID NO: 3003452 - DNA, 14 bp, Homo sapiens
aagtctgtttactg

SEQ ID NO: 3003453 - DNA, 20 bp, Homo sapiens
aagtcttaacaaaccaacat

SEQ ID NO: 3003454 - DNA, 19 bp, Homo sapiens
aagtcttaaggacaaagtg

SEQ ID NO: 3003455 - DNA, 16 bp, Homo sapiens
aagtcttactacagaa

SEQ ID NO: 3003456 - DNA, 22 bp, Homo sapiens
aagtcttatatattgtagataa

SEQ ID NO: 3003457 - DNA, 13 bp, Homo sapiens
aagtctttaatat

SEQ ID NO: 3003458 - DNA, 18 bp, Homo sapiens
aagtctttaggtctttgt

SEQ ID NO: 3003459 - DNA, 16 bp, Homo sapiens
aagtgaaagacatttc

SEQ ID NO: 3003460 - DNA, 14 bp, Homo sapiens
aagtgaatttttct

SEQ ID NO: 3003461 - DNA, 19 bp, Homo sapiens
aagtgaatttttctctaac

SEQ ID NO: 3003462 - DNA, 20 bp, Homo sapiens
aagtgacagggaagctacag

SEQ ID NO: 3003463 - DNA, 23 bp, Homo sapiens
aagtgacagggaagctacaggtt

SEQ ID NO: 3003464 - DNA, 20 bp, Homo sapiens
aagtgaccagggaagtgtgt

SEQ ID NO: 3003465 - DNA, 23 bp, Homo sapiens
aagtgaccagggaagtgtgtgtg

SEQ ID NO: 3003466 - DNA, 20 bp, Homo sapiens
aagtgagaaagaaagtaaaa

SEQ ID NO: 3003467 - DNA, 18 bp, Homo sapiens
aagtgagtctggtggagg

SEQ ID NO: 3003468 - DNA, 17 bp, Homo sapiens
aagtgagtggcatgtgg

SEQ ID NO: 3003469 - DNA, 13 bp, Homo sapiens
aagtgatgtcatt

SEQ ID NO: 3003470 - DNA, 14 bp, Homo sapiens
aagtgattcttttt

SEQ ID NO: 3003471 - DNA, 19 bp, Homo sapiens
aagtgattttatttttgca

SEQ ID NO: 3003472 - DNA, 19 bp, Homo sapiens
aagtgcaaaggtgtgcaaa

SEQ ID NO: 3003473 - DNA, 22 bp, Homo sapiens
aagtgcaatatgggcgggcagt

SEQ ID NO: 3003474 - DNA, 20 bp, Homo sapiens
aagtgcctcaagaggaatga

SEQ ID NO: 3003475 - DNA, 11 bp, Homo sapiens
aagtgcctgct

SEQ ID NO: 3003476 - DNA, 14 bp, Homo sapiens
aagtgcctgcttag

SEQ ID NO: 3003477 - DNA, 19 bp, Homo sapiens
aagtgcctttatctcagcc

SEQ ID NO: 3003478 - DNA, 20 bp, Homo sapiens
aagtgcctttatctcagcca

SEQ ID NO: 3003479 - DNA, 22 bp, Homo sapiens
aagtgcgtccacgagctgttta

SEQ ID NO: 3003480 - DNA, 16 bp, Homo sapiens
aagtgctaaggttcta

SEQ ID NO: 3003481 - DNA, 17 bp, Homo sapiens
aagtgctaaggttctaa

SEQ ID NO: 3003482 - DNA, 18 bp, Homo sapiens
aagtgctacagaaagcac

SEQ ID NO: 3003483 - DNA, 17 bp, Homo sapiens
aagtgctgtttagattt

SEQ ID NO: 3003484 - DNA, 14 bp, Homo sapiens
aagtgcttgtgtaa

SEQ ID NO: 3003485 - DNA, 19 bp, Homo sapiens
aagtggaaaggatcacaga

SEQ ID NO: 3003486 - DNA, 19 bp, Homo sapiens
aagtggaccaggacaggac

SEQ ID NO: 3003487 - DNA, 22 bp, Homo sapiens
aagtggaccttaggccttcctc

SEQ ID NO: 3003488 - DNA, 17 bp, Homo sapiens
aagtggactcagggcag

SEQ ID NO: 3003489 - DNA, 17 bp, Homo sapiens
aagtggagaaatgaaaa

SEQ ID NO: 3003490 - DNA, 13 bp, Homo sapiens
aagtggatgggaa

SEQ ID NO: 3003491 - DNA, 14 bp, Homo sapiens
aagtggatgggaat

SEQ ID NO: 3003492 - DNA, 19 bp, Homo sapiens
aagtggatgggaatttgtc

SEQ ID NO: 3003493 - DNA, 14 bp, Homo sapiens
aagtggcctctttg

SEQ ID NO: 3003494 - DNA, 11 bp, Homo sapiens
aagtgggacat

SEQ ID NO: 3003495 - DNA, 23 bp, Homo sapiens
aagtgggcattttgacaacatgg

SEQ ID NO: 3003496 - DNA, 13 bp, Homo sapiens
aagtgggcccacc

SEQ ID NO: 3003497 - DNA, 15 bp, Homo sapiens
aagtgggcccacccg

SEQ ID NO: 3003498 - DNA, 19 bp, Homo sapiens
aagtgggctggtattctct

SEQ ID NO: 3003499 - DNA, 17 bp, Homo sapiens
aagtggggaccccaccc

SEQ ID NO: 3003500 - DNA, 18 bp, Homo sapiens
aagtggggaccccacccc

SEQ ID NO: 3003501 - DNA, 23 bp, Homo sapiens
aagtggggcagatggcagggctg

SEQ ID NO: 3003502 - DNA, 17 bp, Homo sapiens
aagtggggctaaatgaa

SEQ ID NO: 3003503 - DNA, 17 bp, Homo sapiens
aagtgggtttcaattta

SEQ ID NO: 3003504 - DNA, 19 bp, Homo sapiens
aagtggtcttaagaaatgt

SEQ ID NO: 3003505 - DNA, 15 bp, Homo sapiens
aagtggtgctcagtt

SEQ ID NO: 3003506 - DNA, 13 bp, Homo sapiens
aagtgtaaagcat

SEQ ID NO: 3003507 - DNA, 14 bp, Homo sapiens
aagtgtaaagcatt

SEQ ID NO: 3003508 - DNA, 16 bp, Homo sapiens
aagtgtaaagcattcc

SEQ ID NO: 3003509 - DNA, 18 bp, Homo sapiens
aagtgtaaagcattccaa

SEQ ID NO: 3003510 - DNA, 20 bp, Homo sapiens
aagtgtaaagcattccaaca

SEQ ID NO: 3003511 - DNA, 15 bp, Homo sapiens
aagtgtacaagttgc

SEQ ID NO: 3003512 - DNA, 17 bp, Homo sapiens
aagtgtacaagttgctt

SEQ ID NO: 3003513 - DNA, 13 bp, Homo sapiens
aagtgtcatgttt

SEQ ID NO: 3003514 - DNA, 14 bp, Homo sapiens
aagtgtctggagcg

SEQ ID NO: 3003515 - DNA, 21 bp, Homo sapiens
aagtgtctgtgatgctcccaa

SEQ ID NO: 3003516 - DNA, 17 bp, Homo sapiens
aagtgtgaacaaaagat

SEQ ID NO: 3003517 - DNA, 18 bp, Homo sapiens
aagtgtgcatattgtaca

SEQ ID NO: 3003518 - DNA, 21 bp, Homo sapiens
aagtgtgcatattgtacactt

SEQ ID NO: 3003519 - DNA, 22 bp, Homo sapiens
aagtgtgcatattgtacacttt

SEQ ID NO: 3003520 - DNA, 17 bp, Homo sapiens
aagtgtgtccatcctga

SEQ ID NO: 3003521 - DNA, 18 bp, Homo sapiens
aagtgtgtctcaaaaata

SEQ ID NO: 3003522 - DNA, 15 bp, Homo sapiens
aagtgtgtgaaacct

SEQ ID NO: 3003523 - DNA, 17 bp, Homo sapiens
aagtgtgtttccttcag

SEQ ID NO: 3003524 - DNA, 15 bp, Homo sapiens
aagttaaaaaacagc

SEQ ID NO: 3003525 - DNA, 17 bp, Homo sapiens
aagttaaaaaacagctg

SEQ ID NO: 3003526 - DNA, 18 bp, Homo sapiens
aagttaaggtatctggta

SEQ ID NO: 3003527 - DNA, 20 bp, Homo sapiens
aagttaataagttgatgttt

SEQ ID NO: 3003528 - DNA, 12 bp, Homo sapiens
aagttaatagat

SEQ ID NO: 3003529 - DNA, 16 bp, Homo sapiens
aagttaatgcttaaga

SEQ ID NO: 3003530 - DNA, 15 bp, Homo sapiens
aagttacaatgtttt

SEQ ID NO: 3003531 - DNA, 20 bp, Homo sapiens
aagttacatgtttgcacctt

SEQ ID NO: 3003532 - DNA, 19 bp, Homo sapiens
aagttactttgtcagaggc

SEQ ID NO: 3003533 - DNA, 14 bp, Homo sapiens
aagttagaattcct

SEQ ID NO: 3003534 - DNA, 15 bp, Homo sapiens
aagttagaattcctt

SEQ ID NO: 3003535 - DNA, 11 bp, Homo sapiens
aagttagtcta

SEQ ID NO: 3003536 - DNA, 14 bp, Homo sapiens
aagttataagactc

SEQ ID NO: 3003537 - DNA, 23 bp, Homo sapiens
aagttatacacgggacagttgct

SEQ ID NO: 3003538 - DNA, 17 bp, Homo sapiens
aagttattagtggttta

SEQ ID NO: 3003539 - DNA, 14 bp, Homo sapiens
aagttattgcagtt

SEQ ID NO: 3003540 - DNA, 12 bp, Homo sapiens
aagttatttatg

SEQ ID NO: 3003541 - DNA, 18 bp, Homo sapiens
aagttatttatgctataa

SEQ ID NO: 3003542 - DNA, 13 bp, Homo sapiens
aagttattttatg

SEQ ID NO: 3003543 - DNA, 21 bp, Homo sapiens
aagttcaagggctctttctcc

SEQ ID NO: 3003544 - DNA, 15 bp, Homo sapiens
aagttcaccattaaa

SEQ ID NO: 3003545 - DNA, 11 bp, Homo sapiens
aagttcacttt

SEQ ID NO: 3003546 - DNA, 14 bp, Homo sapiens
aagttcagagtttt

SEQ ID NO: 3003547 - DNA, 16 bp, Homo sapiens
aagttcagagttttct

SEQ ID NO: 3003548 - DNA, 17 bp, Homo sapiens
aagttccaagagtctaa

SEQ ID NO: 3003549 - DNA, 20 bp, Homo sapiens
aagttccaagagtctaaaga

SEQ ID NO: 3003550 - DNA, 21 bp, Homo sapiens
aagttccaagagtctaaagat

SEQ ID NO: 3003551 - DNA, 20 bp, Homo sapiens
aagttccagttttgttttga

SEQ ID NO: 3003552 - DNA, 19 bp, Homo sapiens
aagttcctctcccttccct

SEQ ID NO: 3003553 - DNA, 21 bp, Homo sapiens
aagttcctctcccttcccttc

SEQ ID NO: 3003554 - DNA, 19 bp, Homo sapiens
aagttctaagattctaatg

SEQ ID NO: 3003555 - DNA, 21 bp, Homo sapiens
aagttctaataatttctaatg

SEQ ID NO: 3003556 - DNA, 21 bp, Homo sapiens
aagttctattggaaaaaccac

SEQ ID NO: 3003557 - DNA, 19 bp, Homo sapiens
aagttctccttttgaactt

SEQ ID NO: 3003558 - DNA, 16 bp, Homo sapiens
aagttctgctttctcc

SEQ ID NO: 3003559 - DNA, 23 bp, Homo sapiens
aagttgagagacagtaacacaat

SEQ ID NO: 3003560 - DNA, 15 bp, Homo sapiens
aagttgatgttttct

SEQ ID NO: 3003561 - DNA, 14 bp, Homo sapiens
aagttgctttgtta

SEQ ID NO: 3003562 - DNA, 16 bp, Homo sapiens
aagttgctttgttaca

SEQ ID NO: 3003563 - DNA, 14 bp, Homo sapiens
aagttgtttaactg

SEQ ID NO: 3003564 - DNA, 18 bp, Homo sapiens
aagttgttttacagctgt

SEQ ID NO: 3003565 - DNA, 19 bp, Homo sapiens
aagtttaagtgtgcagcca

SEQ ID NO: 3003566 - DNA, 18 bp, Homo sapiens
aagtttacaatcaaagga

SEQ ID NO: 3003567 - DNA, 19 bp, Homo sapiens
aagtttacaatcaaaggaa

SEQ ID NO: 3003568 - DNA, 19 bp, Homo sapiens
aagtttcacaggtcaataa

SEQ ID NO: 3003569 - DNA, 20 bp, Homo sapiens
aagtttcacaggtcaataaa

SEQ ID NO: 3003570 - DNA, 21 bp, Homo sapiens
aagtttccttccagcccagaa

SEQ ID NO: 3003571 - DNA, 15 bp, Homo sapiens
aagtttccttttaat

SEQ ID NO: 3003572 - DNA, 22 bp, Homo sapiens
aagtttctcagatccttgtttc

SEQ ID NO: 3003573 - DNA, 10 bp, Homo sapiens
aagtttcttt

SEQ ID NO: 3003574 - DNA, 13 bp, Homo sapiens
aagtttgcttaga

SEQ ID NO: 3003575 - DNA, 16 bp, Homo sapiens
aagtttgcttgtttct

SEQ ID NO: 3003576 - DNA, 17 bp, Homo sapiens
aagtttgggctaacatt

SEQ ID NO: 3003577 - DNA, 19 bp, Homo sapiens
aagtttgggctaacattta

SEQ ID NO: 3003578 - DNA, 22 bp, Homo sapiens
aagtttgttactttgaatagtc

SEQ ID NO: 3003579 - DNA, 16 bp, Homo sapiens
aagttttatttaactt

SEQ ID NO: 3003580 - DNA, 22 bp, Homo sapiens
aagttttcccttgaggaaacaa

SEQ ID NO: 3003581 - DNA, 18 bp, Homo sapiens
aagttttgtgtgtatata

SEQ ID NO: 3003582 - DNA, 12 bp, Homo sapiens
aagtttttacaa

SEQ ID NO: 3003583 - DNA, 23 bp, Homo sapiens
aagtttttattcaaagcagctgt

SEQ ID NO: 3003584 - DNA, 14 bp, Homo sapiens
aagtttttgtatta

SEQ ID NO: 3003585 - DNA, 16 bp, Homo sapiens
aataaaaaacagaaac

SEQ ID NO: 3003586 - DNA, 19 bp, Homo sapiens
aataaaaagaaagatactt

SEQ ID NO: 3003587 - DNA, 14 bp, Homo sapiens
aataaaaagattct

SEQ ID NO: 3003588 - DNA, 13 bp, Homo sapiens
aataaaaaggcac

SEQ ID NO: 3003589 - DNA, 12 bp, Homo sapiens
aataaaaagtta

SEQ ID NO: 3003590 - DNA, 13 bp, Homo sapiens
aataaaaagttaa

SEQ ID NO: 3003591 - DNA, 14 bp, Homo sapiens
aataaaacatttta

SEQ ID NO: 3003592 - DNA, 21 bp, Homo sapiens
aataaaaccaagcctctggaa

SEQ ID NO: 3003593 - DNA, 21 bp, Homo sapiens
aataaaactaaatgtgtacac

SEQ ID NO: 3003594 - DNA, 15 bp, Homo sapiens
aataaaactggcttt

SEQ ID NO: 3003595 - DNA, 16 bp, Homo sapiens
aataaaagtgaccttt

SEQ ID NO: 3003596 - DNA, 19 bp, Homo sapiens
aataaaagttttacaaagg

SEQ ID NO: 3003597 - DNA, 18 bp, Homo sapiens
aataaaatggtacatttc

SEQ ID NO: 3003598 - DNA, 14 bp, Homo sapiens
aataaaattaatga

SEQ ID NO: 3003599 - DNA, 17 bp, Homo sapiens
aataaaatttgttgcat

SEQ ID NO: 3003600 - DNA, 19 bp, Homo sapiens
aataaaattttttttcatg

SEQ ID NO: 3003601 - DNA, 22 bp, Homo sapiens
aataaaattttttttcatgttt

SEQ ID NO: 3003602 - DNA, 21 bp, Homo sapiens
aataaacactggttgtagtca

SEQ ID NO: 3003603 - DNA, 21 bp, Homo sapiens
aataaaccattggacagattt

SEQ ID NO: 3003604 - DNA, 14 bp, Homo sapiens
aataaacctgttta

SEQ ID NO: 3003605 - DNA, 15 bp, Homo sapiens
aataaaccttgtttc

SEQ ID NO: 3003606 - DNA, 15 bp, Homo sapiens
aataaacgatttaat

SEQ ID NO: 3003607 - DNA, 17 bp, Homo sapiens
aataaacgcagaagagg

SEQ ID NO: 3003608 - DNA, 15 bp, Homo sapiens
aataaactagggttt

SEQ ID NO: 3003609 - DNA, 20 bp, Homo sapiens
aataaactagggttttggcc

SEQ ID NO: 3003610 - DNA, 17 bp, Homo sapiens
aataaacttagaggaaa

SEQ ID NO: 3003611 - DNA, 18 bp, Homo sapiens
aataaactttcaaattga

SEQ ID NO: 3003612 - DNA, 13 bp, Homo sapiens
aataaagaatact

SEQ ID NO: 3003613 - DNA, 15 bp, Homo sapiens
aataaagaatacttg

SEQ ID NO: 3003614 - DNA, 11 bp, Homo sapiens
aataaagacag

SEQ ID NO: 3003615 - DNA, 21 bp, Homo sapiens
aataaagcactattgtttaga

SEQ ID NO: 3003616 - DNA, 15 bp, Homo sapiens
aataaagccctggga

SEQ ID NO: 3003617 - DNA, 15 bp, Homo sapiens
aataaagcctgcttt

SEQ ID NO: 3003618 - DNA, 16 bp, Homo sapiens
aataaaggatgtgatt

SEQ ID NO: 3003619 - DNA, 21 bp, Homo sapiens
aataaatagagcaattacaag

SEQ ID NO: 3003620 - DNA, 14 bp, Homo sapiens
aataaatatagttg

SEQ ID NO: 3003621 - DNA, 10 bp, Homo sapiens
aataaatatg

SEQ ID NO: 3003622 - DNA, 16 bp, Homo sapiens
aataaatatgcctctc

SEQ ID NO: 3003623 - DNA, 22 bp, Homo sapiens
aataaatctcttctttgctgca

SEQ ID NO: 3003624 - DNA, 15 bp, Homo sapiens
aataaatctgaccca

SEQ ID NO: 3003625 - DNA, 14 bp, Homo sapiens
aataaatgaagaaa

SEQ ID NO: 3003626 - DNA, 23 bp, Homo sapiens
aataaatgtcttttttttaatgt

SEQ ID NO: 3003627 - DNA, 13 bp, Homo sapiens
aataaatgtttcc

SEQ ID NO: 3003628 - DNA, 17 bp, Homo sapiens
aataaattcctaaactc

SEQ ID NO: 3003629 - DNA, 15 bp, Homo sapiens
aataaatttatatga

SEQ ID NO: 3003630 - DNA, 15 bp, Homo sapiens
aataaattttgtgca

SEQ ID NO: 3003631 - DNA, 14 bp, Homo sapiens
aatataaacaaaga

SEQ ID NO: 3003632 - DNA, 12 bp, Homo sapiens
aatataaatgtt

SEQ ID NO: 3003633 - DNA, 13 bp, Homo sapiens
aatataacatgaa

SEQ ID NO: 3003634 - DNA, 18 bp, Homo sapiens
aatataacatgaaatgat

SEQ ID NO: 3003635 - DNA, 23 bp, Homo sapiens
aatataaggaaagcaataaatga

SEQ ID NO: 3003636 - DNA, 15 bp, Homo sapiens
aatataagtttcttt

SEQ ID NO: 3003637 - DNA, 12 bp, Homo sapiens
aatataatgtgc

SEQ ID NO: 3003638 - DNA, 18 bp, Homo sapiens
aatatacattcaaactta

SEQ ID NO: 3003639 - DNA, 18 bp, Homo sapiens
aatatactgattttgaaa

SEQ ID NO: 3003640 - DNA, 12 bp, Homo sapiens
aatatactgtaa

SEQ ID NO: 3003641 - DNA, 13 bp, Homo sapiens
aatatactgtaaa

SEQ ID NO: 3003642 - DNA, 15 bp, Homo sapiens
aatatagctgagact

SEQ ID NO: 3003643 - DNA, 17 bp, Homo sapiens
aatatatctaaattgaa

SEQ ID NO: 3003644 - DNA, 18 bp, Homo sapiens
aatatatctaaattgaat

SEQ ID NO: 3003645 - DNA, 20 bp, Homo sapiens
aatatatctaaattgaataa

SEQ ID NO: 3003646 - DNA, 21 bp, Homo sapiens
aatatatctaaattgaataat

SEQ ID NO: 3003647 - DNA, 16 bp, Homo sapiens
aatatatgaacattag

SEQ ID NO: 3003648 - DNA, 13 bp, Homo sapiens
aatatatgtattt

SEQ ID NO: 3003649 - DNA, 21 bp, Homo sapiens
aatatattttctgttttcttt

SEQ ID NO: 3003650 - DNA, 14 bp, Homo sapiens
aatatcaaatgcag

SEQ ID NO: 3003651 - DNA, 20 bp, Homo sapiens
aatatcaaatgcagtatatt

SEQ ID NO: 3003652 - DNA, 21 bp, Homo sapiens
aatatcagttactcagccctg

SEQ ID NO: 3003653 - DNA, 17 bp, Homo sapiens
aatatccaggtcaacag

SEQ ID NO: 3003654 - DNA, 24 bp, Homo sapiens
aatatccaggtcaacagaatgaaa

SEQ ID NO: 3003655 - DNA, 13 bp, Homo sapiens
aatatcctgcttg

SEQ ID NO: 3003656 - DNA, 12 bp, Homo sapiens
aatatcctttgc

SEQ ID NO: 3003657 - DNA, 14 bp, Homo sapiens
aatatctaaagtta

SEQ ID NO: 3003658 - DNA, 21 bp, Homo sapiens
aatatgaaggtttgagagcag

SEQ ID NO: 3003659 - DNA, 19 bp, Homo sapiens
aatatgaagttactttctt

SEQ ID NO: 3003660 - DNA, 20 bp, Homo sapiens
aatatgaatctgctcacttt

SEQ ID NO: 3003661 - DNA, 12 bp, Homo sapiens
aatatgaatgcc

SEQ ID NO: 3003662 - DNA, 22 bp, Homo sapiens
aatatgaatgcccccagctggc

SEQ ID NO: 3003663 - DNA, 22 bp, Homo sapiens
aatatgaattcaagaaaggaaa

SEQ ID NO: 3003664 - DNA, 17 bp, Homo sapiens
aatatgcattgtctgca

SEQ ID NO: 3003665 - DNA, 18 bp, Homo sapiens
aatatgccatctatgcag

SEQ ID NO: 3003666 - DNA, 16 bp, Homo sapiens
aatatgcctctccttt

SEQ ID NO: 3003667 - DNA, 21 bp, Homo sapiens
aatatgcctgtaattcagtgt

SEQ ID NO: 3003668 - DNA, 16 bp, Homo sapiens
aatatggggatagtct

SEQ ID NO: 3003669 - DNA, 12 bp, Homo sapiens
aatatgtaccaa

SEQ ID NO: 3003670 - DNA, 15 bp, Homo sapiens
aatatgtaccaagaa

SEQ ID NO: 3003671 - DNA, 17 bp, Homo sapiens
aatatgtatatatgtat

SEQ ID NO: 3003672 - DNA, 21 bp, Homo sapiens
aatatgtgaaaggaacatttt

SEQ ID NO: 3003673 - DNA, 22 bp, Homo sapiens
aatatgtgaagcccagcatctc

SEQ ID NO: 3003674 - DNA, 15 bp, Homo sapiens
aatatgttaaagttt

SEQ ID NO: 3003675 - DNA, 12 bp, Homo sapiens
aatatgttgact

SEQ ID NO: 3003676 - DNA, 17 bp, Homo sapiens
aatattaaaccctggat

SEQ ID NO: 3003677 - DNA, 13 bp, Homo sapiens
aatattaaatctg

SEQ ID NO: 3003678 - DNA, 21 bp, Homo sapiens
aatattaaatctgctggagtt

SEQ ID NO: 3003679 - DNA, 13 bp, Homo sapiens
aatattagatgtg

SEQ ID NO: 3003680 - DNA, 16 bp, Homo sapiens
aatattagatgtgatt

SEQ ID NO: 3003681 - DNA, 18 bp, Homo sapiens
aatattagatgtgattta

SEQ ID NO: 3003682 - DNA, 16 bp, Homo sapiens
aatattagcttgctta

SEQ ID NO: 3003683 - DNA, 15 bp, Homo sapiens
aatattagctttact

SEQ ID NO: 3003684 - DNA, 19 bp, Homo sapiens
aatattagctttactgttt

SEQ ID NO: 3003685 - DNA, 22 bp, Homo sapiens
aatattatgagatgctggcttg

SEQ ID NO: 3003686 - DNA, 21 bp, Homo sapiens
aatattcagaatctttgttaa

SEQ ID NO: 3003687 - DNA, 13 bp, Homo sapiens
aatattcccaagc

SEQ ID NO: 3003688 - DNA, 17 bp, Homo sapiens
aatattccctagaaact

SEQ ID NO: 3003689 - DNA, 15 bp, Homo sapiens
aatattgaacttttt

SEQ ID NO: 3003690 - DNA, 14 bp, Homo sapiens
aatattgaagtact

SEQ ID NO: 3003691 - DNA, 19 bp, Homo sapiens
aatattgagaaagaaacta

SEQ ID NO: 3003692 - DNA, 19 bp, Homo sapiens
aatattgtaaatgctatta

SEQ ID NO: 3003693 - DNA, 21 bp, Homo sapiens
aatattgtaaatgctattata

SEQ ID NO: 3003694 - DNA, 9 bp, Homo sapiens
aatattgtg

SEQ ID NO: 3003695 - DNA, 15 bp, Homo sapiens
aatattgtttcttta

SEQ ID NO: 3003696 - DNA, 15 bp, Homo sapiens
aatatttaaaaatgt

SEQ ID NO: 3003697 - DNA, 16 bp, Homo sapiens
aatatttacattttgc

SEQ ID NO: 3003698 - DNA, 14 bp, Homo sapiens
aatatttagcaaat

SEQ ID NO: 3003699 - DNA, 20 bp, Homo sapiens
aatatttagcaaataatttc

SEQ ID NO: 3003700 - DNA, 21 bp, Homo sapiens
aatatttagcataaatttaat

SEQ ID NO: 3003701 - DNA, 21 bp, Homo sapiens
aatatttattggatgatacag

SEQ ID NO: 3003702 - DNA, 19 bp, Homo sapiens
aatatttccagaaggattt

SEQ ID NO: 3003703 - DNA, 11 bp, Homo sapiens
aatatttctga

SEQ ID NO: 3003704 - DNA, 19 bp, Homo sapiens
aatatttcttaatttggat

SEQ ID NO: 3003705 - DNA, 20 bp, Homo sapiens
aatatttcttaatttggata

SEQ ID NO: 3003706 - DNA, 16 bp, Homo sapiens
aatatttgaagcagct

SEQ ID NO: 3003707 - DNA, 23 bp, Homo sapiens
aatatttgaagcagctctgcctt

SEQ ID NO: 3003708 - DNA, 17 bp, Homo sapiens
aatattttatttgaaaa

SEQ ID NO: 3003709 - DNA, 15 bp, Homo sapiens
aatattttgaatcaa

SEQ ID NO: 3003710 - DNA, 20 bp, Homo sapiens
aatattttgaatcaataata

SEQ ID NO: 3003711 - DNA, 14 bp, Homo sapiens
aatatttttagata

SEQ ID NO: 3003712 - DNA, 15 bp, Homo sapiens
aatatttttccctcc

SEQ ID NO: 3003713 - DNA, 22 bp, Homo sapiens
aatattttttgaggctaaagaa

SEQ ID NO: 3003714 - DNA, 14 bp, Homo sapiens
aatcaaaagtgcct

SEQ ID NO: 3003715 - DNA, 13 bp, Homo sapiens
aatcaaacacaac

SEQ ID NO: 3003716 - DNA, 21 bp, Homo sapiens
aatcaaagccggcctgagaaa

SEQ ID NO: 3003717 - DNA, 14 bp, Homo sapiens
aatcaaatcttaca

SEQ ID NO: 3003718 - DNA, 18 bp, Homo sapiens
aatcaaatcttacaaaat

SEQ ID NO: 3003719 - DNA, 23 bp, Homo sapiens
aatcaacaccaccgagctctgtg

SEQ ID NO: 3003720 - DNA, 16 bp, Homo sapiens
aatcaacactaccagc

SEQ ID NO: 3003721 - DNA, 14 bp, Homo sapiens
aatcaacctgcact

SEQ ID NO: 3003722 - DNA, 18 bp, Homo sapiens
aatcaacctgcacttcat

SEQ ID NO: 3003723 - DNA, 13 bp, Homo sapiens
aatcaacttgctt

SEQ ID NO: 3003724 - DNA, 13 bp, Homo sapiens
aatcaacttttta

SEQ ID NO: 3003725 - DNA, 18 bp, Homo sapiens
aatcaagagtctctccag

SEQ ID NO: 3003726 - DNA, 18 bp, Homo sapiens
aatcaagcaggttagaga

SEQ ID NO: 3003727 - DNA, 16 bp, Homo sapiens
aatcaagcagttattt

SEQ ID NO: 3003728 - DNA, 22 bp, Homo sapiens
aatcaagtacctatattgattt

SEQ ID NO: 3003729 - DNA, 20 bp, Homo sapiens
aatcaagtttgaccagtgca

SEQ ID NO: 3003730 - DNA, 16 bp, Homo sapiens
aatcaataaacgattt

SEQ ID NO: 3003731 - DNA, 18 bp, Homo sapiens
aatcaatttaaacccatt

SEQ ID NO: 3003732 - DNA, 16 bp, Homo sapiens
aatcaatttaaatgtt

SEQ ID NO: 3003733 - DNA, 20 bp, Homo sapiens
aatcacaggcttctgagcac

SEQ ID NO: 3003734 - DNA, 15 bp, Homo sapiens
aatcacagttggcct

SEQ ID NO: 3003735 - DNA, 20 bp, Homo sapiens
aatcacataatttgttttgt

SEQ ID NO: 3003736 - DNA, 19 bp, Homo sapiens
aatcacctgaaccccagag

SEQ ID NO: 3003737 - DNA, 14 bp, Homo sapiens
aatcactgaaacaa

SEQ ID NO: 3003738 - DNA, 14 bp, Homo sapiens
aatcactgttttta

SEQ ID NO: 3003739 - DNA, 16 bp, Homo sapiens
aatcactgtttttaga

SEQ ID NO: 3003740 - DNA, 15 bp, Homo sapiens
aatcagaataaatta

SEQ ID NO: 3003741 - DNA, 18 bp, Homo sapiens
aatcagaataaattaata

SEQ ID NO: 3003742 - DNA, 18 bp, Homo sapiens
aatcagagaccaggccct

SEQ ID NO: 3003743 - DNA, 20 bp, Homo sapiens
aatcagagtctataacagaa

SEQ ID NO: 3003744 - DNA, 14 bp, Homo sapiens
aatcagctgttgca

SEQ ID NO: 3003745 - DNA, 20 bp, Homo sapiens
aatcagctgttgcaggcagt

SEQ ID NO: 3003746 - DNA, 22 bp, Homo sapiens
aatcagctgttgcaggcagtgt

SEQ ID NO: 3003747 - DNA, 21 bp, Homo sapiens
aatcaggcatgtgtcccttcc

SEQ ID NO: 3003748 - DNA, 14 bp, Homo sapiens
aatcagtgtgaatg

SEQ ID NO: 3003749 - DNA, 14 bp, Homo sapiens
aatcagtgtttaaa

SEQ ID NO: 3003750 - DNA, 18 bp, Homo sapiens
aatcagtgtttaaataaa

SEQ ID NO: 3003751 - DNA, 23 bp, Homo sapiens
aatcagttgtttaataatttaca

SEQ ID NO: 3003752 - DNA, 19 bp, Homo sapiens
aatcatagtactctttgta

SEQ ID NO: 3003753 - DNA, 19 bp, Homo sapiens
aatcatcctgtcacaaggc

SEQ ID NO: 3003754 - DNA, 24 bp, Homo sapiens
aatcatcggagtcagccaggagct

SEQ ID NO: 3003755 - DNA, 20 bp, Homo sapiens
aatcatgagcctgtttattg

SEQ ID NO: 3003756 - DNA, 18 bp, Homo sapiens
aatcatgtagtatcaaat

SEQ ID NO: 3003757 - DNA, 23 bp, Homo sapiens
aatcatgttgatcatgtactttt

SEQ ID NO: 3003758 - DNA, 19 bp, Homo sapiens
aatcatttctatttctcct

SEQ ID NO: 3003759 - DNA, 21 bp, Homo sapiens
aatcattttagaattaaaatt

SEQ ID NO: 3003760 - DNA, 14 bp, Homo sapiens
aatccttacttcca

SEQ ID NO: 3003761 - DNA, 16 bp, Homo sapiens
aatccttacttccagc

SEQ ID NO: 3003762 - DNA, 20 bp, Homo sapiens
aatccttacttccagcaaaa

SEQ ID NO: 3003763 - DNA, 15 bp, Homo sapiens
aatccttctgcaact

SEQ ID NO: 3003764 - DNA, 22 bp, Homo sapiens
aatccttctgcaactgaaatta

SEQ ID NO: 3003765 - DNA, 17 bp, Homo sapiens
aatccttgggagtcatt

SEQ ID NO: 3003766 - DNA, 21 bp, Homo sapiens
aatcctttctgccccccaggg

SEQ ID NO: 3003767 - DNA, 18 bp, Homo sapiens
aatcgccttatgagaaca

SEQ ID NO: 3003768 - DNA, 23 bp, Homo sapiens
aatcgcttctcttttgaaacaat

SEQ ID NO: 3003769 - DNA, 18 bp, Homo sapiens
aatcggcagtattttctg

SEQ ID NO: 3003770 - DNA, 21 bp, Homo sapiens
aatcggcagtattttctgttt

SEQ ID NO: 3003771 - DNA, 19 bp, Homo sapiens
aatcgtttaatgtttatac

SEQ ID NO: 3003772 - DNA, 19 bp, Homo sapiens
aatctaaatagatactttt

SEQ ID NO: 3003773 - DNA, 23 bp, Homo sapiens
aatctaaatagatacttttgata

SEQ ID NO: 3003774 - DNA, 13 bp, Homo sapiens
aatctaaggataa

SEQ ID NO: 3003775 - DNA, 21 bp, Homo sapiens
aatctaaggataatgaaataa

SEQ ID NO: 3003776 - DNA, 22 bp, Homo sapiens
aatctaattagaattctctggg

SEQ ID NO: 3003777 - DNA, 14 bp, Homo sapiens
aatctacatttgtt

SEQ ID NO: 3003778 - DNA, 23 bp, Homo sapiens
aatctagagtttatacagtgtac

SEQ ID NO: 3003779 - DNA, 22 bp, Homo sapiens
aatctatatgattaaagaaaat

SEQ ID NO: 3003780 - DNA, 15 bp, Homo sapiens
aatctatgattccag

SEQ ID NO: 3003781 - DNA, 18 bp, Homo sapiens
aatctatgattccaggtg

SEQ ID NO: 3003782 - DNA, 23 bp, Homo sapiens
aatctatgtcgtgttttcaagga

SEQ ID NO: 3003783 - DNA, 12 bp, Homo sapiens
aatctatttaag

SEQ ID NO: 3003784 - DNA, 20 bp, Homo sapiens
aatctatttaattaggaaaa

SEQ ID NO: 3003785 - DNA, 17 bp, Homo sapiens
aatctcaatacagcctg

SEQ ID NO: 3003786 - DNA, 16 bp, Homo sapiens
aatctcaatcctgcag

SEQ ID NO: 3003787 - DNA, 16 bp, Homo sapiens
aatctcagttgatttt

SEQ ID NO: 3003788 - DNA, 21 bp, Homo sapiens
aatctcagttgattttctgga

SEQ ID NO: 3003789 - DNA, 12 bp, Homo sapiens
aatctcatttgg

SEQ ID NO: 3003790 - DNA, 18 bp, Homo sapiens
aatctcgtttcaaaaaca

SEQ ID NO: 3003791 - DNA, 21 bp, Homo sapiens
aatctctgcctagaatcttta

SEQ ID NO: 3003792 - DNA, 13 bp, Homo sapiens
aatctcttccttc

SEQ ID NO: 3003793 - DNA, 22 bp, Homo sapiens
aatctgaaaagaacaaccctga

SEQ ID NO: 3003794 - DNA, 19 bp, Homo sapiens
aatctgaattttaaaacat

SEQ ID NO: 3003795 - DNA, 14 bp, Homo sapiens
aatctgacccagtg

SEQ ID NO: 3003796 - DNA, 16 bp, Homo sapiens
aatctgagggagctga

SEQ ID NO: 3003797 - DNA, 19 bp, Homo sapiens
aatctgcaattcaaaagtt

SEQ ID NO: 3003798 - DNA, 14 bp, Homo sapiens
aatctgccttccag

SEQ ID NO: 3003799 - DNA, 17 bp, Homo sapiens
aatctgccttccagccc

SEQ ID NO: 3003800 - DNA, 15 bp, Homo sapiens
aatctggacacttct

SEQ ID NO: 3003801 - DNA, 15 bp, Homo sapiens
aatctggagaccagg

SEQ ID NO: 3003802 - DNA, 21 bp, Homo sapiens
aatctggcattctacacctgg

SEQ ID NO: 3003803 - DNA, 11 bp, Homo sapiens
aatctgtaaaa

SEQ ID NO: 3003804 - DNA, 17 bp, Homo sapiens
aatctgtaaaaaagaaa

SEQ ID NO: 3003805 - DNA, 22 bp, Homo sapiens
aatctgtagcataggctagtgg

SEQ ID NO: 3003806 - DNA, 18 bp, Homo sapiens
aatctgtataaatgtcta

SEQ ID NO: 3003807 - DNA, 13 bp, Homo sapiens
aatctgtcaagag

SEQ ID NO: 3003808 - DNA, 20 bp, Homo sapiens
aatctgtcaagagtagttat

SEQ ID NO: 3003809 - DNA, 19 bp, Homo sapiens
aatctgtcctctgtagtat

SEQ ID NO: 3003810 - DNA, 15 bp, Homo sapiens
aatctgtcctgtggc

SEQ ID NO: 3003811 - DNA, 21 bp, Homo sapiens
aatctgtcctgtggcatgcaa

SEQ ID NO: 3003812 - DNA, 13 bp, Homo sapiens
aatctgtctagaa

SEQ ID NO: 3003813 - DNA, 23 bp, Homo sapiens
aatctgtctagaatcctgcttta

SEQ ID NO: 3003814 - DNA, 22 bp, Homo sapiens
aatctgtctttgcggggcctgt

SEQ ID NO: 3003815 - DNA, 22 bp, Homo sapiens
aatctgttctactcttaatgat

SEQ ID NO: 3003816 - DNA, 15 bp, Homo sapiens
aatctgttgtttgaa

SEQ ID NO: 3003817 - DNA, 18 bp, Homo sapiens
aatcttaaatcagaataa

SEQ ID NO: 3003818 - DNA, 20 bp, Homo sapiens
aatcttaaatcagaataaat

SEQ ID NO: 3003819 - DNA, 21 bp, Homo sapiens
aatcttaaatcagaataaatt

SEQ ID NO: 3003820 - DNA, 20 bp, Homo sapiens
aatcttaaggtgtagccaca

SEQ ID NO: 3003821 - DNA, 23 bp, Homo sapiens
aatcttaccaggttcacttaaaa

SEQ ID NO: 3003822 - DNA, 16 bp, Homo sapiens
aatcttataatttaaa

SEQ ID NO: 3003823 - DNA, 19 bp, Homo sapiens
aatcttataatttaaaata

SEQ ID NO: 3003824 - DNA, 19 bp, Homo sapiens
aatcttatagttctaggca

SEQ ID NO: 3003825 - DNA, 12 bp, Homo sapiens
aatcttcagctg

SEQ ID NO: 3003826 - DNA, 17 bp, Homo sapiens
aatcttcagctggtgga

SEQ ID NO: 3003827 - DNA, 20 bp, Homo sapiens
aatcttcagctggtggatgg

SEQ ID NO: 3003828 - DNA, 23 bp, Homo sapiens
aatcttcagctggtggatggtga

SEQ ID NO: 3003829 - DNA, 22 bp, Homo sapiens
aatcttccaggtattttccact

SEQ ID NO: 3003830 - DNA, 12 bp, Homo sapiens
aatcttctactt

SEQ ID NO: 3003831 - DNA, 17 bp, Homo sapiens
aatcttgaaattaagaa

SEQ ID NO: 3003832 - DNA, 22 bp, Homo sapiens
aatcttgactacagtcaggaaa

SEQ ID NO: 3003833 - DNA, 18 bp, Homo sapiens
aatcttgcagttttgtaa

SEQ ID NO: 3003834 - DNA, 21 bp, Homo sapiens
aatcttgcagttttgtaagcc

SEQ ID NO: 3003835 - DNA, 14 bp, Homo sapiens
aatcttgctccaat

SEQ ID NO: 3003836 - DNA, 19 bp, Homo sapiens
aatcttgtaggtcattgca

SEQ ID NO: 3003837 - DNA, 17 bp, Homo sapiens
aatcttgttttaagcaa

SEQ ID NO: 3003838 - DNA, 22 bp, Homo sapiens
aatctttattatgcattcttat

SEQ ID NO: 3003839 - DNA, 18 bp, Homo sapiens
aatctttcacttgaaaga

SEQ ID NO: 3003840 - DNA, 16 bp, Homo sapiens
aatctttctgtaaaca

SEQ ID NO: 3003841 - DNA, 23 bp, Homo sapiens
aatctttcttctcgcctaggatt

SEQ ID NO: 3003842 - DNA, 16 bp, Homo sapiens
aatctttgaaagactt

SEQ ID NO: 3003843 - DNA, 23 bp, Homo sapiens
aatctttgaaagacttccaaaga

SEQ ID NO: 3003844 - DNA, 13 bp, Homo sapiens
aatctttgttaag

SEQ ID NO: 3003845 - DNA, 15 bp, Homo sapiens
aatcttttgtagttt

SEQ ID NO: 3003846 - DNA, 22 bp, Homo sapiens
aatcttttgtagtttgtattaa

SEQ ID NO: 3003847 - DNA, 13 bp, Homo sapiens
aatctttttctcc

SEQ ID NO: 3003848 - DNA, 21 bp, Homo sapiens
aatcttttttagcataaaatt

SEQ ID NO: 3003849 - DNA, 14 bp, Homo sapiens
aatgaaaaaatgta

SEQ ID NO: 3003850 - DNA, 21 bp, Homo sapiens
aatgaaaaatagtgtctttgt

SEQ ID NO: 3003851 - DNA, 16 bp, Homo sapiens
aatgaaaatgtcttgt

SEQ ID NO: 3003852 - DNA, 18 bp, Homo sapiens
aatgaaacccccacacac

SEQ ID NO: 3003853 - DNA, 14 bp, Homo sapiens
aatgaaacttggat

SEQ ID NO: 3003854 - DNA, 13 bp, Homo sapiens
aatgaaagatgat

SEQ ID NO: 3003855 - DNA, 14 bp, Homo sapiens
aatgaaatattgct

SEQ ID NO: 3003856 - DNA, 18 bp, Homo sapiens
aatgaaatgctctccttt

SEQ ID NO: 3003857 - DNA, 14 bp, Homo sapiens
aatgaaatgtatgt

SEQ ID NO: 3003858 - DNA, 12 bp, Homo sapiens
aatgaacaaatg

SEQ ID NO: 3003859 - DNA, 14 bp, Homo sapiens
aatgaacacaatca

SEQ ID NO: 3003860 - DNA, 16 bp, Homo sapiens
aggactccaggcccaa

SEQ ID NO: 3003861 - DNA, 17 bp, Homo sapiens
aggactccatttctttc

SEQ ID NO: 3003862 - DNA, 18 bp, Homo sapiens
aggactccatttctttct

SEQ ID NO: 3003863 - DNA, 19 bp, Homo sapiens
aggactgaattgtccccag

SEQ ID NO: 3003864 - DNA, 19 bp, Homo sapiens
aggactgcaccattgctgc

SEQ ID NO: 3003865 - DNA, 20 bp, Homo sapiens
aggactgcaccattgctgct

SEQ ID NO: 3003866 - DNA, 10 bp, Homo sapiens
aggactggaa

SEQ ID NO: 3003867 - DNA, 19 bp, Homo sapiens
aggactgggtctgacctgg

SEQ ID NO: 3003868 - DNA, 22 bp, Homo sapiens
aggactgggtctgacctggtgg

SEQ ID NO: 3003869 - DNA, 22 bp, Homo sapiens
aggactgtatttgtgactaatt

SEQ ID NO: 3003870 - DNA, 21 bp, Homo sapiens
aggactgtgatgccctgccct

SEQ ID NO: 3003871 - DNA, 21 bp, Homo sapiens
aggacttacccagtattactg

SEQ ID NO: 3003872 - DNA, 19 bp, Homo sapiens
aggacttatttaaactctg

SEQ ID NO: 3003873 - DNA, 20 bp, Homo sapiens
aggacttcctgtccagctcc

SEQ ID NO: 3003874 - DNA, 21 bp, Homo sapiens
aggacttcctgtccagctcca

SEQ ID NO: 3003875 - DNA, 22 bp, Homo sapiens
aggactttggtcacccagacta

SEQ ID NO: 3003876 - DNA, 14 bp, Homo sapiens
aggactttttctta

SEQ ID NO: 3003877 - DNA, 16 bp, Homo sapiens
aggagaaatgcatcca

SEQ ID NO: 3003878 - DNA, 14 bp, Homo sapiens
aggagaagcaatgg

SEQ ID NO: 3003879 - DNA, 13 bp, Homo sapiens
aggagaagccagg

SEQ ID NO: 3003880 - DNA, 18 bp, Homo sapiens
aggagaagggctggggcc

SEQ ID NO: 3003881 - DNA, 20 bp, Homo sapiens
aggagaatcacctgaacccc

SEQ ID NO: 3003882 - DNA, 16 bp, Homo sapiens
aggagaatccaagcga

SEQ ID NO: 3003883 - DNA, 17 bp, Homo sapiens
aggagaatcgcttgaac

SEQ ID NO: 3003884 - DNA, 17 bp, Homo sapiens
aggagacaaagcaggag

SEQ ID NO: 3003885 - DNA, 14 bp, Homo sapiens
aggagacacagatg

SEQ ID NO: 3003886 - DNA, 15 bp, Homo sapiens
aggagacacagatgt

SEQ ID NO: 3003887 - DNA, 14 bp, Homo sapiens
aggagacaggaagc

SEQ ID NO: 3003888 - DNA, 15 bp, Homo sapiens
aggagacaggaagcc

SEQ ID NO: 3003889 - DNA, 20 bp, Homo sapiens
aggagacaggttagctgctc

SEQ ID NO: 3003890 - DNA, 13 bp, Homo sapiens
aggagacattttc

SEQ ID NO: 3003891 - DNA, 17 bp, Homo sapiens
aggagacccaacaatga

SEQ ID NO: 3003892 - DNA, 15 bp, Homo sapiens
aggagactcacctct

SEQ ID NO: 3003893 - DNA, 16 bp, Homo sapiens
aggagactcacctctg

SEQ ID NO: 3003894 - DNA, 19 bp, Homo sapiens
aggagactcacctctgcct

SEQ ID NO: 3003895 - DNA, 21 bp, Homo sapiens
aggagactcacctctgcctca

SEQ ID NO: 3003896 - DNA, 22 bp, Homo sapiens
aggagactggtaggaggaggca

SEQ ID NO: 3003897 - DNA, 15 bp, Homo sapiens
aggagagaaaatata

SEQ ID NO: 3003898 - DNA, 12 bp, Homo sapiens
aggagagaagaa

SEQ ID NO: 3003899 - DNA, 19 bp, Homo sapiens
aggagagataccttgaaaa

SEQ ID NO: 3003900 - DNA, 11 bp, Homo sapiens
aggagagatga

SEQ ID NO: 3003901 - DNA, 16 bp, Homo sapiens
aggagagatgacccct

SEQ ID NO: 3003902 - DNA, 22 bp, Homo sapiens
aggagagattattaaatcgttt

SEQ ID NO: 3003903 - DNA, 14 bp, Homo sapiens
aggagagccagaga

SEQ ID NO: 3003904 - DNA, 23 bp, Homo sapiens
aggagagccagagaagtgacagg

SEQ ID NO: 3003905 - DNA, 17 bp, Homo sapiens
aggagaggaaaactatt

SEQ ID NO: 3003906 - DNA, 13 bp, Homo sapiens
aggagaggagagc

SEQ ID NO: 3003907 - DNA, 15 bp, Homo sapiens
aggagaggagagcca

SEQ ID NO: 3003908 - DNA, 19 bp, Homo sapiens
aggagaggagagccagaga

SEQ ID NO: 3003909 - DNA, 23 bp, Homo sapiens
aggagaggagttctttggctcta

SEQ ID NO: 3003910 - DNA, 20 bp, Homo sapiens
aggagaggcaacatccaaaa

SEQ ID NO: 3003911 - DNA, 21 bp, Homo sapiens
aggagaggcaacatccaaaat

SEQ ID NO: 3003912 - DNA, 22 bp, Homo sapiens
aggagaggttaaagcaaaccag

SEQ ID NO: 3003913 - DNA, 23 bp, Homo sapiens
aggagaggttaaagcaaaccagc

SEQ ID NO: 3003914 - DNA, 17 bp, Homo sapiens
aggagatgctccttggg

SEQ ID NO: 3003915 - DNA, 15 bp, Homo sapiens
aggagcaatcacagg

SEQ ID NO: 3003916 - DNA, 21 bp, Homo sapiens
aggagcagaaggacaggtctc

SEQ ID NO: 3003917 - DNA, 17 bp, Homo sapiens
aggagcagagaggtggc

SEQ ID NO: 3003918 - DNA, 13 bp, Homo sapiens
aggagcccagtgg

SEQ ID NO: 3003919 - DNA, 19 bp, Homo sapiens
aggagcccagtgggctgca

SEQ ID NO: 3003920 - DNA, 16 bp, Homo sapiens
aggagccccattcctg

SEQ ID NO: 3003921 - DNA, 21 bp, Homo sapiens
aggagccccattcctgggaaa

SEQ ID NO: 3003922 - DNA, 14 bp, Homo sapiens
aggagcccctgagt

SEQ ID NO: 3003923 - DNA, 10 bp, Homo sapiens
aggagcctca

SEQ ID NO: 3003924 - DNA, 14 bp, Homo sapiens
aggagcctcagaag

SEQ ID NO: 3003925 - DNA, 16 bp, Homo sapiens
aggagcctcagaagaa

SEQ ID NO: 3003926 - DNA, 16 bp, Homo sapiens
aggagcgctagtgcct

SEQ ID NO: 3003927 - DNA, 18 bp, Homo sapiens
aggagcgtgaaggactta

SEQ ID NO: 3003928 - DNA, 19 bp, Homo sapiens
aggagcgtgaaggacttag

SEQ ID NO: 3003929 - DNA, 14 bp, Homo sapiens
aggagctaaggctc

SEQ ID NO: 3003930 - DNA, 17 bp, Homo sapiens
aggagctaaggctctat

SEQ ID NO: 3003931 - DNA, 19 bp, Homo sapiens
aggagctaaggctctatga

SEQ ID NO: 3003932 - DNA, 18 bp, Homo sapiens
aggagctagttctcagct

SEQ ID NO: 3003933 - DNA, 17 bp, Homo sapiens
aggagctctgcgccagg

SEQ ID NO: 3003934 - DNA, 14 bp, Homo sapiens
aggagctgagggag

SEQ ID NO: 3003935 - DNA, 18 bp, Homo sapiens
aggagctgagggagggag

SEQ ID NO: 3003936 - DNA, 16 bp, Homo sapiens
aggagctgggaggaaa

SEQ ID NO: 3003937 - DNA, 12 bp, Homo sapiens
aggagctgggga

SEQ ID NO: 3003938 - DNA, 21 bp, Homo sapiens
aggagctggggatccctcccc

SEQ ID NO: 3003939 - DNA, 20 bp, Homo sapiens
aggagctgtcaccaaggaaa

SEQ ID NO: 3003940 - DNA, 14 bp, Homo sapiens
aggaggaacagtgg

SEQ ID NO: 3003941 - DNA, 22 bp, Homo sapiens
aggaggacaagaccctctcagg

SEQ ID NO: 3003942 - DNA, 13 bp, Homo sapiens
aggaggagctgcc

SEQ ID NO: 3003943 - DNA, 12 bp, Homo sapiens
aggaggaggcat

SEQ ID NO: 3003944 - DNA, 14 bp, Homo sapiens
aggaggaggcatgg

SEQ ID NO: 3003945 - DNA, 14 bp, Homo sapiens
aggaggattgtgct

SEQ ID NO: 3003946 - DNA, 20 bp, Homo sapiens
aggaggcagaggttgcagtg

SEQ ID NO: 3003947 - DNA, 21 bp, Homo sapiens
aggctaaagcccagagacagc

SEQ ID NO: 3003948 - DNA, 14 bp, Homo sapiens
aggctaagctgccg

SEQ ID NO: 3003949 - DNA, 17 bp, Homo sapiens
aggctagagtgcaatgg

SEQ ID NO: 3003950 - DNA, 14 bp, Homo sapiens
aggctagggtgggg

SEQ ID NO: 3003951 - DNA, 21 bp, Homo sapiens
aggctagtcttgaatttctga

SEQ ID NO: 3003952 - DNA, 19 bp, Homo sapiens
aggctcacccccttctcca

SEQ ID NO: 3003953 - DNA, 23 bp, Homo sapiens
aggctcacccccttctccatcca

SEQ ID NO: 3003954 - DNA, 13 bp, Homo sapiens
aggctcagcccac

SEQ ID NO: 3003955 - DNA, 18 bp, Homo sapiens
aggctcagcccaccctcc

SEQ ID NO: 3003956 - DNA, 15 bp, Homo sapiens
aggctccagagggca

SEQ ID NO: 3003957 - DNA, 14 bp, Homo sapiens
aggctcctccctct

SEQ ID NO: 3003958 - DNA, 17 bp, Homo sapiens
aggctcctccctctgcc

SEQ ID NO: 3003959 - DNA, 12 bp, Homo sapiens
aggctcctgtta

SEQ ID NO: 3003960 - DNA, 17 bp, Homo sapiens
aggctctagatcataag

SEQ ID NO: 3003961 - DNA, 22 bp, Homo sapiens
aggctctcgggtgggggagcca

SEQ ID NO: 3003962 - DNA, 23 bp, Homo sapiens
aggctctgagagtctagattctc

SEQ ID NO: 3003963 - DNA, 14 bp, Homo sapiens
aggctctgccttcg

SEQ ID NO: 3003964 - DNA, 16 bp, Homo sapiens
aggctctgtgccttgg

SEQ ID NO: 3003965 - DNA, 18 bp, Homo sapiens
aggctctgtgccttggtc

SEQ ID NO: 3003966 - DNA, 14 bp, Homo sapiens
aggctctgttcctc

SEQ ID NO: 3003967 - DNA, 13 bp, Homo sapiens
aggctgagaaagc

SEQ ID NO: 3003968 - DNA, 19 bp, Homo sapiens
aggctgaggaaaggccagc

SEQ ID NO: 3003969 - DNA, 15 bp, Homo sapiens
aggctgaggcagaag

SEQ ID NO: 3003970 - DNA, 13 bp, Homo sapiens
aggctgaggcagg

SEQ ID NO: 3003971 - DNA, 15 bp, Homo sapiens
aggctgaggcaggag

SEQ ID NO: 3003972 - DNA, 14 bp, Homo sapiens
aggctgaggctggc

SEQ ID NO: 3003973 - DNA, 15 bp, Homo sapiens
aggctgaggctggca

SEQ ID NO: 3003974 - DNA, 15 bp, Homo sapiens
aggctgatcatttgg

SEQ ID NO: 3003975 - DNA, 22 bp, Homo sapiens
aggctgcaaggtttaggctggt

SEQ ID NO: 3003976 - DNA, 18 bp, Homo sapiens
aggctgcaatgagccatg

SEQ ID NO: 3003977 - DNA, 18 bp, Homo sapiens
agggactgctgacccacc

SEQ ID NO: 3003978 - DNA, 22 bp, Homo sapiens
agggactgctgacccaccaagg

SEQ ID NO: 3003979 - DNA, 19 bp, Homo sapiens
agggacttttgtaaaatca

SEQ ID NO: 3003980 - DNA, 21 bp, Homo sapiens
agggagaaaggagaaattttg

SEQ ID NO: 3003981 - DNA, 13 bp, Homo sapiens
agggagaagctcc

SEQ ID NO: 3003982 - DNA, 12 bp, Homo sapiens
agggagacccag

SEQ ID NO: 3003983 - DNA, 16 bp, Homo sapiens
agggagacctggacac

SEQ ID NO: 3003984 - DNA, 14 bp, Homo sapiens
agggagagcggggc

SEQ ID NO: 3003985 - DNA, 16 bp, Homo sapiens
agggagagcggggcag

SEQ ID NO: 3003986 - DNA, 16 bp, Homo sapiens
agggagagctgagcca

SEQ ID NO: 3003987 - DNA, 16 bp, Homo sapiens
agggagaggaagagaa

SEQ ID NO: 3003988 - DNA, 20 bp, Homo sapiens
agggagaggctgtgtccctg

SEQ ID NO: 3003989 - DNA, 15 bp, Homo sapiens
agggagagggcctct

SEQ ID NO: 3003990 - DNA, 21 bp, Homo sapiens
agggagagttggggaaggcaa

SEQ ID NO: 3003991 - DNA, 15 bp, Homo sapiens
agggagcattttcct

SEQ ID NO: 3003992 - DNA, 15 bp, Homo sapiens
agggagccatttgag

SEQ ID NO: 3003993 - DNA, 19 bp, Homo sapiens
agggagcggccggccagcc

SEQ ID NO: 3003994 - DNA, 16 bp, Homo sapiens
agggagctagccagag

SEQ ID NO: 3003995 - DNA, 17 bp, Homo sapiens
agggagctagccagagg

SEQ ID NO: 3003996 - DNA, 22 bp, Homo sapiens
agggagctccaactcagaaggg

SEQ ID NO: 3003997 - DNA, 16 bp, Homo sapiens
agggagctgaggcctc

SEQ ID NO: 3003998 - DNA, 16 bp, Homo sapiens
aggtcaggaccaggac

SEQ ID NO: 3003999 - DNA, 23 bp, Homo sapiens
aggtcaggaccaggacccaggga

SEQ ID NO: 3004000 - DNA, 20 bp, Homo sapiens
aggtcaggggtgacacagac

SEQ ID NO: 3004001 - DNA, 21 bp, Homo sapiens
aggtcaggggtgacacagact

SEQ ID NO: 3004002 - DNA, 21 bp, Homo sapiens
aggttgagaggaggacttggt

SEQ ID NO: 3004003 - DNA, 16 bp, Homo sapiens
aggttgagtgagccgg

SEQ ID NO: 3004004 - DNA, 11 bp, Homo sapiens
aggttgataac

SEQ ID NO: 3004005 - DNA, 15 bp, Homo sapiens
aggttgataactttg

SEQ ID NO: 3004006 - DNA, 17 bp, Homo sapiens
aggttgataactttgct

SEQ ID NO: 3004007 - DNA, 20 bp, Homo sapiens
aggttgataactttgcttgc

SEQ ID NO: 3004008 - DNA, 12 bp, Homo sapiens
aggttgcctgaa

SEQ ID NO: 3004009 - DNA, 22 bp, Homo sapiens
aggttggcagtgatcctgcaag

SEQ ID NO: 3004010 - DNA, 14 bp, Homo sapiens
aggttggtgaattt

SEQ ID NO: 3004011 - DNA, 17 bp, Homo sapiens
aggttgtagtgagccca

SEQ ID NO: 3004012 - DNA, 14 bp, Homo sapiens
aggttgtggggagg

SEQ ID NO: 3004013 - DNA, 16 bp, Homo sapiens
aggttgtggggaggct

SEQ ID NO: 3004014 - DNA, 21 bp, Homo sapiens
aggttgtggggaggctgcact

SEQ ID NO: 3004015 - DNA, 24 bp, Homo sapiens
aggttgtggggaggctgcactgga

SEQ ID NO: 3004016 - DNA, 16 bp, Homo sapiens
aggtttaaagagtcta

SEQ ID NO: 3004017 - DNA, 20 bp, Homo sapiens
aggtttaaagagtctagatt

SEQ ID NO: 3004018 - DNA, 18 bp, Homo sapiens
aggtttaggctggtggcc

SEQ ID NO: 3004019 - DNA, 14 bp, Homo sapiens
aggtttcaaagatg

SEQ ID NO: 3004020 - DNA, 18 bp, Homo sapiens
aggtttcaagacttgata

SEQ ID NO: 3004021 - DNA, 19 bp, Homo sapiens
aggtttcactattcctatg

SEQ ID NO: 3004022 - DNA, 19 bp, Homo sapiens
aggtttcaggaagttgcca

SEQ ID NO: 3004023 - DNA, 17 bp, Homo sapiens
aggtttcctttcagccc

SEQ ID NO: 3004024 - DNA, 15 bp, Homo sapiens
aggtttcgtggcagc

SEQ ID NO: 3004025 - DNA, 15 bp, Homo sapiens
aggtttgaccaggaa

SEQ ID NO: 3004026 - DNA, 16 bp, Homo sapiens
aggtttgggacccctg

SEQ ID NO: 3004027 - DNA, 19 bp, Homo sapiens
aggttttaagttgtttgca

SEQ ID NO: 3004028 - DNA, 14 bp, Homo sapiens
aggttttaggttct

SEQ ID NO: 3004029 - DNA, 15 bp, Homo sapiens
aggttttaggttcta

SEQ ID NO: 3004030 - DNA, 16 bp, Homo sapiens
aggttttatccttcct

SEQ ID NO: 3004031 - DNA, 19 bp, Homo sapiens
aggttttcacataaatgca

SEQ ID NO: 3004032 - DNA, 19 bp, Homo sapiens
aggtttttgcccatcctcc

SEQ ID NO: 3004033 - DNA, 19 bp, Homo sapiens
aggtttttgtagtgatttt

SEQ ID NO: 3004034 - DNA, 12 bp, Homo sapiens
agtaaaaataca

SEQ ID NO: 3004035 - DNA, 17 bp, Homo sapiens
agtaaaataataatttt

SEQ ID NO: 3004036 - DNA, 17 bp, Homo sapiens
agtaaagccgttgttta

SEQ ID NO: 3004037 - DNA, 18 bp, Homo sapiens
agtaaagccgttgtttac

SEQ ID NO: 3004038 - DNA, 19 bp, Homo sapiens
agtaaaggcattccacagg

SEQ ID NO: 3004039 - DNA, 14 bp, Homo sapiens
agtaaatctctttt

SEQ ID NO: 3004040 - DNA, 19 bp, Homo sapiens
agtaacattctacttgctt

SEQ ID NO: 3004041 - DNA, 18 bp, Homo sapiens
agtaacccccactggact

SEQ ID NO: 3004042 - DNA, 13 bp, Homo sapiens
agtaacctttaaa

SEQ ID NO: 3004043 - DNA, 17 bp, Homo sapiens
agtaactataacaaaaa

SEQ ID NO: 3004044 - DNA, 20 bp, Homo sapiens
agtaactataacaaaaaaag

SEQ ID NO: 3004045 - DNA, 14 bp, Homo sapiens
agtaactgctgtcg

SEQ ID NO: 3004046 - DNA, 14 bp, Homo sapiens
agtaactgtccctg

SEQ ID NO: 3004047 - DNA, 15 bp, Homo sapiens
agtaacttggctttc

SEQ ID NO: 3004048 - DNA, 18 bp, Homo sapiens
agtaacttggctttcatt

SEQ ID NO: 3004049 - DNA, 20 bp, Homo sapiens
agtaactttatgtgtaaata

SEQ ID NO: 3004050 - DNA, 15 bp, Homo sapiens
agtaactttattctt

SEQ ID NO: 3004051 - DNA, 13 bp, Homo sapiens
agtaagaaaagtg

SEQ ID NO: 3004052 - DNA, 21 bp, Homo sapiens
agtaagaaagtgaagcaaatc

SEQ ID NO: 3004053 - DNA, 18 bp, Homo sapiens
agtaagaaatttcaggtt

SEQ ID NO: 3004054 - DNA, 17 bp, Homo sapiens
agtaagaaatttgcagt

SEQ ID NO: 3004055 - DNA, 15 bp, Homo sapiens
agtaagaagaggagc

SEQ ID NO: 3004056 - DNA, 19 bp, Homo sapiens
agtaagaagaggagcctca

SEQ ID NO: 3004057 - DNA, 21 bp, Homo sapiens
agtaagaagaggagcctcaga

SEQ ID NO: 3004058 - DNA, 18 bp, Homo sapiens
agtaagatggttttcaaa

SEQ ID NO: 3004059 - DNA, 14 bp, Homo sapiens
agtaagtattatgc

SEQ ID NO: 3004060 - DNA, 21 bp, Homo sapiens
agtaagtgcgaagactgagcc

SEQ ID NO: 3004061 - DNA, 12 bp, Homo sapiens
agtaatgaattt

SEQ ID NO: 3004062 - DNA, 21 bp, Homo sapiens
agtaatgaatttttatgatat

SEQ ID NO: 3004063 - DNA, 14 bp, Homo sapiens
agtaatgagtttaa

SEQ ID NO: 3004064 - DNA, 16 bp, Homo sapiens
agtaatgctaaatgtg

SEQ ID NO: 3004065 - DNA, 17 bp, Homo sapiens
agtaatgctaaatgtgt

SEQ ID NO: 3004066 - DNA, 19 bp, Homo sapiens
agtaatgctacgtgtgatt

SEQ ID NO: 3004067 - DNA, 14 bp, Homo sapiens
agtaattattttct

SEQ ID NO: 3004068 - DNA, 12 bp, Homo sapiens
agtaattgtgaa

SEQ ID NO: 3004069 - DNA, 14 bp, Homo sapiens
agtaatttcttttt

SEQ ID NO: 3004070 - DNA, 13 bp, Homo sapiens
agtaattttctga

SEQ ID NO: 3004071 - DNA, 14 bp, Homo sapiens
agtacaattcattg

SEQ ID NO: 3004072 - DNA, 16 bp, Homo sapiens
agtacaattcattgtt

SEQ ID NO: 3004073 - DNA, 20 bp, Homo sapiens
agtacacagcaccagaatgt

SEQ ID NO: 3004074 - DNA, 14 bp, Homo sapiens
agtacactgtgtct

SEQ ID NO: 3004075 - DNA, 16 bp, Homo sapiens
agtacagatactgtga

SEQ ID NO: 3004076 - DNA, 17 bp, Homo sapiens
agtacagatactgtgag

SEQ ID NO: 3004077 - DNA, 13 bp, Homo sapiens
agtacataattga

SEQ ID NO: 3004078 - DNA, 18 bp, Homo sapiens
agtacccctaaaatccca

SEQ ID NO: 3004079 - DNA, 23 bp, Homo sapiens
agtacctatattgatttaaaagt

SEQ ID NO: 3004080 - DNA, 13 bp, Homo sapiens
agtaccttgcttc

SEQ ID NO: 3004081 - DNA, 18 bp, Homo sapiens
agtactaaaggcttgccg

SEQ ID NO: 3004082 - DNA, 24 bp, Homo sapiens
agtactaaggtgactttctgaaac

SEQ ID NO: 3004083 - DNA, 14 bp, Homo sapiens
agtactagaaactg

SEQ ID NO: 3004084 - DNA, 23 bp, Homo sapiens
agtactgtaagaataatttatag

SEQ ID NO: 3004085 - DNA, 18 bp, Homo sapiens
agtactgtgggcaattta

SEQ ID NO: 3004086 - DNA, 19 bp, Homo sapiens
agtactgtgggcaatttag

SEQ ID NO: 3004087 - DNA, 22 bp, Homo sapiens
agtactgtgggcaatttagaaa

SEQ ID NO: 3004088 - DNA, 15 bp, Homo sapiens
agtacttcagcaaga

SEQ ID NO: 3004089 - DNA, 13 bp, Homo sapiens
agtacttttaacg

SEQ ID NO: 3004090 - DNA, 23 bp, Homo sapiens
agtacttttaacgtatgtatttc

SEQ ID NO: 3004091 - DNA, 13 bp, Homo sapiens
agtacttttttaa

SEQ ID NO: 3004092 - DNA, 23 bp, Homo sapiens
agtacttttttaaatattttcta

SEQ ID NO: 3004093 - DNA, 15 bp, Homo sapiens
agtagaagcatgttt

SEQ ID NO: 3004094 - DNA, 21 bp, Homo sapiens
agtagaatctcagttgatttt

SEQ ID NO: 3004095 - DNA, 19 bp, Homo sapiens
agtagacattttaacaaga

SEQ ID NO: 3004096 - DNA, 22 bp, Homo sapiens
agtagcaccaaataaattacac

SEQ ID NO: 3004097 - DNA, 17 bp, Homo sapiens
agtagcatctcagtggt

SEQ ID NO: 3004098 - DNA, 19 bp, Homo sapiens
agtagccaaacccctagag

SEQ ID NO: 3004099 - DNA, 21 bp, Homo sapiens
agtagcccttcagtcttaata

SEQ ID NO: 3004100 - DNA, 13 bp, Homo sapiens
agtagctgggatg

SEQ ID NO: 3004101 - DNA, 21 bp, Homo sapiens
agtagctgggattttaaacta

SEQ ID NO: 3004102 - DNA, 22 bp, Homo sapiens
agtagctgggattttaaactag

SEQ ID NO: 3004103 - DNA, 23 bp, Homo sapiens
agtagctgggattttaaactaga

SEQ ID NO: 3004104 - DNA, 13 bp, Homo sapiens
agtagctttcatt

SEQ ID NO: 3004105 - DNA, 17 bp, Homo sapiens
agtaggcatttttacca

SEQ ID NO: 3004106 - DNA, 13 bp, Homo sapiens
agtaggccctgct

SEQ ID NO: 3004107 - DNA, 13 bp, Homo sapiens
agtagtaaaaatt

SEQ ID NO: 3004108 - DNA, 18 bp, Homo sapiens
agtagtcagctagatcat

SEQ ID NO: 3004109 - DNA, 17 bp, Homo sapiens
agtagtgcatagaattc

SEQ ID NO: 3004110 - DNA, 13 bp, Homo sapiens
agtagttatataa

SEQ ID NO: 3004111 - DNA, 21 bp, Homo sapiens
agtagtttcatgtaaagaaaa

SEQ ID NO: 3004112 - DNA, 17 bp, Homo sapiens
agtataaaatacaacaa

SEQ ID NO: 3004113 - DNA, 12 bp, Homo sapiens
agtataaagtca

SEQ ID NO: 3004114 - DNA, 14 bp, Homo sapiens
agtataacaaacta

SEQ ID NO: 3004115 - DNA, 23 bp, Homo sapiens
agtatacctgtggtttggtttta

SEQ ID NO: 3004116 - DNA, 13 bp, Homo sapiens
agtatacggaaac

SEQ ID NO: 3004117 - DNA, 16 bp, Homo sapiens
agtatacgtttttaaa

SEQ ID NO: 3004118 - DNA, 16 bp, Homo sapiens
agtatattcttgtaaa

SEQ ID NO: 3004119 - DNA, 18 bp, Homo sapiens
agtatattcttgtaaata

SEQ ID NO: 3004120 - DNA, 22 bp, Homo sapiens
agtatatttcttcgttcttttt

SEQ ID NO: 3004121 - DNA, 19 bp, Homo sapiens
agtatcaagtgttctaaaa

SEQ ID NO: 3004122 - DNA, 21 bp, Homo sapiens
agtatccatgctcttgacctt

SEQ ID NO: 3004123 - DNA, 17 bp, Homo sapiens
agtatctatatatgtgt

SEQ ID NO: 3004124 - DNA, 14 bp, Homo sapiens
agtatggtacattt

SEQ ID NO: 3004125 - DNA, 16 bp, Homo sapiens
agtatggtacattttt

SEQ ID NO: 3004126 - DNA, 23 bp, Homo sapiens
agtatggtacatttttcaacttt

SEQ ID NO: 3004127 - DNA, 14 bp, Homo sapiens
agtatgtaatttct

SEQ ID NO: 3004128 - DNA, 23 bp, Homo sapiens
agtatgtattacttttgtaatca

SEQ ID NO: 3004129 - DNA, 14 bp, Homo sapiens
agtatgttgtatat

SEQ ID NO: 3004130 - DNA, 15 bp, Homo sapiens
agtatttatttatgt

SEQ ID NO: 3004131 - DNA, 16 bp, Homo sapiens
agtatttatttatgta

SEQ ID NO: 3004132 - DNA, 20 bp, Homo sapiens
agtatttatttatgtacttt

SEQ ID NO: 3004133 - DNA, 16 bp, Homo sapiens
agtatttctgattttg

SEQ ID NO: 3004134 - DNA, 17 bp, Homo sapiens
agtatttgattcaaaat

SEQ ID NO: 3004135 - DNA, 20 bp, Homo sapiens
agtatttgattcaaaatatt

SEQ ID NO: 3004136 - DNA, 23 bp, Homo sapiens
agtatttgattcaaaatatttaa

SEQ ID NO: 3004137 - DNA, 11 bp, Homo sapiens
agtatttggaa

SEQ ID NO: 3004138 - DNA, 21 bp, Homo sapiens
agtatttgggaagtgaagact

SEQ ID NO: 3004139 - DNA, 14 bp, Homo sapiens
agtattttcctgta

SEQ ID NO: 3004140 - DNA, 17 bp, Homo sapiens
agtatttttcagatata

SEQ ID NO: 3004141 - DNA, 18 bp, Homo sapiens
agtatttttcagatataa

SEQ ID NO: 3004142 - DNA, 17 bp, Homo sapiens
agtcaaaactacaaatc

SEQ ID NO: 3004143 - DNA, 12 bp, Homo sapiens
agtcaaaaggaa

SEQ ID NO: 3004144 - DNA, 19 bp, Homo sapiens
agtcaaaatatttttaaaa

SEQ ID NO: 3004145 - DNA, 21 bp, Homo sapiens
agtcaaaatatttttaaaaga

SEQ ID NO: 3004146 - DNA, 14 bp, Homo sapiens
agtcaaataaatgt

SEQ ID NO: 3004147 - DNA, 17 bp, Homo sapiens
agtcaaataaatgtttc

SEQ ID NO: 3004148 - DNA, 21 bp, Homo sapiens
agtcaaataaatgtttccccc

SEQ ID NO: 3004149 - DNA, 23 bp, Homo sapiens
agtcaaatggtaggcatttccta

SEQ ID NO: 3004150 - DNA, 22 bp, Homo sapiens
agtcaaatttgaaaataattgt

SEQ ID NO: 3004151 - DNA, 15 bp, Homo sapiens
agtcaacctgggcaa

SEQ ID NO: 3004152 - DNA, 12 bp, Homo sapiens
agtcaactggct

SEQ ID NO: 3004153 - DNA, 14 bp, Homo sapiens
agtcaactggctgg

SEQ ID NO: 3004154 - DNA, 22 bp, Homo sapiens
agtcaagaagcaattatttaaa

SEQ ID NO: 3004155 - DNA, 13 bp, Homo sapiens
agtcaagctcctc

SEQ ID NO: 3004156 - DNA, 17 bp, Homo sapiens
agtcaagctcctcctcc

SEQ ID NO: 3004157 - DNA, 20 bp, Homo sapiens
agtcaagtgcgtccacgagc

SEQ ID NO: 3004158 - DNA, 18 bp, Homo sapiens
agtcaatcaagtctgttt

SEQ ID NO: 3004159 - DNA, 24 bp, Homo sapiens
agtcaatcaagtctgtttactgca

SEQ ID NO: 3004160 - DNA, 12 bp, Homo sapiens
agtcacaatgag

SEQ ID NO: 3004161 - DNA, 17 bp, Homo sapiens
agtcacacagtgttgga

SEQ ID NO: 3004162 - DNA, 15 bp, Homo sapiens
agtcaccacttattt

SEQ ID NO: 3004163 - DNA, 13 bp, Homo sapiens
agtcaccatgcaa

SEQ ID NO: 3004164 - DNA, 14 bp, Homo sapiens
agtcaccatgcaag

SEQ ID NO: 3004165 - DNA, 15 bp, Homo sapiens
agtcaccctagccct

SEQ ID NO: 3004166 - DNA, 13 bp, Homo sapiens
agtcacctctgtc

SEQ ID NO: 3004167 - DNA, 17 bp, Homo sapiens
agtcactgagcatcact

SEQ ID NO: 3004168 - DNA, 19 bp, Homo sapiens
agtcactggcagcctgcac

SEQ ID NO: 3004169 - DNA, 13 bp, Homo sapiens
agtcacttctcca

SEQ ID NO: 3004170 - DNA, 19 bp, Homo sapiens
agtcactttttttttccaa

SEQ ID NO: 3004171 - DNA, 17 bp, Homo sapiens
agtcagaacagcagact

SEQ ID NO: 3004172 - DNA, 17 bp, Homo sapiens
agtcagaaggacggcag

SEQ ID NO: 3004173 - DNA, 18 bp, Homo sapiens
agtcagaatttttaactg

SEQ ID NO: 3004174 - DNA, 20 bp, Homo sapiens
agtcagaatttttaactgta

SEQ ID NO: 3004175 - DNA, 15 bp, Homo sapiens
agtcagagaaaacac

SEQ ID NO: 3004176 - DNA, 16 bp, Homo sapiens
agtcagcaccttggcc

SEQ ID NO: 3004177 - DNA, 23 bp, Homo sapiens
agtcagcaccttggcccaggagc

SEQ ID NO: 3004178 - DNA, 19 bp, Homo sapiens
agtcagccatgtctgtgct

SEQ ID NO: 3004179 - DNA, 23 bp, Homo sapiens
agtcagctggccagatttcctca

SEQ ID NO: 3004180 - DNA, 17 bp, Homo sapiens
agtcaggacctggcttg

SEQ ID NO: 3004181 - DNA, 22 bp, Homo sapiens
agtcaggagtccaagaccagac

SEQ ID NO: 3004182 - DNA, 19 bp, Homo sapiens
agtcagggacccctgccct

SEQ ID NO: 3004183 - DNA, 14 bp, Homo sapiens
agtcaggtccaatt

SEQ ID NO: 3004184 - DNA, 14 bp, Homo sapiens
agtcagtgatgagg

SEQ ID NO: 3004185 - DNA, 23 bp, Homo sapiens
agtcagtgcaaatgtcagataca

SEQ ID NO: 3004186 - DNA, 23 bp, Homo sapiens
agtcataccaatgaaaaaatgta

SEQ ID NO: 3004187 - DNA, 14 bp, Homo sapiens
agtcatcatctctt

SEQ ID NO: 3004188 - DNA, 20 bp, Homo sapiens
agtcatcatctcttgataaa

SEQ ID NO: 3004189 - DNA, 16 bp, Homo sapiens
agtcatctactttttt

SEQ ID NO: 3004190 - DNA, 22 bp, Homo sapiens
agtcatctatagttgatatgtt

SEQ ID NO: 3004191 - DNA, 15 bp, Homo sapiens
agtcatctcaaccat

SEQ ID NO: 3004192 - DNA, 20 bp, Homo sapiens
agtcatgggaacgcagcctc

SEQ ID NO: 3004193 - DNA, 18 bp, Homo sapiens
agtcatgtaaatactgtt

SEQ ID NO: 3004194 - DNA, 15 bp, Homo sapiens
agtcattggctgtct

SEQ ID NO: 3004195 - DNA, 17 bp, Homo sapiens
agtcattgtaacctcgt

SEQ ID NO: 3004196 - DNA, 17 bp, Homo sapiens
agtccaattttaattta

SEQ ID NO: 3004197 - DNA, 20 bp, Homo sapiens
agtccagaaactgttcccac

SEQ ID NO: 3004198 - DNA, 13 bp, Homo sapiens
agtccagctctac

SEQ ID NO: 3004199 - DNA, 11 bp, Homo sapiens
agtccaggact

SEQ ID NO: 3004200 - DNA, 14 bp, Homo sapiens
agtccatcagcctc

SEQ ID NO: 3004201 - DNA, 14 bp, Homo sapiens
agtccatgctccag

SEQ ID NO: 3004202 - DNA, 20 bp, Homo sapiens
agtccatgctccagggtcag

SEQ ID NO: 3004203 - DNA, 18 bp, Homo sapiens
agtccatttcccacatct

SEQ ID NO: 3004204 - DNA, 19 bp, Homo sapiens
agtccatttcccacatctt

SEQ ID NO: 3004205 - DNA, 22 bp, Homo sapiens
agtcccaccttggagcatttat

SEQ ID NO: 3004206 - DNA, 15 bp, Homo sapiens
agtcccagagctgca

SEQ ID NO: 3004207 - DNA, 21 bp, Homo sapiens
agtcccagagctgcacagggt

SEQ ID NO: 3004208 - DNA, 20 bp, Homo sapiens
agtcccagctacttgggagc

SEQ ID NO: 3004209 - DNA, 23 bp, Homo sapiens
agtcccagctacttgggagcctg

SEQ ID NO: 3004210 - DNA, 13 bp, Homo sapiens
agtcccaggggca

SEQ ID NO: 3004211 - DNA, 16 bp, Homo sapiens
agtccccagaagcaga

SEQ ID NO: 3004212 - DNA, 18 bp, Homo sapiens
agtccccagactctgcct

SEQ ID NO: 3004213 - DNA, 21 bp, Homo sapiens
agtcccccaaagggcctcctc

SEQ ID NO: 3004214 - DNA, 18 bp, Homo sapiens
agtccccgggcatctttg

SEQ ID NO: 3004215 - DNA, 16 bp, Homo sapiens
agtcccgaaatttgga

SEQ ID NO: 3004216 - DNA, 20 bp, Homo sapiens
agtccctatgtatttgcagt

SEQ ID NO: 3004217 - DNA, 13 bp, Homo sapiens
agtccctgcctgg

SEQ ID NO: 3004218 - DNA, 21 bp, Homo sapiens
agtccctgcctggaccagcct

SEQ ID NO: 3004219 - DNA, 21 bp, Homo sapiens
agtccctgggggaagccctgg

SEQ ID NO: 3004220 - DNA, 22 bp, Homo sapiens
agtccctgggggaagccctgga

SEQ ID NO: 3004221 - DNA, 15 bp, Homo sapiens
agtcccttaaaaatt

SEQ ID NO: 3004222 - DNA, 14 bp, Homo sapiens
agtcccttcctgct

SEQ ID NO: 3004223 - DNA, 22 bp, Homo sapiens
agtcccttttcattctcctcct

SEQ ID NO: 3004224 - DNA, 19 bp, Homo sapiens
agtcctaacttcctgtgcc

SEQ ID NO: 3004225 - DNA, 13 bp, Homo sapiens
agtcctagtgaac

SEQ ID NO: 3004226 - DNA, 18 bp, Homo sapiens
agtcctattcaaattcct

SEQ ID NO: 3004227 - DNA, 23 bp, Homo sapiens
agtcctcacttctagatctcagc

SEQ ID NO: 3004228 - DNA, 14 bp, Homo sapiens
agtcctctgcctcc

SEQ ID NO: 3004229 - DNA, 16 bp, Homo sapiens
agtcctgactgggctg

SEQ ID NO: 3004230 - DNA, 19 bp, Homo sapiens
agtcctgactgggctgggt

SEQ ID NO: 3004231 - DNA, 12 bp, Homo sapiens
agtcctgccttt

SEQ ID NO: 3004232 - DNA, 14 bp, Homo sapiens
agtcctgctggcct

SEQ ID NO: 3004233 - DNA, 20 bp, Homo sapiens
agtcctgctggcctgctctt

SEQ ID NO: 3004234 - DNA, 22 bp, Homo sapiens
agtcctggagcaatcacagatg

SEQ ID NO: 3004235 - DNA, 12 bp, Homo sapiens
agtcctggtcct

SEQ ID NO: 3004236 - DNA, 15 bp, Homo sapiens
agtcctggtcctggc

SEQ ID NO: 3004237 - DNA, 18 bp, Homo sapiens
agtcctggtcctggctgc

SEQ ID NO: 3004238 - DNA, 12 bp, Homo sapiens
agtcctggtctg

SEQ ID NO: 3004239 - DNA, 17 bp, Homo sapiens
agtcctggtctgctcag

SEQ ID NO: 3004240 - DNA, 15 bp, Homo sapiens
agtcctgtatgtctg

SEQ ID NO: 3004241 - DNA, 20 bp, Homo sapiens
agtcctgtatgtctgtcatt

SEQ ID NO: 3004242 - DNA, 21 bp, Homo sapiens
agtcctgtatgtctgtcattg

SEQ ID NO: 3004243 - DNA, 23 bp, Homo sapiens
agtcctgtatgtctgtcattgta

SEQ ID NO: 3004244 - DNA, 21 bp, Homo sapiens
agtccttaatgtcaccatgct

SEQ ID NO: 3004245 - DNA, 16 bp, Homo sapiens
agtccttcacctcact

SEQ ID NO: 3004246 - DNA, 11 bp, Homo sapiens
agtccttccac

SEQ ID NO: 3004247 - DNA, 16 bp, Homo sapiens
agtccttgaaaatatt

SEQ ID NO: 3004248 - DNA, 17 bp, Homo sapiens
agtccttgaaaatattt

SEQ ID NO: 3004249 - DNA, 20 bp, Homo sapiens
agtctagatggctcctctca

SEQ ID NO: 3004250 - DNA, 15 bp, Homo sapiens
agtctagattcaaag

SEQ ID NO: 3004251 - DNA, 20 bp, Homo sapiens
agtctaggagctgggaggaa

SEQ ID NO: 3004252 - DNA, 22 bp, Homo sapiens
agtctaggagctgggaggaaaa

SEQ ID NO: 3004253 - DNA, 12 bp, Homo sapiens
agtctagtgtag

SEQ ID NO: 3004254 - DNA, 23 bp, Homo sapiens
agtctatggccaggtatgcatgg

SEQ ID NO: 3004255 - DNA, 11 bp, Homo sapiens
agtctattttt

SEQ ID NO: 3004256 - DNA, 14 bp, Homo sapiens
agtctcaattttgt

SEQ ID NO: 3004257 - DNA, 19 bp, Homo sapiens
agtctcaattttgtattta

SEQ ID NO: 3004258 - DNA, 19 bp, Homo sapiens
agtctcactttgtcgccca

SEQ ID NO: 3004259 - DNA, 13 bp, Homo sapiens
agtctcaggagga

SEQ ID NO: 3004260 - DNA, 21 bp, Homo sapiens
agtctccactttctcaatgct

SEQ ID NO: 3004261 - DNA, 20 bp, Homo sapiens
agtctccagaagaaaatttg

SEQ ID NO: 3004262 - DNA, 22 bp, Homo sapiens
agtctccagggccccccaactg

SEQ ID NO: 3004263 - DNA, 20 bp, Homo sapiens
agtctccccttgcagcctgg

SEQ ID NO: 3004264 - DNA, 12 bp, Homo sapiens
agtctccctccg

SEQ ID NO: 3004265 - DNA, 16 bp, Homo sapiens
agtctccctccgactc

SEQ ID NO: 3004266 - DNA, 18 bp, Homo sapiens
agtctcctaggggcttgg

SEQ ID NO: 3004267 - DNA, 21 bp, Homo sapiens
agtctcctaggggcttggtcc

SEQ ID NO: 3004268 - DNA, 21 bp, Homo sapiens
agtctcctcccctactctgcc

SEQ ID NO: 3004269 - DNA, 16 bp, Homo sapiens
agtctccttctcttct

SEQ ID NO: 3004270 - DNA, 12 bp, Homo sapiens
agtctcctttga

SEQ ID NO: 3004271 - DNA, 13 bp, Homo sapiens
agtctcgctctgt

SEQ ID NO: 3004272 - DNA, 18 bp, Homo sapiens
agtctctacccctttctg

SEQ ID NO: 3004273 - DNA, 18 bp, Homo sapiens
agtctctacctatagaaa

SEQ ID NO: 3004274 - DNA, 21 bp, Homo sapiens
agtctctatcattaaagttct

SEQ ID NO: 3004275 - DNA, 14 bp, Homo sapiens
agtctctccagcct

SEQ ID NO: 3004276 - DNA, 16 bp, Homo sapiens
agtctctccagcctca

SEQ ID NO: 3004277 - DNA, 17 bp, Homo sapiens
agtctctccagcctcac

SEQ ID NO: 3004278 - DNA, 13 bp, Homo sapiens
agtctctgagcag

SEQ ID NO: 3004279 - DNA, 16 bp, Homo sapiens
agtctctggctcagct

SEQ ID NO: 3004280 - DNA, 17 bp, Homo sapiens
agtctcttaattctgat

SEQ ID NO: 3004281 - DNA, 14 bp, Homo sapiens
agtctgaagcagat

SEQ ID NO: 3004282 - DNA, 16 bp, Homo sapiens
agtctgagagaggcca

SEQ ID NO: 3004283 - DNA, 18 bp, Homo sapiens
agtctgaggcacctgcat

SEQ ID NO: 3004284 - DNA, 15 bp, Homo sapiens
agtctgcaagattct

SEQ ID NO: 3004285 - DNA, 21 bp, Homo sapiens
agtctgcagatagaaagcatt

SEQ ID NO: 3004286 - DNA, 23 bp, Homo sapiens
agtctgctctagatgagctgggc

SEQ ID NO: 3004287 - DNA, 10 bp, Homo sapiens
agtctgggtc

SEQ ID NO: 3004288 - DNA, 17 bp, Homo sapiens
agtctgggtcagaccca

SEQ ID NO: 3004289 - DNA, 21 bp, Homo sapiens
agtctgggtcagacccatctc

SEQ ID NO: 3004290 - DNA, 23 bp, Homo sapiens
agtctgggtcagacccatctctc

SEQ ID NO: 3004291 - DNA, 21 bp, Homo sapiens
agtctgtatttttaaagcatg

SEQ ID NO: 3004292 - DNA, 18 bp, Homo sapiens
agtctgtcaggtttggtt

SEQ ID NO: 3004293 - DNA, 15 bp, Homo sapiens
agtctgtccaggctc

SEQ ID NO: 3004294 - DNA, 17 bp, Homo sapiens
agtctgtcttctgtata

SEQ ID NO: 3004295 - DNA, 20 bp, Homo sapiens
agtctgtgccacgtgtttgt

SEQ ID NO: 3004296 - DNA, 21 bp, Homo sapiens
agtctgtgttcaaaaatatat

SEQ ID NO: 3004297 - DNA, 15 bp, Homo sapiens
agtctgttcactgca

SEQ ID NO: 3004298 - DNA, 13 bp, Homo sapiens
agtctgttgtgtg

SEQ ID NO: 3004299 - DNA, 21 bp, Homo sapiens
agtcttaaggacaaagtgcca

SEQ ID NO: 3004300 - DNA, 16 bp, Homo sapiens
agtcttactacagaaa

SEQ ID NO: 3004301 - DNA, 23 bp, Homo sapiens
agtcttagctgaggctgagaaag

SEQ ID NO: 3004302 - DNA, 21 bp, Homo sapiens
agtcttatctgagctgagcca

SEQ ID NO: 3004303 - DNA, 23 bp, Homo sapiens
agtcttatctgagctgagccagg

SEQ ID NO: 3004304 - DNA, 16 bp, Homo sapiens
agtcttcctcttagcc

SEQ ID NO: 3004305 - DNA, 12 bp, Homo sapiens
agtcttgcattg

SEQ ID NO: 3004306 - DNA, 15 bp, Homo sapiens
agtcttggctcactg

SEQ ID NO: 3004307 - DNA, 10 bp, Homo sapiens
agtcttgtct

SEQ ID NO: 3004308 - DNA, 18 bp, Homo sapiens
agtcttgtcttagctctg

SEQ ID NO: 3004309 - DNA, 16 bp, Homo sapiens
agtctttaatatttta

SEQ ID NO: 3004310 - DNA, 15 bp, Homo sapiens
agtctttaggtcttt

SEQ ID NO: 3004311 - DNA, 16 bp, Homo sapiens
agtctttcaagaatga

SEQ ID NO: 3004312 - DNA, 15 bp, Homo sapiens
agtctttcatgtgtg

SEQ ID NO: 3004313 - DNA, 20 bp, Homo sapiens
agtctttcatgtgtgccaag

SEQ ID NO: 3004314 - DNA, 13 bp, Homo sapiens
agtctttccccca

SEQ ID NO: 3004315 - DNA, 17 bp, Homo sapiens
agtcttttgttcgcatg

SEQ ID NO: 3004316 - DNA, 13 bp, Homo sapiens
agtgaaagtactt

SEQ ID NO: 3004317 - DNA, 21 bp, Homo sapiens
agtgaaatattgtaaatgcta

SEQ ID NO: 3004318 - DNA, 15 bp, Homo sapiens
agtgaacacagcaga

SEQ ID NO: 3004319 - DNA, 17 bp, Homo sapiens
agtgaacacagcagacc

SEQ ID NO: 3004320 - DNA, 15 bp, Homo sapiens
agtgaacagtttgga

SEQ ID NO: 3004321 - DNA, 18 bp, Homo sapiens
agtgaacagtttggatgt

SEQ ID NO: 3004322 - DNA, 22 bp, Homo sapiens
agtgaaccttaaggaagagaga

SEQ ID NO: 3004323 - DNA, 18 bp, Homo sapiens
agtgaactaagttattgt

SEQ ID NO: 3004324 - DNA, 21 bp, Homo sapiens
agtgaactaagttattgttaa

SEQ ID NO: 3004325 - DNA, 14 bp, Homo sapiens
agtgaagacagaag

SEQ ID NO: 3004326 - DNA, 15 bp, Homo sapiens
agtgaaggcttctct

SEQ ID NO: 3004327 - DNA, 13 bp, Homo sapiens
agtgaagtggcct

SEQ ID NO: 3004328 - DNA, 18 bp, Homo sapiens
agtgaagtgttctgctga

SEQ ID NO: 3004329 - DNA, 13 bp, Homo sapiens
agtgaatgattca

SEQ ID NO: 3004330 - DNA, 17 bp, Homo sapiens
agtgaatgattcagtgt

SEQ ID NO: 3004331 - DNA, 17 bp, Homo sapiens
agtgaatttttctctaa

SEQ ID NO: 3004332 - DNA, 23 bp, Homo sapiens
agtgaatttttctctaactcaga

SEQ ID NO: 3004333 - DNA, 24 bp, Homo sapiens
agtgaatttttgcaataatgcagt

SEQ ID NO: 3004334 - DNA, 20 bp, Homo sapiens
agtgacaatgcttatggaaa

SEQ ID NO: 3004335 - DNA, 15 bp, Homo sapiens
agtgacactggacca

SEQ ID NO: 3004336 - DNA, 20 bp, Homo sapiens
agtgacagatcctccatttt

SEQ ID NO: 3004337 - DNA, 14 bp, Homo sapiens
agtgacagctttcc

SEQ ID NO: 3004338 - DNA, 13 bp, Homo sapiens
agtgacagggaag

SEQ ID NO: 3004339 - DNA, 22 bp, Homo sapiens
agtgacagggaagctacaggtt

SEQ ID NO: 3004340 - DNA, 16 bp, Homo sapiens
agtgacatagcctcat

SEQ ID NO: 3004341 - DNA, 15 bp, Homo sapiens
agtgaccagggaagt

SEQ ID NO: 3004342 - DNA, 18 bp, Homo sapiens
agtgacgtgactcagagc

SEQ ID NO: 3004343 - DNA, 17 bp, Homo sapiens
agtgactgaaaccattt

SEQ ID NO: 3004344 - DNA, 14 bp, Homo sapiens
agtgagaccttgtc

SEQ ID NO: 3004345 - DNA, 16 bp, Homo sapiens
agtgagaccttgtctc

SEQ ID NO: 3004346 - DNA, 15 bp, Homo sapiens
agtgagactccatct

SEQ ID NO: 3004347 - DNA, 13 bp, Homo sapiens
agtgagaggggag

SEQ ID NO: 3004348 - DNA, 15 bp, Homo sapiens
agtgagaggggaggg

SEQ ID NO: 3004349 - DNA, 18 bp, Homo sapiens
agtgagaggggagggagg

SEQ ID NO: 3004350 - DNA, 19 bp, Homo sapiens
agtgagccagaaattgatt

SEQ ID NO: 3004351 - DNA, 23 bp, Homo sapiens
agtgagcggtgctgtcctcaggt

SEQ ID NO: 3004352 - DNA, 19 bp, Homo sapiens
agtgagtcagcaccttggc

SEQ ID NO: 3004353 - DNA, 17 bp, Homo sapiens
agtgagtctggtggagg

SEQ ID NO: 3004354 - DNA, 14 bp, Homo sapiens
agtgagtggcatgt

SEQ ID NO: 3004355 - DNA, 16 bp, Homo sapiens
agtgagtgtttctatg

SEQ ID NO: 3004356 - DNA, 14 bp, Homo sapiens
agtgagttcaacta

SEQ ID NO: 3004357 - DNA, 17 bp, Homo sapiens
agtgatacaacttcaag

SEQ ID NO: 3004358 - DNA, 23 bp, Homo sapiens
agtgatacaacttcaagtgcatg

SEQ ID NO: 3004359 - DNA, 15 bp, Homo sapiens
agtgatatggagcaa

SEQ ID NO: 3004360 - DNA, 14 bp, Homo sapiens
agcagggcggctgc

SEQ ID NO: 3004361 - DNA, 23 bp, Homo sapiens
agcagggcggctgccgactcccc

SEQ ID NO: 3004362 - DNA, 18 bp, Homo sapiens
agcaggggctgctggggg

SEQ ID NO: 3004363 - DNA, 23 bp, Homo sapiens
agcaggggctgctgggggctccc

SEQ ID NO: 3004364 - DNA, 19 bp, Homo sapiens
agcagggtacctgaaagag

SEQ ID NO: 3004365 - DNA, 16 bp, Homo sapiens
agcagggtcttttcat

SEQ ID NO: 3004366 - DNA, 19 bp, Homo sapiens
agcagggtcttttcatctg

SEQ ID NO: 3004367 - DNA, 20 bp, Homo sapiens
agcagggtcttttcatctgg

SEQ ID NO: 3004368 - DNA, 14 bp, Homo sapiens
agcaggtaccactg

SEQ ID NO: 3004369 - DNA, 20 bp, Homo sapiens
agcaggtccccagctttggc

SEQ ID NO: 3004370 - DNA, 21 bp, Homo sapiens
agcaggtccccagctttggct

SEQ ID NO: 3004371 - DNA, 13 bp, Homo sapiens
agcaggtgctgac

SEQ ID NO: 3004372 - DNA, 16 bp, Homo sapiens
agcaggttcccaagct

SEQ ID NO: 3004373 - DNA, 20 bp, Homo sapiens
agcaggttggcttttttccc

SEQ ID NO: 3004374 - DNA, 22 bp, Homo sapiens
agcaggttggcttttttccctg

SEQ ID NO: 3004375 - DNA, 17 bp, Homo sapiens
agcagtaactgtccctg

SEQ ID NO: 3004376 - DNA, 17 bp, Homo sapiens
agcagtagacattttaa

SEQ ID NO: 3004377 - DNA, 13 bp, Homo sapiens
agcagtccctgct

SEQ ID NO: 3004378 - DNA, 22 bp, Homo sapiens
agcagtcgtggctttggcagtg

SEQ ID NO: 3004379 - DNA, 17 bp, Homo sapiens
agcagtctctgccttgc

SEQ ID NO: 3004380 - DNA, 15 bp, Homo sapiens
agcagtcttgctctg

SEQ ID NO: 3004381 - DNA, 20 bp, Homo sapiens
agcagtgaatgattcagtgt

SEQ ID NO: 3004382 - DNA, 20 bp, Homo sapiens
agcagtgcacatctgaccca

SEQ ID NO: 3004383 - DNA, 13 bp, Homo sapiens
agcagtgcctgcc

SEQ ID NO: 3004384 - DNA, 20 bp, Homo sapiens
agcagtggcttagctgccat

SEQ ID NO: 3004385 - DNA, 13 bp, Homo sapiens
agcagtgggcagg

SEQ ID NO: 3004386 - DNA, 19 bp, Homo sapiens
agcagtgggcaggtggccg

SEQ ID NO: 3004387 - DNA, 13 bp, Homo sapiens
agcagtttccagt

SEQ ID NO: 3004388 - DNA, 16 bp, Homo sapiens
agcagttttgtaaatg

SEQ ID NO: 3004389 - DNA, 17 bp, Homo sapiens
agcagttttgtaaatgt

SEQ ID NO: 3004390 - DNA, 13 bp, Homo sapiens
agcataaatttaa

SEQ ID NO: 3004391 - DNA, 18 bp, Homo sapiens
agcataaatttaatgtag

SEQ ID NO: 3004392 - DNA, 13 bp, Homo sapiens
agcataacatatg

SEQ ID NO: 3004393 - DNA, 15 bp, Homo sapiens
agcataatttgttta

SEQ ID NO: 3004394 - DNA, 20 bp, Homo sapiens
agcataatttgtttaaaatt

SEQ ID NO: 3004395 - DNA, 15 bp, Homo sapiens
agcatacaaaataaa

SEQ ID NO: 3004396 - DNA, 14 bp, Homo sapiens
agcatactttgtaa

SEQ ID NO: 3004397 - DNA, 17 bp, Homo sapiens
agcatactttgtaaata

SEQ ID NO: 3004398 - DNA, 20 bp, Homo sapiens
agcataggctagtgggcagg

SEQ ID NO: 3004399 - DNA, 20 bp, Homo sapiens
agcatatgggttagatgttg

SEQ ID NO: 3004400 - DNA, 14 bp, Homo sapiens
agcatattcttcac

SEQ ID NO: 3004401 - DNA, 14 bp, Homo sapiens
agcatcaaacatga

SEQ ID NO: 3004402 - DNA, 13 bp, Homo sapiens
agcatcacagaat

SEQ ID NO: 3004403 - DNA, 19 bp, Homo sapiens
agcatcactagtgacaagt

SEQ ID NO: 3004404 - DNA, 21 bp, Homo sapiens
agcatcattgtccccatgcaa

SEQ ID NO: 3004405 - DNA, 16 bp, Homo sapiens
agcatccaagtggcat

SEQ ID NO: 3004406 - DNA, 12 bp, Homo sapiens
agcatccaggct

SEQ ID NO: 3004407 - DNA, 17 bp, Homo sapiens
agcatccccttgaactc

SEQ ID NO: 3004408 - DNA, 21 bp, Homo sapiens
agcatcccgcgcgcccttcct

SEQ ID NO: 3004409 - DNA, 16 bp, Homo sapiens
agcatccgcaggtgct

SEQ ID NO: 3004410 - DNA, 22 bp, Homo sapiens
agcatcggacaagacccccagc

SEQ ID NO: 3004411 - DNA, 20 bp, Homo sapiens
agcatctaagttataagact

SEQ ID NO: 3004412 - DNA, 15 bp, Homo sapiens
agcatctcaaatgtt

SEQ ID NO: 3004413 - DNA, 17 bp, Homo sapiens
agcatctcaaatgtttt

SEQ ID NO: 3004414 - DNA, 19 bp, Homo sapiens
agcatctcaaatgttttct

SEQ ID NO: 3004415 - DNA, 23 bp, Homo sapiens
agcatctcagtggtgtgtgaagt

SEQ ID NO: 3004416 - DNA, 14 bp, Homo sapiens
agcatctcatgagt

SEQ ID NO: 3004417 - DNA, 23 bp, Homo sapiens
agcatctccagcattctcagcca

SEQ ID NO: 3004418 - DNA, 14 bp, Homo sapiens
agcatctcttcttc

SEQ ID NO: 3004419 - DNA, 19 bp, Homo sapiens
agcatctcttcttccctgt

SEQ ID NO: 3004420 - DNA, 12 bp, Homo sapiens
agcatctgacca

SEQ ID NO: 3004421 - DNA, 13 bp, Homo sapiens
agcatctgaccat

SEQ ID NO: 3004422 - DNA, 14 bp, Homo sapiens
agcatctgaccatc

SEQ ID NO: 3004423 - DNA, 22 bp, Homo sapiens
agcatctgaccatctgtgacta

SEQ ID NO: 3004424 - DNA, 19 bp, Homo sapiens
agcatctgcattgcccagt

SEQ ID NO: 3004425 - DNA, 12 bp, Homo sapiens
agcatctgtaca

SEQ ID NO: 3004426 - DNA, 17 bp, Homo sapiens
agcatgacaaaagtgac

SEQ ID NO: 3004427 - DNA, 15 bp, Homo sapiens
agcatgacatttctt

SEQ ID NO: 3004428 - DNA, 15 bp, Homo sapiens
agcatgagtggcctt

SEQ ID NO: 3004429 - DNA, 13 bp, Homo sapiens
agcatgatgggaa

SEQ ID NO: 3004430 - DNA, 17 bp, Homo sapiens
agcatgatgggaaaata

SEQ ID NO: 3004431 - DNA, 19 bp, Homo sapiens
agcatgatgggaaaatatt

SEQ ID NO: 3004432 - DNA, 16 bp, Homo sapiens
agcatgccaacaagaa

SEQ ID NO: 3004433 - DNA, 17 bp, Homo sapiens
agcatgccaacaagaat

SEQ ID NO: 3004434 - DNA, 15 bp, Homo sapiens
agcatgccttcaaat

SEQ ID NO: 3004435 - DNA, 22 bp, Homo sapiens
agcatgcttgtgaaaatgtgtt

SEQ ID NO: 3004436 - DNA, 23 bp, Homo sapiens
agcatgcttgtgaaaatgtgttc

SEQ ID NO: 3004437 - DNA, 14 bp, Homo sapiens
agcatggacagtgt

SEQ ID NO: 3004438 - DNA, 18 bp, Homo sapiens
agcatggcactccctcca

SEQ ID NO: 3004439 - DNA, 20 bp, Homo sapiens
agcatggcactccctccagc

SEQ ID NO: 3004440 - DNA, 19 bp, Homo sapiens
agcatggccagactattcc

SEQ ID NO: 3004441 - DNA, 13 bp, Homo sapiens
agcatggccctgc

SEQ ID NO: 3004442 - DNA, 22 bp, Homo sapiens
agcatggccctgctgcccctcc

SEQ ID NO: 3004443 - DNA, 23 bp, Homo sapiens
agcatggccctgctgcccctccc

SEQ ID NO: 3004444 - DNA, 20 bp, Homo sapiens
agcatgggaatacaaaaggt

SEQ ID NO: 3004445 - DNA, 20 bp, Homo sapiens
agcatgtcgtcaaagctgaa

SEQ ID NO: 3004446 - DNA, 18 bp, Homo sapiens
agcatgtctctgcttcca

SEQ ID NO: 3004447 - DNA, 20 bp, Homo sapiens
agcatgtgaggggtagtggg

SEQ ID NO: 3004448 - DNA, 21 bp, Homo sapiens
agcatgttgttttttcatagt

SEQ ID NO: 3004449 - DNA, 12 bp, Homo sapiens
agcatgttttct

SEQ ID NO: 3004450 - DNA, 15 bp, Homo sapiens
agcatgttttctgct

SEQ ID NO: 3004451 - DNA, 20 bp, Homo sapiens
agcatgttttctgctttaaa

SEQ ID NO: 3004452 - DNA, 15 bp, Homo sapiens
agcattaaaataact

SEQ ID NO: 3004453 - DNA, 16 bp, Homo sapiens
agcattaaaataacta

SEQ ID NO: 3004454 - DNA, 20 bp, Homo sapiens
agcattagattcctttcctg

SEQ ID NO: 3004455 - DNA, 19 bp, Homo sapiens
agcattcaggcagcactga

SEQ ID NO: 3004456 - DNA, 15 bp, Homo sapiens
agcattccaacaaag

SEQ ID NO: 3004457 - DNA, 16 bp, Homo sapiens
agcattctcagccaca

SEQ ID NO: 3004458 - DNA, 14 bp, Homo sapiens
agcattctggcagt

SEQ ID NO: 3004459 - DNA, 11 bp, Homo sapiens
agcattgcttt

SEQ ID NO: 3004460 - DNA, 12 bp, Homo sapiens
agcattgctttc

SEQ ID NO: 3004461 - DNA, 19 bp, Homo sapiens
agcatttaccaacatgtat

SEQ ID NO: 3004462 - DNA, 22 bp, Homo sapiens
agcatttaccaacatgtatctg

SEQ ID NO: 3004463 - DNA, 22 bp, Homo sapiens
agcatttagaacgagcctggaa

SEQ ID NO: 3004464 - DNA, 22 bp, Homo sapiens
agcatttatgtagacattgtaa

SEQ ID NO: 3004465 - DNA, 20 bp, Homo sapiens
agcatttcaaagccctgcct

SEQ ID NO: 3004466 - DNA, 23 bp, Homo sapiens
agcatttcaaagccctgcctctg

SEQ ID NO: 3004467 - DNA, 15 bp, Homo sapiens
agcatttcccgaagg

SEQ ID NO: 3004468 - DNA, 19 bp, Homo sapiens
agccaaaccaacaccccat

SEQ ID NO: 3004469 - DNA, 19 bp, Homo sapiens
agccaaaggcatccaggcc

SEQ ID NO: 3004470 - DNA, 19 bp, Homo sapiens
agccaaagggaaatatgct

SEQ ID NO: 3004471 - DNA, 16 bp, Homo sapiens
agccaaagttaaatgt

SEQ ID NO: 3004472 - DNA, 19 bp, Homo sapiens
agccaacacgcacctgcct

SEQ ID NO: 3004473 - DNA, 15 bp, Homo sapiens
agccaacattgcctt

SEQ ID NO: 3004474 - DNA, 13 bp, Homo sapiens
agccaaccagcct

SEQ ID NO: 3004475 - DNA, 14 bp, Homo sapiens
agccaaccagcctt

SEQ ID NO: 3004476 - DNA, 14 bp, Homo sapiens
agccaactctccca

SEQ ID NO: 3004477 - DNA, 20 bp, Homo sapiens
agccaagaaacactgcctgc

SEQ ID NO: 3004478 - DNA, 15 bp, Homo sapiens
agccaagaggctgca

SEQ ID NO: 3004479 - DNA, 19 bp, Homo sapiens
agccaagatcgcaccactg

SEQ ID NO: 3004480 - DNA, 13 bp, Homo sapiens
agccaagcacagt

SEQ ID NO: 3004481 - DNA, 14 bp, Homo sapiens
agccaagcacagtg

SEQ ID NO: 3004482 - DNA, 15 bp, Homo sapiens
agccaagctccttgg

SEQ ID NO: 3004483 - DNA, 12 bp, Homo sapiens
agccaagctgtg

SEQ ID NO: 3004484 - DNA, 16 bp, Homo sapiens
agccaagggcctcggg

SEQ ID NO: 3004485 - DNA, 18 bp, Homo sapiens
agccaaggtgtcatttat

SEQ ID NO: 3004486 - DNA, 14 bp, Homo sapiens
agccacacacacag

SEQ ID NO: 3004487 - DNA, 19 bp, Homo sapiens
agccacacacacagaaaat

SEQ ID NO: 3004488 - DNA, 20 bp, Homo sapiens
agccacacacacagaaaata

SEQ ID NO: 3004489 - DNA, 22 bp, Homo sapiens
agccacacacacagaaaatata

SEQ ID NO: 3004490 - DNA, 23 bp, Homo sapiens
agccacacacacagaaaatatac

SEQ ID NO: 3004491 - DNA, 20 bp, Homo sapiens
agccacacgcaggcggccag

SEQ ID NO: 3004492 - DNA, 14 bp, Homo sapiens
agcctagaagctgg

SEQ ID NO: 3004493 - DNA, 13 bp, Homo sapiens
agcctagccctgg

SEQ ID NO: 3004494 - DNA, 17 bp, Homo sapiens
agcctaggaggactggg

SEQ ID NO: 3004495 - DNA, 20 bp, Homo sapiens
agcctagtgaaggcttctct

SEQ ID NO: 3004496 - DNA, 14 bp, Homo sapiens
agcctatggcagaa

SEQ ID NO: 3004497 - DNA, 19 bp, Homo sapiens
agcctatggcagaaaaaat

SEQ ID NO: 3004498 - DNA, 15 bp, Homo sapiens
agcctcacagatgct

SEQ ID NO: 3004499 - DNA, 20 bp, Homo sapiens
agcctcacagatgctggcct

SEQ ID NO: 3004500 - DNA, 23 bp, Homo sapiens
agcctcacagatgctggcctctt

SEQ ID NO: 3004501 - DNA, 22 bp, Homo sapiens
agcctcacttggtctgccaggc

SEQ ID NO: 3004502 - DNA, 15 bp, Homo sapiens
agcctcagcctactc

SEQ ID NO: 3004503 - DNA, 12 bp, Homo sapiens
agcctcagctca

SEQ ID NO: 3004504 - DNA, 15 bp, Homo sapiens
agcctcatgctctga

SEQ ID NO: 3004505 - DNA, 18 bp, Homo sapiens
agcctcccaacgtgctgg

SEQ ID NO: 3004506 - DNA, 18 bp, Homo sapiens
agcctcccatccagggcc

SEQ ID NO: 3004507 - DNA, 19 bp, Homo sapiens
agcctcccctgccagggca

SEQ ID NO: 3004508 - DNA, 15 bp, Homo sapiens
agcctccctgaagcc

SEQ ID NO: 3004509 - DNA, 22 bp, Homo sapiens
agcctccggggttcagcctcct

SEQ ID NO: 3004510 - DNA, 14 bp, Homo sapiens
agcctcctgtctcg

SEQ ID NO: 3004511 - DNA, 19 bp, Homo sapiens
agcctccttacattaaaaa

SEQ ID NO: 3004512 - DNA, 18 bp, Homo sapiens
agcctcgaggtgccttct

SEQ ID NO: 3004513 - DNA, 15 bp, Homo sapiens
agcctcgcacaggcc

SEQ ID NO: 3004514 - DNA, 19 bp, Homo sapiens
agcctcgcacaggccctag

SEQ ID NO: 3004515 - DNA, 21 bp, Homo sapiens
agcctcgcacaggccctagct

SEQ ID NO: 3004516 - DNA, 23 bp, Homo sapiens
agcctcgctctgttacccagggt

SEQ ID NO: 3004517 - DNA, 19 bp, Homo sapiens
agcgcaagccacagcctgt

SEQ ID NO: 3004518 - DNA, 23 bp, Homo sapiens
agcgccagggcccaggccatgtg

SEQ ID NO: 3004519 - DNA, 14 bp, Homo sapiens
agcgcccacccagg

SEQ ID NO: 3004520 - DNA, 14 bp, Homo sapiens
agcgcccccaggcc

SEQ ID NO: 3004521 - DNA, 20 bp, Homo sapiens
agcgcccccaggcctgccct

SEQ ID NO: 3004522 - DNA, 21 bp, Homo sapiens
agcgcccccaggcctgccctg

SEQ ID NO: 3004523 - DNA, 23 bp, Homo sapiens
agcgcccccaggcctgccctgct

SEQ ID NO: 3004524 - DNA, 22 bp, Homo sapiens
agcgcctagtggggtctccctc

SEQ ID NO: 3004525 - DNA, 23 bp, Homo sapiens
agcgcctagtggggtctccctct

SEQ ID NO: 3004526 - DNA, 13 bp, Homo sapiens
agcgcctggccta

SEQ ID NO: 3004527 - DNA, 20 bp, Homo sapiens
agcgcctgtcccctcacaga

SEQ ID NO: 3004528 - DNA, 17 bp, Homo sapiens
agcgcggctggctctgt

SEQ ID NO: 3004529 - DNA, 16 bp, Homo sapiens
agcgctagtgccttgc

SEQ ID NO: 3004530 - DNA, 22 bp, Homo sapiens
agcgctagtgccttgcccacag

SEQ ID NO: 3004531 - DNA, 15 bp, Homo sapiens
agcgctagtggaggg

SEQ ID NO: 3004532 - DNA, 16 bp, Homo sapiens
agcgctctggacagat

SEQ ID NO: 3004533 - DNA, 19 bp, Homo sapiens
agcgctggtcccctccctc

SEQ ID NO: 3004534 - DNA, 21 bp, Homo sapiens
agcggaataaactagagaagg

SEQ ID NO: 3004535 - DNA, 19 bp, Homo sapiens
agcggacatcagctggtca

SEQ ID NO: 3004536 - DNA, 17 bp, Homo sapiens
agcggcccaagagcccg

SEQ ID NO: 3004537 - DNA, 19 bp, Homo sapiens
agcggcccaagagcccgtg

SEQ ID NO: 3004538 - DNA, 17 bp, Homo sapiens
agcggccgcagagactg

SEQ ID NO: 3004539 - DNA, 16 bp, Homo sapiens
agcggcgccctggact

SEQ ID NO: 3004540 - DNA, 21 bp, Homo sapiens
agcggctctaaacctcaggcc

SEQ ID NO: 3004541 - DNA, 14 bp, Homo sapiens
agcggctctggtcc

SEQ ID NO: 3004542 - DNA, 20 bp, Homo sapiens
agcggctgctcgcccaggaa

SEQ ID NO: 3004543 - DNA, 21 bp, Homo sapiens
agcggctggacttggaggtag

SEQ ID NO: 3004544 - DNA, 20 bp, Homo sapiens
agcgggaatggcagctgcca

SEQ ID NO: 3004545 - DNA, 21 bp, Homo sapiens
agcgggagggagtctcaggag

SEQ ID NO: 3004546 - DNA, 16 bp, Homo sapiens
agcgggggccttgaag

SEQ ID NO: 3004547 - DNA, 17 bp, Homo sapiens
agcggtcagactggagg

SEQ ID NO: 3004548 - DNA, 14 bp, Homo sapiens
ataaattaattgtg

SEQ ID NO: 3004549 - DNA, 16 bp, Homo sapiens
ataaattatgagattt

SEQ ID NO: 3004550 - DNA, 21 bp, Homo sapiens
ataaattccccatatttgtgt

SEQ ID NO: 3004551 - DNA, 21 bp, Homo sapiens
ataaattcctctttgctttgc

SEQ ID NO: 3004552 - DNA, 17 bp, Homo sapiens
ataaattctactaagtt

SEQ ID NO: 3004553 - DNA, 21 bp, Homo sapiens
ataaattctactaagttattt

SEQ ID NO: 3004554 - DNA, 16 bp, Homo sapiens
ataaattctataggaa

SEQ ID NO: 3004555 - DNA, 12 bp, Homo sapiens
ataaatttaatg

SEQ ID NO: 3004556 - DNA, 20 bp, Homo sapiens
ataaatttgaactccatggg

SEQ ID NO: 3004557 - DNA, 16 bp, Homo sapiens
ataaatttgttgtcat

SEQ ID NO: 3004558 - DNA, 17 bp, Homo sapiens
ataaatttgttgtcatg

SEQ ID NO: 3004559 - DNA, 17 bp, Homo sapiens
ataaattttttgaaaca

SEQ ID NO: 3004560 - DNA, 16 bp, Homo sapiens
ataacaaaaaaagaaa

SEQ ID NO: 3004561 - DNA, 20 bp, Homo sapiens
ataacaaaaaaagaaaagag

SEQ ID NO: 3004562 - DNA, 14 bp, Homo sapiens
ataacaaagatatc

SEQ ID NO: 3004563 - DNA, 13 bp, Homo sapiens
ataacaaattctg

SEQ ID NO: 3004564 - DNA, 19 bp, Homo sapiens
ataacaactggatgcatca

SEQ ID NO: 3004565 - DNA, 15 bp, Homo sapiens
ataacaattcctcta

SEQ ID NO: 3004566 - DNA, 14 bp, Homo sapiens
ataacacctgccac

SEQ ID NO: 3004567 - DNA, 14 bp, Homo sapiens
ataacaggttattt

SEQ ID NO: 3004568 - DNA, 17 bp, Homo sapiens
ataacatagttgaaaaa

SEQ ID NO: 3004569 - DNA, 23 bp, Homo sapiens
ataacatagttgaaaaaagaagt

SEQ ID NO: 3004570 - DNA, 16 bp, Homo sapiens
ataacatatctaaagt

SEQ ID NO: 3004571 - DNA, 14 bp, Homo sapiens
ataacatgaaatga

SEQ ID NO: 3004572 - DNA, 11 bp, Homo sapiens
ataacattttc

SEQ ID NO: 3004573 - DNA, 21 bp, Homo sapiens
ataacctcagagtatctttac

SEQ ID NO: 3004574 - DNA, 20 bp, Homo sapiens
ataactaatgaattgaaatt

SEQ ID NO: 3004575 - DNA, 15 bp, Homo sapiens
ataactatcaggcag

SEQ ID NO: 3004576 - DNA, 22 bp, Homo sapiens
ataactatcaggcagaagaatc

SEQ ID NO: 3004577 - DNA, 15 bp, Homo sapiens
ataactattcagttg

SEQ ID NO: 3004578 - DNA, 13 bp, Homo sapiens
ataactgaaccaa

SEQ ID NO: 3004579 - DNA, 19 bp, Homo sapiens
ataactgaaccaaattgca

SEQ ID NO: 3004580 - DNA, 12 bp, Homo sapiens
ataactgaggag

SEQ ID NO: 3004581 - DNA, 14 bp, Homo sapiens
ataactgatctatt

SEQ ID NO: 3004582 - DNA, 22 bp, Homo sapiens
ataactgatctcaagtatatgt

SEQ ID NO: 3004583 - DNA, 13 bp, Homo sapiens
ataacttctatat

SEQ ID NO: 3004584 - DNA, 15 bp, Homo sapiens
ataacttctcatgta

SEQ ID NO: 3004585 - DNA, 14 bp, Homo sapiens
ataacttgctttct

SEQ ID NO: 3004586 - DNA, 21 bp, Homo sapiens
ataacttgctttcttctttcc

SEQ ID NO: 3004587 - DNA, 14 bp, Homo sapiens
ataactttatgaag

SEQ ID NO: 3004588 - DNA, 16 bp, Homo sapiens
ataactttttttcaat

SEQ ID NO: 3004589 - DNA, 21 bp, Homo sapiens
ataagaaaaaggaaaagttga

SEQ ID NO: 3004590 - DNA, 16 bp, Homo sapiens
ataagaactttgagct

SEQ ID NO: 3004591 - DNA, 11 bp, Homo sapiens
ataagacatta

SEQ ID NO: 3004592 - DNA, 18 bp, Homo sapiens
ataagagggcatatacag

SEQ ID NO: 3004593 - DNA, 16 bp, Homo sapiens
ataagagtagaaactg

SEQ ID NO: 3004594 - DNA, 18 bp, Homo sapiens
ataagataaaatgatgtt

SEQ ID NO: 3004595 - DNA, 19 bp, Homo sapiens
ataagatcctagatcctaa

SEQ ID NO: 3004596 - DNA, 19 bp, Homo sapiens
ataagatgatttaatgttg

SEQ ID NO: 3004597 - DNA, 12 bp, Homo sapiens
ataagattctaa

SEQ ID NO: 3004598 - DNA, 20 bp, Homo sapiens
ataagcataagaccaatctc

SEQ ID NO: 3004599 - DNA, 19 bp, Homo sapiens
ataagcccaaatggctctg

SEQ ID NO: 3004600 - DNA, 18 bp, Homo sapiens
ataagcttatgcttaaat

SEQ ID NO: 3004601 - DNA, 14 bp, Homo sapiens
ataagctttttaat

SEQ ID NO: 3004602 - DNA, 20 bp, Homo sapiens
ataagctttttaatgctgta

SEQ ID NO: 3004603 - DNA, 20 bp, Homo sapiens
ataaggaaatcaacttgctt

SEQ ID NO: 3004604 - DNA, 24 bp, Homo sapiens
ataaggaaatcaacttgcttatca

SEQ ID NO: 3004605 - DNA, 12 bp, Homo sapiens
ataaggaagaaa

SEQ ID NO: 3004606 - DNA, 13 bp, Homo sapiens
ataaggaagaaac

SEQ ID NO: 3004607 - DNA, 20 bp, Homo sapiens
ataagggagagctgagccag

SEQ ID NO: 3004608 - DNA, 19 bp, Homo sapiens
ataaggtgttttctgtgta

SEQ ID NO: 3004609 - DNA, 19 bp, Homo sapiens
ataaggtttcgtttctgta

SEQ ID NO: 3004610 - DNA, 17 bp, Homo sapiens
ataagtacctcagcatt

SEQ ID NO: 3004611 - DNA, 19 bp, Homo sapiens
ataagtacctcagcattta

SEQ ID NO: 3004612 - DNA, 21 bp, Homo sapiens
ataagtagatctgctttctgt

SEQ ID NO: 3004613 - DNA, 23 bp, Homo sapiens
ataagtagatctgctttctgttc

SEQ ID NO: 3004614 - DNA, 19 bp, Homo sapiens
ataagtatttcaaattgga

SEQ ID NO: 3004615 - DNA, 17 bp, Homo sapiens
ataagtcaaaaggaaca

SEQ ID NO: 3004616 - DNA, 14 bp, Homo sapiens
ataagtcattgaaa

SEQ ID NO: 3004617 - DNA, 14 bp, Homo sapiens
ataagtgaaaatct

SEQ ID NO: 3004618 - DNA, 16 bp, Homo sapiens
ataagtgaaaatctta

SEQ ID NO: 3004619 - DNA, 17 bp, Homo sapiens
ataagttaaaggcagtc

SEQ ID NO: 3004620 - DNA, 16 bp, Homo sapiens
ataagttattgcagtt

SEQ ID NO: 3004621 - DNA, 21 bp, Homo sapiens
ataagttattgcagtttatca

SEQ ID NO: 3004622 - DNA, 13 bp, Homo sapiens
ataagttgatgtt

SEQ ID NO: 3004623 - DNA, 18 bp, Homo sapiens
ataagttgatgttttcta

SEQ ID NO: 3004624 - DNA, 23 bp, Homo sapiens
ataagtttaactttaaaactgta

SEQ ID NO: 3004625 - DNA, 19 bp, Homo sapiens
ataagtttttctttaatat

SEQ ID NO: 3004626 - DNA, 17 bp, Homo sapiens
ataataaaaagaaagat

SEQ ID NO: 3004627 - DNA, 23 bp, Homo sapiens
ataataaaaagaaagatacttac

SEQ ID NO: 3004628 - DNA, 21 bp, Homo sapiens
ataataaaaattgtagctttt

SEQ ID NO: 3004629 - DNA, 12 bp, Homo sapiens
ataataaaatag

SEQ ID NO: 3004630 - DNA, 14 bp, Homo sapiens
ataataacatatat

SEQ ID NO: 3004631 - DNA, 17 bp, Homo sapiens
ataataagataaaagaa

SEQ ID NO: 3004632 - DNA, 14 bp, Homo sapiens
ataataattagtaa

SEQ ID NO: 3004633 - DNA, 16 bp, Homo sapiens
ataataattgaagaat

SEQ ID NO: 3004634 - DNA, 17 bp, Homo sapiens
ataataattgaagaatg

SEQ ID NO: 3004635 - DNA, 13 bp, Homo sapiens
ataatacattccg

SEQ ID NO: 3004636 - DNA, 16 bp, Homo sapiens
ataatactactactgt

SEQ ID NO: 3004637 - DNA, 22 bp, Homo sapiens
ataatactgctgagatacatac

SEQ ID NO: 3004638 - DNA, 23 bp, Homo sapiens
ataatagtcaatttctacttctg

SEQ ID NO: 3004639 - DNA, 14 bp, Homo sapiens
ataatatactttta

SEQ ID NO: 3004640 - DNA, 20 bp, Homo sapiens
ataatatccaggtcaacaga

SEQ ID NO: 3004641 - DNA, 20 bp, Homo sapiens
ataatatctaaagttatatt

SEQ ID NO: 3004642 - DNA, 12 bp, Homo sapiens
ataatatttctt

SEQ ID NO: 3004643 - DNA, 13 bp, Homo sapiens
ataatatttctta

SEQ ID NO: 3004644 - DNA, 14 bp, Homo sapiens
ataatatttcttaa

SEQ ID NO: 3004645 - DNA, 19 bp, Homo sapiens
ataatcatgtgaaatgttt

SEQ ID NO: 3004646 - DNA, 22 bp, Homo sapiens
ataatctggtgttcttgctaac

SEQ ID NO: 3004647 - DNA, 15 bp, Homo sapiens
ataatcttttacatt

SEQ ID NO: 3004648 - DNA, 18 bp, Homo sapiens
ataatgaaataatcagtg

SEQ ID NO: 3004649 - DNA, 14 bp, Homo sapiens
ataatgaatacttt

SEQ ID NO: 3004650 - DNA, 14 bp, Homo sapiens
ataatgacttttaa

SEQ ID NO: 3004651 - DNA, 15 bp, Homo sapiens
ataatgcagtatggt

SEQ ID NO: 3004652 - DNA, 19 bp, Homo sapiens
ataatgcagtatggtacat

SEQ ID NO: 3004653 - DNA, 22 bp, Homo sapiens
ataatgcagttgtggtgtgcca

SEQ ID NO: 3004654 - DNA, 21 bp, Homo sapiens
ataatggaaaaaaaaaaaaga

SEQ ID NO: 3004655 - DNA, 19 bp, Homo sapiens
ataatggacagattaatat

SEQ ID NO: 3004656 - DNA, 20 bp, Homo sapiens
ataatggactcagctctgtc

SEQ ID NO: 3004657 - DNA, 21 bp, Homo sapiens
ataatggactcagctctgtct

SEQ ID NO: 3004658 - DNA, 18 bp, Homo sapiens
ataatgggattagaaaca

SEQ ID NO: 3004659 - DNA, 19 bp, Homo sapiens
ataatggggtcctggccat

SEQ ID NO: 3004660 - DNA, 19 bp, Homo sapiens
ataatggtaccagataaaa

SEQ ID NO: 3004661 - DNA, 19 bp, Homo sapiens
ataatgtaaacaatatcag

SEQ ID NO: 3004662 - DNA, 14 bp, Homo sapiens
ataatgtaacatga

SEQ ID NO: 3004663 - DNA, 15 bp, Homo sapiens
ataatgtaacatgat

SEQ ID NO: 3004664 - DNA, 15 bp, Homo sapiens
ataatgtaattgtaa

SEQ ID NO: 3004665 - DNA, 17 bp, Homo sapiens
ataatgtaattgtaatt

SEQ ID NO: 3004666 - DNA, 18 bp, Homo sapiens
ataatgtagttttgttta

SEQ ID NO: 3004667 - DNA, 13 bp, Homo sapiens
ataatgtgaaaat

SEQ ID NO: 3004668 - DNA, 12 bp, Homo sapiens
ataatgttcctt

SEQ ID NO: 3004669 - DNA, 17 bp, Homo sapiens
ataatgttgtatttaat

SEQ ID NO: 3004670 - DNA, 19 bp, Homo sapiens
ataatgtttaatattgaga

SEQ ID NO: 3004671 - DNA, 23 bp, Homo sapiens
ataattcagtatgttttacactg

SEQ ID NO: 3004672 - DNA, 14 bp, Homo sapiens
ataattctatactg

SEQ ID NO: 3004673 - DNA, 16 bp, Homo sapiens
ataattgattaaaatc

SEQ ID NO: 3004674 - DNA, 19 bp, Homo sapiens
ataattgggtcatagaaat

SEQ ID NO: 3004675 - DNA, 23 bp, Homo sapiens
ataattgtgaccaatacatttgt

SEQ ID NO: 3004676 - DNA, 13 bp, Homo sapiens
ataatttaaagtt

SEQ ID NO: 3004677 - DNA, 18 bp, Homo sapiens
ataatttacaggttctta

SEQ ID NO: 3004678 - DNA, 16 bp, Homo sapiens
ataatttagtggatta

SEQ ID NO: 3004679 - DNA, 16 bp, Homo sapiens
ataatttattttgctc

SEQ ID NO: 3004680 - DNA, 12 bp, Homo sapiens
ataatttcacag

SEQ ID NO: 3004681 - DNA, 12 bp, Homo sapiens
ataatttcaggg

SEQ ID NO: 3004682 - DNA, 12 bp, Homo sapiens
ataatttctaat

SEQ ID NO: 3004683 - DNA, 14 bp, Homo sapiens
ataatttgaacttt

SEQ ID NO: 3004684 - DNA, 18 bp, Homo sapiens
ataatttgaactttggaa

SEQ ID NO: 3004685 - DNA, 18 bp, Homo sapiens
ataatttgatagatgttt

SEQ ID NO: 3004686 - DNA, 13 bp, Homo sapiens
ataatttgtttaa

SEQ ID NO: 3004687 - DNA, 12 bp, Homo sapiens
atacaaatctgt

SEQ ID NO: 3004688 - DNA, 22 bp, Homo sapiens
atacaaatctgtataaatgtct

SEQ ID NO: 3004689 - DNA, 12 bp, Homo sapiens
atacaacagtgc

SEQ ID NO: 3004690 - DNA, 20 bp, Homo sapiens
atacaacagtgctaaaaatg

SEQ ID NO: 3004691 - DNA, 21 bp, Homo sapiens
atacaacagtgctaaaaatgg

SEQ ID NO: 3004692 - DNA, 18 bp, Homo sapiens
atacaacctgcttgggtg

SEQ ID NO: 3004693 - DNA, 19 bp, Homo sapiens
atacaagttcttggtccct

SEQ ID NO: 3004694 - DNA, 17 bp, Homo sapiens
atacaattattgtatat

SEQ ID NO: 3004695 - DNA, 10 bp, Homo sapiens
atacacacac

SEQ ID NO: 3004696 - DNA, 20 bp, Homo sapiens
atacacacacacacacagcc

SEQ ID NO: 3004697 - DNA, 18 bp, Homo sapiens
atacaccagcattccttt

SEQ ID NO: 3004698 - DNA, 23 bp, Homo sapiens
atacaccccctcttctgagcaca

SEQ ID NO: 3004699 - DNA, 19 bp, Homo sapiens
atacacgggacagttgctg

SEQ ID NO: 3004700 - DNA, 23 bp, Homo sapiens
atacagaactctttcaaaacctt

SEQ ID NO: 3004701 - DNA, 20 bp, Homo sapiens
atacagaattactgtaactg

SEQ ID NO: 3004702 - DNA, 20 bp, Homo sapiens
atacagacaaacttgatttc

SEQ ID NO: 3004703 - DNA, 20 bp, Homo sapiens
atacagagattgtagtattt

SEQ ID NO: 3004704 - DNA, 19 bp, Homo sapiens
atacagagtaattatagga

SEQ ID NO: 3004705 - DNA, 20 bp, Homo sapiens
atacagcagcaagaaaaaaa

SEQ ID NO: 3004706 - DNA, 17 bp, Homo sapiens
atacagcagtagacatt

SEQ ID NO: 3004707 - DNA, 20 bp, Homo sapiens
atacagcctgaataaaccaa

SEQ ID NO: 3004708 - DNA, 20 bp, Homo sapiens
atacaggagacccaacaatg

SEQ ID NO: 3004709 - DNA, 21 bp, Homo sapiens
atacaggagacccaacaatga

SEQ ID NO: 3004710 - DNA, 20 bp, Homo sapiens
atacagtaactttatgtgta

SEQ ID NO: 3004711 - DNA, 19 bp, Homo sapiens
atacagtacaggcagcaca

SEQ ID NO: 3004712 - DNA, 19 bp, Homo sapiens
atacagtcttccatttgca

SEQ ID NO: 3004713 - DNA, 15 bp, Homo sapiens
atacagtgtacatgt

SEQ ID NO: 3004714 - DNA, 17 bp, Homo sapiens
atacagtgtacatgtac

SEQ ID NO: 3004715 - DNA, 18 bp, Homo sapiens
atacagtgtacatgtaca

SEQ ID NO: 3004716 - DNA, 19 bp, Homo sapiens
atacagtgttttttaggaa

SEQ ID NO: 3004717 - DNA, 18 bp, Homo sapiens
atacagtttataaagcca

SEQ ID NO: 3004718 - DNA, 21 bp, Homo sapiens
atacagtttataaagccaaga

SEQ ID NO: 3004719 - DNA, 14 bp, Homo sapiens
atacataaactgtc

SEQ ID NO: 3004720 - DNA, 18 bp, Homo sapiens
atacataaatagtagaaa

SEQ ID NO: 3004721 - DNA, 12 bp, Homo sapiens
atacataatggg

SEQ ID NO: 3004722 - DNA, 12 bp, Homo sapiens
atacatacagaa

SEQ ID NO: 3004723 - DNA, 16 bp, Homo sapiens
atacatagacatttca

SEQ ID NO: 3004724 - DNA, 19 bp, Homo sapiens
atacatagacatttcaaaa

SEQ ID NO: 3004725 - DNA, 13 bp, Homo sapiens
atacatatatata

SEQ ID NO: 3004726 - DNA, 20 bp, Homo sapiens
atacatatatatatataaca

SEQ ID NO: 3004727 - DNA, 20 bp, Homo sapiens
atacatatgtagaaacattt

SEQ ID NO: 3004728 - DNA, 16 bp, Homo sapiens
atacatcaatatgtat

SEQ ID NO: 3004729 - DNA, 14 bp, Homo sapiens
atacatcactgtat

SEQ ID NO: 3004730 - DNA, 16 bp, Homo sapiens
atacatcactgtatac

SEQ ID NO: 3004731 - DNA, 14 bp, Homo sapiens
atacatcacttcct

SEQ ID NO: 3004732 - DNA, 21 bp, Homo sapiens
atacatcacttcctgttttaa

SEQ ID NO: 3004733 - DNA, 19 bp, Homo sapiens
atacatgctgcgcatgttt

SEQ ID NO: 3004734 - DNA, 22 bp, Homo sapiens
atacatgctgcgcatgttttct

SEQ ID NO: 3004735 - DNA, 15 bp, Homo sapiens
atacatttgtatttt

SEQ ID NO: 3004736 - DNA, 21 bp, Homo sapiens
ataccaatgaaaaaatgtata

SEQ ID NO: 3004737 - DNA, 22 bp, Homo sapiens
ataccagcgaggaggctccaga

SEQ ID NO: 3004738 - DNA, 21 bp, Homo sapiens
ataccatatgaatgaaacatg

SEQ ID NO: 3004739 - DNA, 23 bp, Homo sapiens
ataccatatgaatgaaacatggg

SEQ ID NO: 3004740 - DNA, 19 bp, Homo sapiens
ataccgcctcgtgccagca

SEQ ID NO: 3004741 - DNA, 14 bp, Homo sapiens
ataccgtgccactt

SEQ ID NO: 3004742 - DNA, 21 bp, Homo sapiens
ataccgtgccactttccacca

SEQ ID NO: 3004743 - DNA, 13 bp, Homo sapiens
atacctaaaacat

SEQ ID NO: 3004744 - DNA, 22 bp, Homo sapiens
atacctactgactgatgacaaa

SEQ ID NO: 3004745 - DNA, 19 bp, Homo sapiens
atacctcctccctaatgct

SEQ ID NO: 3004746 - DNA, 13 bp, Homo sapiens
atacctctgtgtg

SEQ ID NO: 3004747 - DNA, 20 bp, Homo sapiens
atacctgggatactgtgccc

SEQ ID NO: 3004748 - DNA, 20 bp, Homo sapiens
atacctgtggtttggtttta

SEQ ID NO: 3004749 - DNA, 18 bp, Homo sapiens
atacctttcacagctttt

SEQ ID NO: 3004750 - DNA, 14 bp, Homo sapiens
ataccttttatttt

SEQ ID NO: 3004751 - DNA, 21 bp, Homo sapiens
atacgctggcaacacagaggc

SEQ ID NO: 3004752 - DNA, 23 bp, Homo sapiens
atacgggagtgacccagctactg

SEQ ID NO: 3004753 - DNA, 20 bp, Homo sapiens
atacgggggctgtgactctg

SEQ ID NO: 3004754 - DNA, 13 bp, Homo sapiens
atacgtttgataa

SEQ ID NO: 3004755 - DNA, 18 bp, Homo sapiens
atactaaaaatcatgaga

SEQ ID NO: 3004756 - DNA, 16 bp, Homo sapiens
atactacctataggaa

SEQ ID NO: 3004757 - DNA, 14 bp, Homo sapiens
atactactactgtt

SEQ ID NO: 3004758 - DNA, 13 bp, Homo sapiens
atactagttgtga

SEQ ID NO: 3004759 - DNA, 20 bp, Homo sapiens
atactagttgtgaccttagt

SEQ ID NO: 3004760 - DNA, 22 bp, Homo sapiens
atactattaaaaaggtttacag

SEQ ID NO: 3004761 - DNA, 15 bp, Homo sapiens
atactcataatgtga

SEQ ID NO: 3004762 - DNA, 19 bp, Homo sapiens
atactcataatgtgaagtg

SEQ ID NO: 3004763 - DNA, 12 bp, Homo sapiens
atactcatgtgt

SEQ ID NO: 3004764 - DNA, 14 bp, Homo sapiens
atactcatttctta

SEQ ID NO: 3004765 - DNA, 20 bp, Homo sapiens
atactccgtgaggctgctgc

SEQ ID NO: 3004766 - DNA, 15 bp, Homo sapiens
atactctcttccctt

SEQ ID NO: 3004767 - DNA, 16 bp, Homo sapiens
atactctcttcccttt

SEQ ID NO: 3004768 - DNA, 12 bp, Homo sapiens
atactctgttgc

SEQ ID NO: 3004769 - DNA, 17 bp, Homo sapiens
atactctgttgcctcct

SEQ ID NO: 3004770 - DNA, 19 bp, Homo sapiens
atactctgttgcctcctct

SEQ ID NO: 3004771 - DNA, 22 bp, Homo sapiens
atactctgttgcctcctctctc

SEQ ID NO: 3004772 - DNA, 15 bp, Homo sapiens
atactctgtttttca

SEQ ID NO: 3004773 - DNA, 13 bp, Homo sapiens
atactcttcccac

SEQ ID NO: 3004774 - DNA, 23 bp, Homo sapiens
atactctttctgtatatactttt

SEQ ID NO: 3004775 - DNA, 18 bp, Homo sapiens
atactgaatttctttgat

SEQ ID NO: 3004776 - DNA, 19 bp, Homo sapiens
atactgaatttctttgatt

SEQ ID NO: 3004777 - DNA, 19 bp, Homo sapiens
atactgcatgtttgctgtt

SEQ ID NO: 3004778 - DNA, 16 bp, Homo sapiens
atactgccagatgctg

SEQ ID NO: 3004779 - DNA, 21 bp, Homo sapiens
atactgctgagatacatacag

SEQ ID NO: 3004780 - DNA, 22 bp, Homo sapiens
atactgctgagatacatacaga

SEQ ID NO: 3004781 - DNA, 21 bp, Homo sapiens
atactgctgatgctgaaataa

SEQ ID NO: 3004782 - DNA, 21 bp, Homo sapiens
atactgcttgcttacaatctt

SEQ ID NO: 3004783 - DNA, 20 bp, Homo sapiens
atactgcttggagctgagca

SEQ ID NO: 3004784 - DNA, 13 bp, Homo sapiens
atactgcttgtca

SEQ ID NO: 3004785 - DNA, 23 bp, Homo sapiens
atactgcttgtcatctgcatgtc

SEQ ID NO: 3004786 - DNA, 18 bp, Homo sapiens
atactgtaaagaaagaga

SEQ ID NO: 3004787 - DNA, 16 bp, Homo sapiens
atactgtagtattctt

SEQ ID NO: 3004788 - DNA, 14 bp, Homo sapiens
atactgtgaagtta

SEQ ID NO: 3004789 - DNA, 14 bp, Homo sapiens
atactgttatccat

SEQ ID NO: 3004790 - DNA, 21 bp, Homo sapiens
atacttaaatggaaaaaatga

SEQ ID NO: 3004791 - DNA, 16 bp, Homo sapiens
atacttaatactgaat

SEQ ID NO: 3004792 - DNA, 17 bp, Homo sapiens
atacttacatgttccca

SEQ ID NO: 3004793 - DNA, 15 bp, Homo sapiens
atacttattaagttc

SEQ ID NO: 3004794 - DNA, 14 bp, Homo sapiens
atacttcaaaagta

SEQ ID NO: 3004795 - DNA, 16 bp, Homo sapiens
atacttgaagggccag

SEQ ID NO: 3004796 - DNA, 17 bp, Homo sapiens
atacttgaagggccaga

SEQ ID NO: 3004797 - DNA, 20 bp, Homo sapiens
atacttgaagggccagagcc

SEQ ID NO: 3004798 - DNA, 18 bp, Homo sapiens
atacttgcattccagagt

SEQ ID NO: 3004799 - DNA, 16 bp, Homo sapiens
atactttatcaaagat

SEQ ID NO: 3004800 - DNA, 17 bp, Homo sapiens
atactttatcaaagatt

SEQ ID NO: 3004801 - DNA, 20 bp, Homo sapiens
atactttcggagaaattctc

SEQ ID NO: 3004802 - DNA, 17 bp, Homo sapiens
atactttgttgttttta

SEQ ID NO: 3004803 - DNA, 14 bp, Homo sapiens
atacttttaaatta

SEQ ID NO: 3004804 - DNA, 16 bp, Homo sapiens
atacttttaaattatg

SEQ ID NO: 3004805 - DNA, 12 bp, Homo sapiens
atacttttcctt

SEQ ID NO: 3004806 - DNA, 19 bp, Homo sapiens
atacttttccttaccttta

SEQ ID NO: 3004807 - DNA, 20 bp, Homo sapiens
atactttttacaattaaaaa

SEQ ID NO: 3004808 - DNA, 15 bp, Homo sapiens
atagaaaaaaaatct

SEQ ID NO: 3004809 - DNA, 16 bp, Homo sapiens
atagaaaaatgatgtc

SEQ ID NO: 3004810 - DNA, 18 bp, Homo sapiens
atagaaaagcacttgaag

SEQ ID NO: 3004811 - DNA, 20 bp, Homo sapiens
atagaaacactttctcactt

SEQ ID NO: 3004812 - DNA, 14 bp, Homo sapiens
atagaaataaattc

SEQ ID NO: 3004813 - DNA, 23 bp, Homo sapiens
atagaaatggaaattttgctatc

SEQ ID NO: 3004814 - DNA, 20 bp, Homo sapiens
atagaacacagagtgtgttt

SEQ ID NO: 3004815 - DNA, 16 bp, Homo sapiens
atagaagagaagagcc

SEQ ID NO: 3004816 - DNA, 13 bp, Homo sapiens
atagaagtaaaaa

SEQ ID NO: 3004817 - DNA, 16 bp, Homo sapiens
atagaagttttaaatt

SEQ ID NO: 3004818 - DNA, 20 bp, Homo sapiens
atagaatttcctaatgagat

SEQ ID NO: 3004819 - DNA, 21 bp, Homo sapiens
atagacatttcaaaattaata

SEQ ID NO: 3004820 - DNA, 16 bp, Homo sapiens
atagaccctctttctt

SEQ ID NO: 3004821 - DNA, 13 bp, Homo sapiens
agtgcagaatgta

SEQ ID NO: 3004822 - DNA, 23 bp, Homo sapiens
agtgcagaatgtaagtgggccca

SEQ ID NO: 3004823 - DNA, 20 bp, Homo sapiens
agtgcagagatcctacttct

SEQ ID NO: 3004824 - DNA, 17 bp, Homo sapiens
agtgcagccgtttgaga

SEQ ID NO: 3004825 - DNA, 18 bp, Homo sapiens
agtgcagctaacatgagt

SEQ ID NO: 3004826 - DNA, 18 bp, Homo sapiens
agtgcaggggatggggtg

SEQ ID NO: 3004827 - DNA, 21 bp, Homo sapiens
agtgcatccccacgacccctg

SEQ ID NO: 3004828 - DNA, 22 bp, Homo sapiens
agtgcatccccacgacccctgc

SEQ ID NO: 3004829 - DNA, 13 bp, Homo sapiens
agtgcatctactt

SEQ ID NO: 3004830 - DNA, 15 bp, Homo sapiens
agtgcatgctctctg

SEQ ID NO: 3004831 - DNA, 13 bp, Homo sapiens
agtgcattagaaa

SEQ ID NO: 3004832 - DNA, 15 bp, Homo sapiens
agtgcattgtttctg

SEQ ID NO: 3004833 - DNA, 16 bp, Homo sapiens
agtgcattgtttctgt

SEQ ID NO: 3004834 - DNA, 20 bp, Homo sapiens
agtgcattgtttctgtgggc

SEQ ID NO: 3004835 - DNA, 17 bp, Homo sapiens
agtgcattttgtttctg

SEQ ID NO: 3004836 - DNA, 22 bp, Homo sapiens
agtgcattttgtttctgtatat

SEQ ID NO: 3004837 - DNA, 16 bp, Homo sapiens
agtgccaacaatccta

SEQ ID NO: 3004838 - DNA, 21 bp, Homo sapiens
agtgccaacaatcctagtgct

SEQ ID NO: 3004839 - DNA, 16 bp, Homo sapiens
agtgccaactgtggct

SEQ ID NO: 3004840 - DNA, 12 bp, Homo sapiens
agtgccaccaca

SEQ ID NO: 3004841 - DNA, 14 bp, Homo sapiens
agtgccagcccctg

SEQ ID NO: 3004842 - DNA, 15 bp, Homo sapiens
agtgccagctccctc

SEQ ID NO: 3004843 - DNA, 15 bp, Homo sapiens
agtgcccaactgtta

SEQ ID NO: 3004844 - DNA, 19 bp, Homo sapiens
agtgcccaccaacatccca

SEQ ID NO: 3004845 - DNA, 21 bp, Homo sapiens
agtgccccagacagttctttt

SEQ ID NO: 3004846 - DNA, 13 bp, Homo sapiens
agtgccccagact

SEQ ID NO: 3004847 - DNA, 20 bp, Homo sapiens
agtgccccagactgagctct

SEQ ID NO: 3004848 - DNA, 21 bp, Homo sapiens
agtgccccagactgagctctc

SEQ ID NO: 3004849 - DNA, 20 bp, Homo sapiens
agtgccccattcttttgtaa

SEQ ID NO: 3004850 - DNA, 16 bp, Homo sapiens
agtgcccccactgacc

SEQ ID NO: 3004851 - DNA, 22 bp, Homo sapiens
agtgccggaggccttggggtgg

SEQ ID NO: 3004852 - DNA, 22 bp, Homo sapiens
agtgcctccccttcttgtgtcc

SEQ ID NO: 3004853 - DNA, 16 bp, Homo sapiens
agtgccttctaaaggt

SEQ ID NO: 3004854 - DNA, 11 bp, Homo sapiens
agtgccttctc

SEQ ID NO: 3004855 - DNA, 20 bp, Homo sapiens
agtgcctttatctcagccat

SEQ ID NO: 3004856 - DNA, 19 bp, Homo sapiens
agtgccttttgcagaagag

SEQ ID NO: 3004857 - DNA, 15 bp, Homo sapiens
agtgcggcgtggaga

SEQ ID NO: 3004858 - DNA, 18 bp, Homo sapiens
agtgcggcgtggagactg

SEQ ID NO: 3004859 - DNA, 23 bp, Homo sapiens
agtgcggcgtggagactggcagg

SEQ ID NO: 3004860 - DNA, 15 bp, Homo sapiens
agtgcgtccacgagc

SEQ ID NO: 3004861 - DNA, 14 bp, Homo sapiens
agtgctaaaaatgg

SEQ ID NO: 3004862 - DNA, 20 bp, Homo sapiens
agtgctaaaaatgggacttc

SEQ ID NO: 3004863 - DNA, 18 bp, Homo sapiens
agtgctaaagttttcttc

SEQ ID NO: 3004864 - DNA, 12 bp, Homo sapiens
agtgctatttca

SEQ ID NO: 3004865 - DNA, 23 bp, Homo sapiens
agtgctcaagcagcaaaatcctt

SEQ ID NO: 3004866 - DNA, 20 bp, Homo sapiens
agtgctgagattacagacgt

SEQ ID NO: 3004867 - DNA, 20 bp, Homo sapiens
agtgctgagattacaggcat

SEQ ID NO: 3004868 - DNA, 21 bp, Homo sapiens
agtgctgcccatgagcaagcc

SEQ ID NO: 3004869 - DNA, 16 bp, Homo sapiens
agtgctggcccaccca

SEQ ID NO: 3004870 - DNA, 17 bp, Homo sapiens
agtgctgggattacagg

SEQ ID NO: 3004871 - DNA, 20 bp, Homo sapiens
agtgctgtgctgtgtttaat

SEQ ID NO: 3004872 - DNA, 12 bp, Homo sapiens
agtgctgtttag

SEQ ID NO: 3004873 - DNA, 18 bp, Homo sapiens
agtgcttctccaacactg

SEQ ID NO: 3004874 - DNA, 19 bp, Homo sapiens
agtgcttctccaacactga

SEQ ID NO: 3004875 - DNA, 13 bp, Homo sapiens
agtgcttcttgta

SEQ ID NO: 3004876 - DNA, 13 bp, Homo sapiens
agtgcttggcaca

SEQ ID NO: 3004877 - DNA, 21 bp, Homo sapiens
agtgcttgggggtttttgaag

SEQ ID NO: 3004878 - DNA, 22 bp, Homo sapiens
agtgcttgggggtttttgaagt

SEQ ID NO: 3004879 - DNA, 13 bp, Homo sapiens
agtgcttgtgtaa

SEQ ID NO: 3004880 - DNA, 14 bp, Homo sapiens
agtgcttgtgtaat

SEQ ID NO: 3004881 - DNA, 19 bp, Homo sapiens
agtgctttccttttttaaa

SEQ ID NO: 3004882 - DNA, 11 bp, Homo sapiens
agtggaaaaag

SEQ ID NO: 3004883 - DNA, 15 bp, Homo sapiens
agtggaaatgttcta

SEQ ID NO: 3004884 - DNA, 13 bp, Homo sapiens
agtggaagccact

SEQ ID NO: 3004885 - DNA, 21 bp, Homo sapiens
agtggaccacttggaaataaa

SEQ ID NO: 3004886 - DNA, 16 bp, Homo sapiens
agtggaccaggacagg

SEQ ID NO: 3004887 - DNA, 20 bp, Homo sapiens
agtggaccaggacaggacca

SEQ ID NO: 3004888 - DNA, 19 bp, Homo sapiens
agtggaccttaggccttcc

SEQ ID NO: 3004889 - DNA, 20 bp, Homo sapiens
agtggaccttaggccttcct

SEQ ID NO: 3004890 - DNA, 13 bp, Homo sapiens
agtggactcaggg

SEQ ID NO: 3004891 - DNA, 14 bp, Homo sapiens
agtggacttctgaa

SEQ ID NO: 3004892 - DNA, 22 bp, Homo sapiens
agtggacttctgaaaaatgaat

SEQ ID NO: 3004893 - DNA, 23 bp, Homo sapiens
agtggaggttaaggctgaggaaa

SEQ ID NO: 3004894 - DNA, 21 bp, Homo sapiens
agtggaggttgagtgagccgg

SEQ ID NO: 3004895 - DNA, 23 bp, Homo sapiens
agtggagttgttttaacagatgc

SEQ ID NO: 3004896 - DNA, 16 bp, Homo sapiens
agtggatctcagtttt

SEQ ID NO: 3004897 - DNA, 13 bp, Homo sapiens
agtggatgatgtt

SEQ ID NO: 3004898 - DNA, 20 bp, Homo sapiens
agtggatgatgtttcgtgaa

SEQ ID NO: 3004899 - DNA, 16 bp, Homo sapiens
agtggatgctgtgcta

SEQ ID NO: 3004900 - DNA, 12 bp, Homo sapiens
agtggatgtata

SEQ ID NO: 3004901 - DNA, 19 bp, Homo sapiens
agtggccacggcccaggga

SEQ ID NO: 3004902 - DNA, 14 bp, Homo sapiens
agtggccactaagc

SEQ ID NO: 3004903 - DNA, 20 bp, Homo sapiens
agtggccactaagcagagga

SEQ ID NO: 3004904 - DNA, 15 bp, Homo sapiens
agtggccagcgccag

SEQ ID NO: 3004905 - DNA, 17 bp, Homo sapiens
agtggccagcgccaggg

SEQ ID NO: 3004906 - DNA, 15 bp, Homo sapiens
agtggccccacctgt

SEQ ID NO: 3004907 - DNA, 20 bp, Homo sapiens
agtggccccacctgtgtccc

SEQ ID NO: 3004908 - DNA, 14 bp, Homo sapiens
agtggcctagagca

SEQ ID NO: 3004909 - DNA, 14 bp, Homo sapiens
agtggcctcttgga

SEQ ID NO: 3004910 - DNA, 14 bp, Homo sapiens
agtggcctctttgt

SEQ ID NO: 3004911 - DNA, 15 bp, Homo sapiens
agtggcctctttgtc

SEQ ID NO: 3004912 - DNA, 12 bp, Homo sapiens
agtggcctggcc

SEQ ID NO: 3004913 - DNA, 23 bp, Homo sapiens
agtggcctggccgttcagcctgt

SEQ ID NO: 3004914 - DNA, 14 bp, Homo sapiens
agtggcgtgagctg

SEQ ID NO: 3004915 - DNA, 14 bp, Homo sapiens
agtggctagtcctc

SEQ ID NO: 3004916 - DNA, 16 bp, Homo sapiens
agtggctcgccaggcc

SEQ ID NO: 3004917 - DNA, 21 bp, Homo sapiens
agtggcttagctgccatcttg

SEQ ID NO: 3004918 - DNA, 14 bp, Homo sapiens
agtggcttctttcc

SEQ ID NO: 3004919 - DNA, 14 bp, Homo sapiens
agtggcttgtcctc

SEQ ID NO: 3004920 - DNA, 18 bp, Homo sapiens
agtgggaaagcattttct

SEQ ID NO: 3004921 - DNA, 13 bp, Homo sapiens
agtgggagaaaac

SEQ ID NO: 3004922 - DNA, 17 bp, Homo sapiens
agtgggagaaaacactt

SEQ ID NO: 3004923 - DNA, 20 bp, Homo sapiens
atagacttattcttttataa

SEQ ID NO: 3004924 - DNA, 19 bp, Homo sapiens
atagacttggagaatactg

SEQ ID NO: 3004925 - DNA, 20 bp, Homo sapiens
atagacttggagaatactgc

SEQ ID NO: 3004926 - DNA, 22 bp, Homo sapiens
atagacttggagaatactgcca

SEQ ID NO: 3004927 - DNA, 22 bp, Homo sapiens
atagagaaggaaagctttggca

SEQ ID NO: 3004928 - DNA, 18 bp, Homo sapiens
atagagagggagaagaag

SEQ ID NO: 3004929 - DNA, 16 bp, Homo sapiens
atagagatatttaaaa

SEQ ID NO: 3004930 - DNA, 21 bp, Homo sapiens
atagagatatttaaaagacaa

SEQ ID NO: 3004931 - DNA, 13 bp, Homo sapiens
atagagctgccac

SEQ ID NO: 3004932 - DNA, 14 bp, Homo sapiens
atagagctgtatta

SEQ ID NO: 3004933 - DNA, 23 bp, Homo sapiens
atagagctgttcaacatcactga

SEQ ID NO: 3004934 - DNA, 18 bp, Homo sapiens
atagagcttttaaaaatg

SEQ ID NO: 3004935 - DNA, 19 bp, Homo sapiens
atagaggctaaattactca

SEQ ID NO: 3004936 - DNA, 21 bp, Homo sapiens
atagaggctttgagcaactaa

SEQ ID NO: 3004937 - DNA, 21 bp, Homo sapiens
atagagggccacggggaggcc

SEQ ID NO: 3004938 - DNA, 16 bp, Homo sapiens
atagagtgtagtttac

SEQ ID NO: 3004939 - DNA, 13 bp, Homo sapiens
atagagtgttttt

SEQ ID NO: 3004940 - DNA, 20 bp, Homo sapiens
atagataagagtagaaactg

SEQ ID NO: 3004941 - DNA, 15 bp, Homo sapiens
atagatacttttgat

SEQ ID NO: 3004942 - DNA, 18 bp, Homo sapiens
atagatagtaaaaagctt

SEQ ID NO: 3004943 - DNA, 19 bp, Homo sapiens
atagatggacagtttgttt

SEQ ID NO: 3004944 - DNA, 20 bp, Homo sapiens
atagatggacagtttgtttc

SEQ ID NO: 3004945 - DNA, 13 bp, Homo sapiens
atagatgggaatg

SEQ ID NO: 3004946 - DNA, 19 bp, Homo sapiens
atagatgggaatgaagctt

SEQ ID NO: 3004947 - DNA, 12 bp, Homo sapiens
atagatgtttga

SEQ ID NO: 3004948 - DNA, 16 bp, Homo sapiens
atagatgttttaactt

SEQ ID NO: 3004949 - DNA, 12 bp, Homo sapiens
atagattctaaa

SEQ ID NO: 3004950 - DNA, 21 bp, Homo sapiens
atagatttgaagatctgattt

SEQ ID NO: 3004951 - DNA, 14 bp, Homo sapiens
atagatttgacctc

SEQ ID NO: 3004952 - DNA, 19 bp, Homo sapiens
atagcaaagatatatattc

SEQ ID NO: 3004953 - DNA, 18 bp, Homo sapiens
atagcaagacctcatctc

SEQ ID NO: 3004954 - DNA, 20 bp, Homo sapiens
atagcaagtgctatttcagc

SEQ ID NO: 3004955 - DNA, 16 bp, Homo sapiens
atagcattgtgaactg

SEQ ID NO: 3004956 - DNA, 16 bp, Homo sapiens
atagccaactctccca

SEQ ID NO: 3004957 - DNA, 21 bp, Homo sapiens
atagccacatttggaatactt

SEQ ID NO: 3004958 - DNA, 21 bp, Homo sapiens
atagccgaactccaggctggg

SEQ ID NO: 3004959 - DNA, 19 bp, Homo sapiens
atagcctatggcagaaaaa

SEQ ID NO: 3004960 - DNA, 13 bp, Homo sapiens
atagcctcatgtt

SEQ ID NO: 3004961 - DNA, 12 bp, Homo sapiens
atagcctgtggc

SEQ ID NO: 3004962 - DNA, 14 bp, Homo sapiens
atagccttcctgac

SEQ ID NO: 3004963 - DNA, 15 bp, Homo sapiens
atagcgcctgtataa

SEQ ID NO: 3004964 - DNA, 17 bp, Homo sapiens
atagcgtcctgccctgc

SEQ ID NO: 3004965 - DNA, 16 bp, Homo sapiens
atagctaactgtaaat

SEQ ID NO: 3004966 - DNA, 19 bp, Homo sapiens
atagctcaatactctctga

SEQ ID NO: 3004967 - DNA, 22 bp, Homo sapiens
atagctcaatactctctgagta

SEQ ID NO: 3004968 - DNA, 14 bp, Homo sapiens
atagctcatcctta

SEQ ID NO: 3004969 - DNA, 16 bp, Homo sapiens
atagctccaagctgtt

SEQ ID NO: 3004970 - DNA, 20 bp, Homo sapiens
atagctccaagctgttaaag

SEQ ID NO: 3004971 - DNA, 17 bp, Homo sapiens
atagctctacacaacat

SEQ ID NO: 3004972 - DNA, 23 bp, Homo sapiens
atagctctacacaacatgtatgt

SEQ ID NO: 3004973 - DNA, 17 bp, Homo sapiens
atagctcttcacttcct

SEQ ID NO: 3004974 - DNA, 18 bp, Homo sapiens
atagctcttcacttcctc

SEQ ID NO: 3004975 - DNA, 10 bp, Homo sapiens
atatactgta

SEQ ID NO: 3004976 - DNA, 11 bp, Homo sapiens
atatactgtaa

SEQ ID NO: 3004977 - DNA, 12 bp, Homo sapiens
atatactgtaaa

SEQ ID NO: 3004978 - DNA, 14 bp, Homo sapiens
atatactgtaaaga

SEQ ID NO: 3004979 - DNA, 18 bp, Homo sapiens
atatactgtaaagaaaga

SEQ ID NO: 3004980 - DNA, 17 bp, Homo sapiens
atatacttttaaattat

SEQ ID NO: 3004981 - DNA, 18 bp, Homo sapiens
atatacttttaaattatg

SEQ ID NO: 3004982 - DNA, 20 bp, Homo sapiens
atatacttttttttctttaa

SEQ ID NO: 3004983 - DNA, 12 bp, Homo sapiens
atatagaaaaca

SEQ ID NO: 3004984 - DNA, 14 bp, Homo sapiens
atatagaaaacaaa

SEQ ID NO: 3004985 - DNA, 17 bp, Homo sapiens
atatagaattagctttt

SEQ ID NO: 3004986 - DNA, 18 bp, Homo sapiens
atatagcaaagatatata

SEQ ID NO: 3004987 - DNA, 12 bp, Homo sapiens
atatagccttta

SEQ ID NO: 3004988 - DNA, 22 bp, Homo sapiens
atatagctctacacaacatgta

SEQ ID NO: 3004989 - DNA, 18 bp, Homo sapiens
atataggaaaacaataat

SEQ ID NO: 3004990 - DNA, 14 bp, Homo sapiens
atataggttttgtt

SEQ ID NO: 3004991 - DNA, 19 bp, Homo sapiens
atatagtatttaattgttt

SEQ ID NO: 3004992 - DNA, 17 bp, Homo sapiens
atatagttgtctttctt

SEQ ID NO: 3004993 - DNA, 16 bp, Homo sapiens
atatatacagtaactt

SEQ ID NO: 3004994 - DNA, 18 bp, Homo sapiens
atatatacagtaacttta

SEQ ID NO: 3004995 - DNA, 12 bp, Homo sapiens
atatatagaaaa

SEQ ID NO: 3004996 - DNA, 22 bp, Homo sapiens
atatatagtatttaattgtttc

SEQ ID NO: 3004997 - DNA, 15 bp, Homo sapiens
atatatataaattga

SEQ ID NO: 3004998 - DNA, 11 bp, Homo sapiens
atatatataat

SEQ ID NO: 3004999 - DNA, 15 bp, Homo sapiens
atatatatatataac

SEQ ID NO: 3005000 - DNA, 14 bp, Homo sapiens
atatatatatatac

SEQ ID NO: 3005001 - DNA, 20 bp, Homo sapiens
atatatatgtacagttatct

SEQ ID NO: 3005002 - DNA, 21 bp, Homo sapiens
atatatccttttcttctatgt

SEQ ID NO: 3005003 - DNA, 23 bp, Homo sapiens
atatatccttttcttctatgtag

SEQ ID NO: 3005004 - DNA, 15 bp, Homo sapiens
atatatgatttatat

SEQ ID NO: 3005005 - DNA, 15 bp, Homo sapiens
atatatgcactatgt

SEQ ID NO: 3005006 - DNA, 15 bp, Homo sapiens
atatatgtatttcta

SEQ ID NO: 3005007 - DNA, 13 bp, Homo sapiens
atatatgtatttt

SEQ ID NO: 3005008 - DNA, 12 bp, Homo sapiens
atatatgtgtat

SEQ ID NO: 3005009 - DNA, 13 bp, Homo sapiens
atatatgtgtatg

SEQ ID NO: 3005010 - DNA, 13 bp, Homo sapiens
atatatgtgtttt

SEQ ID NO: 3005011 - DNA, 21 bp, Homo sapiens
atatatgtgtttttcacattt

SEQ ID NO: 3005012 - DNA, 23 bp, Homo sapiens
atatatgtgtttttcacatttgc

SEQ ID NO: 3005013 - DNA, 12 bp, Homo sapiens
atatattatata

SEQ ID NO: 3005014 - DNA, 15 bp, Homo sapiens
atatattatatatag

SEQ ID NO: 3005015 - DNA, 17 bp, Homo sapiens
atatattcaccaatgtt

SEQ ID NO: 3005016 - DNA, 13 bp, Homo sapiens
atatattcacttt

SEQ ID NO: 3005017 - DNA, 12 bp, Homo sapiens
atatatttaaaa

SEQ ID NO: 3005018 - DNA, 20 bp, Homo sapiens
atatatttaagcaacatctt

SEQ ID NO: 3005019 - DNA, 17 bp, Homo sapiens
atatatttctattatta

SEQ ID NO: 3005020 - DNA, 19 bp, Homo sapiens
atatttataggtacccaat

SEQ ID NO: 3005021 - DNA, 15 bp, Homo sapiens
atatttatccaaaat

SEQ ID NO: 3005022 - DNA, 14 bp, Homo sapiens
atatttcaataaat

SEQ ID NO: 3005023 - DNA, 18 bp, Homo sapiens
atatttcagatgtaatgt

SEQ ID NO: 3005024 - DNA, 12 bp, Homo sapiens
atatttccaatg

SEQ ID NO: 3005025 - DNA, 13 bp, Homo sapiens
atatttctctagt

SEQ ID NO: 3005026 - DNA, 13 bp, Homo sapiens
atatttcttgctt

SEQ ID NO: 3005027 - DNA, 15 bp, Homo sapiens
atatttcttgctttc

SEQ ID NO: 3005028 - DNA, 14 bp, Homo sapiens
atatttgaaaaaat

SEQ ID NO: 3005029 - DNA, 12 bp, Homo sapiens
atatttgaattg

SEQ ID NO: 3005030 - DNA, 15 bp, Homo sapiens
atatttgaattggcc

SEQ ID NO: 3005031 - DNA, 17 bp, Homo sapiens
atatttgaattggcctg

SEQ ID NO: 3005032 - DNA, 23 bp, Homo sapiens
atatttgctgtgaagggagaaag

SEQ ID NO: 3005033 - DNA, 15 bp, Homo sapiens
atatttgtaaagcta

SEQ ID NO: 3005034 - DNA, 16 bp, Homo sapiens
atatttgtgctttgaa

SEQ ID NO: 3005035 - DNA, 21 bp, Homo sapiens
atatttgtttgggtggtttgt

SEQ ID NO: 3005036 - DNA, 12 bp, Homo sapiens
atattttacatc

SEQ ID NO: 3005037 - DNA, 13 bp, Homo sapiens
atattttatactg

SEQ ID NO: 3005038 - DNA, 14 bp, Homo sapiens
atattttcaacaat

SEQ ID NO: 3005039 - DNA, 18 bp, Homo sapiens
atattttctctgtacttt

SEQ ID NO: 3005040 - DNA, 19 bp, Homo sapiens
atattttgaatcaataata

SEQ ID NO: 3005041 - DNA, 16 bp, Homo sapiens
atatttttattcaaac

SEQ ID NO: 3005042 - DNA, 22 bp, Homo sapiens
atatttttccctccgggcaggg

SEQ ID NO: 3005043 - DNA, 14 bp, Homo sapiens
atatttttttaact

SEQ ID NO: 3005044 - DNA, 17 bp, Homo sapiens
atatttttttaactgtg

SEQ ID NO: 3005045 - DNA, 18 bp, Homo sapiens
atatttttttaactgtga

SEQ ID NO: 3005046 - DNA, 21 bp, Homo sapiens
atatttttttaactgtgataa

SEQ ID NO: 3005047 - DNA, 15 bp, Homo sapiens
atcaaaagacaattc

SEQ ID NO: 3005048 - DNA, 18 bp, Homo sapiens
atcaaaagacaattcttt

SEQ ID NO: 3005049 - DNA, 23 bp, Homo sapiens
atcaaaagacaattctttataca

SEQ ID NO: 3005050 - DNA, 12 bp, Homo sapiens
atcaaaagtgat

SEQ ID NO: 3005051 - DNA, 23 bp, Homo sapiens
atcaaaagtgatcagcaatgaag

SEQ ID NO: 3005052 - DNA, 20 bp, Homo sapiens
atcaaacacaacacaagaaa

SEQ ID NO: 3005053 - DNA, 14 bp, Homo sapiens
atcaaacatgaaaa

SEQ ID NO: 3005054 - DNA, 17 bp, Homo sapiens
atcaaacatgaaaacat

SEQ ID NO: 3005055 - DNA, 13 bp, Homo sapiens
atcaaagaagatg

SEQ ID NO: 3005056 - DNA, 16 bp, Homo sapiens
atcaaagccacactct

SEQ ID NO: 3005057 - DNA, 20 bp, Homo sapiens
atcaaagttctgctttctcc

SEQ ID NO: 3005058 - DNA, 23 bp, Homo sapiens
atcaaagttctgctttctcccca

SEQ ID NO: 3005059 - DNA, 16 bp, Homo sapiens
atcaaatattagatgt

SEQ ID NO: 3005060 - DNA, 18 bp, Homo sapiens
atcaaatattagatgtga

SEQ ID NO: 3005061 - DNA, 19 bp, Homo sapiens
atcaaatattagatgtgat

SEQ ID NO: 3005062 - DNA, 21 bp, Homo sapiens
atcaaatattagatgtgattt

SEQ ID NO: 3005063 - DNA, 20 bp, Homo sapiens
atcaaatttcacgtcgtctt

SEQ ID NO: 3005064 - DNA, 22 bp, Homo sapiens
atcaaatttcacgtcgtcttct

SEQ ID NO: 3005065 - DNA, 17 bp, Homo sapiens
atcaacaataaaatttt

SEQ ID NO: 3005066 - DNA, 18 bp, Homo sapiens
atcaaccccagacactgg

SEQ ID NO: 3005067 - DNA, 11 bp, Homo sapiens
atcaacccttc

SEQ ID NO: 3005068 - DNA, 19 bp, Homo sapiens
atcaacctgcacttcatat

SEQ ID NO: 3005069 - DNA, 21 bp, Homo sapiens
atcaacctgcacttcatatct

SEQ ID NO: 3005070 - DNA, 21 bp, Homo sapiens
atcaactggggggaccaaata

SEQ ID NO: 3005071 - DNA, 12 bp, Homo sapiens
atcaacttttta

SEQ ID NO: 3005072 - DNA, 22 bp, Homo sapiens
atcaagaggcaggttagaagaa

SEQ ID NO: 3005073 - DNA, 12 bp, Homo sapiens
atcaagagtctc

SEQ ID NO: 3005074 - DNA, 17 bp, Homo sapiens
atcaagagtctctccag

SEQ ID NO: 3005075 - DNA, 18 bp, Homo sapiens
atcaagcacttcccagga

SEQ ID NO: 3005076 - DNA, 19 bp, Homo sapiens
atcaagcacttcccaggat

SEQ ID NO: 3005077 - DNA, 18 bp, Homo sapiens
atcaaggccttattggaa

SEQ ID NO: 3005078 - DNA, 21 bp, Homo sapiens
atcaagtatttgggaagtgaa

SEQ ID NO: 3005079 - DNA, 15 bp, Homo sapiens
atcaagtctgtttac

SEQ ID NO: 3005080 - DNA, 13 bp, Homo sapiens
atcaagttttaag

SEQ ID NO: 3005081 - DNA, 20 bp, Homo sapiens
atcaataatatattttctgt

SEQ ID NO: 3005082 - DNA, 18 bp, Homo sapiens
atcaataggcaaaagtgt

SEQ ID NO: 3005083 - DNA, 19 bp, Homo sapiens
atcaataggcaaaagtgta

SEQ ID NO: 3005084 - DNA, 15 bp, Homo sapiens
atcaatatgtatata

SEQ ID NO: 3005085 - DNA, 18 bp, Homo sapiens
atcaatgggattttctag

SEQ ID NO: 3005086 - DNA, 23 bp, Homo sapiens
atcaatgtaccttttttggtagt

SEQ ID NO: 3005087 - DNA, 13 bp, Homo sapiens
atcaatgtgacat

SEQ ID NO: 3005088 - DNA, 16 bp, Homo sapiens
atcaatgtgacattta

SEQ ID NO: 3005089 - DNA, 17 bp, Homo sapiens
atcaatttaaacccatt

SEQ ID NO: 3005090 - DNA, 21 bp, Homo sapiens
atcaatttaaacccattttag

SEQ ID NO: 3005091 - DNA, 17 bp, Homo sapiens
atcaatttaaatgttta

SEQ ID NO: 3005092 - DNA, 19 bp, Homo sapiens
atcaatttaaatgtttact

SEQ ID NO: 3005093 - DNA, 23 bp, Homo sapiens
atcacaaaagctgtgtctctgta

SEQ ID NO: 3005094 - DNA, 15 bp, Homo sapiens
atcacaaggtcagga

SEQ ID NO: 3005095 - DNA, 17 bp, Homo sapiens
atcacaaggtcaggagt

SEQ ID NO: 3005096 - DNA, 22 bp, Homo sapiens
atcacagctcaagcattctgtt

SEQ ID NO: 3005097 - DNA, 21 bp, Homo sapiens
atcacccacaaccctctggaa

SEQ ID NO: 3005098 - DNA, 16 bp, Homo sapiens
atcacccccctgctta

SEQ ID NO: 3005099 - DNA, 19 bp, Homo sapiens
atcaccgtgggctccctga

SEQ ID NO: 3005100 - DNA, 22 bp, Homo sapiens
atcaccgtgggctccctgactg

SEQ ID NO: 3005101 - DNA, 12 bp, Homo sapiens
atcacctaaaat

SEQ ID NO: 3005102 - DNA, 13 bp, Homo sapiens
atcacctctctgt

SEQ ID NO: 3005103 - DNA, 14 bp, Homo sapiens
atcacctctttgcc

SEQ ID NO: 3005104 - DNA, 15 bp, Homo sapiens
atcacctgaacccca

SEQ ID NO: 3005105 - DNA, 12 bp, Homo sapiens
atcacctgcctg

SEQ ID NO: 3005106 - DNA, 15 bp, Homo sapiens
atcaccttaggcagg

SEQ ID NO: 3005107 - DNA, 16 bp, Homo sapiens
atcaccttaggcaggg

SEQ ID NO: 3005108 - DNA, 18 bp, Homo sapiens
atcacgatgtaaattatt

SEQ ID NO: 3005109 - DNA, 19 bp, Homo sapiens
atcacgatgtaaattatta

SEQ ID NO: 3005110 - DNA, 15 bp, Homo sapiens
atcactagagtgctc

SEQ ID NO: 3005111 - DNA, 23 bp, Homo sapiens
atcactcagcccctacccctgcc

SEQ ID NO: 3005112 - DNA, 14 bp, Homo sapiens
atcactctgcaatg

SEQ ID NO: 3005113 - DNA, 18 bp, Homo sapiens
atcactgagttttccatg

SEQ ID NO: 3005114 - DNA, 17 bp, Homo sapiens
atcactggagcaccagg

SEQ ID NO: 3005115 - DNA, 22 bp, Homo sapiens
atcactgtgaaccaacccccat

SEQ ID NO: 3005116 - DNA, 14 bp, Homo sapiens
atcacttaaagtca

SEQ ID NO: 3005117 - DNA, 13 bp, Homo sapiens
atcacttcctgtt

SEQ ID NO: 3005118 - DNA, 23 bp, Homo sapiens
atcactttgagcctgggaaataa

SEQ ID NO: 3005119 - DNA, 13 bp, Homo sapiens
atcactttttaaa

SEQ ID NO: 3005120 - DNA, 18 bp, Homo sapiens
atcagaaaaatggagcaa

SEQ ID NO: 3005121 - DNA, 13 bp, Homo sapiens
atcagaagaaagg

SEQ ID NO: 3005122 - DNA, 14 bp, Homo sapiens
atcagctgggcagt

SEQ ID NO: 3005123 - DNA, 16 bp, Homo sapiens
atcagctgttgcaggc

SEQ ID NO: 3005124 - DNA, 17 bp, Homo sapiens
atcagctgttgcaggca

SEQ ID NO: 3005125 - DNA, 20 bp, Homo sapiens
atcagctgttgcaggcagtg

SEQ ID NO: 3005126 - DNA, 18 bp, Homo sapiens
atcagctttcaaagcatt

SEQ ID NO: 3005127 - DNA, 16 bp, Homo sapiens
atcaggacccagagga

SEQ ID NO: 3005128 - DNA, 22 bp, Homo sapiens
atcaggcagaagaatctttctt

SEQ ID NO: 3005129 - DNA, 18 bp, Homo sapiens
atcaggctctgttcctca

SEQ ID NO: 3005130 - DNA, 13 bp, Homo sapiens
atcaggcttcctg

SEQ ID NO: 3005131 - DNA, 14 bp, Homo sapiens
atcaggcttcctgg

SEQ ID NO: 3005132 - DNA, 21 bp, Homo sapiens
atcaggcttcctggtgagaac

SEQ ID NO: 3005133 - DNA, 19 bp, Homo sapiens
atcaggggacaaaccaggg

SEQ ID NO: 3005134 - DNA, 14 bp, Homo sapiens
atcagtgactgaaa

SEQ ID NO: 3005135 - DNA, 17 bp, Homo sapiens
atcagtgccagcccctg

SEQ ID NO: 3005136 - DNA, 17 bp, Homo sapiens
atcagtgggatttggta

SEQ ID NO: 3005137 - DNA, 19 bp, Homo sapiens
atcagtggttatttaggga

SEQ ID NO: 3005138 - DNA, 16 bp, Homo sapiens
atcagtgtattgatgt

SEQ ID NO: 3005139 - DNA, 18 bp, Homo sapiens
atcagtgtttaaataaag

SEQ ID NO: 3005140 - DNA, 22 bp, Homo sapiens
atcagttcttagattcagggga

SEQ ID NO: 3005141 - DNA, 14 bp, Homo sapiens
atcagtttattaaa

SEQ ID NO: 3005142 - DNA, 13 bp, Homo sapiens
atcataattacca

SEQ ID NO: 3005143 - DNA, 16 bp, Homo sapiens
atcatagaacagaaat

SEQ ID NO: 3005144 - DNA, 20 bp, Homo sapiens
atcatagaacagaaatatat

SEQ ID NO: 3005145 - DNA, 18 bp, Homo sapiens
atcatagcaagacctcat

SEQ ID NO: 3005146 - DNA, 20 bp, Homo sapiens
atcatagcaagacctcatct

SEQ ID NO: 3005147 - DNA, 14 bp, Homo sapiens
atcatagttgcaaa

SEQ ID NO: 3005148 - DNA, 20 bp, Homo sapiens
atcatatgaattgctgtcta

SEQ ID NO: 3005149 - DNA, 13 bp, Homo sapiens
atcatatttgaaa

SEQ ID NO: 3005150 - DNA, 18 bp, Homo sapiens
atcatcacaattagggaa

SEQ ID NO: 3005151 - DNA, 18 bp, Homo sapiens
atcatcatgtgtgtccac

SEQ ID NO: 3005152 - DNA, 13 bp, Homo sapiens
atcatccctccct

SEQ ID NO: 3005153 - DNA, 14 bp, Homo sapiens
atcatccctccctg

SEQ ID NO: 3005154 - DNA, 15 bp, Homo sapiens
atcatccctccctgc

SEQ ID NO: 3005155 - DNA, 17 bp, Homo sapiens
atcatccctccctgcct

SEQ ID NO: 3005156 - DNA, 12 bp, Homo sapiens
atcatcctactg

SEQ ID NO: 3005157 - DNA, 16 bp, Homo sapiens
atcatcctttgttctg

SEQ ID NO: 3005158 - DNA, 20 bp, Homo sapiens
atcatcctttgttctgagca

SEQ ID NO: 3005159 - DNA, 21 bp, Homo sapiens
atcatcctttgttctgagcat

SEQ ID NO: 3005160 - DNA, 24 bp, Homo sapiens
atcatcggagtcagccaggagctg

SEQ ID NO: 3005161 - DNA, 14 bp, Homo sapiens
atcatctctgcctt

SEQ ID NO: 3005162 - DNA, 13 bp, Homo sapiens
atcatctgccgtg

SEQ ID NO: 3005163 - DNA, 13 bp, Homo sapiens
atcatctgctgca

SEQ ID NO: 3005164 - DNA, 20 bp, Homo sapiens
atcatctgctgcacatagca

SEQ ID NO: 3005165 - DNA, 13 bp, Homo sapiens
atcatgaactggc

SEQ ID NO: 3005166 - DNA, 22 bp, Homo sapiens
atcatgaactggcttgtacatt

SEQ ID NO: 3005167 - DNA, 15 bp, Homo sapiens
atcatgaagccttgc

SEQ ID NO: 3005168 - DNA, 16 bp, Homo sapiens
atcatgaagccttgct

SEQ ID NO: 3005169 - DNA, 18 bp, Homo sapiens
atcatgaagccttgctga

SEQ ID NO: 3005170 - DNA, 13 bp, Homo sapiens
atcatgagcctgt

SEQ ID NO: 3005171 - DNA, 18 bp, Homo sapiens
atcatgagcctgtttatt

SEQ ID NO: 3005172 - DNA, 22 bp, Homo sapiens
atcatgcatcttactgaaggta

SEQ ID NO: 3005173 - DNA, 15 bp, Homo sapiens
atcatgctaaaattc

SEQ ID NO: 3005174 - DNA, 21 bp, Homo sapiens
atcatgctaaaattctataga

SEQ ID NO: 3005175 - DNA, 18 bp, Homo sapiens
atcatgctttgaaaaatc

SEQ ID NO: 3005176 - DNA, 17 bp, Homo sapiens
atcatgtactttttagt

SEQ ID NO: 3005177 - DNA, 18 bp, Homo sapiens
atcatgtactttttagta

SEQ ID NO: 3005178 - DNA, 17 bp, Homo sapiens
atcatgtatctctctgt

SEQ ID NO: 3005179 - DNA, 13 bp, Homo sapiens
atcatgtgtaatc

SEQ ID NO: 3005180 - DNA, 21 bp, Homo sapiens
atcatgtgtaatcaataaacg

SEQ ID NO: 3005181 - DNA, 16 bp, Homo sapiens
atcatgttgatcatgt

SEQ ID NO: 3005182 - DNA, 19 bp, Homo sapiens
atcatgttgatcatgtact

SEQ ID NO: 3005183 - DNA, 15 bp, Homo sapiens
atcattaaagttcta

SEQ ID NO: 3005184 - DNA, 14 bp, Homo sapiens
atcattaatgtaat

SEQ ID NO: 3005185 - DNA, 22 bp, Homo sapiens
atcattataactgaaggagaag

SEQ ID NO: 3005186 - DNA, 15 bp, Homo sapiens
atcattccctctcat

SEQ ID NO: 3005187 - DNA, 17 bp, Homo sapiens
atcattggataaatttg

SEQ ID NO: 3005188 - DNA, 22 bp, Homo sapiens
atcattggattctgagagctgt

SEQ ID NO: 3005189 - DNA, 12 bp, Homo sapiens
atcatttcagcc

SEQ ID NO: 3005190 - DNA, 14 bp, Homo sapiens
atcatttcagccaa

SEQ ID NO: 3005191 - DNA, 21 bp, Homo sapiens
atcatttccgttttgcctgtg

SEQ ID NO: 3005192 - DNA, 19 bp, Homo sapiens
atccaaaagaagcccccag

SEQ ID NO: 3005193 - DNA, 17 bp, Homo sapiens
atccaaaatgtgtattt

SEQ ID NO: 3005194 - DNA, 15 bp, Homo sapiens
atccaaactgctgtc

SEQ ID NO: 3005195 - DNA, 17 bp, Homo sapiens
atccaaatgcattcatg

SEQ ID NO: 3005196 - DNA, 20 bp, Homo sapiens
atccaaatgcattcatgttt

SEQ ID NO: 3005197 - DNA, 20 bp, Homo sapiens
atccaaatgctgtgcaaaca

SEQ ID NO: 3005198 - DNA, 19 bp, Homo sapiens
atccaacagacctggtgct

SEQ ID NO: 3005199 - DNA, 21 bp, Homo sapiens
atccaaggccgcggcccagac

SEQ ID NO: 3005200 - DNA, 17 bp, Homo sapiens
atccaatcagagaccag

SEQ ID NO: 3005201 - DNA, 22 bp, Homo sapiens
atccaatgctcaagaaacaact

SEQ ID NO: 3005202 - DNA, 14 bp, Homo sapiens
atccaatgtcgctg

SEQ ID NO: 3005203 - DNA, 18 bp, Homo sapiens
atccaattcatttcttct

SEQ ID NO: 3005204 - DNA, 15 bp, Homo sapiens
atccacatgaaaata

SEQ ID NO: 3005205 - DNA, 14 bp, Homo sapiens
atccacttctttca

SEQ ID NO: 3005206 - DNA, 22 bp, Homo sapiens
atccagaagtattgtttacatt

SEQ ID NO: 3005207 - DNA, 23 bp, Homo sapiens
atccagaagtattgtttacatta

SEQ ID NO: 3005208 - DNA, 12 bp, Homo sapiens
atccagaggaat

SEQ ID NO: 3005209 - DNA, 17 bp, Homo sapiens
atccagcctggggtctg

SEQ ID NO: 3005210 - DNA, 19 bp, Homo sapiens
atccagctacttagctggc

SEQ ID NO: 3005211 - DNA, 21 bp, Homo sapiens
atccagctacttagctggcca

SEQ ID NO: 3005212 - DNA, 22 bp, Homo sapiens
atccagctctaagtctcaactg

SEQ ID NO: 3005213 - DNA, 16 bp, Homo sapiens
atccaggcagatccag

SEQ ID NO: 3005214 - DNA, 18 bp, Homo sapiens
atccaggcttctcccgga

SEQ ID NO: 3005215 - DNA, 17 bp, Homo sapiens
atccaggtacgcacaga

SEQ ID NO: 3005216 - DNA, 19 bp, Homo sapiens
atccaggtacgcacagaca

SEQ ID NO: 3005217 - DNA, 19 bp, Homo sapiens
atccaggtcaacagaatga

SEQ ID NO: 3005218 - DNA, 15 bp, Homo sapiens
atccagtaaaataat

SEQ ID NO: 3005219 - DNA, 16 bp, Homo sapiens
atccagtagggaaaat

SEQ ID NO: 3005220 - DNA, 22 bp, Homo sapiens
atccagtggatggattcatcat

SEQ ID NO: 3005221 - DNA, 16 bp, Homo sapiens
atccataaagaagcaa

SEQ ID NO: 3005222 - DNA, 20 bp, Homo sapiens
atccatagtaactgacatga

SEQ ID NO: 3005223 - DNA, 15 bp, Homo sapiens
atccatattacgttg

SEQ ID NO: 3005224 - DNA, 14 bp, Homo sapiens
atccatcatcatgt

SEQ ID NO: 3005225 - DNA, 20 bp, Homo sapiens
atccatcgtattaaaaaaca

SEQ ID NO: 3005226 - DNA, 18 bp, Homo sapiens
atccatctttttcttttt

SEQ ID NO: 3005227 - DNA, 17 bp, Homo sapiens
atccatgggtctggcta

SEQ ID NO: 3005228 - DNA, 17 bp, Homo sapiens
atccatgtaatgatctt

SEQ ID NO: 3005229 - DNA, 13 bp, Homo sapiens
atccattaattaa

SEQ ID NO: 3005230 - DNA, 14 bp, Homo sapiens
atccattcctcagg

SEQ ID NO: 3005231 - DNA, 20 bp, Homo sapiens
atccattgaaagtgcttcaa

SEQ ID NO: 3005232 - DNA, 15 bp, Homo sapiens
atccatttggcagaa

SEQ ID NO: 3005233 - DNA, 18 bp, Homo sapiens
atccatttggcagaactg

SEQ ID NO: 3005234 - DNA, 15 bp, Homo sapiens
atccattttcactaa

SEQ ID NO: 3005235 - DNA, 24 bp, Homo sapiens
atcccaaactgtgatgaagccgac

SEQ ID NO: 3005236 - DNA, 18 bp, Homo sapiens
atcccaacaagcaagggt

SEQ ID NO: 3005237 - DNA, 11 bp, Homo sapiens
atcccaacact

SEQ ID NO: 3005238 - DNA, 11 bp, Homo sapiens
atcccacagcc

SEQ ID NO: 3005239 - DNA, 14 bp, Homo sapiens
atcccacccacatg

SEQ ID NO: 3005240 - DNA, 15 bp, Homo sapiens
atcccacccacatgt

SEQ ID NO: 3005241 - DNA, 21 bp, Homo sapiens
atcccactggatctggcttac

SEQ ID NO: 3005242 - DNA, 12 bp, Homo sapiens
atcccagcccaa

SEQ ID NO: 3005243 - DNA, 17 bp, Homo sapiens
atcccagctactcagga

SEQ ID NO: 3005244 - DNA, 20 bp, Homo sapiens
atcccagctttaaaaagaaa

SEQ ID NO: 3005245 - DNA, 13 bp, Homo sapiens
atcccatgtaaca

SEQ ID NO: 3005246 - DNA, 16 bp, Homo sapiens
atcccatgtaacagaa

SEQ ID NO: 3005247 - DNA, 16 bp, Homo sapiens
atcccattgccctggt

SEQ ID NO: 3005248 - DNA, 14 bp, Homo sapiens
atccccaagtgtga

SEQ ID NO: 3005249 - DNA, 17 bp, Homo sapiens
atccccacgacccctgc

SEQ ID NO: 3005250 - DNA, 13 bp, Homo sapiens
atccccagagccc

SEQ ID NO: 3005251 - DNA, 18 bp, Homo sapiens
atccccagatatttatgt

SEQ ID NO: 3005252 - DNA, 22 bp, Homo sapiens
atccccagggggcatgaccaga

SEQ ID NO: 3005253 - DNA, 18 bp, Homo sapiens
atccccatgcctgtggct

SEQ ID NO: 3005254 - DNA, 20 bp, Homo sapiens
atccccatgcctgtggctgc

SEQ ID NO: 3005255 - DNA, 21 bp, Homo sapiens
atccccctctcacgccacccc

SEQ ID NO: 3005256 - DNA, 18 bp, Homo sapiens
atcccctgcgctttgaac

SEQ ID NO: 3005257 - DNA, 16 bp, Homo sapiens
atccccttgaactctt

SEQ ID NO: 3005258 - DNA, 18 bp, Homo sapiens
atcccctttggttttact

SEQ ID NO: 3005259 - DNA, 17 bp, Homo sapiens
atcccgagcacctccac

SEQ ID NO: 3005260 - DNA, 15 bp, Homo sapiens
atcccgttttcccca

SEQ ID NO: 3005261 - DNA, 18 bp, Homo sapiens
atcccgttttccccatga

SEQ ID NO: 3005262 - DNA, 16 bp, Homo sapiens
atccctaacaggctgt

SEQ ID NO: 3005263 - DNA, 16 bp, Homo sapiens
atccctaattcttcat

SEQ ID NO: 3005264 - DNA, 17 bp, Homo sapiens
atccctcaccttctgag

SEQ ID NO: 3005265 - DNA, 14 bp, Homo sapiens
atccctcatcctga

SEQ ID NO: 3005266 - DNA, 13 bp, Homo sapiens
atccctcatctgt

SEQ ID NO: 3005267 - DNA, 19 bp, Homo sapiens
atccctcccccccatgcac

SEQ ID NO: 3005268 - DNA, 21 bp, Homo sapiens
atccctcccccccatgcactg

SEQ ID NO: 3005269 - DNA, 12 bp, Homo sapiens
atccctccctgc

SEQ ID NO: 3005270 - DNA, 17 bp, Homo sapiens
atccctctacagagctt

SEQ ID NO: 3005271 - DNA, 14 bp, Homo sapiens
atccctctcctccc

SEQ ID NO: 3005272 - DNA, 15 bp, Homo sapiens
atccctgccagctct

SEQ ID NO: 3005273 - DNA, 18 bp, Homo sapiens
atccctgggcattgcttt

SEQ ID NO: 3005274 - DNA, 14 bp, Homo sapiens
atccctttattacc

SEQ ID NO: 3005275 - DNA, 16 bp, Homo sapiens
atccgaacctcctctg

SEQ ID NO: 3005276 - DNA, 19 bp, Homo sapiens
atccgccagggcccacacc

SEQ ID NO: 3005277 - DNA, 18 bp, Homo sapiens
atccgcctacctcagcct

SEQ ID NO: 3005278 - DNA, 19 bp, Homo sapiens
atccgcctacctcagcctc

SEQ ID NO: 3005279 - DNA, 22 bp, Homo sapiens
atccggcaacatcaacccgagt

SEQ ID NO: 3005280 - DNA, 17 bp, Homo sapiens
atccgtagttccctgaa

SEQ ID NO: 3005281 - DNA, 19 bp, Homo sapiens
atccgtctgtgtggggttc

SEQ ID NO: 3005282 - DNA, 15 bp, Homo sapiens
atcctaaagattatt

SEQ ID NO: 3005283 - DNA, 21 bp, Homo sapiens
atcctaagggtcgaaagctct

SEQ ID NO: 3005284 - DNA, 22 bp, Homo sapiens
atcctaagggtcgaaagctcta

SEQ ID NO: 3005285 - DNA, 22 bp, Homo sapiens
atcctacacacctaagggacat

SEQ ID NO: 3005286 - DNA, 16 bp, Homo sapiens
atcctaccccctgtgc

SEQ ID NO: 3005287 - DNA, 23 bp, Homo sapiens
atcctagagatttggtgtacaat

SEQ ID NO: 3005288 - DNA, 16 bp, Homo sapiens
atcctagatcctaagg

SEQ ID NO: 3005289 - DNA, 18 bp, Homo sapiens
atcctagattatatcaaa

SEQ ID NO: 3005290 - DNA, 17 bp, Homo sapiens
atcctattacttttcat

SEQ ID NO: 3005291 - DNA, 22 bp, Homo sapiens
atcctatttcagtacttcagca

SEQ ID NO: 3005292 - DNA, 15 bp, Homo sapiens
atcctcaatccagct

SEQ ID NO: 3005293 - DNA, 16 bp, Homo sapiens
atcctcacgccttggc

SEQ ID NO: 3005294 - DNA, 18 bp, Homo sapiens
atcctcacgccttggcct

SEQ ID NO: 3005295 - DNA, 14 bp, Homo sapiens
atcctcagatgctc

SEQ ID NO: 3005296 - DNA, 23 bp, Homo sapiens
atcctcagttctcaaatgtgtgt

SEQ ID NO: 3005297 - DNA, 19 bp, Homo sapiens
atcctccagtaccttgctt

SEQ ID NO: 3005298 - DNA, 20 bp, Homo sapiens
atcctccagtaccttgcttc

SEQ ID NO: 3005299 - DNA, 15 bp, Homo sapiens
atcctccatttttgt

SEQ ID NO: 3005300 - DNA, 13 bp, Homo sapiens
atcctccccacca

SEQ ID NO: 3005301 - DNA, 14 bp, Homo sapiens
atcctccccaccag

SEQ ID NO: 3005302 - DNA, 18 bp, Homo sapiens
atcctccccaccagagct

SEQ ID NO: 3005303 - DNA, 21 bp, Homo sapiens
atcctccccaccagagctgcc

SEQ ID NO: 3005304 - DNA, 17 bp, Homo sapiens
atcctccccgctctgcc

SEQ ID NO: 3005305 - DNA, 17 bp, Homo sapiens
atcctccctggcagaca

SEQ ID NO: 3005306 - DNA, 19 bp, Homo sapiens
atcctccctggcagacaca

SEQ ID NO: 3005307 - DNA, 17 bp, Homo sapiens
atcctccgccctttttg

SEQ ID NO: 3005308 - DNA, 23 bp, Homo sapiens
atcctccgccctttttgtcctag

SEQ ID NO: 3005309 - DNA, 15 bp, Homo sapiens
atcctcctccagggt

SEQ ID NO: 3005310 - DNA, 13 bp, Homo sapiens
atcctcctctcca

SEQ ID NO: 3005311 - DNA, 14 bp, Homo sapiens
atcctcctctccat

SEQ ID NO: 3005312 - DNA, 20 bp, Homo sapiens
atcctcctctccatgcaagt

SEQ ID NO: 3005313 - DNA, 14 bp, Homo sapiens
atcctcctgttctg

SEQ ID NO: 3005314 - DNA, 13 bp, Homo sapiens
atcctctcacctc

SEQ ID NO: 3005315 - DNA, 16 bp, Homo sapiens
atcctctcacctcagc

SEQ ID NO: 3005316 - DNA, 11 bp, Homo sapiens
atcctctctct

SEQ ID NO: 3005317 - DNA, 12 bp, Homo sapiens
atcctctctctc

SEQ ID NO: 3005318 - DNA, 14 bp, Homo sapiens
atcctctctctctc

SEQ ID NO: 3005319 - DNA, 15 bp, Homo sapiens
atcctgctagcaggc

SEQ ID NO: 3005320 - DNA, 15 bp, Homo sapiens
atcctgctgttctag

SEQ ID NO: 3005321 - DNA, 15 bp, Homo sapiens
atcctgcttctcttt

SEQ ID NO: 3005322 - DNA, 20 bp, Homo sapiens
atcctgcttctcttttcctc

SEQ ID NO: 3005323 - DNA, 22 bp, Homo sapiens
atcctgcttctcttttcctcgc

SEQ ID NO: 3005324 - DNA, 21 bp, Homo sapiens
atcctgcttctgatatgcagt

SEQ ID NO: 3005325 - DNA, 12 bp, Homo sapiens
atcctgcttgat

SEQ ID NO: 3005326 - DNA, 22 bp, Homo sapiens
atcctggacatgaagattcttt

SEQ ID NO: 3005327 - DNA, 14 bp, Homo sapiens
atcctggaggccca

SEQ ID NO: 3005328 - DNA, 14 bp, Homo sapiens
atcctggaggtctt

SEQ ID NO: 3005329 - DNA, 15 bp, Homo sapiens
atcctggctggagaa

SEQ ID NO: 3005330 - DNA, 12 bp, Homo sapiens
atcctgggcccc

SEQ ID NO: 3005331 - DNA, 18 bp, Homo sapiens
atcctgggcccccagaga

SEQ ID NO: 3005332 - DNA, 22 bp, Homo sapiens
atcctgggtggtctgcaggcag

SEQ ID NO: 3005333 - DNA, 23 bp, Homo sapiens
atcctgggtggtctgcaggcagg

SEQ ID NO: 3005334 - DNA, 14 bp, Homo sapiens
atcctggtttcata

SEQ ID NO: 3005335 - DNA, 23 bp, Homo sapiens
atcctggtttcataacttcctgt

SEQ ID NO: 3005336 - DNA, 16 bp, Homo sapiens
atcctgtattcagaca

SEQ ID NO: 3005337 - DNA, 20 bp, Homo sapiens
atcctgtattcagacagatg

SEQ ID NO: 3005338 - DNA, 19 bp, Homo sapiens
atcctgtcgattagactgg

SEQ ID NO: 3005339 - DNA, 21 bp, Homo sapiens
atcctgtcgattagactggac

SEQ ID NO: 3005340 - DNA, 19 bp, Homo sapiens
atcctgtgtcccctgacct

SEQ ID NO: 3005341 - DNA, 14 bp, Homo sapiens
atcctgtgtttcta

SEQ ID NO: 3005342 - DNA, 17 bp, Homo sapiens
atcctgttggctgctgc

SEQ ID NO: 3005343 - DNA, 16 bp, Homo sapiens
atccttacttccagca

SEQ ID NO: 3005344 - DNA, 17 bp, Homo sapiens
atccttcatcttttaaa

SEQ ID NO: 3005345 - DNA, 19 bp, Homo sapiens
atccttcatcttttaaaga

SEQ ID NO: 3005346 - DNA, 22 bp, Homo sapiens
atccttcccaaggtacagctgt

SEQ ID NO: 3005347 - DNA, 23 bp, Homo sapiens
atccttcccaagtaagaggctgg

SEQ ID NO: 3005348 - DNA, 22 bp, Homo sapiens
atccttccctgtctgccagggc

SEQ ID NO: 3005349 - DNA, 19 bp, Homo sapiens
atccttctggctgtagata

SEQ ID NO: 3005350 - DNA, 17 bp, Homo sapiens
atccttgagattctgaa

SEQ ID NO: 3005351 - DNA, 17 bp, Homo sapiens
atccttgcagtttaaga

SEQ ID NO: 3005352 - DNA, 21 bp, Homo sapiens
atccttgcagtttaagatgac

SEQ ID NO: 3005353 - DNA, 20 bp, Homo sapiens
atccttgcctgtctaaagcc

SEQ ID NO: 3005354 - DNA, 23 bp, Homo sapiens
atccttggagtcccaggggcagc

SEQ ID NO: 3005355 - DNA, 17 bp, Homo sapiens
atccttggcttcaggtt

SEQ ID NO: 3005356 - DNA, 23 bp, Homo sapiens
atccttgtttcaaacacaaatgc

SEQ ID NO: 3005357 - DNA, 18 bp, Homo sapiens
atcctttaactctgcgga

SEQ ID NO: 3005358 - DNA, 15 bp, Homo sapiens
atcctttcatcaatg

SEQ ID NO: 3005359 - DNA, 19 bp, Homo sapiens
atcctttcctcattaaatt

SEQ ID NO: 3005360 - DNA, 14 bp, Homo sapiens
atcctttctgcccc

SEQ ID NO: 3005361 - DNA, 15 bp, Homo sapiens
atcctttctgccccc

SEQ ID NO: 3005362 - DNA, 23 bp, Homo sapiens
atcctttctgccccccagggcta

SEQ ID NO: 3005363 - DNA, 19 bp, Homo sapiens
atcctttgttctgagcatt

SEQ ID NO: 3005364 - DNA, 13 bp, Homo sapiens
atccttttgtaga

SEQ ID NO: 3005365 - DNA, 20 bp, Homo sapiens
atcgaatctactaattccac

SEQ ID NO: 3005366 - DNA, 15 bp, Homo sapiens
atcgatgttatgtaa

SEQ ID NO: 3005367 - DNA, 17 bp, Homo sapiens
atcgccataggccaagg

SEQ ID NO: 3005368 - DNA, 20 bp, Homo sapiens
atcgccataggccaaggtgc

SEQ ID NO: 3005369 - DNA, 20 bp, Homo sapiens
atctttgcgaaaagataaac

SEQ ID NO: 3005370 - DNA, 23 bp, Homo sapiens
atctttgtggccaaggagctgct

SEQ ID NO: 3005371 - DNA, 14 bp, Homo sapiens
atcttttaaagaaa

SEQ ID NO: 3005372 - DNA, 18 bp, Homo sapiens
atcttttaatcatgagcc

SEQ ID NO: 3005373 - DNA, 13 bp, Homo sapiens
atcttttatttca

SEQ ID NO: 3005374 - DNA, 12 bp, Homo sapiens
atcttttcttta

SEQ ID NO: 3005375 - DNA, 23 bp, Homo sapiens
atcttttctttagagaactgaaa

SEQ ID NO: 3005376 - DNA, 14 bp, Homo sapiens
atcttttggctctg

SEQ ID NO: 3005377 - DNA, 17 bp, Homo sapiens
atcttttggctctgaag

SEQ ID NO: 3005378 - DNA, 13 bp, Homo sapiens
atctttttcatta

SEQ ID NO: 3005379 - DNA, 17 bp, Homo sapiens
atctttttctccaccca

SEQ ID NO: 3005380 - DNA, 16 bp, Homo sapiens
atcttttttagcataa

SEQ ID NO: 3005381 - DNA, 18 bp, Homo sapiens
atcttttttagcataaaa

SEQ ID NO: 3005382 - DNA, 21 bp, Homo sapiens
atcttttttgttaactgattt

SEQ ID NO: 3005383 - DNA, 23 bp, Homo sapiens
atctttttttcatttttaaatgt

SEQ ID NO: 3005384 - DNA, 17 bp, Homo sapiens
atgaaaaatatttctga

SEQ ID NO: 3005385 - DNA, 11 bp, Homo sapiens
atgaaaacact

SEQ ID NO: 3005386 - DNA, 12 bp, Homo sapiens
atgaaaacactc

SEQ ID NO: 3005387 - DNA, 11 bp, Homo sapiens
atgaaaacatt

SEQ ID NO: 3005388 - DNA, 15 bp, Homo sapiens
atgaaaacattgatg

SEQ ID NO: 3005389 - DNA, 13 bp, Homo sapiens
atgaaaaccagtg

SEQ ID NO: 3005390 - DNA, 12 bp, Homo sapiens
atgaaaacctgc

SEQ ID NO: 3005391 - DNA, 17 bp, Homo sapiens
atgaaaagattcttctg

SEQ ID NO: 3005392 - DNA, 21 bp, Homo sapiens
atgaaaaggatattatctacc

SEQ ID NO: 3005393 - DNA, 12 bp, Homo sapiens
atgaaaagttat

SEQ ID NO: 3005394 - DNA, 14 bp, Homo sapiens
atgaaaataactga

SEQ ID NO: 3005395 - DNA, 17 bp, Homo sapiens
atgaaaatacaacttaa

SEQ ID NO: 3005396 - DNA, 16 bp, Homo sapiens
atgaaaccgtccctga

SEQ ID NO: 3005397 - DNA, 13 bp, Homo sapiens
atgaaactaaagc

SEQ ID NO: 3005398 - DNA, 16 bp, Homo sapiens
atgaaactaaagcaat

SEQ ID NO: 3005399 - DNA, 18 bp, Homo sapiens
atgaaactctacatttaa

SEQ ID NO: 3005400 - DNA, 12 bp, Homo sapiens
atgaaacttctc

SEQ ID NO: 3005401 - DNA, 12 bp, Homo sapiens
atgaaacttgaa

SEQ ID NO: 3005402 - DNA, 15 bp, Homo sapiens
atgaaaggaataaaa

SEQ ID NO: 3005403 - DNA, 13 bp, Homo sapiens
atgaaatgtatgt

SEQ ID NO: 3005404 - DNA, 20 bp, Homo sapiens
atgaacaccatacctttgct

SEQ ID NO: 3005405 - DNA, 18 bp, Homo sapiens
atgaacacttaaattatg

SEQ ID NO: 3005406 - DNA, 16 bp, Homo sapiens
atgaacacttaataaa

SEQ ID NO: 3005407 - DNA, 19 bp, Homo sapiens
atgaacagcttgccaggga

SEQ ID NO: 3005408 - DNA, 14 bp, Homo sapiens
atgaacccataggg

SEQ ID NO: 3005409 - DNA, 20 bp, Homo sapiens
atgaacccatagggagctga

SEQ ID NO: 3005410 - DNA, 19 bp, Homo sapiens
atgaactggcttgtacatt

SEQ ID NO: 3005411 - DNA, 13 bp, Homo sapiens
atgaactgtatta

SEQ ID NO: 3005412 - DNA, 16 bp, Homo sapiens
atgaactgtattattg

SEQ ID NO: 3005413 - DNA, 13 bp, Homo sapiens
atgaactttgtca

SEQ ID NO: 3005414 - DNA, 18 bp, Homo sapiens
atgaactttgtcagtgtt

SEQ ID NO: 3005415 - DNA, 20 bp, Homo sapiens
atgaagaaagggaggcccag

SEQ ID NO: 3005416 - DNA, 23 bp, Homo sapiens
atgaagaaagggaggcccagccg

SEQ ID NO: 3005417 - DNA, 19 bp, Homo sapiens
atgaagaatataccatttc

SEQ ID NO: 3005418 - DNA, 13 bp, Homo sapiens
atgaagcaacaga

SEQ ID NO: 3005419 - DNA, 16 bp, Homo sapiens
atgaagcaagctgtgt

SEQ ID NO: 3005420 - DNA, 17 bp, Homo sapiens
atgaagcaagctgtgtt

SEQ ID NO: 3005421 - DNA, 22 bp, Homo sapiens
atgaagcaagctgtgttacttg

SEQ ID NO: 3005422 - DNA, 17 bp, Homo sapiens
atgaagccacagcccag

SEQ ID NO: 3005423 - DNA, 23 bp, Homo sapiens
atgaagccacagcccaggcctcc

SEQ ID NO: 3005424 - DNA, 19 bp, Homo sapiens
atgaagccgaccttagatt

SEQ ID NO: 3005425 - DNA, 15 bp, Homo sapiens
atgaagcttgtgtat

SEQ ID NO: 3005426 - DNA, 20 bp, Homo sapiens
atgaaggtgtgctacagaaa

SEQ ID NO: 3005427 - DNA, 14 bp, Homo sapiens
atgaagtactttta

SEQ ID NO: 3005428 - DNA, 18 bp, Homo sapiens
atgaagtctgagggaaac

SEQ ID NO: 3005429 - DNA, 19 bp, Homo sapiens
atgaagtgctacagaaagc

SEQ ID NO: 3005430 - DNA, 20 bp, Homo sapiens
atgaagttactttcttaatg

SEQ ID NO: 3005431 - DNA, 17 bp, Homo sapiens
atgaatacagcagcaag

SEQ ID NO: 3005432 - DNA, 21 bp, Homo sapiens
atgaatagcttgtttctgtca

SEQ ID NO: 3005433 - DNA, 23 bp, Homo sapiens
atgaatattttatattaaaatat

SEQ ID NO: 3005434 - DNA, 18 bp, Homo sapiens
atgaatcactgtttttag

SEQ ID NO: 3005435 - DNA, 21 bp, Homo sapiens
atgaatcactgtttttagaca

SEQ ID NO: 3005436 - DNA, 21 bp, Homo sapiens
atgaatcccacccacatgtga

SEQ ID NO: 3005437 - DNA, 15 bp, Homo sapiens
atgaatcgcttctct

SEQ ID NO: 3005438 - DNA, 17 bp, Homo sapiens
atgaatctacatttgtt

SEQ ID NO: 3005439 - DNA, 22 bp, Homo sapiens
atgaatctacatttgtttgtat

SEQ ID NO: 3005440 - DNA, 14 bp, Homo sapiens
atgaatctgctcac

SEQ ID NO: 3005441 - DNA, 15 bp, Homo sapiens
atgaatgaatgggat

SEQ ID NO: 3005442 - DNA, 15 bp, Homo sapiens
atgaatgagtctgtt

SEQ ID NO: 3005443 - DNA, 20 bp, Homo sapiens
atgaatgcagcactgctgcc

SEQ ID NO: 3005444 - DNA, 18 bp, Homo sapiens
atgaatgcccccagctgg

SEQ ID NO: 3005445 - DNA, 22 bp, Homo sapiens
atgaatggtctagaaacatttc

SEQ ID NO: 3005446 - DNA, 20 bp, Homo sapiens
atgaatgtatttatttggga

SEQ ID NO: 3005447 - DNA, 19 bp, Homo sapiens
atgaattcaagaaaggaaa

SEQ ID NO: 3005448 - DNA, 20 bp, Homo sapiens
atgaattcaagaaaggaaat

SEQ ID NO: 3005449 - DNA, 13 bp, Homo sapiens
atgaattcatact

SEQ ID NO: 3005450 - DNA, 16 bp, Homo sapiens
atgaattcatactctg

SEQ ID NO: 3005451 - DNA, 16 bp, Homo sapiens
atgaattcctagaatt

SEQ ID NO: 3005452 - DNA, 17 bp, Homo sapiens
atgaattcctatatacc

SEQ ID NO: 3005453 - DNA, 21 bp, Homo sapiens
atgaattcgatgcgtattctg

SEQ ID NO: 3005454 - DNA, 21 bp, Homo sapiens
atgaattgcgttggtctctgc

SEQ ID NO: 3005455 - DNA, 15 bp, Homo sapiens
atgaattgctgtcta

SEQ ID NO: 3005456 - DNA, 21 bp, Homo sapiens
atgaattgctgtctagcctta

SEQ ID NO: 3005457 - DNA, 17 bp, Homo sapiens
atgacaaaaaatgtttt

SEQ ID NO: 3005458 - DNA, 22 bp, Homo sapiens
atgacaaacccaggagtttgtg

SEQ ID NO: 3005459 - DNA, 14 bp, Homo sapiens
atgacaaagtgttg

SEQ ID NO: 3005460 - DNA, 16 bp, Homo sapiens
atgacaagatgggaca

SEQ ID NO: 3005461 - DNA, 17 bp, Homo sapiens
atgacaagatggtacaa

SEQ ID NO: 3005462 - DNA, 16 bp, Homo sapiens
atgacaagctgtatca

SEQ ID NO: 3005463 - DNA, 15 bp, Homo sapiens
atgacacatttgttg

SEQ ID NO: 3005464 - DNA, 17 bp, Homo sapiens
atgacacatttgttgca

SEQ ID NO: 3005465 - DNA, 16 bp, Homo sapiens
atgacacttccaaaga

SEQ ID NO: 3005466 - DNA, 20 bp, Homo sapiens
atgacacttttaaaataaat

SEQ ID NO: 3005467 - DNA, 21 bp, Homo sapiens
atgacagccccttaagcatgc

SEQ ID NO: 3005468 - DNA, 16 bp, Homo sapiens
atgacagctgtccctg

SEQ ID NO: 3005469 - DNA, 17 bp, Homo sapiens
atgacagctgtccctgt

SEQ ID NO: 3005470 - DNA, 19 bp, Homo sapiens
atgacagtccgtcaaaaca

SEQ ID NO: 3005471 - DNA, 21 bp, Homo sapiens
atgacataaaatttacattta

SEQ ID NO: 3005472 - DNA, 17 bp, Homo sapiens
atgacatggaggcactg

SEQ ID NO: 3005473 - DNA, 20 bp, Homo sapiens
atgacattgctaagatgctc

SEQ ID NO: 3005474 - DNA, 11 bp, Homo sapiens
atgacattttt

SEQ ID NO: 3005475 - DNA, 21 bp, Homo sapiens
atgacattttttttaactact

SEQ ID NO: 3005476 - DNA, 18 bp, Homo sapiens
atgaccaaagtcccttcc

SEQ ID NO: 3005477 - DNA, 15 bp, Homo sapiens
atgaccaaagtcctt

SEQ ID NO: 3005478 - DNA, 17 bp, Homo sapiens
atgaccacgcacctcca

SEQ ID NO: 3005479 - DNA, 23 bp, Homo sapiens
atgaccacgcacctccacgccac

SEQ ID NO: 3005480 - DNA, 14 bp, Homo sapiens
atgaccagaaacag

SEQ ID NO: 3005481 - DNA, 18 bp, Homo sapiens
atgaccagagcaaaaatg

SEQ ID NO: 3005482 - DNA, 19 bp, Homo sapiens
atgaccagagcaaaaatgt

SEQ ID NO: 3005483 - DNA, 21 bp, Homo sapiens
atgaccagatgcgtcccaaga

SEQ ID NO: 3005484 - DNA, 18 bp, Homo sapiens
atgacccctaccccctca

SEQ ID NO: 3005485 - DNA, 18 bp, Homo sapiens
atgaccctctgtccccag

SEQ ID NO: 3005486 - DNA, 20 bp, Homo sapiens
atgaccctctgtccccaggc

SEQ ID NO: 3005487 - DNA, 21 bp, Homo sapiens
atgacctcagggctatgtgga

SEQ ID NO: 3005488 - DNA, 17 bp, Homo sapiens
atgaccttatccttcct

SEQ ID NO: 3005489 - DNA, 15 bp, Homo sapiens
atgactaagccaagc

SEQ ID NO: 3005490 - DNA, 20 bp, Homo sapiens
atgactagagacgcaccttg

SEQ ID NO: 3005491 - DNA, 19 bp, Homo sapiens
atgactcaggacatccccc

SEQ ID NO: 3005492 - DNA, 13 bp, Homo sapiens
atgactcatgcct

SEQ ID NO: 3005493 - DNA, 20 bp, Homo sapiens
atgactggtgagagaagaaa

SEQ ID NO: 3005494 - DNA, 15 bp, Homo sapiens
atgacttagaaacaa

SEQ ID NO: 3005495 - DNA, 18 bp, Homo sapiens
atgacttagaaacaatgt

SEQ ID NO: 3005496 - DNA, 24 bp, Homo sapiens
atgctgatgttcagtgtaatttct

SEQ ID NO: 3005497 - DNA, 16 bp, Homo sapiens
atgctgctggcctccc

SEQ ID NO: 3005498 - DNA, 20 bp, Homo sapiens
atgctgctggcctccctccg

SEQ ID NO: 3005499 - DNA, 15 bp, Homo sapiens
atgctgcttttatat

SEQ ID NO: 3005500 - DNA, 18 bp, Homo sapiens
atgctgcttttatatctg

SEQ ID NO: 3005501 - DNA, 19 bp, Homo sapiens
atgctggatgctccttcca

SEQ ID NO: 3005502 - DNA, 12 bp, Homo sapiens
atgctggcccag

SEQ ID NO: 3005503 - DNA, 15 bp, Homo sapiens
atgctggcccagggc

SEQ ID NO: 3005504 - DNA, 18 bp, Homo sapiens
atgctggcccagggccca

SEQ ID NO: 3005505 - DNA, 22 bp, Homo sapiens
atgctggcccagggcccagagc

SEQ ID NO: 3005506 - DNA, 14 bp, Homo sapiens
atgctggcctcttg

SEQ ID NO: 3005507 - DNA, 20 bp, Homo sapiens
atgctggcctcttggcacct

SEQ ID NO: 3005508 - DNA, 22 bp, Homo sapiens
atgctggcctcttggcacctgc

SEQ ID NO: 3005509 - DNA, 21 bp, Homo sapiens
atgctggggtacacagtgaga

SEQ ID NO: 3005510 - DNA, 12 bp, Homo sapiens
atgctgtacatc

SEQ ID NO: 3005511 - DNA, 22 bp, Homo sapiens
atgctgtacatctattttggat

SEQ ID NO: 3005512 - DNA, 16 bp, Homo sapiens
atgctgtccctgcact

SEQ ID NO: 3005513 - DNA, 11 bp, Homo sapiens
atgctgtgcta

SEQ ID NO: 3005514 - DNA, 14 bp, Homo sapiens
atgctgtgctacgt

SEQ ID NO: 3005515 - DNA, 20 bp, Homo sapiens
atgctgtgctacgtgtgaaa

SEQ ID NO: 3005516 - DNA, 23 bp, Homo sapiens
atgctgtgtatatggtatatata

SEQ ID NO: 3005517 - DNA, 11 bp, Homo sapiens
atgctgttgat

SEQ ID NO: 3005518 - DNA, 15 bp, Homo sapiens
atgctgttgattgct

SEQ ID NO: 3005519 - DNA, 14 bp, Homo sapiens
atgctgttgcctca

SEQ ID NO: 3005520 - DNA, 22 bp, Homo sapiens
atgcttaataataattgaagaa

SEQ ID NO: 3005521 - DNA, 23 bp, Homo sapiens
atgcttacgtgatcctctcacct

SEQ ID NO: 3005522 - DNA, 20 bp, Homo sapiens
atgcttagagggatttcttt

SEQ ID NO: 3005523 - DNA, 14 bp, Homo sapiens
atgcttatggaaag

SEQ ID NO: 3005524 - DNA, 23 bp, Homo sapiens
atgcttcatacagggatggtgtt

SEQ ID NO: 3005525 - DNA, 13 bp, Homo sapiens
atgggaacgcagc

SEQ ID NO: 3005526 - DNA, 16 bp, Homo sapiens
atgggaatacaaaagg

SEQ ID NO: 3005527 - DNA, 21 bp, Homo sapiens
atgggaatgaagcttgtgtat

SEQ ID NO: 3005528 - DNA, 23 bp, Homo sapiens
atgggaattctttacaataaaca

SEQ ID NO: 3005529 - DNA, 14 bp, Homo sapiens
atgggaatttgtca

SEQ ID NO: 3005530 - DNA, 19 bp, Homo sapiens
atgggacttcttttcacat

SEQ ID NO: 3005531 - DNA, 23 bp, Homo sapiens
atgggatattttgaaatgaactt

SEQ ID NO: 3005532 - DNA, 23 bp, Homo sapiens
atgggatgtatgaatacagcagc

SEQ ID NO: 3005533 - DNA, 17 bp, Homo sapiens
atgggattagaaacaaa

SEQ ID NO: 3005534 - DNA, 17 bp, Homo sapiens
atgggattctggacagg

SEQ ID NO: 3005535 - DNA, 22 bp, Homo sapiens
atgggattttctagtttcctgc

SEQ ID NO: 3005536 - DNA, 17 bp, Homo sapiens
atgggcaggtggcctct

SEQ ID NO: 3005537 - DNA, 17 bp, Homo sapiens
atgggcatctatgggag

SEQ ID NO: 3005538 - DNA, 16 bp, Homo sapiens
atgggccactgaaatc

SEQ ID NO: 3005539 - DNA, 22 bp, Homo sapiens
atgggccagcccctccatctgt

SEQ ID NO: 3005540 - DNA, 17 bp, Homo sapiens
atgggccccccatgcat

SEQ ID NO: 3005541 - DNA, 16 bp, Homo sapiens
atgggcccctggcact

SEQ ID NO: 3005542 - DNA, 19 bp, Homo sapiens
atgggccctatgtctcagg

SEQ ID NO: 3005543 - DNA, 17 bp, Homo sapiens
atgggctaatgaagatc

SEQ ID NO: 3005544 - DNA, 13 bp, Homo sapiens
atgggctgtgatt

SEQ ID NO: 3005545 - DNA, 18 bp, Homo sapiens
atgggctgtgattactgc

SEQ ID NO: 3005546 - DNA, 21 bp, Homo sapiens
atgggctgtgattactgcaat

SEQ ID NO: 3005547 - DNA, 18 bp, Homo sapiens
atgggcttttacctgtgc

SEQ ID NO: 3005548 - DNA, 21 bp, Homo sapiens
atgggcttttgttctgagggg

SEQ ID NO: 3005549 - DNA, 20 bp, Homo sapiens
atggggatagtctgggtcag

SEQ ID NO: 3005550 - DNA, 21 bp, Homo sapiens
atggggcatcctctttttcca

SEQ ID NO: 3005551 - DNA, 19 bp, Homo sapiens
atggggccagatccagcct

SEQ ID NO: 3005552 - DNA, 19 bp, Homo sapiens
atggggctgaacggggaga

SEQ ID NO: 3005553 - DNA, 22 bp, Homo sapiens
atggggctgaacggggagaaaa

SEQ ID NO: 3005554 - DNA, 19 bp, Homo sapiens
atgggggaactcagatcca

SEQ ID NO: 3005555 - DNA, 21 bp, Homo sapiens
atgggggaactcagatccagg

SEQ ID NO: 3005556 - DNA, 21 bp, Homo sapiens
atgggggctttcggggagggc

SEQ ID NO: 3005557 - DNA, 17 bp, Homo sapiens
atgggggtgtattggaa

SEQ ID NO: 3005558 - DNA, 16 bp, Homo sapiens
atggggtcctggccat

SEQ ID NO: 3005559 - DNA, 15 bp, Homo sapiens
atgggtcctcggccc

SEQ ID NO: 3005560 - DNA, 13 bp, Homo sapiens
atgggtcgggaga

SEQ ID NO: 3005561 - DNA, 18 bp, Homo sapiens
atgggtcgggagagggga

SEQ ID NO: 3005562 - DNA, 21 bp, Homo sapiens
atgttattttctgttgaagtt

SEQ ID NO: 3005563 - DNA, 14 bp, Homo sapiens
atgttatttttgta

SEQ ID NO: 3005564 - DNA, 18 bp, Homo sapiens
atgttcagtgtaatttct

SEQ ID NO: 3005565 - DNA, 21 bp, Homo sapiens
atgttcagtgtaatttctttg

SEQ ID NO: 3005566 - DNA, 15 bp, Homo sapiens
atgttcccttgacca

SEQ ID NO: 3005567 - DNA, 16 bp, Homo sapiens
atgttcccttgaccat

SEQ ID NO: 3005568 - DNA, 23 bp, Homo sapiens
atgttcggtttttttcctgtttc

SEQ ID NO: 3005569 - DNA, 13 bp, Homo sapiens
atgttctaaggct

SEQ ID NO: 3005570 - DNA, 18 bp, Homo sapiens
atgttctaaggctctgag

SEQ ID NO: 3005571 - DNA, 19 bp, Homo sapiens
atgttctaaggctctgaga

SEQ ID NO: 3005572 - DNA, 20 bp, Homo sapiens
atgttctaaggctctgagag

SEQ ID NO: 3005573 - DNA, 12 bp, Homo sapiens
atgttctaagtt

SEQ ID NO: 3005574 - DNA, 13 bp, Homo sapiens
atgttctaagttt

SEQ ID NO: 3005575 - DNA, 16 bp, Homo sapiens
atgttctaagtttcta

SEQ ID NO: 3005576 - DNA, 20 bp, Homo sapiens
atgttctcctgatgtagctt

SEQ ID NO: 3005577 - DNA, 13 bp, Homo sapiens
atgttctgctttc

SEQ ID NO: 3005578 - DNA, 18 bp, Homo sapiens
atgttctgtgatacagaa

SEQ ID NO: 3005579 - DNA, 15 bp, Homo sapiens
atgttcttatagaat

SEQ ID NO: 3005580 - DNA, 20 bp, Homo sapiens
atgttcttatagaataaaag

SEQ ID NO: 3005581 - DNA, 16 bp, Homo sapiens
atgttctttatataca

SEQ ID NO: 3005582 - DNA, 22 bp, Homo sapiens
atgttctttatatacaataatg

SEQ ID NO: 3005583 - DNA, 23 bp, Homo sapiens
atgttgaaactgcttgagcatca

SEQ ID NO: 3005584 - DNA, 15 bp, Homo sapiens
atgttgaatactttt

SEQ ID NO: 3005585 - DNA, 14 bp, Homo sapiens
atgttgaatgttaa

SEQ ID NO: 3005586 - DNA, 14 bp, Homo sapiens
atgttgaattcttt

SEQ ID NO: 3005587 - DNA, 16 bp, Homo sapiens
atgttgaccatgtcta

SEQ ID NO: 3005588 - DNA, 19 bp, Homo sapiens
atgttgaccatgtctatga

SEQ ID NO: 3005589 - DNA, 12 bp, Homo sapiens
atgttgataatt

SEQ ID NO: 3005590 - DNA, 15 bp, Homo sapiens
atgttgataatttca

SEQ ID NO: 3005591 - DNA, 17 bp, Homo sapiens
atgttgataatttcagg

SEQ ID NO: 3005592 - DNA, 18 bp, Homo sapiens
atgttgatcatgtacttt

SEQ ID NO: 3005593 - DNA, 20 bp, Homo sapiens
atgttgatccatccagcttg

SEQ ID NO: 3005594 - DNA, 18 bp, Homo sapiens
atgttgattacagtgcag

SEQ ID NO: 3005595 - DNA, 14 bp, Homo sapiens
atgttgcactgaaa

SEQ ID NO: 3005596 - DNA, 14 bp, Homo sapiens
atgttgcatgataa

SEQ ID NO: 3005597 - DNA, 12 bp, Homo sapiens
atgttgctattg

SEQ ID NO: 3005598 - DNA, 18 bp, Homo sapiens
atgttgctattgtaaggt

SEQ ID NO: 3005599 - DNA, 17 bp, Homo sapiens
atgttgctgttattata

SEQ ID NO: 3005600 - DNA, 19 bp, Homo sapiens
atgttggccaggctggtct

SEQ ID NO: 3005601 - DNA, 17 bp, Homo sapiens
atgttggtcaggctggt

SEQ ID NO: 3005602 - DNA, 18 bp, Homo sapiens
atgttgtagtgtccccca

SEQ ID NO: 3005603 - DNA, 19 bp, Homo sapiens
atgttgtagtgtcccccac

SEQ ID NO: 3005604 - DNA, 18 bp, Homo sapiens
atgttgtgtgttgcactc

SEQ ID NO: 3005605 - DNA, 23 bp, Homo sapiens
atgttgttagagaaaaatgcttt

SEQ ID NO: 3005606 - DNA, 16 bp, Homo sapiens
atgtttaatgtgaact

SEQ ID NO: 3005607 - DNA, 16 bp, Homo sapiens
atgtttactgtaaatt

SEQ ID NO: 3005608 - DNA, 20 bp, Homo sapiens
atgtttatacagagtaatta

SEQ ID NO: 3005609 - DNA, 15 bp, Homo sapiens
atgtttatagcattc

SEQ ID NO: 3005610 - DNA, 13 bp, Homo sapiens
atgtttatatcaa

SEQ ID NO: 3005611 - DNA, 14 bp, Homo sapiens
atgtttatgttctt

SEQ ID NO: 3005612 - DNA, 15 bp, Homo sapiens
atgtttattaataga

SEQ ID NO: 3005613 - DNA, 15 bp, Homo sapiens
atgtttattctaata

SEQ ID NO: 3005614 - DNA, 14 bp, Homo sapiens
atgtttcctggaag

SEQ ID NO: 3005615 - DNA, 23 bp, Homo sapiens
atgtttcgtgaagtatactgtat

SEQ ID NO: 3005616 - DNA, 13 bp, Homo sapiens
atgtttgacttta

SEQ ID NO: 3005617 - DNA, 22 bp, Homo sapiens
atgtttgcacctttctagttga

SEQ ID NO: 3005618 - DNA, 18 bp, Homo sapiens
atgtttggaaaggttcta

SEQ ID NO: 3005619 - DNA, 17 bp, Homo sapiens
atgtttggattctctta

SEQ ID NO: 3005620 - DNA, 18 bp, Homo sapiens
atgtttgtacacaacacc

SEQ ID NO: 3005621 - DNA, 21 bp, Homo sapiens
atgtttgtacacaacacctaa

SEQ ID NO: 3005622 - DNA, 13 bp, Homo sapiens
atgtttgtgtctg

SEQ ID NO: 3005623 - DNA, 14 bp, Homo sapiens
atgtttgttaaaaa

SEQ ID NO: 3005624 - DNA, 15 bp, Homo sapiens
atgttttaaatgtac

SEQ ID NO: 3005625 - DNA, 17 bp, Homo sapiens
atgttttaattccatga

SEQ ID NO: 3005626 - DNA, 17 bp, Homo sapiens
atgttttacgcaaggaa

SEQ ID NO: 3005627 - DNA, 16 bp, Homo sapiens
atgttttccattgttt

SEQ ID NO: 3005628 - DNA, 18 bp, Homo sapiens
atgttttccttttattca

SEQ ID NO: 3005629 - DNA, 20 bp, Homo sapiens
atgttttctgcagaaaaaaa

SEQ ID NO: 3005630 - DNA, 16 bp, Homo sapiens
atgttttctttgcaaa

SEQ ID NO: 3005631 - DNA, 17 bp, Homo sapiens
atgttttctttgcaaag

SEQ ID NO: 3005632 - DNA, 18 bp, Homo sapiens
atgttttctttgcaaagt

SEQ ID NO: 3005633 - DNA, 21 bp, Homo sapiens
atgttttctttgcaaagtatt

SEQ ID NO: 3005634 - DNA, 18 bp, Homo sapiens
atgttttgataaagtagt

SEQ ID NO: 3005635 - DNA, 14 bp, Homo sapiens
atgtttttatacaa

SEQ ID NO: 3005636 - DNA, 14 bp, Homo sapiens
atgtttttgccaaa

SEQ ID NO: 3005637 - DNA, 14 bp, Homo sapiens
attattcagtgtca

SEQ ID NO: 3005638 - DNA, 19 bp, Homo sapiens
attattccgtattacattt

SEQ ID NO: 3005639 - DNA, 21 bp, Homo sapiens
attattccgtattacattttt

SEQ ID NO: 3005640 - DNA, 13 bp, Homo sapiens
attattcttgtag

SEQ ID NO: 3005641 - DNA, 15 bp, Homo sapiens
attattgaaatatta

SEQ ID NO: 3005642 - DNA, 13 bp, Homo sapiens
attattgctgttg

SEQ ID NO: 3005643 - DNA, 13 bp, Homo sapiens
attatttaaagaa

SEQ ID NO: 3005644 - DNA, 12 bp, Homo sapiens
attatttaactc

SEQ ID NO: 3005645 - DNA, 16 bp, Homo sapiens
attatttctaggaaga

SEQ ID NO: 3005646 - DNA, 22 bp, Homo sapiens
attatttctaggaagaatttta

SEQ ID NO: 3005647 - DNA, 17 bp, Homo sapiens
attatttgtactttgtt

SEQ ID NO: 3005648 - DNA, 15 bp, Homo sapiens
attattttatctggt

SEQ ID NO: 3005649 - DNA, 21 bp, Homo sapiens
attcaaaaaactctctcccag

SEQ ID NO: 3005650 - DNA, 11 bp, Homo sapiens
attcaaaacat

SEQ ID NO: 3005651 - DNA, 21 bp, Homo sapiens
attcaaaggttctaggtttca

SEQ ID NO: 3005652 - DNA, 13 bp, Homo sapiens
attcaaatgaagg

SEQ ID NO: 3005653 - DNA, 21 bp, Homo sapiens
attcaacacactgccttatta

SEQ ID NO: 3005654 - DNA, 13 bp, Homo sapiens
attcaagaaagga

SEQ ID NO: 3005655 - DNA, 19 bp, Homo sapiens
attcaatatcctttgcctc

SEQ ID NO: 3005656 - DNA, 19 bp, Homo sapiens
attcaatcaacctgcactt

SEQ ID NO: 3005657 - DNA, 14 bp, Homo sapiens
attcacaaactttt

SEQ ID NO: 3005658 - DNA, 22 bp, Homo sapiens
attcacaatgaaatgctctcct

SEQ ID NO: 3005659 - DNA, 18 bp, Homo sapiens
attcacagcctttctgaa

SEQ ID NO: 3005660 - DNA, 22 bp, Homo sapiens
attcacagttctttgggccaga

SEQ ID NO: 3005661 - DNA, 16 bp, Homo sapiens
attcacatcatttggg

SEQ ID NO: 3005662 - DNA, 20 bp, Homo sapiens
attcacatctaacctcatct

SEQ ID NO: 3005663 - DNA, 14 bp, Homo sapiens
attcaccaatgttg

SEQ ID NO: 3005664 - DNA, 14 bp, Homo sapiens
attcaccatcatgt

SEQ ID NO: 3005665 - DNA, 16 bp, Homo sapiens
attcacctaagagatt

SEQ ID NO: 3005666 - DNA, 17 bp, Homo sapiens
attcacctaagagattc

SEQ ID NO: 3005667 - DNA, 14 bp, Homo sapiens
attcactttcattt

SEQ ID NO: 3005668 - DNA, 12 bp, Homo sapiens
attcagaaaaaa

SEQ ID NO: 3005669 - DNA, 23 bp, Homo sapiens
attcagaatcaaacctttttata

SEQ ID NO: 3005670 - DNA, 14 bp, Homo sapiens
attcagacaggcaa

SEQ ID NO: 3005671 - DNA, 20 bp, Homo sapiens
attcagagaaaggcaaggga

SEQ ID NO: 3005672 - DNA, 20 bp, Homo sapiens
attcagcagcaaattttcag

SEQ ID NO: 3005673 - DNA, 17 bp, Homo sapiens
attcagcggcagtgtgt

SEQ ID NO: 3005674 - DNA, 12 bp, Homo sapiens
attcaggcactg

SEQ ID NO: 3005675 - DNA, 14 bp, Homo sapiens
attcaggggaaggg

SEQ ID NO: 3005676 - DNA, 19 bp, Homo sapiens
attcaggggctgacacttc

SEQ ID NO: 3005677 - DNA, 18 bp, Homo sapiens
attcaggtatgttgcctt

SEQ ID NO: 3005678 - DNA, 19 bp, Homo sapiens
attcagtctgctctccctt

SEQ ID NO: 3005679 - DNA, 22 bp, Homo sapiens
attcagtgcacctgcctcagct

SEQ ID NO: 3005680 - DNA, 14 bp, Homo sapiens
attcagtgtcactg

SEQ ID NO: 3005681 - DNA, 15 bp, Homo sapiens
attcagttttcattt

SEQ ID NO: 3005682 - DNA, 17 bp, Homo sapiens
attcatactctgttgcc

SEQ ID NO: 3005683 - DNA, 20 bp, Homo sapiens
attcatactctgttgcctcc

SEQ ID NO: 3005684 - DNA, 19 bp, Homo sapiens
attcatagtaacttcttat

SEQ ID NO: 3005685 - DNA, 16 bp, Homo sapiens
attcatatcctccgcc

SEQ ID NO: 3005686 - DNA, 13 bp, Homo sapiens
attcatattgaat

SEQ ID NO: 3005687 - DNA, 20 bp, Homo sapiens
attcatatttgtagttgcat

SEQ ID NO: 3005688 - DNA, 16 bp, Homo sapiens
attcatatttttcctt

SEQ ID NO: 3005689 - DNA, 18 bp, Homo sapiens
attcatcaaataaacctt

SEQ ID NO: 3005690 - DNA, 13 bp, Homo sapiens
attcatgaacttc

SEQ ID NO: 3005691 - DNA, 14 bp, Homo sapiens
attcatgctaccca

SEQ ID NO: 3005692 - DNA, 13 bp, Homo sapiens
attcatgttcatg

SEQ ID NO: 3005693 - DNA, 17 bp, Homo sapiens
attcatgttttaaaagt

SEQ ID NO: 3005694 - DNA, 21 bp, Homo sapiens
attcatgttttaaaagtttgt

SEQ ID NO: 3005695 - DNA, 23 bp, Homo sapiens
attctgaatttgcaaagtactgt

SEQ ID NO: 3005696 - DNA, 14 bp, Homo sapiens
attctgagaaaaca

SEQ ID NO: 3005697 - DNA, 13 bp, Homo sapiens
attctgagagctg

SEQ ID NO: 3005698 - DNA, 17 bp, Homo sapiens
attctgagccacactga

SEQ ID NO: 3005699 - DNA, 16 bp, Homo sapiens
attctgataggagggg

SEQ ID NO: 3005700 - DNA, 12 bp, Homo sapiens
attctgattcag

SEQ ID NO: 3005701 - DNA, 12 bp, Homo sapiens
attctgattggt

SEQ ID NO: 3005702 - DNA, 17 bp, Homo sapiens
attctgcagtaaatctt

SEQ ID NO: 3005703 - DNA, 20 bp, Homo sapiens
attctgcagtaaatctttta

SEQ ID NO: 3005704 - DNA, 22 bp, Homo sapiens
attctgccataacagattatgt

SEQ ID NO: 3005705 - DNA, 19 bp, Homo sapiens
attctgcccaaaaatatgg

SEQ ID NO: 3005706 - DNA, 16 bp, Homo sapiens
attctgcctctctagg

SEQ ID NO: 3005707 - DNA, 13 bp, Homo sapiens
attctgcttgaga

SEQ ID NO: 3005708 - DNA, 18 bp, Homo sapiens
attctggacagtcagctc

SEQ ID NO: 3005709 - DNA, 15 bp, Homo sapiens
attctgttgtgttca

SEQ ID NO: 3005710 - DNA, 15 bp, Homo sapiens
attctgtttaaatcc

SEQ ID NO: 3005711 - DNA, 15 bp, Homo sapiens
attcttaaaaaaaga

SEQ ID NO: 3005712 - DNA, 20 bp, Homo sapiens
attcttaatttggatctatt

SEQ ID NO: 3005713 - DNA, 21 bp, Homo sapiens
attcttaatttggatctattt

SEQ ID NO: 3005714 - DNA, 15 bp, Homo sapiens
attcttacatgtttt

SEQ ID NO: 3005715 - DNA, 17 bp, Homo sapiens
attcttacatgttttct

SEQ ID NO: 3005716 - DNA, 12 bp, Homo sapiens
attcttataaat

SEQ ID NO: 3005717 - DNA, 16 bp, Homo sapiens
attcttataaatatga

SEQ ID NO: 3005718 - DNA, 20 bp, Homo sapiens
attcttataaatatgaagct

SEQ ID NO: 3005719 - DNA, 15 bp, Homo sapiens
attcttattttgtgg

SEQ ID NO: 3005720 - DNA, 17 bp, Homo sapiens
attcttatttttaattt

SEQ ID NO: 3005721 - DNA, 20 bp, Homo sapiens
attcttcacgcagagatttt

SEQ ID NO: 3005722 - DNA, 22 bp, Homo sapiens
attcttctcttgctttatacta

SEQ ID NO: 3005723 - DNA, 19 bp, Homo sapiens
attcttggttattctgcca

SEQ ID NO: 3005724 - DNA, 17 bp, Homo sapiens
attcttggttgaggaaa

SEQ ID NO: 3005725 - DNA, 17 bp, Homo sapiens
attctttaaatttcatc

SEQ ID NO: 3005726 - DNA, 21 bp, Homo sapiens
attctttatacaacagtgcta

SEQ ID NO: 3005727 - DNA, 14 bp, Homo sapiens
attctttcaattct

SEQ ID NO: 3005728 - DNA, 13 bp, Homo sapiens
attctttcccaac

SEQ ID NO: 3005729 - DNA, 16 bp, Homo sapiens
attctttcccaacacc

SEQ ID NO: 3005730 - DNA, 12 bp, Homo sapiens
attctttccttc

SEQ ID NO: 3005731 - DNA, 13 bp, Homo sapiens
attctttgatgtt

SEQ ID NO: 3005732 - DNA, 15 bp, Homo sapiens
attctttgatgttaa

SEQ ID NO: 3005733 - DNA, 16 bp, Homo sapiens
attctttgatgttaac

SEQ ID NO: 3005734 - DNA, 19 bp, Homo sapiens
attctttgatgttaacaca

SEQ ID NO: 3005735 - DNA, 21 bp, Homo sapiens
attctttgatgttaacacatt

SEQ ID NO: 3005736 - DNA, 22 bp, Homo sapiens
attctttgatgttaacacattt

SEQ ID NO: 3005737 - DNA, 13 bp, Homo sapiens
attcttttcaatt

SEQ ID NO: 3005738 - DNA, 13 bp, Homo sapiens
attcttttctata

SEQ ID NO: 3005739 - DNA, 22 bp, Homo sapiens
attcttttctataatgtgcctg

SEQ ID NO: 3005740 - DNA, 23 bp, Homo sapiens
attcttttctataatgtgcctgg

SEQ ID NO: 3005741 - DNA, 16 bp, Homo sapiens
attcttttgaattgtt

SEQ ID NO: 3005742 - DNA, 17 bp, Homo sapiens
attcttttgtaatttaa

SEQ ID NO: 3005743 - DNA, 13 bp, Homo sapiens
attgaaaaaaata

SEQ ID NO: 3005744 - DNA, 22 bp, Homo sapiens
attgaaaaaatagagcctgagg

SEQ ID NO: 3005745 - DNA, 14 bp, Homo sapiens
attgaaaacagata

SEQ ID NO: 3005746 - DNA, 18 bp, Homo sapiens
attgaaatgtaatttcag

SEQ ID NO: 3005747 - DNA, 13 bp, Homo sapiens
attgaaatttgaa

SEQ ID NO: 3005748 - DNA, 18 bp, Homo sapiens
attgaacacaaactgtaa

SEQ ID NO: 3005749 - DNA, 11 bp, Homo sapiens
attgaactttc

SEQ ID NO: 3005750 - DNA, 16 bp, Homo sapiens
attgaagtaatgaatt

SEQ ID NO: 3005751 - DNA, 14 bp, Homo sapiens
attgaataatggta

SEQ ID NO: 3005752 - DNA, 22 bp, Homo sapiens
attgaataatggtaccagataa

SEQ ID NO: 3005753 - DNA, 23 bp, Homo sapiens
attgaatataatatatttgtgta

SEQ ID NO: 3005754 - DNA, 16 bp, Homo sapiens
attgaatctatttaag

SEQ ID NO: 3005755 - DNA, 21 bp, Homo sapiens
attgacaaacccggaagatca

SEQ ID NO: 3005756 - DNA, 17 bp, Homo sapiens
attgacaacagttacat

SEQ ID NO: 3005757 - DNA, 18 bp, Homo sapiens
attgacagctttgctgct

SEQ ID NO: 3005758 - DNA, 18 bp, Homo sapiens
attgacattctctattgt

SEQ ID NO: 3005759 - DNA, 15 bp, Homo sapiens
attgacgaactggct

SEQ ID NO: 3005760 - DNA, 16 bp, Homo sapiens
attgacgaactggcta

SEQ ID NO: 3005761 - DNA, 22 bp, Homo sapiens
attgacgaactggctacagtac

SEQ ID NO: 3005762 - DNA, 14 bp, Homo sapiens
attgacttcaatga

SEQ ID NO: 3005763 - DNA, 16 bp, Homo sapiens
attgagaaagaaacta

SEQ ID NO: 3005764 - DNA, 14 bp, Homo sapiens
attgagacagtgca

SEQ ID NO: 3005765 - DNA, 17 bp, Homo sapiens
attgagatgattaaaat

SEQ ID NO: 3005766 - DNA, 16 bp, Homo sapiens
attgagcttgcttctt

SEQ ID NO: 3005767 - DNA, 16 bp, Homo sapiens
attgagttttcagtgg

SEQ ID NO: 3005768 - DNA, 19 bp, Homo sapiens
attgattaaaatctcttga

SEQ ID NO: 3005769 - DNA, 22 bp, Homo sapiens
attgattccttttttcaaaatc

SEQ ID NO: 3005770 - DNA, 17 bp, Homo sapiens
attgattgtcatatttc

SEQ ID NO: 3005771 - DNA, 20 bp, Homo sapiens
attgattgtgaattccttaa

SEQ ID NO: 3005772 - DNA, 15 bp, Homo sapiens
attgatttaaaagtg

SEQ ID NO: 3005773 - DNA, 14 bp, Homo sapiens
attgatttgaagaa

SEQ ID NO: 3005774 - DNA, 12 bp, Homo sapiens
attgatttgcat

SEQ ID NO: 3005775 - DNA, 23 bp, Homo sapiens
attgcaaaatgcgtatttgcatt

SEQ ID NO: 3005776 - DNA, 20 bp, Homo sapiens
attgcaatacattgttcagg

SEQ ID NO: 3005777 - DNA, 17 bp, Homo sapiens
attgcaatatctgaagc

SEQ ID NO: 3005778 - DNA, 22 bp, Homo sapiens
attgcacaatattgaacttttt

SEQ ID NO: 3005779 - DNA, 14 bp, Homo sapiens
attgcacattgttc

SEQ ID NO: 3005780 - DNA, 17 bp, Homo sapiens
attgcactgaagttttt

SEQ ID NO: 3005781 - DNA, 18 bp, Homo sapiens
attgcactgaagtttttg

SEQ ID NO: 3005782 - DNA, 23 bp, Homo sapiens
attgcactgaagtttttgaaata

SEQ ID NO: 3005783 - DNA, 14 bp, Homo sapiens
gctgcatctgataa

SEQ ID NO: 3005784 - DNA, 21 bp, Homo sapiens
gctgcatttcacatgccttgc

SEQ ID NO: 3005785 - DNA, 20 bp, Homo sapiens
gctgccaccaaatctgtcta

SEQ ID NO: 3005786 - DNA, 15 bp, Homo sapiens
gctgccactctgctg

SEQ ID NO: 3005787 - DNA, 19 bp, Homo sapiens
gctgccactctgctgcctg

SEQ ID NO: 3005788 - DNA, 14 bp, Homo sapiens
gctgccactgggca

SEQ ID NO: 3005789 - DNA, 18 bp, Homo sapiens
gctgccactgggcacctg

SEQ ID NO: 3005790 - DNA, 16 bp, Homo sapiens
gctgccagggcttcct

SEQ ID NO: 3005791 - DNA, 18 bp, Homo sapiens
gctgccatcttgcttttc

SEQ ID NO: 3005792 - DNA, 19 bp, Homo sapiens
gctgccccacaggtgtgtt

SEQ ID NO: 3005793 - DNA, 14 bp, Homo sapiens
gctgccccaggccg

SEQ ID NO: 3005794 - DNA, 19 bp, Homo sapiens
gctgccccaggccggagcc

SEQ ID NO: 3005795 - DNA, 18 bp, Homo sapiens
gctgccccatcagtgctc

SEQ ID NO: 3005796 - DNA, 21 bp, Homo sapiens
gctgccccatgaagccacagc

SEQ ID NO: 3005797 - DNA, 22 bp, Homo sapiens
gctgcccctcatctctctgccc

SEQ ID NO: 3005798 - DNA, 16 bp, Homo sapiens
gctgcccctccctgcc

SEQ ID NO: 3005799 - DNA, 17 bp, Homo sapiens
gctgcccctccctgcct

SEQ ID NO: 3005800 - DNA, 20 bp, Homo sapiens
gctgcccctccctgcctcca

SEQ ID NO: 3005801 - DNA, 16 bp, Homo sapiens
gctgcccctctctggg

SEQ ID NO: 3005802 - DNA, 17 bp, Homo sapiens
gctgcccctctctgggc

SEQ ID NO: 3005803 - DNA, 17 bp, Homo sapiens
gctgccctgaggggctg

SEQ ID NO: 3005804 - DNA, 23 bp, Homo sapiens
gctgccctgaggggctggggagg

SEQ ID NO: 3005805 - DNA, 14 bp, Homo sapiens
gctgccctgggtcc

SEQ ID NO: 3005806 - DNA, 15 bp, Homo sapiens
gctgccctgggtcct

SEQ ID NO: 3005807 - DNA, 22 bp, Homo sapiens
gctgccctgggtcctgcctgca

SEQ ID NO: 3005808 - DNA, 23 bp, Homo sapiens
gctgccctgggtcctgcctgcag

SEQ ID NO: 3005809 - DNA, 13 bp, Homo sapiens
gctgcccttgggc

SEQ ID NO: 3005810 - DNA, 18 bp, Homo sapiens
gctgcccttgggccaccc

SEQ ID NO: 3005811 - DNA, 18 bp, Homo sapiens
gctgccgcaccccagagt

SEQ ID NO: 3005812 - DNA, 22 bp, Homo sapiens
gctgccgcaccccagagtgtgg

SEQ ID NO: 3005813 - DNA, 18 bp, Homo sapiens
gctgccgtgccgcctgca

SEQ ID NO: 3005814 - DNA, 22 bp, Homo sapiens
gctgccgtgccgcctgcactcc

SEQ ID NO: 3005815 - DNA, 16 bp, Homo sapiens
gctgcctaagtggctg

SEQ ID NO: 3005816 - DNA, 17 bp, Homo sapiens
gctgcctaagtggctgc

SEQ ID NO: 3005817 - DNA, 19 bp, Homo sapiens
gctgcctcagctcagcttc

SEQ ID NO: 3005818 - DNA, 14 bp, Homo sapiens
gctgcctcatttag

SEQ ID NO: 3005819 - DNA, 21 bp, Homo sapiens
gctgcctcatttagagaggaa

SEQ ID NO: 3005820 - DNA, 15 bp, Homo sapiens
gctgcctccccaatc

SEQ ID NO: 3005821 - DNA, 15 bp, Homo sapiens
gctgcctcctgatgt

SEQ ID NO: 3005822 - DNA, 12 bp, Homo sapiens
gctgcctgcagc

SEQ ID NO: 3005823 - DNA, 16 bp, Homo sapiens
gctgcctgcagcacat

SEQ ID NO: 3005824 - DNA, 17 bp, Homo sapiens
gctgcctgcagcacatg

SEQ ID NO: 3005825 - DNA, 15 bp, Homo sapiens
gctgcctgcccacac

SEQ ID NO: 3005826 - DNA, 13 bp, Homo sapiens
gctgcctggagcc

SEQ ID NO: 3005827 - DNA, 11 bp, Homo sapiens
gctgcctggcc

SEQ ID NO: 3005828 - DNA, 17 bp, Homo sapiens
gctgcctggccaggccc

SEQ ID NO: 3005829 - DNA, 22 bp, Homo sapiens
gctgcctggccaggccctgggt

SEQ ID NO: 3005830 - DNA, 18 bp, Homo sapiens
gctgcctggccatgctgt

SEQ ID NO: 3005831 - DNA, 23 bp, Homo sapiens
gctgcctgggtaggccccacaag

SEQ ID NO: 3005832 - DNA, 20 bp, Homo sapiens
gctgccttagcttcaggaac

SEQ ID NO: 3005833 - DNA, 21 bp, Homo sapiens
gctgccttggctcagacatgt

SEQ ID NO: 3005834 - DNA, 13 bp, Homo sapiens
gctgcctttgtgg

SEQ ID NO: 3005835 - DNA, 20 bp, Homo sapiens
gctgcctttgtggtgggcgc

SEQ ID NO: 3005836 - DNA, 17 bp, Homo sapiens
gctgcgatccggcagcc

SEQ ID NO: 3005837 - DNA, 16 bp, Homo sapiens
gctgcgctaaccccca

SEQ ID NO: 3005838 - DNA, 22 bp, Homo sapiens
gctgcggacaccgtggcctggg

SEQ ID NO: 3005839 - DNA, 16 bp, Homo sapiens
gctgcgggctgagggc

SEQ ID NO: 3005840 - DNA, 17 bp, Homo sapiens
gctgcgggctgagggca

SEQ ID NO: 3005841 - DNA, 18 bp, Homo sapiens
gctgcgtgcccctgctgc

SEQ ID NO: 3005842 - DNA, 13 bp, Homo sapiens
gctgctaaaataa

SEQ ID NO: 3005843 - DNA, 18 bp, Homo sapiens
gctgctaaaataaacctg

SEQ ID NO: 3005844 - DNA, 21 bp, Homo sapiens
gctgctaaaataaacctgttt

SEQ ID NO: 3005845 - DNA, 15 bp, Homo sapiens
gctgctacaaagaag

SEQ ID NO: 3005846 - DNA, 18 bp, Homo sapiens
gctgctacaaagaagaca

SEQ ID NO: 3005847 - DNA, 19 bp, Homo sapiens
gctgctacaaagaagacat

SEQ ID NO: 3005848 - DNA, 20 bp, Homo sapiens
gctgctacaaagaagacatg

SEQ ID NO: 3005849 - DNA, 21 bp, Homo sapiens
gctgctacaaagaagacatgt

SEQ ID NO: 3005850 - DNA, 16 bp, Homo sapiens
gctgctactagctctt

SEQ ID NO: 3005851 - DNA, 18 bp, Homo sapiens
gctgctaggggaaggact

SEQ ID NO: 3005852 - DNA, 20 bp, Homo sapiens
gctgctaggggaaggactgg

SEQ ID NO: 3005853 - DNA, 21 bp, Homo sapiens
gctgctcagggaaaagcagct

SEQ ID NO: 3005854 - DNA, 19 bp, Homo sapiens
gctgctcattccacactgt

SEQ ID NO: 3005855 - DNA, 21 bp, Homo sapiens
gctgctcattccacactgttg

SEQ ID NO: 3005856 - DNA, 12 bp, Homo sapiens
gctgctcccaca

SEQ ID NO: 3005857 - DNA, 22 bp, Homo sapiens
gctgctcccacacttgtgccag

SEQ ID NO: 3005858 - DNA, 14 bp, Homo sapiens
gctgctccccaccc

SEQ ID NO: 3005859 - DNA, 13 bp, Homo sapiens
gctgctccccacg

SEQ ID NO: 3005860 - DNA, 21 bp, Homo sapiens
gctgctcctagagggaggggc

SEQ ID NO: 3005861 - DNA, 12 bp, Homo sapiens
gctgctcctcca

SEQ ID NO: 3005862 - DNA, 20 bp, Homo sapiens
gctgctcctctttcccctcc

SEQ ID NO: 3005863 - DNA, 23 bp, Homo sapiens
gctgctccttagctgccaagccc

SEQ ID NO: 3005864 - DNA, 19 bp, Homo sapiens
gctgctgaactaatttctg

SEQ ID NO: 3005865 - DNA, 15 bp, Homo sapiens
gctgctgaaggctca

SEQ ID NO: 3005866 - DNA, 18 bp, Homo sapiens
gctgctgacctccacagc

SEQ ID NO: 3005867 - DNA, 18 bp, Homo sapiens
gctgctgccactctgctg

SEQ ID NO: 3005868 - DNA, 14 bp, Homo sapiens
gctgctggagcccg

SEQ ID NO: 3005869 - DNA, 19 bp, Homo sapiens
gctgctggagcccgcactg

SEQ ID NO: 3005870 - DNA, 16 bp, Homo sapiens
gctgctggcctccctc

SEQ ID NO: 3005871 - DNA, 15 bp, Homo sapiens
gctgctggtgcacag

SEQ ID NO: 3005872 - DNA, 22 bp, Homo sapiens
gctgctgtgcaacggtctcctg

SEQ ID NO: 3005873 - DNA, 21 bp, Homo sapiens
gctgctgtgcgtggaaaaaga

SEQ ID NO: 3005874 - DNA, 22 bp, Homo sapiens
gctgctgtgcgtggaaaaagac

SEQ ID NO: 3005875 - DNA, 22 bp, Homo sapiens
gctgcttcccatgcctgcaacc

SEQ ID NO: 3005876 - DNA, 12 bp, Homo sapiens
gctgcttcctaa

SEQ ID NO: 3005877 - DNA, 16 bp, Homo sapiens
gctgcttgcagccagg

SEQ ID NO: 3005878 - DNA, 14 bp, Homo sapiens
gctgcttttatatc

SEQ ID NO: 3005879 - DNA, 22 bp, Homo sapiens
gctgcttttccttggggcaggc

SEQ ID NO: 3005880 - DNA, 17 bp, Homo sapiens
gctggaaaataatactg

SEQ ID NO: 3005881 - DNA, 22 bp, Homo sapiens
gctggaaaataatactgctgag

SEQ ID NO: 3005882 - DNA, 22 bp, Homo sapiens
gctggaaaccaagtcaggccag

SEQ ID NO: 3005883 - DNA, 17 bp, Homo sapiens
gctggaagaaccactgt

SEQ ID NO: 3005884 - DNA, 16 bp, Homo sapiens
gctggaaggacaaata

SEQ ID NO: 3005885 - DNA, 22 bp, Homo sapiens
gctggactctcagtctctgagc

SEQ ID NO: 3005886 - DNA, 13 bp, Homo sapiens
gctggacttggag

SEQ ID NO: 3005887 - DNA, 21 bp, Homo sapiens
gctggagcccgcactgtccca

SEQ ID NO: 3005888 - DNA, 22 bp, Homo sapiens
gctggagcccgcactgtcccag

SEQ ID NO: 3005889 - DNA, 12 bp, Homo sapiens
gctggaggcagg

SEQ ID NO: 3005890 - DNA, 12 bp, Homo sapiens
gctggaggccca

SEQ ID NO: 3005891 - DNA, 16 bp, Homo sapiens
gctggaggcccaggct

SEQ ID NO: 3005892 - DNA, 23 bp, Homo sapiens
gctggagggaggcgggggctgcc

SEQ ID NO: 3005893 - DNA, 15 bp, Homo sapiens
gctggagtgcagtga

SEQ ID NO: 3005894 - DNA, 20 bp, Homo sapiens
gctggagtgcagtggtgtga

SEQ ID NO: 3005895 - DNA, 15 bp, Homo sapiens
gctggatgatggtct

SEQ ID NO: 3005896 - DNA, 22 bp, Homo sapiens
gctggatgctccttccaacagg

SEQ ID NO: 3005897 - DNA, 21 bp, Homo sapiens
gctggatgtctgccaattttt

SEQ ID NO: 3005898 - DNA, 16 bp, Homo sapiens
gctggattacaggcat

SEQ ID NO: 3005899 - DNA, 21 bp, Homo sapiens
gctggcaacacagaggcagcc

SEQ ID NO: 3005900 - DNA, 18 bp, Homo sapiens
gctggcaagataaacact

SEQ ID NO: 3005901 - DNA, 13 bp, Homo sapiens
gctggcagcagag

SEQ ID NO: 3005902 - DNA, 13 bp, Homo sapiens
gctggccaaggag

SEQ ID NO: 3005903 - DNA, 14 bp, Homo sapiens
gctggccagccgct

SEQ ID NO: 3005904 - DNA, 21 bp, Homo sapiens
gctggccagccgctctcctgc

SEQ ID NO: 3005905 - DNA, 18 bp, Homo sapiens
gctggccagtgctgccca

SEQ ID NO: 3005906 - DNA, 12 bp, Homo sapiens
gctggcccagca

SEQ ID NO: 3005907 - DNA, 17 bp, Homo sapiens
gctggcccagcatggaa

SEQ ID NO: 3005908 - DNA, 16 bp, Homo sapiens
gctggcccagggccca

SEQ ID NO: 3005909 - DNA, 17 bp, Homo sapiens
gctggcccagggcccag

SEQ ID NO: 3005910 - DNA, 18 bp, Homo sapiens
gctggcccagggcccaga

SEQ ID NO: 3005911 - DNA, 20 bp, Homo sapiens
gctggcccagggcccagagc

SEQ ID NO: 3005912 - DNA, 15 bp, Homo sapiens
gctggcccagggggc

SEQ ID NO: 3005913 - DNA, 20 bp, Homo sapiens
gctggcccagggggcctgga

SEQ ID NO: 3005914 - DNA, 23 bp, Homo sapiens
gctggccccgccgcctggtactc

SEQ ID NO: 3005915 - DNA, 14 bp, Homo sapiens
gctggcccctttgg

SEQ ID NO: 3005916 - DNA, 14 bp, Homo sapiens
gctggccctgtgca

SEQ ID NO: 3005917 - DNA, 21 bp, Homo sapiens
gctggcctcacccacccctgc

SEQ ID NO: 3005918 - DNA, 22 bp, Homo sapiens
gctggcctcccaaatgagccat

SEQ ID NO: 3005919 - DNA, 19 bp, Homo sapiens
tctgtttcataatgcagaa

SEQ ID NO: 3005920 - DNA, 12 bp, Homo sapiens
tctgtttcctgt

SEQ ID NO: 3005921 - DNA, 19 bp, Homo sapiens
tctgtttggactgcagaag

SEQ ID NO: 3005922 - DNA, 12 bp, Homo sapiens
tctgttttctgt

SEQ ID NO: 3005923 - DNA, 18 bp, Homo sapiens
tctgttttcttctcagtc

SEQ ID NO: 3005924 - DNA, 16 bp, Homo sapiens
tcttaaaaagttgttc

SEQ ID NO: 3005925 - DNA, 15 bp, Homo sapiens
tgttgcttcttgtga

SEQ ID NO: 3005926 - DNA, 12 bp, Homo sapiens
tgttgctttgtt

SEQ ID NO: 3005927 - DNA, 21 bp, Homo sapiens
tgttggaagcttgttttccag

SEQ ID NO: 3005928 - DNA, 14 bp, Homo sapiens
tgttggacaaatgt

SEQ ID NO: 3005929 - DNA, 18 bp, Homo sapiens
tgttggagatgcagcctt

SEQ ID NO: 3005930 - DNA, 20 bp, Homo sapiens
tgttggataaatcagtggtt

SEQ ID NO: 3005931 - DNA, 19 bp, Homo sapiens
tgttggcacatcctatgca

SEQ ID NO: 3005932 - DNA, 18 bp, Homo sapiens
tgttggcccttccagtgg

SEQ ID NO: 3005933 - DNA, 13 bp, Homo sapiens
tgttggtcacatg

SEQ ID NO: 3005934 - DNA, 15 bp, Homo sapiens
tgttggtgctttgca

SEQ ID NO: 3005935 - DNA, 14 bp, Homo sapiens
tgttggttttgact

SEQ ID NO: 3005936 - DNA, 13 bp, Homo sapiens
tgttgtaaaacaa

SEQ ID NO: 3005937 - DNA, 22 bp, Homo sapiens
tgttgtaaaacaaaatttgact

SEQ ID NO: 3005938 - DNA, 19 bp, Homo sapiens
tgttgtaaaagatgcagag

SEQ ID NO: 3005939 - DNA, 21 bp, Homo sapiens
tgttacttaaacatcattgga

SEQ ID NO: 3005940 - DNA, 11 bp, Homo sapiens
tgttactttga

SEQ ID NO: 3005941 - DNA, 15 bp, Homo sapiens
tgttactttgaatag

SEQ ID NO: 3005942 - DNA, 17 bp, Homo sapiens
tgttagaattgatttcc

SEQ ID NO: 3005943 - DNA, 19 bp, Homo sapiens
tgttagcctcaatttctga

SEQ ID NO: 3005944 - DNA, 18 bp, Homo sapiens
tgttagctcctcactgtg

SEQ ID NO: 3005945 - DNA, 23 bp, Homo sapiens
tgttagtttagtgtgtgtgcaga

SEQ ID NO: 3005946 - DNA, 20 bp, Homo sapiens
tgttatacatcaatatgtat

SEQ ID NO: 3005947 - DNA, 21 bp, Homo sapiens
tgttatcagtcaatattttta

SEQ ID NO: 3005948 - DNA, 16 bp, Homo sapiens
tgttatcatcctccct

SEQ ID NO: 3005949 - DNA, 17 bp, Homo sapiens
tgttatcttaacactga

SEQ ID NO: 3005950 - DNA, 19 bp, Homo sapiens
tgttatcttaacactgaaa

SEQ ID NO: 3005951 - DNA, 21 bp, Homo sapiens
tgttatcttatactgtacaat

SEQ ID NO: 3005952 - DNA, 22 bp, Homo sapiens
tgttatcttatactgtacaata

SEQ ID NO: 3005953 - DNA, 18 bp, Homo sapiens
tgttatggcttaatgaca

SEQ ID NO: 3005954 - DNA, 23 bp, Homo sapiens
tgttatggcttattgtgtgaagg

SEQ ID NO: 3005955 - DNA, 22 bp, Homo sapiens
tgttatgtaaaaggccaaacct

SEQ ID NO: 3005956 - DNA, 20 bp, Homo sapiens
tgttatgtagtgtgcttttt

SEQ ID NO: 3005957 - DNA, 14 bp, Homo sapiens
tgttatgtgaattt

SEQ ID NO: 3005958 - DNA, 17 bp, Homo sapiens
tgttatgtgtctggaag

SEQ ID NO: 3005959 - DNA, 18 bp, Homo sapiens
tgttatgtgtctggaaga

SEQ ID NO: 3005960 - DNA, 21 bp, Homo sapiens
tgttattaaacgtatgcatgt

SEQ ID NO: 3005961 - DNA, 19 bp, Homo sapiens
ttacttgaagtaactataa

SEQ ID NO: 3005962 - DNA, 20 bp, Homo sapiens
ttactttactgcctgaataa

SEQ ID NO: 3005963 - DNA, 15 bp, Homo sapiens
ttactttgaatagtc

SEQ ID NO: 3005964 - DNA, 14 bp, Homo sapiens
ttactttgccaact

SEQ ID NO: 3005965 - DNA, 14 bp, Homo sapiens
ttactttgtgcaaa

SEQ ID NO: 3005966 - DNA, 14 bp, Homo sapiens
ttactttttaaaca

SEQ ID NO: 3005967 - DNA, 17 bp, Homo sapiens
ttactttttaaacagtg

SEQ ID NO: 3005968 - DNA, 22 bp, Homo sapiens
ttacttttttttttttttggta

SEQ ID NO: 3005969 - DNA, 21 bp, Homo sapiens
ttagaaaaagaacatgcagtt

SEQ ID NO: 3005970 - DNA, 22 bp, Homo sapiens
ttagaaaaagaacatgcagttt

SEQ ID NO: 3005971 - DNA, 21 bp, Homo sapiens
ttagaaacaaacaaaactctt

SEQ ID NO: 3005972 - DNA, 22 bp, Homo sapiens
ttagaaagctgacattgccaaa

SEQ ID NO: 3005973 - DNA, 14 bp, Homo sapiens
ttagaaataataaa

SEQ ID NO: 3005974 - DNA, 16 bp, Homo sapiens
ttagaacaattttctt

SEQ ID NO: 3005975 - DNA, 14 bp, Homo sapiens
ttagaagtgtcatg

SEQ ID NO: 3005976 - DNA, 13 bp, Homo sapiens
ttagaattaaaaa

SEQ ID NO: 3005977 - DNA, 13 bp, Homo sapiens
ttagaattggaaa

SEQ ID NO: 3005978 - DNA, 21 bp, Homo sapiens
ttagacacttttatatttgaa

SEQ ID NO: 3005979 - DNA, 23 bp, Homo sapiens
ttagacacttttatatttgaaaa

SEQ ID NO: 3005980 - DNA, 21 bp, Homo sapiens
ttagacctgtagatagtgata

SEQ ID NO: 3005981 - DNA, 19 bp, Homo sapiens
ttagactcatcttactgta

SEQ ID NO: 3005982 - DNA, 22 bp, Homo sapiens
ttagactggaacttgaactgat

SEQ ID NO: 3005983 - DNA, 21 bp, Homo sapiens
ttagagaactgaaaagagagc

SEQ ID NO: 3005984 - DNA, 19 bp, Homo sapiens
ttagagcaatgcattctgg

SEQ ID NO: 3005985 - DNA, 19 bp, Homo sapiens
ttagagcattaaaataact

SEQ ID NO: 3005986 - DNA, 13 bp, Homo sapiens
ttagataatcttt

SEQ ID NO: 3005987 - DNA, 16 bp, Homo sapiens
ttagatctctcctgca

SEQ ID NO: 3005988 - DNA, 23 bp, Homo sapiens
ttagatctggtgtccagcatgga

SEQ ID NO: 3005989 - DNA, 17 bp, Homo sapiens
ttagatggattctccac

SEQ ID NO: 3005990 - DNA, 14 bp, Homo sapiens
ttagattattgaaa

SEQ ID NO: 3005991 - DNA, 19 bp, Homo sapiens
ttagattctctgtgtctaa

SEQ ID NO: 3005992 - DNA, 22 bp, Homo sapiens
ttagattctctgtgtctaagat

SEQ ID NO: 3005993 - DNA, 14 bp, Homo sapiens
ttagcaaactttgt

SEQ ID NO: 3005994 - DNA, 12 bp, Homo sapiens
ttagcaaggatt

SEQ ID NO: 3005995 - DNA, 17 bp, Homo sapiens
ttagcaatgctgtgaat

SEQ ID NO: 3005996 - DNA, 14 bp, Homo sapiens
ttagcagcccagca

SEQ ID NO: 3005997 - DNA, 22 bp, Homo sapiens
ttagcaggagaggagagccaga

SEQ ID NO: 3005998 - DNA, 23 bp, Homo sapiens
ttagcaggagaggagagccagag

SEQ ID NO: 3005999 - DNA, 16 bp, Homo sapiens
ttagcataaatttaat

SEQ ID NO: 3006000 - DNA, 17 bp, Homo sapiens
ttagcataaatttaatg

SEQ ID NO: 3006001 - DNA, 19 bp, Homo sapiens
ttagcataaatttaatgta

SEQ ID NO: 3006002 - DNA, 14 bp, Homo sapiens
ttagcatccaggct

SEQ ID NO: 3006003 - DNA, 17 bp, Homo sapiens
ttagcatttaccaacat

SEQ ID NO: 3006004 - DNA, 18 bp, Homo sapiens
ttagcatttaccaacatg

SEQ ID NO: 3006005 - DNA, 16 bp, Homo sapiens
ttagccagtgaaacac

SEQ ID NO: 3006006 - DNA, 20 bp, Homo sapiens
ttagccatctaatgcttgtt

SEQ ID NO: 3006007 - DNA, 18 bp, Homo sapiens
ttagcccttccttgccag

SEQ ID NO: 3006008 - DNA, 20 bp, Homo sapiens
ttagcctctggatctagaag

SEQ ID NO: 3006009 - DNA, 18 bp, Homo sapiens
ttagcctggatagccttg

SEQ ID NO: 3006010 - DNA, 21 bp, Homo sapiens
ttagctaaacggattccaaag

SEQ ID NO: 3006011 - DNA, 19 bp, Homo sapiens
ttagctctggacgtgaaat

SEQ ID NO: 3006012 - DNA, 23 bp, Homo sapiens
ttagctgatgaacttattctgta

SEQ ID NO: 3006013 - DNA, 13 bp, Homo sapiens
ttagctgcagaac

SEQ ID NO: 3006014 - DNA, 17 bp, Homo sapiens
ttagctgccaagcccca

SEQ ID NO: 3006015 - DNA, 22 bp, Homo sapiens
ttagctgccaagccccatcctg

SEQ ID NO: 3006016 - DNA, 11 bp, Homo sapiens
ttagctgccat

SEQ ID NO: 3006017 - DNA, 15 bp, Homo sapiens
ttagcttcctccaga

SEQ ID NO: 3006018 - DNA, 18 bp, Homo sapiens
ttagcttcctccagagga

SEQ ID NO: 3006019 - DNA, 20 bp, Homo sapiens
ttagcttcctccagaggagg

SEQ ID NO: 3006020 - DNA, 12 bp, Homo sapiens
ttagcttgctta

SEQ ID NO: 3006021 - DNA, 20 bp, Homo sapiens
ttagcttggggccagggaag

SEQ ID NO: 3006022 - DNA, 15 bp, Homo sapiens
ttagctttactgttt

SEQ ID NO: 3006023 - DNA, 17 bp, Homo sapiens
ttagctttactgtttgt

SEQ ID NO: 3006024 - DNA, 17 bp, Homo sapiens
ttagctttttcatcccc

SEQ ID NO: 3006025 - DNA, 20 bp, Homo sapiens
ttaggaaggcagcattccat

SEQ ID NO: 3006026 - DNA, 12 bp, Homo sapiens
ttaggaatactg

SEQ ID NO: 3006027 - DNA, 15 bp, Homo sapiens
ttaggaatactgttt

SEQ ID NO: 3006028 - DNA, 15 bp, Homo sapiens
ttaggaatgagaagt

SEQ ID NO: 3006029 - DNA, 18 bp, Homo sapiens
ttaggagaagttggtctt

SEQ ID NO: 3006030 - DNA, 16 bp, Homo sapiens
ttaggattttcacatt

SEQ ID NO: 3006031 - DNA, 21 bp, Homo sapiens
ttaggcacccctttccccagc

SEQ ID NO: 3006032 - DNA, 15 bp, Homo sapiens
ttaggcagactcttt

SEQ ID NO: 3006033 - DNA, 16 bp, Homo sapiens
ttaggccttcctctct

SEQ ID NO: 3006034 - DNA, 14 bp, Homo sapiens
ttaggcgggagctc

SEQ ID NO: 3006035 - DNA, 18 bp, Homo sapiens
ttaggctggtggcccagg

SEQ ID NO: 3006036 - DNA, 19 bp, Homo sapiens
ttaggctggtggcccagga

SEQ ID NO: 3006037 - DNA, 15 bp, Homo sapiens
ttaggggaactgggt

SEQ ID NO: 3006038 - DNA, 17 bp, Homo sapiens
ttaggggatggggagga

SEQ ID NO: 3006039 - DNA, 15 bp, Homo sapiens
ttagggtgcagccac

SEQ ID NO: 3006040 - DNA, 18 bp, Homo sapiens
ttaggtgcaatttcaagg

SEQ ID NO: 3006041 - DNA, 14 bp, Homo sapiens
ttaggttataagaa

SEQ ID NO: 3006042 - DNA, 16 bp, Homo sapiens
ttaggttataagaaac

SEQ ID NO: 3006043 - DNA, 12 bp, Homo sapiens
ttaggttctaaa

SEQ ID NO: 3006044 - DNA, 19 bp, Homo sapiens
ttaggttctaaagttctaa

SEQ ID NO: 3006045 - DNA, 20 bp, Homo sapiens
ttaggttctaaagttctaag

SEQ ID NO: 3006046 - DNA, 14 bp, Homo sapiens
ttaggttcttaaaa

SEQ ID NO: 3006047 - DNA, 16 bp, Homo sapiens
ttaggtttcaggaagt

SEQ ID NO: 3006048 - DNA, 20 bp, Homo sapiens
ttaggtttgctaaatactgt

SEQ ID NO: 3006049 - DNA, 17 bp, Homo sapiens
ttagtaaaaaatcaatt

SEQ ID NO: 3006050 - DNA, 22 bp, Homo sapiens
ttagtaaaaaatcaattaacca

SEQ ID NO: 3006051 - DNA, 13 bp, Homo sapiens
ttagtaaaaacat

SEQ ID NO: 3006052 - DNA, 14 bp, Homo sapiens
ttagtaaagttttg

SEQ ID NO: 3006053 - DNA, 19 bp, Homo sapiens
ttagtaactttttatgtaa

SEQ ID NO: 3006054 - DNA, 18 bp, Homo sapiens
ttagtaagaaatttgcag

SEQ ID NO: 3006055 - DNA, 14 bp, Homo sapiens
ttagtaatggtgct

SEQ ID NO: 3006056 - DNA, 20 bp, Homo sapiens
ttagtatttatttatgtact

SEQ ID NO: 3006057 - DNA, 22 bp, Homo sapiens
ttagtcactttttttttccaaa

SEQ ID NO: 3006058 - DNA, 13 bp, Homo sapiens
ttagtcattatta

SEQ ID NO: 3006059 - DNA, 22 bp, Homo sapiens
ttagtctactcttaagccatct

SEQ ID NO: 3006060 - DNA, 19 bp, Homo sapiens
ttagtgaattaaatttagt

SEQ ID NO: 3006061 - DNA, 23 bp, Homo sapiens
ttagtgatgtccttaaaatgtgg

SEQ ID NO: 3006062 - DNA, 12 bp, Homo sapiens
ttagtgccaggc

SEQ ID NO: 3006063 - DNA, 13 bp, Homo sapiens
ttagtggcaccgc

SEQ ID NO: 3006064 - DNA, 19 bp, Homo sapiens
ttagtggtttatcagcaaa

SEQ ID NO: 3006065 - DNA, 13 bp, Homo sapiens
ttagtgtattttc

SEQ ID NO: 3006066 - DNA, 17 bp, Homo sapiens
ttagtgtgtgtgcagag

SEQ ID NO: 3006067 - DNA, 12 bp, Homo sapiens
ttagtgtttctg

SEQ ID NO: 3006068 - DNA, 18 bp, Homo sapiens
ttagtgtttctgtgcatg

SEQ ID NO: 3006069 - DNA, 13 bp, Homo sapiens
ttagttaataaaa

SEQ ID NO: 3006070 - DNA, 18 bp, Homo sapiens
ttagttatttaagaagaa

SEQ ID NO: 3006071 - DNA, 15 bp, Homo sapiens
ttagttatttctgcc

SEQ ID NO: 3006072 - DNA, 16 bp, Homo sapiens
ttagttccaacaaaga

SEQ ID NO: 3006073 - DNA, 14 bp, Homo sapiens
tgaagaatgggaaa

SEQ ID NO: 3006074 - DNA, 18 bp, Homo sapiens
tgaagaattgccaatctt

SEQ ID NO: 3006075 - DNA, 22 bp, Homo sapiens
tgaagacagagcaaagcgccca

SEQ ID NO: 3006076 - DNA, 12 bp, Homo sapiens
tgaagacataaa

SEQ ID NO: 3006077 - DNA, 20 bp, Homo sapiens
tgaagacattttttgctata

SEQ ID NO: 3006078 - DNA, 18 bp, Homo sapiens
tgaagactggaagctaat

SEQ ID NO: 3006079 - DNA, 20 bp, Homo sapiens
tgaagagatgagcagtgagt

SEQ ID NO: 3006080 - DNA, 19 bp, Homo sapiens
tgaagagtgggtttcacaa

SEQ ID NO: 3006081 - DNA, 14 bp, Homo sapiens
tgaagatctgattt

SEQ ID NO: 3006082 - DNA, 16 bp, Homo sapiens
tgaagatctttatatt

SEQ ID NO: 3006083 - DNA, 17 bp, Homo sapiens
tgaagatggcatcctgt

SEQ ID NO: 3006084 - DNA, 21 bp, Homo sapiens
tgaagatggcatcctgtgaag

SEQ ID NO: 3006085 - DNA, 16 bp, Homo sapiens
tgaagatgttgagaaa

SEQ ID NO: 3006086 - DNA, 21 bp, Homo sapiens
tgaagatttatttttaatatg

SEQ ID NO: 3006087 - DNA, 22 bp, Homo sapiens
tgaagatttatttttaatatgt

SEQ ID NO: 3006088 - DNA, 14 bp, Homo sapiens
tgaagcaaatcaga

SEQ ID NO: 3006089 - DNA, 18 bp, Homo sapiens
tgaagcaaatcagaaact

SEQ ID NO: 3006090 - DNA, 13 bp, Homo sapiens
tgaagcaagctgt

SEQ ID NO: 3006091 - DNA, 22 bp, Homo sapiens
tgaagcaagctgtgttacttga

SEQ ID NO: 3006092 - DNA, 21 bp, Homo sapiens
tgaagcagaggcctttattgt

SEQ ID NO: 3006093 - DNA, 18 bp, Homo sapiens
tgaagcagctctgccttc

SEQ ID NO: 3006094 - DNA, 19 bp, Homo sapiens
tgaagcaggttcccaagct

SEQ ID NO: 3006095 - DNA, 17 bp, Homo sapiens
tgaagcagtcttgctct

SEQ ID NO: 3006096 - DNA, 23 bp, Homo sapiens
tgaagcataatttgtttaaaatt

SEQ ID NO: 3006097 - DNA, 23 bp, Homo sapiens
tgaagcatttcaaagccctgcct

SEQ ID NO: 3006098 - DNA, 19 bp, Homo sapiens
tgaagccacagcccaggcc

SEQ ID NO: 3006099 - DNA, 22 bp, Homo sapiens
tgaagccacagcccaggcctcc

SEQ ID NO: 3006100 - DNA, 15 bp, Homo sapiens
tgaagccctcccagg

SEQ ID NO: 3006101 - DNA, 13 bp, Homo sapiens
tgaagcctttctt

SEQ ID NO: 3006102 - DNA, 23 bp, Homo sapiens
tgaagcgaacatcttcatataaa

SEQ ID NO: 3006103 - DNA, 15 bp, Homo sapiens
tgaagcggtcagact

SEQ ID NO: 3006104 - DNA, 17 bp, Homo sapiens
tgaagcggtcagactgg

SEQ ID NO: 3006105 - DNA, 14 bp, Homo sapiens
tgaagctactgtgt

SEQ ID NO: 3006106 - DNA, 12 bp, Homo sapiens
tgaagctgctgt

SEQ ID NO: 3006107 - DNA, 16 bp, Homo sapiens
tgaagcttatgtttct

SEQ ID NO: 3006108 - DNA, 15 bp, Homo sapiens
tgaagcttgtgtatc

SEQ ID NO: 3006109 - DNA, 21 bp, Homo sapiens
tgaaggaaatgagtggccagc

SEQ ID NO: 3006110 - DNA, 11 bp, Homo sapiens
tgaaggagccc

SEQ ID NO: 3006111 - DNA, 17 bp, Homo sapiens
tgaaggcaaaattgcaa

SEQ ID NO: 3006112 - DNA, 11 bp, Homo sapiens
tgaaggcctgg

SEQ ID NO: 3006113 - DNA, 13 bp, Homo sapiens
tgaaggcttctct

SEQ ID NO: 3006114 - DNA, 19 bp, Homo sapiens
tgaaggcttctctctgtgg

SEQ ID NO: 3006115 - DNA, 14 bp, Homo sapiens
tgaagggccagagc

SEQ ID NO: 3006116 - DNA, 15 bp, Homo sapiens
tgaagggccagagcc

SEQ ID NO: 3006117 - DNA, 21 bp, Homo sapiens
tgaaggtaaaattgaaaggca

SEQ ID NO: 3006118 - DNA, 16 bp, Homo sapiens
tgaaggtcccctggca

SEQ ID NO: 3006119 - DNA, 23 bp, Homo sapiens
tgaaggtctgtcataggactctg

SEQ ID NO: 3006120 - DNA, 19 bp, Homo sapiens
tgaaggtgctgacggccag

SEQ ID NO: 3006121 - DNA, 16 bp, Homo sapiens
tgaaggtgtgctacag

SEQ ID NO: 3006122 - DNA, 16 bp, Homo sapiens
tgaaggttaaaggaaa

SEQ ID NO: 3006123 - DNA, 21 bp, Homo sapiens
tgaagtaactataacaaaaaa

SEQ ID NO: 3006124 - DNA, 14 bp, Homo sapiens
tgaagtccaggact

SEQ ID NO: 3006125 - DNA, 23 bp, Homo sapiens
tgaagtgagctgagattgcacca

SEQ ID NO: 3006126 - DNA, 18 bp, Homo sapiens
tgaagtgaggacaaaatc

SEQ ID NO: 3006127 - DNA, 14 bp, Homo sapiens
tgaagtggcctctt

SEQ ID NO: 3006128 - DNA, 17 bp, Homo sapiens
tgaagtggcctcttgga

SEQ ID NO: 3006129 - DNA, 18 bp, Homo sapiens
tgaagtgtgtccatcctg

SEQ ID NO: 3006130 - DNA, 18 bp, Homo sapiens
tgaagtgtgtttccttca

SEQ ID NO: 3006131 - DNA, 17 bp, Homo sapiens
tgaagttacatgcataa

SEQ ID NO: 3006132 - DNA, 23 bp, Homo sapiens
tgaagttacatgcataaaagggt

SEQ ID NO: 3006133 - DNA, 15 bp, Homo sapiens
tgaagttactttctt

SEQ ID NO: 3006134 - DNA, 16 bp, Homo sapiens
tgaagttcaccattaa

SEQ ID NO: 3006135 - DNA, 13 bp, Homo sapiens
tgaagttgggaaa

SEQ ID NO: 3006136 - DNA, 14 bp, Homo sapiens
tgaagtttttgaaa

SEQ ID NO: 3006137 - DNA, 15 bp, Homo sapiens
tgaagtttttgaaat

SEQ ID NO: 3006138 - DNA, 16 bp, Homo sapiens
tgaagtttttgaaata

SEQ ID NO: 3006139 - DNA, 17 bp, Homo sapiens
tgaagtttttgaaatac

SEQ ID NO: 3006140 - DNA, 19 bp, Homo sapiens
tgaagtttttgaaatacct

SEQ ID NO: 3006141 - DNA, 13 bp, Homo sapiens
tgaataaaaagaa

SEQ ID NO: 3006142 - DNA, 16 bp, Homo sapiens
tgaataaaaaggaact

SEQ ID NO: 3006143 - DNA, 13 bp, Homo sapiens
tgaataaaccaag

SEQ ID NO: 3006144 - DNA, 11 bp, Homo sapiens
tgaataaagaa

SEQ ID NO: 3006145 - DNA, 17 bp, Homo sapiens
tgaataaagaatacttg

SEQ ID NO: 3006146 - DNA, 13 bp, Homo sapiens
tgaataaagagcc

SEQ ID NO: 3006147 - DNA, 21 bp, Homo sapiens
tgaataaagggaacatgcagc

SEQ ID NO: 3006148 - DNA, 21 bp, Homo sapiens
tgaataaatacccattgaact

SEQ ID NO: 3006149 - DNA, 19 bp, Homo sapiens
tgaataaattctataggaa

SEQ ID NO: 3006150 - DNA, 21 bp, Homo sapiens
tgaataagtaaagaattactt

SEQ ID NO: 3006151 - DNA, 18 bp, Homo sapiens
tgaataatggtaccagat

SEQ ID NO: 3006152 - DNA, 14 bp, Homo sapiens
tgaatacagcagca

SEQ ID NO: 3006153 - DNA, 18 bp, Homo sapiens
tgaatacagcagcaagaa

SEQ ID NO: 3006154 - DNA, 15 bp, Homo sapiens
tgaatactcttccca

SEQ ID NO: 3006155 - DNA, 11 bp, Homo sapiens
tgaatagcttg

SEQ ID NO: 3006156 - DNA, 15 bp, Homo sapiens
tgaatagcttgtttc

SEQ ID NO: 3006157 - DNA, 19 bp, Homo sapiens
tgaataggaaataaaatta

SEQ ID NO: 3006158 - DNA, 22 bp, Homo sapiens
tgaatatatttaagcaacatct

SEQ ID NO: 3006159 - DNA, 23 bp, Homo sapiens
tgaatatatttaagcaacatctt

SEQ ID NO: 3006160 - DNA, 21 bp, Homo sapiens
tgaatatggacagttagcatt

SEQ ID NO: 3006161 - DNA, 14 bp, Homo sapiens
tgaatatttgtaaa

SEQ ID NO: 3006162 - DNA, 15 bp, Homo sapiens
tgaatatttgtaaaa

SEQ ID NO: 3006163 - DNA, 13 bp, Homo sapiens
tgaatcaataata

SEQ ID NO: 3006164 - DNA, 15 bp, Homo sapiens
tgaatcaataatata

SEQ ID NO: 3006165 - DNA, 20 bp, Homo sapiens
tgaatcaataatatattttc

SEQ ID NO: 3006166 - DNA, 19 bp, Homo sapiens
tgaatcactgtttttagac

SEQ ID NO: 3006167 - DNA, 13 bp, Homo sapiens
tgaatcagaacag

SEQ ID NO: 3006168 - DNA, 21 bp, Homo sapiens
tgaatcagaacagatgctgag

SEQ ID NO: 3006169 - DNA, 21 bp, Homo sapiens
tgaatcagaccctaccccacc

SEQ ID NO: 3006170 - DNA, 20 bp, Homo sapiens
tgaatcagtttccaattatt

SEQ ID NO: 3006171 - DNA, 22 bp, Homo sapiens
tgaatcagtttccaattatttg

SEQ ID NO: 3006172 - DNA, 14 bp, Homo sapiens
tgaatcatgtagta

SEQ ID NO: 3006173 - DNA, 18 bp, Homo sapiens
tgaatccaaatctgtcct

SEQ ID NO: 3006174 - DNA, 19 bp, Homo sapiens
tgaatccatgggtctggct

SEQ ID NO: 3006175 - DNA, 10 bp, Homo sapiens
tgaatcctac

SEQ ID NO: 3006176 - DNA, 15 bp, Homo sapiens
tgaatcgcttctctt

SEQ ID NO: 3006177 - DNA, 20 bp, Homo sapiens
tgaatctaacagtgacttca

SEQ ID NO: 3006178 - DNA, 21 bp, Homo sapiens
tgcctgggtaggccccacaag

SEQ ID NO: 3006179 - DNA, 19 bp, Homo sapiens
tgcctgggtggggctgctc

SEQ ID NO: 3006180 - DNA, 21 bp, Homo sapiens
tgcctgggtggggctgctcct

SEQ ID NO: 3006181 - DNA, 13 bp, Homo sapiens
tgcctgtacagaa

SEQ ID NO: 3006182 - DNA, 16 bp, Homo sapiens
tgcctgtagagccagc

SEQ ID NO: 3006183 - DNA, 20 bp, Homo sapiens
tgcctgtagcccactctgct

SEQ ID NO: 3006184 - DNA, 20 bp, Homo sapiens
tgcctgtagccccagtgaca

SEQ ID NO: 3006185 - DNA, 21 bp, Homo sapiens
tgcctgtagccccagtgacag

SEQ ID NO: 3006186 - DNA, 19 bp, Homo sapiens
tgcctgtcctagtctcctt

SEQ ID NO: 3006187 - DNA, 21 bp, Homo sapiens
tgcctgtctgtccaacccctc

SEQ ID NO: 3006188 - DNA, 18 bp, Homo sapiens
tgcctgtctgttacactg

SEQ ID NO: 3006189 - DNA, 11 bp, Homo sapiens
tgcctgtggct

SEQ ID NO: 3006190 - DNA, 13 bp, Homo sapiens
tgcctgtggctgc

SEQ ID NO: 3006191 - DNA, 22 bp, Homo sapiens
tgcctgttcagttacagaaagt

SEQ ID NO: 3006192 - DNA, 21 bp, Homo sapiens
tgccttacctcctgcccagga

SEQ ID NO: 3006193 - DNA, 22 bp, Homo sapiens
tgccttagcaatgggggcctcc

SEQ ID NO: 3006194 - DNA, 17 bp, Homo sapiens
tgccttagcttcaggaa

SEQ ID NO: 3006195 - DNA, 18 bp, Homo sapiens
tgccttattacataactg

SEQ ID NO: 3006196 - DNA, 21 bp, Homo sapiens
tgccttattagagtgtctttc

SEQ ID NO: 3006197 - DNA, 17 bp, Homo sapiens
tgccttcattacctttt

SEQ ID NO: 3006198 - DNA, 19 bp, Homo sapiens
tgccttcattacctttttt

SEQ ID NO: 3006199 - DNA, 12 bp, Homo sapiens
tgccttcccctt

SEQ ID NO: 3006200 - DNA, 20 bp, Homo sapiens
tgccttccccttgaacctca

SEQ ID NO: 3006201 - DNA, 22 bp, Homo sapiens
tgccttccccttgaacctcatt

SEQ ID NO: 3006202 - DNA, 16 bp, Homo sapiens
tgccttcgtttatatt

SEQ ID NO: 3006203 - DNA, 22 bp, Homo sapiens
tgccttctcaccagctgcaaag

SEQ ID NO: 3006204 - DNA, 13 bp, Homo sapiens
tgccttcttcagg

SEQ ID NO: 3006205 - DNA, 19 bp, Homo sapiens
tgccttcttcagggcctgg

SEQ ID NO: 3006206 - DNA, 12 bp, Homo sapiens
tgccttgaataa

SEQ ID NO: 3006207 - DNA, 12 bp, Homo sapiens
tgccttgcattt

SEQ ID NO: 3006208 - DNA, 15 bp, Homo sapiens
tgccttgcatttgta

SEQ ID NO: 3006209 - DNA, 13 bp, Homo sapiens
tgccttgccttta

SEQ ID NO: 3006210 - DNA, 19 bp, Homo sapiens
tgccttggctcagacatgt

SEQ ID NO: 3006211 - DNA, 15 bp, Homo sapiens
tgccttgtcacgcca

SEQ ID NO: 3006212 - DNA, 14 bp, Homo sapiens
tgccttgtttggat

SEQ ID NO: 3006213 - DNA, 20 bp, Homo sapiens
tgcctttagcccctcccaag

SEQ ID NO: 3006214 - DNA, 18 bp, Homo sapiens
tgcctttatctcagccat

SEQ ID NO: 3006215 - DNA, 15 bp, Homo sapiens
tgcctttcctatcac

SEQ ID NO: 3006216 - DNA, 15 bp, Homo sapiens
tgccttttgcagaag

SEQ ID NO: 3006217 - DNA, 17 bp, Homo sapiens
tgccttttgcagaagag

SEQ ID NO: 3006218 - DNA, 13 bp, Homo sapiens
tgcctttttattt

SEQ ID NO: 3006219 - DNA, 21 bp, Homo sapiens
tgcctttttatttatatgtac

SEQ ID NO: 3006220 - DNA, 13 bp, Homo sapiens
tgcgaccctgggg

SEQ ID NO: 3006221 - DNA, 15 bp, Homo sapiens
tgcgaccctgggggc

SEQ ID NO: 3006222 - DNA, 15 bp, Homo sapiens
tgcgagtatgtgttt

SEQ ID NO: 3006223 - DNA, 22 bp, Homo sapiens
tgcgagtatgtgtttgtgtgtg

SEQ ID NO: 3006224 - DNA, 13 bp, Homo sapiens
tgcgatagagtct

SEQ ID NO: 3006225 - DNA, 16 bp, Homo sapiens
tgcgattttatctgtt

SEQ ID NO: 3006226 - DNA, 20 bp, Homo sapiens
tgcgcagccccatctgtgca

SEQ ID NO: 3006227 - DNA, 22 bp, Homo sapiens
tgctggcccagggcccagagcc

SEQ ID NO: 3006228 - DNA, 20 bp, Homo sapiens
tgctggcctcttggcacctg

SEQ ID NO: 3006229 - DNA, 14 bp, Homo sapiens
tgctggcctgctct

SEQ ID NO: 3006230 - DNA, 14 bp, Homo sapiens
tgctggcctggcag

SEQ ID NO: 3006231 - DNA, 15 bp, Homo sapiens
tgctggcctggcagg

SEQ ID NO: 3006232 - DNA, 17 bp, Homo sapiens
tgctggcctggcagggg

SEQ ID NO: 3006233 - DNA, 21 bp, Homo sapiens
tgctggccttggtatgtgcca

SEQ ID NO: 3006234 - DNA, 13 bp, Homo sapiens
tgctggcgacact

SEQ ID NO: 3006235 - DNA, 17 bp, Homo sapiens
tgctggcgacactcagg

SEQ ID NO: 3006236 - DNA, 23 bp, Homo sapiens
tgctggcgagtgaatgccagtgt

SEQ ID NO: 3006237 - DNA, 21 bp, Homo sapiens
tgctggctggtgcctgagccc

SEQ ID NO: 3006238 - DNA, 16 bp, Homo sapiens
tgctgggatggtgggc

SEQ ID NO: 3006239 - DNA, 19 bp, Homo sapiens
tgctgggatggtgggcttc

SEQ ID NO: 3006240 - DNA, 20 bp, Homo sapiens
tgctgggatggtgggcttca

SEQ ID NO: 3006241 - DNA, 17 bp, Homo sapiens
tgctgggctctccacct

SEQ ID NO: 3006242 - DNA, 24 bp, Homo sapiens
tgctgggctgacggtgcagtctgg

SEQ ID NO: 3006243 - DNA, 17 bp, Homo sapiens
tgctggggcctcagacg

SEQ ID NO: 3006244 - DNA, 18 bp, Homo sapiens
tgctggggcctcagacga

SEQ ID NO: 3006245 - DNA, 13 bp, Homo sapiens
tgctggggctggt

SEQ ID NO: 3006246 - DNA, 19 bp, Homo sapiens
tgctggggctggtgaggcc

SEQ ID NO: 3006247 - DNA, 20 bp, Homo sapiens
tgctgggggcaactggccat

SEQ ID NO: 3006248 - DNA, 17 bp, Homo sapiens
tgctgggggctcccctt

SEQ ID NO: 3006249 - DNA, 14 bp, Homo sapiens
tgctggtagctgag

SEQ ID NO: 3006250 - DNA, 16 bp, Homo sapiens
tgctggtagctgaggg

SEQ ID NO: 3006251 - DNA, 19 bp, Homo sapiens
tgctggtagctgaggggac

SEQ ID NO: 3006252 - DNA, 17 bp, Homo sapiens
tgctgtaagatgtctgt

SEQ ID NO: 3006253 - DNA, 13 bp, Homo sapiens
tgctgtagagact

SEQ ID NO: 3006254 - DNA, 14 bp, Homo sapiens
tgctgtagagactt

SEQ ID NO: 3006255 - DNA, 16 bp, Homo sapiens
tgctgtagagacttcc

SEQ ID NO: 3006256 - DNA, 18 bp, Homo sapiens
tgctgtaggatctaaggc

SEQ ID NO: 3006257 - DNA, 20 bp, Homo sapiens
tgctgtatgaatattttata

SEQ ID NO: 3006258 - DNA, 22 bp, Homo sapiens
tgctgtatgctgatcatcgcca

SEQ ID NO: 3006259 - DNA, 15 bp, Homo sapiens
tgctgtcacctctcc

SEQ ID NO: 3006260 - DNA, 21 bp, Homo sapiens
tgctgtcacctctcccacggg

SEQ ID NO: 3006261 - DNA, 20 bp, Homo sapiens
tgctgtccaaaccagcaaac

SEQ ID NO: 3006262 - DNA, 15 bp, Homo sapiens
tgctgtcctggtggc

SEQ ID NO: 3006263 - DNA, 22 bp, Homo sapiens
tgctgtctagccttagtcaata

SEQ ID NO: 3006264 - DNA, 10 bp, Homo sapiens
tgctgtctct

SEQ ID NO: 3006265 - DNA, 19 bp, Homo sapiens
tgctgtctcttaaatctct

SEQ ID NO: 3006266 - DNA, 13 bp, Homo sapiens
tgctgtctgcagc

SEQ ID NO: 3006267 - DNA, 14 bp, Homo sapiens
tgctgtctttgtgg

SEQ ID NO: 3006268 - DNA, 16 bp, Homo sapiens
tgctgtgactgtgtcc

SEQ ID NO: 3006269 - DNA, 15 bp, Homo sapiens
tgctgtgccaggagg

SEQ ID NO: 3006270 - DNA, 21 bp, Homo sapiens
tgctgtgcgtggaaaaagacg

SEQ ID NO: 3006271 - DNA, 16 bp, Homo sapiens
tgctgtgctacgtgtg

SEQ ID NO: 3006272 - DNA, 17 bp, Homo sapiens
tgctgtgctacgtgtga

SEQ ID NO: 3006273 - DNA, 15 bp, Homo sapiens
tgctgtgctgggagg

SEQ ID NO: 3006274 - DNA, 18 bp, Homo sapiens
tgctgtgctgtgctatgg

SEQ ID NO: 3006275 - DNA, 16 bp, Homo sapiens
tgctgtgctgtgttta

SEQ ID NO: 3006276 - DNA, 19 bp, Homo sapiens
tgctgtgcttttgatctct

SEQ ID NO: 3006277 - DNA, 15 bp, Homo sapiens
tgctgtgtaaagtta

SEQ ID NO: 3006278 - DNA, 17 bp, Homo sapiens
tgctgtgtaaagttagt

SEQ ID NO: 3006279 - DNA, 21 bp, Homo sapiens
tgctgtgtgtcccaggcaggg

SEQ ID NO: 3006280 - DNA, 23 bp, Homo sapiens
tgctgtgtgtcccaggcagggag

SEQ ID NO: 3006281 - DNA, 22 bp, Homo sapiens
tgctgttctagcacttcatctg

SEQ ID NO: 3006282 - DNA, 22 bp, Homo sapiens
tgctgttgaaagcaaaaatgct

SEQ ID NO: 3006283 - DNA, 22 bp, Homo sapiens
tgctgttgaactttttaaagaa

SEQ ID NO: 3006284 - DNA, 21 bp, Homo sapiens
tgctgttgacatatttaatgt

SEQ ID NO: 3006285 - DNA, 12 bp, Homo sapiens
tgctgttgattg

SEQ ID NO: 3006286 - DNA, 14 bp, Homo sapiens
tgctgtttcctttt

SEQ ID NO: 3006287 - DNA, 13 bp, Homo sapiens
tgctgtttgacaa

SEQ ID NO: 3006288 - DNA, 14 bp, Homo sapiens
tgctgttttcctcc

SEQ ID NO: 3006289 - DNA, 15 bp, Homo sapiens
tgctgttttcctccc

SEQ ID NO: 3006290 - DNA, 16 bp, Homo sapiens
tgctgttttcctccct

SEQ ID NO: 3006291 - DNA, 17 bp, Homo sapiens
tgctgttttcctccctt

SEQ ID NO: 3006292 - DNA, 19 bp, Homo sapiens
tgcttaagggagtttaata

SEQ ID NO: 3006293 - DNA, 17 bp, Homo sapiens
tgcttaattcaaataat

SEQ ID NO: 3006294 - DNA, 14 bp, Homo sapiens
tgcttacaatcttt

SEQ ID NO: 3006295 - DNA, 13 bp, Homo sapiens
tgcttacaatttt

SEQ ID NO: 3006296 - DNA, 14 bp, Homo sapiens
tgcttacaattttt

SEQ ID NO: 3006297 - DNA, 21 bp, Homo sapiens
tgcttaccttgttttgccagt

SEQ ID NO: 3006298 - DNA, 13 bp, Homo sapiens
tgcttagaaccct

SEQ ID NO: 3006299 - DNA, 20 bp, Homo sapiens
tgcttagaacccttctgctt

SEQ ID NO: 3006300 - DNA, 20 bp, Homo sapiens
tgcttagtccaattccttgc

SEQ ID NO: 3006301 - DNA, 16 bp, Homo sapiens
tgcttataagagagag

SEQ ID NO: 3006302 - DNA, 22 bp, Homo sapiens
tgcttatgatgggctccccagg

SEQ ID NO: 3006303 - DNA, 14 bp, Homo sapiens
tgcttatggtacca

SEQ ID NO: 3006304 - DNA, 19 bp, Homo sapiens
tgcttattacatttaaatc

SEQ ID NO: 3006305 - DNA, 22 bp, Homo sapiens
tgcttcaatagttcaaggaact

SEQ ID NO: 3006306 - DNA, 15 bp, Homo sapiens
tgcttcaattaaaat

SEQ ID NO: 3006307 - DNA, 16 bp, Homo sapiens
tgcttcaattaaaatt

SEQ ID NO: 3006308 - DNA, 21 bp, Homo sapiens
tgcttcactttccttctctgt

SEQ ID NO: 3006309 - DNA, 20 bp, Homo sapiens
tgcttcagatgtggagccag

SEQ ID NO: 3006310 - DNA, 16 bp, Homo sapiens
tgcttcatacagggat

SEQ ID NO: 3006311 - DNA, 13 bp, Homo sapiens
tgcttcatatctc

SEQ ID NO: 3006312 - DNA, 15 bp, Homo sapiens
tgcttcatatctctc

SEQ ID NO: 3006313 - DNA, 17 bp, Homo sapiens
tgcttcatatctctccc

SEQ ID NO: 3006314 - DNA, 22 bp, Homo sapiens
tgcttcatatctctcccttctt

SEQ ID NO: 3006315 - DNA, 19 bp, Homo sapiens
tgcttccaagaccatttgt

SEQ ID NO: 3006316 - DNA, 19 bp, Homo sapiens
tgcttccatggcttcctga

SEQ ID NO: 3006317 - DNA, 18 bp, Homo sapiens
tgcttccccttttgccaa

SEQ ID NO: 3006318 - DNA, 16 bp, Homo sapiens
tgcttcctaacttatt

SEQ ID NO: 3006319 - DNA, 19 bp, Homo sapiens
tgcttcctgttacctgtct

SEQ ID NO: 3006320 - DNA, 15 bp, Homo sapiens
tgcttcgggcccttc

SEQ ID NO: 3006321 - DNA, 18 bp, Homo sapiens
tgcttctaaatgcccagt

SEQ ID NO: 3006322 - DNA, 14 bp, Homo sapiens
tgcttctacatgat

SEQ ID NO: 3006323 - DNA, 23 bp, Homo sapiens
tgcttctacggccatgagactga

SEQ ID NO: 3006324 - DNA, 18 bp, Homo sapiens
tgcttctagttctgccag

SEQ ID NO: 3006325 - DNA, 20 bp, Homo sapiens
tgcttctcggggtccagtgc

SEQ ID NO: 3006326 - DNA, 17 bp, Homo sapiens
tgcttctctcatagtgt

SEQ ID NO: 3006327 - DNA, 17 bp, Homo sapiens
tgcttcttactgataat

SEQ ID NO: 3006328 - DNA, 15 bp, Homo sapiens
tgcttcttcagctga

SEQ ID NO: 3006329 - DNA, 12 bp, Homo sapiens
tgcttcttgctt

SEQ ID NO: 3006330 - DNA, 13 bp, Homo sapiens
tgcttcttgcttc

SEQ ID NO: 3006331 - DNA, 14 bp, Homo sapiens
tgcttcttgtaata

SEQ ID NO: 3006332 - DNA, 15 bp, Homo sapiens
tgcttcttgtaatat

SEQ ID NO: 3006333 - DNA, 15 bp, Homo sapiens
tggaattattttaaa

SEQ ID NO: 3006334 - DNA, 17 bp, Homo sapiens
tggaattattttaaaag

SEQ ID NO: 3006335 - DNA, 19 bp, Homo sapiens
tggaattattttaaaagat

SEQ ID NO: 3006336 - DNA, 12 bp, Homo sapiens
tggaattgattt

SEQ ID NO: 3006337 - DNA, 19 bp, Homo sapiens
tggaattgatttgcattga

SEQ ID NO: 3006338 - DNA, 22 bp, Homo sapiens
tggaattgggtggggggcttca

SEQ ID NO: 3006339 - DNA, 16 bp, Homo sapiens
tggaattggtgtatat

SEQ ID NO: 3006340 - DNA, 17 bp, Homo sapiens
tggaattggtgtatatc

SEQ ID NO: 3006341 - DNA, 20 bp, Homo sapiens
tggacaatttccaagaatga

SEQ ID NO: 3006342 - DNA, 15 bp, Homo sapiens
tggacacaggcctgc

SEQ ID NO: 3006343 - DNA, 15 bp, Homo sapiens
tggacactgtgacaa

SEQ ID NO: 3006344 - DNA, 13 bp, Homo sapiens
tggacacttcttt

SEQ ID NO: 3006345 - DNA, 23 bp, Homo sapiens
tggacacttttcacctccttcaa

SEQ ID NO: 3006346 - DNA, 17 bp, Homo sapiens
tggacagaagcagctct

SEQ ID NO: 3006347 - DNA, 15 bp, Homo sapiens
tggccaagaaaattg

SEQ ID NO: 3006348 - DNA, 15 bp, Homo sapiens
tggccaaggagctgc

SEQ ID NO: 3006349 - DNA, 16 bp, Homo sapiens
tggccaaggagctgct

SEQ ID NO: 3006350 - DNA, 14 bp, Homo sapiens
tggccacaaattct

SEQ ID NO: 3006351 - DNA, 19 bp, Homo sapiens
tggccacactgtgacacac

SEQ ID NO: 3006352 - DNA, 22 bp, Homo sapiens
tggccacagcccatccatagta

SEQ ID NO: 3006353 - DNA, 18 bp, Homo sapiens
tggccacagcgtgctggc

SEQ ID NO: 3006354 - DNA, 11 bp, Homo sapiens
tggccaccagt

SEQ ID NO: 3006355 - DNA, 21 bp, Homo sapiens
tggccacgttcagggaggggc

SEQ ID NO: 3006356 - DNA, 17 bp, Homo sapiens
tggccacttctgtccat

SEQ ID NO: 3006357 - DNA, 13 bp, Homo sapiens
tggccagacacag

SEQ ID NO: 3006358 - DNA, 18 bp, Homo sapiens
tggccagacacaggccct

SEQ ID NO: 3006359 - DNA, 22 bp, Homo sapiens
tggccagatgcggggacaggct

SEQ ID NO: 3006360 - DNA, 14 bp, Homo sapiens
tggccagccgctct

SEQ ID NO: 3006361 - DNA, 23 bp, Homo sapiens
tggccagccgctctcctgccaca

SEQ ID NO: 3006362 - DNA, 21 bp, Homo sapiens
tggccagcgccagggcccagg

SEQ ID NO: 3006363 - DNA, 13 bp, Homo sapiens
tggccaggaagct

SEQ ID NO: 3006364 - DNA, 15 bp, Homo sapiens
tggccaggccctggg

SEQ ID NO: 3006365 - DNA, 22 bp, Homo sapiens
tggccagtcctggtcctggctg

SEQ ID NO: 3006366 - DNA, 17 bp, Homo sapiens
tggccagtctgggtctg

SEQ ID NO: 3006367 - DNA, 16 bp, Homo sapiens
tggccatcactcagcc

SEQ ID NO: 3006368 - DNA, 12 bp, Homo sapiens
tggccatgctgt

SEQ ID NO: 3006369 - DNA, 14 bp, Homo sapiens
tggccatgctgtcc

SEQ ID NO: 3006370 - DNA, 16 bp, Homo sapiens
tggccatgctgtccct

SEQ ID NO: 3006371 - DNA, 17 bp, Homo sapiens
tggccatgctgtccctg

SEQ ID NO: 3006372 - DNA, 24 bp, Homo sapiens
tggccatgctgtccctgcactgtg

SEQ ID NO: 3006373 - DNA, 14 bp, Homo sapiens
tggccatggcctct

SEQ ID NO: 3006374 - DNA, 14 bp, Homo sapiens
tggcccaagactgg

SEQ ID NO: 3006375 - DNA, 18 bp, Homo sapiens
tggcccaagactgggctg

SEQ ID NO: 3006376 - DNA, 20 bp, Homo sapiens
tggcccaagtgaagcatggc

SEQ ID NO: 3006377 - DNA, 22 bp, Homo sapiens
tggcccaagtttctaagggagg

SEQ ID NO: 3006378 - DNA, 21 bp, Homo sapiens
tggcccacccagtccatgctc

SEQ ID NO: 3006379 - DNA, 12 bp, Homo sapiens
tggcccactgct

SEQ ID NO: 3006380 - DNA, 15 bp, Homo sapiens
tggcccaggagctct

SEQ ID NO: 3006381 - DNA, 18 bp, Homo sapiens
tggcccaggagctctgcg

SEQ ID NO: 3006382 - DNA, 13 bp, Homo sapiens
tggcccaggagga

SEQ ID NO: 3006383 - DNA, 20 bp, Homo sapiens
tggcccaggccttgctgact

SEQ ID NO: 3006384 - DNA, 16 bp, Homo sapiens
tggcccagggcccaga

SEQ ID NO: 3006385 - DNA, 18 bp, Homo sapiens
tggcccagggcccagagc

SEQ ID NO: 3006386 - DNA, 22 bp, Homo sapiens
tggcccagggcccagagcccag

SEQ ID NO: 3006387 - DNA, 22 bp, Homo sapiens
tggcccagggggcctggagcat

SEQ ID NO: 3006388 - DNA, 12 bp, Homo sapiens
tggcccaggtgg

SEQ ID NO: 3006389 - DNA, 12 bp, Homo sapiens
tggccccaggac

SEQ ID NO: 3006390 - DNA, 13 bp, Homo sapiens
tggccccagggga

SEQ ID NO: 3006391 - DNA, 23 bp, Homo sapiens
tggccccatgtctctcagaattc

SEQ ID NO: 3006392 - DNA, 16 bp, Homo sapiens
tggccccctcagctct

SEQ ID NO: 3006393 - DNA, 11 bp, Homo sapiens
tggcccctcca

SEQ ID NO: 3006394 - DNA, 19 bp, Homo sapiens
tggcccctccaatcctccc

SEQ ID NO: 3006395 - DNA, 20 bp, Homo sapiens
tggcccctccaatcctcccc

SEQ ID NO: 3006396 - DNA, 20 bp, Homo sapiens
tggcccctttgggccctgca

SEQ ID NO: 3006397 - DNA, 23 bp, Homo sapiens
tggcccctttgggccctgcatgt

SEQ ID NO: 3006398 - DNA, 18 bp, Homo sapiens
tggcccgcggcctgcacc

SEQ ID NO: 3006399 - DNA, 15 bp, Homo sapiens
tggcccgtgacagac

SEQ ID NO: 3006400 - DNA, 23 bp, Homo sapiens
tggcccgtgacagactcctgagg

SEQ ID NO: 3006401 - DNA, 18 bp, Homo sapiens
tggcccgtggcctggcat

SEQ ID NO: 3006402 - DNA, 19 bp, Homo sapiens
tggcccgtggcctggcatc

SEQ ID NO: 3006403 - DNA, 20 bp, Homo sapiens
tggcccgtggcttggcatct

SEQ ID NO: 3006404 - DNA, 21 bp, Homo sapiens
tggccctgactgtcagggagg

SEQ ID NO: 3006405 - DNA, 22 bp, Homo sapiens
tggccctgactgtcagggaggg

SEQ ID NO: 3006406 - DNA, 15 bp, Homo sapiens
tggccctgcaaaagg

SEQ ID NO: 3006407 - DNA, 12 bp, Homo sapiens
tggccctgcccc

SEQ ID NO: 3006408 - DNA, 13 bp, Homo sapiens
tggccctgcccct

SEQ ID NO: 3006409 - DNA, 14 bp, Homo sapiens
tggccctgcccctc

SEQ ID NO: 3006410 - DNA, 18 bp, Homo sapiens
tggccctgcccctccccc

SEQ ID NO: 3006411 - DNA, 17 bp, Homo sapiens
tggccctgctgcccctc

SEQ ID NO: 3006412 - DNA, 16 bp, Homo sapiens
tggccctggcctgctg

SEQ ID NO: 3006413 - DNA, 17 bp, Homo sapiens
tggccctggcctgctgg

SEQ ID NO: 3006414 - DNA, 21 bp, Homo sapiens
tggccctgggcggggcgtggg

SEQ ID NO: 3006415 - DNA, 18 bp, Homo sapiens
tggccctggggtgtgtct

SEQ ID NO: 3006416 - DNA, 21 bp, Homo sapiens
tggccctgtctggaggttcct

SEQ ID NO: 3006417 - DNA, 20 bp, Homo sapiens
tggcccttcctcctccacca

SEQ ID NO: 3006418 - DNA, 21 bp, Homo sapiens
tggcccttcctcctccaccac

SEQ ID NO: 3006419 - DNA, 15 bp, Homo sapiens
tggccgagtccaagc

SEQ ID NO: 3006420 - DNA, 16 bp, Homo sapiens
tggccgcccctgaggc

SEQ ID NO: 3006421 - DNA, 22 bp, Homo sapiens
tggccggagcaaactctgctgt

SEQ ID NO: 3006422 - DNA, 20 bp, Homo sapiens
tggccggccagccagccact

SEQ ID NO: 3006423 - DNA, 23 bp, Homo sapiens
tggccgggaccccgagcctggct

SEQ ID NO: 3006424 - DNA, 14 bp, Homo sapiens
tggccgggcaggcg

SEQ ID NO: 3006425 - DNA, 15 bp, Homo sapiens
tggccgtggctccag

SEQ ID NO: 3006426 - DNA, 14 bp, Homo sapiens
tggccgttatctgg

SEQ ID NO: 3006427 - DNA, 19 bp, Homo sapiens
tggccgttcagcctgtctc

SEQ ID NO: 3006428 - DNA, 21 bp, Homo sapiens
tggcctaaacctcagttatta

SEQ ID NO: 3006429 - DNA, 18 bp, Homo sapiens
tggcctaggggccagggc

SEQ ID NO: 3006430 - DNA, 20 bp, Homo sapiens
tggcctaggggccagggctt

SEQ ID NO: 3006431 - DNA, 15 bp, Homo sapiens
tggcctatctcctag

SEQ ID NO: 3006432 - DNA, 20 bp, Homo sapiens
tggcctatgcacatatggac

SEQ ID NO: 3006433 - DNA, 19 bp, Homo sapiens
tggcctcaagccatcttcc

SEQ ID NO: 3006434 - DNA, 12 bp, Homo sapiens
tggcctcagact

SEQ ID NO: 3006435 - DNA, 17 bp, Homo sapiens
tggcctcagactgcacc

SEQ ID NO: 3006436 - DNA, 22 bp, Homo sapiens
tggcctcagactgcacccagga

SEQ ID NO: 3006437 - DNA, 20 bp, Homo sapiens
tggcctcagggccaggaagg

SEQ ID NO: 3006438 - DNA, 12 bp, Homo sapiens
tggcctccagtc

SEQ ID NO: 3006439 - DNA, 12 bp, Homo sapiens
tggcctccctcc

SEQ ID NO: 3006440 - DNA, 15 bp, Homo sapiens
tggcctccttgcttg

SEQ ID NO: 3006441 - DNA, 16 bp, Homo sapiens
tggcctctctgtacac

SEQ ID NO: 3006442 - DNA, 19 bp, Homo sapiens
tggcctctgcaactgctca

SEQ ID NO: 3006443 - DNA, 14 bp, Homo sapiens
tggcctctgctggt

SEQ ID NO: 3006444 - DNA, 23 bp, Homo sapiens
tggcctctgctggtctctggctc

SEQ ID NO: 3006445 - DNA, 15 bp, Homo sapiens
tggcctcttggcacc

SEQ ID NO: 3006446 - DNA, 20 bp, Homo sapiens
tggcctcttggcacctgcct

SEQ ID NO: 3006447 - DNA, 16 bp, Homo sapiens
tggcctgaacagatgt

SEQ ID NO: 3006448 - DNA, 19 bp, Homo sapiens
tggcctgaacagatgtaaa

SEQ ID NO: 3006449 - DNA, 12 bp, Homo sapiens
tggcctgaggtc

SEQ ID NO: 3006450 - DNA, 16 bp, Homo sapiens
tggcctggaggctcag

SEQ ID NO: 3006451 - DNA, 18 bp, Homo sapiens
tggcctggaggctcagcc

SEQ ID NO: 3006452 - DNA, 16 bp, Homo sapiens
tggcctggcatctgtg

SEQ ID NO: 3006453 - DNA, 17 bp, Homo sapiens
tggcctgggcttggccc

SEQ ID NO: 3006454 - DNA, 15 bp, Homo sapiens
tggcctggtccctgg

SEQ ID NO: 3006455 - DNA, 17 bp, Homo sapiens
tggcctggtccctggtc

SEQ ID NO: 3006456 - DNA, 19 bp, Homo sapiens
tggcctggtccctggtcct

SEQ ID NO: 3006457 - DNA, 19 bp, Homo sapiens
tggcctgtagaatagcctg

SEQ ID NO: 3006458 - DNA, 22 bp, Homo sapiens
tggcctgtgaggggcccctggc

SEQ ID NO: 3006459 - DNA, 22 bp, Homo sapiens
tggccttccacgtcttcctcca

SEQ ID NO: 3006460 - DNA, 13 bp, Homo sapiens
tggccttgcagct

SEQ ID NO: 3006461 - DNA, 22 bp, Homo sapiens
tggccttgctcttctccttgat

SEQ ID NO: 3006462 - DNA, 17 bp, Homo sapiens
tggccttggtatgtgcc

SEQ ID NO: 3006463 - DNA, 22 bp, Homo sapiens
tggccttggtatgtgccaggct

SEQ ID NO: 3006464 - DNA, 23 bp, Homo sapiens
tggccttggtatgtgccaggctt

SEQ ID NO: 3006465 - DNA, 23 bp, Homo sapiens
tggcctttaagcctgcattctta

SEQ ID NO: 3006466 - DNA, 16 bp, Homo sapiens
tggcgacactcagggc

SEQ ID NO: 3006467 - DNA, 20 bp, Homo sapiens
tggcgacactcagggcagct

SEQ ID NO: 3006468 - DNA, 23 bp, Homo sapiens
tggcgacactcagggcagctgcc

SEQ ID NO: 3006469 - DNA, 17 bp, Homo sapiens
tggcgagcccttagcct

SEQ ID NO: 3006470 - DNA, 19 bp, Homo sapiens
tggcgagtgaatgccagtg

SEQ ID NO: 3006471 - DNA, 14 bp, Homo sapiens
tggcgcaagcctgt

SEQ ID NO: 3006472 - DNA, 13 bp, Homo sapiens
tggcgcgcctgcc

SEQ ID NO: 3006473 - DNA, 17 bp, Homo sapiens
tgggagggaggctcagg

SEQ ID NO: 3006474 - DNA, 14 bp, Homo sapiens
tgggagggcagcag

SEQ ID NO: 3006475 - DNA, 15 bp, Homo sapiens
tgggaggggccatgc

SEQ ID NO: 3006476 - DNA, 19 bp, Homo sapiens
tgggagtcattaccacgcc

SEQ ID NO: 3006477 - DNA, 16 bp, Homo sapiens
tgggagtgcagagaaa

SEQ ID NO: 3006478 - DNA, 23 bp, Homo sapiens
tgggatattttgaaatgaacttt

SEQ ID NO: 3006479 - DNA, 14 bp, Homo sapiens
tgggatcatgaaag

SEQ ID NO: 3006480 - DNA, 15 bp, Homo sapiens
tgggatctgtaagga

SEQ ID NO: 3006481 - DNA, 22 bp, Homo sapiens
tgggatctgtaaggaactggaa

SEQ ID NO: 3006482 - DNA, 16 bp, Homo sapiens
tgggatgaaactaaag

SEQ ID NO: 3006483 - DNA, 14 bp, Homo sapiens
tgggatggaggaga

SEQ ID NO: 3006484 - DNA, 16 bp, Homo sapiens
tgggatgggaggccgg

SEQ ID NO: 3006485 - DNA, 19 bp, Homo sapiens
tgggattacagccgtgagc

SEQ ID NO: 3006486 - DNA, 20 bp, Homo sapiens
tgggattacaggcgtgagcc

SEQ ID NO: 3006487 - DNA, 17 bp, Homo sapiens
tgggattcaggaatgtg

SEQ ID NO: 3006488 - DNA, 23 bp, Homo sapiens
tgggattgacagaagcttctgcc

SEQ ID NO: 3006489 - DNA, 21 bp, Homo sapiens
tgggattttaaactagatgac

SEQ ID NO: 3006490 - DNA, 20 bp, Homo sapiens
tgggattttctagtttcctg

SEQ ID NO: 3006491 - DNA, 21 bp, Homo sapiens
tgggcaaagcctagtgaaggc

SEQ ID NO: 3006492 - DNA, 12 bp, Homo sapiens
tgggcaacaaag

SEQ ID NO: 3006493 - DNA, 16 bp, Homo sapiens
tgggcaatatagcaag

SEQ ID NO: 3006494 - DNA, 15 bp, Homo sapiens
tgggcaatttagaaa

SEQ ID NO: 3006495 - DNA, 20 bp, Homo sapiens
tgggcacccaccctgggacc

SEQ ID NO: 3006496 - DNA, 16 bp, Homo sapiens
tgggcacttccctgct

SEQ ID NO: 3006497 - DNA, 23 bp, Homo sapiens
tgggcagaatcctgggcccccag

SEQ ID NO: 3006498 - DNA, 14 bp, Homo sapiens
tgggcagagcccaa

SEQ ID NO: 3006499 - DNA, 14 bp, Homo sapiens
tgggcagagcctgt

SEQ ID NO: 3006500 - DNA, 22 bp, Homo sapiens
tgggcagagcctgtccccgcct

SEQ ID NO: 3006501 - DNA, 13 bp, Homo sapiens
tgggcagcagcat

SEQ ID NO: 3006502 - DNA, 18 bp, Homo sapiens
tgggcagcagcatcccag

SEQ ID NO: 3006503 - DNA, 15 bp, Homo sapiens
tgggcagcccaacag

SEQ ID NO: 3006504 - DNA, 19 bp, Homo sapiens
tgggcagcccaacagcact

SEQ ID NO: 3006505 - DNA, 13 bp, Homo sapiens
tgggcaggaggga

SEQ ID NO: 3006506 - DNA, 15 bp, Homo sapiens
tgggcaggagggagg

SEQ ID NO: 3006507 - DNA, 22 bp, Homo sapiens
tgggcaggagtcaccatgcaag

SEQ ID NO: 3006508 - DNA, 17 bp, Homo sapiens
tgggcaggtgggagctg

SEQ ID NO: 3006509 - DNA, 15 bp, Homo sapiens
tgggcagtgccagcc

SEQ ID NO: 3006510 - DNA, 17 bp, Homo sapiens
tgggcagtgccagccaa

SEQ ID NO: 3006511 - DNA, 15 bp, Homo sapiens
tgggcagttacatgc

SEQ ID NO: 3006512 - DNA, 16 bp, Homo sapiens
tgggcatgtgggcttc

SEQ ID NO: 3006513 - DNA, 13 bp, Homo sapiens
tgggcattgcttt

SEQ ID NO: 3006514 - DNA, 17 bp, Homo sapiens
tgggcattttgacaaca

SEQ ID NO: 3006515 - DNA, 18 bp, Homo sapiens
tgggcattttgacaacat

SEQ ID NO: 3006516 - DNA, 19 bp, Homo sapiens
tgggcattttgacaacatg

SEQ ID NO: 3006517 - DNA, 17 bp, Homo sapiens
tgggccaccggggcaag

SEQ ID NO: 3006518 - DNA, 13 bp, Homo sapiens
tgggccagcccct

SEQ ID NO: 3006519 - DNA, 16 bp, Homo sapiens
tgggccatgggtcctc

SEQ ID NO: 3006520 - DNA, 14 bp, Homo sapiens
tgggcccacagccc

SEQ ID NO: 3006521 - DNA, 18 bp, Homo sapiens
tgggcccacagcccccac

SEQ ID NO: 3006522 - DNA, 19 bp, Homo sapiens
tgggcccacagcccccacc

SEQ ID NO: 3006523 - DNA, 15 bp, Homo sapiens
tgggcccaggcaggt

SEQ ID NO: 3006524 - DNA, 16 bp, Homo sapiens
tgggcccaggcaggtc

SEQ ID NO: 3006525 - DNA, 17 bp, Homo sapiens
tgggcccaggcaggtct

SEQ ID NO: 3006526 - DNA, 18 bp, Homo sapiens
tgggccccaccacctagg

SEQ ID NO: 3006527 - DNA, 22 bp, Homo sapiens
tgggcccctcaggggaagctgc

SEQ ID NO: 3006528 - DNA, 23 bp, Homo sapiens
tgggcccctcaggggaagctgct

SEQ ID NO: 3006529 - DNA, 11 bp, Homo sapiens
tgggcccctcc

SEQ ID NO: 3006530 - DNA, 21 bp, Homo sapiens
tgggcccctcccctcagagcc

SEQ ID NO: 3006531 - DNA, 12 bp, Homo sapiens
tgggcccctggc

SEQ ID NO: 3006532 - DNA, 19 bp, Homo sapiens
tgggccctatgtctcagga

SEQ ID NO: 3006533 - DNA, 23 bp, Homo sapiens
tgggccctatgtctcaggagtgg

SEQ ID NO: 3006534 - DNA, 13 bp, Homo sapiens
tgggccctgcatg

SEQ ID NO: 3006535 - DNA, 17 bp, Homo sapiens
tgggccgcaagggcctg

SEQ ID NO: 3006536 - DNA, 22 bp, Homo sapiens
tgggccgcgtgccgggccccca

SEQ ID NO: 3006537 - DNA, 23 bp, Homo sapiens
tgggcctaaaacagtattctgta

SEQ ID NO: 3006538 - DNA, 23 bp, Homo sapiens
tgggcctgacctccagtcctgct

SEQ ID NO: 3006539 - DNA, 15 bp, Homo sapiens
tgggcctgctccaga

SEQ ID NO: 3006540 - DNA, 16 bp, Homo sapiens
tgggcctgctccagac

SEQ ID NO: 3006541 - DNA, 17 bp, Homo sapiens
tgggcctggccagtctt

SEQ ID NO: 3006542 - DNA, 15 bp, Homo sapiens
tgggccttctcagct

SEQ ID NO: 3006543 - DNA, 16 bp, Homo sapiens
tgggccttctcagctc

SEQ ID NO: 3006544 - DNA, 15 bp, Homo sapiens
tgggcgctctcccta

SEQ ID NO: 3006545 - DNA, 23 bp, Homo sapiens
tgggcggaagtacttccctcagg

SEQ ID NO: 3006546 - DNA, 22 bp, Homo sapiens
tgggcggacaaaagggccaggt

SEQ ID NO: 3006547 - DNA, 16 bp, Homo sapiens
tgggcggctctgaagc

SEQ ID NO: 3006548 - DNA, 20 bp, Homo sapiens
tgggcgtctgactccctccc

SEQ ID NO: 3006549 - DNA, 20 bp, Homo sapiens
tgggctcaagcaatcctctc

SEQ ID NO: 3006550 - DNA, 20 bp, Homo sapiens
tgggctcaagtgatcctcac

SEQ ID NO: 3006551 - DNA, 17 bp, Homo sapiens
tgggctcagagagtaca

SEQ ID NO: 3006552 - DNA, 16 bp, Homo sapiens
tgggctcccgtgtttt

SEQ ID NO: 3006553 - DNA, 19 bp, Homo sapiens
tgggctccctgactgggag

SEQ ID NO: 3006554 - DNA, 23 bp, Homo sapiens
tgggctcctccagggtgtgtgct

SEQ ID NO: 3006555 - DNA, 17 bp, Homo sapiens
tgggctctccacctcag

SEQ ID NO: 3006556 - DNA, 20 bp, Homo sapiens
tgggctctccacctcagcct

SEQ ID NO: 3006557 - DNA, 18 bp, Homo sapiens
tgggctgacggtgcagtc

SEQ ID NO: 3006558 - DNA, 11 bp, Homo sapiens
tgggctgaggg

SEQ ID NO: 3006559 - DNA, 15 bp, Homo sapiens
tgggctggtattctc

SEQ ID NO: 3006560 - DNA, 16 bp, Homo sapiens
tgggctggtattctct

SEQ ID NO: 3006561 - DNA, 19 bp, Homo sapiens
tgggctggtattctctcta

SEQ ID NO: 3006562 - DNA, 21 bp, Homo sapiens
tgggctgtgttgactgctgct

SEQ ID NO: 3006563 - DNA, 22 bp, Homo sapiens
tgggcttacaggcatgagccac

SEQ ID NO: 3006564 - DNA, 11 bp, Homo sapiens
tgggcttcagc

SEQ ID NO: 3006565 - DNA, 13 bp, Homo sapiens
tgggcttcagggc

SEQ ID NO: 3006566 - DNA, 14 bp, Homo sapiens
tgggcttctgcgtc

SEQ ID NO: 3006567 - DNA, 18 bp, Homo sapiens
tgggctttaaaagaaaaa

SEQ ID NO: 3006568 - DNA, 19 bp, Homo sapiens
tgggcttttgttctgaggg

SEQ ID NO: 3006569 - DNA, 13 bp, Homo sapiens
tggggaaaaattc

SEQ ID NO: 3006570 - DNA, 15 bp, Homo sapiens
tggggaaaaattctt

SEQ ID NO: 3006571 - DNA, 18 bp, Homo sapiens
tggggaaagacactgcct

SEQ ID NO: 3006572 - DNA, 19 bp, Homo sapiens
tggggaaagacactgcctg

SEQ ID NO: 3006573 - DNA, 20 bp, Homo sapiens
tggggaaagacactgcctgg

SEQ ID NO: 3006574 - DNA, 16 bp, Homo sapiens
tggggaatgggcaggt

SEQ ID NO: 3006575 - DNA, 20 bp, Homo sapiens
tggggacatctctttgaatt

SEQ ID NO: 3006576 - DNA, 16 bp, Homo sapiens
tggggacctcagcctg

SEQ ID NO: 3006577 - DNA, 21 bp, Homo sapiens
tggggagacagttgagagcgg

SEQ ID NO: 3006578 - DNA, 17 bp, Homo sapiens
tggggagactgggctga

SEQ ID NO: 3006579 - DNA, 21 bp, Homo sapiens
tggggagactgggctgaggga

SEQ ID NO: 3006580 - DNA, 20 bp, Homo sapiens
tggggaggctgaggcaggag

SEQ ID NO: 3006581 - DNA, 23 bp, Homo sapiens
tggggaggctgcactggagccac

SEQ ID NO: 3006582 - DNA, 11 bp, Homo sapiens
tggggaggggg

SEQ ID NO: 3006583 - DNA, 17 bp, Homo sapiens
tggggaggtggcactag

SEQ ID NO: 3006584 - DNA, 18 bp, Homo sapiens
tggggaggtgggaggcca

SEQ ID NO: 3006585 - DNA, 20 bp, Homo sapiens
tggggaggtgggaggccagg

SEQ ID NO: 3006586 - DNA, 17 bp, Homo sapiens
tggggagttaagacctg

SEQ ID NO: 3006587 - DNA, 19 bp, Homo sapiens
tggggagttaagacctggc

SEQ ID NO: 3006588 - DNA, 19 bp, Homo sapiens
tggggagtttagggtgggg

SEQ ID NO: 3006589 - DNA, 15 bp, Homo sapiens
tggggatagtctggg

SEQ ID NO: 3006590 - DNA, 17 bp, Homo sapiens
tggggatagtctgggtc

SEQ ID NO: 3006591 - DNA, 13 bp, Homo sapiens
tggggatatgctt

SEQ ID NO: 3006592 - DNA, 17 bp, Homo sapiens
tggggatcaattttcat

SEQ ID NO: 3006593 - DNA, 16 bp, Homo sapiens
tggggcactcccccag

SEQ ID NO: 3006594 - DNA, 16 bp, Homo sapiens
tggggcactgggcgtc

SEQ ID NO: 3006595 - DNA, 21 bp, Homo sapiens
tggggcagatggcagggctga

SEQ ID NO: 3006596 - DNA, 12 bp, Homo sapiens
tggggcaggcag

SEQ ID NO: 3006597 - DNA, 16 bp, Homo sapiens
tggggcaggggccggg

SEQ ID NO: 3006598 - DNA, 13 bp, Homo sapiens
tggggccagatcc

SEQ ID NO: 3006599 - DNA, 14 bp, Homo sapiens
tggggccagatcca

SEQ ID NO: 3006600 - DNA, 15 bp, Homo sapiens
tggggccagatccag

SEQ ID NO: 3006601 - DNA, 18 bp, Homo sapiens
tggggccagatccagcct

SEQ ID NO: 3006602 - DNA, 13 bp, Homo sapiens
tggggccaggccg

SEQ ID NO: 3006603 - DNA, 14 bp, Homo sapiens
tggggcccagtgca

SEQ ID NO: 3006604 - DNA, 17 bp, Homo sapiens
tggggcccatggaggag

SEQ ID NO: 3006605 - DNA, 18 bp, Homo sapiens
tggggcccatggaggaga

SEQ ID NO: 3006606 - DNA, 20 bp, Homo sapiens
tggggccctaattcagccat

SEQ ID NO: 3006607 - DNA, 20 bp, Homo sapiens
tggggcctccagaactcact

SEQ ID NO: 3006608 - DNA, 15 bp, Homo sapiens
tggggctaaatgaag

SEQ ID NO: 3006609 - DNA, 16 bp, Homo sapiens
tggggctaaatgaagt

SEQ ID NO: 3006610 - DNA, 19 bp, Homo sapiens
tggctaagggggaccatgg

SEQ ID NO: 3006611 - DNA, 15 bp, Homo sapiens
tggctactttttcat

SEQ ID NO: 3006612 - DNA, 15 bp, Homo sapiens
tggctagtcaagctc

SEQ ID NO: 3006613 - DNA, 20 bp, Homo sapiens
tggctagtcaagctcctcct

SEQ ID NO: 3006614 - DNA, 22 bp, Homo sapiens
tggctagtcaagctcctcctcc

SEQ ID NO: 3006615 - DNA, 15 bp, Homo sapiens
tggctagtccttgtt

SEQ ID NO: 3006616 - DNA, 14 bp, Homo sapiens
tggctatataaaat

SEQ ID NO: 3006617 - DNA, 17 bp, Homo sapiens
tggctattttgagaact

SEQ ID NO: 3006618 - DNA, 22 bp, Homo sapiens
tggctattttgagaactccagc

SEQ ID NO: 3006619 - DNA, 22 bp, Homo sapiens
tggctcacacctgtaatcccag

SEQ ID NO: 3006620 - DNA, 15 bp, Homo sapiens
tggctcacgccccgc

SEQ ID NO: 3006621 - DNA, 12 bp, Homo sapiens
tggctcagccag

SEQ ID NO: 3006622 - DNA, 14 bp, Homo sapiens
tggctcagctcggg

SEQ ID NO: 3006623 - DNA, 19 bp, Homo sapiens
tggctccagaatgtgctgc

SEQ ID NO: 3006624 - DNA, 20 bp, Homo sapiens
tggctccagaatgtgctgcc

SEQ ID NO: 3006625 - DNA, 21 bp, Homo sapiens
tggctccagaatgtgctgcct

SEQ ID NO: 3006626 - DNA, 13 bp, Homo sapiens
tggctccccgagg

SEQ ID NO: 3006627 - DNA, 22 bp, Homo sapiens
tggctccctctctcctggactg

SEQ ID NO: 3006628 - DNA, 22 bp, Homo sapiens
tggctcctctgtggtgtctgcc

SEQ ID NO: 3006629 - DNA, 13 bp, Homo sapiens
tggctctattgga

SEQ ID NO: 3006630 - DNA, 22 bp, Homo sapiens
tggctcttcagaggagcatcag

SEQ ID NO: 3006631 - DNA, 21 bp, Homo sapiens
tggctgaacagtgctctgcct

SEQ ID NO: 3006632 - DNA, 20 bp, Homo sapiens
tggctgaagacttttgttat

SEQ ID NO: 3006633 - DNA, 15 bp, Homo sapiens
tggctgacccagtcc

SEQ ID NO: 3006634 - DNA, 17 bp, Homo sapiens
tggctgacccagtccct

SEQ ID NO: 3006635 - DNA, 21 bp, Homo sapiens
tggctgacccagtccctgggg

SEQ ID NO: 3006636 - DNA, 16 bp, Homo sapiens
tggctgactttgctct

SEQ ID NO: 3006637 - DNA, 17 bp, Homo sapiens
tggctgagatagcagag

SEQ ID NO: 3006638 - DNA, 17 bp, Homo sapiens
tggctgagcccctgtct

SEQ ID NO: 3006639 - DNA, 15 bp, Homo sapiens
tggctgcaagcccac

SEQ ID NO: 3006640 - DNA, 23 bp, Homo sapiens
tggctgcaagcccacctcggccc

SEQ ID NO: 3006641 - DNA, 13 bp, Homo sapiens
tggctgcactctt

SEQ ID NO: 3006642 - DNA, 14 bp, Homo sapiens
tggctgcaggaatc

SEQ ID NO: 3006643 - DNA, 16 bp, Homo sapiens
tggctgcctggagccc

SEQ ID NO: 3006644 - DNA, 21 bp, Homo sapiens
tggctgcctttgatcacagga

SEQ ID NO: 3006645 - DNA, 17 bp, Homo sapiens
tggctgcttgcagccag

SEQ ID NO: 3006646 - DNA, 20 bp, Homo sapiens
tggctgcttgcagccaggag

SEQ ID NO: 3006647 - DNA, 14 bp, Homo sapiens
tggctgggcccagc

SEQ ID NO: 3006648 - DNA, 15 bp, Homo sapiens
tggctgggcccagca

SEQ ID NO: 3006649 - DNA, 18 bp, Homo sapiens
tggctgggggagggactg

SEQ ID NO: 3006650 - DNA, 13 bp, Homo sapiens
tggctgggtcctt

SEQ ID NO: 3006651 - DNA, 23 bp, Homo sapiens
tggctgggtccttgggcctggcc

SEQ ID NO: 3006652 - DNA, 15 bp, Homo sapiens
tggctgtagataaat

SEQ ID NO: 3006653 - DNA, 17 bp, Homo sapiens
tggctgtatcttgtttt

SEQ ID NO: 3006654 - DNA, 23 bp, Homo sapiens
tggctgtctggatccttcccaag

SEQ ID NO: 3006655 - DNA, 22 bp, Homo sapiens
tggctgtggagacaatgtctgc

SEQ ID NO: 3006656 - DNA, 17 bp, Homo sapiens
tggctgtggcatccaga

SEQ ID NO: 3006657 - DNA, 20 bp, Homo sapiens
tggctgtgtaaccttgggtg

SEQ ID NO: 3006658 - DNA, 15 bp, Homo sapiens
tggcttagctgccat

SEQ ID NO: 3006659 - DNA, 16 bp, Homo sapiens
tggcttataggtgttg

SEQ ID NO: 3006660 - DNA, 23 bp, Homo sapiens
tggcttcactctccctgacggct

SEQ ID NO: 3006661 - DNA, 21 bp, Homo sapiens
tggcttcagagcgataataca

SEQ ID NO: 3006662 - DNA, 12 bp, Homo sapiens
tggcttcagctc

SEQ ID NO: 3006663 - DNA, 18 bp, Homo sapiens
tggcttcagctccagccc

SEQ ID NO: 3006664 - DNA, 15 bp, Homo sapiens
tggcttcagggatgc

SEQ ID NO: 3006665 - DNA, 16 bp, Homo sapiens
tggcttccatgatggt

SEQ ID NO: 3006666 - DNA, 21 bp, Homo sapiens
tggcttccccttggcctctct

SEQ ID NO: 3006667 - DNA, 15 bp, Homo sapiens
tggcttccctctctg

SEQ ID NO: 3006668 - DNA, 13 bp, Homo sapiens
tggcttcctgaga

SEQ ID NO: 3006669 - DNA, 14 bp, Homo sapiens
tggcttctcctttg

SEQ ID NO: 3006670 - DNA, 18 bp, Homo sapiens
tggcttctcctttggcat

SEQ ID NO: 3006671 - DNA, 19 bp, Homo sapiens
tggcttctcctttggcatg

SEQ ID NO: 3006672 - DNA, 15 bp, Homo sapiens
tggcttctggccagg

SEQ ID NO: 3006673 - DNA, 16 bp, Homo sapiens
tggcttctggccagga

SEQ ID NO: 3006674 - DNA, 18 bp, Homo sapiens
tggcttctggccaggaag

SEQ ID NO: 3006675 - DNA, 13 bp, Homo sapiens
tggcttctttcca

SEQ ID NO: 3006676 - DNA, 15 bp, Homo sapiens
tggcttgagaaatat

SEQ ID NO: 3006677 - DNA, 15 bp, Homo sapiens
tggcttgagtgaatt

SEQ ID NO: 3006678 - DNA, 13 bp, Homo sapiens
tggcttggcttta

SEQ ID NO: 3006679 - DNA, 22 bp, Homo sapiens
tggcttgtacatttttaaattc

SEQ ID NO: 3006680 - DNA, 22 bp, Homo sapiens
tggcttgttattgcctctactt

SEQ ID NO: 3006681 - DNA, 21 bp, Homo sapiens
tggctttaaccgtttttcaag

SEQ ID NO: 3006682 - DNA, 11 bp, Homo sapiens
tggctttcagg

SEQ ID NO: 3006683 - DNA, 13 bp, Homo sapiens
tggctttcatcct

SEQ ID NO: 3006684 - DNA, 14 bp, Homo sapiens
tggctttcatcctg

SEQ ID NO: 3006685 - DNA, 15 bp, Homo sapiens
tggctttcatcctgt

SEQ ID NO: 3006686 - DNA, 19 bp, Homo sapiens
tggctttcatcctgtgtcc

SEQ ID NO: 3006687 - DNA, 15 bp, Homo sapiens
tggctttgaggccga

SEQ ID NO: 3006688 - DNA, 13 bp, Homo sapiens
tggctttggaata

SEQ ID NO: 3006689 - DNA, 17 bp, Homo sapiens
tggctttggcttcttgg

SEQ ID NO: 3006690 - DNA, 22 bp, Homo sapiens
tggcttttattaatgcactttc

SEQ ID NO: 3006691 - DNA, 19 bp, Homo sapiens
tggcttttctgtttcctgt

SEQ ID NO: 3006692 - DNA, 14 bp, Homo sapiens
tgggaaaaactgca

SEQ ID NO: 3006693 - DNA, 19 bp, Homo sapiens
tgggaaaatatttcctgac

SEQ ID NO: 3006694 - DNA, 17 bp, Homo sapiens
tgggaaacactccttgc

SEQ ID NO: 3006695 - DNA, 18 bp, Homo sapiens
tgggaaacactccttgca

SEQ ID NO: 3006696 - DNA, 19 bp, Homo sapiens
tgggaaacactccttgcat

SEQ ID NO: 3006697 - DNA, 20 bp, Homo sapiens
tgggaaacactccttgcatc

SEQ ID NO: 3006698 - DNA, 15 bp, Homo sapiens
tgggaaacagaggct

SEQ ID NO: 3006699 - DNA, 21 bp, Homo sapiens
tgggaaagagaaagagacaga

SEQ ID NO: 3006700 - DNA, 19 bp, Homo sapiens
tgggaaatatttagcaaat

SEQ ID NO: 3006701 - DNA, 14 bp, Homo sapiens
tgggaacatttatt

SEQ ID NO: 3006702 - DNA, 21 bp, Homo sapiens
tgggaagactgttgtgctcca

SEQ ID NO: 3006703 - DNA, 13 bp, Homo sapiens
tgggaagggagag

SEQ ID NO: 3006704 - DNA, 22 bp, Homo sapiens
tgggaaggggacccccgccccc

SEQ ID NO: 3006705 - DNA, 17 bp, Homo sapiens
tgggaagtcgaggctgc

SEQ ID NO: 3006706 - DNA, 19 bp, Homo sapiens
tgggaatctcccagacttg

SEQ ID NO: 3006707 - DNA, 14 bp, Homo sapiens
tgggaatgaagctt

SEQ ID NO: 3006708 - DNA, 15 bp, Homo sapiens
tgggaatttgtcagc

SEQ ID NO: 3006709 - DNA, 19 bp, Homo sapiens
tgggaatttgtcagcgttc

SEQ ID NO: 3006710 - DNA, 21 bp, Homo sapiens
tgggacaccccgacttttgtt

SEQ ID NO: 3006711 - DNA, 23 bp, Homo sapiens
tgggacatcaggagactgggctc

SEQ ID NO: 3006712 - DNA, 16 bp, Homo sapiens
tgggaccaaaggggga

SEQ ID NO: 3006713 - DNA, 14 bp, Homo sapiens
tgggacccccgtgg

SEQ ID NO: 3006714 - DNA, 24 bp, Homo sapiens
tgggacctccaccgttggtgttca

SEQ ID NO: 3006715 - DNA, 21 bp, Homo sapiens
tgggacctgccctccctcagc

SEQ ID NO: 3006716 - DNA, 20 bp, Homo sapiens
tgggacgtggctcagccagc

SEQ ID NO: 3006717 - DNA, 21 bp, Homo sapiens
tgggacgtggctcagccagca

SEQ ID NO: 3006718 - DNA, 17 bp, Homo sapiens
tgggactccaggccagc

SEQ ID NO: 3006719 - DNA, 18 bp, Homo sapiens
tgggactgctaaataaaa

SEQ ID NO: 3006720 - DNA, 13 bp, Homo sapiens
tgggacttctttt

SEQ ID NO: 3006721 - DNA, 18 bp, Homo sapiens
tgggacttcttttcacat

SEQ ID NO: 3006722 - DNA, 21 bp, Homo sapiens
tgggacttcttttcacattct

SEQ ID NO: 3006723 - DNA, 14 bp, Homo sapiens
tgggagaaagcaat

SEQ ID NO: 3006724 - DNA, 19 bp, Homo sapiens
tgggagaaattgacagatc

SEQ ID NO: 3006725 - DNA, 15 bp, Homo sapiens
tgggagaatcagcag

SEQ ID NO: 3006726 - DNA, 17 bp, Homo sapiens
tgggagaatcagcagaa

SEQ ID NO: 3006727 - DNA, 22 bp, Homo sapiens
tggtcctatttttgtgaagagg

SEQ ID NO: 3006728 - DNA, 23 bp, Homo sapiens
tggtcctccgcctactgtccctc

SEQ ID NO: 3006729 - DNA, 23 bp, Homo sapiens
tggtcctctctctgtggggctga

SEQ ID NO: 3006730 - DNA, 13 bp, Homo sapiens
tggtcctggctgc

SEQ ID NO: 3006731 - DNA, 16 bp, Homo sapiens
tggtcctggctgcact

SEQ ID NO: 3006732 - DNA, 16 bp, Homo sapiens
tggtcctgtccccgca

SEQ ID NO: 3006733 - DNA, 12 bp, Homo sapiens
tggtcctgtctg

SEQ ID NO: 3006734 - DNA, 13 bp, Homo sapiens
tggtcctgttttc

SEQ ID NO: 3006735 - DNA, 21 bp, Homo sapiens
tggtcctgttttctaaaaaaa

SEQ ID NO: 3006736 - DNA, 16 bp, Homo sapiens
tggtctcaaactcctg

SEQ ID NO: 3006737 - DNA, 17 bp, Homo sapiens
tggtctcgaactcctga

SEQ ID NO: 3006738 - DNA, 21 bp, Homo sapiens
tggtctcgatgctgctggcct

SEQ ID NO: 3006739 - DNA, 17 bp, Homo sapiens
tggtctctcttggaatt

SEQ ID NO: 3006740 - DNA, 15 bp, Homo sapiens
tggtctctgcatttt

SEQ ID NO: 3006741 - DNA, 19 bp, Homo sapiens
tggtctctgcatttttctg

SEQ ID NO: 3006742 - DNA, 18 bp, Homo sapiens
tggtctgccaatctgtac

SEQ ID NO: 3006743 - DNA, 19 bp, Homo sapiens
tggtctgccaatctgtaca

SEQ ID NO: 3006744 - DNA, 18 bp, Homo sapiens
tggtctgccaggccccca

SEQ ID NO: 3006745 - DNA, 19 bp, Homo sapiens
tggtctgctcaggaattga

SEQ ID NO: 3006746 - DNA, 18 bp, Homo sapiens
tggtctgggtggatgtga

SEQ ID NO: 3006747 - DNA, 18 bp, Homo sapiens
tggtcttaggtcttcctg

SEQ ID NO: 3006748 - DNA, 19 bp, Homo sapiens
tggtcttaggtcttcctgt

SEQ ID NO: 3006749 - DNA, 17 bp, Homo sapiens
tggtcttggcagcacct

SEQ ID NO: 3006750 - DNA, 19 bp, Homo sapiens
tggtgaaacccccatctct

SEQ ID NO: 3006751 - DNA, 19 bp, Homo sapiens
tggtgaatgtgtgagaaaa

SEQ ID NO: 3006752 - DNA, 15 bp, Homo sapiens
tggtgacagccttgg

SEQ ID NO: 3006753 - DNA, 22 bp, Homo sapiens
tggtgaccagtttcttaaactg

SEQ ID NO: 3006754 - DNA, 21 bp, Homo sapiens
tggtgaccttccaagagcctg

SEQ ID NO: 3006755 - DNA, 17 bp, Homo sapiens
tggtgacttttgaagaa

SEQ ID NO: 3006756 - DNA, 20 bp, Homo sapiens
tggtgagaaacctgtatctt

SEQ ID NO: 3006757 - DNA, 16 bp, Homo sapiens
tggtgagagaagaaaa

SEQ ID NO: 3006758 - DNA, 20 bp, Homo sapiens
tggtgagatgcagctggaaa

SEQ ID NO: 3006759 - DNA, 19 bp, Homo sapiens
tggtgagcctagccctggg

SEQ ID NO: 3006760 - DNA, 20 bp, Homo sapiens
tggtgagcctagccctggga

SEQ ID NO: 3006761 - DNA, 19 bp, Homo sapiens
tggtgaggccggccctgcc

SEQ ID NO: 3006762 - DNA, 19 bp, Homo sapiens
tggtgaggtttaaaggata

SEQ ID NO: 3006763 - DNA, 21 bp, Homo sapiens
tggtgataatcgtcttcaaat

SEQ ID NO: 3006764 - DNA, 13 bp, Homo sapiens
tggtgatggaaaa

SEQ ID NO: 3006765 - DNA, 15 bp, Homo sapiens
tggtgatgtgcctgt

SEQ ID NO: 3006766 - DNA, 16 bp, Homo sapiens
tggtgatgtgcctgta

SEQ ID NO: 3006767 - DNA, 15 bp, Homo sapiens
tggtgcactttgtaa

SEQ ID NO: 3006768 - DNA, 17 bp, Homo sapiens
tggtgcactttgtaaat

SEQ ID NO: 3006769 - DNA, 18 bp, Homo sapiens
tggtgccaaatagcccca

SEQ ID NO: 3006770 - DNA, 21 bp, Homo sapiens
tggtgccaaatagccccagac

SEQ ID NO: 3006771 - DNA, 22 bp, Homo sapiens
tggtgccaaatagccccagact

SEQ ID NO: 3006772 - DNA, 20 bp, Homo sapiens
tggtgccagatcctcttctc

SEQ ID NO: 3006773 - DNA, 21 bp, Homo sapiens
tggtgccagatcctcttctca

SEQ ID NO: 3006774 - DNA, 18 bp, Homo sapiens
tggtgccatcattgctgt

SEQ ID NO: 3006775 - DNA, 22 bp, Homo sapiens
tggtgccatcattgctgtctgc

SEQ ID NO: 3006776 - DNA, 23 bp, Homo sapiens
tggtgccccaggaccagctcagg

SEQ ID NO: 3006777 - DNA, 23 bp, Homo sapiens
tggtgcccccagacagctgctca

SEQ ID NO: 3006778 - DNA, 14 bp, Homo sapiens
tggtgcctgagccc

SEQ ID NO: 3006779 - DNA, 17 bp, Homo sapiens
tggtgcctgagcccctc

SEQ ID NO: 3006780 - DNA, 18 bp, Homo sapiens
tggtgcctgagcccctca

SEQ ID NO: 3006781 - DNA, 23 bp, Homo sapiens
tggtgcctgctttgacgggccag

SEQ ID NO: 3006782 - DNA, 12 bp, Homo sapiens
tggtgcctggcc

SEQ ID NO: 3006783 - DNA, 22 bp, Homo sapiens
tggtgcctggcctggcacacat

SEQ ID NO: 3006784 - DNA, 15 bp, Homo sapiens
tggtgctaatatttt

SEQ ID NO: 3006785 - DNA, 16 bp, Homo sapiens
tggtgctacgcctgca

SEQ ID NO: 3006786 - DNA, 14 bp, Homo sapiens
tggtgctcagttgt

SEQ ID NO: 3006787 - DNA, 21 bp, Homo sapiens
tggtgctcgggaagggagggg

SEQ ID NO: 3006788 - DNA, 16 bp, Homo sapiens
tggtgctcttgctttt

SEQ ID NO: 3006789 - DNA, 13 bp, Homo sapiens
tggtgctgggaac

SEQ ID NO: 3006790 - DNA, 13 bp, Homo sapiens
tggtgctggttta

SEQ ID NO: 3006791 - DNA, 20 bp, Homo sapiens
tggtggaggagctgagggag

SEQ ID NO: 3006792 - DNA, 22 bp, Homo sapiens
tggtggaggagctgagggaggg

SEQ ID NO: 3006793 - DNA, 13 bp, Homo sapiens
tggtggagggcca

SEQ ID NO: 3006794 - DNA, 15 bp, Homo sapiens
tggtggcatggaagg

SEQ ID NO: 3006795 - DNA, 21 bp, Homo sapiens
tggtggcttcagctccagccc

SEQ ID NO: 3006796 - DNA, 18 bp, Homo sapiens
tggtgggcttcagggcag

SEQ ID NO: 3006797 - DNA, 18 bp, Homo sapiens
tggtgggcttctgcgtcc

SEQ ID NO: 3006798 - DNA, 18 bp, Homo sapiens
tggtgtaatctcaatgca

SEQ ID NO: 3006799 - DNA, 21 bp, Homo sapiens
tggtgtatatcatgaagcctt

SEQ ID NO: 3006800 - DNA, 14 bp, Homo sapiens
tggtgtcaccccag

SEQ ID NO: 3006801 - DNA, 17 bp, Homo sapiens
tggtgtcaccccagagc

SEQ ID NO: 3006802 - DNA, 19 bp, Homo sapiens
tggtgtcaccccagagcca

SEQ ID NO: 3006803 - DNA, 12 bp, Homo sapiens
tggtgtcactgt

SEQ ID NO: 3006804 - DNA, 19 bp, Homo sapiens
tggtgtcactgtccctcct

SEQ ID NO: 3006805 - DNA, 22 bp, Homo sapiens
tggtgtcactgtccctcctggt

SEQ ID NO: 3006806 - DNA, 15 bp, Homo sapiens
tggtgtccacctggc

SEQ ID NO: 3006807 - DNA, 18 bp, Homo sapiens
tggtgtccacctggcccc

SEQ ID NO: 3006808 - DNA, 18 bp, Homo sapiens
tggtgtccttcttcctca

SEQ ID NO: 3006809 - DNA, 13 bp, Homo sapiens
tggtgtctgcctg

SEQ ID NO: 3006810 - DNA, 19 bp, Homo sapiens
tggtgtgagtatcagaatt

SEQ ID NO: 3006811 - DNA, 16 bp, Homo sapiens
tggtgtgatcgtctga

SEQ ID NO: 3006812 - DNA, 18 bp, Homo sapiens
tggtgtgatcgtctgact

SEQ ID NO: 3006813 - DNA, 12 bp, Homo sapiens
tggtgtgcatct

SEQ ID NO: 3006814 - DNA, 14 bp, Homo sapiens
tggtgtgtgtctct

SEQ ID NO: 3006815 - DNA, 16 bp, Homo sapiens
tggtgtgtgtctctga

SEQ ID NO: 3006816 - DNA, 21 bp, Homo sapiens
tggtgtgttggacagagaagg

SEQ ID NO: 3006817 - DNA, 18 bp, Homo sapiens
tggtgttactgcagttga

SEQ ID NO: 3006818 - DNA, 14 bp, Homo sapiens
tggtttttgttgag

SEQ ID NO: 3006819 - DNA, 13 bp, Homo sapiens
tgtaaaaaacaaa

SEQ ID NO: 3006820 - DNA, 16 bp, Homo sapiens
tgtaaaaaacaaaaaa

SEQ ID NO: 3006821 - DNA, 22 bp, Homo sapiens
tgtaaaaaacaaaaaaaacaac

SEQ ID NO: 3006822 - DNA, 23 bp, Homo sapiens
tgtaaaaaacaaaaaaaacaaca

SEQ ID NO: 3006823 - DNA, 17 bp, Homo sapiens
tgtaaaaaagaaaaaca

SEQ ID NO: 3006824 - DNA, 16 bp, Homo sapiens
tgtaaaaaatggaaaa

SEQ ID NO: 3006825 - DNA, 21 bp, Homo sapiens
tgtaaaaaatggaaaaaaaca

SEQ ID NO: 3006826 - DNA, 19 bp, Homo sapiens
tgtaaaaacagcattgctt

SEQ ID NO: 3006827 - DNA, 20 bp, Homo sapiens
tgtaaaaacagcattgcttt

SEQ ID NO: 3006828 - DNA, 20 bp, Homo sapiens
tgtaaaagacactggtgtat

SEQ ID NO: 3006829 - DNA, 18 bp, Homo sapiens
tgtaaaagattaaactgc

SEQ ID NO: 3006830 - DNA, 21 bp, Homo sapiens
tgtaaaaggccaaacctctgt

SEQ ID NO: 3006831 - DNA, 22 bp, Homo sapiens
tgtaaaaggccaaacctctgtt

SEQ ID NO: 3006832 - DNA, 14 bp, Homo sapiens
tgtaaaatcttcag

SEQ ID NO: 3006833 - DNA, 15 bp, Homo sapiens
tgtaaaatcttcagc

SEQ ID NO: 3006834 - DNA, 19 bp, Homo sapiens
tgtaaaatcttcagctggt

SEQ ID NO: 3006835 - DNA, 15 bp, Homo sapiens
tgtaaaatcttgcag

SEQ ID NO: 3006836 - DNA, 17 bp, Homo sapiens
tgtaaaatttcacttaa

SEQ ID NO: 3006837 - DNA, 14 bp, Homo sapiens
tgtaaacagaataa

SEQ ID NO: 3006838 - DNA, 19 bp, Homo sapiens
tgtaaacagaataaaagtt

SEQ ID NO: 3006839 - DNA, 18 bp, Homo sapiens
tgtaaacagcctcttttt

SEQ ID NO: 3006840 - DNA, 12 bp, Homo sapiens
tgtaaacagtgc

SEQ ID NO: 3006841 - DNA, 14 bp, Homo sapiens
tgtaaacagtgcct

SEQ ID NO: 3006842 - DNA, 16 bp, Homo sapiens
tgtaaacagtgcctgc

SEQ ID NO: 3006843 - DNA, 15 bp, Homo sapiens
tgtaaacatctgctt

SEQ ID NO: 3006844 - DNA, 14 bp, Homo sapiens
tgtaaaccaaatac

SEQ ID NO: 3006845 - DNA, 23 bp, Homo sapiens
tgtaaaccacaaggctgttgcat

SEQ ID NO: 3006846 - DNA, 14 bp, Homo sapiens
tgtaaactcttcac

SEQ ID NO: 3006847 - DNA, 14 bp, Homo sapiens
tgtaaagaaagaga

SEQ ID NO: 3006848 - DNA, 12 bp, Homo sapiens
tgtaaagcaaat

SEQ ID NO: 3006849 - DNA, 18 bp, Homo sapiens
tgtaaagcattccaacaa

SEQ ID NO: 3006850 - DNA, 21 bp, Homo sapiens
tgtaaaggagtcaaaactaca

SEQ ID NO: 3006851 - DNA, 15 bp, Homo sapiens
tgtaaaggggcagct

SEQ ID NO: 3006852 - DNA, 13 bp, Homo sapiens
tgtaaagtgaaga

SEQ ID NO: 3006853 - DNA, 12 bp, Homo sapiens
tgtaaagtgtgg

SEQ ID NO: 3006854 - DNA, 14 bp, Homo sapiens
tgtaaagttagtct

SEQ ID NO: 3006855 - DNA, 13 bp, Homo sapiens
tgtaaataaagcc

SEQ ID NO: 3006856 - DNA, 18 bp, Homo sapiens
tgtaaataaagccctggg

SEQ ID NO: 3006857 - DNA, 15 bp, Homo sapiens
tgtaaataaattttg

SEQ ID NO: 3006858 - DNA, 19 bp, Homo sapiens
tgtaaataaattttgtgca

SEQ ID NO: 3006859 - DNA, 18 bp, Homo sapiens
tgtaaataggatttttag

SEQ ID NO: 3006860 - DNA, 15 bp, Homo sapiens
tgtaaatattgtgtg

SEQ ID NO: 3006861 - DNA, 21 bp, Homo sapiens
tgtaaatcatgttgatcatgt

SEQ ID NO: 3006862 - DNA, 13 bp, Homo sapiens
tgtaaatccttgt

SEQ ID NO: 3006863 - DNA, 19 bp, Homo sapiens
tgtaaatgaagatctttat

SEQ ID NO: 3006864 - DNA, 17 bp, Homo sapiens
tgtaaatgctattatac

SEQ ID NO: 3006865 - DNA, 19 bp, Homo sapiens
tgtaaatgtactggtaatt

SEQ ID NO: 3006866 - DNA, 12 bp, Homo sapiens
tgtaaatgtgtt

SEQ ID NO: 3006867 - DNA, 15 bp, Homo sapiens
tgtaaattcagtctt

SEQ ID NO: 3006868 - DNA, 18 bp, Homo sapiens
tgtaacaagccagatttt

SEQ ID NO: 3006869 - DNA, 21 bp, Homo sapiens
tgtaacaagggttttaatgta

SEQ ID NO: 3006870 - DNA, 16 bp, Homo sapiens
tgtaaccagctcagtg

SEQ ID NO: 3006871 - DNA, 12 bp, Homo sapiens
tgtaaccatttt

SEQ ID NO: 3006872 - DNA, 19 bp, Homo sapiens
tgtaaccattttataaagt

SEQ ID NO: 3006873 - DNA, 18 bp, Homo sapiens
tgtaacctcgtgtctagt

SEQ ID NO: 3006874 - DNA, 15 bp, Homo sapiens
tgtaacgaaacactt

SEQ ID NO: 3006875 - DNA, 15 bp, Homo sapiens
tgtaactatttcttc

SEQ ID NO: 3006876 - DNA, 24 bp, Homo sapiens
tgtaacttgaacctatgaagcaat

SEQ ID NO: 3006877 - DNA, 15 bp, Homo sapiens
tgtaagaactaaaga

SEQ ID NO: 3006878 - DNA, 18 bp, Homo sapiens
tgtaagaattcagaagac

SEQ ID NO: 3006879 - DNA, 20 bp, Homo sapiens
tgtaagacagtgccctgaga

SEQ ID NO: 3006880 - DNA, 11 bp, Homo sapiens
tgtaagacatt

SEQ ID NO: 3006881 - DNA, 18 bp, Homo sapiens
tgtaagattatagattct

SEQ ID NO: 3006882 - DNA, 16 bp, Homo sapiens
tgtaagcaacttgctt

SEQ ID NO: 3006883 - DNA, 17 bp, Homo sapiens
tgtaagcaacttgcttc

SEQ ID NO: 3006884 - DNA, 19 bp, Homo sapiens
tgtaagcttagattttctg

SEQ ID NO: 3006885 - DNA, 21 bp, Homo sapiens
tgtaaggaactggaacacaca

SEQ ID NO: 3006886 - DNA, 13 bp, Homo sapiens
tgtaaggaattga

SEQ ID NO: 3006887 - DNA, 17 bp, Homo sapiens
tgtaaggaattgaagat

SEQ ID NO: 3006888 - DNA, 15 bp, Homo sapiens
tgtaaggctctagat

SEQ ID NO: 3006889 - DNA, 18 bp, Homo sapiens
tgtaaggctctagatcat

SEQ ID NO: 3006890 - DNA, 17 bp, Homo sapiens
tgtaagtgagtgtgctg

SEQ ID NO: 3006891 - DNA, 21 bp, Homo sapiens
tgtaagtgagtgtgctgctgt

SEQ ID NO: 3006892 - DNA, 20 bp, Homo sapiens
tgtaagtttacctatgtaac

SEQ ID NO: 3006893 - DNA, 14 bp, Homo sapiens
tgtaataatcattt

SEQ ID NO: 3006894 - DNA, 21 bp, Homo sapiens
tgtaataatgtaacatgattt

SEQ ID NO: 3006895 - DNA, 11 bp, Homo sapiens
tgtaatacaat

SEQ ID NO: 3006896 - DNA, 20 bp, Homo sapiens
tgtaatatttcttcaagtga

SEQ ID NO: 3006897 - DNA, 14 bp, Homo sapiens
tgtaatcaataaac

SEQ ID NO: 3006898 - DNA, 14 bp, Homo sapiens
tgtaatcatttgtt

SEQ ID NO: 3006899 - DNA, 19 bp, Homo sapiens
tgtaatcccagcactttgg

SEQ ID NO: 3006900 - DNA, 17 bp, Homo sapiens
tgtaatctatgtttata

SEQ ID NO: 3006901 - DNA, 18 bp, Homo sapiens
tgtaatgaaattccagat

SEQ ID NO: 3006902 - DNA, 22 bp, Homo sapiens
tgtcttcggccgagctggtttc

SEQ ID NO: 3006903 - DNA, 18 bp, Homo sapiens
tgtcttctctatcctctc

SEQ ID NO: 3006904 - DNA, 12 bp, Homo sapiens
tgtcttctctcc

SEQ ID NO: 3006905 - DNA, 15 bp, Homo sapiens
tgtcttctctccact

SEQ ID NO: 3006906 - DNA, 12 bp, Homo sapiens
tgtcttctgtat

SEQ ID NO: 3006907 - DNA, 19 bp, Homo sapiens
tgtcttgaaaaaaaataga

SEQ ID NO: 3006908 - DNA, 13 bp, Homo sapiens
tgtcttgctcctg

SEQ ID NO: 3006909 - DNA, 15 bp, Homo sapiens
tgtcttgctcctggg

SEQ ID NO: 3006910 - DNA, 19 bp, Homo sapiens
tgtcttgctgttgacatat

SEQ ID NO: 3006911 - DNA, 18 bp, Homo sapiens
tgtcttggggtcccactg

SEQ ID NO: 3006912 - DNA, 22 bp, Homo sapiens
tgtcttggggtcccactgctcg

SEQ ID NO: 3006913 - DNA, 22 bp, Homo sapiens
tgtcttgtacatgtgtagcctg

SEQ ID NO: 3006914 - DNA, 22 bp, Homo sapiens
tgtcttgtgtatttctctgtga

SEQ ID NO: 3006915 - DNA, 13 bp, Homo sapiens
tgtcttgttctgt

SEQ ID NO: 3006916 - DNA, 21 bp, Homo sapiens
tgtctttatgagctaaaaata

SEQ ID NO: 3006917 - DNA, 21 bp, Homo sapiens
tgtctttccactcctcctagc

SEQ ID NO: 3006918 - DNA, 19 bp, Homo sapiens
tgtctttgcagggcacaga

SEQ ID NO: 3006919 - DNA, 15 bp, Homo sapiens
tgtcttttaaaatgc

SEQ ID NO: 3006920 - DNA, 20 bp, Homo sapiens
tgtcttttaaaatgcaatgt

SEQ ID NO: 3006921 - DNA, 14 bp, Homo sapiens
tgtcttttgaatat

SEQ ID NO: 3006922 - DNA, 15 bp, Homo sapiens
tgtctttttccttcc

SEQ ID NO: 3006923 - DNA, 19 bp, Homo sapiens
tgtcttttttaaggctctg

SEQ ID NO: 3006924 - DNA, 21 bp, Homo sapiens
tgtgaaaaaggaataaattgt

SEQ ID NO: 3006925 - DNA, 18 bp, Homo sapiens
tgtgaaaatggtccagga

SEQ ID NO: 3006926 - DNA, 17 bp, Homo sapiens
tgtgaaaggaacatttt

SEQ ID NO: 3006927 - DNA, 15 bp, Homo sapiens
tgtgaaatctgtctt

SEQ ID NO: 3006928 - DNA, 21 bp, Homo sapiens
tgtgaactatcccctgcgctt

SEQ ID NO: 3006929 - DNA, 15 bp, Homo sapiens
tgtgaactcagccaa

SEQ ID NO: 3006930 - DNA, 20 bp, Homo sapiens
tgtgaactcagccaagcaca

SEQ ID NO: 3006931 - DNA, 22 bp, Homo sapiens
tgtgaagaaagcctcagtgaaa

SEQ ID NO: 3006932 - DNA, 21 bp, Homo sapiens
tgtgaagacattttttgctat

SEQ ID NO: 3006933 - DNA, 23 bp, Homo sapiens
tgtgaagagggacataagataaa

SEQ ID NO: 3006934 - DNA, 20 bp, Homo sapiens
tgtgaagatgcattgtagtt

SEQ ID NO: 3006935 - DNA, 21 bp, Homo sapiens
tgtgaagccaattcagacagg

SEQ ID NO: 3006936 - DNA, 23 bp, Homo sapiens
tgtgaagtgatgttcagatttct

SEQ ID NO: 3006937 - DNA, 14 bp, Homo sapiens
tgtgaagttacatg

SEQ ID NO: 3006938 - DNA, 16 bp, Homo sapiens
tgtgaagtttggagat

SEQ ID NO: 3006939 - DNA, 22 bp, Homo sapiens
tgtgaatagaactctgaaatga

SEQ ID NO: 3006940 - DNA, 15 bp, Homo sapiens
tgtgaatcagaccct

SEQ ID NO: 3006941 - DNA, 19 bp, Homo sapiens
tgtgaatccatgggtctgg

SEQ ID NO: 3006942 - DNA, 14 bp, Homo sapiens
tgtgaatgcttctg

SEQ ID NO: 3006943 - DNA, 18 bp, Homo sapiens
tgtgaatgcttctgattt

SEQ ID NO: 3006944 - DNA, 22 bp, Homo sapiens
tgtgaatggcaaataaacagtt

SEQ ID NO: 3006945 - DNA, 15 bp, Homo sapiens
tgtgaatgtgactac

SEQ ID NO: 3006946 - DNA, 19 bp, Homo sapiens
tgtgacaattctgttttta

SEQ ID NO: 3006947 - DNA, 19 bp, Homo sapiens
tgtgacaattttgtacaaa

SEQ ID NO: 3006948 - DNA, 19 bp, Homo sapiens
tgtgacacactacaccaca

SEQ ID NO: 3006949 - DNA, 17 bp, Homo sapiens
tgtgacacatatgcacc

SEQ ID NO: 3006950 - DNA, 22 bp, Homo sapiens
tgtgacacatatgcaccttgtg

SEQ ID NO: 3006951 - DNA, 23 bp, Homo sapiens
tgtgacattgctggtcatccttg

SEQ ID NO: 3006952 - DNA, 17 bp, Homo sapiens
tgtgaccaaaagttaca

SEQ ID NO: 3006953 - DNA, 16 bp, Homo sapiens
tgtgaccaatgtcttg

SEQ ID NO: 3006954 - DNA, 20 bp, Homo sapiens
tgtgacccccagctccggcc

SEQ ID NO: 3006955 - DNA, 16 bp, Homo sapiens
tgtgacccctcctggg

SEQ ID NO: 3006956 - DNA, 13 bp, Homo sapiens
tgtgaccctctca

SEQ ID NO: 3006957 - DNA, 15 bp, Homo sapiens
tgtgaccctctcact

SEQ ID NO: 3006958 - DNA, 15 bp, Homo sapiens
tgtgacctgaagttc

SEQ ID NO: 3006959 - DNA, 15 bp, Homo sapiens
tgtgaccttagtgtt

SEQ ID NO: 3006960 - DNA, 18 bp, Homo sapiens
tgtgaccttagtgtttct

SEQ ID NO: 3006961 - DNA, 18 bp, Homo sapiens
tgtgactaattgtataac

SEQ ID NO: 3006962 - DNA, 19 bp, Homo sapiens
tgtgactaattgtataaca

SEQ ID NO: 3006963 - DNA, 23 bp, Homo sapiens
tgtgactaattgtataacaggtt

SEQ ID NO: 3006964 - DNA, 19 bp, Homo sapiens
tgtgactagaaattcttaa

SEQ ID NO: 3006965 - DNA, 18 bp, Homo sapiens
tgtgactataaagctgtt

SEQ ID NO: 3006966 - DNA, 19 bp, Homo sapiens
tgtgactataaagctgtta

SEQ ID NO: 3006967 - DNA, 16 bp, Homo sapiens
tgtgactcagcagagg

SEQ ID NO: 3006968 - DNA, 20 bp, Homo sapiens
tgtgactcagcagaggcagt

SEQ ID NO: 3006969 - DNA, 16 bp, Homo sapiens
tgtgactctggcttgg

SEQ ID NO: 3006970 - DNA, 17 bp, Homo sapiens
tgtgactctgggcaggg

SEQ ID NO: 3006971 - DNA, 12 bp, Homo sapiens
tgtgactctttc

SEQ ID NO: 3006972 - DNA, 15 bp, Homo sapiens
tgtgactctttccaa

SEQ ID NO: 3006973 - DNA, 17 bp, Homo sapiens
tgtgactctttccaacc

SEQ ID NO: 3006974 - DNA, 20 bp, Homo sapiens
tgtgactgtggccctgtctg

SEQ ID NO: 3006975 - DNA, 15 bp, Homo sapiens
tgtgagactactaag

SEQ ID NO: 3006976 - DNA, 15 bp, Homo sapiens
tgtgagaggtttgac

SEQ ID NO: 3006977 - DNA, 16 bp, Homo sapiens
tgtgagataacttcct

SEQ ID NO: 3006978 - DNA, 15 bp, Homo sapiens
tgtgagcagaagact

SEQ ID NO: 3006979 - DNA, 16 bp, Homo sapiens
tgtgagccctctaggg

SEQ ID NO: 3006980 - DNA, 15 bp, Homo sapiens
tgtgagcctctttgt

SEQ ID NO: 3006981 - DNA, 13 bp, Homo sapiens
tgtgaggccaggg

SEQ ID NO: 3006982 - DNA, 15 bp, Homo sapiens
tgtgaggccagggca

SEQ ID NO: 3006983 - DNA, 16 bp, Homo sapiens
tgtgaggccagggcag

SEQ ID NO: 3006984 - DNA, 15 bp, Homo sapiens
tgtgagggagtgcag

SEQ ID NO: 3006985 - DNA, 16 bp, Homo sapiens
tgtgagggcagcactg

SEQ ID NO: 3006986 - DNA, 15 bp, Homo sapiens
tgtgaggggcccctg

SEQ ID NO: 3006987 - DNA, 20 bp, Homo sapiens
tgtgaggggcccctggccca

SEQ ID NO: 3006988 - DNA, 16 bp, Homo sapiens
tgtgaggtgaatgtct

SEQ ID NO: 3006989 - DNA, 16 bp, Homo sapiens
tgtgaggtttcccaat

SEQ ID NO: 3006990 - DNA, 22 bp, Homo sapiens
ttaaattctttttcaaaaatta

SEQ ID NO: 3006991 - DNA, 15 bp, Homo sapiens
ttaaatttctaccgc

SEQ ID NO: 3006992 - DNA, 16 bp, Homo sapiens
ttaaattttacccttt

SEQ ID NO: 3006993 - DNA, 23 bp, Homo sapiens
ttaaattttaccctttagactgt

SEQ ID NO: 3006994 - DNA, 15 bp, Homo sapiens
ttaaattttgtaatg

SEQ ID NO: 3006995 - DNA, 13 bp, Homo sapiens
ttaacaaatgcta

SEQ ID NO: 3006996 - DNA, 13 bp, Homo sapiens
ttaacaatgtatt

SEQ ID NO: 3006997 - DNA, 20 bp, Homo sapiens
ttaacacaatgtgaatttct

SEQ ID NO: 3006998 - DNA, 20 bp, Homo sapiens
ttaacacagtacctaagact

SEQ ID NO: 3006999 - DNA, 22 bp, Homo sapiens
ttaacacagtacctaagactaa

SEQ ID NO: 3007000 - DNA, 22 bp, Homo sapiens
ttaacacattgttatttctgta

SEQ ID NO: 3007001 - DNA, 17 bp, Homo sapiens
ttaacacattttgtata

SEQ ID NO: 3007002 - DNA, 22 bp, Homo sapiens
ttaacacattttgtataattgt

SEQ ID NO: 3007003 - DNA, 17 bp, Homo sapiens
ttaacacctgatgtgta

SEQ ID NO: 3007004 - DNA, 20 bp, Homo sapiens
ttaacacctgatgtgtacat

SEQ ID NO: 3007005 - DNA, 14 bp, Homo sapiens
ttaacagaaaaaca

SEQ ID NO: 3007006 - DNA, 23 bp, Homo sapiens
ttaacagagttttctgttgcatt

SEQ ID NO: 3007007 - DNA, 13 bp, Homo sapiens
ttaacagggaggg

SEQ ID NO: 3007008 - DNA, 13 bp, Homo sapiens
ttaacaggtattt

SEQ ID NO: 3007009 - DNA, 17 bp, Homo sapiens
ttaacaggtattttcac

SEQ ID NO: 3007010 - DNA, 22 bp, Homo sapiens
ttaacaggttttcttctaatca

SEQ ID NO: 3007011 - DNA, 22 bp, Homo sapiens
ttaacatcagaactgaaataaa

SEQ ID NO: 3007012 - DNA, 21 bp, Homo sapiens
ttaacatgacatttaccagca

SEQ ID NO: 3007013 - DNA, 15 bp, Homo sapiens
ttaacattcatagag

SEQ ID NO: 3007014 - DNA, 19 bp, Homo sapiens
ttaacattccaagactcta

SEQ ID NO: 3007015 - DNA, 19 bp, Homo sapiens
ttaacatttatctaaaaga

SEQ ID NO: 3007016 - DNA, 20 bp, Homo sapiens
ttaaccgatgctttaccaaa

SEQ ID NO: 3007017 - DNA, 17 bp, Homo sapiens
ttaaccgtttttcaaga

SEQ ID NO: 3007018 - DNA, 21 bp, Homo sapiens
ttaaccttactaattatacta

SEQ ID NO: 3007019 - DNA, 21 bp, Homo sapiens
ttaacctttgctatgtaaggg

SEQ ID NO: 3007020 - DNA, 17 bp, Homo sapiens
ttaacgtatgtatttca

SEQ ID NO: 3007021 - DNA, 19 bp, Homo sapiens
ttaacgtcacccaaaagca

SEQ ID NO: 3007022 - DNA, 19 bp, Homo sapiens
ttaactactatattgattg

SEQ ID NO: 3007023 - DNA, 14 bp, Homo sapiens
ttaactatgatcat

SEQ ID NO: 3007024 - DNA, 16 bp, Homo sapiens
ttaactcattagactg

SEQ ID NO: 3007025 - DNA, 17 bp, Homo sapiens
ttaactcattagactgg

SEQ ID NO: 3007026 - DNA, 16 bp, Homo sapiens
ttaactcgttgcagtc

SEQ ID NO: 3007027 - DNA, 13 bp, Homo sapiens
ttaactctgtctt

SEQ ID NO: 3007028 - DNA, 16 bp, Homo sapiens
ttaactcttaactgaa

SEQ ID NO: 3007029 - DNA, 21 bp, Homo sapiens
ttaactgaagaaagagaagtc

SEQ ID NO: 3007030 - DNA, 19 bp, Homo sapiens
ttaactgaagatattccaa

SEQ ID NO: 3007031 - DNA, 17 bp, Homo sapiens
ttaactgccaatcctta

SEQ ID NO: 3007032 - DNA, 14 bp, Homo sapiens
ttaacttaaaattg

SEQ ID NO: 3007033 - DNA, 17 bp, Homo sapiens
ttaacttatttatatga

SEQ ID NO: 3007034 - DNA, 16 bp, Homo sapiens
ttaacttttttcttta

SEQ ID NO: 3007035 - DNA, 15 bp, Homo sapiens
ttaagaaagcactta

SEQ ID NO: 3007036 - DNA, 17 bp, Homo sapiens
ttaagaaagtgtctctg

SEQ ID NO: 3007037 - DNA, 19 bp, Homo sapiens
ttaagaatagtctctgggt

SEQ ID NO: 3007038 - DNA, 15 bp, Homo sapiens
ttaagacaccaaata

SEQ ID NO: 3007039 - DNA, 20 bp, Homo sapiens
ttaagacctactgttctaaa

SEQ ID NO: 3007040 - DNA, 18 bp, Homo sapiens
ttaagacctggcagctct

SEQ ID NO: 3007041 - DNA, 22 bp, Homo sapiens
ttaagagaacaaagagtgaaat

SEQ ID NO: 3007042 - DNA, 23 bp, Homo sapiens
ttaagagaacaaagagtgaaata

SEQ ID NO: 3007043 - DNA, 13 bp, Homo sapiens
ttaagagactcac

SEQ ID NO: 3007044 - DNA, 14 bp, Homo sapiens
ttaagagactcact

SEQ ID NO: 3007045 - DNA, 19 bp, Homo sapiens
ttaagaggctttggcccaa

SEQ ID NO: 3007046 - DNA, 16 bp, Homo sapiens
ttaagatgtccagggc

SEQ ID NO: 3007047 - DNA, 15 bp, Homo sapiens
ttaagattcagtttt

SEQ ID NO: 3007048 - DNA, 18 bp, Homo sapiens
ttaagattctctgcccag

SEQ ID NO: 3007049 - DNA, 19 bp, Homo sapiens
ttaagcaacatctttttaa

SEQ ID NO: 3007050 - DNA, 12 bp, Homo sapiens
ttaagcatgagt

SEQ ID NO: 3007051 - DNA, 18 bp, Homo sapiens
ttaagcatgagtggcctt

SEQ ID NO: 3007052 - DNA, 17 bp, Homo sapiens
ttaagccaggaaacatg

SEQ ID NO: 3007053 - DNA, 13 bp, Homo sapiens
ttaagcccaatct

SEQ ID NO: 3007054 - DNA, 23 bp, Homo sapiens
ttaaggaaaactacctgtattta

SEQ ID NO: 3007055 - DNA, 23 bp, Homo sapiens
ttaaggaatcaaatcttacaaaa

SEQ ID NO: 3007056 - DNA, 17 bp, Homo sapiens
ttaaggagggagaaagg

SEQ ID NO: 3007057 - DNA, 16 bp, Homo sapiens
ttaaggctctgtgcct

SEQ ID NO: 3007058 - DNA, 22 bp, Homo sapiens
ttaagggccacctacaatacat

SEQ ID NO: 3007059 - DNA, 23 bp, Homo sapiens
ttaaggtgtgcagtgtttttcct

SEQ ID NO: 3007060 - DNA, 18 bp, Homo sapiens
ttaagtacaagcacattt

SEQ ID NO: 3007061 - DNA, 23 bp, Homo sapiens
ttaagtattgattctgcttgaga

SEQ ID NO: 3007062 - DNA, 16 bp, Homo sapiens
ttaagtgatgtcattt

SEQ ID NO: 3007063 - DNA, 22 bp, Homo sapiens
ttaagtgtgcagccatagtttg

SEQ ID NO: 3007064 - DNA, 14 bp, Homo sapiens
ttaagttatgtgtg

SEQ ID NO: 3007065 - DNA, 14 bp, Homo sapiens
ttaagttcactttt

SEQ ID NO: 3007066 - DNA, 16 bp, Homo sapiens
ttaagttggctagagc

SEQ ID NO: 3007067 - DNA, 16 bp, Homo sapiens
ttaagttgtaaaatgt

SEQ ID NO: 3007068 - DNA, 16 bp, Homo sapiens
ttaagttgtttgcatg

SEQ ID NO: 3007069 - DNA, 20 bp, Homo sapiens
ttaagtttccttccagccca

SEQ ID NO: 3007070 - DNA, 17 bp, Homo sapiens
ttaataaaaatgacaga

SEQ ID NO: 3007071 - DNA, 16 bp, Homo sapiens
ttaataaatagagcaa

SEQ ID NO: 3007072 - DNA, 16 bp, Homo sapiens
ttaataactttgctgg

SEQ ID NO: 3007073 - DNA, 20 bp, Homo sapiens
ttaataagttgatgttttct

SEQ ID NO: 3007074 - DNA, 22 bp, Homo sapiens
ttaataagttgatgttttctaa

SEQ ID NO: 3007075 - DNA, 21 bp, Homo sapiens
ttaatacagataagtgttctt

SEQ ID NO: 3007076 - DNA, 17 bp, Homo sapiens
ttaatactgaatttctt

SEQ ID NO: 3007077 - DNA, 23 bp, Homo sapiens
ttaatagaacacagagtgtgttt

SEQ ID NO: 3007078 - DNA, 22 bp, Homo sapiens
ttaatagggtgagcttgagagt

SEQ ID NO: 3007079 - DNA, 18 bp, Homo sapiens
ttaatagtgttaatcaat

SEQ ID NO: 3007080 - DNA, 19 bp, Homo sapiens
ttaatagtgttaatcaatt

SEQ ID NO: 3007081 - DNA, 22 bp, Homo sapiens
ttaatatgattctagtacataa

SEQ ID NO: 3007082 - DNA, 14 bp, Homo sapiens
ttaatatgttgact

SEQ ID NO: 3007083 - DNA, 15 bp, Homo sapiens
ttaatattagcttgc

SEQ ID NO: 3007084 - DNA, 16 bp, Homo sapiens
ttaatattattactgt

SEQ ID NO: 3007085 - DNA, 22 bp, Homo sapiens
ttaatattgtattgctgctgtg

SEQ ID NO: 3007086 - DNA, 16 bp, Homo sapiens
ttaatatttgctaaat

SEQ ID NO: 3007087 - DNA, 14 bp, Homo sapiens
ttaatatttgtgct

SEQ ID NO: 3007088 - DNA, 13 bp, Homo sapiens
ttaatcaactgta

SEQ ID NO: 3007089 - DNA, 14 bp, Homo sapiens
ttaatcagtgttga

SEQ ID NO: 3007090 - DNA, 15 bp, Homo sapiens
ttaatcagtgttgat

SEQ ID NO: 3007091 - DNA, 13 bp, Homo sapiens
ttaatcatgaaat

SEQ ID NO: 3007092 - DNA, 20 bp, Homo sapiens
ttaatcatgagcctgtttat

SEQ ID NO: 3007093 - DNA, 22 bp, Homo sapiens
ttaatcatgagcctgtttattg

SEQ ID NO: 3007094 - DNA, 24 bp, Homo sapiens
ttaatcatgagcctgtttattgcc

SEQ ID NO: 3007095 - DNA, 13 bp, Homo sapiens
ttaatcattttca

SEQ ID NO: 3007096 - DNA, 15 bp, Homo sapiens
ttaatcattttcatt

SEQ ID NO: 3007097 - DNA, 23 bp, Homo sapiens
ttaatccaatcaatttaaatgtt

SEQ ID NO: 3007098 - DNA, 13 bp, Homo sapiens
ttaatcccagcac

SEQ ID NO: 3007099 - DNA, 21 bp, Homo sapiens
ttaatccgtagttattttgca

SEQ ID NO: 3007100 - DNA, 15 bp, Homo sapiens
ttaatgaaccttaga

SEQ ID NO: 3007101 - DNA, 22 bp, Homo sapiens
ttaatgaatcgtaatgaagttg

SEQ ID NO: 3007102 - DNA, 15 bp, Homo sapiens
ttaatgagaagatat

SEQ ID NO: 3007103 - DNA, 18 bp, Homo sapiens
ttaatgatgttatcttaa

SEQ ID NO: 3007104 - DNA, 11 bp, Homo sapiens
ttaatgcactt

SEQ ID NO: 3007105 - DNA, 12 bp, Homo sapiens
ttaatgcacttt

SEQ ID NO: 3007106 - DNA, 15 bp, Homo sapiens
ttaatgcactttcta

SEQ ID NO: 3007107 - DNA, 12 bp, Homo sapiens
ttaatgcccagc

SEQ ID NO: 3007108 - DNA, 14 bp, Homo sapiens
ttaatgctatttga

SEQ ID NO: 3007109 - DNA, 21 bp, Homo sapiens
ttaatgctatttgaacaagtg

SEQ ID NO: 3007110 - DNA, 19 bp, Homo sapiens
ttaatgctgcctgcctttt

SEQ ID NO: 3007111 - DNA, 13 bp, Homo sapiens
ttaatgctgtctt

SEQ ID NO: 3007112 - DNA, 22 bp, Homo sapiens
ttaatggccggctggaaatgct

SEQ ID NO: 3007113 - DNA, 18 bp, Homo sapiens
ttaatgtgaactctcccc

SEQ ID NO: 3007114 - DNA, 19 bp, Homo sapiens
ttaatgtgaactctcccct

SEQ ID NO: 3007115 - DNA, 12 bp, Homo sapiens
ttaatgtgaaga

SEQ ID NO: 3007116 - DNA, 23 bp, Homo sapiens
ttaatgtgacctagcaataggca

SEQ ID NO: 3007117 - DNA, 16 bp, Homo sapiens
ttaatgtgctgtgtaa

SEQ ID NO: 3007118 - DNA, 16 bp, Homo sapiens
ttaatgtggttgaaga

SEQ ID NO: 3007119 - DNA, 14 bp, Homo sapiens
ttaatgtgtaaaga

SEQ ID NO: 3007120 - DNA, 15 bp, Homo sapiens
ttaatgtttaaaaca

SEQ ID NO: 3007121 - DNA, 23 bp, Homo sapiens
ttaatgtttatacagagtaatta

SEQ ID NO: 3007122 - DNA, 10 bp, Homo sapiens
ttaatgtttt

SEQ ID NO: 3007123 - DNA, 15 bp, Homo sapiens
ttaattagcattctg

SEQ ID NO: 3007124 - DNA, 15 bp, Homo sapiens
ttaattataaacagc

SEQ ID NO: 3007125 - DNA, 17 bp, Homo sapiens
ttaattataaacagcag

SEQ ID NO: 3007126 - DNA, 18 bp, Homo sapiens
ttaattatgtacaacatt

SEQ ID NO: 3007127 - DNA, 13 bp, Homo sapiens
ttaattatttaaa

SEQ ID NO: 3007128 - DNA, 22 bp, Homo sapiens
ttaattccatgaatcgcttctc

SEQ ID NO: 3007129 - DNA, 22 bp, Homo sapiens
ttaattgacagtcactcagcca

SEQ ID NO: 3007130 - DNA, 12 bp, Homo sapiens
ttaattgctgca

SEQ ID NO: 3007131 - DNA, 23 bp, Homo sapiens
ttaattgcttataacaagcatat

SEQ ID NO: 3007132 - DNA, 12 bp, Homo sapiens
ttaattgctttg

SEQ ID NO: 3007133 - DNA, 20 bp, Homo sapiens
ttaattggtttaaagtccct

SEQ ID NO: 3007134 - DNA, 21 bp, Homo sapiens
ttaatttaactttccagtctt

SEQ ID NO: 3007135 - DNA, 14 bp, Homo sapiens
ttaatttatgcaga

SEQ ID NO: 3007136 - DNA, 12 bp, Homo sapiens
ttaatttcaaat

SEQ ID NO: 3007137 - DNA, 22 bp, Homo sapiens
ttaatttgcaaccatcagaatt

SEQ ID NO: 3007138 - DNA, 21 bp, Homo sapiens
ttaatttggataataaaaatt

SEQ ID NO: 3007139 - DNA, 19 bp, Homo sapiens
ttaattttagagaaacttt

SEQ ID NO: 3007140 - DNA, 18 bp, Homo sapiens
ttaattttggttgtattc

SEQ ID NO: 3007141 - DNA, 15 bp, Homo sapiens
ttaattttgtatttt

SEQ ID NO: 3007142 - DNA, 16 bp, Homo sapiens
ttaattttgtattttc

SEQ ID NO: 3007143 - DNA, 18 bp, Homo sapiens
ttaatttttaaaagactt

SEQ ID NO: 3007144 - DNA, 13 bp, Homo sapiens
ttaatttttaaga

SEQ ID NO: 3007145 - DNA, 15 bp, Homo sapiens
ttaatttttaagaga

SEQ ID NO: 3007146 - DNA, 20 bp, Homo sapiens
ttaattttttggtacaaaaa

SEQ ID NO: 3007147 - DNA, 16 bp, Homo sapiens
ttaattttttttggtt

SEQ ID NO: 3007148 - DNA, 18 bp, Homo sapiens
ttacaaaaatataaaata

SEQ ID NO: 3007149 - DNA, 12 bp, Homo sapiens
ttacaaaatact

SEQ ID NO: 3007150 - DNA, 13 bp, Homo sapiens
ttacaaattaata

SEQ ID NO: 3007151 - DNA, 15 bp, Homo sapiens
ttacaacagatttgt

SEQ ID NO: 3007152 - DNA, 16 bp, Homo sapiens
ttacaagcattagatt

SEQ ID NO: 3007153 - DNA, 20 bp, Homo sapiens
ttacaataaaactaaatgtg

SEQ ID NO: 3007154 - DNA, 13 bp, Homo sapiens
ttacaatatagat

SEQ ID NO: 3007155 - DNA, 18 bp, Homo sapiens
ttacaatcagtgtgaatg

SEQ ID NO: 3007156 - DNA, 18 bp, Homo sapiens
ttacaattttatctgttt

SEQ ID NO: 3007157 - DNA, 22 bp, Homo sapiens
ttacaatttttttaattttgta

SEQ ID NO: 3007158 - DNA, 20 bp, Homo sapiens
ttacacaatggtttttaaat

SEQ ID NO: 3007159 - DNA, 18 bp, Homo sapiens
ttacacagaaacactgcc

SEQ ID NO: 3007160 - DNA, 19 bp, Homo sapiens
ttacacagaaacactgcct

SEQ ID NO: 3007161 - DNA, 18 bp, Homo sapiens
ttacacagcaattttgta

SEQ ID NO: 3007162 - DNA, 20 bp, Homo sapiens
ttacacagcaattttgtatc

SEQ ID NO: 3007163 - DNA, 17 bp, Homo sapiens
ttacacatcttcaacag

SEQ ID NO: 3007164 - DNA, 23 bp, Homo sapiens
ttacaccacactttcaaagacaa

SEQ ID NO: 3007165 - DNA, 21 bp, Homo sapiens
ttacactacaagtttataagc

SEQ ID NO: 3007166 - DNA, 21 bp, Homo sapiens
ttacactggaggagagaagaa

SEQ ID NO: 3007167 - DNA, 20 bp, Homo sapiens
ttacactgtaccatatagca

SEQ ID NO: 3007168 - DNA, 13 bp, Homo sapiens
ttacagaaaaaga

SEQ ID NO: 3007169 - DNA, 16 bp, Homo sapiens
ttacagaaactgatgc

SEQ ID NO: 3007170 - DNA, 14 bp, Homo sapiens
ttacagcctctgac

SEQ ID NO: 3007171 - DNA, 15 bp, Homo sapiens
ttacagcctctgact

SEQ ID NO: 3007172 - DNA, 11 bp, Homo sapiens
ttacagctgtg

SEQ ID NO: 3007173 - DNA, 14 bp, Homo sapiens
ttacaggatcatgt

SEQ ID NO: 3007174 - DNA, 20 bp, Homo sapiens
ttacaggcatggacatgcag

SEQ ID NO: 3007175 - DNA, 18 bp, Homo sapiens
ttacaggcgtgagccact

SEQ ID NO: 3007176 - DNA, 17 bp, Homo sapiens
ttacagttaaggaatat

SEQ ID NO: 3007177 - DNA, 18 bp, Homo sapiens
ttacataactgatctatt

SEQ ID NO: 3007178 - DNA, 23 bp, Homo sapiens
ttacataagagaaagaggccaga

SEQ ID NO: 3007179 - DNA, 20 bp, Homo sapiens
ttacataattcactctgagt

SEQ ID NO: 3007180 - DNA, 17 bp, Homo sapiens
ttacatactaggtgcct

SEQ ID NO: 3007181 - DNA, 16 bp, Homo sapiens
ttacatgcataaaagg

SEQ ID NO: 3007182 - DNA, 18 bp, Homo sapiens
ttacatgcatacttcaaa

SEQ ID NO: 3007183 - DNA, 22 bp, Homo sapiens
ttacatgcatacttcaaaagta

SEQ ID NO: 3007184 - DNA, 17 bp, Homo sapiens
ttacatggacagaattt

SEQ ID NO: 3007185 - DNA, 16 bp, Homo sapiens
ttacatgtaatttgat

SEQ ID NO: 3007186 - DNA, 20 bp, Homo sapiens
ttacatgtaatttgatgagg

SEQ ID NO: 3007187 - DNA, 17 bp, Homo sapiens
ttacatgtattatttca

SEQ ID NO: 3007188 - DNA, 16 bp, Homo sapiens
ttacatgtttataaat

SEQ ID NO: 3007189 - DNA, 18 bp, Homo sapiens
ttacattaaaaagcctta

SEQ ID NO: 3007190 - DNA, 22 bp, Homo sapiens
ttacattaaaaagccttacagt

SEQ ID NO: 3007191 - DNA, 17 bp, Homo sapiens
ttacattaatgcccagc

SEQ ID NO: 3007192 - DNA, 19 bp, Homo sapiens
ttacattaatgcccagcca

SEQ ID NO: 3007193 - DNA, 16 bp, Homo sapiens
ttaccaaagtgtcttt

SEQ ID NO: 3007194 - DNA, 17 bp, Homo sapiens
ttaccaacatgtatctg

SEQ ID NO: 3007195 - DNA, 12 bp, Homo sapiens
ttaccacagagt

SEQ ID NO: 3007196 - DNA, 22 bp, Homo sapiens
ttaccacatcacaccacttgga

SEQ ID NO: 3007197 - DNA, 19 bp, Homo sapiens
ttaccactggtaacatgtg

SEQ ID NO: 3007198 - DNA, 21 bp, Homo sapiens
ttaccactggtaacatgtgac

SEQ ID NO: 3007199 - DNA, 19 bp, Homo sapiens
ttaccagatgctgactggc

SEQ ID NO: 3007200 - DNA, 17 bp, Homo sapiens
ttacccaagtcttctcc

SEQ ID NO: 3007201 - DNA, 16 bp, Homo sapiens
ttacccacacacagat

SEQ ID NO: 3007202 - DNA, 20 bp, Homo sapiens
ttacccagggtggagtgcag

SEQ ID NO: 3007203 - DNA, 22 bp, Homo sapiens
ttacccagtattactgctgctg

SEQ ID NO: 3007204 - DNA, 18 bp, Homo sapiens
ttaccccaaagagaaaga

SEQ ID NO: 3007205 - DNA, 19 bp, Homo sapiens
ttaccccaaagagaaagag

SEQ ID NO: 3007206 - DNA, 22 bp, Homo sapiens
ttaccccacaacgtgcaactga

SEQ ID NO: 3007207 - DNA, 17 bp, Homo sapiens
ttacccccattcgcgct

SEQ ID NO: 3007208 - DNA, 13 bp, Homo sapiens
ttacccctcattt

SEQ ID NO: 3007209 - DNA, 13 bp, Homo sapiens
ttacccttagaat

SEQ ID NO: 3007210 - DNA, 21 bp, Homo sapiens
ttacccttcctcatctgtgcc

SEQ ID NO: 3007211 - DNA, 13 bp, Homo sapiens
ttacctcctgccc

SEQ ID NO: 3007212 - DNA, 14 bp, Homo sapiens
ttacctcctgccca

SEQ ID NO: 3007213 - DNA, 15 bp, Homo sapiens
ttacctcctgcccag

SEQ ID NO: 3007214 - DNA, 19 bp, Homo sapiens
ttacctgatcaatgacaga

SEQ ID NO: 3007215 - DNA, 20 bp, Homo sapiens
ttacctgatcaatgacagag

SEQ ID NO: 3007216 - DNA, 13 bp, Homo sapiens
ttacctggtgctc

SEQ ID NO: 3007217 - DNA, 23 bp, Homo sapiens
ttaccttattgagcgtgattctg

SEQ ID NO: 3007218 - DNA, 15 bp, Homo sapiens
ttacgatcaggcaca

SEQ ID NO: 3007219 - DNA, 16 bp, Homo sapiens
ttacgcaaggaaggac

SEQ ID NO: 3007220 - DNA, 15 bp, Homo sapiens
ttacgctttgattca

SEQ ID NO: 3007221 - DNA, 22 bp, Homo sapiens
ttactaaagaaaatatctgaaa

SEQ ID NO: 3007222 - DNA, 21 bp, Homo sapiens
ttactaagatgacattgctaa

SEQ ID NO: 3007223 - DNA, 22 bp, Homo sapiens
ttactaagatgacattgctaag

SEQ ID NO: 3007224 - DNA, 17 bp, Homo sapiens
ttactaattatactact

SEQ ID NO: 3007225 - DNA, 14 bp, Homo sapiens
ttactaccctcacc

SEQ ID NO: 3007226 - DNA, 16 bp, Homo sapiens
ttactaccctcaccct

SEQ ID NO: 3007227 - DNA, 21 bp, Homo sapiens
ttactacttctctctgtattt

SEQ ID NO: 3007228 - DNA, 18 bp, Homo sapiens
ttactatgcctgtgtctt

SEQ ID NO: 3007229 - DNA, 13 bp, Homo sapiens
ttactattcccac

SEQ ID NO: 3007230 - DNA, 18 bp, Homo sapiens
ttactcaaaatctgtcat

SEQ ID NO: 3007231 - DNA, 20 bp, Homo sapiens
ttactcaccatatttgaatt

SEQ ID NO: 3007232 - DNA, 13 bp, Homo sapiens
ttactcagagctg

SEQ ID NO: 3007233 - DNA, 15 bp, Homo sapiens
ttactcagagctgcg

SEQ ID NO: 3007234 - DNA, 15 bp, Homo sapiens
ttactcatctttatc

SEQ ID NO: 3007235 - DNA, 15 bp, Homo sapiens
ttactcctcacactt

SEQ ID NO: 3007236 - DNA, 14 bp, Homo sapiens
ttactctaagatct

SEQ ID NO: 3007237 - DNA, 16 bp, Homo sapiens
ttactgaagcctttct

SEQ ID NO: 3007238 - DNA, 12 bp, Homo sapiens
ttactgacttgg

SEQ ID NO: 3007239 - DNA, 22 bp, Homo sapiens
ttactgagcgcaagccacagcc

SEQ ID NO: 3007240 - DNA, 14 bp, Homo sapiens
ttactgataatttt

SEQ ID NO: 3007241 - DNA, 21 bp, Homo sapiens
ttactgatcttacctttatga

SEQ ID NO: 3007242 - DNA, 15 bp, Homo sapiens
ttactgcaatcactg

SEQ ID NO: 3007243 - DNA, 21 bp, Homo sapiens
ttactgctatctactaagttt

SEQ ID NO: 3007244 - DNA, 16 bp, Homo sapiens
ttactgctgctgtgct

SEQ ID NO: 3007245 - DNA, 14 bp, Homo sapiens
ttactgggccctga

SEQ ID NO: 3007246 - DNA, 22 bp, Homo sapiens
ttactggggctggggaaggaag

SEQ ID NO: 3007247 - DNA, 12 bp, Homo sapiens
ttactgtaaatt

SEQ ID NO: 3007248 - DNA, 15 bp, Homo sapiens
ttactgtaactgatt

SEQ ID NO: 3007249 - DNA, 17 bp, Homo sapiens
ttactgtaagacattag

SEQ ID NO: 3007250 - DNA, 17 bp, Homo sapiens
ttactgtcttaaatcag

SEQ ID NO: 3007251 - DNA, 20 bp, Homo sapiens
ttactgtcttaaatcagttt

SEQ ID NO: 3007252 - DNA, 17 bp, Homo sapiens
ttactgtcttttctatt

SEQ ID NO: 3007253 - DNA, 16 bp, Homo sapiens
ttactgttatttaatt

SEQ ID NO: 3007254 - DNA, 21 bp, Homo sapiens
ttactgttgataattcttatt

SEQ ID NO: 3007255 - DNA, 16 bp, Homo sapiens
ttacttaaacatcatt

SEQ ID NO: 3007256 - DNA, 13 bp, Homo sapiens
ttacttaaagatt

SEQ ID NO: 3007257 - DNA, 13 bp, Homo sapiens
ttacttaagattc

SEQ ID NO: 3007258 - DNA, 19 bp, Homo sapiens
ttacttaagattcagtttt

SEQ ID NO: 3007259 - DNA, 17 bp, Homo sapiens
ttacttatcatccacat

SEQ ID NO: 3007260 - DNA, 13 bp, Homo sapiens
ttacttccagcaa

SEQ ID NO: 3007261 - DNA, 21 bp, Homo sapiens
ttacttccagcaaaatccaaa

SEQ ID NO: 3007262 - DNA, 12 bp, Homo sapiens
ttacttccccca

SEQ ID NO: 3007263 - DNA, 20 bp, Homo sapiens
tgaggccggccctgcccctc

SEQ ID NO: 3007264 - DNA, 22 bp, Homo sapiens
tgaggccggccctgcccctccc

SEQ ID NO: 3007265 - DNA, 23 bp, Homo sapiens
tgaggccggccctgcccctccct

SEQ ID NO: 3007266 - DNA, 14 bp, Homo sapiens
tgaggcctcccttg

SEQ ID NO: 3007267 - DNA, 14 bp, Homo sapiens
tgaggcctgagacc

SEQ ID NO: 3007268 - DNA, 16 bp, Homo sapiens
tgaggcctgagaccca

SEQ ID NO: 3007269 - DNA, 20 bp, Homo sapiens
tgaggcctgagacccaggac

SEQ ID NO: 3007270 - DNA, 23 bp, Homo sapiens
tgaggcctgagacccaggactcc

SEQ ID NO: 3007271 - DNA, 16 bp, Homo sapiens
tgaggcgttctcctgc

SEQ ID NO: 3007272 - DNA, 21 bp, Homo sapiens
tgaggctcaggggtgtgcctg

SEQ ID NO: 3007273 - DNA, 13 bp, Homo sapiens
tgaggctgctgcc

SEQ ID NO: 3007274 - DNA, 16 bp, Homo sapiens
tgaggctgctgccatc

SEQ ID NO: 3007275 - DNA, 16 bp, Homo sapiens
tgaggctgctttccaa

SEQ ID NO: 3007276 - DNA, 16 bp, Homo sapiens
tgaggctttaaaaaga

SEQ ID NO: 3007277 - DNA, 18 bp, Homo sapiens
tgaggctttggatttgac

SEQ ID NO: 3007278 - DNA, 14 bp, Homo sapiens
tgagggagcctggc

SEQ ID NO: 3007279 - DNA, 15 bp, Homo sapiens
tgagggagggagcca

SEQ ID NO: 3007280 - DNA, 20 bp, Homo sapiens
tgagggagggagccatggaa

SEQ ID NO: 3007281 - DNA, 17 bp, Homo sapiens
tgagggagtgcagaaca

SEQ ID NO: 3007282 - DNA, 23 bp, Homo sapiens
tgagggagtgcagaacacctggc

SEQ ID NO: 3007283 - DNA, 22 bp, Homo sapiens
tgagggcagaaaccttgtttgt

SEQ ID NO: 3007284 - DNA, 22 bp, Homo sapiens
tgagggcagcactgggaagctg

SEQ ID NO: 3007285 - DNA, 16 bp, Homo sapiens
tgagggcatctctgag

SEQ ID NO: 3007286 - DNA, 15 bp, Homo sapiens
tgagggccctgtgga

SEQ ID NO: 3007287 - DNA, 13 bp, Homo sapiens
tgaggggaaaaaa

SEQ ID NO: 3007288 - DNA, 20 bp, Homo sapiens
tgaggggcccctggcccagg

SEQ ID NO: 3007289 - DNA, 16 bp, Homo sapiens
tgaggggctggggagg

SEQ ID NO: 3007290 - DNA, 19 bp, Homo sapiens
tgaggggctggggaggggg

SEQ ID NO: 3007291 - DNA, 20 bp, Homo sapiens
tgaggggtgtccgagaggct

SEQ ID NO: 3007292 - DNA, 14 bp, Homo sapiens
tgagggtgtttctt

SEQ ID NO: 3007293 - DNA, 19 bp, Homo sapiens
tgaggtggaagagggctgc

SEQ ID NO: 3007294 - DNA, 15 bp, Homo sapiens
tgaggtggaagccct

SEQ ID NO: 3007295 - DNA, 21 bp, Homo sapiens
tgaggtggaagccctccttcc

SEQ ID NO: 3007296 - DNA, 21 bp, Homo sapiens
tgaggtggcctccttgcttgt

SEQ ID NO: 3007297 - DNA, 21 bp, Homo sapiens
tgaggtggtagtaaaacacag

SEQ ID NO: 3007298 - DNA, 17 bp, Homo sapiens
tgaggtgtctggcctga

SEQ ID NO: 3007299 - DNA, 21 bp, Homo sapiens
tgaggtgtctggcctgaggtc

SEQ ID NO: 3007300 - DNA, 24 bp, Homo sapiens
tgaggttgatatcggtgctatgtg

SEQ ID NO: 3007301 - DNA, 14 bp, Homo sapiens
tgagtacagatact

SEQ ID NO: 3007302 - DNA, 21 bp, Homo sapiens
tgagtacagatactgtgagct

SEQ ID NO: 3007303 - DNA, 13 bp, Homo sapiens
tgagtactgttaa

SEQ ID NO: 3007304 - DNA, 17 bp, Homo sapiens
tgagtaggccctgcttt

SEQ ID NO: 3007305 - DNA, 15 bp, Homo sapiens
tgagtatctcctcgc

SEQ ID NO: 3007306 - DNA, 13 bp, Homo sapiens
tgagtatgggaca

SEQ ID NO: 3007307 - DNA, 19 bp, Homo sapiens
tgagtatttggtccaaaaa

SEQ ID NO: 3007308 - DNA, 16 bp, Homo sapiens
tgagtcagtgatgagg

SEQ ID NO: 3007309 - DNA, 21 bp, Homo sapiens
tgagtcatgatctccctgccg

SEQ ID NO: 3007310 - DNA, 17 bp, Homo sapiens
tgagtccgcctgcgcct

SEQ ID NO: 3007311 - DNA, 14 bp, Homo sapiens
tgagtcctggccca

SEQ ID NO: 3007312 - DNA, 16 bp, Homo sapiens
tgagtccttgaaaata

SEQ ID NO: 3007313 - DNA, 14 bp, Homo sapiens
tgagtctgggcagc

SEQ ID NO: 3007314 - DNA, 15 bp, Homo sapiens
tgagtctgttgtgtg

SEQ ID NO: 3007315 - DNA, 20 bp, Homo sapiens
tgagtctttggttctaagga

SEQ ID NO: 3007316 - DNA, 17 bp, Homo sapiens
tgagtgccttttgcaga

SEQ ID NO: 3007317 - DNA, 18 bp, Homo sapiens
tgagtggatgatgtttcg

SEQ ID NO: 3007318 - DNA, 15 bp, Homo sapiens
tgagtggccagcgcc

SEQ ID NO: 3007319 - DNA, 18 bp, Homo sapiens
tgagtggccagcgccagg

SEQ ID NO: 3007320 - DNA, 20 bp, Homo sapiens
tgagtggccagcgccagggc

SEQ ID NO: 3007321 - DNA, 12 bp, Homo sapiens
tgagtggcccca

SEQ ID NO: 3007322 - DNA, 15 bp, Homo sapiens
tgagtggccccacct

SEQ ID NO: 3007323 - DNA, 17 bp, Homo sapiens
tgagtggccccacctgt

SEQ ID NO: 3007324 - DNA, 13 bp, Homo sapiens
tgagtgtgaagct

SEQ ID NO: 3007325 - DNA, 15 bp, Homo sapiens
tgagtgtgagggcag

SEQ ID NO: 3007326 - DNA, 21 bp, Homo sapiens
tgagtgtgatgggccaccggg

SEQ ID NO: 3007327 - DNA, 23 bp, Homo sapiens
tgagtgtgctgctgtaagaaatc

SEQ ID NO: 3007328 - DNA, 21 bp, Homo sapiens
tgagtgttcctttttaaatgt

SEQ ID NO: 3007329 - DNA, 18 bp, Homo sapiens
tgagtgtttaataaagtt

SEQ ID NO: 3007330 - DNA, 15 bp, Homo sapiens
tgagttactgtgcat

SEQ ID NO: 3007331 - DNA, 17 bp, Homo sapiens
tgagttaggaatgagaa

SEQ ID NO: 3007332 - DNA, 18 bp, Homo sapiens
tgagttaggaatgagaag

SEQ ID NO: 3007333 - DNA, 21 bp, Homo sapiens
tgagttattgagattgtcctc

SEQ ID NO: 3007334 - DNA, 15 bp, Homo sapiens
tgagttcaactacat

SEQ ID NO: 3007335 - DNA, 14 bp, Homo sapiens
tgagttcctagcca

SEQ ID NO: 3007336 - DNA, 11 bp, Homo sapiens
tgagttctcac

SEQ ID NO: 3007337 - DNA, 21 bp, Homo sapiens
tgagttctcactatgtttctc

SEQ ID NO: 3007338 - DNA, 20 bp, Homo sapiens
tgagttgcaccattctttct

SEQ ID NO: 3007339 - DNA, 14 bp, Homo sapiens
tgagtttcagctgg

SEQ ID NO: 3007340 - DNA, 19 bp, Homo sapiens
tgagtttctctcacattac

SEQ ID NO: 3007341 - DNA, 16 bp, Homo sapiens
tgagttttaaagaagt

SEQ ID NO: 3007342 - DNA, 15 bp, Homo sapiens
tgataaaaatgatat

SEQ ID NO: 3007343 - DNA, 16 bp, Homo sapiens
tgataaaaccatgtag

SEQ ID NO: 3007344 - DNA, 17 bp, Homo sapiens
tgataaaatgtaaattt

SEQ ID NO: 3007345 - DNA, 16 bp, Homo sapiens
tgataaaatgttcctt

SEQ ID NO: 3007346 - DNA, 14 bp, Homo sapiens
tgataaactttgct

SEQ ID NO: 3007347 - DNA, 13 bp, Homo sapiens
tgataaaggagag

SEQ ID NO: 3007348 - DNA, 23 bp, Homo sapiens
tgataaatggaactattccatca

SEQ ID NO: 3007349 - DNA, 23 bp, Homo sapiens
tgataacaagcaaggatatcaga

SEQ ID NO: 3007350 - DNA, 17 bp, Homo sapiens
tgataactttgcttgca

SEQ ID NO: 3007351 - DNA, 13 bp, Homo sapiens
tgataagatggtt

SEQ ID NO: 3007352 - DNA, 21 bp, Homo sapiens
tgataagattgaaattccagt

SEQ ID NO: 3007353 - DNA, 15 bp, Homo sapiens
tgataataatgctta

SEQ ID NO: 3007354 - DNA, 15 bp, Homo sapiens
tgataatagattctc

SEQ ID NO: 3007355 - DNA, 13 bp, Homo sapiens
tgataattttgct

SEQ ID NO: 3007356 - DNA, 20 bp, Homo sapiens
tgataattttttaattattt

SEQ ID NO: 3007357 - DNA, 14 bp, Homo sapiens
tgatacagaactct

SEQ ID NO: 3007358 - DNA, 14 bp, Homo sapiens
tgataccagctgga

SEQ ID NO: 3007359 - DNA, 13 bp, Homo sapiens
tgatagaactgta

SEQ ID NO: 3007360 - DNA, 14 bp, Homo sapiens
tgatagaactgtac

SEQ ID NO: 3007361 - DNA, 16 bp, Homo sapiens
tgatagaactgtactg

SEQ ID NO: 3007362 - DNA, 19 bp, Homo sapiens
tgatagacacatatgaggg

SEQ ID NO: 3007363 - DNA, 22 bp, Homo sapiens
tgatagacacatatgaggggga

SEQ ID NO: 3007364 - DNA, 14 bp, Homo sapiens
tgatagagcctttg

SEQ ID NO: 3007365 - DNA, 16 bp, Homo sapiens
tgatagagcctttgat

SEQ ID NO: 3007366 - DNA, 23 bp, Homo sapiens
tgatagcaagtgaatttttctct

SEQ ID NO: 3007367 - DNA, 17 bp, Homo sapiens
tgatagttactgttgtg

SEQ ID NO: 3007368 - DNA, 15 bp, Homo sapiens
tgatatgatttaaaa

SEQ ID NO: 3007369 - DNA, 15 bp, Homo sapiens
tgatattctaagact

SEQ ID NO: 3007370 - DNA, 17 bp, Homo sapiens
tgatattctaagactta

SEQ ID NO: 3007371 - DNA, 16 bp, Homo sapiens
tgatattgaccatgtg

SEQ ID NO: 3007372 - DNA, 19 bp, Homo sapiens
tgatattgaccatgtgatt

SEQ ID NO: 3007373 - DNA, 21 bp, Homo sapiens
tgatattgaccatgtgattat

SEQ ID NO: 3007374 - DNA, 12 bp, Homo sapiens
tgatattgctgt

SEQ ID NO: 3007375 - DNA, 22 bp, Homo sapiens
tgatatttattatatttttccc

SEQ ID NO: 3007376 - DNA, 16 bp, Homo sapiens
tgatatttcttgcttt

SEQ ID NO: 3007377 - DNA, 17 bp, Homo sapiens
tgatatttcttgctttc

SEQ ID NO: 3007378 - DNA, 16 bp, Homo sapiens
tgatcaacataatgga

SEQ ID NO: 3007379 - DNA, 13 bp, Homo sapiens
tgatcaaggcctt

SEQ ID NO: 3007380 - DNA, 12 bp, Homo sapiens
tgatcaatgaaa

SEQ ID NO: 3007381 - DNA, 19 bp, Homo sapiens
tgatcaatgacagagcctt

SEQ ID NO: 3007382 - DNA, 18 bp, Homo sapiens
tgatcaattatagtttct

SEQ ID NO: 3007383 - DNA, 14 bp, Homo sapiens
tgatcacaggagca

SEQ ID NO: 3007384 - DNA, 12 bp, Homo sapiens
tgatcagacagc

SEQ ID NO: 3007385 - DNA, 21 bp, Homo sapiens
tgatcagagccgtggtccttt

SEQ ID NO: 3007386 - DNA, 22 bp, Homo sapiens
tgatcagagccgtggtcctttg

SEQ ID NO: 3007387 - DNA, 20 bp, Homo sapiens
tgatcaggacctccaagcca

SEQ ID NO: 3007388 - DNA, 18 bp, Homo sapiens
tgatcaggcttcctggtg

SEQ ID NO: 3007389 - DNA, 16 bp, Homo sapiens
tgatcagggatccaat

SEQ ID NO: 3007390 - DNA, 12 bp, Homo sapiens
tgatcagtgttg

SEQ ID NO: 3007391 - DNA, 16 bp, Homo sapiens
tgatcatcgccagagg

SEQ ID NO: 3007392 - DNA, 15 bp, Homo sapiens
tgatcatctgctgtg

SEQ ID NO: 3007393 - DNA, 14 bp, Homo sapiens
tgatcatgtacttt

SEQ ID NO: 3007394 - DNA, 15 bp, Homo sapiens
tgatcatgtactttt

SEQ ID NO: 3007395 - DNA, 17 bp, Homo sapiens
tgatcatgtacttttta

SEQ ID NO: 3007396 - DNA, 19 bp, Homo sapiens
tgatcatgtactttttagt

SEQ ID NO: 3007397 - DNA, 19 bp, Homo sapiens
tgatccacccacctcagcc

SEQ ID NO: 3007398 - DNA, 15 bp, Homo sapiens
tgatccagccctgag

SEQ ID NO: 3007399 - DNA, 16 bp, Homo sapiens
tgatccatccagcttg

SEQ ID NO: 3007400 - DNA, 17 bp, Homo sapiens
tctcttttcctcgcaga

SEQ ID NO: 3007401 - DNA, 12 bp, Homo sapiens
tctcttttctct

SEQ ID NO: 3007402 - DNA, 15 bp, Homo sapiens
tctcttttctctact

SEQ ID NO: 3007403 - DNA, 14 bp, Homo sapiens
tctctttttgactc

SEQ ID NO: 3007404 - DNA, 21 bp, Homo sapiens
tctctttttgactcttgcaat

SEQ ID NO: 3007405 - DNA, 13 bp, Homo sapiens
tctgaaaaatgaa

SEQ ID NO: 3007406 - DNA, 15 bp, Homo sapiens
tctgaaaaatgaatg

SEQ ID NO: 3007407 - DNA, 16 bp, Homo sapiens
tctgaaaaatgaatgt

SEQ ID NO: 3007408 - DNA, 23 bp, Homo sapiens
tctgaaaaattcctttgtgtttc

SEQ ID NO: 3007409 - DNA, 19 bp, Homo sapiens
tctgaaaacccaaggccag

SEQ ID NO: 3007410 - DNA, 13 bp, Homo sapiens
tctgaaaagaaat

SEQ ID NO: 3007411 - DNA, 16 bp, Homo sapiens
tctgaaaagaggagcc

SEQ ID NO: 3007412 - DNA, 9 bp, Homo sapiens
tctgaaaca

SEQ ID NO: 3007413 - DNA, 17 bp, Homo sapiens
tctgaaacagctgcctt

SEQ ID NO: 3007414 - DNA, 20 bp, Homo sapiens
tctgaaaccagtgttaggga

SEQ ID NO: 3007415 - DNA, 22 bp, Homo sapiens
tctgaaaccttagtttcaagag

SEQ ID NO: 3007416 - DNA, 13 bp, Homo sapiens
tctgaaactccct

SEQ ID NO: 3007417 - DNA, 16 bp, Homo sapiens
tctgaaactcccttgt

SEQ ID NO: 3007418 - DNA, 18 bp, Homo sapiens
tctgaaactcccttgtgt

SEQ ID NO: 3007419 - DNA, 19 bp, Homo sapiens
tctgaaactcccttgtgtt

SEQ ID NO: 3007420 - DNA, 20 bp, Homo sapiens
tctgaaactcccttgtgttc

SEQ ID NO: 3007421 - DNA, 23 bp, Homo sapiens
tctgaaactcccttgtgttcctt

SEQ ID NO: 3007422 - DNA, 16 bp, Homo sapiens
tctgaaacttcccaac

SEQ ID NO: 3007423 - DNA, 15 bp, Homo sapiens
tctgaaagttgtaca

SEQ ID NO: 3007424 - DNA, 17 bp, Homo sapiens
tctgaaagttgtacatg

SEQ ID NO: 3007425 - DNA, 16 bp, Homo sapiens
tctgaaataaatgttc

SEQ ID NO: 3007426 - DNA, 17 bp, Homo sapiens
tctgaaataggaaacaa

SEQ ID NO: 3007427 - DNA, 20 bp, Homo sapiens
tctgaaattcacagaagcct

SEQ ID NO: 3007428 - DNA, 12 bp, Homo sapiens
tctgaacatctg

SEQ ID NO: 3007429 - DNA, 19 bp, Homo sapiens
tctgccccatcctccagca

SEQ ID NO: 3007430 - DNA, 18 bp, Homo sapiens
tctgccccccagggctag

SEQ ID NO: 3007431 - DNA, 17 bp, Homo sapiens
tctgccccctcagggat

SEQ ID NO: 3007432 - DNA, 21 bp, Homo sapiens
tctgcccctaaagatgggagg

SEQ ID NO: 3007433 - DNA, 21 bp, Homo sapiens
tctgcccgcctgcccacctgc

SEQ ID NO: 3007434 - DNA, 22 bp, Homo sapiens
tctgcccgcctgcccacctgcc

SEQ ID NO: 3007435 - DNA, 23 bp, Homo sapiens
tctgcccgcctgcccacctgcct

SEQ ID NO: 3007436 - DNA, 20 bp, Homo sapiens
tctgccctctgctgctgccc

SEQ ID NO: 3007437 - DNA, 20 bp, Homo sapiens
tctgccctgtgggaccccag

SEQ ID NO: 3007438 - DNA, 22 bp, Homo sapiens
tctgccctgtgggaccccaggc

SEQ ID NO: 3007439 - DNA, 18 bp, Homo sapiens
tctgcccttgccaacgga

SEQ ID NO: 3007440 - DNA, 15 bp, Homo sapiens
tctgccgctacctcc

SEQ ID NO: 3007441 - DNA, 16 bp, Homo sapiens
tctgccggccctgggg

SEQ ID NO: 3007442 - DNA, 18 bp, Homo sapiens
tctgcctagaaacagtgt

SEQ ID NO: 3007443 - DNA, 14 bp, Homo sapiens
tctgcctcaactcc

SEQ ID NO: 3007444 - DNA, 19 bp, Homo sapiens
tctgcctcaactccaccct

SEQ ID NO: 3007445 - DNA, 12 bp, Homo sapiens
tctgcctcatcc

SEQ ID NO: 3007446 - DNA, 17 bp, Homo sapiens
tctgcctcatcctcctc

SEQ ID NO: 3007447 - DNA, 19 bp, Homo sapiens
tctgcctcatcctcctcct

SEQ ID NO: 3007448 - DNA, 14 bp, Homo sapiens
tcttgaaaaaaaat

SEQ ID NO: 3007449 - DNA, 18 bp, Homo sapiens
tcttgaaaaaaaatagat

SEQ ID NO: 3007450 - DNA, 21 bp, Homo sapiens
tcttgaaaaaaaatagatgtt

SEQ ID NO: 3007451 - DNA, 13 bp, Homo sapiens
tcttgaaacctga

SEQ ID NO: 3007452 - DNA, 18 bp, Homo sapiens
tcttgaaacctgatgtca

SEQ ID NO: 3007453 - DNA, 18 bp, Homo sapiens
tcttgaaagaagaatgtg

SEQ ID NO: 3007454 - DNA, 18 bp, Homo sapiens
tcttgaactgagcttgga

SEQ ID NO: 3007455 - DNA, 13 bp, Homo sapiens
tcttgaaggtgct

SEQ ID NO: 3007456 - DNA, 23 bp, Homo sapiens
tcttgaatatgggcggaagtact

SEQ ID NO: 3007457 - DNA, 13 bp, Homo sapiens
tcttgaatttaat

SEQ ID NO: 3007458 - DNA, 21 bp, Homo sapiens
tcttgaatttaataatctgta

SEQ ID NO: 3007459 - DNA, 19 bp, Homo sapiens
tcttgaccaagcaggaagc

SEQ ID NO: 3007460 - DNA, 24 bp, Homo sapiens
tcttgactcaggtggtgtccttct

SEQ ID NO: 3007461 - DNA, 17 bp, Homo sapiens
tcttgagcaagttcctt

SEQ ID NO: 3007462 - DNA, 16 bp, Homo sapiens
tcttgagccagccagg

SEQ ID NO: 3007463 - DNA, 15 bp, Homo sapiens
tcttgaggtctcttt

SEQ ID NO: 3007464 - DNA, 19 bp, Homo sapiens
tcttgaggtctcttttctc

SEQ ID NO: 3007465 - DNA, 20 bp, Homo sapiens
tcttgaggtctcttttctct

SEQ ID NO: 3007466 - DNA, 19 bp, Homo sapiens
tcttgagtcatggatttct

SEQ ID NO: 3007467 - DNA, 13 bp, Homo sapiens
tcttgagtgttat

SEQ ID NO: 3007468 - DNA, 16 bp, Homo sapiens
tcttgatcttaaagat

SEQ ID NO: 3007469 - DNA, 21 bp, Homo sapiens
tcttgatgcatgcactgttcc

SEQ ID NO: 3007470 - DNA, 16 bp, Homo sapiens
tcttgcaagcatgctt

SEQ ID NO: 3007471 - DNA, 23 bp, Homo sapiens
tcttgcagttttgtaagccctct

SEQ ID NO: 3007472 - DNA, 21 bp, Homo sapiens
tcttgcattcatggttatgaa

SEQ ID NO: 3007473 - DNA, 20 bp, Homo sapiens
tcttgcccctccagagacag

SEQ ID NO: 3007474 - DNA, 15 bp, Homo sapiens
tcttgcctccaggtg

SEQ ID NO: 3007475 - DNA, 17 bp, Homo sapiens
tcttgcctccaggtgca

SEQ ID NO: 3007476 - DNA, 18 bp, Homo sapiens
tcttgctatattgcccag

SEQ ID NO: 3007477 - DNA, 21 bp, Homo sapiens
tcttgctatcggggaagccag

SEQ ID NO: 3007478 - DNA, 15 bp, Homo sapiens
tcttgctccaataaa

SEQ ID NO: 3007479 - DNA, 17 bp, Homo sapiens
tcttgctcctggggaga

SEQ ID NO: 3007480 - DNA, 11 bp, Homo sapiens
tcttgctctct

SEQ ID NO: 3007481 - DNA, 21 bp, Homo sapiens
tcttgctcttagattgggcca

SEQ ID NO: 3007482 - DNA, 15 bp, Homo sapiens
tcttgctgttgacat

SEQ ID NO: 3007483 - DNA, 21 bp, Homo sapiens
tcttgcttaccttgactgttg

SEQ ID NO: 3007484 - DNA, 13 bp, Homo sapiens
tcttgcttccaag

SEQ ID NO: 3007485 - DNA, 12 bp, Homo sapiens
tcttgcttctgg

SEQ ID NO: 3007486 - DNA, 21 bp, Homo sapiens
tcttggaattagatgtttata

SEQ ID NO: 3007487 - DNA, 16 bp, Homo sapiens
tcttggacactgtaca

SEQ ID NO: 3007488 - DNA, 12 bp, Homo sapiens
tcttggagcctg

SEQ ID NO: 3007489 - DNA, 19 bp, Homo sapiens
tcttggagcctgcagagct

SEQ ID NO: 3007490 - DNA, 20 bp, Homo sapiens
tcttggataccagctcaggg

SEQ ID NO: 3007491 - DNA, 16 bp, Homo sapiens
tcttggcacctgccta

SEQ ID NO: 3007492 - DNA, 19 bp, Homo sapiens
tcttggcagcacctgtctc

SEQ ID NO: 3007493 - DNA, 13 bp, Homo sapiens
tcttggcagtcac

SEQ ID NO: 3007494 - DNA, 15 bp, Homo sapiens
tcttggcttaatcat

SEQ ID NO: 3007495 - DNA, 19 bp, Homo sapiens
tcttggcttaatcattttc

SEQ ID NO: 3007496 - DNA, 21 bp, Homo sapiens
tcttggcttaatcattttcat

SEQ ID NO: 3007497 - DNA, 16 bp, Homo sapiens
tcttggctttcatgtt

SEQ ID NO: 3007498 - DNA, 14 bp, Homo sapiens
tcttgggaaatatg

SEQ ID NO: 3007499 - DNA, 19 bp, Homo sapiens
tcttgggaaatatgaatgc

SEQ ID NO: 3007500 - DNA, 18 bp, Homo sapiens
tcttgggcctgacctcca

SEQ ID NO: 3007501 - DNA, 13 bp, Homo sapiens
tcttggggcccag

SEQ ID NO: 3007502 - DNA, 20 bp, Homo sapiens
tcttgggggttgccattccc

SEQ ID NO: 3007503 - DNA, 15 bp, Homo sapiens
tcttggggttcatag

SEQ ID NO: 3007504 - DNA, 21 bp, Homo sapiens
tcttggggttcataggggcag

SEQ ID NO: 3007505 - DNA, 16 bp, Homo sapiens
tcttggtatgcatctt

SEQ ID NO: 3007506 - DNA, 13 bp, Homo sapiens
tcttggtcagctt

SEQ ID NO: 3007507 - DNA, 20 bp, Homo sapiens
tcttggtgctgttgaaaata

SEQ ID NO: 3007508 - DNA, 13 bp, Homo sapiens
tcttggttccagc

SEQ ID NO: 3007509 - DNA, 13 bp, Homo sapiens
tcttggttgagga

SEQ ID NO: 3007510 - DNA, 18 bp, Homo sapiens
tcttgtaaataaagccct

SEQ ID NO: 3007511 - DNA, 14 bp, Homo sapiens
tcttgtaaatgtgt

SEQ ID NO: 3007512 - DNA, 17 bp, Homo sapiens
tcttgtaaatgtgttgg

SEQ ID NO: 3007513 - DNA, 17 bp, Homo sapiens
tcttgtaaggctttgat

SEQ ID NO: 3007514 - DNA, 19 bp, Homo sapiens
tcttgtacatgtgtagcct

SEQ ID NO: 3007515 - DNA, 23 bp, Homo sapiens
tcttgtagcggatgattcttcaa

SEQ ID NO: 3007516 - DNA, 21 bp, Homo sapiens
tcttgtataagatcctagatc

SEQ ID NO: 3007517 - DNA, 22 bp, Homo sapiens
tcttgtcaggtggaccctgtaa

SEQ ID NO: 3007518 - DNA, 16 bp, Homo sapiens
tcttgtcatcagtaag

SEQ ID NO: 3007519 - DNA, 18 bp, Homo sapiens
tcttgtcattaacacatt

SEQ ID NO: 3007520 - DNA, 13 bp, Homo sapiens
tcttgtccctgtc

SEQ ID NO: 3007521 - DNA, 16 bp, Homo sapiens
tcttgtcttttcccct

SEQ ID NO: 3007522 - DNA, 18 bp, Homo sapiens
tcttgtcttttcccctca

SEQ ID NO: 3007523 - DNA, 11 bp, Homo sapiens
tcttgtgaagg

SEQ ID NO: 3007524 - DNA, 16 bp, Homo sapiens
tcttgtgaaggccatg

SEQ ID NO: 3007525 - DNA, 17 bp, Homo sapiens
tcttgtgactcagcaga

SEQ ID NO: 3007526 - DNA, 22 bp, Homo sapiens
tcttgtgatgtttgctcagagg

SEQ ID NO: 3007527 - DNA, 19 bp, Homo sapiens
tcttgtggatgttttaatt

SEQ ID NO: 3007528 - DNA, 23 bp, Homo sapiens
tcttgtggatgttttaattccat

SEQ ID NO: 3007529 - DNA, 18 bp, Homo sapiens
tcttgtgtatttctctgt

SEQ ID NO: 3007530 - DNA, 13 bp, Homo sapiens
tcttgtgtctgtt

SEQ ID NO: 3007531 - DNA, 21 bp, Homo sapiens
tcttgttgctcaaaaaatgag

SEQ ID NO: 3007532 - DNA, 13 bp, Homo sapiens
tcttgttgctttg

SEQ ID NO: 3007533 - DNA, 16 bp, Homo sapiens
tcttgttgtacccttg

SEQ ID NO: 3007534 - DNA, 13 bp, Homo sapiens
tcttgttgttatt

SEQ ID NO: 3007535 - DNA, 20 bp, Homo sapiens
tcttgtttaaaaaaagaaaa

SEQ ID NO: 3007536 - DNA, 14 bp, Homo sapiens
tcttgtttctgttt

SEQ ID NO: 3007537 - DNA, 22 bp, Homo sapiens
tcttgtttggagggatcatttt

SEQ ID NO: 3007538 - DNA, 16 bp, Homo sapiens
tcttgtttgtcagcat

SEQ ID NO: 3007539 - DNA, 17 bp, Homo sapiens
tcttgtttgtcagcatc

SEQ ID NO: 3007540 - DNA, 14 bp, Homo sapiens
tcttgttttcagtt

SEQ ID NO: 3007541 - DNA, 15 bp, Homo sapiens
tctttaaaaaagaaa

SEQ ID NO: 3007542 - DNA, 16 bp, Homo sapiens
tctttaaaaaagaaat

SEQ ID NO: 3007543 - DNA, 23 bp, Homo sapiens
tctttaaaaaagaaattatcttt

SEQ ID NO: 3007544 - DNA, 12 bp, Homo sapiens
tctttaaaagaa

SEQ ID NO: 3007545 - DNA, 16 bp, Homo sapiens
tctttaaaagaaagtt

SEQ ID NO: 3007546 - DNA, 19 bp, Homo sapiens
tctttaaaagatgctttta

SEQ ID NO: 3007547 - DNA, 14 bp, Homo sapiens
tctttaaagccagt

SEQ ID NO: 3007548 - DNA, 18 bp, Homo sapiens
tctttaaagtcaggtcca

SEQ ID NO: 3007549 - DNA, 19 bp, Homo sapiens
tctttaaatcagtattcca

SEQ ID NO: 3007550 - DNA, 14 bp, Homo sapiens
tctttaagactttt

SEQ ID NO: 3007551 - DNA, 13 bp, Homo sapiens
tctttaagagact

SEQ ID NO: 3007552 - DNA, 14 bp, Homo sapiens
tctttaagagactc

SEQ ID NO: 3007553 - DNA, 19 bp, Homo sapiens
tctttaagtattgattctg

SEQ ID NO: 3007554 - DNA, 12 bp, Homo sapiens
tctttaatattt

SEQ ID NO: 3007555 - DNA, 13 bp, Homo sapiens
tctttaatatttt

SEQ ID NO: 3007556 - DNA, 22 bp, Homo sapiens
tctttaatcaatgtgacatgtt

SEQ ID NO: 3007557 - DNA, 13 bp, Homo sapiens
tctttaatgctgt

SEQ ID NO: 3007558 - DNA, 17 bp, Homo sapiens
tctttaatgctgtcttt

SEQ ID NO: 3007559 - DNA, 22 bp, Homo sapiens
tctttacagctttgtttctgca

SEQ ID NO: 3007560 - DNA, 14 bp, Homo sapiens
tctttagagaactg

SEQ ID NO: 3007561 - DNA, 17 bp, Homo sapiens
tctttagagaactgaaa

SEQ ID NO: 3007562 - DNA, 19 bp, Homo sapiens
tctttagagaactgaaaag

SEQ ID NO: 3007563 - DNA, 16 bp, Homo sapiens
tctttatacttaaaca

SEQ ID NO: 3007564 - DNA, 17 bp, Homo sapiens
tctttatatacaataat

SEQ ID NO: 3007565 - DNA, 18 bp, Homo sapiens
tctttatatacaataatg

SEQ ID NO: 3007566 - DNA, 22 bp, Homo sapiens
tctttatatacaataatggaaa

SEQ ID NO: 3007567 - DNA, 14 bp, Homo sapiens
tctttatatttcaa

SEQ ID NO: 3007568 - DNA, 19 bp, Homo sapiens
tctttatcctaaagattat

SEQ ID NO: 3007569 - DNA, 14 bp, Homo sapiens
tctttatgcttgca

SEQ ID NO: 3007570 - DNA, 13 bp, Homo sapiens
tctttattcctag

SEQ ID NO: 3007571 - DNA, 15 bp, Homo sapiens
tctttattcctagtt

SEQ ID NO: 3007572 - DNA, 11 bp, Homo sapiens
tctttcaaaac

SEQ ID NO: 3007573 - DNA, 20 bp, Homo sapiens
tctttcaaaggtagccatca

SEQ ID NO: 3007574 - DNA, 22 bp, Homo sapiens
tctttcaaaggtagccatcatg

SEQ ID NO: 3007575 - DNA, 18 bp, Homo sapiens
tctttcaacttgcatcca

SEQ ID NO: 3007576 - DNA, 16 bp, Homo sapiens
tctttcaatgcagcac

SEQ ID NO: 3007577 - DNA, 14 bp, Homo sapiens
tctttcaattctgt

SEQ ID NO: 3007578 - DNA, 20 bp, Homo sapiens
tctttcacaaggtataataa

SEQ ID NO: 3007579 - DNA, 16 bp, Homo sapiens
tgaactctgggctcaa

SEQ ID NO: 3007580 - DNA, 21 bp, Homo sapiens
tgaactgacaggcagcctgga

SEQ ID NO: 3007581 - DNA, 22 bp, Homo sapiens
tgaactgaggccttgtgtgtca

SEQ ID NO: 3007582 - DNA, 18 bp, Homo sapiens
tgaactgatagttactgt

SEQ ID NO: 3007583 - DNA, 23 bp, Homo sapiens
tgaactgatagttactgttgtga

SEQ ID NO: 3007584 - DNA, 13 bp, Homo sapiens
tgaactgattttt

SEQ ID NO: 3007585 - DNA, 14 bp, Homo sapiens
tgaactgattttta

SEQ ID NO: 3007586 - DNA, 11 bp, Homo sapiens
tgaactggctt

SEQ ID NO: 3007587 - DNA, 20 bp, Homo sapiens
tgaactggcttgtacatttt

SEQ ID NO: 3007588 - DNA, 16 bp, Homo sapiens
tgaactgttaagaaat

SEQ ID NO: 3007589 - DNA, 18 bp, Homo sapiens
tgaacttaaaatgaaagt

SEQ ID NO: 3007590 - DNA, 21 bp, Homo sapiens
tgaacttcaaaagctttttga

SEQ ID NO: 3007591 - DNA, 19 bp, Homo sapiens
tgaacttcgcatcaaaaga

SEQ ID NO: 3007592 - DNA, 13 bp, Homo sapiens
tgaactttcctgg

SEQ ID NO: 3007593 - DNA, 13 bp, Homo sapiens
tgaactttgaaga

SEQ ID NO: 3007594 - DNA, 13 bp, Homo sapiens
tgaactttgtgct

SEQ ID NO: 3007595 - DNA, 18 bp, Homo sapiens
tgaagaaatactgcactt

SEQ ID NO: 3007596 - DNA, 19 bp, Homo sapiens
tgaagaactattttattct

SEQ ID NO: 3007597 - DNA, 19 bp, Homo sapiens
tgaagaactgcatgtggct

SEQ ID NO: 3007598 - DNA, 17 bp, Homo sapiens
tgaagaagccctgttct

SEQ ID NO: 3007599 - DNA, 18 bp, Homo sapiens
tgaagaagccctgttctc

SEQ ID NO: 3007600 - DNA, 19 bp, Homo sapiens
tgaagaagccctgttctcg

SEQ ID NO: 3007601 - DNA, 13 bp, Homo sapiens
tgaagaagctggg

SEQ ID NO: 3007602 - DNA, 16 bp, Homo sapiens
tgaagaatccttttgt

SEQ ID NO: 3007603 - DNA, 18 bp, Homo sapiens
tgaattatactttgttgt

SEQ ID NO: 3007604 - DNA, 19 bp, Homo sapiens
tgaattatactttgttgtt

SEQ ID NO: 3007605 - DNA, 22 bp, Homo sapiens
tgaattatccacatgaaaataa

SEQ ID NO: 3007606 - DNA, 18 bp, Homo sapiens
tgaattcctgtcttccaa

SEQ ID NO: 3007607 - DNA, 20 bp, Homo sapiens
tgaattcttggttgaggaaa

SEQ ID NO: 3007608 - DNA, 15 bp, Homo sapiens
tgaattcttttgcca

SEQ ID NO: 3007609 - DNA, 13 bp, Homo sapiens
tgaattgctgtct

SEQ ID NO: 3007610 - DNA, 14 bp, Homo sapiens
tgaattgctgtcta

SEQ ID NO: 3007611 - DNA, 20 bp, Homo sapiens
tgaattgctgtctagcctta

SEQ ID NO: 3007612 - DNA, 14 bp, Homo sapiens
tgaattggcatttc

SEQ ID NO: 3007613 - DNA, 15 bp, Homo sapiens
tgaattggcctgaac

SEQ ID NO: 3007614 - DNA, 21 bp, Homo sapiens
tgaattggcctgaacagatgt

SEQ ID NO: 3007615 - DNA, 23 bp, Homo sapiens
tgaattggcctgaacagatgtaa

SEQ ID NO: 3007616 - DNA, 19 bp, Homo sapiens
tgaattgtaactgttcttg

SEQ ID NO: 3007617 - DNA, 15 bp, Homo sapiens
tgaattgtccccagt

SEQ ID NO: 3007618 - DNA, 13 bp, Homo sapiens
tgaatttaagcat

SEQ ID NO: 3007619 - DNA, 19 bp, Homo sapiens
tgaatttaagcatgagtgg

SEQ ID NO: 3007620 - DNA, 20 bp, Homo sapiens
tgaatttattgcacattgtt

SEQ ID NO: 3007621 - DNA, 17 bp, Homo sapiens
tgaatttcaaacatttg

SEQ ID NO: 3007622 - DNA, 23 bp, Homo sapiens
tgaatttcttgatttttcagggt

SEQ ID NO: 3007623 - DNA, 13 bp, Homo sapiens
tgaatttctttga

SEQ ID NO: 3007624 - DNA, 15 bp, Homo sapiens
tgaatttgcaaagta

SEQ ID NO: 3007625 - DNA, 18 bp, Homo sapiens
tgaatttgcaaagtactg

SEQ ID NO: 3007626 - DNA, 23 bp, Homo sapiens
tgaatttgcatgtctaattcatt

SEQ ID NO: 3007627 - DNA, 17 bp, Homo sapiens
tgaatttgccctgggaa

SEQ ID NO: 3007628 - DNA, 21 bp, Homo sapiens
tgaatttgtaagcaacttgct

SEQ ID NO: 3007629 - DNA, 14 bp, Homo sapiens
tgaatttgtatatg

SEQ ID NO: 3007630 - DNA, 19 bp, Homo sapiens
tgaatttgtatatgactgc

SEQ ID NO: 3007631 - DNA, 17 bp, Homo sapiens
tgaattttaagggtttc

SEQ ID NO: 3007632 - DNA, 23 bp, Homo sapiens
tgaattttctttttaataaaaag

SEQ ID NO: 3007633 - DNA, 13 bp, Homo sapiens
tgaatttttctct

SEQ ID NO: 3007634 - DNA, 13 bp, Homo sapiens
tgaatttttgcaa

SEQ ID NO: 3007635 - DNA, 14 bp, Homo sapiens
tgaatttttgcaat

SEQ ID NO: 3007636 - DNA, 21 bp, Homo sapiens
tgacaaaagtgacagatgtta

SEQ ID NO: 3007637 - DNA, 23 bp, Homo sapiens
tgacaaaagtgacagatgttatt

SEQ ID NO: 3007638 - DNA, 21 bp, Homo sapiens
tgacaaacccggaagatcaga

SEQ ID NO: 3007639 - DNA, 17 bp, Homo sapiens
tgacaaaggcaagcact

SEQ ID NO: 3007640 - DNA, 21 bp, Homo sapiens
tgacaaagtgtgtctcaaaaa

SEQ ID NO: 3007641 - DNA, 16 bp, Homo sapiens
tgacaaagtgttgaaa

SEQ ID NO: 3007642 - DNA, 12 bp, Homo sapiens
tgacaacatctg

SEQ ID NO: 3007643 - DNA, 22 bp, Homo sapiens
tgacaacatggcttctcctttg

SEQ ID NO: 3007644 - DNA, 22 bp, Homo sapiens
tgacaactcattttcatattgt

SEQ ID NO: 3007645 - DNA, 14 bp, Homo sapiens
tgacaactggcagg

SEQ ID NO: 3007646 - DNA, 20 bp, Homo sapiens
tgacaagcagatactgctgt

SEQ ID NO: 3007647 - DNA, 16 bp, Homo sapiens
tgacaaggtcaaattt

SEQ ID NO: 3007648 - DNA, 13 bp, Homo sapiens
tgacaataaaaca

SEQ ID NO: 3007649 - DNA, 17 bp, Homo sapiens
tgacaataaaacattaa

SEQ ID NO: 3007650 - DNA, 13 bp, Homo sapiens
tgacaatgactaa

SEQ ID NO: 3007651 - DNA, 21 bp, Homo sapiens
tgacaatgactaagccaagct

SEQ ID NO: 3007652 - DNA, 22 bp, Homo sapiens
tgacaatgactaagccaagctg

SEQ ID NO: 3007653 - DNA, 17 bp, Homo sapiens
tgacaatgcttatggaa

SEQ ID NO: 3007654 - DNA, 14 bp, Homo sapiens
tgacaatgttgtag

SEQ ID NO: 3007655 - DNA, 21 bp, Homo sapiens
tgacaattcccgggcccttca

SEQ ID NO: 3007656 - DNA, 16 bp, Homo sapiens
tgacaattctgttttt

SEQ ID NO: 3007657 - DNA, 17 bp, Homo sapiens
tgacacaaacacacaca

SEQ ID NO: 3007658 - DNA, 16 bp, Homo sapiens
tgacacaagtggacct

SEQ ID NO: 3007659 - DNA, 13 bp, Homo sapiens
tgacacactacac

SEQ ID NO: 3007660 - DNA, 21 bp, Homo sapiens
tgacacactacaccacacaca

SEQ ID NO: 3007661 - DNA, 18 bp, Homo sapiens
tgacacagaaaatgttga

SEQ ID NO: 3007662 - DNA, 18 bp, Homo sapiens
tgacacaggtctttccta

SEQ ID NO: 3007663 - DNA, 18 bp, Homo sapiens
tgacacatcagcatgttt

SEQ ID NO: 3007664 - DNA, 17 bp, Homo sapiens
tgacacccaagagggct

SEQ ID NO: 3007665 - DNA, 20 bp, Homo sapiens
tgacacctttcataatcttt

SEQ ID NO: 3007666 - DNA, 14 bp, Homo sapiens
tgacactcccttgg

SEQ ID NO: 3007667 - DNA, 20 bp, Homo sapiens
tgacactggaccaggtcctg

SEQ ID NO: 3007668 - DNA, 19 bp, Homo sapiens
tgacacttccaaagactcc

SEQ ID NO: 3007669 - DNA, 18 bp, Homo sapiens
tgacacttttaaaataaa

SEQ ID NO: 3007670 - DNA, 16 bp, Homo sapiens
tgacagaaggaccagc

SEQ ID NO: 3007671 - DNA, 15 bp, Homo sapiens
tgacagacatccttg

SEQ ID NO: 3007672 - DNA, 14 bp, Homo sapiens
tgacagactcctga

SEQ ID NO: 3007673 - DNA, 19 bp, Homo sapiens
tgacagactcctgaggaca

SEQ ID NO: 3007674 - DNA, 17 bp, Homo sapiens
tgacagagcgagactcc

SEQ ID NO: 3007675 - DNA, 18 bp, Homo sapiens
tgacagatcaagctgtga

SEQ ID NO: 3007676 - DNA, 16 bp, Homo sapiens
tgacagcagcctgtga

SEQ ID NO: 3007677 - DNA, 14 bp, Homo sapiens
tgacagccttgggc

SEQ ID NO: 3007678 - DNA, 22 bp, Homo sapiens
tgacagctaggatgtgcattct

SEQ ID NO: 3007679 - DNA, 13 bp, Homo sapiens
tgacagctgctcc

SEQ ID NO: 3007680 - DNA, 23 bp, Homo sapiens
tgacagctgctcctagagggagg

SEQ ID NO: 3007681 - DNA, 12 bp, Homo sapiens
tgacagctgtcc

SEQ ID NO: 3007682 - DNA, 20 bp, Homo sapiens
tgacagctgtccctgtcacc

SEQ ID NO: 3007683 - DNA, 12 bp, Homo sapiens
tgacagcttgga

SEQ ID NO: 3007684 - DNA, 13 bp, Homo sapiens
tgacagcttggaa

SEQ ID NO: 3007685 - DNA, 20 bp, Homo sapiens
tgacagcttggaaagggaag

SEQ ID NO: 3007686 - DNA, 17 bp, Homo sapiens
tgacagctttgctgctg

SEQ ID NO: 3007687 - DNA, 20 bp, Homo sapiens
tgacagctttgctgctgaag

SEQ ID NO: 3007688 - DNA, 20 bp, Homo sapiens
tgacaggattccctccacaa

SEQ ID NO: 3007689 - DNA, 20 bp, Homo sapiens
tgacaggcagcctggacata

SEQ ID NO: 3007690 - DNA, 17 bp, Homo sapiens
tgacagggaagctacag

SEQ ID NO: 3007691 - DNA, 19 bp, Homo sapiens
tgacagggaagctacaggt

SEQ ID NO: 3007692 - DNA, 19 bp, Homo sapiens
tgacagggacatgccctgt

SEQ ID NO: 3007693 - DNA, 15 bp, Homo sapiens
tgacaggtttgggac

SEQ ID NO: 3007694 - DNA, 20 bp, Homo sapiens
tgacaggttttccaaaagta

SEQ ID NO: 3007695 - DNA, 18 bp, Homo sapiens
tgacagtcactcagccat

SEQ ID NO: 3007696 - DNA, 22 bp, Homo sapiens
tgacagtccgtcaaaacagatt

SEQ ID NO: 3007697 - DNA, 11 bp, Homo sapiens
tgacagtctga

SEQ ID NO: 3007698 - DNA, 22 bp, Homo sapiens
tgacagtgacgtgactcagagc

SEQ ID NO: 3007699 - DNA, 20 bp, Homo sapiens
tgactctcctgcctcagcct

SEQ ID NO: 3007700 - DNA, 16 bp, Homo sapiens
tgactctggcttggcc

SEQ ID NO: 3007701 - DNA, 17 bp, Homo sapiens
tgactctgggcagggac

SEQ ID NO: 3007702 - DNA, 18 bp, Homo sapiens
tgactcttccattcagtt

SEQ ID NO: 3007703 - DNA, 20 bp, Homo sapiens
tgactcttgttttcagtttc

SEQ ID NO: 3007704 - DNA, 13 bp, Homo sapiens
tgactctttccaa

SEQ ID NO: 3007705 - DNA, 19 bp, Homo sapiens
tgactctttccaaccggct

SEQ ID NO: 3007706 - DNA, 15 bp, Homo sapiens
tgactgaaagaagaa

SEQ ID NO: 3007707 - DNA, 19 bp, Homo sapiens
tgactgaaagaagaacagc

SEQ ID NO: 3007708 - DNA, 14 bp, Homo sapiens
tgactgatgacaaa

SEQ ID NO: 3007709 - DNA, 22 bp, Homo sapiens
tgactgatttcaaatcatgttt

SEQ ID NO: 3007710 - DNA, 11 bp, Homo sapiens
tgactggatat

SEQ ID NO: 3007711 - DNA, 18 bp, Homo sapiens
tgactggcattttataga

SEQ ID NO: 3007712 - DNA, 16 bp, Homo sapiens
tgactgttgcatagaa

SEQ ID NO: 3007713 - DNA, 16 bp, Homo sapiens
tgacttaactgcattt

SEQ ID NO: 3007714 - DNA, 17 bp, Homo sapiens
tgacttagatattaaaa

SEQ ID NO: 3007715 - DNA, 18 bp, Homo sapiens
tgacttagatattaaaat

SEQ ID NO: 3007716 - DNA, 17 bp, Homo sapiens
tgacttcaatgatagta

SEQ ID NO: 3007717 - DNA, 18 bp, Homo sapiens
tgacttcaggtgatccac

SEQ ID NO: 3007718 - DNA, 21 bp, Homo sapiens
tgacttcaggtggagagcact

SEQ ID NO: 3007719 - DNA, 15 bp, Homo sapiens
tgacttcatgctata

SEQ ID NO: 3007720 - DNA, 22 bp, Homo sapiens
tgacttccccgcattccaggct

SEQ ID NO: 3007721 - DNA, 13 bp, Homo sapiens
tgacttctgtgag

SEQ ID NO: 3007722 - DNA, 12 bp, Homo sapiens
tgacttgagtgt

SEQ ID NO: 3007723 - DNA, 22 bp, Homo sapiens
tgacttgtataacatcactgtc

SEQ ID NO: 3007724 - DNA, 19 bp, Homo sapiens
tgacttgttcatttttctc

SEQ ID NO: 3007725 - DNA, 21 bp, Homo sapiens
tgactttagaaagctgacatt

SEQ ID NO: 3007726 - DNA, 16 bp, Homo sapiens
tgactttgctctttct

SEQ ID NO: 3007727 - DNA, 20 bp, Homo sapiens
tgacttttaaggctaaaact

SEQ ID NO: 3007728 - DNA, 23 bp, Homo sapiens
tgactttttaaacgattagtgat

SEQ ID NO: 3007729 - DNA, 13 bp, Homo sapiens
tgagaaaacaagc

SEQ ID NO: 3007730 - DNA, 14 bp, Homo sapiens
tgagaaaacaagca

SEQ ID NO: 3007731 - DNA, 23 bp, Homo sapiens
tgagaaaacaagcaagttctgag

SEQ ID NO: 3007732 - DNA, 22 bp, Homo sapiens
tgagaaacagctacagctttgg

SEQ ID NO: 3007733 - DNA, 22 bp, Homo sapiens
tgagaaacctgtatctttctat

SEQ ID NO: 3007734 - DNA, 24 bp, Homo sapiens
tgagaaacctgtatctttctatgc

SEQ ID NO: 3007735 - DNA, 21 bp, Homo sapiens
tgagaaacgtccatctctctc

SEQ ID NO: 3007736 - DNA, 21 bp, Homo sapiens
tgagaaagcccacctgggctg

SEQ ID NO: 3007737 - DNA, 22 bp, Homo sapiens
tgagaaagcccacctgggctgg

SEQ ID NO: 3007738 - DNA, 23 bp, Homo sapiens
tgagaaagcccacctgggctggg

SEQ ID NO: 3007739 - DNA, 13 bp, Homo sapiens
tgagaaagccctg

SEQ ID NO: 3007740 - DNA, 14 bp, Homo sapiens
tgagaaaggacaga

SEQ ID NO: 3007741 - DNA, 15 bp, Homo sapiens
tgagaaaggacagag

SEQ ID NO: 3007742 - DNA, 16 bp, Homo sapiens
tgagaaaggacagagc

SEQ ID NO: 3007743 - DNA, 20 bp, Homo sapiens
tgagaaaggacagagccagc

SEQ ID NO: 3007744 - DNA, 17 bp, Homo sapiens
tgagaaatatggacact

SEQ ID NO: 3007745 - DNA, 23 bp, Homo sapiens
tgagaaatgtaatgcgattttat

SEQ ID NO: 3007746 - DNA, 18 bp, Homo sapiens
tcctttccaaggcttctc

SEQ ID NO: 3007747 - DNA, 16 bp, Homo sapiens
tcctttcccaagcctt

SEQ ID NO: 3007748 - DNA, 18 bp, Homo sapiens
tcctttcctcagacctgg

SEQ ID NO: 3007749 - DNA, 13 bp, Homo sapiens
tcctttctctgta

SEQ ID NO: 3007750 - DNA, 22 bp, Homo sapiens
tcctttctgcagacgtctgcct

SEQ ID NO: 3007751 - DNA, 22 bp, Homo sapiens
tcctttgaagatagtaactgta

SEQ ID NO: 3007752 - DNA, 16 bp, Homo sapiens
tcctttgatagaagat

SEQ ID NO: 3007753 - DNA, 17 bp, Homo sapiens
tcctttggcatgtttaa

SEQ ID NO: 3007754 - DNA, 22 bp, Homo sapiens
tcctttggcatgtttaattgtg

SEQ ID NO: 3007755 - DNA, 13 bp, Homo sapiens
tcctttgggaaag

SEQ ID NO: 3007756 - DNA, 17 bp, Homo sapiens
tcctttggtatttcact

SEQ ID NO: 3007757 - DNA, 18 bp, Homo sapiens
tcctttggtcctgtcccc

SEQ ID NO: 3007758 - DNA, 20 bp, Homo sapiens
tcctttgtgtttctattgac

SEQ ID NO: 3007759 - DNA, 16 bp, Homo sapiens
tccttttattcacata

SEQ ID NO: 3007760 - DNA, 16 bp, Homo sapiens
tccttttcttctatgt

SEQ ID NO: 3007761 - DNA, 23 bp, Homo sapiens
tccttttgaccttcatttcatgt

SEQ ID NO: 3007762 - DNA, 11 bp, Homo sapiens
tccttttgtag

SEQ ID NO: 3007763 - DNA, 13 bp, Homo sapiens
tccttttgttttg

SEQ ID NO: 3007764 - DNA, 17 bp, Homo sapiens
tccttttgttttgaagc

SEQ ID NO: 3007765 - DNA, 16 bp, Homo sapiens
tcctttttaaatgtga

SEQ ID NO: 3007766 - DNA, 18 bp, Homo sapiens
tcctttttaaatgtgaat

SEQ ID NO: 3007767 - DNA, 12 bp, Homo sapiens
tcctttttaagg

SEQ ID NO: 3007768 - DNA, 13 bp, Homo sapiens
tccttttttctct

SEQ ID NO: 3007769 - DNA, 20 bp, Homo sapiens
tcctttttttaaattttctc

SEQ ID NO: 3007770 - DNA, 13 bp, Homo sapiens
tcgaaacacagaa

SEQ ID NO: 3007771 - DNA, 16 bp, Homo sapiens
tcgaaagctctagaat

SEQ ID NO: 3007772 - DNA, 19 bp, Homo sapiens
tcgaaagctctagaatctg

SEQ ID NO: 3007773 - DNA, 14 bp, Homo sapiens
tcgaaaggtgcagc

SEQ ID NO: 3007774 - DNA, 20 bp, Homo sapiens
tcgaaagtgtcatcaatttg

SEQ ID NO: 3007775 - DNA, 18 bp, Homo sapiens
tcgaacatgtttcactta

SEQ ID NO: 3007776 - DNA, 15 bp, Homo sapiens
tcgaaccgttttgaa

SEQ ID NO: 3007777 - DNA, 14 bp, Homo sapiens
tcgaactgtgctcc

SEQ ID NO: 3007778 - DNA, 15 bp, Homo sapiens
tcgaagatatacaaa

SEQ ID NO: 3007779 - DNA, 17 bp, Homo sapiens
tcgaagcaatcagcaaa

SEQ ID NO: 3007780 - DNA, 17 bp, Homo sapiens
tcgaattttatctgtgg

SEQ ID NO: 3007781 - DNA, 23 bp, Homo sapiens
tcgacactaagaatgaggaatag

SEQ ID NO: 3007782 - DNA, 15 bp, Homo sapiens
tcgacatgctgccag

SEQ ID NO: 3007783 - DNA, 16 bp, Homo sapiens
tcgacatgctgccagg

SEQ ID NO: 3007784 - DNA, 17 bp, Homo sapiens
tcgacatgctgccagga

SEQ ID NO: 3007785 - DNA, 18 bp, Homo sapiens
tcgagaccaacctgacca

SEQ ID NO: 3007786 - DNA, 13 bp, Homo sapiens
tcgagaccagcct

SEQ ID NO: 3007787 - DNA, 14 bp, Homo sapiens
tcgagaccagcctg

SEQ ID NO: 3007788 - DNA, 21 bp, Homo sapiens
tcgagagctggccaaagagcc

SEQ ID NO: 3007789 - DNA, 21 bp, Homo sapiens
tcgagatggcagattcccact

SEQ ID NO: 3007790 - DNA, 20 bp, Homo sapiens
tcgagcatgcggagccagca

SEQ ID NO: 3007791 - DNA, 19 bp, Homo sapiens
tcgagcatgttgttttttc

SEQ ID NO: 3007792 - DNA, 21 bp, Homo sapiens
tcgagcatgttgttttttcat

SEQ ID NO: 3007793 - DNA, 19 bp, Homo sapiens
tcgaggactgtatttgtga

SEQ ID NO: 3007794 - DNA, 20 bp, Homo sapiens
tcgaggactgtatttgtgac

SEQ ID NO: 3007795 - DNA, 17 bp, Homo sapiens
tcgaggcggatctttgg

SEQ ID NO: 3007796 - DNA, 14 bp, Homo sapiens
tcgagggccgcctg

SEQ ID NO: 3007797 - DNA, 15 bp, Homo sapiens
tcgagggccgcctgc

SEQ ID NO: 3007798 - DNA, 23 bp, Homo sapiens
tcgaggggtcctcacctggttga

SEQ ID NO: 3007799 - DNA, 15 bp, Homo sapiens
tcgaggtcagaggag

SEQ ID NO: 3007800 - DNA, 14 bp, Homo sapiens
tcgaggtgccttct

SEQ ID NO: 3007801 - DNA, 20 bp, Homo sapiens
tcgaggtgccttcttcaggg

SEQ ID NO: 3007802 - DNA, 13 bp, Homo sapiens
tcgagtactgtgg

SEQ ID NO: 3007803 - DNA, 14 bp, Homo sapiens
tcgagtactgtggg

SEQ ID NO: 3007804 - DNA, 15 bp, Homo sapiens
tcgatgcgtattctg

SEQ ID NO: 3007805 - DNA, 23 bp, Homo sapiens
tcgatgcgtattctgtggccgcc

SEQ ID NO: 3007806 - DNA, 24 bp, Homo sapiens
tcgatgcgtattctgtggccgcca

SEQ ID NO: 3007807 - DNA, 17 bp, Homo sapiens
tcgatgctgctggcctc

SEQ ID NO: 3007808 - DNA, 23 bp, Homo sapiens
tcgatggtacgtgaccctctgct

SEQ ID NO: 3007809 - DNA, 20 bp, Homo sapiens
tcgatgtgtactctaactta

SEQ ID NO: 3007810 - DNA, 13 bp, Homo sapiens
tcgattagactgg

SEQ ID NO: 3007811 - DNA, 14 bp, Homo sapiens
tcgattagactgga

SEQ ID NO: 3007812 - DNA, 22 bp, Homo sapiens
tcgattagactggacagcttgt

SEQ ID NO: 3007813 - DNA, 22 bp, Homo sapiens
tcgcacacacatttggaatgca

SEQ ID NO: 3007814 - DNA, 13 bp, Homo sapiens
tcgcaccactgca

SEQ ID NO: 3007815 - DNA, 17 bp, Homo sapiens
tcgcaccactgcactcc

SEQ ID NO: 3007816 - DNA, 17 bp, Homo sapiens
tcgcacctgtgctggag

SEQ ID NO: 3007817 - DNA, 17 bp, Homo sapiens
tcgcacttgcagaggag

SEQ ID NO: 3007818 - DNA, 15 bp, Homo sapiens
tcgcagatgataaaa

SEQ ID NO: 3007819 - DNA, 14 bp, Homo sapiens
tcgcatgtttaatg

SEQ ID NO: 3007820 - DNA, 15 bp, Homo sapiens
tcgcatttgtcaatg

SEQ ID NO: 3007821 - DNA, 21 bp, Homo sapiens
tcgccagaagactcctaggcc

SEQ ID NO: 3007822 - DNA, 22 bp, Homo sapiens
tcgccagaagactcctaggccc

SEQ ID NO: 3007823 - DNA, 17 bp, Homo sapiens
tcgccataggccaaggt

SEQ ID NO: 3007824 - DNA, 19 bp, Homo sapiens
tcgcccaggctggagtgca

SEQ ID NO: 3007825 - DNA, 22 bp, Homo sapiens
tcgcccatacccgtgacagtgg

SEQ ID NO: 3007826 - DNA, 14 bp, Homo sapiens
tcgccccagcaggt

SEQ ID NO: 3007827 - DNA, 20 bp, Homo sapiens
tcgccccagcaggtgctgac

SEQ ID NO: 3007828 - DNA, 13 bp, Homo sapiens
tcgccctcccagg

SEQ ID NO: 3007829 - DNA, 22 bp, Homo sapiens
tcgcccttacttcttgccctgg

SEQ ID NO: 3007830 - DNA, 16 bp, Homo sapiens
tcgcctgtaatctcac

SEQ ID NO: 3007831 - DNA, 22 bp, Homo sapiens
tcgcgatgggaaccgatggtgg

SEQ ID NO: 3007832 - DNA, 14 bp, Homo sapiens
tcgcgctctgctca

SEQ ID NO: 3007833 - DNA, 16 bp, Homo sapiens
tcgcggcggagctggc

SEQ ID NO: 3007834 - DNA, 18 bp, Homo sapiens
tcgcggcggagctggccc

SEQ ID NO: 3007835 - DNA, 19 bp, Homo sapiens
tcgcggcggagctggcccc

SEQ ID NO: 3007836 - DNA, 14 bp, Homo sapiens
tcgctcagtctgtt

SEQ ID NO: 3007837 - DNA, 16 bp, Homo sapiens
tcgctcagtctgttca

SEQ ID NO: 3007838 - DNA, 18 bp, Homo sapiens
tcgctcagtctgttcact

SEQ ID NO: 3007839 - DNA, 20 bp, Homo sapiens
tcgctcccgccagcagcata

SEQ ID NO: 3007840 - DNA, 17 bp, Homo sapiens
tcgctccctcccaggac

SEQ ID NO: 3007841 - DNA, 11 bp, Homo sapiens
tcgctctgctg

SEQ ID NO: 3007842 - DNA, 23 bp, Homo sapiens
tcgctgcagggagcaccacggcc

SEQ ID NO: 3007843 - DNA, 23 bp, Homo sapiens
tcgctggactctcagtctctgag

SEQ ID NO: 3007844 - DNA, 22 bp, Homo sapiens
tcgctgtattttgagtttcagc

SEQ ID NO: 3007845 - DNA, 14 bp, Homo sapiens
tcgctgtcccctca

SEQ ID NO: 3007846 - DNA, 17 bp, Homo sapiens
tcgctgtcccctcagcg

SEQ ID NO: 3007847 - DNA, 17 bp, Homo sapiens
tcgctgtcctttctaga

SEQ ID NO: 3007848 - DNA, 14 bp, Homo sapiens
tcgcttgccaaagc

SEQ ID NO: 3007849 - DNA, 18 bp, Homo sapiens
tcgcttgccaaagcagat

SEQ ID NO: 3007850 - DNA, 15 bp, Homo sapiens
tcgcttttggtattt

SEQ ID NO: 3007851 - DNA, 20 bp, Homo sapiens
tcggaaaagcgtctttaaga

SEQ ID NO: 3007852 - DNA, 12 bp, Homo sapiens
tcggaaacactg

SEQ ID NO: 3007853 - DNA, 19 bp, Homo sapiens
tcggacaagacccccagca

SEQ ID NO: 3007854 - DNA, 13 bp, Homo sapiens
tcggacggggcag

SEQ ID NO: 3007855 - DNA, 14 bp, Homo sapiens
tcggagctgcctgc

SEQ ID NO: 3007856 - DNA, 20 bp, Homo sapiens
tcggagctgcctgcagcaca

SEQ ID NO: 3007857 - DNA, 21 bp, Homo sapiens
tcggagctggcccagggggcc

SEQ ID NO: 3007858 - DNA, 20 bp, Homo sapiens
tcggaggctcctccctctgc

SEQ ID NO: 3007859 - DNA, 19 bp, Homo sapiens
tcggatgaccatactcaga

SEQ ID NO: 3007860 - DNA, 18 bp, Homo sapiens
tcggcagaactctctgtc

SEQ ID NO: 3007861 - DNA, 19 bp, Homo sapiens
tcggcagaactctctgtct

SEQ ID NO: 3007862 - DNA, 12 bp, Homo sapiens
tcggcaggaagg

SEQ ID NO: 3007863 - DNA, 13 bp, Homo sapiens
tcggcaggaagga

SEQ ID NO: 3007864 - DNA, 16 bp, Homo sapiens
tcggcaggaaggagcg

SEQ ID NO: 3007865 - DNA, 16 bp, Homo sapiens
tcggcagtattttctg

SEQ ID NO: 3007866 - DNA, 13 bp, Homo sapiens
tcggcatgccagg

SEQ ID NO: 3007867 - DNA, 14 bp, Homo sapiens
tcggcatgccagga

SEQ ID NO: 3007868 - DNA, 11 bp, Homo sapiens
tcggccagccc

SEQ ID NO: 3007869 - DNA, 13 bp, Homo sapiens
tcggcccagggcc

SEQ ID NO: 3007870 - DNA, 16 bp, Homo sapiens
tcggcccatctgtcca

SEQ ID NO: 3007871 - DNA, 21 bp, Homo sapiens
tcggcccatctgtccatcctc

SEQ ID NO: 3007872 - DNA, 23 bp, Homo sapiens
tcggcccatctgtccatcctcct

SEQ ID NO: 3007873 - DNA, 13 bp, Homo sapiens
tcggccccatcgc

SEQ ID NO: 3007874 - DNA, 22 bp, Homo sapiens
tcggccccctcaccccagctcc

SEQ ID NO: 3007875 - DNA, 15 bp, Homo sapiens
tcggccctccctgcg

SEQ ID NO: 3007876 - DNA, 12 bp, Homo sapiens
tcggctctggag

SEQ ID NO: 3007877 - DNA, 17 bp, Homo sapiens
tcggcttggatcctggg

SEQ ID NO: 3007878 - DNA, 21 bp, Homo sapiens
tcggctttgcccccttgccct

SEQ ID NO: 3007879 - DNA, 14 bp, Homo sapiens
tctcagatcactgc

SEQ ID NO: 3007880 - DNA, 17 bp, Homo sapiens
tctcagatcactgcaac

SEQ ID NO: 3007881 - DNA, 22 bp, Homo sapiens
tctcagatccttgtttcaaaca

SEQ ID NO: 3007882 - DNA, 20 bp, Homo sapiens
tctcagccataggtgcagtt

SEQ ID NO: 3007883 - DNA, 17 bp, Homo sapiens
tctcagccccatcgccc

SEQ ID NO: 3007884 - DNA, 13 bp, Homo sapiens
tctcaggagccat

SEQ ID NO: 3007885 - DNA, 13 bp, Homo sapiens
tctcaggatccaa

SEQ ID NO: 3007886 - DNA, 14 bp, Homo sapiens
tctcaggatccaag

SEQ ID NO: 3007887 - DNA, 15 bp, Homo sapiens
tctcaggatccaagc

SEQ ID NO: 3007888 - DNA, 14 bp, Homo sapiens
tctcaggtccagct

SEQ ID NO: 3007889 - DNA, 19 bp, Homo sapiens
tctcaggttggcggcagac

SEQ ID NO: 3007890 - DNA, 22 bp, Homo sapiens
tctcaggttggcggcagacaca

SEQ ID NO: 3007891 - DNA, 23 bp, Homo sapiens
tctcaggttggcggcagacacat

SEQ ID NO: 3007892 - DNA, 16 bp, Homo sapiens
tctcagtaagaagtct

SEQ ID NO: 3007893 - DNA, 23 bp, Homo sapiens
tctcagtaataaaaattaagctg

SEQ ID NO: 3007894 - DNA, 11 bp, Homo sapiens
tctcagtctct

SEQ ID NO: 3007895 - DNA, 19 bp, Homo sapiens
tctcagtgccaactgtggc

SEQ ID NO: 3007896 - DNA, 15 bp, Homo sapiens
tctcagtgccttctc

SEQ ID NO: 3007897 - DNA, 16 bp, Homo sapiens
tctcagtggtgtgtga

SEQ ID NO: 3007898 - DNA, 18 bp, Homo sapiens
tctcagtggtgtgtgaag

SEQ ID NO: 3007899 - DNA, 22 bp, Homo sapiens
tctcagtggttaagattcctaa

SEQ ID NO: 3007900 - DNA, 19 bp, Homo sapiens
tctcagtgttttggactcc

SEQ ID NO: 3007901 - DNA, 13 bp, Homo sapiens
tctcataatcctt

SEQ ID NO: 3007902 - DNA, 21 bp, Homo sapiens
tctcataatccttctgcaact

SEQ ID NO: 3007903 - DNA, 18 bp, Homo sapiens
tctcataatgtgaaatat

SEQ ID NO: 3007904 - DNA, 22 bp, Homo sapiens
tctcatatatagacagctttga

SEQ ID NO: 3007905 - DNA, 16 bp, Homo sapiens
tctcatcacacacatg

SEQ ID NO: 3007906 - DNA, 18 bp, Homo sapiens
tctcatcacacacatgga

SEQ ID NO: 3007907 - DNA, 17 bp, Homo sapiens
tctcatgttttcaactg

SEQ ID NO: 3007908 - DNA, 18 bp, Homo sapiens
tctcattccgttgtctgt

SEQ ID NO: 3007909 - DNA, 20 bp, Homo sapiens
tctcattccgttgtctgtgg

SEQ ID NO: 3007910 - DNA, 21 bp, Homo sapiens
tctcattccgttgtctgtgga

SEQ ID NO: 3007911 - DNA, 18 bp, Homo sapiens
tctcatttatttttagcc

SEQ ID NO: 3007912 - DNA, 15 bp, Homo sapiens
tctccaacctggaca

SEQ ID NO: 3007913 - DNA, 13 bp, Homo sapiens
tctccaagacaga

SEQ ID NO: 3007914 - DNA, 21 bp, Homo sapiens
tctccacccaaaccccttccc

SEQ ID NO: 3007915 - DNA, 22 bp, Homo sapiens
tctccacccaaaccccttccca

SEQ ID NO: 3007916 - DNA, 14 bp, Homo sapiens
tctccacctcagcc

SEQ ID NO: 3007917 - DNA, 17 bp, Homo sapiens
tctccacctcagccttg

SEQ ID NO: 3007918 - DNA, 14 bp, Homo sapiens
tctccacttctggt

SEQ ID NO: 3007919 - DNA, 20 bp, Homo sapiens
tctccacttctggtcccctg

SEQ ID NO: 3007920 - DNA, 21 bp, Homo sapiens
tctccacttctggtcccctgt

SEQ ID NO: 3007921 - DNA, 18 bp, Homo sapiens
tctccagcattctcagcc

SEQ ID NO: 3007922 - DNA, 21 bp, Homo sapiens
tctccagcctcacagatgctg

SEQ ID NO: 3007923 - DNA, 23 bp, Homo sapiens
tctccagcctgggaggcacagca

SEQ ID NO: 3007924 - DNA, 13 bp, Homo sapiens
tctccaggccagg

SEQ ID NO: 3007925 - DNA, 18 bp, Homo sapiens
tctccagggtcagaaaca

SEQ ID NO: 3007926 - DNA, 15 bp, Homo sapiens
tctccatactttgga

SEQ ID NO: 3007927 - DNA, 22 bp, Homo sapiens
tctccatgaggtactggtccct

SEQ ID NO: 3007928 - DNA, 13 bp, Homo sapiens
tctccatgcaagt

SEQ ID NO: 3007929 - DNA, 17 bp, Homo sapiens
tctccatggcatcttcg

SEQ ID NO: 3007930 - DNA, 17 bp, Homo sapiens
tctccatgtagaataaa

SEQ ID NO: 3007931 - DNA, 16 bp, Homo sapiens
tctccatttgtcatcg

SEQ ID NO: 3007932 - DNA, 16 bp, Homo sapiens
tctcccacatcccact

SEQ ID NO: 3007933 - DNA, 22 bp, Homo sapiens
tctcccaccccctccccaaagc

SEQ ID NO: 3007934 - DNA, 16 bp, Homo sapiens
tctcccaccctaaggg

SEQ ID NO: 3007935 - DNA, 23 bp, Homo sapiens
tctcccaccctaagggcagccct

SEQ ID NO: 3007936 - DNA, 19 bp, Homo sapiens
tctcccagacttgtttcct

SEQ ID NO: 3007937 - DNA, 21 bp, Homo sapiens
tctcccagacttgtttcctgt

SEQ ID NO: 3007938 - DNA, 22 bp, Homo sapiens
tctcccagacttgtttcctgtg

SEQ ID NO: 3007939 - DNA, 23 bp, Homo sapiens
tctcccatcccctccctccttca

SEQ ID NO: 3007940 - DNA, 17 bp, Homo sapiens
tctcccattgtccctct

SEQ ID NO: 3007941 - DNA, 14 bp, Homo sapiens
tctcccatttcagg

SEQ ID NO: 3007942 - DNA, 16 bp, Homo sapiens
tctcccatttcaggaa

SEQ ID NO: 3007943 - DNA, 23 bp, Homo sapiens
tctccccaatgagacttgccttc

SEQ ID NO: 3007944 - DNA, 19 bp, Homo sapiens
tctcccccatagcaccctg

SEQ ID NO: 3007945 - DNA, 19 bp, Homo sapiens
tctccccgaggctgcccca

SEQ ID NO: 3007946 - DNA, 23 bp, Homo sapiens
tctcccctaccaggctgtaaatg

SEQ ID NO: 3007947 - DNA, 22 bp, Homo sapiens
tctcccctccccatctgtgttc

SEQ ID NO: 3007948 - DNA, 18 bp, Homo sapiens
tctcccggacctggacta

SEQ ID NO: 3007949 - DNA, 20 bp, Homo sapiens
tctcccgggaagccaccctc

SEQ ID NO: 3007950 - DNA, 13 bp, Homo sapiens
tctcccgtctcgc

SEQ ID NO: 3007951 - DNA, 15 bp, Homo sapiens
tctcccgtctcgcct

SEQ ID NO: 3007952 - DNA, 16 bp, Homo sapiens
tctcccgtctcgcctg

SEQ ID NO: 3007953 - DNA, 15 bp, Homo sapiens
tctccctaaccacta

SEQ ID NO: 3007954 - DNA, 16 bp, Homo sapiens
tctccctaccttgcct

SEQ ID NO: 3007955 - DNA, 17 bp, Homo sapiens
tctccctaccttgcctc

SEQ ID NO: 3007956 - DNA, 16 bp, Homo sapiens
tctccctagcccaccc

SEQ ID NO: 3007957 - DNA, 18 bp, Homo sapiens
tctccctctcctgcctac

SEQ ID NO: 3007958 - DNA, 12 bp, Homo sapiens
tctccctctggc

SEQ ID NO: 3007959 - DNA, 17 bp, Homo sapiens
tctccctctggccctgc

SEQ ID NO: 3007960 - DNA, 17 bp, Homo sapiens
tctccctctttctagcc

SEQ ID NO: 3007961 - DNA, 15 bp, Homo sapiens
tctccctctttttct

SEQ ID NO: 3007962 - DNA, 12 bp, Homo sapiens
tctccctgccat

SEQ ID NO: 3007963 - DNA, 15 bp, Homo sapiens
tctccctgccatccc

SEQ ID NO: 3007964 - DNA, 16 bp, Homo sapiens
tctccctgccatcccc

SEQ ID NO: 3007965 - DNA, 16 bp, Homo sapiens
tctccctgcctcacat

SEQ ID NO: 3007966 - DNA, 18 bp, Homo sapiens
tctccctgcctcacatct

SEQ ID NO: 3007967 - DNA, 20 bp, Homo sapiens
tctccctgcctcacatctcc

SEQ ID NO: 3007968 - DNA, 13 bp, Homo sapiens
tctccctgcttca

SEQ ID NO: 3007969 - DNA, 15 bp, Homo sapiens
tctcccttacccatc

SEQ ID NO: 3007970 - DNA, 12 bp, Homo sapiens
tctcccttacta

SEQ ID NO: 3007971 - DNA, 15 bp, Homo sapiens
tctcccttactattc

SEQ ID NO: 3007972 - DNA, 19 bp, Homo sapiens
tctcccttactattcccac

SEQ ID NO: 3007973 - DNA, 15 bp, Homo sapiens
tctcccttccacctc

SEQ ID NO: 3007974 - DNA, 19 bp, Homo sapiens
tctcccttggcccagagac

SEQ ID NO: 3007975 - DNA, 12 bp, Homo sapiens
tctccgaaagaa

SEQ ID NO: 3007976 - DNA, 16 bp, Homo sapiens
tctccgaaagaagaca

SEQ ID NO: 3007977 - DNA, 16 bp, Homo sapiens
tctccgcacacctctg

SEQ ID NO: 3007978 - DNA, 19 bp, Homo sapiens
tctccgcacacctctggct

SEQ ID NO: 3007979 - DNA, 21 bp, Homo sapiens
tctccgcacacctctggctgt

SEQ ID NO: 3007980 - DNA, 23 bp, Homo sapiens
tctccgcacacctctggctgtct

SEQ ID NO: 3007981 - DNA, 16 bp, Homo sapiens
tctccgcctccacact

SEQ ID NO: 3007982 - DNA, 14 bp, Homo sapiens
tctccgcctcctga

SEQ ID NO: 3007983 - DNA, 17 bp, Homo sapiens
tctccgcgccctccgac

SEQ ID NO: 3007984 - DNA, 15 bp, Homo sapiens
tctccggcgcagaca

SEQ ID NO: 3007985 - DNA, 19 bp, Homo sapiens
tctccgtatgatgtgatat

SEQ ID NO: 3007986 - DNA, 17 bp, Homo sapiens
tctcctactctgtgtaa

SEQ ID NO: 3007987 - DNA, 20 bp, Homo sapiens
tctcctaggggcttggtcct

SEQ ID NO: 3007988 - DNA, 15 bp, Homo sapiens
tctcctatatatttc

SEQ ID NO: 3007989 - DNA, 22 bp, Homo sapiens
tctcctatatatttctattatt

SEQ ID NO: 3007990 - DNA, 23 bp, Homo sapiens
tcctgcttgatgggattctggac

SEQ ID NO: 3007991 - DNA, 18 bp, Homo sapiens
tcctgctttgggaagccg

SEQ ID NO: 3007992 - DNA, 17 bp, Homo sapiens
tcctggaagcagagcaa

SEQ ID NO: 3007993 - DNA, 20 bp, Homo sapiens
tcctggaagcagagcaaaat

SEQ ID NO: 3007994 - DNA, 21 bp, Homo sapiens
tcctggacatgaagattcttt

SEQ ID NO: 3007995 - DNA, 19 bp, Homo sapiens
tcctggacattttttcagt

SEQ ID NO: 3007996 - DNA, 16 bp, Homo sapiens
tcctggactcctgcca

SEQ ID NO: 3007997 - DNA, 14 bp, Homo sapiens
tcctggactggtta

SEQ ID NO: 3007998 - DNA, 19 bp, Homo sapiens
tcctggagcagaaagtgcc

SEQ ID NO: 3007999 - DNA, 15 bp, Homo sapiens
tcctggagctctgtg

SEQ ID NO: 3008000 - DNA, 16 bp, Homo sapiens
tcctggagctctgtgg

SEQ ID NO: 3008001 - DNA, 18 bp, Homo sapiens
tcctggagctctgtgggt

SEQ ID NO: 3008002 - DNA, 21 bp, Homo sapiens
tcctggagggaagcactgcct

SEQ ID NO: 3008003 - DNA, 17 bp, Homo sapiens
tcctggagggcgcccag

SEQ ID NO: 3008004 - DNA, 20 bp, Homo sapiens
tcctggagggcgcccagcag

SEQ ID NO: 3008005 - DNA, 16 bp, Homo sapiens
tcctggaggtcttttc

SEQ ID NO: 3008006 - DNA, 14 bp, Homo sapiens
tcctggatgtctga

SEQ ID NO: 3008007 - DNA, 16 bp, Homo sapiens
tcctggccatcccaca

SEQ ID NO: 3008008 - DNA, 13 bp, Homo sapiens
tcctggcccaggc

SEQ ID NO: 3008009 - DNA, 19 bp, Homo sapiens
tcctggcccaggccttgct

SEQ ID NO: 3008010 - DNA, 17 bp, Homo sapiens
tcctggcctcagactgc

SEQ ID NO: 3008011 - DNA, 15 bp, Homo sapiens
tcctggccttgctga

SEQ ID NO: 3008012 - DNA, 16 bp, Homo sapiens
tcctggctcaggccca

SEQ ID NO: 3008013 - DNA, 18 bp, Homo sapiens
tcctggctcaggcccagc

SEQ ID NO: 3008014 - DNA, 23 bp, Homo sapiens
tcctggctttttaactcccctgt

SEQ ID NO: 3008015 - DNA, 21 bp, Homo sapiens
tcctgggaaatattccctaga

SEQ ID NO: 3008016 - DNA, 20 bp, Homo sapiens
tcctgggagctcatgtgtcc

SEQ ID NO: 3008017 - DNA, 15 bp, Homo sapiens
tcctgggaggctgca

SEQ ID NO: 3008018 - DNA, 16 bp, Homo sapiens
tcctgggaggctgcag

SEQ ID NO: 3008019 - DNA, 18 bp, Homo sapiens
tcctgggaggctgcagcc

SEQ ID NO: 3008020 - DNA, 23 bp, Homo sapiens
tcctgggaggctgcagccaggcc

SEQ ID NO: 3008021 - DNA, 21 bp, Homo sapiens
tcctgggcaggtgggagctga

SEQ ID NO: 3008022 - DNA, 10 bp, Homo sapiens
tcctgggccc

SEQ ID NO: 3008023 - DNA, 19 bp, Homo sapiens
tcctgggcccccagagacc

SEQ ID NO: 3008024 - DNA, 19 bp, Homo sapiens
tcctgggtggtctgcaggc

SEQ ID NO: 3008025 - DNA, 23 bp, Homo sapiens
tcctgggttcaagcaatcctcct

SEQ ID NO: 3008026 - DNA, 19 bp, Homo sapiens
tcctggtcctggctgcact

SEQ ID NO: 3008027 - DNA, 16 bp, Homo sapiens
tcctggtctgctcagg

SEQ ID NO: 3008028 - DNA, 21 bp, Homo sapiens
tcctggtgagaactgaggagc

SEQ ID NO: 3008029 - DNA, 14 bp, Homo sapiens
tcctggtggctggg

SEQ ID NO: 3008030 - DNA, 17 bp, Homo sapiens
tcctggtggctgggccc

SEQ ID NO: 3008031 - DNA, 23 bp, Homo sapiens
tcctggtggctgggcccagcagg

SEQ ID NO: 3008032 - DNA, 22 bp, Homo sapiens
tcctggtgtcaccccagagcca

SEQ ID NO: 3008033 - DNA, 14 bp, Homo sapiens
tcctggtgtgaagg

SEQ ID NO: 3008034 - DNA, 17 bp, Homo sapiens
tcctgtaatgttaaact

SEQ ID NO: 3008035 - DNA, 22 bp, Homo sapiens
tcctgtagccttctgtaggaat

SEQ ID NO: 3008036 - DNA, 23 bp, Homo sapiens
tcctgtagttgcgtggactctgc

SEQ ID NO: 3008037 - DNA, 16 bp, Homo sapiens
tcctgtatgtctgtca

SEQ ID NO: 3008038 - DNA, 20 bp, Homo sapiens
tcctgtccaacctaacccct

SEQ ID NO: 3008039 - DNA, 19 bp, Homo sapiens
tcctgtccacacccagctc

SEQ ID NO: 3008040 - DNA, 13 bp, Homo sapiens
tcctgtccagctc

SEQ ID NO: 3008041 - DNA, 17 bp, Homo sapiens
tcctgtccagctccaac

SEQ ID NO: 3008042 - DNA, 22 bp, Homo sapiens
tcctgtcgattagactggacag

SEQ ID NO: 3008043 - DNA, 15 bp, Homo sapiens
tcctgtctcaatagc

SEQ ID NO: 3008044 - DNA, 17 bp, Homo sapiens
tcctgtctcaatagctc

SEQ ID NO: 3008045 - DNA, 14 bp, Homo sapiens
tcctgtctgaacct

SEQ ID NO: 3008046 - DNA, 15 bp, Homo sapiens
tcctgtctttctgag

SEQ ID NO: 3008047 - DNA, 11 bp, Homo sapiens
tcctgtgagga

SEQ ID NO: 3008048 - DNA, 18 bp, Homo sapiens
tcctgtgaggagccccat

SEQ ID NO: 3008049 - DNA, 22 bp, Homo sapiens
tcctgtgaggagccccatctgt

SEQ ID NO: 3008050 - DNA, 17 bp, Homo sapiens
tcctgtgaggtttccca

SEQ ID NO: 3008051 - DNA, 19 bp, Homo sapiens
tcctgtgaggtttcccaat

SEQ ID NO: 3008052 - DNA, 22 bp, Homo sapiens
tcctgtgcccatcatctctgcc

SEQ ID NO: 3008053 - DNA, 18 bp, Homo sapiens
tcctgtggcatgcaaaag

SEQ ID NO: 3008054 - DNA, 22 bp, Homo sapiens
tcctgtggcatgcaaaagaaag

SEQ ID NO: 3008055 - DNA, 13 bp, Homo sapiens
tcctgtggctccc

SEQ ID NO: 3008056 - DNA, 18 bp, Homo sapiens
tcctgtggctccctctct

SEQ ID NO: 3008057 - DNA, 19 bp, Homo sapiens
tcctgtggctccctctctc

SEQ ID NO: 3008058 - DNA, 14 bp, Homo sapiens
tcctgtgtaaatta

SEQ ID NO: 3008059 - DNA, 23 bp, Homo sapiens
tcctgtgtattaaacctttccat

SEQ ID NO: 3008060 - DNA, 19 bp, Homo sapiens
tcctgtgtgattgacagct

SEQ ID NO: 3008061 - DNA, 23 bp, Homo sapiens
tcctgttagctcctcactgtggt

SEQ ID NO: 3008062 - DNA, 14 bp, Homo sapiens
tcctgttaggccaa

SEQ ID NO: 3008063 - DNA, 21 bp, Homo sapiens
tcctgttaggccaactgcctc

SEQ ID NO: 3008064 - DNA, 23 bp, Homo sapiens
tcctgttcagaaaggggctcttc

SEQ ID NO: 3008065 - DNA, 14 bp, Homo sapiens
tcctgttctgtgac

SEQ ID NO: 3008066 - DNA, 21 bp, Homo sapiens
tcctgttggatttgtttaaaa

SEQ ID NO: 3008067 - DNA, 17 bp, Homo sapiens
tcctgttggctgctgcc

SEQ ID NO: 3008068 - DNA, 18 bp, Homo sapiens
tcctgttggctgctgcca

SEQ ID NO: 3008069 - DNA, 15 bp, Homo sapiens
tcctgtttattttta

SEQ ID NO: 3008070 - DNA, 22 bp, Homo sapiens
tcctgtttctgaaaagaaataa

SEQ ID NO: 3008071 - DNA, 20 bp, Homo sapiens
tcctgttttaagcagctcta

SEQ ID NO: 3008072 - DNA, 23 bp, Homo sapiens
tcctgttttctaaaaaaaaaaac

SEQ ID NO: 3008073 - DNA, 15 bp, Homo sapiens
tccttaaaacagaga

SEQ ID NO: 3008074 - DNA, 13 bp, Homo sapiens
tccttaaaatgtg

SEQ ID NO: 3008075 - DNA, 17 bp, Homo sapiens
tccttaagtcagaacag

SEQ ID NO: 3008076 - DNA, 16 bp, Homo sapiens
tccttacttccagcaa

SEQ ID NO: 3008077 - DNA, 22 bp, Homo sapiens
tccttacttccagcaaaatcca

SEQ ID NO: 3008078 - DNA, 16 bp, Homo sapiens
tccttagctgccaagc

SEQ ID NO: 3008079 - DNA, 20 bp, Homo sapiens
tccttatttcaagggttgct

SEQ ID NO: 3008080 - DNA, 23 bp, Homo sapiens
tccttcaattccatatatccttt

SEQ ID NO: 3008081 - DNA, 16 bp, Homo sapiens
tccttcacatctccca

SEQ ID NO: 3008082 - DNA, 17 bp, Homo sapiens
tccttcacctcactgaa

SEQ ID NO: 3008083 - DNA, 19 bp, Homo sapiens
tccttcacctcactgaaaa

SEQ ID NO: 3008084 - DNA, 23 bp, Homo sapiens
tccttcacctttcccactttctt

SEQ ID NO: 3008085 - DNA, 18 bp, Homo sapiens
tccttcactggcgccttc

SEQ ID NO: 3008086 - DNA, 21 bp, Homo sapiens
tccttcactggcgccttctcg

SEQ ID NO: 3008087 - DNA, 18 bp, Homo sapiens
tccttcagcttccatttc

SEQ ID NO: 3008088 - DNA, 23 bp, Homo sapiens
tccttcagggtgatgccaggttc

SEQ ID NO: 3008089 - DNA, 15 bp, Homo sapiens
tccttccaccaagtt

SEQ ID NO: 3008090 - DNA, 15 bp, Homo sapiens
tccttccagcccaga

SEQ ID NO: 3008091 - DNA, 15 bp, Homo sapiens
tccttccatcaaata

SEQ ID NO: 3008092 - DNA, 15 bp, Homo sapiens
tccttccatgctccc

SEQ ID NO: 3008093 - DNA, 14 bp, Homo sapiens
tccttcctcttggc

SEQ ID NO: 3008094 - DNA, 15 bp, Homo sapiens
tccttcctcttggct

SEQ ID NO: 3008095 - DNA, 16 bp, Homo sapiens
tccttctcttctcttc

SEQ ID NO: 3008096 - DNA, 14 bp, Homo sapiens
tccttctgaaaata

SEQ ID NO: 3008097 - DNA, 22 bp, Homo sapiens
tccttctgaaaatatttacatt

SEQ ID NO: 3008098 - DNA, 22 bp, Homo sapiens
tccttctgaagtgtgtccatcc

SEQ ID NO: 3008099 - DNA, 12 bp, Homo sapiens
tccttctgtgaa

SEQ ID NO: 3008100 - DNA, 17 bp, Homo sapiens
tccttcttccacttctc

SEQ ID NO: 3008101 - DNA, 21 bp, Homo sapiens
tccttgaagacatatcatgtg

SEQ ID NO: 3008102 - DNA, 21 bp, Homo sapiens
tccttgagacacggagcccag

SEQ ID NO: 3008103 - DNA, 14 bp, Homo sapiens
tccttgcacctgca

SEQ ID NO: 3008104 - DNA, 23 bp, Homo sapiens
tccttgcagtttaagatgacact

SEQ ID NO: 3008105 - DNA, 22 bp, Homo sapiens
tccttgcccatcgggaccagaa

SEQ ID NO: 3008106 - DNA, 13 bp, Homo sapiens
tccttgcctgtct

SEQ ID NO: 3008107 - DNA, 15 bp, Homo sapiens
tccttgctatgatga

SEQ ID NO: 3008108 - DNA, 21 bp, Homo sapiens
tccttgctcctggccttgctg

SEQ ID NO: 3008109 - DNA, 16 bp, Homo sapiens
tccttgcttttatgtt

SEQ ID NO: 3008110 - DNA, 21 bp, Homo sapiens
tccttggcaggctgatttcta

SEQ ID NO: 3008111 - DNA, 18 bp, Homo sapiens
tccttggccaagagaagg

SEQ ID NO: 3008112 - DNA, 14 bp, Homo sapiens
tccttgggcccttt

SEQ ID NO: 3008113 - DNA, 14 bp, Homo sapiens
tccttggggcaggc

SEQ ID NO: 3008114 - DNA, 17 bp, Homo sapiens
tccttggggcaggcagt

SEQ ID NO: 3008115 - DNA, 14 bp, Homo sapiens
tccttgtttcaaac

SEQ ID NO: 3008116 - DNA, 22 bp, Homo sapiens
tccttgtttcaaacacaaatgc

SEQ ID NO: 3008117 - DNA, 15 bp, Homo sapiens
tcctttaaaaaagaa

SEQ ID NO: 3008118 - DNA, 18 bp, Homo sapiens
tcctttaaaaaagaaaag

SEQ ID NO: 3008119 - DNA, 13 bp, Homo sapiens
tcctttaactcgt

SEQ ID NO: 3008120 - DNA, 20 bp, Homo sapiens
tcctttaactcgttgcagtc

SEQ ID NO: 3008121 - DNA, 21 bp, Homo sapiens
tcctttaattttttactattt

SEQ ID NO: 3008122 - DNA, 14 bp, Homo sapiens
tcctttactcctgg

SEQ ID NO: 3008123 - DNA, 15 bp, Homo sapiens
tcctttactcctggc

SEQ ID NO: 3008124 - DNA, 21 bp, Homo sapiens
tcctttataagttgctttcct

SEQ ID NO: 3008125 - DNA, 14 bp, Homo sapiens
tcgggaaggatggg

SEQ ID NO: 3008126 - DNA, 16 bp, Homo sapiens
tcgggaaggatgggaa

SEQ ID NO: 3008127 - DNA, 17 bp, Homo sapiens
tcgggaaggatgggaaa

SEQ ID NO: 3008128 - DNA, 10 bp, Homo sapiens
tcgggaccag

SEQ ID NO: 3008129 - DNA, 21 bp, Homo sapiens
tcgggagaggggacgcaggcc

SEQ ID NO: 3008130 - DNA, 19 bp, Homo sapiens
tcgggcaggggctggaggg

SEQ ID NO: 3008131 - DNA, 13 bp, Homo sapiens
tcgggcccttccc

SEQ ID NO: 3008132 - DNA, 13 bp, Homo sapiens
tcgggctgtgccc

SEQ ID NO: 3008133 - DNA, 20 bp, Homo sapiens
tcggggagccgggagcctga

SEQ ID NO: 3008134 - DNA, 13 bp, Homo sapiens
tcggtcaccttgt

SEQ ID NO: 3008135 - DNA, 17 bp, Homo sapiens
tcggtcatgtgtgtatt

SEQ ID NO: 3008136 - DNA, 18 bp, Homo sapiens
tcggtgtggacgctgtgc

SEQ ID NO: 3008137 - DNA, 13 bp, Homo sapiens
tcggttccagaca

SEQ ID NO: 3008138 - DNA, 16 bp, Homo sapiens
tcggttgattgtgcat

SEQ ID NO: 3008139 - DNA, 13 bp, Homo sapiens
tcgtaccttccca

SEQ ID NO: 3008140 - DNA, 21 bp, Homo sapiens
tcgtatagctgtattgaatca

SEQ ID NO: 3008141 - DNA, 17 bp, Homo sapiens
tcgtattaaaaaacaat

SEQ ID NO: 3008142 - DNA, 18 bp, Homo sapiens
tcgtcaatccatcagcaa

SEQ ID NO: 3008143 - DNA, 18 bp, Homo sapiens
tcgtcactaatacacagt

SEQ ID NO: 3008144 - DNA, 19 bp, Homo sapiens
tcgtcaggctgccagagaa

SEQ ID NO: 3008145 - DNA, 14 bp, Homo sapiens
tcgtcatcttccct

SEQ ID NO: 3008146 - DNA, 18 bp, Homo sapiens
tcgtcatcttccctgccc

SEQ ID NO: 3008147 - DNA, 16 bp, Homo sapiens
tcgtccacagcttcct

SEQ ID NO: 3008148 - DNA, 12 bp, Homo sapiens
tcgtccagggag

SEQ ID NO: 3008149 - DNA, 13 bp, Homo sapiens
tcgtcctccccct

SEQ ID NO: 3008150 - DNA, 14 bp, Homo sapiens
tcgtcctccccctg

SEQ ID NO: 3008151 - DNA, 18 bp, Homo sapiens
tcgtcctccccctgccag

SEQ ID NO: 3008152 - DNA, 22 bp, Homo sapiens
tcgtcgaaaggtgcagctgcgt

SEQ ID NO: 3008153 - DNA, 17 bp, Homo sapiens
tcgtgaagtatactgta

SEQ ID NO: 3008154 - DNA, 18 bp, Homo sapiens
tcgtgacgctgaataaat

SEQ ID NO: 3008155 - DNA, 14 bp, Homo sapiens
tcgtgtctggcaca

SEQ ID NO: 3008156 - DNA, 21 bp, Homo sapiens
tcgtgtctggcacagcctggc

SEQ ID NO: 3008157 - DNA, 14 bp, Homo sapiens
tcgtgttttcaagg

SEQ ID NO: 3008158 - DNA, 22 bp, Homo sapiens
tcgtgttttcaaggaagaaaac

SEQ ID NO: 3008159 - DNA, 15 bp, Homo sapiens
tcgttcccatagatt

SEQ ID NO: 3008160 - DNA, 15 bp, Homo sapiens
tcgttccccacccct

SEQ ID NO: 3008161 - DNA, 21 bp, Homo sapiens
tcgttgccctaattcatcttt

SEQ ID NO: 3008162 - DNA, 15 bp, Homo sapiens
tcgttgcctctgatt

SEQ ID NO: 3008163 - DNA, 17 bp, Homo sapiens
tcgttggttgtttctct

SEQ ID NO: 3008164 - DNA, 13 bp, Homo sapiens
tcgtttaatgttt

SEQ ID NO: 3008165 - DNA, 14 bp, Homo sapiens
tcgtttaatgttta

SEQ ID NO: 3008166 - DNA, 12 bp, Homo sapiens
tcgtttctgtat

SEQ ID NO: 3008167 - DNA, 17 bp, Homo sapiens
tctaaaaaaaaaaactg

SEQ ID NO: 3008168 - DNA, 18 bp, Homo sapiens
tctaaaaagatgtaataa

SEQ ID NO: 3008169 - DNA, 18 bp, Homo sapiens
tctaaaacatagactgaa

SEQ ID NO: 3008170 - DNA, 12 bp, Homo sapiens
tctaaaagactt

SEQ ID NO: 3008171 - DNA, 17 bp, Homo sapiens
tctaaaagcagaaaata

SEQ ID NO: 3008172 - DNA, 13 bp, Homo sapiens
tctaaaagtgtca

SEQ ID NO: 3008173 - DNA, 18 bp, Homo sapiens
tctaaaatcttatagttc

SEQ ID NO: 3008174 - DNA, 22 bp, Homo sapiens
tctaaacagatgtccctgaagt

SEQ ID NO: 3008175 - DNA, 22 bp, Homo sapiens
tctaaaccatctatgtgaatat

SEQ ID NO: 3008176 - DNA, 19 bp, Homo sapiens
tctaaacccaatccaaatg

SEQ ID NO: 3008177 - DNA, 18 bp, Homo sapiens
tctaaaccccagattctt

SEQ ID NO: 3008178 - DNA, 24 bp, Homo sapiens
tctaaaccccagattcttcagctt

SEQ ID NO: 3008179 - DNA, 20 bp, Homo sapiens
tctaaacgtaagcactgttt

SEQ ID NO: 3008180 - DNA, 20 bp, Homo sapiens
tctaaagagtttattttaag

SEQ ID NO: 3008181 - DNA, 18 bp, Homo sapiens
tctaaagatggagtttct

SEQ ID NO: 3008182 - DNA, 20 bp, Homo sapiens
tctaaagatggagtttctaa

SEQ ID NO: 3008183 - DNA, 13 bp, Homo sapiens
tctaaaggagcag

SEQ ID NO: 3008184 - DNA, 20 bp, Homo sapiens
tctaaaggatggaaaaataa

SEQ ID NO: 3008185 - DNA, 21 bp, Homo sapiens
tctaaaggatggaaaaataaa

SEQ ID NO: 3008186 - DNA, 20 bp, Homo sapiens
tctaaagtcatcatgaactg

SEQ ID NO: 3008187 - DNA, 11 bp, Homo sapiens
tctaaagttct

SEQ ID NO: 3008188 - DNA, 17 bp, Homo sapiens
tctaaagttctaagatt

SEQ ID NO: 3008189 - DNA, 15 bp, Homo sapiens
tctaaatagatactt

SEQ ID NO: 3008190 - DNA, 19 bp, Homo sapiens
tctaaatagatacttttga

SEQ ID NO: 3008191 - DNA, 20 bp, Homo sapiens
tctaaatagatacttttgat

SEQ ID NO: 3008192 - DNA, 23 bp, Homo sapiens
tctaaatatgaatgaatgggata

SEQ ID NO: 3008193 - DNA, 17 bp, Homo sapiens
tctaaatattcagaatc

SEQ ID NO: 3008194 - DNA, 16 bp, Homo sapiens
tctaaatgcccagttc

SEQ ID NO: 3008195 - DNA, 20 bp, Homo sapiens
tctaaatgttattacttgta

SEQ ID NO: 3008196 - DNA, 15 bp, Homo sapiens
tctaaattaagtccc

SEQ ID NO: 3008197 - DNA, 17 bp, Homo sapiens
tctaaattgatcattca

SEQ ID NO: 3008198 - DNA, 19 bp, Homo sapiens
tctaaccaaagagtctctg

SEQ ID NO: 3008199 - DNA, 20 bp, Homo sapiens
tctaaccaaagagtctctgg

SEQ ID NO: 3008200 - DNA, 18 bp, Homo sapiens
tctaacccagtggctgga

SEQ ID NO: 3008201 - DNA, 12 bp, Homo sapiens
tctaactccctc

SEQ ID NO: 3008202 - DNA, 23 bp, Homo sapiens
tctaactccctcctcacactcca

SEQ ID NO: 3008203 - DNA, 21 bp, Homo sapiens
tctaagactcaaatgttctaa

SEQ ID NO: 3008204 - DNA, 22 bp, Homo sapiens
tctaagactcaaatgttctaag

SEQ ID NO: 3008205 - DNA, 20 bp, Homo sapiens
tctaagacttactctaagat

SEQ ID NO: 3008206 - DNA, 17 bp, Homo sapiens
tctaagatcttagattc

SEQ ID NO: 3008207 - DNA, 22 bp, Homo sapiens
tctaagatgtgatattctaaga

SEQ ID NO: 3008208 - DNA, 13 bp, Homo sapiens
tctaagattctaa

SEQ ID NO: 3008209 - DNA, 19 bp, Homo sapiens
tctaagattctaaaggtcc

SEQ ID NO: 3008210 - DNA, 14 bp, Homo sapiens
tctaagattctaga

SEQ ID NO: 3008211 - DNA, 13 bp, Homo sapiens
tctaagattctga

SEQ ID NO: 3008212 - DNA, 15 bp, Homo sapiens
tctaagcagccagga

SEQ ID NO: 3008213 - DNA, 20 bp, Homo sapiens
tctaagcagttttgtaaatg

SEQ ID NO: 3008214 - DNA, 21 bp, Homo sapiens
tctaagcagttttgtaaatgt

SEQ ID NO: 3008215 - DNA, 22 bp, Homo sapiens
tctaagcagttttgtaaatgta

SEQ ID NO: 3008216 - DNA, 18 bp, Homo sapiens
tctaagcatgtagccagt

SEQ ID NO: 3008217 - DNA, 16 bp, Homo sapiens
tctaagcctgaagggg

SEQ ID NO: 3008218 - DNA, 17 bp, Homo sapiens
tctaaggataatgaaat

SEQ ID NO: 3008219 - DNA, 18 bp, Homo sapiens
tctaaggccctttttcct

SEQ ID NO: 3008220 - DNA, 13 bp, Homo sapiens
tctaaggctctga

SEQ ID NO: 3008221 - DNA, 16 bp, Homo sapiens
tctaaggctctgagag

SEQ ID NO: 3008222 - DNA, 20 bp, Homo sapiens
tctaaggctctgagagtcta

SEQ ID NO: 3008223 - DNA, 20 bp, Homo sapiens
tctaagttataagactctca

SEQ ID NO: 3008224 - DNA, 12 bp, Homo sapiens
tctaagtttcta

SEQ ID NO: 3008225 - DNA, 13 bp, Homo sapiens
tctaagtttctaa

SEQ ID NO: 3008226 - DNA, 14 bp, Homo sapiens
tctaagtttctaag

SEQ ID NO: 3008227 - DNA, 17 bp, Homo sapiens
tctaagtttctaagatt

SEQ ID NO: 3008228 - DNA, 18 bp, Homo sapiens
tctaagtttctaagattc

SEQ ID NO: 3008229 - DNA, 23 bp, Homo sapiens
tctaagtttctaagattctaaag

SEQ ID NO: 3008230 - DNA, 17 bp, Homo sapiens
tctaatacctctgtgtg

SEQ ID NO: 3008231 - DNA, 16 bp, Homo sapiens
tctaattaaaacactt

SEQ ID NO: 3008232 - DNA, 23 bp, Homo sapiens
tctaattaaccttactaattata

SEQ ID NO: 3008233 - DNA, 19 bp, Homo sapiens
tctaattctattaaagtgc

SEQ ID NO: 3008234 - DNA, 17 bp, Homo sapiens
tctaattttgtgctctt

SEQ ID NO: 3008235 - DNA, 21 bp, Homo sapiens
tctaattttgtgctctttcct

SEQ ID NO: 3008236 - DNA, 23 bp, Homo sapiens
tctaattttgtgctctttcctgc

SEQ ID NO: 3008237 - DNA, 18 bp, Homo sapiens
tctacaaaaaataaaata

SEQ ID NO: 3008238 - DNA, 22 bp, Homo sapiens
tctacaaaaaggtataaataat

SEQ ID NO: 3008239 - DNA, 12 bp, Homo sapiens
tctacacctgga

SEQ ID NO: 3008240 - DNA, 15 bp, Homo sapiens
tctacataattgtga

SEQ ID NO: 3008241 - DNA, 17 bp, Homo sapiens
tctacataattgtgacc

SEQ ID NO: 3008242 - DNA, 12 bp, Homo sapiens
tctacatcactc

SEQ ID NO: 3008243 - DNA, 13 bp, Homo sapiens
tctacatgaatgc

SEQ ID NO: 3008244 - DNA, 20 bp, Homo sapiens
tctacatgaggaactgtaga

SEQ ID NO: 3008245 - DNA, 18 bp, Homo sapiens
tctacatttaaacaagta

SEQ ID NO: 3008246 - DNA, 20 bp, Homo sapiens
tctacatttaaacaagtatt

SEQ ID NO: 3008247 - DNA, 14 bp, Homo sapiens
tctacatttcttag

SEQ ID NO: 3008248 - DNA, 12 bp, Homo sapiens
tctacatttgtt

SEQ ID NO: 3008249 - DNA, 18 bp, Homo sapiens
tctacatttgtttgtatt

SEQ ID NO: 3008250 - DNA, 16 bp, Homo sapiens
tctaccaggcaaattc

SEQ ID NO: 3008251 - DNA, 22 bp, Homo sapiens
tctaccagtgcaggctggccag

SEQ ID NO: 3008252 - DNA, 14 bp, Homo sapiens
tctacccgtgcctg

SEQ ID NO: 3008253 - DNA, 16 bp, Homo sapiens
tctcaattttgtattt

SEQ ID NO: 3008254 - DNA, 17 bp, Homo sapiens
tctcacactcctcctgc

SEQ ID NO: 3008255 - DNA, 20 bp, Homo sapiens
tctcacactggttctcaatg

SEQ ID NO: 3008256 - DNA, 13 bp, Homo sapiens
tctcaccagctgc

SEQ ID NO: 3008257 - DNA, 14 bp, Homo sapiens
tctcaccagctgca

SEQ ID NO: 3008258 - DNA, 20 bp, Homo sapiens
tctcaccagctgcaaagtgt

SEQ ID NO: 3008259 - DNA, 23 bp, Homo sapiens
tctcacccatgcaagcagaggac

SEQ ID NO: 3008260 - DNA, 13 bp, Homo sapiens
tctcacctcagcc

SEQ ID NO: 3008261 - DNA, 14 bp, Homo sapiens
tctcacctctgtgc

SEQ ID NO: 3008262 - DNA, 14 bp, Homo sapiens
tctcacgccacccc

SEQ ID NO: 3008263 - DNA, 16 bp, Homo sapiens
tctcactatgtttctc

SEQ ID NO: 3008264 - DNA, 21 bp, Homo sapiens
tctcactcagccgcagacaag

SEQ ID NO: 3008265 - DNA, 17 bp, Homo sapiens
tctcactccaccaccca

SEQ ID NO: 3008266 - DNA, 23 bp, Homo sapiens
tctcactccttttggtgtgttgg

SEQ ID NO: 3008267 - DNA, 23 bp, Homo sapiens
tctcactggccaagaaaattgcc

SEQ ID NO: 3008268 - DNA, 12 bp, Homo sapiens
tctcacttttca

SEQ ID NO: 3008269 - DNA, 20 bp, Homo sapiens
tctcagactggtctcgaact

SEQ ID NO: 3008270 - DNA, 15 bp, Homo sapiens
tccagaaggatttct

SEQ ID NO: 3008271 - DNA, 13 bp, Homo sapiens
tccagaatgctgt

SEQ ID NO: 3008272 - DNA, 15 bp, Homo sapiens
tccagaatgctgtac

SEQ ID NO: 3008273 - DNA, 19 bp, Homo sapiens
tccagaattacccttcctc

SEQ ID NO: 3008274 - DNA, 22 bp, Homo sapiens
tccagacagtcgctcagtctgt

SEQ ID NO: 3008275 - DNA, 18 bp, Homo sapiens
tccagacctgatcctgga

SEQ ID NO: 3008276 - DNA, 22 bp, Homo sapiens
tccagacctgatcctggaggcc

SEQ ID NO: 3008277 - DNA, 19 bp, Homo sapiens
tccagagaaagcacaattt

SEQ ID NO: 3008278 - DNA, 17 bp, Homo sapiens
tccagagacaggaaaga

SEQ ID NO: 3008279 - DNA, 18 bp, Homo sapiens
tccagagacaggaaagaa

SEQ ID NO: 3008280 - DNA, 23 bp, Homo sapiens
tccagagccggcatccttgcctg

SEQ ID NO: 3008281 - DNA, 17 bp, Homo sapiens
tccagagctctgaccca

SEQ ID NO: 3008282 - DNA, 20 bp, Homo sapiens
tccagagctgcttctgtctg

SEQ ID NO: 3008283 - DNA, 12 bp, Homo sapiens
tccagagggcac

SEQ ID NO: 3008284 - DNA, 17 bp, Homo sapiens
tccagagggcactctgc

SEQ ID NO: 3008285 - DNA, 15 bp, Homo sapiens
tccagagtccctgcc

SEQ ID NO: 3008286 - DNA, 19 bp, Homo sapiens
tccagagtccctgcctgga

SEQ ID NO: 3008287 - DNA, 16 bp, Homo sapiens
tccagagttaaaatgt

SEQ ID NO: 3008288 - DNA, 19 bp, Homo sapiens
tccagatgcagggcagtca

SEQ ID NO: 3008289 - DNA, 13 bp, Homo sapiens
tccagatgtgatg

SEQ ID NO: 3008290 - DNA, 23 bp, Homo sapiens
tccagattatctatttgtgtgtg

SEQ ID NO: 3008291 - DNA, 17 bp, Homo sapiens
tccagcaaaatccaaac

SEQ ID NO: 3008292 - DNA, 23 bp, Homo sapiens
tccagcaagcaaacagggtggcc

SEQ ID NO: 3008293 - DNA, 19 bp, Homo sapiens
tccagcaattctcctgcct

SEQ ID NO: 3008294 - DNA, 14 bp, Homo sapiens
tccagcacaaacac

SEQ ID NO: 3008295 - DNA, 17 bp, Homo sapiens
tccagcacaaacacaag

SEQ ID NO: 3008296 - DNA, 14 bp, Homo sapiens
tccagcaccttgtg

SEQ ID NO: 3008297 - DNA, 21 bp, Homo sapiens
tccagcaccttgtgcctgggg

SEQ ID NO: 3008298 - DNA, 22 bp, Homo sapiens
tccagcaccttgtgcctggggt

SEQ ID NO: 3008299 - DNA, 14 bp, Homo sapiens
tccagcagtcactt

SEQ ID NO: 3008300 - DNA, 18 bp, Homo sapiens
tccagcagtctctgcctt

SEQ ID NO: 3008301 - DNA, 20 bp, Homo sapiens
tccagcccagacccccagtg

SEQ ID NO: 3008302 - DNA, 20 bp, Homo sapiens
tccagccctgagttcctagc

SEQ ID NO: 3008303 - DNA, 22 bp, Homo sapiens
tccagccctgagttcctagcca

SEQ ID NO: 3008304 - DNA, 20 bp, Homo sapiens
tccagccctgcccaccctcc

SEQ ID NO: 3008305 - DNA, 20 bp, Homo sapiens
tccagcctcacagatgctgg

SEQ ID NO: 3008306 - DNA, 17 bp, Homo sapiens
tccagcctgagtgacag

SEQ ID NO: 3008307 - DNA, 20 bp, Homo sapiens
tccagcctgagtgacagagc

SEQ ID NO: 3008308 - DNA, 11 bp, Homo sapiens
tccagcctgcc

SEQ ID NO: 3008309 - DNA, 19 bp, Homo sapiens
tccagcctgcctggcaggc

SEQ ID NO: 3008310 - DNA, 11 bp, Homo sapiens
tccagcctggg

SEQ ID NO: 3008311 - DNA, 21 bp, Homo sapiens
tccagcctgggcaacaagagc

SEQ ID NO: 3008312 - DNA, 17 bp, Homo sapiens
tccagcctggggtctgg

SEQ ID NO: 3008313 - DNA, 17 bp, Homo sapiens
tccagcctgggtcacag

SEQ ID NO: 3008314 - DNA, 23 bp, Homo sapiens
tccagcctgggtgacagagcgag

SEQ ID NO: 3008315 - DNA, 20 bp, Homo sapiens
tccagcgatggtgctgccca

SEQ ID NO: 3008316 - DNA, 22 bp, Homo sapiens
tccagcgatggtgctgcccagg

SEQ ID NO: 3008317 - DNA, 23 bp, Homo sapiens
tccagcggttgccttttttatca

SEQ ID NO: 3008318 - DNA, 13 bp, Homo sapiens
tccagctcagcag

SEQ ID NO: 3008319 - DNA, 16 bp, Homo sapiens
tccagctcattcattt

SEQ ID NO: 3008320 - DNA, 19 bp, Homo sapiens
tccagctccaacctgcaaa

SEQ ID NO: 3008321 - DNA, 22 bp, Homo sapiens
tccagctctggcttcctgctga

SEQ ID NO: 3008322 - DNA, 13 bp, Homo sapiens
tccagctgccccg

SEQ ID NO: 3008323 - DNA, 21 bp, Homo sapiens
tccagctgcccttccgcagtg

SEQ ID NO: 3008324 - DNA, 17 bp, Homo sapiens
tccagctggtgccccca

SEQ ID NO: 3008325 - DNA, 12 bp, Homo sapiens
tccagctgtcag

SEQ ID NO: 3008326 - DNA, 17 bp, Homo sapiens
tccagctgtcagcctgg

SEQ ID NO: 3008327 - DNA, 22 bp, Homo sapiens
tccagctgtcagcctggttttc

SEQ ID NO: 3008328 - DNA, 23 bp, Homo sapiens
tccagcttgccagatgctgcaga

SEQ ID NO: 3008329 - DNA, 17 bp, Homo sapiens
tccagcttgctcttcag

SEQ ID NO: 3008330 - DNA, 16 bp, Homo sapiens
tccagctttactgtgg

SEQ ID NO: 3008331 - DNA, 18 bp, Homo sapiens
tccagctttactgtggct

SEQ ID NO: 3008332 - DNA, 19 bp, Homo sapiens
tccagcttttcctcagggt

SEQ ID NO: 3008333 - DNA, 18 bp, Homo sapiens
tccaggaaccacaccaca

SEQ ID NO: 3008334 - DNA, 22 bp, Homo sapiens
tccaggacacagattatcaact

SEQ ID NO: 3008335 - DNA, 20 bp, Homo sapiens
tccaggactatatttgggcc

SEQ ID NO: 3008336 - DNA, 23 bp, Homo sapiens
tccaggactatatttgggcctgc

SEQ ID NO: 3008337 - DNA, 16 bp, Homo sapiens
tccaggactgggtctg

SEQ ID NO: 3008338 - DNA, 21 bp, Homo sapiens
tccaggactgggtctgacctg

SEQ ID NO: 3008339 - DNA, 22 bp, Homo sapiens
tccaggactgggtctgacctgg

SEQ ID NO: 3008340 - DNA, 23 bp, Homo sapiens
tccaggagaaggccaattcctat

SEQ ID NO: 3008341 - DNA, 23 bp, Homo sapiens
tccaggatggtgttactgcagtt

SEQ ID NO: 3008342 - DNA, 14 bp, Homo sapiens
tccaggcactgaga

SEQ ID NO: 3008343 - DNA, 12 bp, Homo sapiens
tccaggcagaag

SEQ ID NO: 3008344 - DNA, 13 bp, Homo sapiens
tccaggcagatcc

SEQ ID NO: 3008345 - DNA, 20 bp, Homo sapiens
tccaggcagatccaggacta

SEQ ID NO: 3008346 - DNA, 15 bp, Homo sapiens
tccaggccagggctc

SEQ ID NO: 3008347 - DNA, 11 bp, Homo sapiens
tccaggcccaa

SEQ ID NO: 3008348 - DNA, 17 bp, Homo sapiens
tccaggcccaaggctcc

SEQ ID NO: 3008349 - DNA, 20 bp, Homo sapiens
tccaggccgcgccctttccc

SEQ ID NO: 3008350 - DNA, 12 bp, Homo sapiens
tccaggctgggc

SEQ ID NO: 3008351 - DNA, 15 bp, Homo sapiens
tccaggctgggcagc

SEQ ID NO: 3008352 - DNA, 13 bp, Homo sapiens
tccaggctgggct

SEQ ID NO: 3008353 - DNA, 18 bp, Homo sapiens
tccaggctgggtgacaga

SEQ ID NO: 3008354 - DNA, 21 bp, Homo sapiens
tccagggacagaggccccagc

SEQ ID NO: 3008355 - DNA, 11 bp, Homo sapiens
tccagggaggg

SEQ ID NO: 3008356 - DNA, 15 bp, Homo sapiens
tccagggctgccagg

SEQ ID NO: 3008357 - DNA, 17 bp, Homo sapiens
tccaggggatgggaggt

SEQ ID NO: 3008358 - DNA, 18 bp, Homo sapiens
tccagggtcccctgccac

SEQ ID NO: 3008359 - DNA, 17 bp, Homo sapiens
tccagggtgtgtgctcg

SEQ ID NO: 3008360 - DNA, 19 bp, Homo sapiens
tccaggtacgcacagacag

SEQ ID NO: 3008361 - DNA, 20 bp, Homo sapiens
tccaggtacgcacagacagg

SEQ ID NO: 3008362 - DNA, 18 bp, Homo sapiens
tccaggtcaacagaatga

SEQ ID NO: 3008363 - DNA, 18 bp, Homo sapiens
tccaggtgagtgtgaggg

SEQ ID NO: 3008364 - DNA, 14 bp, Homo sapiens
tccaggtgcagagg

SEQ ID NO: 3008365 - DNA, 13 bp, Homo sapiens
tccaggtgcccag

SEQ ID NO: 3008366 - DNA, 18 bp, Homo sapiens
tccaggtgttactgtaat

SEQ ID NO: 3008367 - DNA, 14 bp, Homo sapiens
tccagtaaaataat

SEQ ID NO: 3008368 - DNA, 15 bp, Homo sapiens
tccagtaatctaata

SEQ ID NO: 3008369 - DNA, 19 bp, Homo sapiens
tccagtaatctaatatggc

SEQ ID NO: 3008370 - DNA, 18 bp, Homo sapiens
tccagtccctgggagcaa

SEQ ID NO: 3008371 - DNA, 16 bp, Homo sapiens
tccagtcctgctggcc

SEQ ID NO: 3008372 - DNA, 22 bp, Homo sapiens
tccagtcctgctggcctgctct

SEQ ID NO: 3008373 - DNA, 17 bp, Homo sapiens
tccagtctgttctcaca

SEQ ID NO: 3008374 - DNA, 15 bp, Homo sapiens
tccagtcttagctga

SEQ ID NO: 3008375 - DNA, 12 bp, Homo sapiens
tccagtgcagtc

SEQ ID NO: 3008376 - DNA, 22 bp, Homo sapiens
tccagttaaaaaaaattttaat

SEQ ID NO: 3008377 - DNA, 18 bp, Homo sapiens
tccagttgattgtacgta

SEQ ID NO: 3008378 - DNA, 14 bp, Homo sapiens
tccagtttctgtaa

SEQ ID NO: 3008379 - DNA, 16 bp, Homo sapiens
tccatactttggatga

SEQ ID NO: 3008380 - DNA, 16 bp, Homo sapiens
tccatagagcagtgca

SEQ ID NO: 3008381 - DNA, 21 bp, Homo sapiens
tccatagcctaatccctgggc

SEQ ID NO: 3008382 - DNA, 22 bp, Homo sapiens
tccatagcctaatccctgggca

SEQ ID NO: 3008383 - DNA, 20 bp, Homo sapiens
tccatagctcttcacttcct

SEQ ID NO: 3008384 - DNA, 21 bp, Homo sapiens
tccatagctcttcacttcctc

SEQ ID NO: 3008385 - DNA, 15 bp, Homo sapiens
tccatagtaactgac

SEQ ID NO: 3008386 - DNA, 19 bp, Homo sapiens
tccatagtttggcatttgc

SEQ ID NO: 3008387 - DNA, 13 bp, Homo sapiens
tccatagttttga

SEQ ID NO: 3008388 - DNA, 18 bp, Homo sapiens
tccatatccttctggctg

SEQ ID NO: 3008389 - DNA, 20 bp, Homo sapiens
tccatattacgttgtttctt

SEQ ID NO: 3008390 - DNA, 20 bp, Homo sapiens
tcccattggatgcatttcta

SEQ ID NO: 3008391 - DNA, 17 bp, Homo sapiens
tcccattgtccctctgc

SEQ ID NO: 3008392 - DNA, 22 bp, Homo sapiens
tcccattgttggcgctgaggtg

SEQ ID NO: 3008393 - DNA, 14 bp, Homo sapiens
tcccatttcaggaa

SEQ ID NO: 3008394 - DNA, 16 bp, Homo sapiens
tcccatttcaggaatt

SEQ ID NO: 3008395 - DNA, 13 bp, Homo sapiens
tcccatttcctgt

SEQ ID NO: 3008396 - DNA, 17 bp, Homo sapiens
tcccatttgttgctgct

SEQ ID NO: 3008397 - DNA, 19 bp, Homo sapiens
tccccaaatccgaacctcc

SEQ ID NO: 3008398 - DNA, 15 bp, Homo sapiens
tccccaacagtgtga

SEQ ID NO: 3008399 - DNA, 21 bp, Homo sapiens
tccccaactccctctctgtgc

SEQ ID NO: 3008400 - DNA, 22 bp, Homo sapiens
tccccaagcgcctggctgctgc

SEQ ID NO: 3008401 - DNA, 24 bp, Homo sapiens
tccccaagcgcctggctgctgctt

SEQ ID NO: 3008402 - DNA, 20 bp, Homo sapiens
tccccaataattgcagaact

SEQ ID NO: 3008403 - DNA, 20 bp, Homo sapiens
tccccaatccatttggcaga

SEQ ID NO: 3008404 - DNA, 19 bp, Homo sapiens
tccccaatgagacttgcct

SEQ ID NO: 3008405 - DNA, 21 bp, Homo sapiens
tccccacagactgccccagcc

SEQ ID NO: 3008406 - DNA, 22 bp, Homo sapiens
tccccacagactgccccagcca

SEQ ID NO: 3008407 - DNA, 23 bp, Homo sapiens
tccccaccgctgagaggctgcct

SEQ ID NO: 3008408 - DNA, 17 bp, Homo sapiens
tccccacctccaggctt

SEQ ID NO: 3008409 - DNA, 20 bp, Homo sapiens
tccccaccttcttcagccac

SEQ ID NO: 3008410 - DNA, 21 bp, Homo sapiens
tccccacgacccctgcctcga

SEQ ID NO: 3008411 - DNA, 15 bp, Homo sapiens
tccccacgagggctg

SEQ ID NO: 3008412 - DNA, 17 bp, Homo sapiens
tccccacttctgtgcca

SEQ ID NO: 3008413 - DNA, 14 bp, Homo sapiens
tccccagagcccag

SEQ ID NO: 3008414 - DNA, 18 bp, Homo sapiens
tccccagatatttatgta

SEQ ID NO: 3008415 - DNA, 22 bp, Homo sapiens
tccccagcagggtcttttcatc

SEQ ID NO: 3008416 - DNA, 17 bp, Homo sapiens
tccccagcccagagaca

SEQ ID NO: 3008417 - DNA, 15 bp, Homo sapiens
tccccagcctctcct

SEQ ID NO: 3008418 - DNA, 10 bp, Homo sapiens
tccccagggg

SEQ ID NO: 3008419 - DNA, 15 bp, Homo sapiens
tccccaggggagttg

SEQ ID NO: 3008420 - DNA, 20 bp, Homo sapiens
tccccaggtggctgacccag

SEQ ID NO: 3008421 - DNA, 15 bp, Homo sapiens
tccccatcggccctg

SEQ ID NO: 3008422 - DNA, 20 bp, Homo sapiens
tccccatcggccctgtcccc

SEQ ID NO: 3008423 - DNA, 14 bp, Homo sapiens
tccccatctcaggc

SEQ ID NO: 3008424 - DNA, 15 bp, Homo sapiens
tccccatctgtcggc

SEQ ID NO: 3008425 - DNA, 11 bp, Homo sapiens
tccccatgaca

SEQ ID NO: 3008426 - DNA, 17 bp, Homo sapiens
tccccatgcctgtggct

SEQ ID NO: 3008427 - DNA, 20 bp, Homo sapiens
tccccatgcctgtggctgcg

SEQ ID NO: 3008428 - DNA, 16 bp, Homo sapiens
tccccatggagccagc

SEQ ID NO: 3008429 - DNA, 14 bp, Homo sapiens
tccccattcctacc

SEQ ID NO: 3008430 - DNA, 22 bp, Homo sapiens
tcccccaccagctaaggacatt

SEQ ID NO: 3008431 - DNA, 21 bp, Homo sapiens
tcccccaccctgggtttggcc

SEQ ID NO: 3008432 - DNA, 20 bp, Homo sapiens
tcccccaggggcgtgaggct

SEQ ID NO: 3008433 - DNA, 21 bp, Homo sapiens
tcccccagtatgtccttttct

SEQ ID NO: 3008434 - DNA, 20 bp, Homo sapiens
tcccccataaaatgatcctg

SEQ ID NO: 3008435 - DNA, 18 bp, Homo sapiens
tccccccactgcaggccc

SEQ ID NO: 3008436 - DNA, 13 bp, Homo sapiens
tcccccccatgca

SEQ ID NO: 3008437 - DNA, 13 bp, Homo sapiens
tccccccccaggc

SEQ ID NO: 3008438 - DNA, 19 bp, Homo sapiens
tcccccctcctctgaaaca

SEQ ID NO: 3008439 - DNA, 21 bp, Homo sapiens
tcccccgactgcctgtctcca

SEQ ID NO: 3008440 - DNA, 19 bp, Homo sapiens
tccccctaccgcatggcag

SEQ ID NO: 3008441 - DNA, 21 bp, Homo sapiens
tccccctaccgcatggcagct

SEQ ID NO: 3008442 - DNA, 13 bp, Homo sapiens
tccccctctgctt

SEQ ID NO: 3008443 - DNA, 16 bp, Homo sapiens
tccccctctgcttctc

SEQ ID NO: 3008444 - DNA, 12 bp, Homo sapiens
tccccctctgtc

SEQ ID NO: 3008445 - DNA, 18 bp, Homo sapiens
tccccctctgtcttctct

SEQ ID NO: 3008446 - DNA, 12 bp, Homo sapiens
tccccctgcagc

SEQ ID NO: 3008447 - DNA, 16 bp, Homo sapiens
tccccctgccagtgcc

SEQ ID NO: 3008448 - DNA, 16 bp, Homo sapiens
tccccctgccctgtgc

SEQ ID NO: 3008449 - DNA, 15 bp, Homo sapiens
tcccccttcacaaag

SEQ ID NO: 3008450 - DNA, 13 bp, Homo sapiens
tccccgaggctgc

SEQ ID NO: 3008451 - DNA, 20 bp, Homo sapiens
tccccgaggttgtggggagg

SEQ ID NO: 3008452 - DNA, 17 bp, Homo sapiens
tccccgatgctgacctc

SEQ ID NO: 3008453 - DNA, 23 bp, Homo sapiens
tccccgatgctgacctcacctgg

SEQ ID NO: 3008454 - DNA, 19 bp, Homo sapiens
tccccgcagtgtgcactaa

SEQ ID NO: 3008455 - DNA, 20 bp, Homo sapiens
tccccgcagtgtgcactaag

SEQ ID NO: 3008456 - DNA, 21 bp, Homo sapiens
tccccgcagtgtgcactaagg

SEQ ID NO: 3008457 - DNA, 22 bp, Homo sapiens
tccccgcagtgtgcactaaggg

SEQ ID NO: 3008458 - DNA, 19 bp, Homo sapiens
tccccgcattccaggctcc

SEQ ID NO: 3008459 - DNA, 16 bp, Homo sapiens
tccccgccctctctca

SEQ ID NO: 3008460 - DNA, 14 bp, Homo sapiens
tccccgccttccct

SEQ ID NO: 3008461 - DNA, 18 bp, Homo sapiens
tccccgctccgtctctgt

SEQ ID NO: 3008462 - DNA, 19 bp, Homo sapiens
tccccgctccgtctctgtc

SEQ ID NO: 3008463 - DNA, 11 bp, Homo sapiens
tccccggggcc

SEQ ID NO: 3008464 - DNA, 22 bp, Homo sapiens
tccccggtcccttgagacctca

SEQ ID NO: 3008465 - DNA, 15 bp, Homo sapiens
tcccctatccaccca

SEQ ID NO: 3008466 - DNA, 17 bp, Homo sapiens
tcccctatccacccagc

SEQ ID NO: 3008467 - DNA, 20 bp, Homo sapiens
tcccctatccacccagccca

SEQ ID NO: 3008468 - DNA, 13 bp, Homo sapiens
tcccctcacagac

SEQ ID NO: 3008469 - DNA, 15 bp, Homo sapiens
tcccctcacagactc

SEQ ID NO: 3008470 - DNA, 16 bp, Homo sapiens
tcccctcacagactct

SEQ ID NO: 3008471 - DNA, 11 bp, Homo sapiens
tcccctcagcg

SEQ ID NO: 3008472 - DNA, 22 bp, Homo sapiens
tcccctcagcgggggccttgaa

SEQ ID NO: 3008473 - DNA, 23 bp, Homo sapiens
tcccctcagcgggggccttgaag

SEQ ID NO: 3008474 - DNA, 21 bp, Homo sapiens
tcccctccatccccatcggcc

SEQ ID NO: 3008475 - DNA, 20 bp, Homo sapiens
tcccctccccatctgtgttc

SEQ ID NO: 3008476 - DNA, 21 bp, Homo sapiens
tcccctccccatctgtgttct

SEQ ID NO: 3008477 - DNA, 16 bp, Homo sapiens
tcccctcctttgtctt

SEQ ID NO: 3008478 - DNA, 18 bp, Homo sapiens
tcccctcctttgtctttt

SEQ ID NO: 3008479 - DNA, 16 bp, Homo sapiens
tcccctgacctgtcca

SEQ ID NO: 3008480 - DNA, 17 bp, Homo sapiens
tcccctgacctgtccag

SEQ ID NO: 3008481 - DNA, 22 bp, Homo sapiens
tcccctgaggatcccctgtccc

SEQ ID NO: 3008482 - DNA, 23 bp, Homo sapiens
tcccctgcccccagaccttttat

SEQ ID NO: 3008483 - DNA, 16 bp, Homo sapiens
tcccctgcgctttgaa

SEQ ID NO: 3008484 - DNA, 14 bp, Homo sapiens
tcccctgcttcaga

SEQ ID NO: 3008485 - DNA, 12 bp, Homo sapiens
tcccctggcagt

SEQ ID NO: 3008486 - DNA, 15 bp, Homo sapiens
tcccctgtcccctgg

SEQ ID NO: 3008487 - DNA, 16 bp, Homo sapiens
tcccctgtcccctggg

SEQ ID NO: 3008488 - DNA, 20 bp, Homo sapiens
tcccctgtcccctggggctg

SEQ ID NO: 3008489 - DNA, 20 bp, Homo sapiens
tcccctgtggtgatgtgcct

SEQ ID NO: 3008490 - DNA, 21 bp, Homo sapiens
tcccctgtggtgatgtgcctg

SEQ ID NO: 3008491 - DNA, 22 bp, Homo sapiens
tcccctgtggtgatgtgcctgt

SEQ ID NO: 3008492 - DNA, 17 bp, Homo sapiens
tccccttacccttagaa

SEQ ID NO: 3008493 - DNA, 22 bp, Homo sapiens
tcagtgcccaccaacatcccat

SEQ ID NO: 3008494 - DNA, 18 bp, Homo sapiens
tcagtgccggaggccttg

SEQ ID NO: 3008495 - DNA, 22 bp, Homo sapiens
tcagtgccttctctcagctccc

SEQ ID NO: 3008496 - DNA, 12 bp, Homo sapiens
tcagtgctccct

SEQ ID NO: 3008497 - DNA, 13 bp, Homo sapiens
tcagtgctgtgct

SEQ ID NO: 3008498 - DNA, 16 bp, Homo sapiens
tcagtgctgtgctgtg

SEQ ID NO: 3008499 - DNA, 19 bp, Homo sapiens
tcagtggaacacaaatgaa

SEQ ID NO: 3008500 - DNA, 14 bp, Homo sapiens
tcagtggctctggg

SEQ ID NO: 3008501 - DNA, 23 bp, Homo sapiens
tcagtgggaacgtgactgcccca

SEQ ID NO: 3008502 - DNA, 14 bp, Homo sapiens
tcagtggggcagtc

SEQ ID NO: 3008503 - DNA, 18 bp, Homo sapiens
tcagtggggctctctgag

SEQ ID NO: 3008504 - DNA, 19 bp, Homo sapiens
tcagtggggctctctgagt

SEQ ID NO: 3008505 - DNA, 18 bp, Homo sapiens
tcagtgtaatttctttgc

SEQ ID NO: 3008506 - DNA, 16 bp, Homo sapiens
tcagtgtatttcagtt

SEQ ID NO: 3008507 - DNA, 14 bp, Homo sapiens
tcagtgttgattct

SEQ ID NO: 3008508 - DNA, 18 bp, Homo sapiens
tcagtgttgttgctctag

SEQ ID NO: 3008509 - DNA, 11 bp, Homo sapiens
tcagtgtttaa

SEQ ID NO: 3008510 - DNA, 14 bp, Homo sapiens
tcagttaacgtcac

SEQ ID NO: 3008511 - DNA, 14 bp, Homo sapiens
tcagttaattctta

SEQ ID NO: 3008512 - DNA, 18 bp, Homo sapiens
tcagttaattcttagata

SEQ ID NO: 3008513 - DNA, 13 bp, Homo sapiens
tcagttacagaaa

SEQ ID NO: 3008514 - DNA, 15 bp, Homo sapiens
tcagttacagaaagt

SEQ ID NO: 3008515 - DNA, 14 bp, Homo sapiens
tcagttactcagcc

SEQ ID NO: 3008516 - DNA, 16 bp, Homo sapiens
tcagttccagcttttg

SEQ ID NO: 3008517 - DNA, 19 bp, Homo sapiens
tcagttccgtcagaaagtg

SEQ ID NO: 3008518 - DNA, 23 bp, Homo sapiens
tcagttctgtccttggcaacttt

SEQ ID NO: 3008519 - DNA, 23 bp, Homo sapiens
tcagttgagcttcatataccagc

SEQ ID NO: 3008520 - DNA, 17 bp, Homo sapiens
tcagttgattttctgga

SEQ ID NO: 3008521 - DNA, 18 bp, Homo sapiens
tcagttgattttctggat

SEQ ID NO: 3008522 - DNA, 18 bp, Homo sapiens
tcagttgctaaacactgc

SEQ ID NO: 3008523 - DNA, 18 bp, Homo sapiens
tcagttggccctttaata

SEQ ID NO: 3008524 - DNA, 18 bp, Homo sapiens
tcagttgtagaatgtatt

SEQ ID NO: 3008525 - DNA, 13 bp, Homo sapiens
tcagttgtgcagc

SEQ ID NO: 3008526 - DNA, 15 bp, Homo sapiens
tcagtttattaaatc

SEQ ID NO: 3008527 - DNA, 19 bp, Homo sapiens
tcagtttcaattcagtgct

SEQ ID NO: 3008528 - DNA, 22 bp, Homo sapiens
tcagtttcttctgcgcctcagg

SEQ ID NO: 3008529 - DNA, 21 bp, Homo sapiens
tcagtttgaaaatattttgtt

SEQ ID NO: 3008530 - DNA, 13 bp, Homo sapiens
tcagttttcccac

SEQ ID NO: 3008531 - DNA, 17 bp, Homo sapiens
tcagtttttgtgaaaag

SEQ ID NO: 3008532 - DNA, 24 bp, Homo sapiens
tcataaagaggcgttgctttcact

SEQ ID NO: 3008533 - DNA, 21 bp, Homo sapiens
tcataaattaatgattctgaa

SEQ ID NO: 3008534 - DNA, 19 bp, Homo sapiens
tcataaatttgttgtcatg

SEQ ID NO: 3008535 - DNA, 23 bp, Homo sapiens
tcataaatttgttgtcatgtgta

SEQ ID NO: 3008536 - DNA, 19 bp, Homo sapiens
tcataacggttaagaaagc

SEQ ID NO: 3008537 - DNA, 20 bp, Homo sapiens
tcataacggttaagaaagca

SEQ ID NO: 3008538 - DNA, 16 bp, Homo sapiens
tcataactaatgaatt

SEQ ID NO: 3008539 - DNA, 23 bp, Homo sapiens
tcataactaatgaattgaaattt

SEQ ID NO: 3008540 - DNA, 19 bp, Homo sapiens
tcataagactttgggatag

SEQ ID NO: 3008541 - DNA, 16 bp, Homo sapiens
tcataagcgatcactt

SEQ ID NO: 3008542 - DNA, 15 bp, Homo sapiens
tcataaggcttcaaa

SEQ ID NO: 3008543 - DNA, 17 bp, Homo sapiens
tcataatgcagaagtat

SEQ ID NO: 3008544 - DNA, 13 bp, Homo sapiens
tcataatgtgaag

SEQ ID NO: 3008545 - DNA, 14 bp, Homo sapiens
tcataatgtgaagt

SEQ ID NO: 3008546 - DNA, 19 bp, Homo sapiens
tcataatgtgaagtgttaa

SEQ ID NO: 3008547 - DNA, 12 bp, Homo sapiens
tcataattacca

SEQ ID NO: 3008548 - DNA, 20 bp, Homo sapiens
tcataccgcctcgtgccagc

SEQ ID NO: 3008549 - DNA, 24 bp, Homo sapiens
tcataccgcctcgtgccagcagcc

SEQ ID NO: 3008550 - DNA, 15 bp, Homo sapiens
tcatactctgttgcc

SEQ ID NO: 3008551 - DNA, 18 bp, Homo sapiens
tcatactctgttgcctcc

SEQ ID NO: 3008552 - DNA, 19 bp, Homo sapiens
tcatactctgttgcctcct

SEQ ID NO: 3008553 - DNA, 23 bp, Homo sapiens
tcatactctgttgcctcctctct

SEQ ID NO: 3008554 - DNA, 13 bp, Homo sapiens
tcatagaaattct

SEQ ID NO: 3008555 - DNA, 15 bp, Homo sapiens
tcatagagaggcctg

SEQ ID NO: 3008556 - DNA, 16 bp, Homo sapiens
tcatagatattggaag

SEQ ID NO: 3008557 - DNA, 14 bp, Homo sapiens
tcatagattcttga

SEQ ID NO: 3008558 - DNA, 18 bp, Homo sapiens
tcatagcaggaaatgtag

SEQ ID NO: 3008559 - DNA, 14 bp, Homo sapiens
tcatagcatgatat

SEQ ID NO: 3008560 - DNA, 18 bp, Homo sapiens
tcatagggacctttaaaa

SEQ ID NO: 3008561 - DNA, 21 bp, Homo sapiens
tcatagggacctttaaaaagc

SEQ ID NO: 3008562 - DNA, 14 bp, Homo sapiens
tcataggggcaggt

SEQ ID NO: 3008563 - DNA, 16 bp, Homo sapiens
tcatagtaacttctta

SEQ ID NO: 3008564 - DNA, 21 bp, Homo sapiens
tcatagtgaacacagcagacc

SEQ ID NO: 3008565 - DNA, 11 bp, Homo sapiens
tcatagtgcct

SEQ ID NO: 3008566 - DNA, 21 bp, Homo sapiens
tcatagttctgagctgccagt

SEQ ID NO: 3008567 - DNA, 16 bp, Homo sapiens
tcatataccagcaata

SEQ ID NO: 3008568 - DNA, 14 bp, Homo sapiens
tcatatcactgaag

SEQ ID NO: 3008569 - DNA, 23 bp, Homo sapiens
tcatatcctccgccctttttgtc

SEQ ID NO: 3008570 - DNA, 15 bp, Homo sapiens
tcatatctctccctt

SEQ ID NO: 3008571 - DNA, 22 bp, Homo sapiens
tcatatctctcccttctttacc

SEQ ID NO: 3008572 - DNA, 14 bp, Homo sapiens
tcatattaaaaata

SEQ ID NO: 3008573 - DNA, 21 bp, Homo sapiens
tcatattaatataagtttctt

SEQ ID NO: 3008574 - DNA, 16 bp, Homo sapiens
tcatattctttcaatt

SEQ ID NO: 3008575 - DNA, 14 bp, Homo sapiens
tcatattgaatata

SEQ ID NO: 3008576 - DNA, 14 bp, Homo sapiens
tcatattgtaatct

SEQ ID NO: 3008577 - DNA, 12 bp, Homo sapiens
tcatatttgaaa

SEQ ID NO: 3008578 - DNA, 22 bp, Homo sapiens
tcatattttaaaattactaact

SEQ ID NO: 3008579 - DNA, 20 bp, Homo sapiens
tcatcaatgggattttctag

SEQ ID NO: 3008580 - DNA, 19 bp, Homo sapiens
tcatcaatgtgacatttac

SEQ ID NO: 3008581 - DNA, 12 bp, Homo sapiens
tcatcaatttgt

SEQ ID NO: 3008582 - DNA, 22 bp, Homo sapiens
tcatcaatttgtaattttagta

SEQ ID NO: 3008583 - DNA, 12 bp, Homo sapiens
tcatcacacaca

SEQ ID NO: 3008584 - DNA, 14 bp, Homo sapiens
tcatcagaactgaa

SEQ ID NO: 3008585 - DNA, 21 bp, Homo sapiens
tcatcagaggggagcagcggc

SEQ ID NO: 3008586 - DNA, 15 bp, Homo sapiens
tcatcaggaagcctg

SEQ ID NO: 3008587 - DNA, 18 bp, Homo sapiens
tcatcaggagttccagtg

SEQ ID NO: 3008588 - DNA, 14 bp, Homo sapiens
tcatcaggctctgt

SEQ ID NO: 3008589 - DNA, 20 bp, Homo sapiens
tcatcaggctctgttcctca

SEQ ID NO: 3008590 - DNA, 18 bp, Homo sapiens
tcatcagtaacagtattc

SEQ ID NO: 3008591 - DNA, 16 bp, Homo sapiens
tcatcatccctccctg

SEQ ID NO: 3008592 - DNA, 18 bp, Homo sapiens
tcatcatccctccctgcc

SEQ ID NO: 3008593 - DNA, 18 bp, Homo sapiens
tcatcatctcttgataaa

SEQ ID NO: 3008594 - DNA, 22 bp, Homo sapiens
tcatcatctcttgataaaggag

SEQ ID NO: 3008595 - DNA, 23 bp, Homo sapiens
tcatcatctcttgataaaggaga

SEQ ID NO: 3008596 - DNA, 16 bp, Homo sapiens
tcatcatgaactggct

SEQ ID NO: 3008597 - DNA, 14 bp, Homo sapiens
tcatcattccctct

SEQ ID NO: 3008598 - DNA, 13 bp, Homo sapiens
tcatcattctctg

SEQ ID NO: 3008599 - DNA, 18 bp, Homo sapiens
tcatcattctctgtctca

SEQ ID NO: 3008600 - DNA, 19 bp, Homo sapiens
tcatcattctctgtctcat

SEQ ID NO: 3008601 - DNA, 14 bp, Homo sapiens
tcatcatttcagcc

SEQ ID NO: 3008602 - DNA, 16 bp, Homo sapiens
tcatcatttcagccaa

SEQ ID NO: 3008603 - DNA, 20 bp, Homo sapiens
tcatcatttcagccaaagtc

SEQ ID NO: 3008604 - DNA, 15 bp, Homo sapiens
tcatcatttgcacaa

SEQ ID NO: 3008605 - DNA, 18 bp, Homo sapiens
tcatcattttctccacct

SEQ ID NO: 3008606 - DNA, 14 bp, Homo sapiens
tcatcatttttcct

SEQ ID NO: 3008607 - DNA, 19 bp, Homo sapiens
tcatccaaacaatttaaaa

SEQ ID NO: 3008608 - DNA, 19 bp, Homo sapiens
tcatccacattgttttaaa

SEQ ID NO: 3008609 - DNA, 14 bp, Homo sapiens
tcatccatcatcat

SEQ ID NO: 3008610 - DNA, 16 bp, Homo sapiens
tcatccatcatcatgt

SEQ ID NO: 3008611 - DNA, 14 bp, Homo sapiens
tcatcccatgtaca

SEQ ID NO: 3008612 - DNA, 21 bp, Homo sapiens
tcatcccgagcacctccacat

SEQ ID NO: 3008613 - DNA, 14 bp, Homo sapiens
tcatccctccctgc

SEQ ID NO: 3008614 - DNA, 13 bp, Homo sapiens
tcatcctccagta

SEQ ID NO: 3008615 - DNA, 15 bp, Homo sapiens
tcatcctcctcctca

SEQ ID NO: 3008616 - DNA, 22 bp, Homo sapiens
tcatcctgcttctcttttcctc

SEQ ID NO: 3008617 - DNA, 15 bp, Homo sapiens
tcatccttgcccatc

SEQ ID NO: 3008618 - DNA, 22 bp, Homo sapiens
tcatccttggtgctcttgcttt

SEQ ID NO: 3008619 - DNA, 14 bp, Homo sapiens
tcatcgccagaggt

SEQ ID NO: 3008620 - DNA, 15 bp, Homo sapiens
tcatcgccagaggtg

SEQ ID NO: 3008621 - DNA, 22 bp, Homo sapiens
tcatcggagtcagccaggagct

SEQ ID NO: 3008622 - DNA, 18 bp, Homo sapiens
tcatcgggcccagggaca

SEQ ID NO: 3008623 - DNA, 17 bp, Homo sapiens
tcatcgttccccacccc

SEQ ID NO: 3008624 - DNA, 20 bp, Homo sapiens
tcatctccagtatcctgctg

SEQ ID NO: 3008625 - DNA, 12 bp, Homo sapiens
tcatctcccacc

SEQ ID NO: 3008626 - DNA, 17 bp, Homo sapiens
tcatctctgcctttgag

SEQ ID NO: 3008627 - DNA, 18 bp, Homo sapiens
tcatctctgcctttgagt

SEQ ID NO: 3008628 - DNA, 23 bp, Homo sapiens
tcatctctgttcttttcccgcct

SEQ ID NO: 3008629 - DNA, 15 bp, Homo sapiens
tcatctcttgataaa

SEQ ID NO: 3008630 - DNA, 23 bp, Homo sapiens
tcatctgctgcacatagcagact

SEQ ID NO: 3008631 - DNA, 18 bp, Homo sapiens
tcatctgggaaagacatc

SEQ ID NO: 3008632 - DNA, 12 bp, Homo sapiens
tcatctgtccct

SEQ ID NO: 3008633 - DNA, 21 bp, Homo sapiens
tcatctgtgcctgtctgtcca

SEQ ID NO: 3008634 - DNA, 12 bp, Homo sapiens
tcatcttactgt

SEQ ID NO: 3008635 - DNA, 18 bp, Homo sapiens
tcatcttagttctgtata

SEQ ID NO: 3008636 - DNA, 21 bp, Homo sapiens
tcatcttcactgcaattttgt

SEQ ID NO: 3008637 - DNA, 18 bp, Homo sapiens
tcatcttccctgcccctg

SEQ ID NO: 3008638 - DNA, 16 bp, Homo sapiens
tcatcttcttcaccat

SEQ ID NO: 3008639 - DNA, 15 bp, Homo sapiens
tcatcttgtgtttta

SEQ ID NO: 3008640 - DNA, 12 bp, Homo sapiens
tcatctttcttc

SEQ ID NO: 3008641 - DNA, 11 bp, Homo sapiens
tcatctttgct

SEQ ID NO: 3008642 - DNA, 16 bp, Homo sapiens
tcatcttttaaagaaa

SEQ ID NO: 3008643 - DNA, 14 bp, Homo sapiens
tcatcttttaatca

SEQ ID NO: 3008644 - DNA, 20 bp, Homo sapiens
tcatcttttaatcatgagcc

SEQ ID NO: 3008645 - DNA, 22 bp, Homo sapiens
tcatcttttaatcatgagcctg

SEQ ID NO: 3008646 - DNA, 13 bp, Homo sapiens
tcatctttttgtg

SEQ ID NO: 3008647 - DNA, 14 bp, Homo sapiens
tcatgaactggctt

SEQ ID NO: 3008648 - DNA, 17 bp, Homo sapiens
tcatgaactggcttgta

SEQ ID NO: 3008649 - DNA, 15 bp, Homo sapiens
tcatgaagccttgct

SEQ ID NO: 3008650 - DNA, 20 bp, Homo sapiens
tcatgaaggtcctagcttta

SEQ ID NO: 3008651 - DNA, 19 bp, Homo sapiens
tcatgacaagatgggacag

SEQ ID NO: 3008652 - DNA, 12 bp, Homo sapiens
tcatgagcctgt

SEQ ID NO: 3008653 - DNA, 13 bp, Homo sapiens
tcatgagcctgtt

SEQ ID NO: 3008654 - DNA, 20 bp, Homo sapiens
tcatgaggaaagcagttgaa

SEQ ID NO: 3008655 - DNA, 20 bp, Homo sapiens
tcatgaggaccagggtggag

SEQ ID NO: 3008656 - DNA, 20 bp, Homo sapiens
tcatgaggaggggcccccct

SEQ ID NO: 3008657 - DNA, 22 bp, Homo sapiens
tcatgatctccctgccgcctca

SEQ ID NO: 3008658 - DNA, 16 bp, Homo sapiens
tcatgatttataaatg

SEQ ID NO: 3008659 - DNA, 16 bp, Homo sapiens
tcatgcccctggctgg

SEQ ID NO: 3008660 - DNA, 15 bp, Homo sapiens
tcatgccctcctctc

SEQ ID NO: 3008661 - DNA, 19 bp, Homo sapiens
tcatgctggaacctgcaaa

SEQ ID NO: 3008662 - DNA, 20 bp, Homo sapiens
tcatgctggaacctgcaaaa

SEQ ID NO: 3008663 - DNA, 20 bp, Homo sapiens
tcatggaaaagccttcttat

SEQ ID NO: 3008664 - DNA, 23 bp, Homo sapiens
tcatggaacacaaacacattgtt

SEQ ID NO: 3008665 - DNA, 20 bp, Homo sapiens
tcatgggaacgcagcctcca

SEQ ID NO: 3008666 - DNA, 21 bp, Homo sapiens
tcatgggccccccatgcatac

SEQ ID NO: 3008667 - DNA, 17 bp, Homo sapiens
tcatggggatcaatttt

SEQ ID NO: 3008668 - DNA, 16 bp, Homo sapiens
tcatggtgtgttacac

SEQ ID NO: 3008669 - DNA, 14 bp, Homo sapiens
tcatgtaaacatac

SEQ ID NO: 3008670 - DNA, 22 bp, Homo sapiens
tcatgtaaacataccaacatgt

SEQ ID NO: 3008671 - DNA, 14 bp, Homo sapiens
tcatgtaaactgtg

SEQ ID NO: 3008672 - DNA, 17 bp, Homo sapiens
tcatgtaaactgtgcac

SEQ ID NO: 3008673 - DNA, 20 bp, Homo sapiens
tcatgtaaatactgttggtg

SEQ ID NO: 3008674 - DNA, 16 bp, Homo sapiens
tcatgtacaagatgaa

SEQ ID NO: 3008675 - DNA, 15 bp, Homo sapiens
tcatgtactttttag

SEQ ID NO: 3008676 - DNA, 16 bp, Homo sapiens
tcatgtagtatcaaat

SEQ ID NO: 3008677 - DNA, 23 bp, Homo sapiens
tcatgtatattacccaatggaaa

SEQ ID NO: 3008678 - DNA, 14 bp, Homo sapiens
tcatgtcatttctc

SEQ ID NO: 3008679 - DNA, 17 bp, Homo sapiens
tcatgtgactctttcca

SEQ ID NO: 3008680 - DNA, 18 bp, Homo sapiens
tcatgtgcctctgtcctt

SEQ ID NO: 3008681 - DNA, 22 bp, Homo sapiens
tcatgtgtaatcaataaacgat

SEQ ID NO: 3008682 - DNA, 23 bp, Homo sapiens
tcatgtgtaatcaataaacgatt

SEQ ID NO: 3008683 - DNA, 19 bp, Homo sapiens
tcatgtgtatgagaagtac

SEQ ID NO: 3008684 - DNA, 19 bp, Homo sapiens
tcatgtgtatgggcaaaaa

SEQ ID NO: 3008685 - DNA, 19 bp, Homo sapiens
tcatgtgtgtattttttca

SEQ ID NO: 3008686 - DNA, 23 bp, Homo sapiens
tcatgtgtgtccacgactgtctc

SEQ ID NO: 3008687 - DNA, 17 bp, Homo sapiens
tcatgttggatctgtca

SEQ ID NO: 3008688 - DNA, 23 bp, Homo sapiens
tcatgtttataactattcagttg

SEQ ID NO: 3008689 - DNA, 18 bp, Homo sapiens
tcatgttttaaaagtttg

SEQ ID NO: 3008690 - DNA, 14 bp, Homo sapiens
tcatgttttaacaa

SEQ ID NO: 3008691 - DNA, 16 bp, Homo sapiens
tcatgttttaacaaaa

SEQ ID NO: 3008692 - DNA, 14 bp, Homo sapiens
tcatgttttggtga

SEQ ID NO: 3008693 - DNA, 12 bp, Homo sapiens
tcattaaaattg

SEQ ID NO: 3008694 - DNA, 22 bp, Homo sapiens
tcattaaatggtgatttcttgc

SEQ ID NO: 3008695 - DNA, 15 bp, Homo sapiens
tcattaaatgtttgt

SEQ ID NO: 3008696 - DNA, 14 bp, Homo sapiens
tcattaaattacct

SEQ ID NO: 3008697 - DNA, 19 bp, Homo sapiens
tcattaaccgatgctttac

SEQ ID NO: 3008698 - DNA, 21 bp, Homo sapiens
tcattaagttgtaaaatgtca

SEQ ID NO: 3008699 - DNA, 15 bp, Homo sapiens
tcattattctcataa

SEQ ID NO: 3008700 - DNA, 16 bp, Homo sapiens
tcattcaaaagttgaa

SEQ ID NO: 3008701 - DNA, 22 bp, Homo sapiens
tcattcaaaagttgaaattaac

SEQ ID NO: 3008702 - DNA, 21 bp, Homo sapiens
tcattcaatcaacctgcactt

SEQ ID NO: 3008703 - DNA, 14 bp, Homo sapiens
tcattcagaaaaaa

SEQ ID NO: 3008704 - DNA, 20 bp, Homo sapiens
tcattcataaaagtttgcat

SEQ ID NO: 3008705 - DNA, 21 bp, Homo sapiens
tcattcatatcctccgccctt

SEQ ID NO: 3008706 - DNA, 14 bp, Homo sapiens
tcattcattttata

SEQ ID NO: 3008707 - DNA, 20 bp, Homo sapiens
tcattcattttatattgaaa

SEQ ID NO: 3008708 - DNA, 13 bp, Homo sapiens
tcattcattttgt

SEQ ID NO: 3008709 - DNA, 15 bp, Homo sapiens
tcattcattttgtgt

SEQ ID NO: 3008710 - DNA, 14 bp, Homo sapiens
tcattccacaggac

SEQ ID NO: 3008711 - DNA, 23 bp, Homo sapiens
tcattccccaggtggctgaccca

SEQ ID NO: 3008712 - DNA, 15 bp, Homo sapiens
tcattcctgttcttt

SEQ ID NO: 3008713 - DNA, 14 bp, Homo sapiens
tcattctcctcctc

SEQ ID NO: 3008714 - DNA, 15 bp, Homo sapiens
tcattctctgtctca

SEQ ID NO: 3008715 - DNA, 14 bp, Homo sapiens
tcattgagggacca

SEQ ID NO: 3008716 - DNA, 11 bp, Homo sapiens
tcattgcattt

SEQ ID NO: 3008717 - DNA, 16 bp, Homo sapiens
tcattgcatttattgc

SEQ ID NO: 3008718 - DNA, 21 bp, Homo sapiens
tcattgcatttattgcagttt

SEQ ID NO: 3008719 - DNA, 16 bp, Homo sapiens
tcattgctgagcctct

SEQ ID NO: 3008720 - DNA, 21 bp, Homo sapiens
tcattggattctgagagctgt

SEQ ID NO: 3008721 - DNA, 21 bp, Homo sapiens
tcattggcattctttgcaata

SEQ ID NO: 3008722 - DNA, 21 bp, Homo sapiens
tcattggctatataaaatgtg

SEQ ID NO: 3008723 - DNA, 16 bp, Homo sapiens
tcattgttttgcaaaa

SEQ ID NO: 3008724 - DNA, 22 bp, Homo sapiens
tcatttaactgaagatgttgag

SEQ ID NO: 3008725 - DNA, 19 bp, Homo sapiens
tcatttagtttgattattc

SEQ ID NO: 3008726 - DNA, 17 bp, Homo sapiens
tcatttcagccaaagtc

SEQ ID NO: 3008727 - DNA, 13 bp, Homo sapiens
tcatttccgtccc

SEQ ID NO: 3008728 - DNA, 20 bp, Homo sapiens
tcatttccgttttgcctgtg

SEQ ID NO: 3008729 - DNA, 22 bp, Homo sapiens
tcatttcctatgtaactgcatt

SEQ ID NO: 3008730 - DNA, 21 bp, Homo sapiens
tcatttccttcaaggcatcat

SEQ ID NO: 3008731 - DNA, 15 bp, Homo sapiens
tcatttctctttttt

SEQ ID NO: 3008732 - DNA, 13 bp, Homo sapiens
tcatttctgtctc

SEQ ID NO: 3008733 - DNA, 21 bp, Homo sapiens
tcatttgcttcaggagtttca

SEQ ID NO: 3008734 - DNA, 23 bp, Homo sapiens
tcatttggggtagctagaggaac

SEQ ID NO: 3008735 - DNA, 22 bp, Homo sapiens
tcatttgttctgggagtataaa

SEQ ID NO: 3008736 - DNA, 15 bp, Homo sapiens
tcattttatattgaa

SEQ ID NO: 3008737 - DNA, 15 bp, Homo sapiens
tcattttcagagtga

SEQ ID NO: 3008738 - DNA, 12 bp, Homo sapiens
tcattttgaggg

SEQ ID NO: 3008739 - DNA, 20 bp, Homo sapiens
tcattttgtccatgtccccc

SEQ ID NO: 3008740 - DNA, 19 bp, Homo sapiens
tcatttttaactactgtat

SEQ ID NO: 3008741 - DNA, 22 bp, Homo sapiens
tcatttttatcccttcctgtct

SEQ ID NO: 3008742 - DNA, 15 bp, Homo sapiens
tcatttttccgtaaa

SEQ ID NO: 3008743 - DNA, 13 bp, Homo sapiens
tcatttttgaatg

SEQ ID NO: 3008744 - DNA, 14 bp, Homo sapiens
tcatttttgaatgc

SEQ ID NO: 3008745 - DNA, 22 bp, Homo sapiens
tcatttttgtgagcctctttgt

SEQ ID NO: 3008746 - DNA, 22 bp, Homo sapiens
tcatttttttctctctggagcc

SEQ ID NO: 3008747 - DNA, 17 bp, Homo sapiens
tccaaaaaaaggaaaaa

SEQ ID NO: 3008748 - DNA, 18 bp, Homo sapiens
tccaaaaagacaagtgct

SEQ ID NO: 3008749 - DNA, 19 bp, Homo sapiens
tccaaaaagctcctggggc

SEQ ID NO: 3008750 - DNA, 12 bp, Homo sapiens
tccaaaactgcc

SEQ ID NO: 3008751 - DNA, 13 bp, Homo sapiens
tccaaaactgcct

SEQ ID NO: 3008752 - DNA, 21 bp, Homo sapiens
tccaaaagaagcccccagcta

SEQ ID NO: 3008753 - DNA, 23 bp, Homo sapiens
tccaaaagtggcctctttgtcta

SEQ ID NO: 3008754 - DNA, 13 bp, Homo sapiens
tccaaaataataa

SEQ ID NO: 3008755 - DNA, 24 bp, Homo sapiens
tccaaaatttgtttgtcactgcca

SEQ ID NO: 3008756 - DNA, 21 bp, Homo sapiens
tccaaaatttttcaaccccac

SEQ ID NO: 3008757 - DNA, 22 bp, Homo sapiens
tccaaacaggtgctggcccagc

SEQ ID NO: 3008758 - DNA, 15 bp, Homo sapiens
tccaaaccaggacac

SEQ ID NO: 3008759 - DNA, 14 bp, Homo sapiens
tccaaactgctgtc

SEQ ID NO: 3008760 - DNA, 15 bp, Homo sapiens
tccaaactgctgtct

SEQ ID NO: 3008761 - DNA, 17 bp, Homo sapiens
tccaaactgctgtctct

SEQ ID NO: 3008762 - DNA, 12 bp, Homo sapiens
tccaaagaatgt

SEQ ID NO: 3008763 - DNA, 13 bp, Homo sapiens
tccaaagaatgtt

SEQ ID NO: 3008764 - DNA, 15 bp, Homo sapiens
tccaaaggctctgtt

SEQ ID NO: 3008765 - DNA, 20 bp, Homo sapiens
tccaaatgaatgttgtctgt

SEQ ID NO: 3008766 - DNA, 14 bp, Homo sapiens
tccaaatgcattca

SEQ ID NO: 3008767 - DNA, 19 bp, Homo sapiens
tccaaatgcattcatgttt

SEQ ID NO: 3008768 - DNA, 18 bp, Homo sapiens
tccaacaaagggttttaa

SEQ ID NO: 3008769 - DNA, 22 bp, Homo sapiens
tccaacaaagggttttaatgta

SEQ ID NO: 3008770 - DNA, 23 bp, Homo sapiens
tccaacaccaagcacagcagcct

SEQ ID NO: 3008771 - DNA, 14 bp, Homo sapiens
tccaacaggagctg

SEQ ID NO: 3008772 - DNA, 13 bp, Homo sapiens
tccaacccctccc

SEQ ID NO: 3008773 - DNA, 23 bp, Homo sapiens
tccaacctaacccctttcctgcg

SEQ ID NO: 3008774 - DNA, 19 bp, Homo sapiens
tccaacctaacctgtgtct

SEQ ID NO: 3008775 - DNA, 23 bp, Homo sapiens
tccaacctgaaggtcccctggca

SEQ ID NO: 3008776 - DNA, 21 bp, Homo sapiens
tccaacctgcaaagatctgtc

SEQ ID NO: 3008777 - DNA, 13 bp, Homo sapiens
tccaaccttccca

SEQ ID NO: 3008778 - DNA, 22 bp, Homo sapiens
tccaacgccgccttggccttgc

SEQ ID NO: 3008779 - DNA, 15 bp, Homo sapiens
tccaacgtttggaag

SEQ ID NO: 3008780 - DNA, 14 bp, Homo sapiens
tccaactgcaactc

SEQ ID NO: 3008781 - DNA, 23 bp, Homo sapiens
tccaagaatagcatctgtacaaa

SEQ ID NO: 3008782 - DNA, 16 bp, Homo sapiens
tccaagaatccacatt

SEQ ID NO: 3008783 - DNA, 19 bp, Homo sapiens
tccaagaatggaagcctga

SEQ ID NO: 3008784 - DNA, 20 bp, Homo sapiens
tccaagactctagagtccaa

SEQ ID NO: 3008785 - DNA, 13 bp, Homo sapiens
tccaagagcctga

SEQ ID NO: 3008786 - DNA, 18 bp, Homo sapiens
tccaagagtctaaagatg

SEQ ID NO: 3008787 - DNA, 15 bp, Homo sapiens
tccaagattccggat

SEQ ID NO: 3008788 - DNA, 15 bp, Homo sapiens
tccaagccagcggga

SEQ ID NO: 3008789 - DNA, 16 bp, Homo sapiens
tccaagccccctggca

SEQ ID NO: 3008790 - DNA, 22 bp, Homo sapiens
tccaagccccctggcagctgcc

SEQ ID NO: 3008791 - DNA, 14 bp, Homo sapiens
tccaagctaagcac

SEQ ID NO: 3008792 - DNA, 22 bp, Homo sapiens
tccaagctgggagattcaaggg

SEQ ID NO: 3008793 - DNA, 17 bp, Homo sapiens
tccaagctgttaaagat

SEQ ID NO: 3008794 - DNA, 19 bp, Homo sapiens
tccaagctgttaaagatat

SEQ ID NO: 3008795 - DNA, 18 bp, Homo sapiens
tccaaggccgcggcccag

SEQ ID NO: 3008796 - DNA, 14 bp, Homo sapiens
tccaaggtgtttct

SEQ ID NO: 3008797 - DNA, 14 bp, Homo sapiens
tccaaggtttaaag

SEQ ID NO: 3008798 - DNA, 19 bp, Homo sapiens
tccaaggtttaaagagtct

SEQ ID NO: 3008799 - DNA, 22 bp, Homo sapiens
tccaaggtttaaagagtctaga

SEQ ID NO: 3008800 - DNA, 12 bp, Homo sapiens
tccaagtccttt

SEQ ID NO: 3008801 - DNA, 16 bp, Homo sapiens
tccaagtgtattttaa

SEQ ID NO: 3008802 - DNA, 22 bp, Homo sapiens
tccaagtgtattttaaaataga

SEQ ID NO: 3008803 - DNA, 20 bp, Homo sapiens
tccaagtgtgcatattgtac

SEQ ID NO: 3008804 - DNA, 14 bp, Homo sapiens
tccaataaaggaac

SEQ ID NO: 3008805 - DNA, 20 bp, Homo sapiens
tccaatcaatttaaatgttt

SEQ ID NO: 3008806 - DNA, 21 bp, Homo sapiens
tccaatcaatttaaatgttta

SEQ ID NO: 3008807 - DNA, 23 bp, Homo sapiens
tccaatcaatttaaatgtttact

SEQ ID NO: 3008808 - DNA, 21 bp, Homo sapiens
tccaatcagagaccaggccct

SEQ ID NO: 3008809 - DNA, 23 bp, Homo sapiens
tccaatcagagaccaggccctgg

SEQ ID NO: 3008810 - DNA, 14 bp, Homo sapiens
tccaatcctccccg

SEQ ID NO: 3008811 - DNA, 19 bp, Homo sapiens
tccaatcctccccgctctg

SEQ ID NO: 3008812 - DNA, 21 bp, Homo sapiens
tccaatcctccccgctctgcc

SEQ ID NO: 3008813 - DNA, 19 bp, Homo sapiens
tccaatgtcgctgtaaatt

SEQ ID NO: 3008814 - DNA, 11 bp, Homo sapiens
tccaatgtgaa

SEQ ID NO: 3008815 - DNA, 19 bp, Homo sapiens
tccaattccttgcacatag

SEQ ID NO: 3008816 - DNA, 15 bp, Homo sapiens
tccaattttaattta

SEQ ID NO: 3008817 - DNA, 20 bp, Homo sapiens
tccacaaaataaccaatcct

SEQ ID NO: 3008818 - DNA, 14 bp, Homo sapiens
tccacaaagcagtg

SEQ ID NO: 3008819 - DNA, 14 bp, Homo sapiens
tccacaaattatta

SEQ ID NO: 3008820 - DNA, 22 bp, Homo sapiens
tccacaacactgtgtcacatca

SEQ ID NO: 3008821 - DNA, 16 bp, Homo sapiens
tccacaagattcccag

SEQ ID NO: 3008822 - DNA, 18 bp, Homo sapiens
tccacaagattcccagag

SEQ ID NO: 3008823 - DNA, 20 bp, Homo sapiens
tccacaagattcccagagac

SEQ ID NO: 3008824 - DNA, 18 bp, Homo sapiens
tccacaaggaataaatga

SEQ ID NO: 3008825 - DNA, 15 bp, Homo sapiens
tccacacaagggaag

SEQ ID NO: 3008826 - DNA, 23 bp, Homo sapiens
tccacacaagggaaggacagaaa

SEQ ID NO: 3008827 - DNA, 17 bp, Homo sapiens
tccacaccaagcagcaa

SEQ ID NO: 3008828 - DNA, 18 bp, Homo sapiens
tccacacccaattccact

SEQ ID NO: 3008829 - DNA, 17 bp, Homo sapiens
tccacactatgtgtgtt

SEQ ID NO: 3008830 - DNA, 19 bp, Homo sapiens
tccacactgaccaagtgct

SEQ ID NO: 3008831 - DNA, 17 bp, Homo sapiens
tccacagagatgtttat

SEQ ID NO: 3008832 - DNA, 17 bp, Homo sapiens
tccacagagtaagacat

SEQ ID NO: 3008833 - DNA, 15 bp, Homo sapiens
tccacagatatcttt

SEQ ID NO: 3008834 - DNA, 21 bp, Homo sapiens
tccacagatatctttttcatt

SEQ ID NO: 3008835 - DNA, 11 bp, Homo sapiens
tccacagattg

SEQ ID NO: 3008836 - DNA, 17 bp, Homo sapiens
tccacagcaaccccagg

SEQ ID NO: 3008837 - DNA, 19 bp, Homo sapiens
tccacagctgaagagcaag

SEQ ID NO: 3008838 - DNA, 23 bp, Homo sapiens
tccacagcttcccctctctcctc

SEQ ID NO: 3008839 - DNA, 15 bp, Homo sapiens
tccacagcttcctgt

SEQ ID NO: 3008840 - DNA, 23 bp, Homo sapiens
tccacagcttcctgtccccatct

SEQ ID NO: 3008841 - DNA, 19 bp, Homo sapiens
tccacaggatcatcattta

SEQ ID NO: 3008842 - DNA, 16 bp, Homo sapiens
tccacaggtctagact

SEQ ID NO: 3008843 - DNA, 16 bp, Homo sapiens
tccacatccccagagc

SEQ ID NO: 3008844 - DNA, 18 bp, Homo sapiens
tccacatccccagagccc

SEQ ID NO: 3008845 - DNA, 16 bp, Homo sapiens
tccacattgttttaaa

SEQ ID NO: 3008846 - DNA, 17 bp, Homo sapiens
tccacattgttttaaaa

SEQ ID NO: 3008847 - DNA, 13 bp, Homo sapiens
tccacatttctaa

SEQ ID NO: 3008848 - DNA, 16 bp, Homo sapiens
tccacatttttgcaca

SEQ ID NO: 3008849 - DNA, 22 bp, Homo sapiens
tccacatttttgcacagattat

SEQ ID NO: 3008850 - DNA, 22 bp, Homo sapiens
tccaccaaccccgcggcccaga

SEQ ID NO: 3008851 - DNA, 11 bp, Homo sapiens
tccaccaactt

SEQ ID NO: 3008852 - DNA, 16 bp, Homo sapiens
tccaccaactttttcc

SEQ ID NO: 3008853 - DNA, 17 bp, Homo sapiens
tccaccacccaaaagtc

SEQ ID NO: 3008854 - DNA, 21 bp, Homo sapiens
tccaccagagcaggggctgct

SEQ ID NO: 3008855 - DNA, 12 bp, Homo sapiens
tccaccagcatc

SEQ ID NO: 3008856 - DNA, 19 bp, Homo sapiens
tccaccagcatcacctgcc

SEQ ID NO: 3008857 - DNA, 19 bp, Homo sapiens
tccacccaaaccccttccc

SEQ ID NO: 3008858 - DNA, 15 bp, Homo sapiens
tccacccacctcagc

SEQ ID NO: 3008859 - DNA, 12 bp, Homo sapiens
tccacccagccc

SEQ ID NO: 3008860 - DNA, 13 bp, Homo sapiens
tccacccagccca

SEQ ID NO: 3008861 - DNA, 14 bp, Homo sapiens
tccacccagcccat

SEQ ID NO: 3008862 - DNA, 16 bp, Homo sapiens
tccacccgccttcagc

SEQ ID NO: 3008863 - DNA, 15 bp, Homo sapiens
tccaccgctgcctaa

SEQ ID NO: 3008864 - DNA, 17 bp, Homo sapiens
tccacctcacaactcct

SEQ ID NO: 3008865 - DNA, 11 bp, Homo sapiens
tccacctcagc

SEQ ID NO: 3008866 - DNA, 17 bp, Homo sapiens
tccacctggccccatgt

SEQ ID NO: 3008867 - DNA, 21 bp, Homo sapiens
tccacctggtactccctctca

SEQ ID NO: 3008868 - DNA, 18 bp, Homo sapiens
tccacctttcagcccacg

SEQ ID NO: 3008869 - DNA, 20 bp, Homo sapiens
tccacctttcagcccacgtc

SEQ ID NO: 3008870 - DNA, 21 bp, Homo sapiens
tccaccttttgtttttccagt

SEQ ID NO: 3008871 - DNA, 15 bp, Homo sapiens
tccacgactgtctcc

SEQ ID NO: 3008872 - DNA, 18 bp, Homo sapiens
tccacgactgtctccatg

SEQ ID NO: 3008873 - DNA, 18 bp, Homo sapiens
tccacggtccgcggcctg

SEQ ID NO: 3008874 - DNA, 19 bp, Homo sapiens
tccacggtccgcggcctgc

SEQ ID NO: 3008875 - DNA, 20 bp, Homo sapiens
tccacggtccgcggcctgca

SEQ ID NO: 3008876 - DNA, 16 bp, Homo sapiens
tccacggtctgttctt

SEQ ID NO: 3008877 - DNA, 17 bp, Homo sapiens
tccacgtattccccttc

SEQ ID NO: 3008878 - DNA, 14 bp, Homo sapiens
tccacgtgtatgca

SEQ ID NO: 3008879 - DNA, 18 bp, Homo sapiens
tccacgtgtatgcaagtg

SEQ ID NO: 3008880 - DNA, 15 bp, Homo sapiens
tccactcagttgcaa

SEQ ID NO: 3008881 - DNA, 21 bp, Homo sapiens
tccactcatgtgactctttcc

SEQ ID NO: 3008882 - DNA, 14 bp, Homo sapiens
tccactcctctcaa

SEQ ID NO: 3008883 - DNA, 15 bp, Homo sapiens
tccactgagggcagt

SEQ ID NO: 3008884 - DNA, 12 bp, Homo sapiens
tccactgtgcta

SEQ ID NO: 3008885 - DNA, 12 bp, Homo sapiens
tccacttctggt

SEQ ID NO: 3008886 - DNA, 13 bp, Homo sapiens
tccacttgccagg

SEQ ID NO: 3008887 - DNA, 17 bp, Homo sapiens
tccacttgccagggctc

SEQ ID NO: 3008888 - DNA, 14 bp, Homo sapiens
tccacttgttcagg

SEQ ID NO: 3008889 - DNA, 21 bp, Homo sapiens
tccactttgttggcccttcca

SEQ ID NO: 3008890 - DNA, 18 bp, Homo sapiens
gtatacaacatgatttta

SEQ ID NO: 3008891 - DNA, 20 bp, Homo sapiens
gtatagtgtgtgttgcaaat

SEQ ID NO: 3008892 - DNA, 20 bp, Homo sapiens
gtatataaatgggaacattt

SEQ ID NO: 3008893 - DNA, 15 bp, Homo sapiens
gtatatacttttaaa

SEQ ID NO: 3008894 - DNA, 19 bp, Homo sapiens
gtatatacttttaaattat

SEQ ID NO: 3008895 - DNA, 20 bp, Homo sapiens
gtatataggacaaaatgtta

SEQ ID NO: 3008896 - DNA, 10 bp, Homo sapiens
gtatatatat

SEQ ID NO: 3008897 - DNA, 14 bp, Homo sapiens
gtatatattcccaa

SEQ ID NO: 3008898 - DNA, 16 bp, Homo sapiens
gtatatgactgcattt

SEQ ID NO: 3008899 - DNA, 18 bp, Homo sapiens
gtatattacccaatggaa

SEQ ID NO: 3008900 - DNA, 21 bp, Homo sapiens
gtatattatgtatttatattt

SEQ ID NO: 3008901 - DNA, 15 bp, Homo sapiens
gtatattatttctag

SEQ ID NO: 3008902 - DNA, 16 bp, Homo sapiens
gtatattcttgtaaat

SEQ ID NO: 3008903 - DNA, 19 bp, Homo sapiens
gtatatttatgaccagagc

SEQ ID NO: 3008904 - DNA, 19 bp, Homo sapiens
gtatatttctcataatgtg

SEQ ID NO: 3008905 - DNA, 24 bp, Homo sapiens
gtatcaaatattagatgtgattta

SEQ ID NO: 3008906 - DNA, 14 bp, Homo sapiens
gtatcaagtgttct

SEQ ID NO: 3008907 - DNA, 23 bp, Homo sapiens
gtatcaatacagtttataaagcc

SEQ ID NO: 3008908 - DNA, 18 bp, Homo sapiens
gtatcagaagagagggga

SEQ ID NO: 3008909 - DNA, 19 bp, Homo sapiens
gtatcagaattgaaacact

SEQ ID NO: 3008910 - DNA, 18 bp, Homo sapiens
gtatcaggaatataaata

SEQ ID NO: 3008911 - DNA, 22 bp, Homo sapiens
gtatcaggacccagaggaaggg

SEQ ID NO: 3008912 - DNA, 17 bp, Homo sapiens
gtatcaggacgagaatg

SEQ ID NO: 3008913 - DNA, 19 bp, Homo sapiens
gtatcataattaccaagtg

SEQ ID NO: 3008914 - DNA, 18 bp, Homo sapiens
gtatcatgtatctctctg

SEQ ID NO: 3008915 - DNA, 14 bp, Homo sapiens
gtatcattaatgta

SEQ ID NO: 3008916 - DNA, 16 bp, Homo sapiens
gtatcattcaactctc

SEQ ID NO: 3008917 - DNA, 14 bp, Homo sapiens
gtatccatgctctt

SEQ ID NO: 3008918 - DNA, 16 bp, Homo sapiens
gtatccattatcatgt

SEQ ID NO: 3008919 - DNA, 18 bp, Homo sapiens
gtatccattatcatgtgt

SEQ ID NO: 3008920 - DNA, 22 bp, Homo sapiens
gtatcctcatttggggtagcta

SEQ ID NO: 3008921 - DNA, 20 bp, Homo sapiens
gtatcctccctggcagacac

SEQ ID NO: 3008922 - DNA, 13 bp, Homo sapiens
gtatcctgctggt

SEQ ID NO: 3008923 - DNA, 20 bp, Homo sapiens
gtatctagacccatcttctt

SEQ ID NO: 3008924 - DNA, 24 bp, Homo sapiens
gtatctatgttgcatgataaacat

SEQ ID NO: 3008925 - DNA, 21 bp, Homo sapiens
gtatctgagcgtttaaagtac

SEQ ID NO: 3008926 - DNA, 17 bp, Homo sapiens
gtatctggtatctgcat

SEQ ID NO: 3008927 - DNA, 18 bp, Homo sapiens
gtatctgtctactttctc

SEQ ID NO: 3008928 - DNA, 21 bp, Homo sapiens
gtatctgtctactttctcttg

SEQ ID NO: 3008929 - DNA, 14 bp, Homo sapiens
gtatgaaagctggg

SEQ ID NO: 3008930 - DNA, 15 bp, Homo sapiens
gtatgaataattgca

SEQ ID NO: 3008931 - DNA, 15 bp, Homo sapiens
gtatgaatacagcag

SEQ ID NO: 3008932 - DNA, 20 bp, Homo sapiens
gtatgaatacagcagcaaga

SEQ ID NO: 3008933 - DNA, 22 bp, Homo sapiens
gtatgaatggtctagaaacatt

SEQ ID NO: 3008934 - DNA, 21 bp, Homo sapiens
gtatgagataggcacatgcat

SEQ ID NO: 3008935 - DNA, 20 bp, Homo sapiens
gtatgatctccgtatgatgt

SEQ ID NO: 3008936 - DNA, 16 bp, Homo sapiens
gtatgatttgttttga

SEQ ID NO: 3008937 - DNA, 23 bp, Homo sapiens
gtatgatttgttttgaattttgt

SEQ ID NO: 3008938 - DNA, 15 bp, Homo sapiens
gtatgcatgtgaaga

SEQ ID NO: 3008939 - DNA, 16 bp, Homo sapiens
gtatgcatgtgaagaa

SEQ ID NO: 3008940 - DNA, 17 bp, Homo sapiens
gtatgcatgtgaagaaa

SEQ ID NO: 3008941 - DNA, 18 bp, Homo sapiens
gtatgcatgtgaagaaag

SEQ ID NO: 3008942 - DNA, 16 bp, Homo sapiens
gtatgcatttttttag

SEQ ID NO: 3008943 - DNA, 23 bp, Homo sapiens
gtatgctgtatgaatattttata

SEQ ID NO: 3008944 - DNA, 15 bp, Homo sapiens
gtatgcttcatacag

SEQ ID NO: 3008945 - DNA, 20 bp, Homo sapiens
gtatggtgctaatattttat

SEQ ID NO: 3008946 - DNA, 15 bp, Homo sapiens
gtatgtacagttcat

SEQ ID NO: 3008947 - DNA, 16 bp, Homo sapiens
gtatgtagaagcatga

SEQ ID NO: 3008948 - DNA, 11 bp, Homo sapiens
gtatgtatttc

SEQ ID NO: 3008949 - DNA, 17 bp, Homo sapiens
gtatgtcatttccttca

SEQ ID NO: 3008950 - DNA, 15 bp, Homo sapiens
gtatgtgccaggctt

SEQ ID NO: 3008951 - DNA, 22 bp, Homo sapiens
gtatgtgccaggcttgcctggg

SEQ ID NO: 3008952 - DNA, 21 bp, Homo sapiens
gtatgtggatacagtcattat

SEQ ID NO: 3008953 - DNA, 14 bp, Homo sapiens
gtattaaacttgaa

SEQ ID NO: 3008954 - DNA, 21 bp, Homo sapiens
gtattaataaatagagcaatt

SEQ ID NO: 3008955 - DNA, 16 bp, Homo sapiens
gtattaatatctccat

SEQ ID NO: 3008956 - DNA, 18 bp, Homo sapiens
gtattactagtggacgta

SEQ ID NO: 3008957 - DNA, 19 bp, Homo sapiens
gtattactgctgctgtgct

SEQ ID NO: 3008958 - DNA, 15 bp, Homo sapiens
gtattagccagtcat

SEQ ID NO: 3008959 - DNA, 16 bp, Homo sapiens
gtattagtagagcaac

SEQ ID NO: 3008960 - DNA, 14 bp, Homo sapiens
gtattcaggcactg

SEQ ID NO: 3008961 - DNA, 16 bp, Homo sapiens
gtattcatgttcatgt

SEQ ID NO: 3008962 - DNA, 18 bp, Homo sapiens
gtattctagttttgtcaa

SEQ ID NO: 3008963 - DNA, 14 bp, Homo sapiens
gtattctctctatg

SEQ ID NO: 3008964 - DNA, 12 bp, Homo sapiens
gtattctctgag

SEQ ID NO: 3008965 - DNA, 13 bp, Homo sapiens
gtattctctgagc

SEQ ID NO: 3008966 - DNA, 12 bp, Homo sapiens
gtattctgtcat

SEQ ID NO: 3008967 - DNA, 16 bp, Homo sapiens
gtattcttctcttcct

SEQ ID NO: 3008968 - DNA, 19 bp, Homo sapiens
gtattcttttcaattatat

SEQ ID NO: 3008969 - DNA, 15 bp, Homo sapiens
gtattgctgctgtgc

SEQ ID NO: 3008970 - DNA, 20 bp, Homo sapiens
gtattgctgctgtgcgtgga

SEQ ID NO: 3008971 - DNA, 20 bp, Homo sapiens
gtattgtaaattatatttgt

SEQ ID NO: 3008972 - DNA, 17 bp, Homo sapiens
gtatttaaaaatagaaa

SEQ ID NO: 3008973 - DNA, 16 bp, Homo sapiens
gtatttacgctttgat

SEQ ID NO: 3008974 - DNA, 16 bp, Homo sapiens
gtatttatttatgtac

SEQ ID NO: 3008975 - DNA, 12 bp, Homo sapiens
gtatttcattgc

SEQ ID NO: 3008976 - DNA, 20 bp, Homo sapiens
gtatttcctgaaataaatgt

SEQ ID NO: 3008977 - DNA, 14 bp, Homo sapiens
gtatttctctgtga

SEQ ID NO: 3008978 - DNA, 22 bp, Homo sapiens
gtatttcttatacgcttttctt

SEQ ID NO: 3008979 - DNA, 21 bp, Homo sapiens
gtatttgggaaacttgtcact

SEQ ID NO: 3008980 - DNA, 20 bp, Homo sapiens
gtatttgggaagtgaagact

SEQ ID NO: 3008981 - DNA, 21 bp, Homo sapiens
gtatttggtccaaaaaaagga

SEQ ID NO: 3008982 - DNA, 23 bp, Homo sapiens
gtatttgtttgtagctttcctgg

SEQ ID NO: 3008983 - DNA, 12 bp, Homo sapiens
gtattttaaaat

SEQ ID NO: 3008984 - DNA, 13 bp, Homo sapiens
gtattttaaaata

SEQ ID NO: 3008985 - DNA, 19 bp, Homo sapiens
gtattttagtgaacttgaa

SEQ ID NO: 3008986 - DNA, 12 bp, Homo sapiens
gtattttcaaag

SEQ ID NO: 3008987 - DNA, 23 bp, Homo sapiens
gtattttcacaggtttgtttctt

SEQ ID NO: 3008988 - DNA, 16 bp, Homo sapiens
gtattttccaagtgtg

SEQ ID NO: 3008989 - DNA, 20 bp, Homo sapiens
gtattttccaagtgtgcata

SEQ ID NO: 3008990 - DNA, 16 bp, Homo sapiens
gtattttcctccaaag

SEQ ID NO: 3008991 - DNA, 16 bp, Homo sapiens
gtattttcctgtaaaa

SEQ ID NO: 3008992 - DNA, 18 bp, Homo sapiens
gtattttgagtttcagct

SEQ ID NO: 3008993 - DNA, 13 bp, Homo sapiens
gtattttggaaga

SEQ ID NO: 3008994 - DNA, 17 bp, Homo sapiens
gtccaacccctccccca

SEQ ID NO: 3008995 - DNA, 21 bp, Homo sapiens
gtccaacctaacccctttcct

SEQ ID NO: 3008996 - DNA, 16 bp, Homo sapiens
gtccaacgccgccttg

SEQ ID NO: 3008997 - DNA, 22 bp, Homo sapiens
gtccaagaatccacatttctaa

SEQ ID NO: 3008998 - DNA, 23 bp, Homo sapiens
gtccaagaatccacatttctaaa

SEQ ID NO: 3008999 - DNA, 20 bp, Homo sapiens
gtccaaggtttaaagagtct

SEQ ID NO: 3009000 - DNA, 12 bp, Homo sapiens
gtccaatgtggc

SEQ ID NO: 3009001 - DNA, 16 bp, Homo sapiens
gtccaattttaattta

SEQ ID NO: 3009002 - DNA, 20 bp, Homo sapiens
gtccacaaaataaccaatcc

SEQ ID NO: 3009003 - DNA, 19 bp, Homo sapiens
gtccacacccaattccact

SEQ ID NO: 3009004 - DNA, 14 bp, Homo sapiens
gtccacatccccag

SEQ ID NO: 3009005 - DNA, 24 bp, Homo sapiens
gtccaccaggcctcactggctcat

SEQ ID NO: 3009006 - DNA, 23 bp, Homo sapiens
gtccactgtgtatagaagtagat

SEQ ID NO: 3009007 - DNA, 14 bp, Homo sapiens
gtccacttgccagg

SEQ ID NO: 3009008 - DNA, 18 bp, Homo sapiens
gtccacttgccagggctc

SEQ ID NO: 3009009 - DNA, 20 bp, Homo sapiens
gtccacttgccagggctctg

SEQ ID NO: 3009010 - DNA, 14 bp, Homo sapiens
gtccacttgtgggt

SEQ ID NO: 3009011 - DNA, 21 bp, Homo sapiens
gtccacttgtgggtcctgggg

SEQ ID NO: 3009012 - DNA, 15 bp, Homo sapiens
gtccagagcttttca

SEQ ID NO: 3009013 - DNA, 15 bp, Homo sapiens
gtccagcagtttcca

SEQ ID NO: 3009014 - DNA, 11 bp, Homo sapiens
gtccagccccc

SEQ ID NO: 3009015 - DNA, 13 bp, Homo sapiens
gtccagcccccag

SEQ ID NO: 3009016 - DNA, 14 bp, Homo sapiens
gtccagcctgcccc

SEQ ID NO: 3009017 - DNA, 24 bp, Homo sapiens
gtccagctcccgctgtggccgcac

SEQ ID NO: 3009018 - DNA, 17 bp, Homo sapiens
gtccagctgagcgccag

SEQ ID NO: 3009019 - DNA, 14 bp, Homo sapiens
gtccagcttgctct

SEQ ID NO: 3009020 - DNA, 17 bp, Homo sapiens
gtccagcttgctcttca

SEQ ID NO: 3009021 - DNA, 24 bp, Homo sapiens
gtccaggactgggtctgacctggt

SEQ ID NO: 3009022 - DNA, 15 bp, Homo sapiens
gtccaggcactgaga

SEQ ID NO: 3009023 - DNA, 17 bp, Homo sapiens
gtccaggccctgtggca

SEQ ID NO: 3009024 - DNA, 21 bp, Homo sapiens
gtccagtgcattttgtttctg

SEQ ID NO: 3009025 - DNA, 22 bp, Homo sapiens
gtccagttgattgtacgtagcc

SEQ ID NO: 3009026 - DNA, 14 bp, Homo sapiens
gtccatcactattc

SEQ ID NO: 3009027 - DNA, 15 bp, Homo sapiens
gtccatcagcctcca

SEQ ID NO: 3009028 - DNA, 16 bp, Homo sapiens
gtccatcctcctctcc

SEQ ID NO: 3009029 - DNA, 14 bp, Homo sapiens
gtccatcctgacct

SEQ ID NO: 3009030 - DNA, 14 bp, Homo sapiens
gtccatctctctcc

SEQ ID NO: 3009031 - DNA, 17 bp, Homo sapiens
gtccatctgcccgcctg

SEQ ID NO: 3009032 - DNA, 22 bp, Homo sapiens
gtccatctgcccgcctgcccac

SEQ ID NO: 3009033 - DNA, 18 bp, Homo sapiens
gtccatgggcagagccca

SEQ ID NO: 3009034 - DNA, 15 bp, Homo sapiens
gtccatgggtctggc

SEQ ID NO: 3009035 - DNA, 19 bp, Homo sapiens
gtccatttcccacatcttt

SEQ ID NO: 3009036 - DNA, 13 bp, Homo sapiens
gtccatttctacc

SEQ ID NO: 3009037 - DNA, 22 bp, Homo sapiens
gtccatttggcaggggtggctg

SEQ ID NO: 3009038 - DNA, 14 bp, Homo sapiens
gtccattttgtgaa

SEQ ID NO: 3009039 - DNA, 20 bp, Homo sapiens
gtccattttgtgaagccctg

SEQ ID NO: 3009040 - DNA, 15 bp, Homo sapiens
gtcccacccaggaag

SEQ ID NO: 3009041 - DNA, 21 bp, Homo sapiens
gtcccactcaagccaagcagc

SEQ ID NO: 3009042 - DNA, 22 bp, Homo sapiens
gtcccactcaagccaagcagcc

SEQ ID NO: 3009043 - DNA, 18 bp, Homo sapiens
gtcccagacaaggagagc

SEQ ID NO: 3009044 - DNA, 13 bp, Homo sapiens
gtcccagcgagcc

SEQ ID NO: 3009045 - DNA, 19 bp, Homo sapiens
gtcccagcgagccacagga

SEQ ID NO: 3009046 - DNA, 18 bp, Homo sapiens
gtcccagcggcctcaggg

SEQ ID NO: 3009047 - DNA, 18 bp, Homo sapiens
gtcccagctacttgggag

SEQ ID NO: 3009048 - DNA, 22 bp, Homo sapiens
gtcccagctacttgggagcctg

SEQ ID NO: 3009049 - DNA, 18 bp, Homo sapiens
gtcccaggactcaccctc

SEQ ID NO: 3009050 - DNA, 23 bp, Homo sapiens
gtcccaggactcaccctccacaa

SEQ ID NO: 3009051 - DNA, 14 bp, Homo sapiens
gtcccaggggcagc

SEQ ID NO: 3009052 - DNA, 18 bp, Homo sapiens
gtcccaggggcagccaca

SEQ ID NO: 3009053 - DNA, 17 bp, Homo sapiens
gtcccagtagccaaggc

SEQ ID NO: 3009054 - DNA, 22 bp, Homo sapiens
gtcccataatatgctttttact

SEQ ID NO: 3009055 - DNA, 21 bp, Homo sapiens
gtcccattgttggcgctgagg

SEQ ID NO: 3009056 - DNA, 23 bp, Homo sapiens
gtcccattgttggcgctgaggtg

SEQ ID NO: 3009057 - DNA, 16 bp, Homo sapiens
gtccccaacctgcact

SEQ ID NO: 3009058 - DNA, 17 bp, Homo sapiens
gtccccaacctgcactc

SEQ ID NO: 3009059 - DNA, 20 bp, Homo sapiens
gtccccacgaggggacccat

SEQ ID NO: 3009060 - DNA, 12 bp, Homo sapiens
gtccccagactc

SEQ ID NO: 3009061 - DNA, 17 bp, Homo sapiens
gtccccagactctgcct

SEQ ID NO: 3009062 - DNA, 19 bp, Homo sapiens
gtccccaggccccaggaag

SEQ ID NO: 3009063 - DNA, 20 bp, Homo sapiens
gtccccaggccccaggaagc

SEQ ID NO: 3009064 - DNA, 21 bp, Homo sapiens
gtccccaggccccaggaagcc

SEQ ID NO: 3009065 - DNA, 23 bp, Homo sapiens
gtccccagggctgtcatctgaat

SEQ ID NO: 3009066 - DNA, 19 bp, Homo sapiens
gtccccagtttgcagaaaa

SEQ ID NO: 3009067 - DNA, 11 bp, Homo sapiens
gtccccccacc

SEQ ID NO: 3009068 - DNA, 16 bp, Homo sapiens
gtccccccccaggccc

SEQ ID NO: 3009069 - DNA, 17 bp, Homo sapiens
gtccccccccaggccct

SEQ ID NO: 3009070 - DNA, 16 bp, Homo sapiens
gtcccccgactgcctg

SEQ ID NO: 3009071 - DNA, 19 bp, Homo sapiens
gtcccccgactgcctgtct

SEQ ID NO: 3009072 - DNA, 17 bp, Homo sapiens
gtccccgatgctgacct

SEQ ID NO: 3009073 - DNA, 16 bp, Homo sapiens
gtccccgccctctctc

SEQ ID NO: 3009074 - DNA, 16 bp, Homo sapiens
gtccccgctgctgtgc

SEQ ID NO: 3009075 - DNA, 13 bp, Homo sapiens
gtcccctcacaga

SEQ ID NO: 3009076 - DNA, 15 bp, Homo sapiens
gtcccctcacagact

SEQ ID NO: 3009077 - DNA, 14 bp, Homo sapiens
gtcccctgacctgt

SEQ ID NO: 3009078 - DNA, 17 bp, Homo sapiens
gtcccctgacctgtcca

SEQ ID NO: 3009079 - DNA, 12 bp, Homo sapiens
gtcccctggggc

SEQ ID NO: 3009080 - DNA, 13 bp, Homo sapiens
gtcccctggggct

SEQ ID NO: 3009081 - DNA, 16 bp, Homo sapiens
gtcccctggggctggt

SEQ ID NO: 3009082 - DNA, 15 bp, Homo sapiens
gtcctcccagctcct

SEQ ID NO: 3009083 - DNA, 19 bp, Homo sapiens
gtcctccccctgccagtgc

SEQ ID NO: 3009084 - DNA, 20 bp, Homo sapiens
gtcctccggttcttcctcgg

SEQ ID NO: 3009085 - DNA, 17 bp, Homo sapiens
gtcctcctctacctctc

SEQ ID NO: 3009086 - DNA, 14 bp, Homo sapiens
gtcctcctctgtga

SEQ ID NO: 3009087 - DNA, 19 bp, Homo sapiens
gtcctcggcccatctgtcc

SEQ ID NO: 3009088 - DNA, 12 bp, Homo sapiens
gtcctctctctg

SEQ ID NO: 3009089 - DNA, 14 bp, Homo sapiens
gtcctctctctgtg

SEQ ID NO: 3009090 - DNA, 18 bp, Homo sapiens
gtcctctctctgtggggc

SEQ ID NO: 3009091 - DNA, 19 bp, Homo sapiens
gtcctctgtcagtcacagc

SEQ ID NO: 3009092 - DNA, 18 bp, Homo sapiens
gtcctcttccctctctgc

SEQ ID NO: 3009093 - DNA, 19 bp, Homo sapiens
gtcctcttccctctctgca

SEQ ID NO: 3009094 - DNA, 13 bp, Homo sapiens
gtcctcttctggg

SEQ ID NO: 3009095 - DNA, 14 bp, Homo sapiens
gtcctgaagctgct

SEQ ID NO: 3009096 - DNA, 16 bp, Homo sapiens
gtcctgaagctgctgg

SEQ ID NO: 3009097 - DNA, 17 bp, Homo sapiens
gtcctgaagctgctgga

SEQ ID NO: 3009098 - DNA, 17 bp, Homo sapiens
gtcctgatgatttttat

SEQ ID NO: 3009099 - DNA, 23 bp, Homo sapiens
gtcctgcacagattcccaggcca

SEQ ID NO: 3009100 - DNA, 19 bp, Homo sapiens
gtcctgcaccggggcctgg

SEQ ID NO: 3009101 - DNA, 13 bp, Homo sapiens
gtcctgccctgcc

SEQ ID NO: 3009102 - DNA, 19 bp, Homo sapiens
gtcctgcctaaaatgaatt

SEQ ID NO: 3009103 - DNA, 12 bp, Homo sapiens
gtcctgcctgca

SEQ ID NO: 3009104 - DNA, 14 bp, Homo sapiens
gtcctgcctgcagt

SEQ ID NO: 3009105 - DNA, 15 bp, Homo sapiens
gtcctgctccgctgc

SEQ ID NO: 3009106 - DNA, 15 bp, Homo sapiens
gtcctgctggcctgc

SEQ ID NO: 3009107 - DNA, 17 bp, Homo sapiens
gtcctgctggcctgctc

SEQ ID NO: 3009108 - DNA, 17 bp, Homo sapiens
gtcctggagcaatcaca

SEQ ID NO: 3009109 - DNA, 17 bp, Homo sapiens
gtcctggattcactggc

SEQ ID NO: 3009110 - DNA, 14 bp, Homo sapiens
gtcctggctgcact

SEQ ID NO: 3009111 - DNA, 20 bp, Homo sapiens
gtcctggctgcactcttgaa

SEQ ID NO: 3009112 - DNA, 19 bp, Homo sapiens
gtcctgggaggctgcagcc

SEQ ID NO: 3009113 - DNA, 12 bp, Homo sapiens
gtcctgggcagg

SEQ ID NO: 3009114 - DNA, 16 bp, Homo sapiens
gtcctgggcaggtggg

SEQ ID NO: 3009115 - DNA, 17 bp, Homo sapiens
gtcctggtcctggctgc

SEQ ID NO: 3009116 - DNA, 15 bp, Homo sapiens
gtcctggtggctggg

SEQ ID NO: 3009117 - DNA, 22 bp, Homo sapiens
gtcctggtggctgggcccagca

SEQ ID NO: 3009118 - DNA, 23 bp, Homo sapiens
gtcctggtggctgggcccagcag

SEQ ID NO: 3009119 - DNA, 15 bp, Homo sapiens
gtcctgtatgtctgt

SEQ ID NO: 3009120 - DNA, 22 bp, Homo sapiens
gtcctgtccacacccagctcag

SEQ ID NO: 3009121 - DNA, 14 bp, Homo sapiens
gtcctgtctgtcct

SEQ ID NO: 3009122 - DNA, 23 bp, Homo sapiens
gtcctgtctgtccttctgaagtg

SEQ ID NO: 3009123 - DNA, 20 bp, Homo sapiens
gtcctgtgaggtttcccaat

SEQ ID NO: 3009124 - DNA, 15 bp, Homo sapiens
gtcctgtgatcttat

SEQ ID NO: 3009125 - DNA, 16 bp, Homo sapiens
gtccttactcagagct

SEQ ID NO: 3009126 - DNA, 18 bp, Homo sapiens
gtccttactcagagctgc

SEQ ID NO: 3009127 - DNA, 17 bp, Homo sapiens
gtccttcactggcgcct

SEQ ID NO: 3009128 - DNA, 13 bp, Homo sapiens
gtccttcttcctc

SEQ ID NO: 3009129 - DNA, 11 bp, Homo sapiens
gtccttgaaaa

SEQ ID NO: 3009130 - DNA, 14 bp, Homo sapiens
gtccttgaaaatat

SEQ ID NO: 3009131 - DNA, 15 bp, Homo sapiens
gtccttggctgtatc

SEQ ID NO: 3009132 - DNA, 15 bp, Homo sapiens
gtccttgggcctggc

SEQ ID NO: 3009133 - DNA, 17 bp, Homo sapiens
gtccttgggcctggcca

SEQ ID NO: 3009134 - DNA, 21 bp, Homo sapiens
gtcctttatgtggaaaacaga

SEQ ID NO: 3009135 - DNA, 18 bp, Homo sapiens
gtcctttccaaggcttct

SEQ ID NO: 3009136 - DNA, 19 bp, Homo sapiens
gtcctttccatctgtccac

SEQ ID NO: 3009137 - DNA, 22 bp, Homo sapiens
gtcctttctagagcactgccac

SEQ ID NO: 3009138 - DNA, 16 bp, Homo sapiens
gtccttttcttgctta

SEQ ID NO: 3009139 - DNA, 13 bp, Homo sapiens
gtccttttgtaaa

SEQ ID NO: 3009140 - DNA, 16 bp, Homo sapiens
gtcctttttttccatc

SEQ ID NO: 3009141 - DNA, 19 bp, Homo sapiens
gtcctttttttccatcttt

SEQ ID NO: 3009142 - DNA, 18 bp, Homo sapiens
gtcgaaaggtgcagctgc

SEQ ID NO: 3009143 - DNA, 16 bp, Homo sapiens
gtcgagagctggccaa

SEQ ID NO: 3009144 - DNA, 17 bp, Homo sapiens
gtcgaggctgcagtcag

SEQ ID NO: 3009145 - DNA, 20 bp, Homo sapiens
gtcgcccaggctggagtgca

SEQ ID NO: 3009146 - DNA, 14 bp, Homo sapiens
gtcgctcagtctgt

SEQ ID NO: 3009147 - DNA, 22 bp, Homo sapiens
gtcgctcagtctgttcactgca

SEQ ID NO: 3009148 - DNA, 15 bp, Homo sapiens
gtcgcttgccaaagc

SEQ ID NO: 3009149 - DNA, 16 bp, Homo sapiens
gtcgcttgccaaagca

SEQ ID NO: 3009150 - DNA, 18 bp, Homo sapiens
gtcgcttgccaaagcaga

SEQ ID NO: 3009151 - DNA, 23 bp, Homo sapiens
gtcggaaaagcgtctttaagaga

SEQ ID NO: 3009152 - DNA, 13 bp, Homo sapiens
gtcggaagcctgt

SEQ ID NO: 3009153 - DNA, 14 bp, Homo sapiens
gtcggaagcctgtc

SEQ ID NO: 3009154 - DNA, 14 bp, Homo sapiens
gtcggagctgcctg

SEQ ID NO: 3009155 - DNA, 15 bp, Homo sapiens
gtcggaggaaagaca

SEQ ID NO: 3009156 - DNA, 21 bp, Homo sapiens
gtcgggagaggggacgcaggc

SEQ ID NO: 3009157 - DNA, 18 bp, Homo sapiens
gtcgggagttcgagacca

SEQ ID NO: 3009158 - DNA, 16 bp, Homo sapiens
gtcgggctttgtgtga

SEQ ID NO: 3009159 - DNA, 14 bp, Homo sapiens
gtcgggggccactg

SEQ ID NO: 3009160 - DNA, 19 bp, Homo sapiens
gtcgtcactaatacacagt

SEQ ID NO: 3009161 - DNA, 15 bp, Homo sapiens
gtcgtctggcatctc

SEQ ID NO: 3009162 - DNA, 20 bp, Homo sapiens
gttttaaaacgtgtaaatga

SEQ ID NO: 3009163 - DNA, 13 bp, Homo sapiens
gttttaaagaagt

SEQ ID NO: 3009164 - DNA, 22 bp, Homo sapiens
gttttaaagacctgacaccttt

SEQ ID NO: 3009165 - DNA, 15 bp, Homo sapiens
gttttaaatgtacag

SEQ ID NO: 3009166 - DNA, 15 bp, Homo sapiens
gttttaacagatgcc

SEQ ID NO: 3009167 - DNA, 22 bp, Homo sapiens
gttttaagcaaatgcattctat

SEQ ID NO: 3009168 - DNA, 14 bp, Homo sapiens
taaaaatcaatgga

SEQ ID NO: 3009169 - DNA, 16 bp, Homo sapiens
taaaaatcacactgta

SEQ ID NO: 3009170 - DNA, 18 bp, Homo sapiens
taaaaatcctaaaatatg

SEQ ID NO: 3009171 - DNA, 23 bp, Homo sapiens
taaaaatctgagaaactctacat

SEQ ID NO: 3009172 - DNA, 13 bp, Homo sapiens
taaaaatgaaaaa

SEQ ID NO: 3009173 - DNA, 13 bp, Homo sapiens
taaaaatgacaga

SEQ ID NO: 3009174 - DNA, 18 bp, Homo sapiens
taaaaatgagtgtgaagg

SEQ ID NO: 3009175 - DNA, 19 bp, Homo sapiens
taaaaatgatttcagtagc

SEQ ID NO: 3009176 - DNA, 11 bp, Homo sapiens
taaaaatgcaa

SEQ ID NO: 3009177 - DNA, 19 bp, Homo sapiens
taaaaatgcaaatcctatg

SEQ ID NO: 3009178 - DNA, 17 bp, Homo sapiens
taaaaatgggacttctt

SEQ ID NO: 3009179 - DNA, 18 bp, Homo sapiens
taaaaatgggacttcttt

SEQ ID NO: 3009180 - DNA, 23 bp, Homo sapiens
taaaaatgggacttcttttcaca

SEQ ID NO: 3009181 - DNA, 16 bp, Homo sapiens
taaaaatggtggcttc

SEQ ID NO: 3009182 - DNA, 20 bp, Homo sapiens
taaaaatggtggcttcagct

SEQ ID NO: 3009183 - DNA, 18 bp, Homo sapiens
taaagaaagagagaaaat

SEQ ID NO: 3009184 - DNA, 20 bp, Homo sapiens
taaagaaagagagaaaataa

SEQ ID NO: 3009185 - DNA, 21 bp, Homo sapiens
taaagaaagagagaaaataaa

SEQ ID NO: 3009186 - DNA, 20 bp, Homo sapiens
taaagaactgcacatgaaga

SEQ ID NO: 3009187 - DNA, 13 bp, Homo sapiens
taaagaagcaata

SEQ ID NO: 3009188 - DNA, 23 bp, Homo sapiens
taaagaagtctcttaattctgat

SEQ ID NO: 3009189 - DNA, 15 bp, Homo sapiens
taaagaagtgcatga

SEQ ID NO: 3009190 - DNA, 16 bp, Homo sapiens
taaagaatacttgaac

SEQ ID NO: 3009191 - DNA, 17 bp, Homo sapiens
taaagaatacttgaact

SEQ ID NO: 3009192 - DNA, 19 bp, Homo sapiens
taaagaatacttgaacttg

SEQ ID NO: 3009193 - DNA, 16 bp, Homo sapiens
taaagaatatgacttt

SEQ ID NO: 3009194 - DNA, 14 bp, Homo sapiens
taaagaattacttg

SEQ ID NO: 3009195 - DNA, 10 bp, Homo sapiens
taaagacaga

SEQ ID NO: 3009196 - DNA, 14 bp, Homo sapiens
taaagacagggtct

SEQ ID NO: 3009197 - DNA, 16 bp, Homo sapiens
taaagacagggtcttg

SEQ ID NO: 3009198 - DNA, 18 bp, Homo sapiens
taaagagataaagaataa

SEQ ID NO: 3009199 - DNA, 13 bp, Homo sapiens
taaagagtctaga

SEQ ID NO: 3009200 - DNA, 21 bp, Homo sapiens
taaagagtctagattcaaagg

SEQ ID NO: 3009201 - DNA, 23 bp, Homo sapiens
taaagagtctagattcaaaggtt

SEQ ID NO: 3009202 - DNA, 16 bp, Homo sapiens
taaagatattctttag

SEQ ID NO: 3009203 - DNA, 16 bp, Homo sapiens
taaagatatttttatt

SEQ ID NO: 3009204 - DNA, 19 bp, Homo sapiens
taaagatatttttattcaa

SEQ ID NO: 3009205 - DNA, 16 bp, Homo sapiens
taaagatctacatgaa

SEQ ID NO: 3009206 - DNA, 18 bp, Homo sapiens
taaagatggagtttctaa

SEQ ID NO: 3009207 - DNA, 21 bp, Homo sapiens
taaagatggagtttctaaggt

SEQ ID NO: 3009208 - DNA, 17 bp, Homo sapiens
taaagatgggaggagac

SEQ ID NO: 3009209 - DNA, 21 bp, Homo sapiens
taaagattctatagttctaga

SEQ ID NO: 3009210 - DNA, 15 bp, Homo sapiens
taaagatttatcaaa

SEQ ID NO: 3009211 - DNA, 22 bp, Homo sapiens
taaagatttatcaaatcagtca

SEQ ID NO: 3009212 - DNA, 13 bp, Homo sapiens
taaagcaatagaa

SEQ ID NO: 3009213 - DNA, 14 bp, Homo sapiens
taaagcaatagaaa

SEQ ID NO: 3009214 - DNA, 15 bp, Homo sapiens
taaagcaatagaaac

SEQ ID NO: 3009215 - DNA, 17 bp, Homo sapiens
taaagcaatatgcattt

SEQ ID NO: 3009216 - DNA, 12 bp, Homo sapiens
taaagcattcca

SEQ ID NO: 3009217 - DNA, 15 bp, Homo sapiens
taaagcattccaaca

SEQ ID NO: 3009218 - DNA, 15 bp, Homo sapiens
taaagccatgctgga

SEQ ID NO: 3009219 - DNA, 21 bp, Homo sapiens
taaagcctcaaggttttaggt

SEQ ID NO: 3009220 - DNA, 15 bp, Homo sapiens
taaagctaaaataac

SEQ ID NO: 3009221 - DNA, 13 bp, Homo sapiens
taaagctgttctc

SEQ ID NO: 3009222 - DNA, 16 bp, Homo sapiens
taaaggaaatgattga

SEQ ID NO: 3009223 - DNA, 14 bp, Homo sapiens
taaaggaatttaaa

SEQ ID NO: 3009224 - DNA, 16 bp, Homo sapiens
taaaggacaaacagtg

SEQ ID NO: 3009225 - DNA, 19 bp, Homo sapiens
taaaggagaggttaaagca

SEQ ID NO: 3009226 - DNA, 13 bp, Homo sapiens
taaaggagcagaa

SEQ ID NO: 3009227 - DNA, 13 bp, Homo sapiens
taaaggatgaggg

SEQ ID NO: 3009228 - DNA, 14 bp, Homo sapiens
taaaggatgagggt

SEQ ID NO: 3009229 - DNA, 14 bp, Homo sapiens
taaaggcagtccag

SEQ ID NO: 3009230 - DNA, 15 bp, Homo sapiens
taaaggcagtccaga

SEQ ID NO: 3009231 - DNA, 17 bp, Homo sapiens
taaaggcattccacagg

SEQ ID NO: 3009232 - DNA, 17 bp, Homo sapiens
taaaggcttaggcatgt

SEQ ID NO: 3009233 - DNA, 17 bp, Homo sapiens
taaagggataaagaaat

SEQ ID NO: 3009234 - DNA, 20 bp, Homo sapiens
taaagggcgcaaagggcatg

SEQ ID NO: 3009235 - DNA, 21 bp, Homo sapiens
taaaggtccacaggtctagac

SEQ ID NO: 3009236 - DNA, 20 bp, Homo sapiens
taaaggtgtgctatttgtca

SEQ ID NO: 3009237 - DNA, 13 bp, Homo sapiens
taaagtaaatctc

SEQ ID NO: 3009238 - DNA, 12 bp, Homo sapiens
taaagtaccaga

SEQ ID NO: 3009239 - DNA, 22 bp, Homo sapiens
taaagtacttgactacctactg

SEQ ID NO: 3009240 - DNA, 19 bp, Homo sapiens
taaagtatttttgattaac

SEQ ID NO: 3009241 - DNA, 19 bp, Homo sapiens
taaagtcaggacctggctt

SEQ ID NO: 3009242 - DNA, 22 bp, Homo sapiens
taaagtcatcatgaactggctt

SEQ ID NO: 3009243 - DNA, 21 bp, Homo sapiens
taaagtccttttcttgcttac

SEQ ID NO: 3009244 - DNA, 16 bp, Homo sapiens
taaagtgaagaatcct

SEQ ID NO: 3009245 - DNA, 14 bp, Homo sapiens
taaagtgaattgtt

SEQ ID NO: 3009246 - DNA, 22 bp, Homo sapiens
taaagtgaattgttgacaaatg

SEQ ID NO: 3009247 - DNA, 16 bp, Homo sapiens
taaagtgagtactgtt

SEQ ID NO: 3009248 - DNA, 17 bp, Homo sapiens
taaagtgagtactgtta

SEQ ID NO: 3009249 - DNA, 23 bp, Homo sapiens
taaagtgagtactgttaagaata

SEQ ID NO: 3009250 - DNA, 17 bp, Homo sapiens
taaagtgctaaggttct

SEQ ID NO: 3009251 - DNA, 22 bp, Homo sapiens
taaagtgctaaggttctaaggc

SEQ ID NO: 3009252 - DNA, 14 bp, Homo sapiens
taaagtgctgttta

SEQ ID NO: 3009253 - DNA, 15 bp, Homo sapiens
taaagtgcttgtgta

SEQ ID NO: 3009254 - DNA, 20 bp, Homo sapiens
taaagtgtggtcccaacagg

SEQ ID NO: 3009255 - DNA, 17 bp, Homo sapiens
taaagtgtgtttctatg

SEQ ID NO: 3009256 - DNA, 20 bp, Homo sapiens
taaagttagtctactcttaa

SEQ ID NO: 3009257 - DNA, 13 bp, Homo sapiens
taaagttctaaga

SEQ ID NO: 3009258 - DNA, 15 bp, Homo sapiens
taaagttctaagatt

SEQ ID NO: 3009259 - DNA, 16 bp, Homo sapiens
taaagttctaagattc

SEQ ID NO: 3009260 - DNA, 17 bp, Homo sapiens
taaagttctaagattct

SEQ ID NO: 3009261 - DNA, 17 bp, Homo sapiens
taaagtttgcttagaaa

SEQ ID NO: 3009262 - DNA, 16 bp, Homo sapiens
taaagtttggttttga

SEQ ID NO: 3009263 - DNA, 20 bp, Homo sapiens
taaagtttttttatttcttt

SEQ ID NO: 3009264 - DNA, 14 bp, Homo sapiens
taaataaaaatgga

SEQ ID NO: 3009265 - DNA, 13 bp, Homo sapiens
taaataaaatttg

SEQ ID NO: 3009266 - DNA, 13 bp, Homo sapiens
taaataaataatc

SEQ ID NO: 3009267 - DNA, 13 bp, Homo sapiens
taaataaattatg

SEQ ID NO: 3009268 - DNA, 10 bp, Homo sapiens
taaataacta

SEQ ID NO: 3009269 - DNA, 15 bp, Homo sapiens
taaataactatataa

SEQ ID NO: 3009270 - DNA, 22 bp, Homo sapiens
taaataagaaacaactctttga

SEQ ID NO: 3009271 - DNA, 13 bp, Homo sapiens
taaataatgtagt

SEQ ID NO: 3009272 - DNA, 20 bp, Homo sapiens
taaatacaaatctgtataaa

SEQ ID NO: 3009273 - DNA, 21 bp, Homo sapiens
taaatacacttcctgcttaaa

SEQ ID NO: 3009274 - DNA, 20 bp, Homo sapiens
taaatacagtcttccatttg

SEQ ID NO: 3009275 - DNA, 22 bp, Homo sapiens
taaatacagtcttccatttgca

SEQ ID NO: 3009276 - DNA, 23 bp, Homo sapiens
taaatacagtcttccatttgcaa

SEQ ID NO: 3009277 - DNA, 21 bp, Homo sapiens
taaatacataaatagtagaaa

SEQ ID NO: 3009278 - DNA, 17 bp, Homo sapiens
taaatacatcactgtat

SEQ ID NO: 3009279 - DNA, 20 bp, Homo sapiens
taaatacccattgaactctg

SEQ ID NO: 3009280 - DNA, 15 bp, Homo sapiens
taaatagatactttt

SEQ ID NO: 3009281 - DNA, 18 bp, Homo sapiens
taaatagatacttttgat

SEQ ID NO: 3009282 - DNA, 23 bp, Homo sapiens
taaatagatacttttgataatag

SEQ ID NO: 3009283 - DNA, 15 bp, Homo sapiens
taaataggatcctgg

SEQ ID NO: 3009284 - DNA, 12 bp, Homo sapiens
taaataggattt

SEQ ID NO: 3009285 - DNA, 16 bp, Homo sapiens
taaatagtagaaaaat

SEQ ID NO: 3009286 - DNA, 19 bp, Homo sapiens
taaatataaatctgatcac

SEQ ID NO: 3009287 - DNA, 18 bp, Homo sapiens
taaatatatgctaagtct

SEQ ID NO: 3009288 - DNA, 22 bp, Homo sapiens
taaatatgaatctgctcacttt

SEQ ID NO: 3009289 - DNA, 23 bp, Homo sapiens
taaatatgaatctgctcacttta

SEQ ID NO: 3009290 - DNA, 13 bp, Homo sapiens
taaatatgaatga

SEQ ID NO: 3009291 - DNA, 17 bp, Homo sapiens
taaatatggggatagtc

SEQ ID NO: 3009292 - DNA, 23 bp, Homo sapiens
taaatatggggatagtctgggtc

SEQ ID NO: 3009293 - DNA, 14 bp, Homo sapiens
taaatatttcttaa

SEQ ID NO: 3009294 - DNA, 12 bp, Homo sapiens
taaatatttgtt

SEQ ID NO: 3009295 - DNA, 15 bp, Homo sapiens
taaatattttcaaga

SEQ ID NO: 3009296 - DNA, 17 bp, Homo sapiens
taaatattttctatttt

SEQ ID NO: 3009297 - DNA, 13 bp, Homo sapiens
taaatcaataaag

SEQ ID NO: 3009298 - DNA, 16 bp, Homo sapiens
taaatcatgatgctag

SEQ ID NO: 3009299 - DNA, 19 bp, Homo sapiens
taaatccttgggagtcatt

SEQ ID NO: 3009300 - DNA, 16 bp, Homo sapiens
taaatctagagtttat

SEQ ID NO: 3009301 - DNA, 22 bp, Homo sapiens
taaatctgaagtggttcagtct

SEQ ID NO: 3009302 - DNA, 15 bp, Homo sapiens
taaatctgcagcaca

SEQ ID NO: 3009303 - DNA, 20 bp, Homo sapiens
taaatctgctggagtttcat

SEQ ID NO: 3009304 - DNA, 19 bp, Homo sapiens
taaatcttaaaaagttgtt

SEQ ID NO: 3009305 - DNA, 15 bp, Homo sapiens
taaatgaactgattt

SEQ ID NO: 3009306 - DNA, 23 bp, Homo sapiens
taaatgaagaaagggaggcccag

SEQ ID NO: 3009307 - DNA, 18 bp, Homo sapiens
taaatgaagatctttata

SEQ ID NO: 3009308 - DNA, 22 bp, Homo sapiens
taaatgacttagaaacaatgtt

SEQ ID NO: 3009309 - DNA, 16 bp, Homo sapiens
taaatgattttatgtt

SEQ ID NO: 3009310 - DNA, 18 bp, Homo sapiens
taaatgcaatattcttga

SEQ ID NO: 3009311 - DNA, 14 bp, Homo sapiens
taaatgctactgaa

SEQ ID NO: 3009312 - DNA, 18 bp, Homo sapiens
taaatgctattatactgt

SEQ ID NO: 3009313 - DNA, 17 bp, Homo sapiens
taaatgctttatgcaaa

SEQ ID NO: 3009314 - DNA, 16 bp, Homo sapiens
taaatgggaacattta

SEQ ID NO: 3009315 - DNA, 23 bp, Homo sapiens
taaatgggaacatttattttatg

SEQ ID NO: 3009316 - DNA, 22 bp, Homo sapiens
taaatgggtcatgacaagatgg

SEQ ID NO: 3009317 - DNA, 16 bp, Homo sapiens
taaatggtgatttctt

SEQ ID NO: 3009318 - DNA, 17 bp, Homo sapiens
taaatggtgatttcttg

SEQ ID NO: 3009319 - DNA, 19 bp, Homo sapiens
taaatggtgatttcttgct

SEQ ID NO: 3009320 - DNA, 14 bp, Homo sapiens
taaatgtaacagtc

SEQ ID NO: 3009321 - DNA, 18 bp, Homo sapiens
taaatgtaacagtctgat

SEQ ID NO: 3009322 - DNA, 16 bp, Homo sapiens
taaatgtacttatatt

SEQ ID NO: 3009323 - DNA, 12 bp, Homo sapiens
taaatgtgtaat

SEQ ID NO: 3009324 - DNA, 14 bp, Homo sapiens
taaatgtgtaataa

SEQ ID NO: 3009325 - DNA, 22 bp, Homo sapiens
taaatgtgtaataatgtaacat

SEQ ID NO: 3009326 - DNA, 20 bp, Homo sapiens
taaatgtgttggacaaatgt

SEQ ID NO: 3009327 - DNA, 15 bp, Homo sapiens
taaatgtgttttgtt

SEQ ID NO: 3009328 - DNA, 18 bp, Homo sapiens
taaatgttagtttcttgg

SEQ ID NO: 3009329 - DNA, 22 bp, Homo sapiens
taaatgttagtttcttggtaaa

SEQ ID NO: 3009330 - DNA, 19 bp, Homo sapiens
taaatgttattacttgtaa

SEQ ID NO: 3009331 - DNA, 19 bp, Homo sapiens
taaatgtttcccccactcc

SEQ ID NO: 3009332 - DNA, 14 bp, Homo sapiens
taaatgtttggaaa

SEQ ID NO: 3009333 - DNA, 14 bp, Homo sapiens
taaatgtttgttga

SEQ ID NO: 3009334 - DNA, 15 bp, Homo sapiens
taaatgtttgttgaa

SEQ ID NO: 3009335 - DNA, 13 bp, Homo sapiens
taaattaaaattt

SEQ ID NO: 3009336 - DNA, 22 bp, Homo sapiens
taaattaatattgtattgctgc

SEQ ID NO: 3009337 - DNA, 14 bp, Homo sapiens
taaattaatgattc

SEQ ID NO: 3009338 - DNA, 16 bp, Homo sapiens
taaattaatgattctg

SEQ ID NO: 3009339 - DNA, 21 bp, Homo sapiens
taaattaggaataaataaaaa

SEQ ID NO: 3009340 - DNA, 14 bp, Homo sapiens
taaattatgagatt

SEQ ID NO: 3009341 - DNA, 19 bp, Homo sapiens
taaattattagtttacatc

SEQ ID NO: 3009342 - DNA, 16 bp, Homo sapiens
taaattcacaaacttt

SEQ ID NO: 3009343 - DNA, 19 bp, Homo sapiens
taaattccccatatttgtg

SEQ ID NO: 3009344 - DNA, 15 bp, Homo sapiens
taactcccactccta

SEQ ID NO: 3009345 - DNA, 23 bp, Homo sapiens
taactccgagagcagtgggcagg

SEQ ID NO: 3009346 - DNA, 17 bp, Homo sapiens
taactcctaagaggagc

SEQ ID NO: 3009347 - DNA, 20 bp, Homo sapiens
taactctaaccaaggctgtg

SEQ ID NO: 3009348 - DNA, 19 bp, Homo sapiens
taactgaagatgttgagaa

SEQ ID NO: 3009349 - DNA, 14 bp, Homo sapiens
taactgaaggagaa

SEQ ID NO: 3009350 - DNA, 13 bp, Homo sapiens
taactgacaactt

SEQ ID NO: 3009351 - DNA, 15 bp, Homo sapiens
taactgctgattttg

SEQ ID NO: 3009352 - DNA, 12 bp, Homo sapiens
taactgcttttg

SEQ ID NO: 3009353 - DNA, 22 bp, Homo sapiens
taactggaagcatgtaggagaa

SEQ ID NO: 3009354 - DNA, 20 bp, Homo sapiens
taactggtgcactttgtaaa

SEQ ID NO: 3009355 - DNA, 14 bp, Homo sapiens
taactgtaaatcat

SEQ ID NO: 3009356 - DNA, 12 bp, Homo sapiens
taactgtccctg

SEQ ID NO: 3009357 - DNA, 12 bp, Homo sapiens
taactgtgcatg

SEQ ID NO: 3009358 - DNA, 18 bp, Homo sapiens
taactgtgccagttcttt

SEQ ID NO: 3009359 - DNA, 15 bp, Homo sapiens
taactgttgcacttt

SEQ ID NO: 3009360 - DNA, 18 bp, Homo sapiens
taacttaccattcctata

SEQ ID NO: 3009361 - DNA, 13 bp, Homo sapiens
taacttattgcct

SEQ ID NO: 3009362 - DNA, 14 bp, Homo sapiens
taacttatttataa

SEQ ID NO: 3009363 - DNA, 19 bp, Homo sapiens
taacttatttatatgaagc

SEQ ID NO: 3009364 - DNA, 13 bp, Homo sapiens
taacttcataaaa

SEQ ID NO: 3009365 - DNA, 19 bp, Homo sapiens
taacttcgtattttttgat

SEQ ID NO: 3009366 - DNA, 17 bp, Homo sapiens
taacttctcatgtatat

SEQ ID NO: 3009367 - DNA, 14 bp, Homo sapiens
taactttatgtgta

SEQ ID NO: 3009368 - DNA, 15 bp, Homo sapiens
taactttatgtgtaa

SEQ ID NO: 3009369 - DNA, 18 bp, Homo sapiens
taactttattcttgaaag

SEQ ID NO: 3009370 - DNA, 23 bp, Homo sapiens
taactttattcttgaaagaagaa

SEQ ID NO: 3009371 - DNA, 13 bp, Homo sapiens
taactttccagtc

SEQ ID NO: 3009372 - DNA, 20 bp, Homo sapiens
taacttttcaatgacatttt

SEQ ID NO: 3009373 - DNA, 18 bp, Homo sapiens
taagaaaatgctagaaga

SEQ ID NO: 3009374 - DNA, 23 bp, Homo sapiens
taagaaaatgctagaagaaaaca

SEQ ID NO: 3009375 - DNA, 20 bp, Homo sapiens
taagaaacaactctttgaga

SEQ ID NO: 3009376 - DNA, 16 bp, Homo sapiens
taagaaacaatttaaa

SEQ ID NO: 3009377 - DNA, 17 bp, Homo sapiens
taagaaacaatttaaat

SEQ ID NO: 3009378 - DNA, 21 bp, Homo sapiens
taagaaacacactgaggcagg

SEQ ID NO: 3009379 - DNA, 23 bp, Homo sapiens
taagaaacacactgaggcaggga

SEQ ID NO: 3009380 - DNA, 12 bp, Homo sapiens
taagaaagacat

SEQ ID NO: 3009381 - DNA, 14 bp, Homo sapiens
taagaaagacatct

SEQ ID NO: 3009382 - DNA, 21 bp, Homo sapiens
taagaaagacatctttctctt

SEQ ID NO: 3009383 - DNA, 20 bp, Homo sapiens
taagaaagcacttaaacaga

SEQ ID NO: 3009384 - DNA, 21 bp, Homo sapiens
taagaaataggaaagactttc

SEQ ID NO: 3009385 - DNA, 15 bp, Homo sapiens
taaggaacatgtact

SEQ ID NO: 3009386 - DNA, 16 bp, Homo sapiens
taaggaaccctggaaa

SEQ ID NO: 3009387 - DNA, 14 bp, Homo sapiens
taaggaactggaac

SEQ ID NO: 3009388 - DNA, 14 bp, Homo sapiens
taaggaagaaacag

SEQ ID NO: 3009389 - DNA, 17 bp, Homo sapiens
taaggaattgaagatag

SEQ ID NO: 3009390 - DNA, 23 bp, Homo sapiens
taaggacaaagtgccaaagaaag

SEQ ID NO: 3009391 - DNA, 18 bp, Homo sapiens
taaggacatttcccaggg

SEQ ID NO: 3009392 - DNA, 19 bp, Homo sapiens
taaggagaaatctatagaa

SEQ ID NO: 3009393 - DNA, 15 bp, Homo sapiens
taaggagcatgattt

SEQ ID NO: 3009394 - DNA, 20 bp, Homo sapiens
taaggagggagaaaggagaa

SEQ ID NO: 3009395 - DNA, 20 bp, Homo sapiens
taaggaggggaaaaaaatgt

SEQ ID NO: 3009396 - DNA, 22 bp, Homo sapiens
taaggaggggaaaaaaatgttg

SEQ ID NO: 3009397 - DNA, 22 bp, Homo sapiens
taaggattttggactgagattt

SEQ ID NO: 3009398 - DNA, 16 bp, Homo sapiens
taaggccactgtttta

SEQ ID NO: 3009399 - DNA, 22 bp, Homo sapiens
taaggccccctctcaggagcca

SEQ ID NO: 3009400 - DNA, 16 bp, Homo sapiens
taaggcctaggattct

SEQ ID NO: 3009401 - DNA, 19 bp, Homo sapiens
taaggctctgagagtctag

SEQ ID NO: 3009402 - DNA, 18 bp, Homo sapiens
taaggctctgtgccttgg

SEQ ID NO: 3009403 - DNA, 13 bp, Homo sapiens
taaggctgaggaa

SEQ ID NO: 3009404 - DNA, 21 bp, Homo sapiens
taaggctgcaaggtttaggct

SEQ ID NO: 3009405 - DNA, 18 bp, Homo sapiens
taagggagagctgagcca

SEQ ID NO: 3009406 - DNA, 21 bp, Homo sapiens
taagggagagctgagccagtt

SEQ ID NO: 3009407 - DNA, 21 bp, Homo sapiens
taagggaggaggagcttctgg

SEQ ID NO: 3009408 - DNA, 17 bp, Homo sapiens
taagggatttcttaggg

SEQ ID NO: 3009409 - DNA, 14 bp, Homo sapiens
taagggcagccctc

SEQ ID NO: 3009410 - DNA, 21 bp, Homo sapiens
taaggtatctggtatctgcat

SEQ ID NO: 3009411 - DNA, 18 bp, Homo sapiens
taaggtcatagattcttg

SEQ ID NO: 3009412 - DNA, 17 bp, Homo sapiens
taaggtccggtgttcta

SEQ ID NO: 3009413 - DNA, 18 bp, Homo sapiens
taaggtccggtgttctaa

SEQ ID NO: 3009414 - DNA, 21 bp, Homo sapiens
taaggtccggtgttctaagat

SEQ ID NO: 3009415 - DNA, 12 bp, Homo sapiens
taaggtctttgt

SEQ ID NO: 3009416 - DNA, 15 bp, Homo sapiens
taaggtctttgtaaa

SEQ ID NO: 3009417 - DNA, 17 bp, Homo sapiens
taaggtctttgtaaaat

SEQ ID NO: 3009418 - DNA, 21 bp, Homo sapiens
taaggtgactttctgaaactc

SEQ ID NO: 3009419 - DNA, 17 bp, Homo sapiens
taaggtgaggcctgtct

SEQ ID NO: 3009420 - DNA, 13 bp, Homo sapiens
taaggtgccttct

SEQ ID NO: 3009421 - DNA, 15 bp, Homo sapiens
taaggttctaaggcc

SEQ ID NO: 3009422 - DNA, 22 bp, Homo sapiens
taaggtttcgtttctgtataca

SEQ ID NO: 3009423 - DNA, 21 bp, Homo sapiens
taagtagatctgctttctgtt

SEQ ID NO: 3009424 - DNA, 22 bp, Homo sapiens
taagtagatctgctttctgttc

SEQ ID NO: 3009425 - DNA, 23 bp, Homo sapiens
taagtagatctgctttctgttca

SEQ ID NO: 3009426 - DNA, 14 bp, Homo sapiens
taagtataaacctt

SEQ ID NO: 3009427 - DNA, 17 bp, Homo sapiens
taagtcaacctgcctga

SEQ ID NO: 3009428 - DNA, 20 bp, Homo sapiens
taagtcctttatgtggaaaa

SEQ ID NO: 3009429 - DNA, 17 bp, Homo sapiens
taagtcgttgagggaat

SEQ ID NO: 3009430 - DNA, 21 bp, Homo sapiens
taagtgaccttctgatcttgg

SEQ ID NO: 3009431 - DNA, 20 bp, Homo sapiens
taagtgagtgtgctgctgta

SEQ ID NO: 3009432 - DNA, 22 bp, Homo sapiens
taagtgggcattttgacaacat

SEQ ID NO: 3009433 - DNA, 16 bp, Homo sapiens
taagtgtctgtgatgc

SEQ ID NO: 3009434 - DNA, 22 bp, Homo sapiens
taagttaaaggcagtccagagc

SEQ ID NO: 3009435 - DNA, 23 bp, Homo sapiens
tagacatggaggttctaaggcct

SEQ ID NO: 3009436 - DNA, 19 bp, Homo sapiens
tagacattatcttttggct

SEQ ID NO: 3009437 - DNA, 14 bp, Homo sapiens
tagacattgtaaat

SEQ ID NO: 3009438 - DNA, 18 bp, Homo sapiens
tagacatttcaaaattaa

SEQ ID NO: 3009439 - DNA, 21 bp, Homo sapiens
tagacatttcaaaattaatag

SEQ ID NO: 3009440 - DNA, 16 bp, Homo sapiens
tagacattttaacaag

SEQ ID NO: 3009441 - DNA, 19 bp, Homo sapiens
tagacattttaacaagaag

SEQ ID NO: 3009442 - DNA, 23 bp, Homo sapiens
tagaccatgtcttatcttgtttc

SEQ ID NO: 3009443 - DNA, 23 bp, Homo sapiens
tagaccatttatctgggattatg

SEQ ID NO: 3009444 - DNA, 17 bp, Homo sapiens
tagactcatcttactgt

SEQ ID NO: 3009445 - DNA, 15 bp, Homo sapiens
tagactgaagattta

SEQ ID NO: 3009446 - DNA, 22 bp, Homo sapiens
tagacttggagaatactgccaa

SEQ ID NO: 3009447 - DNA, 15 bp, Homo sapiens
tagactttaggcttt

SEQ ID NO: 3009448 - DNA, 18 bp, Homo sapiens
tagactttaggctttcag

SEQ ID NO: 3009449 - DNA, 20 bp, Homo sapiens
tagagaacacgcgtatttac

SEQ ID NO: 3009450 - DNA, 14 bp, Homo sapiens
tagagaactgaaaa

SEQ ID NO: 3009451 - DNA, 15 bp, Homo sapiens
tagagaactgaaaag

SEQ ID NO: 3009452 - DNA, 16 bp, Homo sapiens
tagagactggtttctc

SEQ ID NO: 3009453 - DNA, 19 bp, Homo sapiens
tagagaggcctgctttgtt

SEQ ID NO: 3009454 - DNA, 16 bp, Homo sapiens
tagagagggagaagaa

SEQ ID NO: 3009455 - DNA, 14 bp, Homo sapiens
tagagatatttaaa

SEQ ID NO: 3009456 - DNA, 20 bp, Homo sapiens
tagagatatttaaaagacaa

SEQ ID NO: 3009457 - DNA, 15 bp, Homo sapiens
tagagatgaggtttc

SEQ ID NO: 3009458 - DNA, 21 bp, Homo sapiens
tagagatgtgcaattgatttc

SEQ ID NO: 3009459 - DNA, 18 bp, Homo sapiens
tagagattacctcctgag

SEQ ID NO: 3009460 - DNA, 17 bp, Homo sapiens
tagagcactgccaccag

SEQ ID NO: 3009461 - DNA, 13 bp, Homo sapiens
tagagcagacagg

SEQ ID NO: 3009462 - DNA, 13 bp, Homo sapiens
tagagcattaaaa

SEQ ID NO: 3009463 - DNA, 18 bp, Homo sapiens
tagagcattaaaataact

SEQ ID NO: 3009464 - DNA, 19 bp, Homo sapiens
tagagcattaaaataacta

SEQ ID NO: 3009465 - DNA, 13 bp, Homo sapiens
tagagccagcctt

SEQ ID NO: 3009466 - DNA, 22 bp, Homo sapiens
tagagcctttgatcttcaggat

SEQ ID NO: 3009467 - DNA, 17 bp, Homo sapiens
tagagcgcggctggctc

SEQ ID NO: 3009468 - DNA, 19 bp, Homo sapiens
tagagcgcggctggctctg

SEQ ID NO: 3009469 - DNA, 12 bp, Homo sapiens
tagagctgccac

SEQ ID NO: 3009470 - DNA, 18 bp, Homo sapiens
tagagcttctgtattttc

SEQ ID NO: 3009471 - DNA, 23 bp, Homo sapiens
tagagcttgcagtgaagtgttct

SEQ ID NO: 3009472 - DNA, 16 bp, Homo sapiens
tagaggaagacgagac

SEQ ID NO: 3009473 - DNA, 22 bp, Homo sapiens
tagaggaatttaaagaggaaaa

SEQ ID NO: 3009474 - DNA, 16 bp, Homo sapiens
tagaggagctgcttgt

SEQ ID NO: 3009475 - DNA, 23 bp, Homo sapiens
tagagggacggccaagaatgtac

SEQ ID NO: 3009476 - DNA, 22 bp, Homo sapiens
tagaggtgagttttaaagaagt

SEQ ID NO: 3009477 - DNA, 15 bp, Homo sapiens
tagagtaagaaattt

SEQ ID NO: 3009478 - DNA, 13 bp, Homo sapiens
tagagtccaaggt

SEQ ID NO: 3009479 - DNA, 19 bp, Homo sapiens
tagagtggcgattgaatgc

SEQ ID NO: 3009480 - DNA, 20 bp, Homo sapiens
tagagtgtagtttacagaaa

SEQ ID NO: 3009481 - DNA, 15 bp, Homo sapiens
tagagtgtctttcca

SEQ ID NO: 3009482 - DNA, 15 bp, Homo sapiens
tagagtttacagctc

SEQ ID NO: 3009483 - DNA, 16 bp, Homo sapiens
tagagtttatacagtg

SEQ ID NO: 3009484 - DNA, 20 bp, Homo sapiens
tagagtttatacagtgtaca

SEQ ID NO: 3009485 - DNA, 22 bp, Homo sapiens
tagagtttatacagtgtacatg

SEQ ID NO: 3009486 - DNA, 23 bp, Homo sapiens
tagagtttatacagtgtacatgt

SEQ ID NO: 3009487 - DNA, 23 bp, Homo sapiens
tagagttttttttttctttcaca

SEQ ID NO: 3009488 - DNA, 13 bp, Homo sapiens
tagataaaggaaa

SEQ ID NO: 3009489 - DNA, 14 bp, Homo sapiens
tagataaaggaaac

SEQ ID NO: 3009490 - DNA, 17 bp, Homo sapiens
tagataatcttttacat

SEQ ID NO: 3009491 - DNA, 19 bp, Homo sapiens
tagatacactaaaaatctg

SEQ ID NO: 3009492 - DNA, 14 bp, Homo sapiens
tagatacttttgat

SEQ ID NO: 3009493 - DNA, 16 bp, Homo sapiens
tagatattggacaaag

SEQ ID NO: 3009494 - DNA, 21 bp, Homo sapiens
tagatattgtcctaagtgtca

SEQ ID NO: 3009495 - DNA, 14 bp, Homo sapiens
tagatatttcatgt

SEQ ID NO: 3009496 - DNA, 18 bp, Homo sapiens
tagatcagatgctccaag

SEQ ID NO: 3009497 - DNA, 19 bp, Homo sapiens
tagatcagatgctccaaga

SEQ ID NO: 3009498 - DNA, 15 bp, Homo sapiens
tagatcataaggctt

SEQ ID NO: 3009499 - DNA, 21 bp, Homo sapiens
tagatcataaggcttcaaaat

SEQ ID NO: 3009500 - DNA, 15 bp, Homo sapiens
tagatcccatattta

SEQ ID NO: 3009501 - DNA, 18 bp, Homo sapiens
tagatcccatatttactt

SEQ ID NO: 3009502 - DNA, 18 bp, Homo sapiens
tagatctgctttctgttc

SEQ ID NO: 3009503 - DNA, 19 bp, Homo sapiens
tagatctgctttctgttca

SEQ ID NO: 3009504 - DNA, 15 bp, Homo sapiens
tagatgactttgcag

SEQ ID NO: 3009505 - DNA, 21 bp, Homo sapiens
tagatgattaaataagattct

SEQ ID NO: 3009506 - DNA, 20 bp, Homo sapiens
tagatgattgaataacagta

SEQ ID NO: 3009507 - DNA, 15 bp, Homo sapiens
tagatgctggcccag

SEQ ID NO: 3009508 - DNA, 18 bp, Homo sapiens
tagatgctggcccagggc

SEQ ID NO: 3009509 - DNA, 21 bp, Homo sapiens
tagatgctggcccagggccca

SEQ ID NO: 3009510 - DNA, 16 bp, Homo sapiens
tagatggacagtttgt

SEQ ID NO: 3009511 - DNA, 15 bp, Homo sapiens
tagatgggaatgaag

SEQ ID NO: 3009512 - DNA, 17 bp, Homo sapiens
tagatgggaatgaagct

SEQ ID NO: 3009513 - DNA, 18 bp, Homo sapiens
tagatgggaatgaagctt

SEQ ID NO: 3009514 - DNA, 19 bp, Homo sapiens
tagatgggaatgaagcttg

SEQ ID NO: 3009515 - DNA, 19 bp, Homo sapiens
tagatggtttgagcctgag

SEQ ID NO: 3009516 - DNA, 23 bp, Homo sapiens
tagatgtagataaactcagaaat

SEQ ID NO: 3009517 - DNA, 21 bp, Homo sapiens
tagatgtctaggtacttcagg

SEQ ID NO: 3009518 - DNA, 23 bp, Homo sapiens
tagatgtgatttaatagtgttaa

SEQ ID NO: 3009519 - DNA, 18 bp, Homo sapiens
tagatgtttgactttaaa

SEQ ID NO: 3009520 - DNA, 20 bp, Homo sapiens
tagatgtttgactttaaaga

SEQ ID NO: 3009521 - DNA, 19 bp, Homo sapiens
tagatgttttaacttattt

SEQ ID NO: 3009522 - DNA, 12 bp, Homo sapiens
tagattaaaata

SEQ ID NO: 3009523 - DNA, 14 bp, Homo sapiens
tagattatatcaaa

SEQ ID NO: 3009524 - DNA, 18 bp, Homo sapiens
tagattattttatctggt

SEQ ID NO: 3009525 - DNA, 15 bp, Homo sapiens
tagattcaaaggttc

SEQ ID NO: 3009526 - DNA, 16 bp, Homo sapiens
tagattcaaaggttct

SEQ ID NO: 3009527 - DNA, 18 bp, Homo sapiens
tagattcaggggaagggc

SEQ ID NO: 3009528 - DNA, 19 bp, Homo sapiens
tagattcaggggaagggca

SEQ ID NO: 3009529 - DNA, 21 bp, Homo sapiens
tagattcaggggaagggcagg

SEQ ID NO: 3009530 - DNA, 23 bp, Homo sapiens
tagattcatcattttctccacct

SEQ ID NO: 3009531 - DNA, 15 bp, Homo sapiens
tagattcctttcctg

SEQ ID NO: 3009532 - DNA, 21 bp, Homo sapiens
tagattcgctgtcccctcagc

SEQ ID NO: 3009533 - DNA, 14 bp, Homo sapiens
tagattctaaagat

SEQ ID NO: 3009534 - DNA, 15 bp, Homo sapiens
tagattctaaagatt

SEQ ID NO: 3009535 - DNA, 18 bp, Homo sapiens
tagattctaaagattcta

SEQ ID NO: 3009536 - DNA, 21 bp, Homo sapiens
tagattgaaaacttttctcag

SEQ ID NO: 3009537 - DNA, 13 bp, Homo sapiens
tagatttctagaa

SEQ ID NO: 3009538 - DNA, 21 bp, Homo sapiens
tagatttgaagatctgattta

SEQ ID NO: 3009539 - DNA, 14 bp, Homo sapiens
tagatttgacctcc

SEQ ID NO: 3009540 - DNA, 22 bp, Homo sapiens
tagattttctggttctaacatt

SEQ ID NO: 3009541 - DNA, 15 bp, Homo sapiens
tagattttctttaaa

SEQ ID NO: 3009542 - DNA, 14 bp, Homo sapiens
taggatttttagaa

SEQ ID NO: 3009543 - DNA, 22 bp, Homo sapiens
taggattttttttaatgtttaa

SEQ ID NO: 3009544 - DNA, 20 bp, Homo sapiens
taggcacccctttccccagc

SEQ ID NO: 3009545 - DNA, 19 bp, Homo sapiens
taggcactgtagttctaag

SEQ ID NO: 3009546 - DNA, 20 bp, Homo sapiens
taggcactgtagttctaaga

SEQ ID NO: 3009547 - DNA, 22 bp, Homo sapiens
taggcagcctgctataaagtta

SEQ ID NO: 3009548 - DNA, 15 bp, Homo sapiens
taggcatctaaagaa

SEQ ID NO: 3009549 - DNA, 14 bp, Homo sapiens
taggcatgtaaaca

SEQ ID NO: 3009550 - DNA, 15 bp, Homo sapiens
taggccactcctcca

SEQ ID NO: 3009551 - DNA, 14 bp, Homo sapiens
taggcccacacaca

SEQ ID NO: 3009552 - DNA, 15 bp, Homo sapiens
taggcccacacacag

SEQ ID NO: 3009553 - DNA, 19 bp, Homo sapiens
taggcccggagctgcccct

SEQ ID NO: 3009554 - DNA, 18 bp, Homo sapiens
taggccctggttcctgct

SEQ ID NO: 3009555 - DNA, 15 bp, Homo sapiens
tagtttctgttctgt

SEQ ID NO: 3009556 - DNA, 20 bp, Homo sapiens
tagtttctgttctgtggaaa

SEQ ID NO: 3009557 - DNA, 17 bp, Homo sapiens
tagtttgactcagtata

SEQ ID NO: 3009558 - DNA, 15 bp, Homo sapiens
tagtttgctttgctt

SEQ ID NO: 3009559 - DNA, 16 bp, Homo sapiens
tagtttgctttgcttt

SEQ ID NO: 3009560 - DNA, 16 bp, Homo sapiens
tagtttgggtattttt

SEQ ID NO: 3009561 - DNA, 20 bp, Homo sapiens
tagttttagaggcattgtta

SEQ ID NO: 3009562 - DNA, 13 bp, Homo sapiens
tagttttattctt

SEQ ID NO: 3009563 - DNA, 13 bp, Homo sapiens
tagttttgtttat

SEQ ID NO: 3009564 - DNA, 14 bp, Homo sapiens
tagttttgtttatg

SEQ ID NO: 3009565 - DNA, 13 bp, Homo sapiens
tataaaaacaaaa

SEQ ID NO: 3009566 - DNA, 18 bp, Homo sapiens
tataaaaagcttccatga

SEQ ID NO: 3009567 - DNA, 21 bp, Homo sapiens
tataaaaatagataattaaaa

SEQ ID NO: 3009568 - DNA, 19 bp, Homo sapiens
tataaaaatatatgttgaa

SEQ ID NO: 3009569 - DNA, 13 bp, Homo sapiens
tataaaagtgatt

SEQ ID NO: 3009570 - DNA, 11 bp, Homo sapiens
tataaaataat

SEQ ID NO: 3009571 - DNA, 23 bp, Homo sapiens
tataaaatatgaagacataaacc

SEQ ID NO: 3009572 - DNA, 17 bp, Homo sapiens
tataaaatattgttaat

SEQ ID NO: 3009573 - DNA, 22 bp, Homo sapiens
tataaaatgcagtaacattcta

SEQ ID NO: 3009574 - DNA, 12 bp, Homo sapiens
tataaacagcag

SEQ ID NO: 3009575 - DNA, 19 bp, Homo sapiens
tataaaccttgtcaataaa

SEQ ID NO: 3009576 - DNA, 23 bp, Homo sapiens
tataaaccttgtcaataaaaata

SEQ ID NO: 3009577 - DNA, 20 bp, Homo sapiens
tataaactaaagttgtacct

SEQ ID NO: 3009578 - DNA, 23 bp, Homo sapiens
tataaactccaggcttgattcca

SEQ ID NO: 3009579 - DNA, 13 bp, Homo sapiens
tataaagtgcttg

SEQ ID NO: 3009580 - DNA, 18 bp, Homo sapiens
tataaagtgcttgtgtaa

SEQ ID NO: 3009581 - DNA, 20 bp, Homo sapiens
tataaagttttatttgaatg

SEQ ID NO: 3009582 - DNA, 15 bp, Homo sapiens
tataaatacaaatct

SEQ ID NO: 3009583 - DNA, 17 bp, Homo sapiens
tataaatacaaatctgt

SEQ ID NO: 3009584 - DNA, 18 bp, Homo sapiens
tataaatacaaatctgta

SEQ ID NO: 3009585 - DNA, 22 bp, Homo sapiens
tataaatacaaatctgtataaa

SEQ ID NO: 3009586 - DNA, 15 bp, Homo sapiens
tataaatgggaacat

SEQ ID NO: 3009587 - DNA, 17 bp, Homo sapiens
tataaatgttagttcta

SEQ ID NO: 3009588 - DNA, 14 bp, Homo sapiens
tataaatgtttgga

SEQ ID NO: 3009589 - DNA, 12 bp, Homo sapiens
tataaattactt

SEQ ID NO: 3009590 - DNA, 13 bp, Homo sapiens
tataacaggttat

SEQ ID NO: 3009591 - DNA, 20 bp, Homo sapiens
tataacaggttattttagtt

SEQ ID NO: 3009592 - DNA, 14 bp, Homo sapiens
tataacatgaaatg

SEQ ID NO: 3009593 - DNA, 20 bp, Homo sapiens
tataaccacaaagcacagtt

SEQ ID NO: 3009594 - DNA, 23 bp, Homo sapiens
tataacctgatgccataaataca

SEQ ID NO: 3009595 - DNA, 16 bp, Homo sapiens
tataactagctagaag

SEQ ID NO: 3009596 - DNA, 12 bp, Homo sapiens
tataagaaaaag

SEQ ID NO: 3009597 - DNA, 13 bp, Homo sapiens
tataagaaaaagg

SEQ ID NO: 3009598 - DNA, 15 bp, Homo sapiens
tataagaaagacatc

SEQ ID NO: 3009599 - DNA, 22 bp, Homo sapiens
tataagaaagacatctttctct

SEQ ID NO: 3009600 - DNA, 18 bp, Homo sapiens
tataagtaactttattct

SEQ ID NO: 3009601 - DNA, 22 bp, Homo sapiens
tataagtaactttattcttgaa

SEQ ID NO: 3009602 - DNA, 13 bp, Homo sapiens
tataagtttgaag

SEQ ID NO: 3009603 - DNA, 16 bp, Homo sapiens
tataagtttgaaggaa

SEQ ID NO: 3009604 - DNA, 21 bp, Homo sapiens
tataataaatacaagttcttt

SEQ ID NO: 3009605 - DNA, 16 bp, Homo sapiens
tataatactactactg

SEQ ID NO: 3009606 - DNA, 15 bp, Homo sapiens
tataatatatttgtg

SEQ ID NO: 3009607 - DNA, 18 bp, Homo sapiens
tataatatttcttaattt

SEQ ID NO: 3009608 - DNA, 15 bp, Homo sapiens
tataatcattagttt

SEQ ID NO: 3009609 - DNA, 21 bp, Homo sapiens
tataatcattagttttagagg

SEQ ID NO: 3009610 - DNA, 15 bp, Homo sapiens
tataatgacttttaa

SEQ ID NO: 3009611 - DNA, 16 bp, Homo sapiens
tataatgacttttaaa

SEQ ID NO: 3009612 - DNA, 20 bp, Homo sapiens
tataatgccagaatataatg

SEQ ID NO: 3009613 - DNA, 17 bp, Homo sapiens
tataattctatactgtt

SEQ ID NO: 3009614 - DNA, 19 bp, Homo sapiens
tataatttgatagatgttt

SEQ ID NO: 3009615 - DNA, 22 bp, Homo sapiens
tatacaaccctggcattatgtc

SEQ ID NO: 3009616 - DNA, 15 bp, Homo sapiens
tatacaataatggaa

SEQ ID NO: 3009617 - DNA, 11 bp, Homo sapiens
tatacacacac

SEQ ID NO: 3009618 - DNA, 14 bp, Homo sapiens
tatacacacacaca

SEQ ID NO: 3009619 - DNA, 19 bp, Homo sapiens
tatacagtaactttatgtg

SEQ ID NO: 3009620 - DNA, 20 bp, Homo sapiens
tatacagtaactttatgtgt

SEQ ID NO: 3009621 - DNA, 22 bp, Homo sapiens
tatacagtaactttatgtgtaa

SEQ ID NO: 3009622 - DNA, 14 bp, Homo sapiens
tatacagtgtacat

SEQ ID NO: 3009623 - DNA, 15 bp, Homo sapiens
tatacagtgtacatg

SEQ ID NO: 3009624 - DNA, 16 bp, Homo sapiens
tatacagtgtacatgt

SEQ ID NO: 3009625 - DNA, 19 bp, Homo sapiens
tatacatatatatatataa

SEQ ID NO: 3009626 - DNA, 16 bp, Homo sapiens
tatacatcaatatgta

SEQ ID NO: 3009627 - DNA, 12 bp, Homo sapiens
tatacatcactt

SEQ ID NO: 3009628 - DNA, 15 bp, Homo sapiens
tatacatcacttcct

SEQ ID NO: 3009629 - DNA, 18 bp, Homo sapiens
tataccatttcctcagct

SEQ ID NO: 3009630 - DNA, 18 bp, Homo sapiens
tataccgtgccactttcc

SEQ ID NO: 3009631 - DNA, 21 bp, Homo sapiens
tatacctgtggtttggtttta

SEQ ID NO: 3009632 - DNA, 20 bp, Homo sapiens
tatacgtttatataaatata

SEQ ID NO: 3009633 - DNA, 22 bp, Homo sapiens
tatactagggagccatttgaga

SEQ ID NO: 3009634 - DNA, 15 bp, Homo sapiens
tatactctcttccct

SEQ ID NO: 3009635 - DNA, 16 bp, Homo sapiens
tatactctttctgtat

SEQ ID NO: 3009636 - DNA, 15 bp, Homo sapiens
tatactgatttaatt

SEQ ID NO: 3009637 - DNA, 13 bp, Homo sapiens
tatactgtaaaga

SEQ ID NO: 3009638 - DNA, 15 bp, Homo sapiens
tatactgtaaagaaa

SEQ ID NO: 3009639 - DNA, 15 bp, Homo sapiens
tatactgtacaataa

SEQ ID NO: 3009640 - DNA, 22 bp, Homo sapiens
tatactgtacaataaaaacatt

SEQ ID NO: 3009641 - DNA, 19 bp, Homo sapiens
tatactgtgaagttacatg

SEQ ID NO: 3009642 - DNA, 22 bp, Homo sapiens
tatacttaaatggaaaaaatga

SEQ ID NO: 3009643 - DNA, 17 bp, Homo sapiens
tatacttaataaaacat

SEQ ID NO: 3009644 - DNA, 18 bp, Homo sapiens
tatacttttacattaaag

SEQ ID NO: 3009645 - DNA, 13 bp, Homo sapiens
tatagaagaaatg

SEQ ID NO: 3009646 - DNA, 15 bp, Homo sapiens
tatagaattagcttt

SEQ ID NO: 3009647 - DNA, 20 bp, Homo sapiens
tatagaattagctttttcat

SEQ ID NO: 3009648 - DNA, 14 bp, Homo sapiens
tatagacagctttg

SEQ ID NO: 3009649 - DNA, 16 bp, Homo sapiens
tatagacccgaggaaa

SEQ ID NO: 3009650 - DNA, 22 bp, Homo sapiens
tatagagaaaggtctatgcaga

SEQ ID NO: 3009651 - DNA, 16 bp, Homo sapiens
tatagatgggaatgaa

SEQ ID NO: 3009652 - DNA, 12 bp, Homo sapiens
tatagattctaa

SEQ ID NO: 3009653 - DNA, 14 bp, Homo sapiens
tatagattctaaag

SEQ ID NO: 3009654 - DNA, 21 bp, Homo sapiens
tatagcaaaacttttaaacta

SEQ ID NO: 3009655 - DNA, 23 bp, Homo sapiens
tatagcaaagatatatattcacc

SEQ ID NO: 3009656 - DNA, 16 bp, Homo sapiens
tatagcaatgtgattt

SEQ ID NO: 3009657 - DNA, 19 bp, Homo sapiens
tatagcctatggcagaaaa

SEQ ID NO: 3009658 - DNA, 20 bp, Homo sapiens
tatagcctatggcagaaaaa

SEQ ID NO: 3009659 - DNA, 21 bp, Homo sapiens
tatagcctatggcagaaaaaa

SEQ ID NO: 3009660 - DNA, 13 bp, Homo sapiens
tatagctagctat

SEQ ID NO: 3009661 - DNA, 21 bp, Homo sapiens
tatagctctacacaacatgta

SEQ ID NO: 3009662 - DNA, 20 bp, Homo sapiens
tatagctgtattgaatcatg

SEQ ID NO: 3009663 - DNA, 17 bp, Homo sapiens
tataggacaaaatgtta

SEQ ID NO: 3009664 - DNA, 21 bp, Homo sapiens
tataggtgttggttttggggg

SEQ ID NO: 3009665 - DNA, 16 bp, Homo sapiens
tataggttttgtttgc

SEQ ID NO: 3009666 - DNA, 18 bp, Homo sapiens
tatagtagcttataagag

SEQ ID NO: 3009667 - DNA, 18 bp, Homo sapiens
tatagtcctagctgacgc

SEQ ID NO: 3009668 - DNA, 14 bp, Homo sapiens
tatagtgtatagaa

SEQ ID NO: 3009669 - DNA, 12 bp, Homo sapiens
tatagttctaga

SEQ ID NO: 3009670 - DNA, 16 bp, Homo sapiens
tatagttgtctttctt

SEQ ID NO: 3009671 - DNA, 22 bp, Homo sapiens
tatagttgtctttctttgctgc

SEQ ID NO: 3009672 - DNA, 18 bp, Homo sapiens
tatagttgttttatatgt

SEQ ID NO: 3009673 - DNA, 14 bp, Homo sapiens
tatataaaatgtgg

SEQ ID NO: 3009674 - DNA, 23 bp, Homo sapiens
tatataaagtttttttatttctt

SEQ ID NO: 3009675 - DNA, 14 bp, Homo sapiens
tatataaatgggaa

SEQ ID NO: 3009676 - DNA, 13 bp, Homo sapiens
tatataagaaaga

SEQ ID NO: 3009677 - DNA, 15 bp, Homo sapiens
tatataagaaagaca

SEQ ID NO: 3009678 - DNA, 16 bp, Homo sapiens
tatataagaaagacat

SEQ ID NO: 3009679 - DNA, 12 bp, Homo sapiens
tatataatatct

SEQ ID NO: 3009680 - DNA, 17 bp, Homo sapiens
tatataatatctaaagt

SEQ ID NO: 3009681 - DNA, 19 bp, Homo sapiens
tatataatatctaaagtta

SEQ ID NO: 3009682 - DNA, 13 bp, Homo sapiens
tatatacacacac

SEQ ID NO: 3009683 - DNA, 14 bp, Homo sapiens
tatatacacacaca

SEQ ID NO: 3009684 - DNA, 23 bp, Homo sapiens
tatatacagtaactttatgtgta

SEQ ID NO: 3009685 - DNA, 18 bp, Homo sapiens
tatatacgcatctataaa

SEQ ID NO: 3009686 - DNA, 20 bp, Homo sapiens
tatatacgtatgtatataca

SEQ ID NO: 3009687 - DNA, 23 bp, Homo sapiens
tatctgcaatgtttttgtgtaga

SEQ ID NO: 3009688 - DNA, 21 bp, Homo sapiens
tatctgcatgtaaaatcttca

SEQ ID NO: 3009689 - DNA, 19 bp, Homo sapiens
tatctggaagtaaccattt

SEQ ID NO: 3009690 - DNA, 21 bp, Homo sapiens
tatctgggagatgacctgcct

SEQ ID NO: 3009691 - DNA, 19 bp, Homo sapiens
tatctgggtgcatgatctt

SEQ ID NO: 3009692 - DNA, 11 bp, Homo sapiens
tatctggtatc

SEQ ID NO: 3009693 - DNA, 15 bp, Homo sapiens
tatctggtatctgca

SEQ ID NO: 3009694 - DNA, 12 bp, Homo sapiens
tatctgtctact

SEQ ID NO: 3009695 - DNA, 18 bp, Homo sapiens
tatctgtctactttctct

SEQ ID NO: 3009696 - DNA, 14 bp, Homo sapiens
tatctgtgctcagg

SEQ ID NO: 3009697 - DNA, 22 bp, Homo sapiens
tatctgtggagttcctgctccg

SEQ ID NO: 3009698 - DNA, 23 bp, Homo sapiens
tatctgtggattcagcttctgtt

SEQ ID NO: 3009699 - DNA, 20 bp, Homo sapiens
tatctgtgtttttgaaatat

SEQ ID NO: 3009700 - DNA, 14 bp, Homo sapiens
tatcttaacactga

SEQ ID NO: 3009701 - DNA, 14 bp, Homo sapiens
tatcttctttggac

SEQ ID NO: 3009702 - DNA, 17 bp, Homo sapiens
tatcttgagtgttatgt

SEQ ID NO: 3009703 - DNA, 21 bp, Homo sapiens
tatcttgatgttcagacattt

SEQ ID NO: 3009704 - DNA, 15 bp, Homo sapiens
tatcttgctttggag

SEQ ID NO: 3009705 - DNA, 14 bp, Homo sapiens
tatcttgtgaagtt

SEQ ID NO: 3009706 - DNA, 15 bp, Homo sapiens
tatcttgtgaagttg

SEQ ID NO: 3009707 - DNA, 23 bp, Homo sapiens
tatcttgttattattgttaataa

SEQ ID NO: 3009708 - DNA, 14 bp, Homo sapiens
tatctttatagttg

SEQ ID NO: 3009709 - DNA, 15 bp, Homo sapiens
tatctttatagttgt

SEQ ID NO: 3009710 - DNA, 20 bp, Homo sapiens
tatcttttctttagagaact

SEQ ID NO: 3009711 - DNA, 20 bp, Homo sapiens
tatcttttggctctgaagaa

SEQ ID NO: 3009712 - DNA, 21 bp, Homo sapiens
tatcttttgtaagacatttcc

SEQ ID NO: 3009713 - DNA, 17 bp, Homo sapiens
tatgaaaaccagtggct

SEQ ID NO: 3009714 - DNA, 14 bp, Homo sapiens
tatgaaacttgaaa

SEQ ID NO: 3009715 - DNA, 17 bp, Homo sapiens
tatgaacacttaaatta

SEQ ID NO: 3009716 - DNA, 21 bp, Homo sapiens
tatgaacagggcccaggcctg

SEQ ID NO: 3009717 - DNA, 22 bp, Homo sapiens
tatgaacagggcccaggcctgg

SEQ ID NO: 3009718 - DNA, 20 bp, Homo sapiens
tatgaactttatagttgttt

SEQ ID NO: 3009719 - DNA, 18 bp, Homo sapiens
tatgaagaattgccaatc

SEQ ID NO: 3009720 - DNA, 22 bp, Homo sapiens
tatgaagaattgccaatcttgt

SEQ ID NO: 3009721 - DNA, 23 bp, Homo sapiens
tatgaagaattgccaatcttgtt

SEQ ID NO: 3009722 - DNA, 24 bp, Homo sapiens
tatgaagaattgccaatcttgttt

SEQ ID NO: 3009723 - DNA, 13 bp, Homo sapiens
tatgaagcaagct

SEQ ID NO: 3009724 - DNA, 22 bp, Homo sapiens
tatgaagcaagctgtgttactt

SEQ ID NO: 3009725 - DNA, 21 bp, Homo sapiens
tatgaagctacctcaaacttc

SEQ ID NO: 3009726 - DNA, 18 bp, Homo sapiens
tatgaaggtttgagagca

SEQ ID NO: 3009727 - DNA, 15 bp, Homo sapiens
tatgaagtactttta

SEQ ID NO: 3009728 - DNA, 20 bp, Homo sapiens
tatgaagttactttcttaat

SEQ ID NO: 3009729 - DNA, 15 bp, Homo sapiens
tatgaatacagcagc

SEQ ID NO: 3009730 - DNA, 20 bp, Homo sapiens
tatgaatacagcagcaagaa

SEQ ID NO: 3009731 - DNA, 15 bp, Homo sapiens
tatgaatgaaacatg

SEQ ID NO: 3009732 - DNA, 19 bp, Homo sapiens
tatgaatgcccccagctgg

SEQ ID NO: 3009733 - DNA, 17 bp, Homo sapiens
tatgaatggtctagaaa

SEQ ID NO: 3009734 - DNA, 20 bp, Homo sapiens
tatgaatggtctagaaacat

SEQ ID NO: 3009735 - DNA, 17 bp, Homo sapiens
tatgacaagctgtatca

SEQ ID NO: 3009736 - DNA, 20 bp, Homo sapiens
tatgacagctgtccctgtca

SEQ ID NO: 3009737 - DNA, 14 bp, Homo sapiens
tatgacattttggg

SEQ ID NO: 3009738 - DNA, 19 bp, Homo sapiens
tatgaccagagcaaaaatg

SEQ ID NO: 3009739 - DNA, 19 bp, Homo sapiens
tatgactttttataaaatg

SEQ ID NO: 3009740 - DNA, 12 bp, Homo sapiens
tatgagaaatgt

SEQ ID NO: 3009741 - DNA, 14 bp, Homo sapiens
tatgagaaatgtaa

SEQ ID NO: 3009742 - DNA, 21 bp, Homo sapiens
tatgagaactggttcttgcct

SEQ ID NO: 3009743 - DNA, 21 bp, Homo sapiens
tatgagaagtactttgtgctg

SEQ ID NO: 3009744 - DNA, 12 bp, Homo sapiens
tatgagactttc

SEQ ID NO: 3009745 - DNA, 14 bp, Homo sapiens
tatgagtctagatg

SEQ ID NO: 3009746 - DNA, 16 bp, Homo sapiens
tatgagtctagatgtt

SEQ ID NO: 3009747 - DNA, 17 bp, Homo sapiens
tatgataatagattctc

SEQ ID NO: 3009748 - DNA, 14 bp, Homo sapiens
tatgatactgatgc

SEQ ID NO: 3009749 - DNA, 13 bp, Homo sapiens
tatgatatttctt

SEQ ID NO: 3009750 - DNA, 14 bp, Homo sapiens
tatgatcagtgttg

SEQ ID NO: 3009751 - DNA, 18 bp, Homo sapiens
tatgatgagattcactta

SEQ ID NO: 3009752 - DNA, 19 bp, Homo sapiens
tatgatgagattcacttag

SEQ ID NO: 3009753 - DNA, 19 bp, Homo sapiens
tatgatgggctccccagga

SEQ ID NO: 3009754 - DNA, 23 bp, Homo sapiens
tatgattcccttttctttaagtt

SEQ ID NO: 3009755 - DNA, 15 bp, Homo sapiens
tatgattgtttgcac

SEQ ID NO: 3009756 - DNA, 19 bp, Homo sapiens
tatgatttataaacagaca

SEQ ID NO: 3009757 - DNA, 16 bp, Homo sapiens
tatgatttgttttgaa

SEQ ID NO: 3009758 - DNA, 14 bp, Homo sapiens
tatgcaaaactttt

SEQ ID NO: 3009759 - DNA, 16 bp, Homo sapiens
tatgcaaaatgtctgt

SEQ ID NO: 3009760 - DNA, 15 bp, Homo sapiens
tatgcaagtgggaga

SEQ ID NO: 3009761 - DNA, 12 bp, Homo sapiens
tatgcaattcag

SEQ ID NO: 3009762 - DNA, 13 bp, Homo sapiens
tatgcacatatgg

SEQ ID NO: 3009763 - DNA, 14 bp, Homo sapiens
tatgcaccttgtgt

SEQ ID NO: 3009764 - DNA, 22 bp, Homo sapiens
tatgcaccttgtgtctgtacac

SEQ ID NO: 3009765 - DNA, 23 bp, Homo sapiens
tatgcacgttaacagcgtgtcaa

SEQ ID NO: 3009766 - DNA, 19 bp, Homo sapiens
tatgcatgctaaattatta

SEQ ID NO: 3009767 - DNA, 21 bp, Homo sapiens
tatgcatggtgccccaggacc

SEQ ID NO: 3009768 - DNA, 22 bp, Homo sapiens
tatgcatggtgccccaggacca

SEQ ID NO: 3009769 - DNA, 21 bp, Homo sapiens
tatgcatttaaatacagtctt

SEQ ID NO: 3009770 - DNA, 22 bp, Homo sapiens
tatgcatttaaatacagtcttc

SEQ ID NO: 3009771 - DNA, 12 bp, Homo sapiens
tatgcatttttt

SEQ ID NO: 3009772 - DNA, 18 bp, Homo sapiens
tatgcccacatttagtct

SEQ ID NO: 3009773 - DNA, 23 bp, Homo sapiens
tatgccctcaagtaaaagaaaag

SEQ ID NO: 3009774 - DNA, 18 bp, Homo sapiens
tatgcctctcctttgtat

SEQ ID NO: 3009775 - DNA, 14 bp, Homo sapiens
tatgcctgctattt

SEQ ID NO: 3009776 - DNA, 20 bp, Homo sapiens
tatgcctgtactaaggagca

SEQ ID NO: 3009777 - DNA, 10 bp, Homo sapiens
tatgcctgtg

SEQ ID NO: 3009778 - DNA, 17 bp, Homo sapiens
tatgctatcctcttatt

SEQ ID NO: 3009779 - DNA, 15 bp, Homo sapiens
tatgctgacagctct

SEQ ID NO: 3009780 - DNA, 20 bp, Homo sapiens
tatgctgatcatcgccagag

SEQ ID NO: 3009781 - DNA, 22 bp, Homo sapiens
tatgctggggtacacagtgaga

SEQ ID NO: 3009782 - DNA, 17 bp, Homo sapiens
tatgcttagtaatgcta

SEQ ID NO: 3009783 - DNA, 13 bp, Homo sapiens
tatgcttcataca

SEQ ID NO: 3009784 - DNA, 16 bp, Homo sapiens
tatgcttcatacaggg

SEQ ID NO: 3009785 - DNA, 11 bp, Homo sapiens
tatggaaatag

SEQ ID NO: 3009786 - DNA, 17 bp, Homo sapiens
tatggaagtaaaggcat

SEQ ID NO: 3009787 - DNA, 11 bp, Homo sapiens
tatggaattga

SEQ ID NO: 3009788 - DNA, 19 bp, Homo sapiens
tatggaattgatttgcatt

SEQ ID NO: 3009789 - DNA, 20 bp, Homo sapiens
tatggaatttataattcagt

SEQ ID NO: 3009790 - DNA, 22 bp, Homo sapiens
tatggaatttataattcagtat

SEQ ID NO: 3009791 - DNA, 16 bp, Homo sapiens
tatggacaacttattt

SEQ ID NO: 3009792 - DNA, 22 bp, Homo sapiens
tatggacaacttatttaaaaat

SEQ ID NO: 3009793 - DNA, 16 bp, Homo sapiens
tatggactctgcacat

SEQ ID NO: 3009794 - DNA, 18 bp, Homo sapiens
tatggcactatttttatt

SEQ ID NO: 3009795 - DNA, 23 bp, Homo sapiens
tatggcagaagggaattgctcag

SEQ ID NO: 3009796 - DNA, 14 bp, Homo sapiens
tatggcagcgaaag

SEQ ID NO: 3009797 - DNA, 23 bp, Homo sapiens
tatggcctaaatttattaaataa

SEQ ID NO: 3009798 - DNA, 15 bp, Homo sapiens
tatgggcaaaaaact

SEQ ID NO: 3009799 - DNA, 13 bp, Homo sapiens
tatgggcgggcag

SEQ ID NO: 3009800 - DNA, 19 bp, Homo sapiens
tatgggggagattgaactt

SEQ ID NO: 3009801 - DNA, 22 bp, Homo sapiens
tatggtaatagctttagtgaat

SEQ ID NO: 3009802 - DNA, 16 bp, Homo sapiens
tatggtaccagatgca

SEQ ID NO: 3009803 - DNA, 12 bp, Homo sapiens
tatggtgagatg

SEQ ID NO: 3009804 - DNA, 20 bp, Homo sapiens
tatggttgatagtttacctg

SEQ ID NO: 3009805 - DNA, 21 bp, Homo sapiens
tatggttgatagtttacctga

SEQ ID NO: 3009806 - DNA, 23 bp, Homo sapiens
tatgtaaaaggccaaacctctgt

SEQ ID NO: 3009807 - DNA, 15 bp, Homo sapiens
tatgtaaaatgtttt

SEQ ID NO: 3009808 - DNA, 13 bp, Homo sapiens
tattgaaatatta

SEQ ID NO: 3009809 - DNA, 14 bp, Homo sapiens
tattgaactttttt

SEQ ID NO: 3009810 - DNA, 20 bp, Homo sapiens
tattgaatacttacattctc

SEQ ID NO: 3009811 - DNA, 18 bp, Homo sapiens
tattgaatcatgtagtat

SEQ ID NO: 3009812 - DNA, 22 bp, Homo sapiens
tattgaatcatgtagtatcaaa

SEQ ID NO: 3009813 - DNA, 11 bp, Homo sapiens
tattgaatcta

SEQ ID NO: 3009814 - DNA, 17 bp, Homo sapiens
tattgaatctatttaag

SEQ ID NO: 3009815 - DNA, 13 bp, Homo sapiens
tattgacacagaa

SEQ ID NO: 3009816 - DNA, 16 bp, Homo sapiens
tattgacgaactggct

SEQ ID NO: 3009817 - DNA, 17 bp, Homo sapiens
tattgacgaactggcta

SEQ ID NO: 3009818 - DNA, 17 bp, Homo sapiens
tattgagattgtcctca

SEQ ID NO: 3009819 - DNA, 16 bp, Homo sapiens
tattgatttaaaagtg

SEQ ID NO: 3009820 - DNA, 17 bp, Homo sapiens
tattgatttaaaagtgt

SEQ ID NO: 3009821 - DNA, 22 bp, Homo sapiens
tattgcaaaggttccaactgta

SEQ ID NO: 3009822 - DNA, 12 bp, Homo sapiens
tattgcaatgca

SEQ ID NO: 3009823 - DNA, 21 bp, Homo sapiens
tattgcattgtacctaaagga

SEQ ID NO: 3009824 - DNA, 22 bp, Homo sapiens
tattgcatttggattggggtcc

SEQ ID NO: 3009825 - DNA, 22 bp, Homo sapiens
tattgccaggaatgtttcagct

SEQ ID NO: 3009826 - DNA, 15 bp, Homo sapiens
tattgcccaggctgg

SEQ ID NO: 3009827 - DNA, 19 bp, Homo sapiens
tattgcctgggcagtgccc

SEQ ID NO: 3009828 - DNA, 11 bp, Homo sapiens
tattgccttct

SEQ ID NO: 3009829 - DNA, 16 bp, Homo sapiens
tattgccttctcacca

SEQ ID NO: 3009830 - DNA, 17 bp, Homo sapiens
tattgccttttaatttt

SEQ ID NO: 3009831 - DNA, 21 bp, Homo sapiens
tattgccttttaatttttaat

SEQ ID NO: 3009832 - DNA, 14 bp, Homo sapiens
tattggaaatgtga

SEQ ID NO: 3009833 - DNA, 14 bp, Homo sapiens
tattggatttgtcc

SEQ ID NO: 3009834 - DNA, 13 bp, Homo sapiens
tattggtccagct

SEQ ID NO: 3009835 - DNA, 15 bp, Homo sapiens
tattggtgcgttttt

SEQ ID NO: 3009836 - DNA, 13 bp, Homo sapiens
tattggtggaatc

SEQ ID NO: 3009837 - DNA, 15 bp, Homo sapiens
tattgtaaatattgt

SEQ ID NO: 3009838 - DNA, 13 bp, Homo sapiens
tattgtaaattat

SEQ ID NO: 3009839 - DNA, 23 bp, Homo sapiens
tattgtaaatttggatttacgac

SEQ ID NO: 3009840 - DNA, 15 bp, Homo sapiens
tattgtaaggtcttt

SEQ ID NO: 3009841 - DNA, 12 bp, Homo sapiens
tattgtacactt

SEQ ID NO: 3009842 - DNA, 13 bp, Homo sapiens
tattgtacacttt

SEQ ID NO: 3009843 - DNA, 15 bp, Homo sapiens
tattgtacacttttt

SEQ ID NO: 3009844 - DNA, 14 bp, Homo sapiens
tattgtataaaaag

SEQ ID NO: 3009845 - DNA, 13 bp, Homo sapiens
tattgtattttga

SEQ ID NO: 3009846 - DNA, 17 bp, Homo sapiens
tattgtattttgatgag

SEQ ID NO: 3009847 - DNA, 13 bp, Homo sapiens
tattgtcatgttt

SEQ ID NO: 3009848 - DNA, 17 bp, Homo sapiens
tattgtccattgtccaa

SEQ ID NO: 3009849 - DNA, 11 bp, Homo sapiens
tattgtcccac

SEQ ID NO: 3009850 - DNA, 15 bp, Homo sapiens
tattgtctgtaaaaa

SEQ ID NO: 3009851 - DNA, 16 bp, Homo sapiens
tattgtctgtaaaaaa

SEQ ID NO: 3009852 - DNA, 14 bp, Homo sapiens
tattgtgaacattt

SEQ ID NO: 3009853 - DNA, 15 bp, Homo sapiens
tattgtgactcttct

SEQ ID NO: 3009854 - DNA, 23 bp, Homo sapiens
tattgtgtgaaggtaactaagaa

SEQ ID NO: 3009855 - DNA, 20 bp, Homo sapiens
tattgtgtgcgctgcctggc

SEQ ID NO: 3009856 - DNA, 13 bp, Homo sapiens
tattgtgtgttct

SEQ ID NO: 3009857 - DNA, 16 bp, Homo sapiens
tattgttatgttctcc

SEQ ID NO: 3009858 - DNA, 13 bp, Homo sapiens
tattgtttatgta

SEQ ID NO: 3009859 - DNA, 12 bp, Homo sapiens
tattgtttcaat

SEQ ID NO: 3009860 - DNA, 17 bp, Homo sapiens
tatttaaaaaaaaacat

SEQ ID NO: 3009861 - DNA, 18 bp, Homo sapiens
tatttaaaaaaaaacata

SEQ ID NO: 3009862 - DNA, 16 bp, Homo sapiens
tatttaaaaatagaaa

SEQ ID NO: 3009863 - DNA, 13 bp, Homo sapiens
tatttaaaaatgt

SEQ ID NO: 3009864 - DNA, 16 bp, Homo sapiens
tatttaaaaatgtctt

SEQ ID NO: 3009865 - DNA, 18 bp, Homo sapiens
tatttaaaacaacttgtt

SEQ ID NO: 3009866 - DNA, 13 bp, Homo sapiens
tatttaaaacttg

SEQ ID NO: 3009867 - DNA, 13 bp, Homo sapiens
tatttaaaagaca

SEQ ID NO: 3009868 - DNA, 14 bp, Homo sapiens
tatttaaaagacaa

SEQ ID NO: 3009869 - DNA, 17 bp, Homo sapiens
tatttaaaagacaaaca

SEQ ID NO: 3009870 - DNA, 18 bp, Homo sapiens
tatttaaaagacaaacac

SEQ ID NO: 3009871 - DNA, 15 bp, Homo sapiens
tatttaaaagattca

SEQ ID NO: 3009872 - DNA, 16 bp, Homo sapiens
tatttaaaagattcat

SEQ ID NO: 3009873 - DNA, 21 bp, Homo sapiens
tatttaaaatgctcaatttca

SEQ ID NO: 3009874 - DNA, 23 bp, Homo sapiens
tatttaaaatgctcaatttcagc

SEQ ID NO: 3009875 - DNA, 15 bp, Homo sapiens
tatttaaaccttttt

SEQ ID NO: 3009876 - DNA, 13 bp, Homo sapiens
tatttaaagaaag

SEQ ID NO: 3009877 - DNA, 13 bp, Homo sapiens
tatttaaccaaag

SEQ ID NO: 3009878 - DNA, 12 bp, Homo sapiens
tatttaactctt

SEQ ID NO: 3009879 - DNA, 21 bp, Homo sapiens
tatttaactcttaactgaaga

SEQ ID NO: 3009880 - DNA, 23 bp, Homo sapiens
tatttaactcttaactgaagaaa

SEQ ID NO: 3009881 - DNA, 23 bp, Homo sapiens
tatttaactggtgcactttgtaa

SEQ ID NO: 3009882 - DNA, 21 bp, Homo sapiens
tatttaaggaatcaaatctta

SEQ ID NO: 3009883 - DNA, 18 bp, Homo sapiens
tatttaatgatgattatg

SEQ ID NO: 3009884 - DNA, 16 bp, Homo sapiens
tatttaatgatttttg

SEQ ID NO: 3009885 - DNA, 17 bp, Homo sapiens
tatttaatgatttttgt

SEQ ID NO: 3009886 - DNA, 18 bp, Homo sapiens
tatttaatgatttttgtg

SEQ ID NO: 3009887 - DNA, 21 bp, Homo sapiens
tatttaatgccgatatactct

SEQ ID NO: 3009888 - DNA, 12 bp, Homo sapiens
tatttaatgttt

SEQ ID NO: 3009889 - DNA, 13 bp, Homo sapiens
tatttaatgtttt

SEQ ID NO: 3009890 - DNA, 16 bp, Homo sapiens
tatttaatgttttaaa

SEQ ID NO: 3009891 - DNA, 20 bp, Homo sapiens
tatttaatgttttaaatgta

SEQ ID NO: 3009892 - DNA, 16 bp, Homo sapiens
tatttacttactgcta

SEQ ID NO: 3009893 - DNA, 17 bp, Homo sapiens
tatttagggaactgctt

SEQ ID NO: 3009894 - DNA, 18 bp, Homo sapiens
tatttagggaactgcttg

SEQ ID NO: 3009895 - DNA, 17 bp, Homo sapiens
tatttatactataaaat

SEQ ID NO: 3009896 - DNA, 19 bp, Homo sapiens
tatttatatgaagcaagct

SEQ ID NO: 3009897 - DNA, 21 bp, Homo sapiens
tatttatatgaagcaagctgt

SEQ ID NO: 3009898 - DNA, 15 bp, Homo sapiens
tatttatatgtacat

SEQ ID NO: 3009899 - DNA, 16 bp, Homo sapiens
tatttatatgtactgt

SEQ ID NO: 3009900 - DNA, 17 bp, Homo sapiens
tatttatatgtactgtt

SEQ ID NO: 3009901 - DNA, 18 bp, Homo sapiens
tatttatattcatcaaat

SEQ ID NO: 3009902 - DNA, 19 bp, Homo sapiens
tatttatattcatcaaata

SEQ ID NO: 3009903 - DNA, 20 bp, Homo sapiens
tatttatccaaaatgtgtat

SEQ ID NO: 3009904 - DNA, 22 bp, Homo sapiens
tatttatctgtgtttttgaaat

SEQ ID NO: 3009905 - DNA, 16 bp, Homo sapiens
tatttatgaccagagc

SEQ ID NO: 3009906 - DNA, 13 bp, Homo sapiens
tatttatttaaaa

SEQ ID NO: 3009907 - DNA, 11 bp, Homo sapiens
tatttatttac

SEQ ID NO: 3009908 - DNA, 20 bp, Homo sapiens
tatttcaaaatatacattca

SEQ ID NO: 3009909 - DNA, 23 bp, Homo sapiens
tatttcaagggttgcttctgagt

SEQ ID NO: 3009910 - DNA, 15 bp, Homo sapiens
tatttcaatgttagc

SEQ ID NO: 3009911 - DNA, 13 bp, Homo sapiens
tatttcacagagc

SEQ ID NO: 3009912 - DNA, 20 bp, Homo sapiens
tatttcagatatcaaaattc

SEQ ID NO: 3009913 - DNA, 22 bp, Homo sapiens
tatttcagatatcaaaattcta

SEQ ID NO: 3009914 - DNA, 20 bp, Homo sapiens
tatttcagatgtaatgtttt

SEQ ID NO: 3009915 - DNA, 22 bp, Homo sapiens
tcaaacaaccttcagctttatt

SEQ ID NO: 3009916 - DNA, 14 bp, Homo sapiens
tcaaacacaaatgc

SEQ ID NO: 3009917 - DNA, 16 bp, Homo sapiens
tcaaacacaaatgcag

SEQ ID NO: 3009918 - DNA, 17 bp, Homo sapiens
tcaaacacaaatgcagg

SEQ ID NO: 3009919 - DNA, 13 bp, Homo sapiens
tcaaacacaagtg

SEQ ID NO: 3009920 - DNA, 17 bp, Homo sapiens
tcaaacatgaaaacatt

SEQ ID NO: 3009921 - DNA, 22 bp, Homo sapiens
tcaaacatgaagtgtgtttcct

SEQ ID NO: 3009922 - DNA, 17 bp, Homo sapiens
tcaaacatgagatgtgt

SEQ ID NO: 3009923 - DNA, 19 bp, Homo sapiens
tcaaaccttgaggagaagt

SEQ ID NO: 3009924 - DNA, 21 bp, Homo sapiens
tcaaactacctatattccttg

SEQ ID NO: 3009925 - DNA, 20 bp, Homo sapiens
tcaaactcctgacctcaggt

SEQ ID NO: 3009926 - DNA, 23 bp, Homo sapiens
tcaaactgaatgaaacccccaca

SEQ ID NO: 3009927 - DNA, 19 bp, Homo sapiens
tcaaactggggcctccaga

SEQ ID NO: 3009928 - DNA, 22 bp, Homo sapiens
tcaaactggggcctccagaact

SEQ ID NO: 3009929 - DNA, 14 bp, Homo sapiens
tcaaacttccagtc

SEQ ID NO: 3009930 - DNA, 17 bp, Homo sapiens
tcaaacttctgtgtact

SEQ ID NO: 3009931 - DNA, 14 bp, Homo sapiens
tcaaagaaggcatt

SEQ ID NO: 3009932 - DNA, 19 bp, Homo sapiens
tcaaagatgctgtgagtct

SEQ ID NO: 3009933 - DNA, 20 bp, Homo sapiens
tcaaagatgtaatgtagttc

SEQ ID NO: 3009934 - DNA, 16 bp, Homo sapiens
tcaaagcaaggaaact

SEQ ID NO: 3009935 - DNA, 22 bp, Homo sapiens
tcaaagccagcgtcctcctctg

SEQ ID NO: 3009936 - DNA, 22 bp, Homo sapiens
tcaaagccatatggacactgtg

SEQ ID NO: 3009937 - DNA, 23 bp, Homo sapiens
tcaaagccatatggacactgtga

SEQ ID NO: 3009938 - DNA, 12 bp, Homo sapiens
tcaaagccctgc

SEQ ID NO: 3009939 - DNA, 16 bp, Homo sapiens
tcaaagccctgcctct

SEQ ID NO: 3009940 - DNA, 19 bp, Homo sapiens
tcaaagccctgcctctgtg

SEQ ID NO: 3009941 - DNA, 17 bp, Homo sapiens
tcaaagccggcctgaga

SEQ ID NO: 3009942 - DNA, 19 bp, Homo sapiens
tcaaagccggcctgagaaa

SEQ ID NO: 3009943 - DNA, 15 bp, Homo sapiens
tcaaagcttcaaaaa

SEQ ID NO: 3009944 - DNA, 23 bp, Homo sapiens
tcaaagggacttttgtaaaatca

SEQ ID NO: 3009945 - DNA, 17 bp, Homo sapiens
tcaaaggtgatgtaatt

SEQ ID NO: 3009946 - DNA, 16 bp, Homo sapiens
tcaaaggttctaggtt

SEQ ID NO: 3009947 - DNA, 15 bp, Homo sapiens
tcaaagtatgtatgt

SEQ ID NO: 3009948 - DNA, 13 bp, Homo sapiens
tcaaagtatttgt

SEQ ID NO: 3009949 - DNA, 11 bp, Homo sapiens
tcaaagtggaa

SEQ ID NO: 3009950 - DNA, 17 bp, Homo sapiens
tcaaagttctgctttct

SEQ ID NO: 3009951 - DNA, 15 bp, Homo sapiens
tcaaataaatgtttc

SEQ ID NO: 3009952 - DNA, 16 bp, Homo sapiens
tcaaataaatgtttcc

SEQ ID NO: 3009953 - DNA, 18 bp, Homo sapiens
tcaaataaatgtttcccc

SEQ ID NO: 3009954 - DNA, 22 bp, Homo sapiens
tcaaataaatgtttcccccact

SEQ ID NO: 3009955 - DNA, 20 bp, Homo sapiens
tcaaggcactctagattcca

SEQ ID NO: 3009956 - DNA, 21 bp, Homo sapiens
tcaaggcactctagattccat

SEQ ID NO: 3009957 - DNA, 16 bp, Homo sapiens
tcaaggcggtgcttga

SEQ ID NO: 3009958 - DNA, 18 bp, Homo sapiens
tcaaggctaattggaaaa

SEQ ID NO: 3009959 - DNA, 22 bp, Homo sapiens
tcaaggctaattggaaaagagt

SEQ ID NO: 3009960 - DNA, 15 bp, Homo sapiens
tcaagggacaaggac

SEQ ID NO: 3009961 - DNA, 13 bp, Homo sapiens
tcaaggggtcact

SEQ ID NO: 3009962 - DNA, 14 bp, Homo sapiens
tcaaggggtcactt

SEQ ID NO: 3009963 - DNA, 21 bp, Homo sapiens
tcaagggtggcaggtcactgt

SEQ ID NO: 3009964 - DNA, 16 bp, Homo sapiens
tcaagggttgcttctg

SEQ ID NO: 3009965 - DNA, 23 bp, Homo sapiens
tcaaggttttaggttctaaagtt

SEQ ID NO: 3009966 - DNA, 12 bp, Homo sapiens
tcaagtaaaaga

SEQ ID NO: 3009967 - DNA, 16 bp, Homo sapiens
tcaagtactacatttt

SEQ ID NO: 3009968 - DNA, 21 bp, Homo sapiens
tcaagtataaagtcaggacct

SEQ ID NO: 3009969 - DNA, 21 bp, Homo sapiens
tcaagtcctgactgggctggg

SEQ ID NO: 3009970 - DNA, 19 bp, Homo sapiens
tcaagtctgtttactgcaa

SEQ ID NO: 3009971 - DNA, 18 bp, Homo sapiens
tcaagtgagtggcatgtg

SEQ ID NO: 3009972 - DNA, 20 bp, Homo sapiens
tcaagtgatctgcccacctc

SEQ ID NO: 3009973 - DNA, 13 bp, Homo sapiens
tcaagttctaaga

SEQ ID NO: 3009974 - DNA, 16 bp, Homo sapiens
tcaagttctaagattc

SEQ ID NO: 3009975 - DNA, 19 bp, Homo sapiens
tcaagttctaagattctaa

SEQ ID NO: 3009976 - DNA, 19 bp, Homo sapiens
tcaagttgtttaactgtgc

SEQ ID NO: 3009977 - DNA, 13 bp, Homo sapiens
tcaagtttttaca

SEQ ID NO: 3009978 - DNA, 20 bp, Homo sapiens
tcaataaacttagaggaaaa

SEQ ID NO: 3009979 - DNA, 20 bp, Homo sapiens
tcaataaagcactattgttt

SEQ ID NO: 3009980 - DNA, 13 bp, Homo sapiens
tcaataagaaggt

SEQ ID NO: 3009981 - DNA, 22 bp, Homo sapiens
tcaataagaaggtagaatgagt

SEQ ID NO: 3009982 - DNA, 18 bp, Homo sapiens
tcaataatatattttctg

SEQ ID NO: 3009983 - DNA, 20 bp, Homo sapiens
tcaataatatattttctgtt

SEQ ID NO: 3009984 - DNA, 15 bp, Homo sapiens
tcaatacaaatgtta

SEQ ID NO: 3009985 - DNA, 13 bp, Homo sapiens
tcaatacagcctg

SEQ ID NO: 3009986 - DNA, 23 bp, Homo sapiens
tcaatacagcctgaataaaccaa

SEQ ID NO: 3009987 - DNA, 17 bp, Homo sapiens
tcaatacagtacaggca

SEQ ID NO: 3009988 - DNA, 19 bp, Homo sapiens
tcaatacagtacaggcagc

SEQ ID NO: 3009989 - DNA, 22 bp, Homo sapiens
tcaatacagtttataaagccaa

SEQ ID NO: 3009990 - DNA, 15 bp, Homo sapiens
tcaatactctctgag

SEQ ID NO: 3009991 - DNA, 22 bp, Homo sapiens
tcaatactgtcccacttctcat

SEQ ID NO: 3009992 - DNA, 20 bp, Homo sapiens
tcaatagctccaagctgtta

SEQ ID NO: 3009993 - DNA, 22 bp, Homo sapiens
tcaatagctccaagctgttaaa

SEQ ID NO: 3009994 - DNA, 16 bp, Homo sapiens
tcaatatttttagata

SEQ ID NO: 3009995 - DNA, 18 bp, Homo sapiens
tcaatccagatggtggga

SEQ ID NO: 3009996 - DNA, 16 bp, Homo sapiens
tcaatccatcagcaat

SEQ ID NO: 3009997 - DNA, 24 bp, Homo sapiens
tcaatccatcagcaatgcttctct

SEQ ID NO: 3009998 - DNA, 18 bp, Homo sapiens
tcaatgccttgattagac

SEQ ID NO: 3009999 - DNA, 17 bp, Homo sapiens
tcaatgcttaggagaca

SEQ ID NO: 3010000 - DNA, 19 bp, Homo sapiens
tcaatgggagaatcagcag

SEQ ID NO: 3010001 - DNA, 23 bp, Homo sapiens
tcaatgggattttctagtttcct

SEQ ID NO: 3010002 - DNA, 20 bp, Homo sapiens
tcaatggtagattcgctgtc

SEQ ID NO: 3010003 - DNA, 15 bp, Homo sapiens
tcaatgtgacatgtt

SEQ ID NO: 3010004 - DNA, 15 bp, Homo sapiens
tcaatgtgacattta

SEQ ID NO: 3010005 - DNA, 22 bp, Homo sapiens
tcaattaggggcaatagtagaa

SEQ ID NO: 3010006 - DNA, 15 bp, Homo sapiens
tcaattcagtgatgg

SEQ ID NO: 3010007 - DNA, 20 bp, Homo sapiens
tcaattctgtaggttaaaaa

SEQ ID NO: 3010008 - DNA, 16 bp, Homo sapiens
tcaattcttgccaaat

SEQ ID NO: 3010009 - DNA, 16 bp, Homo sapiens
tcaattgcatctccca

SEQ ID NO: 3010010 - DNA, 17 bp, Homo sapiens
tcaattgcatctcccag

SEQ ID NO: 3010011 - DNA, 22 bp, Homo sapiens
tcaattgcatctcccagataat

SEQ ID NO: 3010012 - DNA, 21 bp, Homo sapiens
tcaatttaaacccattttagt

SEQ ID NO: 3010013 - DNA, 14 bp, Homo sapiens
tcaatttaaatgtt

SEQ ID NO: 3010014 - DNA, 19 bp, Homo sapiens
tcaatttaaatgtttacta

SEQ ID NO: 3010015 - DNA, 12 bp, Homo sapiens
tcaatttaaatt

SEQ ID NO: 3010016 - DNA, 23 bp, Homo sapiens
tcaatttactttttaaacagtgt

SEQ ID NO: 3010017 - DNA, 13 bp, Homo sapiens
tcaatttatgaat

SEQ ID NO: 3010018 - DNA, 14 bp, Homo sapiens
tcaatttgccattg

SEQ ID NO: 3010019 - DNA, 22 bp, Homo sapiens
tcaatttgtaattttagtatta

SEQ ID NO: 3010020 - DNA, 18 bp, Homo sapiens
tcaatttgttaacagagc

SEQ ID NO: 3010021 - DNA, 19 bp, Homo sapiens
tcaatttgttaacagagca

SEQ ID NO: 3010022 - DNA, 13 bp, Homo sapiens
tcaattttgtatt

SEQ ID NO: 3010023 - DNA, 20 bp, Homo sapiens
tcaattttgtatttaatgat

SEQ ID NO: 3010024 - DNA, 14 bp, Homo sapiens
tcacaaaagctgtg

SEQ ID NO: 3010025 - DNA, 19 bp, Homo sapiens
tcacaaaagctgtgtctct

SEQ ID NO: 3010026 - DNA, 14 bp, Homo sapiens
tcacaaactgtggt

SEQ ID NO: 3010027 - DNA, 17 bp, Homo sapiens
tcacaaacttttatact

SEQ ID NO: 3010028 - DNA, 12 bp, Homo sapiens
tcacaaagccca

SEQ ID NO: 3010029 - DNA, 15 bp, Homo sapiens
tcacaaagcccaagg

SEQ ID NO: 3010030 - DNA, 16 bp, Homo sapiens
tcacaacaaaaggaag

SEQ ID NO: 3010031 - DNA, 19 bp, Homo sapiens
tcacaacctgaacctagga

SEQ ID NO: 3010032 - DNA, 19 bp, Homo sapiens
tcacaagagtccccagact

SEQ ID NO: 3010033 - DNA, 23 bp, Homo sapiens
tcacaatgaaatgctctcctttc

SEQ ID NO: 3010034 - DNA, 14 bp, Homo sapiens
tcacaatgttcttt

SEQ ID NO: 3010035 - DNA, 17 bp, Homo sapiens
tcacaatgttctttata

SEQ ID NO: 3010036 - DNA, 14 bp, Homo sapiens
tcacaattagggaa

SEQ ID NO: 3010037 - DNA, 12 bp, Homo sapiens
tcacacacatgg

SEQ ID NO: 3010038 - DNA, 12 bp, Homo sapiens
tcacacactgat

SEQ ID NO: 3010039 - DNA, 18 bp, Homo sapiens
tcacacactttctcttca

SEQ ID NO: 3010040 - DNA, 14 bp, Homo sapiens
tcacacagcccagt

SEQ ID NO: 3010041 - DNA, 19 bp, Homo sapiens
tcacacatctgggtgccct

SEQ ID NO: 3010042 - DNA, 21 bp, Homo sapiens
tcacacatctgggtgccctga

SEQ ID NO: 3010043 - DNA, 22 bp, Homo sapiens
tcacacatctgggtgccctgaa

SEQ ID NO: 3010044 - DNA, 23 bp, Homo sapiens
tcacaccctaccttccccagact

SEQ ID NO: 3010045 - DNA, 19 bp, Homo sapiens
tcacacgtttaatcccagc

SEQ ID NO: 3010046 - DNA, 23 bp, Homo sapiens
tcacacgtttaatcccagcactt

SEQ ID NO: 3010047 - DNA, 14 bp, Homo sapiens
tcacactcctcctg

SEQ ID NO: 3010048 - DNA, 16 bp, Homo sapiens
tcacactcctcctgcc

SEQ ID NO: 3010049 - DNA, 17 bp, Homo sapiens
tcacactcctcctgcca

SEQ ID NO: 3010050 - DNA, 19 bp, Homo sapiens
tcacactcctcctgccagc

SEQ ID NO: 3010051 - DNA, 20 bp, Homo sapiens
tcacactcctcctgccagct

SEQ ID NO: 3010052 - DNA, 18 bp, Homo sapiens
tcacactgcaagagcctt

SEQ ID NO: 3010053 - DNA, 16 bp, Homo sapiens
tcacactggctatcaa

SEQ ID NO: 3010054 - DNA, 22 bp, Homo sapiens
tcacacttactgtaagacatta

SEQ ID NO: 3010055 - DNA, 14 bp, Homo sapiens
tcacagaaaaagca

SEQ ID NO: 3010056 - DNA, 11 bp, Homo sapiens
tcacagaagaa

SEQ ID NO: 3010057 - DNA, 17 bp, Homo sapiens
tcacagaagcctaggag

SEQ ID NO: 3010058 - DNA, 15 bp, Homo sapiens
tcacagactcttcca

SEQ ID NO: 3010059 - DNA, 17 bp, Homo sapiens
tcacagactcttccacc

SEQ ID NO: 3010060 - DNA, 20 bp, Homo sapiens
tcacagactcttccaccaga

SEQ ID NO: 3010061 - DNA, 17 bp, Homo sapiens
tcacagagcacgcctgc

SEQ ID NO: 3010062 - DNA, 20 bp, Homo sapiens
tcacagagcacgcctgccat

SEQ ID NO: 3010063 - DNA, 12 bp, Homo sapiens
tcacagaggctt

SEQ ID NO: 3010064 - DNA, 21 bp, Homo sapiens
tcacagagtgagactccatct

SEQ ID NO: 3010065 - DNA, 22 bp, Homo sapiens
tcacagatgagttatctaagaa

SEQ ID NO: 3010066 - DNA, 17 bp, Homo sapiens
tcacagatgctggcctc

SEQ ID NO: 3010067 - DNA, 18 bp, Homo sapiens
tcacagatgctggcctct

SEQ ID NO: 3010068 - DNA, 14 bp, Homo sapiens
tcacagctcttgtt

SEQ ID NO: 3010069 - DNA, 23 bp, Homo sapiens
tcacaggaaaatgtatccagagg

SEQ ID NO: 3010070 - DNA, 19 bp, Homo sapiens
tcacaggagcaatcacagg

SEQ ID NO: 3010071 - DNA, 22 bp, Homo sapiens
tcacaggcttctgagcacagct

SEQ ID NO: 3010072 - DNA, 19 bp, Homo sapiens
tcacagggtgggcctcggc

SEQ ID NO: 3010073 - DNA, 20 bp, Homo sapiens
tcacaggtgtcagccattgc

SEQ ID NO: 3010074 - DNA, 14 bp, Homo sapiens
tcacagttcctcgc

SEQ ID NO: 3010075 - DNA, 16 bp, Homo sapiens
tcacagttcctcgccc

SEQ ID NO: 3010076 - DNA, 22 bp, Homo sapiens
tcacagttctttgggccagaca

SEQ ID NO: 3010077 - DNA, 17 bp, Homo sapiens
tcacagttggccttcag

SEQ ID NO: 3010078 - DNA, 23 bp, Homo sapiens
tcacataaaaaagaagcactttg

SEQ ID NO: 3010079 - DNA, 19 bp, Homo sapiens
tcacataacagagtagttt

SEQ ID NO: 3010080 - DNA, 23 bp, Homo sapiens
tcacataggtaggtatctttata

SEQ ID NO: 3010081 - DNA, 16 bp, Homo sapiens
tcacatagtttttcct

SEQ ID NO: 3010082 - DNA, 20 bp, Homo sapiens
tcacatatgattctcttaga

SEQ ID NO: 3010083 - DNA, 14 bp, Homo sapiens
tcacatcaagcatc

SEQ ID NO: 3010084 - DNA, 22 bp, Homo sapiens
tcacatcacgaaggaaaactgc

SEQ ID NO: 3010085 - DNA, 22 bp, Homo sapiens
tcacatcatgctgttttatcct

SEQ ID NO: 3010086 - DNA, 14 bp, Homo sapiens
tcacatcatttggg

SEQ ID NO: 3010087 - DNA, 14 bp, Homo sapiens
tcacatctcccttc

SEQ ID NO: 3010088 - DNA, 13 bp, Homo sapiens
tcacatgaccaca

SEQ ID NO: 3010089 - DNA, 14 bp, Homo sapiens
tcacatgaccacat

SEQ ID NO: 3010090 - DNA, 19 bp, Homo sapiens
tcacatgatgaaaaattat

SEQ ID NO: 3010091 - DNA, 15 bp, Homo sapiens
tcacatgattctcct

SEQ ID NO: 3010092 - DNA, 15 bp, Homo sapiens
tcacatgccttgcaa

SEQ ID NO: 3010093 - DNA, 21 bp, Homo sapiens
tcacatggtgctacgcctgca

SEQ ID NO: 3010094 - DNA, 21 bp, Homo sapiens
tcacatgtcagtaccttcaaa

SEQ ID NO: 3010095 - DNA, 21 bp, Homo sapiens
tcacattcccctggggaccca

SEQ ID NO: 3010096 - DNA, 15 bp, Homo sapiens
tcacattcttataaa

SEQ ID NO: 3010097 - DNA, 20 bp, Homo sapiens
tcacatttttacttggtgta

SEQ ID NO: 3010098 - DNA, 16 bp, Homo sapiens
tcaccaagctcacagt

SEQ ID NO: 3010099 - DNA, 22 bp, Homo sapiens
tcaccaagctcacagttcctcg

SEQ ID NO: 3010100 - DNA, 15 bp, Homo sapiens
tcaccaatgttgtac

SEQ ID NO: 3010101 - DNA, 15 bp, Homo sapiens
tcaccacccccactg

SEQ ID NO: 3010102 - DNA, 18 bp, Homo sapiens
tcaccagaggaatcactc

SEQ ID NO: 3010103 - DNA, 16 bp, Homo sapiens
tcaccagctgcaaagt

SEQ ID NO: 3010104 - DNA, 18 bp, Homo sapiens
tcaccagctgcaaagtgt

SEQ ID NO: 3010105 - DNA, 21 bp, Homo sapiens
tcaccagctgcaaagtgtttt

SEQ ID NO: 3010106 - DNA, 15 bp, Homo sapiens
tcaccaggatttata

SEQ ID NO: 3010107 - DNA, 15 bp, Homo sapiens
tcaccatatttgaat

SEQ ID NO: 3010108 - DNA, 17 bp, Homo sapiens
tcaccatatttgaattg

SEQ ID NO: 3010109 - DNA, 21 bp, Homo sapiens
tcaccatatttgaattggcct

SEQ ID NO: 3010110 - DNA, 21 bp, Homo sapiens
tcaccatgcaagggtgacatc

SEQ ID NO: 3010111 - DNA, 13 bp, Homo sapiens
tcaccatgcttgt

SEQ ID NO: 3010112 - DNA, 11 bp, Homo sapiens
tcaccatggcc

SEQ ID NO: 3010113 - DNA, 13 bp, Homo sapiens
tcaccatgtattt

SEQ ID NO: 3010114 - DNA, 19 bp, Homo sapiens
tcaccatgtattttgtaaa

SEQ ID NO: 3010115 - DNA, 17 bp, Homo sapiens
tcaccatttgattatgt

SEQ ID NO: 3010116 - DNA, 14 bp, Homo sapiens
tcacccaaaagcac

SEQ ID NO: 3010117 - DNA, 22 bp, Homo sapiens
tcacccaaagcctgtcccagga

SEQ ID NO: 3010118 - DNA, 21 bp, Homo sapiens
tcacccacaaccctctggaag

SEQ ID NO: 3010119 - DNA, 17 bp, Homo sapiens
tcacccaccctgtggct

SEQ ID NO: 3010120 - DNA, 11 bp, Homo sapiens
tcacccagact

SEQ ID NO: 3010121 - DNA, 12 bp, Homo sapiens
tcacccagacta

SEQ ID NO: 3010122 - DNA, 17 bp, Homo sapiens
tcaccccagagccacac

SEQ ID NO: 3010123 - DNA, 19 bp, Homo sapiens
tcaccccagagccacacat

SEQ ID NO: 3010124 - DNA, 14 bp, Homo sapiens
tcacccccctgctt

SEQ ID NO: 3010125 - DNA, 17 bp, Homo sapiens
tcaccccgaggccctgc

SEQ ID NO: 3010126 - DNA, 14 bp, Homo sapiens
tcaccccgtctggg

SEQ ID NO: 3010127 - DNA, 13 bp, Homo sapiens
tcacccctccagg

SEQ ID NO: 3010128 - DNA, 22 bp, Homo sapiens
tcaccctaacttcgtatttttt

SEQ ID NO: 3010129 - DNA, 17 bp, Homo sapiens
tcaccctagccctctcc

SEQ ID NO: 3010130 - DNA, 21 bp, Homo sapiens
tcaccctagccctctccctct

SEQ ID NO: 3010131 - DNA, 14 bp, Homo sapiens
tcaccctctgtccc

SEQ ID NO: 3010132 - DNA, 23 bp, Homo sapiens
tcaccctgatttaggagaagcca

SEQ ID NO: 3010133 - DNA, 16 bp, Homo sapiens
tcaccctggccaccac

SEQ ID NO: 3010134 - DNA, 18 bp, Homo sapiens
tcaccctggccaccaccc

SEQ ID NO: 3010135 - DNA, 19 bp, Homo sapiens
tcaccctgtgaccctctca

SEQ ID NO: 3010136 - DNA, 17 bp, Homo sapiens
tcacccttcctggccca

SEQ ID NO: 3010137 - DNA, 20 bp, Homo sapiens
tcacccttcctggcccaggc

SEQ ID NO: 3010138 - DNA, 16 bp, Homo sapiens
attaagagaacaaaga

SEQ ID NO: 3010139 - DNA, 19 bp, Homo sapiens
attaagccaggaaacatga

SEQ ID NO: 3010140 - DNA, 20 bp, Homo sapiens
attaagccaggaaacatgaa

SEQ ID NO: 3010141 - DNA, 13 bp, Homo sapiens
attaagcccaatc

SEQ ID NO: 3010142 - DNA, 21 bp, Homo sapiens
attaaggatgtagcttttcac

SEQ ID NO: 3010143 - DNA, 14 bp, Homo sapiens
attaagtagaacaa

SEQ ID NO: 3010144 - DNA, 12 bp, Homo sapiens
attaatagttca

SEQ ID NO: 3010145 - DNA, 18 bp, Homo sapiens
attaatataagtttcttt

SEQ ID NO: 3010146 - DNA, 11 bp, Homo sapiens
attaatatttg

SEQ ID NO: 3010147 - DNA, 22 bp, Homo sapiens
attaatcaagtacctatattga

SEQ ID NO: 3010148 - DNA, 20 bp, Homo sapiens
attaatcagctgttgcaggc

SEQ ID NO: 3010149 - DNA, 21 bp, Homo sapiens
attaatcatttgatttaaaca

SEQ ID NO: 3010150 - DNA, 20 bp, Homo sapiens
attaatgatgaggatctgaa

SEQ ID NO: 3010151 - DNA, 14 bp, Homo sapiens
attaatgattctga

SEQ ID NO: 3010152 - DNA, 11 bp, Homo sapiens
attaatgcact

SEQ ID NO: 3010153 - DNA, 13 bp, Homo sapiens
attaatgcccagc

SEQ ID NO: 3010154 - DNA, 15 bp, Homo sapiens
attaattataaaatg

SEQ ID NO: 3010155 - DNA, 14 bp, Homo sapiens
attaattgctttga

SEQ ID NO: 3010156 - DNA, 23 bp, Homo sapiens
attaatttgttaattaaatattt

SEQ ID NO: 3010157 - DNA, 15 bp, Homo sapiens
attacaaagaaaata

SEQ ID NO: 3010158 - DNA, 13 bp, Homo sapiens
attacaaatggtt

SEQ ID NO: 3010159 - DNA, 13 bp, Homo sapiens
attacaattttat

SEQ ID NO: 3010160 - DNA, 15 bp, Homo sapiens
attacaattttatct

SEQ ID NO: 3010161 - DNA, 19 bp, Homo sapiens
attacacttggtaattgta

SEQ ID NO: 3010162 - DNA, 22 bp, Homo sapiens
attacaggtgggatatgctaga

SEQ ID NO: 3010163 - DNA, 24 bp, Homo sapiens
attacaggtgggatatgctagaaa

SEQ ID NO: 3010164 - DNA, 18 bp, Homo sapiens
attacataactgatctat

SEQ ID NO: 3010165 - DNA, 20 bp, Homo sapiens
attacataactgatctattt

SEQ ID NO: 3010166 - DNA, 18 bp, Homo sapiens
attacataatctgtacaa

SEQ ID NO: 3010167 - DNA, 21 bp, Homo sapiens
attacataatctgtacaatga

SEQ ID NO: 3010168 - DNA, 22 bp, Homo sapiens
attacatctttcacattggcta

SEQ ID NO: 3010169 - DNA, 16 bp, Homo sapiens
attacatgtaatttga

SEQ ID NO: 3010170 - DNA, 15 bp, Homo sapiens
attacatttttgcag

SEQ ID NO: 3010171 - DNA, 24 bp, Homo sapiens
attacccagagatatctatgaaaa

SEQ ID NO: 3010172 - DNA, 19 bp, Homo sapiens
attacccagctaaataatc

SEQ ID NO: 3010173 - DNA, 14 bp, Homo sapiens
attacccctcattt

SEQ ID NO: 3010174 - DNA, 17 bp, Homo sapiens
attacccctcatttaaa

SEQ ID NO: 3010175 - DNA, 16 bp, Homo sapiens
attacccttcctcatc

SEQ ID NO: 3010176 - DNA, 12 bp, Homo sapiens
attacctcctga

SEQ ID NO: 3010177 - DNA, 20 bp, Homo sapiens
attaccttttttgataaagt

SEQ ID NO: 3010178 - DNA, 15 bp, Homo sapiens
attacgataaggaag

SEQ ID NO: 3010179 - DNA, 19 bp, Homo sapiens
attacgataaggaagaaac

SEQ ID NO: 3010180 - DNA, 21 bp, Homo sapiens
attacggtgtacagtttaaca

SEQ ID NO: 3010181 - DNA, 23 bp, Homo sapiens
attacggtgtacagtttaacaga

SEQ ID NO: 3010182 - DNA, 14 bp, Homo sapiens
attacgttgtttct

SEQ ID NO: 3010183 - DNA, 16 bp, Homo sapiens
attacgttgtttctta

SEQ ID NO: 3010184 - DNA, 13 bp, Homo sapiens
attactgcaatca

SEQ ID NO: 3010185 - DNA, 15 bp, Homo sapiens
attactgcaatcact

SEQ ID NO: 3010186 - DNA, 18 bp, Homo sapiens
attactgcctgcagagat

SEQ ID NO: 3010187 - DNA, 20 bp, Homo sapiens
attactgcctgcagagatat

SEQ ID NO: 3010188 - DNA, 17 bp, Homo sapiens
attacttaagatgttta

SEQ ID NO: 3010189 - DNA, 18 bp, Homo sapiens
attacttatccctgccca

SEQ ID NO: 3010190 - DNA, 19 bp, Homo sapiens
attacttatccctgcccat

SEQ ID NO: 3010191 - DNA, 16 bp, Homo sapiens
attacttgtgttactt

SEQ ID NO: 3010192 - DNA, 14 bp, Homo sapiens
attactttgtgaat

SEQ ID NO: 3010193 - DNA, 21 bp, Homo sapiens
attagaaaaatagcaacttgt

SEQ ID NO: 3010194 - DNA, 16 bp, Homo sapiens
attagaaacaaacaaa

SEQ ID NO: 3010195 - DNA, 15 bp, Homo sapiens
attagaatgtgattt

SEQ ID NO: 3010196 - DNA, 22 bp, Homo sapiens
attagactggaacttgaactga

SEQ ID NO: 3010197 - DNA, 14 bp, Homo sapiens
attagactggacag

SEQ ID NO: 3010198 - DNA, 19 bp, Homo sapiens
attagactggacagcttgt

SEQ ID NO: 3010199 - DNA, 20 bp, Homo sapiens
attagactggacagcttgtg

SEQ ID NO: 3010200 - DNA, 18 bp, Homo sapiens
attagagagatttttcat

SEQ ID NO: 3010201 - DNA, 15 bp, Homo sapiens
attagaggaatttaa

SEQ ID NO: 3010202 - DNA, 17 bp, Homo sapiens
attagagtgtctttcca

SEQ ID NO: 3010203 - DNA, 23 bp, Homo sapiens
attagagtgtctttccacggagc

SEQ ID NO: 3010204 - DNA, 15 bp, Homo sapiens
atttaaaacatgtaa

SEQ ID NO: 3010205 - DNA, 11 bp, Homo sapiens
atttaaaactt

SEQ ID NO: 3010206 - DNA, 16 bp, Homo sapiens
atttaaaagacaaaca

SEQ ID NO: 3010207 - DNA, 13 bp, Homo sapiens
atttaaaagattc

SEQ ID NO: 3010208 - DNA, 15 bp, Homo sapiens
atttaaaagggaagt

SEQ ID NO: 3010209 - DNA, 20 bp, Homo sapiens
atttaaaagtgtattttatt

SEQ ID NO: 3010210 - DNA, 11 bp, Homo sapiens
atttaaaatgt

SEQ ID NO: 3010211 - DNA, 14 bp, Homo sapiens
atttaaaattaagt

SEQ ID NO: 3010212 - DNA, 11 bp, Homo sapiens
atttaaacctt

SEQ ID NO: 3010213 - DNA, 19 bp, Homo sapiens
atttaaacctttttcttga

SEQ ID NO: 3010214 - DNA, 22 bp, Homo sapiens
atttaaacctttttcttgatct

SEQ ID NO: 3010215 - DNA, 20 bp, Homo sapiens
atttaaactaaccttttatc

SEQ ID NO: 3010216 - DNA, 12 bp, Homo sapiens
atttaaagcaca

SEQ ID NO: 3010217 - DNA, 20 bp, Homo sapiens
atttaaaggccctatctgtt

SEQ ID NO: 3010218 - DNA, 18 bp, Homo sapiens
atttaaagggaaaaccct

SEQ ID NO: 3010219 - DNA, 22 bp, Homo sapiens
atttaaagttgtttgtgccttt

SEQ ID NO: 3010220 - DNA, 21 bp, Homo sapiens
atttaaatacagtcttccatt

SEQ ID NO: 3010221 - DNA, 12 bp, Homo sapiens
atttaaatgaaa

SEQ ID NO: 3010222 - DNA, 13 bp, Homo sapiens
atttaaatgtact

SEQ ID NO: 3010223 - DNA, 15 bp, Homo sapiens
atttaaatgtttact

SEQ ID NO: 3010224 - DNA, 13 bp, Homo sapiens
atttaacatgtgg

SEQ ID NO: 3010225 - DNA, 21 bp, Homo sapiens
atttaacgttgatgtaatgaa

SEQ ID NO: 3010226 - DNA, 13 bp, Homo sapiens
atttaactggctt

SEQ ID NO: 3010227 - DNA, 14 bp, Homo sapiens
atttaagaagaatg

SEQ ID NO: 3010228 - DNA, 12 bp, Homo sapiens
atttaagcatga

SEQ ID NO: 3010229 - DNA, 17 bp, Homo sapiens
atttaagcatgagtggc

SEQ ID NO: 3010230 - DNA, 19 bp, Homo sapiens
atttaagcatgagtggcct

SEQ ID NO: 3010231 - DNA, 15 bp, Homo sapiens
atttaagcattcaaa

SEQ ID NO: 3010232 - DNA, 19 bp, Homo sapiens
atttaaggaatcaaatctt

SEQ ID NO: 3010233 - DNA, 16 bp, Homo sapiens
atttaagttcctgctg

SEQ ID NO: 3010234 - DNA, 18 bp, Homo sapiens
atttaataactttgctgg

SEQ ID NO: 3010235 - DNA, 22 bp, Homo sapiens
atttaataactttgctggaaaa

SEQ ID NO: 3010236 - DNA, 17 bp, Homo sapiens
atttaatagtgttaatc

SEQ ID NO: 3010237 - DNA, 19 bp, Homo sapiens
atttccccaacagtgtgaa

SEQ ID NO: 3010238 - DNA, 16 bp, Homo sapiens
atttccccagccacag

SEQ ID NO: 3010239 - DNA, 21 bp, Homo sapiens
atttccccagccacaggccaa

SEQ ID NO: 3010240 - DNA, 19 bp, Homo sapiens
atttccctccagagaaagc

SEQ ID NO: 3010241 - DNA, 17 bp, Homo sapiens
atttccctgaaggaacc

SEQ ID NO: 3010242 - DNA, 15 bp, Homo sapiens
atttccgtccccccc

SEQ ID NO: 3010243 - DNA, 18 bp, Homo sapiens
atttccgtccccccccag

SEQ ID NO: 3010244 - DNA, 15 bp, Homo sapiens
atttcctatcctggt

SEQ ID NO: 3010245 - DNA, 20 bp, Homo sapiens
atttcctatgtaactgcatt

SEQ ID NO: 3010246 - DNA, 13 bp, Homo sapiens
atttcctcacgtg

SEQ ID NO: 3010247 - DNA, 21 bp, Homo sapiens
atttcctcagcttatctcttt

SEQ ID NO: 3010248 - DNA, 18 bp, Homo sapiens
atttcctcataaacattt

SEQ ID NO: 3010249 - DNA, 18 bp, Homo sapiens
atttcctctgttcttttc

SEQ ID NO: 3010250 - DNA, 15 bp, Homo sapiens
atttcctgacttgag

SEQ ID NO: 3010251 - DNA, 12 bp, Homo sapiens
atttcctgtgtc

SEQ ID NO: 3010252 - DNA, 23 bp, Homo sapiens
atttcctgttggatttgtttaaa

SEQ ID NO: 3010253 - DNA, 21 bp, Homo sapiens
atttccttcaccacctcatgt

SEQ ID NO: 3010254 - DNA, 13 bp, Homo sapiens
atttcctttatac

SEQ ID NO: 3010255 - DNA, 22 bp, Homo sapiens
atttcctttatactgtgaagtt

SEQ ID NO: 3010256 - DNA, 17 bp, Homo sapiens
atttccttttttaaaaa

SEQ ID NO: 3010257 - DNA, 20 bp, Homo sapiens
atttcgtgtaatattctctg

SEQ ID NO: 3010258 - DNA, 14 bp, Homo sapiens
atttctaaaatctt

SEQ ID NO: 3010259 - DNA, 14 bp, Homo sapiens
atttctaagcagat

SEQ ID NO: 3010260 - DNA, 20 bp, Homo sapiens
atttctagaaaagcttccta

SEQ ID NO: 3010261 - DNA, 21 bp, Homo sapiens
atttctagaacatccctgcca

SEQ ID NO: 3010262 - DNA, 19 bp, Homo sapiens
atttctaggaagaatttta

SEQ ID NO: 3010263 - DNA, 22 bp, Homo sapiens
atttctagggctgggaaacact

SEQ ID NO: 3010264 - DNA, 11 bp, Homo sapiens
atttctaggta

SEQ ID NO: 3010265 - DNA, 14 bp, Homo sapiens
atttctataaatag

SEQ ID NO: 3010266 - DNA, 14 bp, Homo sapiens
atttctatgtatgt

SEQ ID NO: 3010267 - DNA, 22 bp, Homo sapiens
atttctatgtatgtgccaattt

SEQ ID NO: 3010268 - DNA, 14 bp, Homo sapiens
atttctattattaa

SEQ ID NO: 3010269 - DNA, 22 bp, Homo sapiens
atttctattattaattgcaaaa

SEQ ID NO: 3010270 - DNA, 15 bp, Homo sapiens
atttctatttctcct

SEQ ID NO: 3010271 - DNA, 23 bp, Homo sapiens
atttctcatagcaggaaatgtag

SEQ ID NO: 3010272 - DNA, 12 bp, Homo sapiens
atttctccagaa

SEQ ID NO: 3010273 - DNA, 15 bp, Homo sapiens
atttctccatacgca

SEQ ID NO: 3010274 - DNA, 22 bp, Homo sapiens
atttctctagtagttaaaaaaa

SEQ ID NO: 3010275 - DNA, 19 bp, Homo sapiens
atttctgcacaggtctctg

SEQ ID NO: 3010276 - DNA, 18 bp, Homo sapiens
atttctgcatatgttgaa

SEQ ID NO: 3010277 - DNA, 13 bp, Homo sapiens
atttctgtgggag

SEQ ID NO: 3010278 - DNA, 23 bp, Homo sapiens
atttcttaaatctttcttcaaat

SEQ ID NO: 3010279 - DNA, 15 bp, Homo sapiens
atttcttaaattttt

SEQ ID NO: 3010280 - DNA, 15 bp, Homo sapiens
atttcttcagagttt

SEQ ID NO: 3010281 - DNA, 17 bp, Homo sapiens
atttcttcgttcttttt

SEQ ID NO: 3010282 - DNA, 17 bp, Homo sapiens
atttcttctagaagata

SEQ ID NO: 3010283 - DNA, 23 bp, Homo sapiens
atttcttctagaagataacattt

SEQ ID NO: 3010284 - DNA, 22 bp, Homo sapiens
atttcttctcctggagttgcat

SEQ ID NO: 3010285 - DNA, 13 bp, Homo sapiens
atttcttcttttc

SEQ ID NO: 3010286 - DNA, 21 bp, Homo sapiens
atttcttgagttttgttttaa

SEQ ID NO: 3010287 - DNA, 14 bp, Homo sapiens
atttcttgcgagcc

SEQ ID NO: 3010288 - DNA, 13 bp, Homo sapiens
atttcttgctttc

SEQ ID NO: 3010289 - DNA, 16 bp, Homo sapiens
atttctttaaaaaaga

SEQ ID NO: 3010290 - DNA, 17 bp, Homo sapiens
atttctttaaaaaagaa

SEQ ID NO: 3010291 - DNA, 22 bp, Homo sapiens
atttctttaaaaaagaaattat

SEQ ID NO: 3010292 - DNA, 11 bp, Homo sapiens
atttctttaat

SEQ ID NO: 3010293 - DNA, 22 bp, Homo sapiens
atttctttaatctgttgtttga

SEQ ID NO: 3010294 - DNA, 14 bp, Homo sapiens
atttctttcttcca

SEQ ID NO: 3010295 - DNA, 19 bp, Homo sapiens
atttctttgcctgttcagt

SEQ ID NO: 3010296 - DNA, 21 bp, Homo sapiens
atttctttgctgtaagatgtc

SEQ ID NO: 3010297 - DNA, 22 bp, Homo sapiens
atttctttgctgtaagatgtct

SEQ ID NO: 3010298 - DNA, 19 bp, Homo sapiens
atttctttgtgctttggct

SEQ ID NO: 3010299 - DNA, 18 bp, Homo sapiens
atttcttttcttcctggc

SEQ ID NO: 3010300 - DNA, 11 bp, Homo sapiens
atttcttttgt

SEQ ID NO: 3010301 - DNA, 21 bp, Homo sapiens
atttcttttgtaataaactat

SEQ ID NO: 3010302 - DNA, 22 bp, Homo sapiens
atttctttttaattattttaaa

SEQ ID NO: 3010303 - DNA, 20 bp, Homo sapiens
atttgaaaaaagttactgca

SEQ ID NO: 3010304 - DNA, 17 bp, Homo sapiens
atttgaaaataattgtt

SEQ ID NO: 3010305 - DNA, 23 bp, Homo sapiens
atttgaaagtgggtttcaattta

SEQ ID NO: 3010306 - DNA, 14 bp, Homo sapiens
atttgaaccaataa

SEQ ID NO: 3010307 - DNA, 11 bp, Homo sapiens
atttgaacttt

SEQ ID NO: 3010308 - DNA, 16 bp, Homo sapiens
atttgaactttggaac

SEQ ID NO: 3010309 - DNA, 18 bp, Homo sapiens
atttgaatgggtccattt

SEQ ID NO: 3010310 - DNA, 20 bp, Homo sapiens
atttgaatgtatgcttcata

SEQ ID NO: 3010311 - DNA, 11 bp, Homo sapiens
atttgacctcc

SEQ ID NO: 3010312 - DNA, 12 bp, Homo sapiens
atttgactaatt

SEQ ID NO: 3010313 - DNA, 13 bp, Homo sapiens
atttgactaattt

SEQ ID NO: 3010314 - DNA, 21 bp, Homo sapiens
atttgagatcgtccactgtca

SEQ ID NO: 3010315 - DNA, 17 bp, Homo sapiens
atttgaggggaaaacac

SEQ ID NO: 3010316 - DNA, 13 bp, Homo sapiens
atttgagtctctt

SEQ ID NO: 3010317 - DNA, 21 bp, Homo sapiens
atttgagtctcttaatagcca

SEQ ID NO: 3010318 - DNA, 16 bp, Homo sapiens
atttgagtgctctgat

SEQ ID NO: 3010319 - DNA, 16 bp, Homo sapiens
atttgagttgtgattg

SEQ ID NO: 3010320 - DNA, 19 bp, Homo sapiens
atttgagttgtgattgaaa

SEQ ID NO: 3010321 - DNA, 23 bp, Homo sapiens
atttgagtttcctttaaatactc

SEQ ID NO: 3010322 - DNA, 14 bp, Homo sapiens
atttgagtttgctg

SEQ ID NO: 3010323 - DNA, 22 bp, Homo sapiens
atttgagttttgttgaaaagat

SEQ ID NO: 3010324 - DNA, 14 bp, Homo sapiens
atttgatagatgtt

SEQ ID NO: 3010325 - DNA, 11 bp, Homo sapiens
atttgcaaagt

SEQ ID NO: 3010326 - DNA, 13 bp, Homo sapiens
atttgcaaagtac

SEQ ID NO: 3010327 - DNA, 16 bp, Homo sapiens
atttgcaaagtactgt

SEQ ID NO: 3010328 - DNA, 14 bp, Homo sapiens
atttgcagggtcct

SEQ ID NO: 3010329 - DNA, 12 bp, Homo sapiens
atttgcatgaaa

SEQ ID NO: 3010330 - DNA, 17 bp, Homo sapiens
atttgcatgaaagcaca

SEQ ID NO: 3010331 - DNA, 23 bp, Homo sapiens
atttgcattaaattcacaaactt

SEQ ID NO: 3010332 - DNA, 22 bp, Homo sapiens
atttgcattgaacacaaactgt

SEQ ID NO: 3010333 - DNA, 20 bp, Homo sapiens
atttgccactgatattcaga

SEQ ID NO: 3010334 - DNA, 22 bp, Homo sapiens
atttgccactgatattcagaat

SEQ ID NO: 3010335 - DNA, 18 bp, Homo sapiens
atttgccattggtttctg

SEQ ID NO: 3010336 - DNA, 12 bp, Homo sapiens
atttgccctggg

SEQ ID NO: 3010337 - DNA, 16 bp, Homo sapiens
atttgccctgggaaac

SEQ ID NO: 3010338 - DNA, 16 bp, Homo sapiens
atttgccttctccctg

SEQ ID NO: 3010339 - DNA, 19 bp, Homo sapiens
atttgctgagtttcccttc

SEQ ID NO: 3010340 - DNA, 15 bp, Homo sapiens
atttggaaaaagaaa

SEQ ID NO: 3010341 - DNA, 21 bp, Homo sapiens
atttggaaccaaagtctaaac

SEQ ID NO: 3010342 - DNA, 17 bp, Homo sapiens
atttggaagcaacgtgt

SEQ ID NO: 3010343 - DNA, 22 bp, Homo sapiens
atttggaagcaacgtgttaatt

SEQ ID NO: 3010344 - DNA, 13 bp, Homo sapiens
atttggaatactt

SEQ ID NO: 3010345 - DNA, 18 bp, Homo sapiens
atttggaatgcacacagc

SEQ ID NO: 3010346 - DNA, 15 bp, Homo sapiens
atttggaattgacat

SEQ ID NO: 3010347 - DNA, 22 bp, Homo sapiens
atttggaattgacattctctat

SEQ ID NO: 3010348 - DNA, 21 bp, Homo sapiens
atttggaggaaaaaaagcatg

SEQ ID NO: 3010349 - DNA, 18 bp, Homo sapiens
atttggataataaaaatt

SEQ ID NO: 3010350 - DNA, 17 bp, Homo sapiens
ctcttctgggcagagcc

SEQ ID NO: 3010351 - DNA, 23 bp, Homo sapiens
ctcttctgggcagagcctgtccc

SEQ ID NO: 3010352 - DNA, 22 bp, Homo sapiens
ctcttctgtattttttttttcc

SEQ ID NO: 3010353 - DNA, 22 bp, Homo sapiens
ctcttcttggggcccagtgcat

SEQ ID NO: 3010354 - DNA, 20 bp, Homo sapiens
ctcttctttcagacttgcca

SEQ ID NO: 3010355 - DNA, 21 bp, Homo sapiens
ctcttctttgggatgctattt

SEQ ID NO: 3010356 - DNA, 14 bp, Homo sapiens
ctcttgaaacctga

SEQ ID NO: 3010357 - DNA, 16 bp, Homo sapiens
ctcttgaagtccagga

SEQ ID NO: 3010358 - DNA, 14 bp, Homo sapiens
ctcttgacagtctg

SEQ ID NO: 3010359 - DNA, 22 bp, Homo sapiens
ctcttgacattcaaaacagtta

SEQ ID NO: 3010360 - DNA, 15 bp, Homo sapiens
ctcttgactcaggtg

SEQ ID NO: 3010361 - DNA, 23 bp, Homo sapiens
ctcttgactcaggtggtgtcctt

SEQ ID NO: 3010362 - DNA, 15 bp, Homo sapiens
ctcttgattataaat

SEQ ID NO: 3010363 - DNA, 17 bp, Homo sapiens
ctcttgattataaatgt

SEQ ID NO: 3010364 - DNA, 17 bp, Homo sapiens
ctcttgatttgggtgga

SEQ ID NO: 3010365 - DNA, 20 bp, Homo sapiens
ctcttgcaatccacaatctg

SEQ ID NO: 3010366 - DNA, 13 bp, Homo sapiens
ctcttgcaggctg

SEQ ID NO: 3010367 - DNA, 14 bp, Homo sapiens
ctcttgcaggctga

SEQ ID NO: 3010368 - DNA, 14 bp, Homo sapiens
ctcttggagcctgc

SEQ ID NO: 3010369 - DNA, 17 bp, Homo sapiens
ctcttggataccagctc

SEQ ID NO: 3010370 - DNA, 21 bp, Homo sapiens
ctcttggataccagctcaggg

SEQ ID NO: 3010371 - DNA, 14 bp, Homo sapiens
ctcttggcacctgc

SEQ ID NO: 3010372 - DNA, 20 bp, Homo sapiens
ctcttggcacctgcctagct

SEQ ID NO: 3010373 - DNA, 16 bp, Homo sapiens
ctcttggcctgatcag

SEQ ID NO: 3010374 - DNA, 14 bp, Homo sapiens
ctcttggctccact

SEQ ID NO: 3010375 - DNA, 18 bp, Homo sapiens
ctcttgggcctgacctcc

SEQ ID NO: 3010376 - DNA, 23 bp, Homo sapiens
ctcttgggcctgacctccagtcc

SEQ ID NO: 3010377 - DNA, 19 bp, Homo sapiens
ctcttgggttcaagtgatt

SEQ ID NO: 3010378 - DNA, 23 bp, Homo sapiens
ctcttgtaaataaagccctggga

SEQ ID NO: 3010379 - DNA, 20 bp, Homo sapiens
ctcttgtataagatcctaga

SEQ ID NO: 3010380 - DNA, 15 bp, Homo sapiens
ctcttgtcctttaat

SEQ ID NO: 3010381 - DNA, 20 bp, Homo sapiens
ctcttgtgacgtgcactgtg

SEQ ID NO: 3010382 - DNA, 12 bp, Homo sapiens
ctcttgtgctca

SEQ ID NO: 3010383 - DNA, 20 bp, Homo sapiens
ctcttgtgctcagtcgccct

SEQ ID NO: 3010384 - DNA, 23 bp, Homo sapiens
ctcttgtggtgcattgaaagaag

SEQ ID NO: 3010385 - DNA, 17 bp, Homo sapiens
ctcttgttgtccaggct

SEQ ID NO: 3010386 - DNA, 21 bp, Homo sapiens
ctcttgtttaaaaaaagaaaa

SEQ ID NO: 3010387 - DNA, 15 bp, Homo sapiens
ctcttgtttctgttt

SEQ ID NO: 3010388 - DNA, 18 bp, Homo sapiens
ctcttgtttctgtttagt

SEQ ID NO: 3010389 - DNA, 16 bp, Homo sapiens
ctcttgttttcagttt

SEQ ID NO: 3010390 - DNA, 21 bp, Homo sapiens
ctctttatgcttgcaaaaact

SEQ ID NO: 3010391 - DNA, 14 bp, Homo sapiens
ctctttcatctgta

SEQ ID NO: 3010392 - DNA, 18 bp, Homo sapiens
ctctttcccctcctttgt

SEQ ID NO: 3010393 - DNA, 9 bp, Homo sapiens
ctctttcta

SEQ ID NO: 3010394 - DNA, 15 bp, Homo sapiens
ctctttctgtatata

SEQ ID NO: 3010395 - DNA, 19 bp, Homo sapiens
ctctttctgtcccttctgt

SEQ ID NO: 3010396 - DNA, 12 bp, Homo sapiens
ctctttcttgtt

SEQ ID NO: 3010397 - DNA, 18 bp, Homo sapiens
ctctttcttgtttgtcag

SEQ ID NO: 3010398 - DNA, 12 bp, Homo sapiens
ctctttgaattt

SEQ ID NO: 3010399 - DNA, 12 bp, Homo sapiens
ctctttgctttg

SEQ ID NO: 3010400 - DNA, 14 bp, Homo sapiens
ctctttgtaataaa

SEQ ID NO: 3010401 - DNA, 17 bp, Homo sapiens
ctctttgtctaaaacaa

SEQ ID NO: 3010402 - DNA, 18 bp, Homo sapiens
ctctttgtctaaaacaat

SEQ ID NO: 3010403 - DNA, 11 bp, Homo sapiens
ctcttttacta

SEQ ID NO: 3010404 - DNA, 23 bp, Homo sapiens
ctcttttatatttgtaggagaaa

SEQ ID NO: 3010405 - DNA, 17 bp, Homo sapiens
ctcttttcctctctctc

SEQ ID NO: 3010406 - DNA, 21 bp, Homo sapiens
ctctttttccaacttggctgc

SEQ ID NO: 3010407 - DNA, 14 bp, Homo sapiens
ctctttttctctgt

SEQ ID NO: 3010408 - DNA, 16 bp, Homo sapiens
ctctttttctctgtat

SEQ ID NO: 3010409 - DNA, 14 bp, Homo sapiens
ctctttttgaaaaa

SEQ ID NO: 3010410 - DNA, 13 bp, Homo sapiens
ctgaaaaatggga

SEQ ID NO: 3010411 - DNA, 15 bp, Homo sapiens
ctgaaaaattccttt

SEQ ID NO: 3010412 - DNA, 14 bp, Homo sapiens
ctgaaaacatctgg

SEQ ID NO: 3010413 - DNA, 15 bp, Homo sapiens
ctgaaaacccagaga

SEQ ID NO: 3010414 - DNA, 20 bp, Homo sapiens
ctgaaaacctctcctcatgt

SEQ ID NO: 3010415 - DNA, 14 bp, Homo sapiens
ctgaaaagaaataa

SEQ ID NO: 3010416 - DNA, 16 bp, Homo sapiens
ctgaaaagaaataata

SEQ ID NO: 3010417 - DNA, 23 bp, Homo sapiens
ctgaaaagaacaaccctgaagca

SEQ ID NO: 3010418 - DNA, 13 bp, Homo sapiens
ctgaaaagagagc

SEQ ID NO: 3010419 - DNA, 13 bp, Homo sapiens
ctgaaaagcaaag

SEQ ID NO: 3010420 - DNA, 15 bp, Homo sapiens
ctgaaaatacatttc

SEQ ID NO: 3010421 - DNA, 16 bp, Homo sapiens
ctgaaacactgcttct

SEQ ID NO: 3010422 - DNA, 12 bp, Homo sapiens
ctgaaacagctg

SEQ ID NO: 3010423 - DNA, 18 bp, Homo sapiens
ctgaaacagctgccttag

SEQ ID NO: 3010424 - DNA, 19 bp, Homo sapiens
ctgaaacagctgccttagc

SEQ ID NO: 3010425 - DNA, 18 bp, Homo sapiens
ctgaaacctttaagaaaa

SEQ ID NO: 3010426 - DNA, 23 bp, Homo sapiens
ctgaaagaagaacagctgttcct

SEQ ID NO: 3010427 - DNA, 14 bp, Homo sapiens
ctgaaagcctgtct

SEQ ID NO: 3010428 - DNA, 17 bp, Homo sapiens
ctgaaaggaaagtgctt

SEQ ID NO: 3010429 - DNA, 20 bp, Homo sapiens
ctgaaaggatgtagaaacaa

SEQ ID NO: 3010430 - DNA, 20 bp, Homo sapiens
ctgaaagggcccttcccctc

SEQ ID NO: 3010431 - DNA, 23 bp, Homo sapiens
ctgaaagtgaaagtccagaaact

SEQ ID NO: 3010432 - DNA, 24 bp, Homo sapiens
ctgaaagttggggcccagtccttg

SEQ ID NO: 3010433 - DNA, 12 bp, Homo sapiens
ctgaaataaact

SEQ ID NO: 3010434 - DNA, 14 bp, Homo sapiens
ctgaaataaatgtt

SEQ ID NO: 3010435 - DNA, 15 bp, Homo sapiens
ctgaaataaatgttt

SEQ ID NO: 3010436 - DNA, 16 bp, Homo sapiens
ctgaaataggaaacaa

SEQ ID NO: 3010437 - DNA, 18 bp, Homo sapiens
ctgaaataggaaacaagt

SEQ ID NO: 3010438 - DNA, 16 bp, Homo sapiens
ctgaaatgccaagtgc

SEQ ID NO: 3010439 - DNA, 14 bp, Homo sapiens
ctgaaatgtttgga

SEQ ID NO: 3010440 - DNA, 20 bp, Homo sapiens
ctgaaattcacagaagccta

SEQ ID NO: 3010441 - DNA, 21 bp, Homo sapiens
ctgaacaataggctgttccca

SEQ ID NO: 3010442 - DNA, 22 bp, Homo sapiens
ctgaacacacaccagtttacag

SEQ ID NO: 3010443 - DNA, 22 bp, Homo sapiens
ctgaacaccataggtagaatgt

SEQ ID NO: 3010444 - DNA, 20 bp, Homo sapiens
ctgaacacttttgttgtaaa

SEQ ID NO: 3010445 - DNA, 17 bp, Homo sapiens
ctgaacagtgctctgcc

SEQ ID NO: 3010446 - DNA, 18 bp, Homo sapiens
ctgaacatcctaaatatt

SEQ ID NO: 3010447 - DNA, 19 bp, Homo sapiens
ctgaaccaaattgcactga

SEQ ID NO: 3010448 - DNA, 15 bp, Homo sapiens
ctgaaccccagaggc

SEQ ID NO: 3010449 - DNA, 17 bp, Homo sapiens
ctgaaccccagaggcag

SEQ ID NO: 3010450 - DNA, 19 bp, Homo sapiens
ctgaaccccagaggcagag

SEQ ID NO: 3010451 - DNA, 13 bp, Homo sapiens
ctgactctctgag

SEQ ID NO: 3010452 - DNA, 19 bp, Homo sapiens
ctgactgatgttgagggaa

SEQ ID NO: 3010453 - DNA, 14 bp, Homo sapiens
ctgactgcccagca

SEQ ID NO: 3010454 - DNA, 15 bp, Homo sapiens
ctgactgcccagcat

SEQ ID NO: 3010455 - DNA, 13 bp, Homo sapiens
ctgactgggctgg

SEQ ID NO: 3010456 - DNA, 23 bp, Homo sapiens
ctgactgtcagggagggccaggg

SEQ ID NO: 3010457 - DNA, 15 bp, Homo sapiens
ctgacttaacaactg

SEQ ID NO: 3010458 - DNA, 23 bp, Homo sapiens
ctgacttcatctcccacctagca

SEQ ID NO: 3010459 - DNA, 13 bp, Homo sapiens
ctgacttgagtgt

SEQ ID NO: 3010460 - DNA, 21 bp, Homo sapiens
ctgacttgagtgttccttttt

SEQ ID NO: 3010461 - DNA, 20 bp, Homo sapiens
ctgacttggggagatggagt

SEQ ID NO: 3010462 - DNA, 21 bp, Homo sapiens
ctgacttggggagatggagtt

SEQ ID NO: 3010463 - DNA, 18 bp, Homo sapiens
ctgactttttgtttcttt

SEQ ID NO: 3010464 - DNA, 12 bp, Homo sapiens
ctgagaaaacaa

SEQ ID NO: 3010465 - DNA, 14 bp, Homo sapiens
ctgagaaaacaagc

SEQ ID NO: 3010466 - DNA, 20 bp, Homo sapiens
ctgagaaacactatttgtga

SEQ ID NO: 3010467 - DNA, 17 bp, Homo sapiens
ctgagaaagcccacctg

SEQ ID NO: 3010468 - DNA, 21 bp, Homo sapiens
ctgagaaagcccacctgggct

SEQ ID NO: 3010469 - DNA, 22 bp, Homo sapiens
ctgagaaagcccacctgggctg

SEQ ID NO: 3010470 - DNA, 18 bp, Homo sapiens
ctgagaaagctaaagttt

SEQ ID NO: 3010471 - DNA, 20 bp, Homo sapiens
ctgagaaccataggactgtg

SEQ ID NO: 3010472 - DNA, 22 bp, Homo sapiens
ctgagaaccataggactgtggc

SEQ ID NO: 3010473 - DNA, 15 bp, Homo sapiens
ctgagaagaggagga

SEQ ID NO: 3010474 - DNA, 19 bp, Homo sapiens
ctgagaatttaatttttaa

SEQ ID NO: 3010475 - DNA, 13 bp, Homo sapiens
ctgagacccagga

SEQ ID NO: 3010476 - DNA, 17 bp, Homo sapiens
ctgagacccaggactcc

SEQ ID NO: 3010477 - DNA, 19 bp, Homo sapiens
ctgagacctctagagaaaa

SEQ ID NO: 3010478 - DNA, 14 bp, Homo sapiens
ctgagagaccatct

SEQ ID NO: 3010479 - DNA, 16 bp, Homo sapiens
ctgagagaccatctcc

SEQ ID NO: 3010480 - DNA, 20 bp, Homo sapiens
ctgagagaccatctcctatc

SEQ ID NO: 3010481 - DNA, 20 bp, Homo sapiens
ctgagagagaatagagctgc

SEQ ID NO: 3010482 - DNA, 21 bp, Homo sapiens
ctgagagagaatagagctgcc

SEQ ID NO: 3010483 - DNA, 21 bp, Homo sapiens
ctgagagaggccattctttcc

SEQ ID NO: 3010484 - DNA, 22 bp, Homo sapiens
ctgagagaggccattctttccc

SEQ ID NO: 3010485 - DNA, 17 bp, Homo sapiens
ctgagagcaaagtgacc

SEQ ID NO: 3010486 - DNA, 12 bp, Homo sapiens
ctgagaggctgc

SEQ ID NO: 3010487 - DNA, 17 bp, Homo sapiens
ctgagaggctgcctccg

SEQ ID NO: 3010488 - DNA, 15 bp, Homo sapiens
ctgagagtttagttg

SEQ ID NO: 3010489 - DNA, 14 bp, Homo sapiens
ctgagatcgtgcca

SEQ ID NO: 3010490 - DNA, 15 bp, Homo sapiens
ctgagatttcttaaa

SEQ ID NO: 3010491 - DNA, 21 bp, Homo sapiens
ctgagatttcttaaatctttc

SEQ ID NO: 3010492 - DNA, 17 bp, Homo sapiens
ctgagcacactttagtg

SEQ ID NO: 3010493 - DNA, 15 bp, Homo sapiens
ctgagcagtattagc

SEQ ID NO: 3010494 - DNA, 21 bp, Homo sapiens
ctgagcagtctacttctgtgt

SEQ ID NO: 3010495 - DNA, 16 bp, Homo sapiens
ctgagcattcaggcag

SEQ ID NO: 3010496 - DNA, 22 bp, Homo sapiens
ctgagcattcaggcagcactga

SEQ ID NO: 3010497 - DNA, 14 bp, Homo sapiens
ctgagccacactga

SEQ ID NO: 3010498 - DNA, 22 bp, Homo sapiens
ctgagccagattggccaattaa

SEQ ID NO: 3010499 - DNA, 11 bp, Homo sapiens
ctgagccaggc

SEQ ID NO: 3010500 - DNA, 12 bp, Homo sapiens
ctgagccaggct

SEQ ID NO: 3010501 - DNA, 14 bp, Homo sapiens
ctgagccaggctag

SEQ ID NO: 3010502 - DNA, 14 bp, Homo sapiens
ctgagcccctcaga

SEQ ID NO: 3010503 - DNA, 15 bp, Homo sapiens
ctgattcactgcatg

SEQ ID NO: 3010504 - DNA, 22 bp, Homo sapiens
ctgattcataataaatatctgt

SEQ ID NO: 3010505 - DNA, 15 bp, Homo sapiens
ctgattccatcctgt

SEQ ID NO: 3010506 - DNA, 19 bp, Homo sapiens
ctgattccatcctgtgtcc

SEQ ID NO: 3010507 - DNA, 17 bp, Homo sapiens
ctgattcgaatgacact

SEQ ID NO: 3010508 - DNA, 19 bp, Homo sapiens
ctgattcgaatgacactgt

SEQ ID NO: 3010509 - DNA, 18 bp, Homo sapiens
ctgattctgttgtgttca

SEQ ID NO: 3010510 - DNA, 22 bp, Homo sapiens
ctgattgtgccagtgcactccg

SEQ ID NO: 3010511 - DNA, 22 bp, Homo sapiens
ctgatttaaaaagtgagaaaga

SEQ ID NO: 3010512 - DNA, 24 bp, Homo sapiens
ctgatttaaaaagtgagaaagaaa

SEQ ID NO: 3010513 - DNA, 21 bp, Homo sapiens
ctgatttagcaatgctgtgaa

SEQ ID NO: 3010514 - DNA, 23 bp, Homo sapiens
ctgatttagcaatgctgtgaata

SEQ ID NO: 3010515 - DNA, 20 bp, Homo sapiens
ctgatttaggagaagccagg

SEQ ID NO: 3010516 - DNA, 13 bp, Homo sapiens
ctgatttcttcag

SEQ ID NO: 3010517 - DNA, 13 bp, Homo sapiens
ctgatttgagttt

SEQ ID NO: 3010518 - DNA, 22 bp, Homo sapiens
ctgatttgcaataaaaatgata

SEQ ID NO: 3010519 - DNA, 14 bp, Homo sapiens
ctgatttgcaggat

SEQ ID NO: 3010520 - DNA, 23 bp, Homo sapiens
ctgattttaaaaggttgactcaa

SEQ ID NO: 3010521 - DNA, 22 bp, Homo sapiens
ctgattttctccacaacactgt

SEQ ID NO: 3010522 - DNA, 23 bp, Homo sapiens
ctgattttctccacaacactgtg

SEQ ID NO: 3010523 - DNA, 11 bp, Homo sapiens
ctgatttttat

SEQ ID NO: 3010524 - DNA, 17 bp, Homo sapiens
ctgcaaaaggactctca

SEQ ID NO: 3010525 - DNA, 18 bp, Homo sapiens
ctgcaaaaggactctcag

SEQ ID NO: 3010526 - DNA, 17 bp, Homo sapiens
ctgcaaacgctgcctgc

SEQ ID NO: 3010527 - DNA, 18 bp, Homo sapiens
ctgcaaacgctgcctgcc

SEQ ID NO: 3010528 - DNA, 19 bp, Homo sapiens
ctgcaaacgctgcctgccc

SEQ ID NO: 3010529 - DNA, 23 bp, Homo sapiens
ctgcaaagatctgtcctcagcct

SEQ ID NO: 3010530 - DNA, 19 bp, Homo sapiens
ctgcaaatccttgtgggaa

SEQ ID NO: 3010531 - DNA, 20 bp, Homo sapiens
ctgcaacctccgccttccgg

SEQ ID NO: 3010532 - DNA, 15 bp, Homo sapiens
ctgcaacttctgcct

SEQ ID NO: 3010533 - DNA, 14 bp, Homo sapiens
ctgcaagcagaact

SEQ ID NO: 3010534 - DNA, 12 bp, Homo sapiens
ctgcaagggaca

SEQ ID NO: 3010535 - DNA, 17 bp, Homo sapiens
ctgcaagggacaggaag

SEQ ID NO: 3010536 - DNA, 17 bp, Homo sapiens
ctgcaagggcccagagt

SEQ ID NO: 3010537 - DNA, 20 bp, Homo sapiens
ctgcaaggtttaggctggtg

SEQ ID NO: 3010538 - DNA, 22 bp, Homo sapiens
ctgcaaggtttaggctggtggc

SEQ ID NO: 3010539 - DNA, 16 bp, Homo sapiens
ctgcaagtgtctggag

SEQ ID NO: 3010540 - DNA, 21 bp, Homo sapiens
ctgcaagtgtctggagcggct

SEQ ID NO: 3010541 - DNA, 16 bp, Homo sapiens
ctgcaatcactgtgct

SEQ ID NO: 3010542 - DNA, 16 bp, Homo sapiens
ctgcaatcctgtcttt

SEQ ID NO: 3010543 - DNA, 17 bp, Homo sapiens
ctgcaatgtttttgtgt

SEQ ID NO: 3010544 - DNA, 18 bp, Homo sapiens
ctgcaattcaaaagttcc

SEQ ID NO: 3010545 - DNA, 22 bp, Homo sapiens
ctgcaattcaaaagttccaaga

SEQ ID NO: 3010546 - DNA, 14 bp, Homo sapiens
ctgcacaataaaac

SEQ ID NO: 3010547 - DNA, 20 bp, Homo sapiens
ctgcacaataaaaccaagcc

SEQ ID NO: 3010548 - DNA, 22 bp, Homo sapiens
ctgcacaataaaaccaagcctc

SEQ ID NO: 3010549 - DNA, 21 bp, Homo sapiens
ctgcacagattcccaggccag

SEQ ID NO: 3010550 - DNA, 23 bp, Homo sapiens
ctgcacagattcccaggccaggg

SEQ ID NO: 3010551 - DNA, 22 bp, Homo sapiens
ctgcacagggtttggcccaagt

SEQ ID NO: 3010552 - DNA, 22 bp, Homo sapiens
ctgcacagtcagaaggacggca

SEQ ID NO: 3010553 - DNA, 15 bp, Homo sapiens
ctgcacagttgaagg

SEQ ID NO: 3010554 - DNA, 15 bp, Homo sapiens
ctgcacagtttagaa

SEQ ID NO: 3010555 - DNA, 16 bp, Homo sapiens
ctgcacagtttagaac

SEQ ID NO: 3010556 - DNA, 21 bp, Homo sapiens
ctgcacagtttagaacagagg

SEQ ID NO: 3010557 - DNA, 21 bp, Homo sapiens
ctgcacatgtcttgtacatgt

SEQ ID NO: 3010558 - DNA, 23 bp, Homo sapiens
ctgcacatgtcttgtacatgtgt

SEQ ID NO: 3010559 - DNA, 19 bp, Homo sapiens
ctgcaccaccatgcccagc

SEQ ID NO: 3010560 - DNA, 16 bp, Homo sapiens
ctgcaccattgctgct

SEQ ID NO: 3010561 - DNA, 14 bp, Homo sapiens
ctgcacccccctgg

SEQ ID NO: 3010562 - DNA, 15 bp, Homo sapiens
ctgcacccccctggg

SEQ ID NO: 3010563 - DNA, 16 bp, Homo sapiens
ctgcacccccctgggc

SEQ ID NO: 3010564 - DNA, 19 bp, Homo sapiens
ctgcaccgacccgaggccc

SEQ ID NO: 3010565 - DNA, 24 bp, Homo sapiens
ctgcaccgacccgaggcccagatc

SEQ ID NO: 3010566 - DNA, 15 bp, Homo sapiens
ctgcaccggacagtc

SEQ ID NO: 3010567 - DNA, 11 bp, Homo sapiens
ctgcacctccc

SEQ ID NO: 3010568 - DNA, 22 bp, Homo sapiens
ctgcacctccccccactgcagg

SEQ ID NO: 3010569 - DNA, 23 bp, Homo sapiens
ctgcacctggtgggtggtgtcct

SEQ ID NO: 3010570 - DNA, 15 bp, Homo sapiens
ctgcacgctcccctc

SEQ ID NO: 3010571 - DNA, 23 bp, Homo sapiens
ctgcctctgacagcagcctgtga

SEQ ID NO: 3010572 - DNA, 12 bp, Homo sapiens
ctgcctctgtgt

SEQ ID NO: 3010573 - DNA, 22 bp, Homo sapiens
ctgcctcttctcttgacagtct

SEQ ID NO: 3010574 - DNA, 16 bp, Homo sapiens
ctgcctcttctgggag

SEQ ID NO: 3010575 - DNA, 17 bp, Homo sapiens
ctgcctcttctgggagg

SEQ ID NO: 3010576 - DNA, 14 bp, Homo sapiens
ctgcctgcactccc

SEQ ID NO: 3010577 - DNA, 20 bp, Homo sapiens
ctgcctgcactccctggcct

SEQ ID NO: 3010578 - DNA, 15 bp, Homo sapiens
ctgcctgccagctgc

SEQ ID NO: 3010579 - DNA, 13 bp, Homo sapiens
ctgcctgcccaca

SEQ ID NO: 3010580 - DNA, 23 bp, Homo sapiens
ctgcctgccggtaaacacgcctg

SEQ ID NO: 3010581 - DNA, 13 bp, Homo sapiens
ctgcctgctgggc

SEQ ID NO: 3010582 - DNA, 15 bp, Homo sapiens
ctgcctgctgggctc

SEQ ID NO: 3010583 - DNA, 17 bp, Homo sapiens
ctgcctgctgggctctt

SEQ ID NO: 3010584 - DNA, 12 bp, Homo sapiens
ctgcctgctgtg

SEQ ID NO: 3010585 - DNA, 18 bp, Homo sapiens
ctgcctgctgtgctggga

SEQ ID NO: 3010586 - DNA, 18 bp, Homo sapiens
ctgcctggactagaggga

SEQ ID NO: 3010587 - DNA, 15 bp, Homo sapiens
ctgcctggagcaggg

SEQ ID NO: 3010588 - DNA, 17 bp, Homo sapiens
ctgcctggagcaggggt

SEQ ID NO: 3010589 - DNA, 12 bp, Homo sapiens
ctgcctggagcc

SEQ ID NO: 3010590 - DNA, 15 bp, Homo sapiens
ctgcctggagcccca

SEQ ID NO: 3010591 - DNA, 19 bp, Homo sapiens
ctgcctggagtgctgtgct

SEQ ID NO: 3010592 - DNA, 18 bp, Homo sapiens
ctgcctggccaggccctg

SEQ ID NO: 3010593 - DNA, 15 bp, Homo sapiens
ctgcctggccggcca

SEQ ID NO: 3010594 - DNA, 19 bp, Homo sapiens
ctgcctggccggccagcca

SEQ ID NO: 3010595 - DNA, 15 bp, Homo sapiens
ctgcctgggacactg

SEQ ID NO: 3010596 - DNA, 11 bp, Homo sapiens
ctgcctgggct

SEQ ID NO: 3010597 - DNA, 12 bp, Homo sapiens
ctgcctgggctg

SEQ ID NO: 3010598 - DNA, 12 bp, Homo sapiens
ctgcctgggtag

SEQ ID NO: 3010599 - DNA, 20 bp, Homo sapiens
ctgcctgggtaggccccaca

SEQ ID NO: 3010600 - DNA, 21 bp, Homo sapiens
ctgcctgggtaggccccacaa

SEQ ID NO: 3010601 - DNA, 23 bp, Homo sapiens
ctgcctgggtaggccccacaagg

SEQ ID NO: 3010602 - DNA, 12 bp, Homo sapiens
ctgcctgtctcc

SEQ ID NO: 3010603 - DNA, 22 bp, Homo sapiens
ctgcctgttaggagaagctgca

SEQ ID NO: 3010604 - DNA, 14 bp, Homo sapiens
ctgccttagcttca

SEQ ID NO: 3010605 - DNA, 20 bp, Homo sapiens
ctgccttcagagtatctaat

SEQ ID NO: 3010606 - DNA, 13 bp, Homo sapiens
ctgccttcctcct

SEQ ID NO: 3010607 - DNA, 14 bp, Homo sapiens
ctgccttcctcctg

SEQ ID NO: 3010608 - DNA, 14 bp, Homo sapiens
ctgccttggctcag

SEQ ID NO: 3010609 - DNA, 15 bp, Homo sapiens
ctgccttggctcaga

SEQ ID NO: 3010610 - DNA, 17 bp, Homo sapiens
ctgccttggctcagaca

SEQ ID NO: 3010611 - DNA, 19 bp, Homo sapiens
ctgcctttgatcacaggag

SEQ ID NO: 3010612 - DNA, 14 bp, Homo sapiens
ctgcctttgcacca

SEQ ID NO: 3010613 - DNA, 14 bp, Homo sapiens
ctgcctttgcctcc

SEQ ID NO: 3010614 - DNA, 20 bp, Homo sapiens
ctgcctttgtggtgggcgct

SEQ ID NO: 3010615 - DNA, 22 bp, Homo sapiens
ctgcctttgtggtgggcgctgg

SEQ ID NO: 3010616 - DNA, 15 bp, Homo sapiens
ctgccttttctagtt

SEQ ID NO: 3010617 - DNA, 12 bp, Homo sapiens
ctgcgaagtcct

SEQ ID NO: 3010618 - DNA, 14 bp, Homo sapiens
ctgcgaagtcctat

SEQ ID NO: 3010619 - DNA, 22 bp, Homo sapiens
ctgcgaccctgggggcacagga

SEQ ID NO: 3010620 - DNA, 16 bp, Homo sapiens
ctgcgcagggtggtgg

SEQ ID NO: 3010621 - DNA, 13 bp, Homo sapiens
ctgcgccaggcag

SEQ ID NO: 3010622 - DNA, 14 bp, Homo sapiens
ctgcgccaggcaga

SEQ ID NO: 3010623 - DNA, 17 bp, Homo sapiens
ctgcgccaggcagagct

SEQ ID NO: 3010624 - DNA, 19 bp, Homo sapiens
ctgcgccccgcctgacctg

SEQ ID NO: 3010625 - DNA, 17 bp, Homo sapiens
ctgcgctcggcaggaag

SEQ ID NO: 3010626 - DNA, 16 bp, Homo sapiens
ctgcgcttcctgagca

SEQ ID NO: 3010627 - DNA, 13 bp, Homo sapiens
ctgcgggacagag

SEQ ID NO: 3010628 - DNA, 18 bp, Homo sapiens
ctgcgggccacagggcaa

SEQ ID NO: 3010629 - DNA, 15 bp, Homo sapiens
ctgcgggctgagggc

SEQ ID NO: 3010630 - DNA, 20 bp, Homo sapiens
ctgcgggctgagggcatctc

SEQ ID NO: 3010631 - DNA, 15 bp, Homo sapiens
ctgcgggtcctcagc

SEQ ID NO: 3010632 - DNA, 17 bp, Homo sapiens
ctgcgggtcctcagctg

SEQ ID NO: 3010633 - DNA, 14 bp, Homo sapiens
ctgcggtgggcagc

SEQ ID NO: 3010634 - DNA, 16 bp, Homo sapiens
ctgcggtgggcagcca

SEQ ID NO: 3010635 - DNA, 15 bp, Homo sapiens
ctgcgtccaccaggc

SEQ ID NO: 3010636 - DNA, 16 bp, Homo sapiens
ctgcgtccaccaggcc

SEQ ID NO: 3010637 - DNA, 22 bp, Homo sapiens
ctgcgtccaccaggcctcactg

SEQ ID NO: 3010638 - DNA, 19 bp, Homo sapiens
ctgcgtgacaataaaacat

SEQ ID NO: 3010639 - DNA, 16 bp, Homo sapiens
ctgcgtgcccctgctg

SEQ ID NO: 3010640 - DNA, 16 bp, Homo sapiens
ctgctaaaataaacct

SEQ ID NO: 3010641 - DNA, 12 bp, Homo sapiens
ctgctaaataaa

SEQ ID NO: 3010642 - DNA, 15 bp, Homo sapiens
ctgctaaataaaatt

SEQ ID NO: 3010643 - DNA, 14 bp, Homo sapiens
ctgctaaatgcact

SEQ ID NO: 3010644 - DNA, 18 bp, Homo sapiens
ctgctaactctgttattc

SEQ ID NO: 3010645 - DNA, 19 bp, Homo sapiens
ctgctacaaagaagacatg

SEQ ID NO: 3010646 - DNA, 20 bp, Homo sapiens
ctgctacaaagaagacatgt

SEQ ID NO: 3010647 - DNA, 13 bp, Homo sapiens
ctgctacatgtgc

SEQ ID NO: 3010648 - DNA, 20 bp, Homo sapiens
ctgctacctttcaaagcttg

SEQ ID NO: 3010649 - DNA, 15 bp, Homo sapiens
ctgctactagctctt

SEQ ID NO: 3010650 - DNA, 17 bp, Homo sapiens
ctgctacttgctctgct

SEQ ID NO: 3010651 - DNA, 14 bp, Homo sapiens
ctgctagagcagac

SEQ ID NO: 3010652 - DNA, 16 bp, Homo sapiens
ctgctagagcagacag

SEQ ID NO: 3010653 - DNA, 23 bp, Homo sapiens
ctgctaggggaaggactggccgt

SEQ ID NO: 3010654 - DNA, 18 bp, Homo sapiens
ctgctataaagttaaagt

SEQ ID NO: 3010655 - DNA, 17 bp, Homo sapiens
ctgctatttcaggccct

SEQ ID NO: 3010656 - DNA, 24 bp, Homo sapiens
ctgctatttcaggccctcagctgt

SEQ ID NO: 3010657 - DNA, 19 bp, Homo sapiens
ctgctgcctcagctcagct

SEQ ID NO: 3010658 - DNA, 12 bp, Homo sapiens
ctgctgcctggg

SEQ ID NO: 3010659 - DNA, 23 bp, Homo sapiens
ctgctgcctgggtaggccccaca

SEQ ID NO: 3010660 - DNA, 15 bp, Homo sapiens
ctgctgcctgtacag

SEQ ID NO: 3010661 - DNA, 22 bp, Homo sapiens
ctgctgctcattccacactgtt

SEQ ID NO: 3010662 - DNA, 12 bp, Homo sapiens
ctgctgctcccc

SEQ ID NO: 3010663 - DNA, 19 bp, Homo sapiens
ctgctgctccccaccccta

SEQ ID NO: 3010664 - DNA, 14 bp, Homo sapiens
ctgctgctgcccgg

SEQ ID NO: 3010665 - DNA, 14 bp, Homo sapiens
ctgctgctgctcat

SEQ ID NO: 3010666 - DNA, 15 bp, Homo sapiens
ctgctgctgtcacct

SEQ ID NO: 3010667 - DNA, 17 bp, Homo sapiens
ctgctgctgtgcttttg

SEQ ID NO: 3010668 - DNA, 17 bp, Homo sapiens
ctgctgcttcctaactt

SEQ ID NO: 3010669 - DNA, 23 bp, Homo sapiens
ctgctgctttgttgttctgcctg

SEQ ID NO: 3010670 - DNA, 21 bp, Homo sapiens
ctgctggagtttcatgtacaa

SEQ ID NO: 3010671 - DNA, 15 bp, Homo sapiens
ctgctggcctccctc

SEQ ID NO: 3010672 - DNA, 11 bp, Homo sapiens
ctgctggctca

SEQ ID NO: 3010673 - DNA, 16 bp, Homo sapiens
ctgctggctcacgccc

SEQ ID NO: 3010674 - DNA, 19 bp, Homo sapiens
ctgctgggatggtgggctt

SEQ ID NO: 3010675 - DNA, 14 bp, Homo sapiens
ctgctgggctctcc

SEQ ID NO: 3010676 - DNA, 17 bp, Homo sapiens
ctgctggggcctcagac

SEQ ID NO: 3010677 - DNA, 14 bp, Homo sapiens
ctgctggggctggt

SEQ ID NO: 3010678 - DNA, 20 bp, Homo sapiens
ctgctgggggcaactggcca

SEQ ID NO: 3010679 - DNA, 21 bp, Homo sapiens
ctgctgggggctccccttgcc

SEQ ID NO: 3010680 - DNA, 23 bp, Homo sapiens
ctgctgggggctccccttgccct

SEQ ID NO: 3010681 - DNA, 18 bp, Homo sapiens
ctgctggggtctcaggtc

SEQ ID NO: 3010682 - DNA, 17 bp, Homo sapiens
ctgctggtctctggctc

SEQ ID NO: 3010683 - DNA, 20 bp, Homo sapiens
ctgctggtctctggctctac

SEQ ID NO: 3010684 - DNA, 15 bp, Homo sapiens
ctgctggtgcacagc

SEQ ID NO: 3010685 - DNA, 15 bp, Homo sapiens
ctgctgtcacctctc

SEQ ID NO: 3010686 - DNA, 16 bp, Homo sapiens
ctgctgtcacctctcc

SEQ ID NO: 3010687 - DNA, 20 bp, Homo sapiens
ctgctgtcacctctcccacg

SEQ ID NO: 3010688 - DNA, 21 bp, Homo sapiens
ctgctgtcacctctcccacgg

SEQ ID NO: 3010689 - DNA, 15 bp, Homo sapiens
ctgctgtcctggtgg

SEQ ID NO: 3010690 - DNA, 20 bp, Homo sapiens
ctgctgtcctggtggctggg

SEQ ID NO: 3010691 - DNA, 19 bp, Homo sapiens
ctgctgtctctctgggctg

SEQ ID NO: 3010692 - DNA, 21 bp, Homo sapiens
ctgctgtctcttaaatctctt

SEQ ID NO: 3010693 - DNA, 21 bp, Homo sapiens
ctgctgtgcgtggaaaaagac

SEQ ID NO: 3010694 - DNA, 13 bp, Homo sapiens
ctgctgtggaaag

SEQ ID NO: 3010695 - DNA, 13 bp, Homo sapiens
ctgctgtggagcc

SEQ ID NO: 3010696 - DNA, 14 bp, Homo sapiens
ctgctgttgaactt

SEQ ID NO: 3010697 - DNA, 16 bp, Homo sapiens
ctgctgttgaactttt

SEQ ID NO: 3010698 - DNA, 17 bp, Homo sapiens
ctgctgttgaacttttt

SEQ ID NO: 3010699 - DNA, 13 bp, Homo sapiens
ctgcttaattcaa

SEQ ID NO: 3010700 - DNA, 20 bp, Homo sapiens
ctgcttagaacccttctgct

SEQ ID NO: 3010701 - DNA, 23 bp, Homo sapiens
ctgcttagaacccttctgctttc

SEQ ID NO: 3010702 - DNA, 13 bp, Homo sapiens
ctgcttatctgaa

SEQ ID NO: 3010703 - DNA, 17 bp, Homo sapiens
ctgcttatctgaaactt

SEQ ID NO: 3010704 - DNA, 23 bp, Homo sapiens
ctgcttatgatgggctccccagg

SEQ ID NO: 3010705 - DNA, 18 bp, Homo sapiens
ctgcttcaccagactttt

SEQ ID NO: 3010706 - DNA, 13 bp, Homo sapiens
ctgcttcatatct

SEQ ID NO: 3010707 - DNA, 14 bp, Homo sapiens
ctgcttcatatctc

SEQ ID NO: 3010708 - DNA, 13 bp, Homo sapiens
ctgcttccatggc

SEQ ID NO: 3010709 - DNA, 23 bp, Homo sapiens
ctgcttcccaggttcaagcgatt

SEQ ID NO: 3010710 - DNA, 16 bp, Homo sapiens
ctgcttctcggccagc

SEQ ID NO: 3010711 - DNA, 23 bp, Homo sapiens
ctgcttctcggggtccagtgcat

SEQ ID NO: 3010712 - DNA, 17 bp, Homo sapiens
ctgcttgacaacatctg

SEQ ID NO: 3010713 - DNA, 20 bp, Homo sapiens
ctgcttgagaatattgaagt

SEQ ID NO: 3010714 - DNA, 20 bp, Homo sapiens
ctgcttgagctcaggagttc

SEQ ID NO: 3010715 - DNA, 14 bp, Homo sapiens
ctgcttgaggaaaa

SEQ ID NO: 3010716 - DNA, 23 bp, Homo sapiens
ctgcttgatgggattctggacag

SEQ ID NO: 3010717 - DNA, 14 bp, Homo sapiens
ctgcttgcagccag

SEQ ID NO: 3010718 - DNA, 15 bp, Homo sapiens
ctgcttgcagccagg

SEQ ID NO: 3010719 - DNA, 17 bp, Homo sapiens
ctgcttgcagccaggag

SEQ ID NO: 3010720 - DNA, 12 bp, Homo sapiens
ctgcttggccag

SEQ ID NO: 3010721 - DNA, 16 bp, Homo sapiens
ctgcttggccagatgc

SEQ ID NO: 3010722 - DNA, 14 bp, Homo sapiens
ctgcttgggtggag

SEQ ID NO: 3010723 - DNA, 21 bp, Homo sapiens
ctgcttgggtggagaagccat

SEQ ID NO: 3010724 - DNA, 23 bp, Homo sapiens
ctgcttgggttcctttttcaact

SEQ ID NO: 3010725 - DNA, 19 bp, Homo sapiens
ctgcttgtactaagccagg

SEQ ID NO: 3010726 - DNA, 20 bp, Homo sapiens
ctgcttgtactaagccagga

SEQ ID NO: 3010727 - DNA, 16 bp, Homo sapiens
ctgcttgtgcctccct

SEQ ID NO: 3010728 - DNA, 12 bp, Homo sapiens
ctgctttaaatt

SEQ ID NO: 3010729 - DNA, 17 bp, Homo sapiens
ctgctttaaattaaaat

SEQ ID NO: 3010730 - DNA, 16 bp, Homo sapiens
ctgctttagagctagg

SEQ ID NO: 3010731 - DNA, 17 bp, Homo sapiens
ctgctttccaaagccaa

SEQ ID NO: 3010732 - DNA, 20 bp, Homo sapiens
ctgctttctattacccctca

SEQ ID NO: 3010733 - DNA, 21 bp, Homo sapiens
ctgctttctattacccctcat

SEQ ID NO: 3010734 - DNA, 22 bp, Homo sapiens
ctgctttctccattgtaaacca

SEQ ID NO: 3010735 - DNA, 12 bp, Homo sapiens
ctgctttctccc

SEQ ID NO: 3010736 - DNA, 13 bp, Homo sapiens
ctgctttctcttt

SEQ ID NO: 3010737 - DNA, 18 bp, Homo sapiens
ctgctttctctttcagta

SEQ ID NO: 3010738 - DNA, 11 bp, Homo sapiens
ctgctttctgt

SEQ ID NO: 3010739 - DNA, 19 bp, Homo sapiens
ctgctttgacgggccaggc

SEQ ID NO: 3010740 - DNA, 21 bp, Homo sapiens
ctgctttgacgggccaggccc

SEQ ID NO: 3010741 - DNA, 22 bp, Homo sapiens
ctgctttgacgggccaggccct

SEQ ID NO: 3010742 - DNA, 24 bp, Homo sapiens
ctgctttgacgggccaggccctgg

SEQ ID NO: 3010743 - DNA, 21 bp, Homo sapiens
ctgctttgttgttctgcctgt

SEQ ID NO: 3010744 - DNA, 21 bp, Homo sapiens
ctgcttttccttggggcaggc

SEQ ID NO: 3010745 - DNA, 21 bp, Homo sapiens
ctggaaaaatgaactgtatta

SEQ ID NO: 3010746 - DNA, 22 bp, Homo sapiens
ctggaaaagggtcttgggaaat

SEQ ID NO: 3010747 - DNA, 20 bp, Homo sapiens
ctggaaaataatactgctga

SEQ ID NO: 3010748 - DNA, 23 bp, Homo sapiens
ctggaaaataatactgctgagat

SEQ ID NO: 3010749 - DNA, 19 bp, Homo sapiens
ctggaaaatctgtaaaaaa

SEQ ID NO: 3010750 - DNA, 19 bp, Homo sapiens
ctggaaacattcaggagct

SEQ ID NO: 3010751 - DNA, 14 bp, Homo sapiens
ctggacagcttgtg

SEQ ID NO: 3010752 - DNA, 16 bp, Homo sapiens
ctggacagtcagctct

SEQ ID NO: 3010753 - DNA, 18 bp, Homo sapiens
ctggacatagagagggag

SEQ ID NO: 3010754 - DNA, 23 bp, Homo sapiens
ctggacatgaagattctttccca

SEQ ID NO: 3010755 - DNA, 15 bp, Homo sapiens
ctggaccaaggagca

SEQ ID NO: 3010756 - DNA, 15 bp, Homo sapiens
ctggaccaggtcctg

SEQ ID NO: 3010757 - DNA, 19 bp, Homo sapiens
ctggacctagggtggcctg

SEQ ID NO: 3010758 - DNA, 18 bp, Homo sapiens
ctggaccttgacagagca

SEQ ID NO: 3010759 - DNA, 19 bp, Homo sapiens
ctggacgaagagcaggcca

SEQ ID NO: 3010760 - DNA, 16 bp, Homo sapiens
ctggacgtgaaatact

SEQ ID NO: 3010761 - DNA, 20 bp, Homo sapiens
ctggactagagggacctctc

SEQ ID NO: 3010762 - DNA, 15 bp, Homo sapiens
ctggactagggcctc

SEQ ID NO: 3010763 - DNA, 16 bp, Homo sapiens
ctggactagggcctcg

SEQ ID NO: 3010764 - DNA, 13 bp, Homo sapiens
ctggactccggcc

SEQ ID NO: 3010765 - DNA, 24 bp, Homo sapiens
ctggactcctgccaccagcatcca

SEQ ID NO: 3010766 - DNA, 17 bp, Homo sapiens
ctggactctcagtctct

SEQ ID NO: 3010767 - DNA, 12 bp, Homo sapiens
ctggactggtta

SEQ ID NO: 3010768 - DNA, 18 bp, Homo sapiens
ctggactggttatcttgt

SEQ ID NO: 3010769 - DNA, 19 bp, Homo sapiens
ctggactggttatcttgtt

SEQ ID NO: 3010770 - DNA, 15 bp, Homo sapiens
ctggacttggtacag

SEQ ID NO: 3010771 - DNA, 23 bp, Homo sapiens
ctggacttggtacagttgcagga

SEQ ID NO: 3010772 - DNA, 21 bp, Homo sapiens
ctggagaagcagtgagccgca

SEQ ID NO: 3010773 - DNA, 19 bp, Homo sapiens
ctggagcaatcacagatga

SEQ ID NO: 3010774 - DNA, 15 bp, Homo sapiens
ctggagcaccaggca

SEQ ID NO: 3010775 - DNA, 16 bp, Homo sapiens
ctggagccacaggcag

SEQ ID NO: 3010776 - DNA, 16 bp, Homo sapiens
ctggagccccactgcc

SEQ ID NO: 3010777 - DNA, 17 bp, Homo sapiens
ctggagcccctcctccc

SEQ ID NO: 3010778 - DNA, 18 bp, Homo sapiens
ctggagcccctcctcccc

SEQ ID NO: 3010779 - DNA, 21 bp, Homo sapiens
ctggagcccctcctcccccgg

SEQ ID NO: 3010780 - DNA, 16 bp, Homo sapiens
ctggagccctgttcct

SEQ ID NO: 3010781 - DNA, 13 bp, Homo sapiens
ctggagcggctgc

SEQ ID NO: 3010782 - DNA, 15 bp, Homo sapiens
ctggagcggctgctc

SEQ ID NO: 3010783 - DNA, 20 bp, Homo sapiens
ctggagcgtttgctgtgcca

SEQ ID NO: 3010784 - DNA, 21 bp, Homo sapiens
ctggagcgtttgctgtgccag

SEQ ID NO: 3010785 - DNA, 15 bp, Homo sapiens
ctggagctctgtggg

SEQ ID NO: 3010786 - DNA, 16 bp, Homo sapiens
ctggagctctgtgggt

SEQ ID NO: 3010787 - DNA, 14 bp, Homo sapiens
ctggagctgggagg

SEQ ID NO: 3010788 - DNA, 12 bp, Homo sapiens
ctggaggcaggg

SEQ ID NO: 3010789 - DNA, 16 bp, Homo sapiens
ctggaggcagggcctt

SEQ ID NO: 3010790 - DNA, 23 bp, Homo sapiens
ctggaggcagggccttgcccaga

SEQ ID NO: 3010791 - DNA, 12 bp, Homo sapiens
ctggaggcccag

SEQ ID NO: 3010792 - DNA, 17 bp, Homo sapiens
ctggaggcccaggctgg

SEQ ID NO: 3010793 - DNA, 13 bp, Homo sapiens
ctggaggcccagt

SEQ ID NO: 3010794 - DNA, 21 bp, Homo sapiens
ctggaggcccagttcaccctg

SEQ ID NO: 3010795 - DNA, 19 bp, Homo sapiens
ctggaggctcagcccaccc

SEQ ID NO: 3010796 - DNA, 13 bp, Homo sapiens
ctggagggcagag

SEQ ID NO: 3010797 - DNA, 14 bp, Homo sapiens
ctggagggcagaga

SEQ ID NO: 3010798 - DNA, 15 bp, Homo sapiens
ctggagggcgcccag

SEQ ID NO: 3010799 - DNA, 15 bp, Homo sapiens
ctggagggggagcac

SEQ ID NO: 3010800 - DNA, 16 bp, Homo sapiens
ctggaggtcgaagcaa

SEQ ID NO: 3010801 - DNA, 12 bp, Homo sapiens
ctggaggtgctg

SEQ ID NO: 3010802 - DNA, 20 bp, Homo sapiens
ctggaggtggctgagcccct

SEQ ID NO: 3010803 - DNA, 18 bp, Homo sapiens
ctggaggttgataacttt

SEQ ID NO: 3010804 - DNA, 13 bp, Homo sapiens
ctggagtactttt

SEQ ID NO: 3010805 - DNA, 22 bp, Homo sapiens
ctggagtcatgtgcctctgtcc

SEQ ID NO: 3010806 - DNA, 19 bp, Homo sapiens
ctggagtgctgcttgtgcc

SEQ ID NO: 3010807 - DNA, 13 bp, Homo sapiens
ctggagtggccac

SEQ ID NO: 3010808 - DNA, 21 bp, Homo sapiens
ctggagtggctcgccaggcca

SEQ ID NO: 3010809 - DNA, 16 bp, Homo sapiens
ctggagttgatctgga

SEQ ID NO: 3010810 - DNA, 13 bp, Homo sapiens
ctggagttgtcac

SEQ ID NO: 3010811 - DNA, 12 bp, Homo sapiens
ctggataaaaaa

SEQ ID NO: 3010812 - DNA, 16 bp, Homo sapiens
ctggataaaaaagaaa

SEQ ID NO: 3010813 - DNA, 16 bp, Homo sapiens
ctggatataaattaat

SEQ ID NO: 3010814 - DNA, 19 bp, Homo sapiens
ctggatataaattaattgt

SEQ ID NO: 3010815 - DNA, 19 bp, Homo sapiens
ctggatctagaagggacca

SEQ ID NO: 3010816 - DNA, 15 bp, Homo sapiens
ctggatgtctgccaa

SEQ ID NO: 3010817 - DNA, 21 bp, Homo sapiens
ctggattccccatctcaggcc

SEQ ID NO: 3010818 - DNA, 17 bp, Homo sapiens
ctggatttgcagaagtt

SEQ ID NO: 3010819 - DNA, 20 bp, Homo sapiens
ctggattttcagcgaacatg

SEQ ID NO: 3010820 - DNA, 19 bp, Homo sapiens
ctggcaaaaggatctttgt

SEQ ID NO: 3010821 - DNA, 20 bp, Homo sapiens
ctggcaaaaggatctttgtg

SEQ ID NO: 3010822 - DNA, 21 bp, Homo sapiens
ctggcaaaaggatctttgtgg

SEQ ID NO: 3010823 - DNA, 23 bp, Homo sapiens
ctggcaaaaggatctttgtggcc

SEQ ID NO: 3010824 - DNA, 13 bp, Homo sapiens
ctggcagaaggga

SEQ ID NO: 3010825 - DNA, 12 bp, Homo sapiens
ctggcagacaca

SEQ ID NO: 3010826 - DNA, 13 bp, Homo sapiens
ctggcagacacaa

SEQ ID NO: 3010827 - DNA, 19 bp, Homo sapiens
ctggcagcaaactgctgcc

SEQ ID NO: 3010828 - DNA, 15 bp, Homo sapiens
ctggcagcagagtgt

SEQ ID NO: 3010829 - DNA, 13 bp, Homo sapiens
ctggcagccccag

SEQ ID NO: 3010830 - DNA, 16 bp, Homo sapiens
ctggcagccccagcac

SEQ ID NO: 3010831 - DNA, 12 bp, Homo sapiens
ctggcagcctcc

SEQ ID NO: 3010832 - DNA, 12 bp, Homo sapiens
ctggcagcctgc

SEQ ID NO: 3010833 - DNA, 19 bp, Homo sapiens
ctggcagcctgcacctggt

SEQ ID NO: 3010834 - DNA, 18 bp, Homo sapiens
ctggcagctctggacagc

SEQ ID NO: 3010835 - DNA, 20 bp, Homo sapiens
ctggcagctctggacagccc

SEQ ID NO: 3010836 - DNA, 18 bp, Homo sapiens
ctggcaggcaggctccca

SEQ ID NO: 3010837 - DNA, 17 bp, Homo sapiens
ctggcagggtgggatgg

SEQ ID NO: 3010838 - DNA, 19 bp, Homo sapiens
ctggcagtgctgagggacc

SEQ ID NO: 3010839 - DNA, 22 bp, Homo sapiens
ctggcagtgctgagggaccgag

SEQ ID NO: 3010840 - DNA, 15 bp, Homo sapiens
ctggcagttttccat

SEQ ID NO: 3010841 - DNA, 14 bp, Homo sapiens
ctggcatctgtgcg

SEQ ID NO: 3010842 - DNA, 14 bp, Homo sapiens
ctggcatctgtgtg

SEQ ID NO: 3010843 - DNA, 16 bp, Homo sapiens
ctggcatctgtgtgcg

SEQ ID NO: 3010844 - DNA, 18 bp, Homo sapiens
ctggcatgatccaagcaa

SEQ ID NO: 3010845 - DNA, 22 bp, Homo sapiens
ctggcattactcagcaggagcc

SEQ ID NO: 3010846 - DNA, 19 bp, Homo sapiens
ctggcattatgtccactgt

SEQ ID NO: 3010847 - DNA, 18 bp, Homo sapiens
ctggcattctacacctgg

SEQ ID NO: 3010848 - DNA, 19 bp, Homo sapiens
ctggcattctacacctgga

SEQ ID NO: 3010849 - DNA, 17 bp, Homo sapiens
ctggccaacatggtaaa

SEQ ID NO: 3010850 - DNA, 12 bp, Homo sapiens
ctggccaccacc

SEQ ID NO: 3010851 - DNA, 19 bp, Homo sapiens
ctggccaccacccaacctg

SEQ ID NO: 3010852 - DNA, 16 bp, Homo sapiens
ctggccagatttcctc

SEQ ID NO: 3010853 - DNA, 19 bp, Homo sapiens
ctggccagccgctctcctg

SEQ ID NO: 3010854 - DNA, 20 bp, Homo sapiens
ctggccagccgctctcctgc

SEQ ID NO: 3010855 - DNA, 14 bp, Homo sapiens
ctgggtgccctgaa

SEQ ID NO: 3010856 - DNA, 16 bp, Homo sapiens
ctgggtggagggagac

SEQ ID NO: 3010857 - DNA, 19 bp, Homo sapiens
ctgggtggatgtgagcaga

SEQ ID NO: 3010858 - DNA, 20 bp, Homo sapiens
ctgggtggggctgctcctcc

SEQ ID NO: 3010859 - DNA, 21 bp, Homo sapiens
ctgggtggggctgctcctcca

SEQ ID NO: 3010860 - DNA, 21 bp, Homo sapiens
ctgggtggtctgcaggcaggg

SEQ ID NO: 3010861 - DNA, 19 bp, Homo sapiens
ctgggtgttgaccactcca

SEQ ID NO: 3010862 - DNA, 13 bp, Homo sapiens
ctgggtttgctgt

SEQ ID NO: 3010863 - DNA, 14 bp, Homo sapiens
ctgggtttggccca

SEQ ID NO: 3010864 - DNA, 13 bp, Homo sapiens
ctgtagattctgt

SEQ ID NO: 3010865 - DNA, 18 bp, Homo sapiens
ctgtgctcaggactcaga

SEQ ID NO: 3010866 - DNA, 23 bp, Homo sapiens
ctgtgctcaggactcagaagcct

SEQ ID NO: 3010867 - DNA, 13 bp, Homo sapiens
ctgtgctggagcc

SEQ ID NO: 3010868 - DNA, 18 bp, Homo sapiens
ctgtgctgtgtttaatca

SEQ ID NO: 3010869 - DNA, 17 bp, Homo sapiens
ctgtgcttcgggccctt

SEQ ID NO: 3010870 - DNA, 22 bp, Homo sapiens
ctgtggaaaagaaacacgcact

SEQ ID NO: 3010871 - DNA, 22 bp, Homo sapiens
ctgtggaaaagccatctcaggt

SEQ ID NO: 3010872 - DNA, 16 bp, Homo sapiens
ctgtggaaagtgtaaa

SEQ ID NO: 3010873 - DNA, 21 bp, Homo sapiens
ctgtggacaggatgaggacag

SEQ ID NO: 3010874 - DNA, 22 bp, Homo sapiens
ctgtggacaggatgaggacaga

SEQ ID NO: 3010875 - DNA, 15 bp, Homo sapiens
ctgtggagactttct

SEQ ID NO: 3010876 - DNA, 22 bp, Homo sapiens
ctgtggaggtacactcttatag

SEQ ID NO: 3010877 - DNA, 12 bp, Homo sapiens
ctgttctaaagc

SEQ ID NO: 3010878 - DNA, 16 bp, Homo sapiens
ctgttctaacatgtaa

SEQ ID NO: 3010879 - DNA, 23 bp, Homo sapiens
ctgttctactcttaatgatgtta

SEQ ID NO: 3010880 - DNA, 15 bp, Homo sapiens
ctgttctcattcctg

SEQ ID NO: 3010881 - DNA, 16 bp, Homo sapiens
ctgttctcattcctgt

SEQ ID NO: 3010882 - DNA, 20 bp, Homo sapiens
ctgttctcattcctgttctt

SEQ ID NO: 3010883 - DNA, 15 bp, Homo sapiens
ctgttctcgttgccc

SEQ ID NO: 3010884 - DNA, 18 bp, Homo sapiens
ctgttctcgttgccctaa

SEQ ID NO: 3010885 - DNA, 18 bp, Homo sapiens
ctgttctgccccctcagg

SEQ ID NO: 3010886 - DNA, 18 bp, Homo sapiens
ctgttctgtagctttctg

SEQ ID NO: 3010887 - DNA, 12 bp, Homo sapiens
ctgttctgtgac

SEQ ID NO: 3010888 - DNA, 20 bp, Homo sapiens
ctgttctgtggaaagtgtaa

SEQ ID NO: 3010889 - DNA, 23 bp, Homo sapiens
ctgttctgtggaaagtgtaaagc

SEQ ID NO: 3010890 - DNA, 12 bp, Homo sapiens
ctgttgaaagca

SEQ ID NO: 3010891 - DNA, 15 bp, Homo sapiens
ctgttgaaagcaaaa

SEQ ID NO: 3010892 - DNA, 22 bp, Homo sapiens
ctgttgacacaggtctttccta

SEQ ID NO: 3010893 - DNA, 15 bp, Homo sapiens
ctgttgactggctgt

SEQ ID NO: 3010894 - DNA, 21 bp, Homo sapiens
ctgttgataattcttattttg

SEQ ID NO: 3010895 - DNA, 17 bp, Homo sapiens
ctgttgattgctaaatg

SEQ ID NO: 3010896 - DNA, 15 bp, Homo sapiens
ctgttgcacttttga

SEQ ID NO: 3010897 - DNA, 16 bp, Homo sapiens
ctgttgcacttttgaa

SEQ ID NO: 3010898 - DNA, 18 bp, Homo sapiens
ctgttgcacttttgaatg

SEQ ID NO: 3010899 - DNA, 23 bp, Homo sapiens
cttacaatttttttaattttgta

SEQ ID NO: 3010900 - DNA, 21 bp, Homo sapiens
cttacacaaatctatttaatt

SEQ ID NO: 3010901 - DNA, 16 bp, Homo sapiens
cttacagcctctgact

SEQ ID NO: 3010902 - DNA, 19 bp, Homo sapiens
cttacatactaggtgcctt

SEQ ID NO: 3010903 - DNA, 12 bp, Homo sapiens
cttacattaaaa

SEQ ID NO: 3010904 - DNA, 15 bp, Homo sapiens
cttacattgtgaaac

SEQ ID NO: 3010905 - DNA, 16 bp, Homo sapiens
cttaccaatagcaggg

SEQ ID NO: 3010906 - DNA, 19 bp, Homo sapiens
cttaccaggttcacttaaa

SEQ ID NO: 3010907 - DNA, 19 bp, Homo sapiens
cttacccatcttgcttcca

SEQ ID NO: 3010908 - DNA, 13 bp, Homo sapiens
cttacccctgcct

SEQ ID NO: 3010909 - DNA, 15 bp, Homo sapiens
cttaccgccctgcgg

SEQ ID NO: 3010910 - DNA, 20 bp, Homo sapiens
cttaccgtgagcgacaaaga

SEQ ID NO: 3010911 - DNA, 14 bp, Homo sapiens
cttacctcctgccc

SEQ ID NO: 3010912 - DNA, 16 bp, Homo sapiens
cttacctcctgcccag

SEQ ID NO: 3010913 - DNA, 17 bp, Homo sapiens
cttacctcctgcccagg

SEQ ID NO: 3010914 - DNA, 18 bp, Homo sapiens
cttacctcctgcccagga

SEQ ID NO: 3010915 - DNA, 19 bp, Homo sapiens
cttacctcctgcccaggag

SEQ ID NO: 3010916 - DNA, 12 bp, Homo sapiens
cttaccttgttt

SEQ ID NO: 3010917 - DNA, 23 bp, Homo sapiens
cttacgaatacttttgccctttg

SEQ ID NO: 3010918 - DNA, 12 bp, Homo sapiens
cttactattccc

SEQ ID NO: 3010919 - DNA, 21 bp, Homo sapiens
cttactattcccactttcatt

SEQ ID NO: 3010920 - DNA, 13 bp, Homo sapiens
cttactcagagct

SEQ ID NO: 3010921 - DNA, 15 bp, Homo sapiens
cttactcagagctgc

SEQ ID NO: 3010922 - DNA, 16 bp, Homo sapiens
cttactcagagctgcg

SEQ ID NO: 3010923 - DNA, 13 bp, Homo sapiens
cttactcagggga

SEQ ID NO: 3010924 - DNA, 12 bp, Homo sapiens
cttactctaaga

SEQ ID NO: 3010925 - DNA, 13 bp, Homo sapiens
cttactctaagat

SEQ ID NO: 3010926 - DNA, 20 bp, Homo sapiens
cttactctaagatcttagat

SEQ ID NO: 3010927 - DNA, 18 bp, Homo sapiens
cttactgctgaccttttt

SEQ ID NO: 3010928 - DNA, 17 bp, Homo sapiens
cttactgtaagacatta

SEQ ID NO: 3010929 - DNA, 20 bp, Homo sapiens
cttattgtgtgcgctgcctg

SEQ ID NO: 3010930 - DNA, 22 bp, Homo sapiens
cttattgtgtgcgctgcctggc

SEQ ID NO: 3010931 - DNA, 23 bp, Homo sapiens
cttattgtgtgcgctgcctggcc

SEQ ID NO: 3010932 - DNA, 15 bp, Homo sapiens
cttatttaaaaatat

SEQ ID NO: 3010933 - DNA, 16 bp, Homo sapiens
cttatttaaaaatatt

SEQ ID NO: 3010934 - DNA, 18 bp, Homo sapiens
cttatttaaaaatatttc

SEQ ID NO: 3010935 - DNA, 19 bp, Homo sapiens
cttatttaaaaatatttca

SEQ ID NO: 3010936 - DNA, 23 bp, Homo sapiens
cttatttacctataaaatgagat

SEQ ID NO: 3010937 - DNA, 14 bp, Homo sapiens
cttatttagaaaaa

SEQ ID NO: 3010938 - DNA, 21 bp, Homo sapiens
cttatttatattcatcaaata

SEQ ID NO: 3010939 - DNA, 19 bp, Homo sapiens
cttatttggaattgacatt

SEQ ID NO: 3010940 - DNA, 23 bp, Homo sapiens
cttatttgtcggggaagatgaaa

SEQ ID NO: 3010941 - DNA, 16 bp, Homo sapiens
cttattttacacagca

SEQ ID NO: 3010942 - DNA, 13 bp, Homo sapiens
cttattttacatt

SEQ ID NO: 3010943 - DNA, 21 bp, Homo sapiens
cttattttgggttcaggcctg

SEQ ID NO: 3010944 - DNA, 22 bp, Homo sapiens
cttattttgggttcaggcctgg

SEQ ID NO: 3010945 - DNA, 20 bp, Homo sapiens
cttattttgttggtgctttg

SEQ ID NO: 3010946 - DNA, 13 bp, Homo sapiens
cttcaaaacattc

SEQ ID NO: 3010947 - DNA, 15 bp, Homo sapiens
cttcaaaagtatttt

SEQ ID NO: 3010948 - DNA, 21 bp, Homo sapiens
cttcaaaagtattttcctgta

SEQ ID NO: 3010949 - DNA, 20 bp, Homo sapiens
cttcaaaatgttatcttctc

SEQ ID NO: 3010950 - DNA, 23 bp, Homo sapiens
cttcaaactagggccaagcccag

SEQ ID NO: 3010951 - DNA, 15 bp, Homo sapiens
cttcaaccccctcgc

SEQ ID NO: 3010952 - DNA, 17 bp, Homo sapiens
cttcaacgtttcttcac

SEQ ID NO: 3010953 - DNA, 20 bp, Homo sapiens
cttcaagcatcctcagaagc

SEQ ID NO: 3010954 - DNA, 19 bp, Homo sapiens
cttcaaggcttcagtctca

SEQ ID NO: 3010955 - DNA, 20 bp, Homo sapiens
cttcaagtgagtggcatgtg

SEQ ID NO: 3010956 - DNA, 19 bp, Homo sapiens
cttcaatagttcaaggaac

SEQ ID NO: 3010957 - DNA, 18 bp, Homo sapiens
cttcaatgaattaattca

SEQ ID NO: 3010958 - DNA, 13 bp, Homo sapiens
cttcaattaaaat

SEQ ID NO: 3010959 - DNA, 12 bp, Homo sapiens
cttcaatttgga

SEQ ID NO: 3010960 - DNA, 21 bp, Homo sapiens
cttcaatttgttaacagagca

SEQ ID NO: 3010961 - DNA, 22 bp, Homo sapiens
cttcaatttgttaacagagcaa

SEQ ID NO: 3010962 - DNA, 13 bp, Homo sapiens
cttcacactgcaa

SEQ ID NO: 3010963 - DNA, 23 bp, Homo sapiens
cttcacagtgacactggaccagg

SEQ ID NO: 3010964 - DNA, 21 bp, Homo sapiens
cttcacatcctgtgtttctag

SEQ ID NO: 3010965 - DNA, 15 bp, Homo sapiens
cttcaccaacactgt

SEQ ID NO: 3010966 - DNA, 17 bp, Homo sapiens
cttctccatctggcagg

SEQ ID NO: 3010967 - DNA, 16 bp, Homo sapiens
cttctccccgaggctg

SEQ ID NO: 3010968 - DNA, 20 bp, Homo sapiens
cttctccccgaggctgcccc

SEQ ID NO: 3010969 - DNA, 23 bp, Homo sapiens
cttctccccgaggctgccccagg

SEQ ID NO: 3010970 - DNA, 16 bp, Homo sapiens
cttctcccggacctgg

SEQ ID NO: 3010971 - DNA, 18 bp, Homo sapiens
cttctcccggacctggac

SEQ ID NO: 3010972 - DNA, 20 bp, Homo sapiens
cttctcccggacctggacta

SEQ ID NO: 3010973 - DNA, 21 bp, Homo sapiens
cttctcccggacctggactag

SEQ ID NO: 3010974 - DNA, 14 bp, Homo sapiens
cttctcctcttgta

SEQ ID NO: 3010975 - DNA, 23 bp, Homo sapiens
cttctcctcttgtaaataaagcc

SEQ ID NO: 3010976 - DNA, 15 bp, Homo sapiens
cttctccttggagga

SEQ ID NO: 3010977 - DNA, 21 bp, Homo sapiens
cttctcctttggcatgtttaa

SEQ ID NO: 3010978 - DNA, 19 bp, Homo sapiens
cttctcggagctggcccag

SEQ ID NO: 3010979 - DNA, 20 bp, Homo sapiens
cttctcggagctggcccagg

SEQ ID NO: 3010980 - DNA, 13 bp, Homo sapiens
cttctcggccagc

SEQ ID NO: 3010981 - DNA, 15 bp, Homo sapiens
cttctctatcctctc

SEQ ID NO: 3010982 - DNA, 17 bp, Homo sapiens
cttctctatcctctctc

SEQ ID NO: 3010983 - DNA, 17 bp, Homo sapiens
cttctctcagctcccag

SEQ ID NO: 3010984 - DNA, 15 bp, Homo sapiens
cttctctccacttct

SEQ ID NO: 3010985 - DNA, 18 bp, Homo sapiens
cttctctccacttctggt

SEQ ID NO: 3010986 - DNA, 13 bp, Homo sapiens
cttctctctgtgg

SEQ ID NO: 3010987 - DNA, 12 bp, Homo sapiens
cttctctgagtc

SEQ ID NO: 3010988 - DNA, 17 bp, Homo sapiens
cttctctgagtcagctg

SEQ ID NO: 3010989 - DNA, 19 bp, Homo sapiens
cttctctgagtcagctgac

SEQ ID NO: 3010990 - DNA, 16 bp, Homo sapiens
cttctctgggtcccgg

SEQ ID NO: 3010991 - DNA, 17 bp, Homo sapiens
cttctctgggtcccggg

SEQ ID NO: 3010992 - DNA, 11 bp, Homo sapiens
cttctctgtga

SEQ ID NO: 3010993 - DNA, 12 bp, Homo sapiens
cttctcttctct

SEQ ID NO: 3010994 - DNA, 12 bp, Homo sapiens
cttctcttcttt

SEQ ID NO: 3010995 - DNA, 14 bp, Homo sapiens
cttctcttctttgg

SEQ ID NO: 3010996 - DNA, 18 bp, Homo sapiens
cttctcttgacagtctga

SEQ ID NO: 3010997 - DNA, 23 bp, Homo sapiens
cttctcttgacagtctgaagctc

SEQ ID NO: 3010998 - DNA, 18 bp, Homo sapiens
cttctcttttcctcgcag

SEQ ID NO: 3010999 - DNA, 15 bp, Homo sapiens
cttctgaaaaatgaa

SEQ ID NO: 3011000 - DNA, 17 bp, Homo sapiens
cttctgaaaaatgaatg

SEQ ID NO: 3011001 - DNA, 21 bp, Homo sapiens
cttctgaagagaccactcaat

SEQ ID NO: 3011002 - DNA, 21 bp, Homo sapiens
cttctgaagtgtgtccatcct

SEQ ID NO: 3011003 - DNA, 23 bp, Homo sapiens
cttctgaagtgtgtccatcctga

SEQ ID NO: 3011004 - DNA, 14 bp, Homo sapiens
cttctgaatatttt

SEQ ID NO: 3011005 - DNA, 18 bp, Homo sapiens
cttctgaatattttatct

SEQ ID NO: 3011006 - DNA, 20 bp, Homo sapiens
cttctgaggacattccaaga

SEQ ID NO: 3011007 - DNA, 20 bp, Homo sapiens
cttctgccctaacctgacag

SEQ ID NO: 3011008 - DNA, 21 bp, Homo sapiens
cttctgcgtccaccaggcctc

SEQ ID NO: 3011009 - DNA, 14 bp, Homo sapiens
cttctgctcagctc

SEQ ID NO: 3011010 - DNA, 16 bp, Homo sapiens
cttctgctcagctctg

SEQ ID NO: 3011011 - DNA, 18 bp, Homo sapiens
cttctgctcagctctggg

SEQ ID NO: 3011012 - DNA, 23 bp, Homo sapiens
cttctgcttgtcccaaatccgcc

SEQ ID NO: 3011013 - DNA, 12 bp, Homo sapiens
cttctggccagg

SEQ ID NO: 3011014 - DNA, 17 bp, Homo sapiens
cttctggccaggaagct

SEQ ID NO: 3011015 - DNA, 19 bp, Homo sapiens
cttctggcctcccacagac

SEQ ID NO: 3011016 - DNA, 15 bp, Homo sapiens
cttctggctgtagat

SEQ ID NO: 3011017 - DNA, 19 bp, Homo sapiens
cttctgggagggcagcagg

SEQ ID NO: 3011018 - DNA, 22 bp, Homo sapiens
cttctgggagggcagcagggct

SEQ ID NO: 3011019 - DNA, 14 bp, Homo sapiens
cttctgggcagagc

SEQ ID NO: 3011020 - DNA, 20 bp, Homo sapiens
cttgcctgggctgggcagcc

SEQ ID NO: 3011021 - DNA, 17 bp, Homo sapiens
cttgcctgtctaaagcc

SEQ ID NO: 3011022 - DNA, 21 bp, Homo sapiens
cttgccttccccttgaacctc

SEQ ID NO: 3011023 - DNA, 22 bp, Homo sapiens
cttgccttcctaagcctgtggc

SEQ ID NO: 3011024 - DNA, 19 bp, Homo sapiens
cttgcgaactagagatgtg

SEQ ID NO: 3011025 - DNA, 23 bp, Homo sapiens
cttgctaactttgcccttcactg

SEQ ID NO: 3011026 - DNA, 18 bp, Homo sapiens
cttgctagctagccagcc

SEQ ID NO: 3011027 - DNA, 22 bp, Homo sapiens
cttgctatattgcccaggctgg

SEQ ID NO: 3011028 - DNA, 13 bp, Homo sapiens
cttgctatgatga

SEQ ID NO: 3011029 - DNA, 20 bp, Homo sapiens
cttgctcctggggagaaaga

SEQ ID NO: 3011030 - DNA, 14 bp, Homo sapiens
cttgctctcttgtg

SEQ ID NO: 3011031 - DNA, 23 bp, Homo sapiens
cttgctctgcttgacaacatctg

SEQ ID NO: 3011032 - DNA, 15 bp, Homo sapiens
cttgctctgtaatct

SEQ ID NO: 3011033 - DNA, 12 bp, Homo sapiens
cttgctgccaag

SEQ ID NO: 3011034 - DNA, 13 bp, Homo sapiens
cttgctgccaagt

SEQ ID NO: 3011035 - DNA, 15 bp, Homo sapiens
cttgctgccaagtcc

SEQ ID NO: 3011036 - DNA, 16 bp, Homo sapiens
cttgctgtagagactt

SEQ ID NO: 3011037 - DNA, 19 bp, Homo sapiens
cttgctgtatgctgatcat

SEQ ID NO: 3011038 - DNA, 19 bp, Homo sapiens
cttgctgtcccttggaact

SEQ ID NO: 3011039 - DNA, 19 bp, Homo sapiens
cttgctgttgacatattta

SEQ ID NO: 3011040 - DNA, 21 bp, Homo sapiens
cttgctgttgacatatttaat

SEQ ID NO: 3011041 - DNA, 19 bp, Homo sapiens
cttgcttacaatctttatt

SEQ ID NO: 3011042 - DNA, 19 bp, Homo sapiens
cttgcttattacatttaaa

SEQ ID NO: 3011043 - DNA, 22 bp, Homo sapiens
cttgcttctggctttgttcttg

SEQ ID NO: 3011044 - DNA, 20 bp, Homo sapiens
cttgcttcttactgataatt

SEQ ID NO: 3011045 - DNA, 17 bp, Homo sapiens
cttgcttgcctgcaggg

SEQ ID NO: 3011046 - DNA, 18 bp, Homo sapiens
cttggaaaaacagcgtct

SEQ ID NO: 3011047 - DNA, 18 bp, Homo sapiens
cttggaaaaagaaagaaa

SEQ ID NO: 3011048 - DNA, 17 bp, Homo sapiens
cttggaattccatttga

SEQ ID NO: 3011049 - DNA, 18 bp, Homo sapiens
cttggagaatactgccaa

SEQ ID NO: 3011050 - DNA, 22 bp, Homo sapiens
cttggagatctttgcttccttg

SEQ ID NO: 3011051 - DNA, 11 bp, Homo sapiens
cttggagcatt

SEQ ID NO: 3011052 - DNA, 13 bp, Homo sapiens
cttggaggacagt

SEQ ID NO: 3011053 - DNA, 14 bp, Homo sapiens
cttggaggacagtg

SEQ ID NO: 3011054 - DNA, 15 bp, Homo sapiens
cttggaggccagcca

SEQ ID NO: 3011055 - DNA, 23 bp, Homo sapiens
cttggataagccccaagcgaatt

SEQ ID NO: 3011056 - DNA, 22 bp, Homo sapiens
cttggataatgctgttgcctca

SEQ ID NO: 3011057 - DNA, 19 bp, Homo sapiens
cttggataccagctcaggg

SEQ ID NO: 3011058 - DNA, 12 bp, Homo sapiens
cttggatgagga

SEQ ID NO: 3011059 - DNA, 16 bp, Homo sapiens
cttggcaactttcttc

SEQ ID NO: 3011060 - DNA, 16 bp, Homo sapiens
cttggcaccagacacc

SEQ ID NO: 3011061 - DNA, 20 bp, Homo sapiens
cttggcaccagacacccagg

SEQ ID NO: 3011062 - DNA, 13 bp, Homo sapiens
cttggcatctact

SEQ ID NO: 3011063 - DNA, 17 bp, Homo sapiens
cttggcccaggagctct

SEQ ID NO: 3011064 - DNA, 20 bp, Homo sapiens
cttggcccaggagctctgcg

SEQ ID NO: 3011065 - DNA, 20 bp, Homo sapiens
cttggccggctgtgctcaga

SEQ ID NO: 3011066 - DNA, 17 bp, Homo sapiens
cttggccttgcagctgg

SEQ ID NO: 3011067 - DNA, 18 bp, Homo sapiens
cttggccttgcagctggc

SEQ ID NO: 3011068 - DNA, 16 bp, Homo sapiens
cttggctcagacatgt

SEQ ID NO: 3011069 - DNA, 23 bp, Homo sapiens
cttggctgagatagcagaggggc

SEQ ID NO: 3011070 - DNA, 14 bp, Homo sapiens
cttggcttgcccac

SEQ ID NO: 3011071 - DNA, 20 bp, Homo sapiens
cttggctttgaggccgaagc

SEQ ID NO: 3011072 - DNA, 11 bp, Homo sapiens
cttgggaaata

SEQ ID NO: 3011073 - DNA, 18 bp, Homo sapiens
cttgggaccaaaggggga

SEQ ID NO: 3011074 - DNA, 14 bp, Homo sapiens
cttgggagcctgag

SEQ ID NO: 3011075 - DNA, 17 bp, Homo sapiens
cttgggagcctgaggca

SEQ ID NO: 3011076 - DNA, 19 bp, Homo sapiens
cttgggaggccccactggg

SEQ ID NO: 3011077 - DNA, 21 bp, Homo sapiens
cttgggaggccccactgggga

SEQ ID NO: 3011078 - DNA, 13 bp, Homo sapiens
cttgggattctga

SEQ ID NO: 3011079 - DNA, 13 bp, Homo sapiens
cttgggcagggtc

SEQ ID NO: 3011080 - DNA, 17 bp, Homo sapiens
cttgggccctttgagtg

SEQ ID NO: 3011081 - DNA, 19 bp, Homo sapiens
cttgggccctttgagtgca

SEQ ID NO: 3011082 - DNA, 18 bp, Homo sapiens
cttgggcctgacctccag

SEQ ID NO: 3011083 - DNA, 22 bp, Homo sapiens
cttgggcctgacctccagtcct

SEQ ID NO: 3011084 - DNA, 16 bp, Homo sapiens
cttgggcctggccagt

SEQ ID NO: 3011085 - DNA, 17 bp, Homo sapiens
ctttcagtcccaaagcg

SEQ ID NO: 3011086 - DNA, 14 bp, Homo sapiens
ctttcatagagagg

SEQ ID NO: 3011087 - DNA, 22 bp, Homo sapiens
ctttcatcattcataaaagttt

SEQ ID NO: 3011088 - DNA, 12 bp, Homo sapiens
ctttcatcctgt

SEQ ID NO: 3011089 - DNA, 14 bp, Homo sapiens
ctttcatcctgtgt

SEQ ID NO: 3011090 - DNA, 16 bp, Homo sapiens
ctttcatcttgaagtt

SEQ ID NO: 3011091 - DNA, 18 bp, Homo sapiens
ctttcatgagtttttccc

SEQ ID NO: 3011092 - DNA, 22 bp, Homo sapiens
ctttcatgttaatcaaacaagt

SEQ ID NO: 3011093 - DNA, 19 bp, Homo sapiens
ctttcattttaaatattgt

SEQ ID NO: 3011094 - DNA, 14 bp, Homo sapiens
ctttcatttttgac

SEQ ID NO: 3011095 - DNA, 23 bp, Homo sapiens
ctttccaaagccaatgtgaacag

SEQ ID NO: 3011096 - DNA, 23 bp, Homo sapiens
ctttccaccaactttttccaagt

SEQ ID NO: 3011097 - DNA, 21 bp, Homo sapiens
ctttccactttgttggccctt

SEQ ID NO: 3011098 - DNA, 14 bp, Homo sapiens
ctttccatctgtcc

SEQ ID NO: 3011099 - DNA, 13 bp, Homo sapiens
ctttcccaacacc

SEQ ID NO: 3011100 - DNA, 17 bp, Homo sapiens
ctttccccttcctttta

SEQ ID NO: 3011101 - DNA, 19 bp, Homo sapiens
ctttccgtggcactgcata

SEQ ID NO: 3011102 - DNA, 16 bp, Homo sapiens
ctttcctaagacctgg

SEQ ID NO: 3011103 - DNA, 20 bp, Homo sapiens
ctttcctcaagtatcttcta

SEQ ID NO: 3011104 - DNA, 22 bp, Homo sapiens
ctttcctcctcaggcacacagc

SEQ ID NO: 3011105 - DNA, 13 bp, Homo sapiens
ctttcctggaagt

SEQ ID NO: 3011106 - DNA, 13 bp, Homo sapiens
ctttcctggatgt

SEQ ID NO: 3011107 - DNA, 23 bp, Homo sapiens
ctttcctggatgtctgaactttg

SEQ ID NO: 3011108 - DNA, 20 bp, Homo sapiens
ctttcctgtagccttctgta

SEQ ID NO: 3011109 - DNA, 11 bp, Homo sapiens
ctttccttcct

SEQ ID NO: 3011110 - DNA, 17 bp, Homo sapiens
ctttcctttactcctgg

SEQ ID NO: 3011111 - DNA, 13 bp, Homo sapiens
ctttcggggaggg

SEQ ID NO: 3011112 - DNA, 14 bp, Homo sapiens
ctttcggggagggc

SEQ ID NO: 3011113 - DNA, 17 bp, Homo sapiens
ctttcgttggttgtttc

SEQ ID NO: 3011114 - DNA, 13 bp, Homo sapiens
ctttctagcctgg

SEQ ID NO: 3011115 - DNA, 22 bp, Homo sapiens
ctttctagcctggggcttgaat

SEQ ID NO: 3011116 - DNA, 16 bp, Homo sapiens
ctttctagttgaaaat

SEQ ID NO: 3011117 - DNA, 17 bp, Homo sapiens
ctttctatcctctgtaa

SEQ ID NO: 3011118 - DNA, 14 bp, Homo sapiens
ctttctatgctgct

SEQ ID NO: 3011119 - DNA, 15 bp, Homo sapiens
ctttctccactgggt

SEQ ID NO: 3011120 - DNA, 18 bp, Homo sapiens
ctttctccctaaccacta

SEQ ID NO: 3011121 - DNA, 19 bp, Homo sapiens
ctttctcctgtttatgggt

SEQ ID NO: 3011122 - DNA, 14 bp, Homo sapiens
ctttctctctcttt

SEQ ID NO: 3011123 - DNA, 15 bp, Homo sapiens
ctttctctgtatatt

SEQ ID NO: 3011124 - DNA, 11 bp, Homo sapiens
ctttctctttc

SEQ ID NO: 3011125 - DNA, 13 bp, Homo sapiens
ctttctgaaactc

SEQ ID NO: 3011126 - DNA, 13 bp, Homo sapiens
ctttctgaaattc

SEQ ID NO: 3011127 - DNA, 16 bp, Homo sapiens
ctttctgaaattcaca

SEQ ID NO: 3011128 - DNA, 16 bp, Homo sapiens
ctttctgacatcagca

SEQ ID NO: 3011129 - DNA, 20 bp, Homo sapiens
ctttctgagcacactttagt

SEQ ID NO: 3011130 - DNA, 21 bp, Homo sapiens
ctttctgagcacactttagtg

SEQ ID NO: 3011131 - DNA, 16 bp, Homo sapiens
ctttctgatcaaggcc

SEQ ID NO: 3011132 - DNA, 15 bp, Homo sapiens
ctttctgcagaaaca

SEQ ID NO: 3011133 - DNA, 18 bp, Homo sapiens
ctttctgccccccagggc

SEQ ID NO: 3011134 - DNA, 20 bp, Homo sapiens
ctttctgccccccagggcta

SEQ ID NO: 3011135 - DNA, 11 bp, Homo sapiens
ctttggcccaa

SEQ ID NO: 3011136 - DNA, 14 bp, Homo sapiens
ctttggcctgagtt

SEQ ID NO: 3011137 - DNA, 15 bp, Homo sapiens
ctttgggaaaggaga

SEQ ID NO: 3011138 - DNA, 22 bp, Homo sapiens
ctttgggaaaggagaagttaag

SEQ ID NO: 3011139 - DNA, 14 bp, Homo sapiens
ctttgggaagcctt

SEQ ID NO: 3011140 - DNA, 14 bp, Homo sapiens
ctttgggcagtgcc

SEQ ID NO: 3011141 - DNA, 13 bp, Homo sapiens
ctttgggccagac

SEQ ID NO: 3011142 - DNA, 13 bp, Homo sapiens
ctttgggccctgc

SEQ ID NO: 3011143 - DNA, 13 bp, Homo sapiens
ctttggggaaaaa

SEQ ID NO: 3011144 - DNA, 15 bp, Homo sapiens
ctttggggaaaaatt

SEQ ID NO: 3011145 - DNA, 16 bp, Homo sapiens
ctttggggaaaaattc

SEQ ID NO: 3011146 - DNA, 18 bp, Homo sapiens
ctttgggtcctgggcagg

SEQ ID NO: 3011147 - DNA, 17 bp, Homo sapiens
ctttgggtttttaactc

SEQ ID NO: 3011148 - DNA, 15 bp, Homo sapiens
ctttggtaggtaaat

SEQ ID NO: 3011149 - DNA, 14 bp, Homo sapiens
ctttggtccttcaa

SEQ ID NO: 3011150 - DNA, 19 bp, Homo sapiens
ctttggtgagaacctgggt

SEQ ID NO: 3011151 - DNA, 14 bp, Homo sapiens
ctttggttctaagg

SEQ ID NO: 3011152 - DNA, 15 bp, Homo sapiens
ctttggttctaagga

SEQ ID NO: 3011153 - DNA, 19 bp, Homo sapiens
ctttggttctggccagaat

SEQ ID NO: 3011154 - DNA, 21 bp, Homo sapiens
ctttggttctggccagaatgc

SEQ ID NO: 3011155 - DNA, 17 bp, Homo sapiens
ctttggttcttcagatg

SEQ ID NO: 3011156 - DNA, 13 bp, Homo sapiens
ctttgtaaaatct

SEQ ID NO: 3011157 - DNA, 21 bp, Homo sapiens
ctttgtaatgtcaccaccttc

SEQ ID NO: 3011158 - DNA, 22 bp, Homo sapiens
ctttgtaatgtcaccaccttcc

SEQ ID NO: 3011159 - DNA, 15 bp, Homo sapiens
ctttgtacagcccag

SEQ ID NO: 3011160 - DNA, 14 bp, Homo sapiens
ctttgtactttgtg

SEQ ID NO: 3011161 - DNA, 15 bp, Homo sapiens
ctttgtagtttgctt

SEQ ID NO: 3011162 - DNA, 10 bp, Homo sapiens
ctttgtatat

SEQ ID NO: 3011163 - DNA, 18 bp, Homo sapiens
ctttgtatattatttcta

SEQ ID NO: 3011164 - DNA, 22 bp, Homo sapiens
ctttgtcaccctaacttcgtat

SEQ ID NO: 3011165 - DNA, 14 bp, Homo sapiens
ctttgtcagtgttg

SEQ ID NO: 3011166 - DNA, 14 bp, Homo sapiens
ctttgtcctgaatg

SEQ ID NO: 3011167 - DNA, 15 bp, Homo sapiens
ctttgtctgaaaaat

SEQ ID NO: 3011168 - DNA, 16 bp, Homo sapiens
ctttgtcttgaaaaaa

SEQ ID NO: 3011169 - DNA, 17 bp, Homo sapiens
ctttgtcttgaaaaaaa

SEQ ID NO: 3011170 - DNA, 19 bp, Homo sapiens
ctttgtgagagtgagctgt

SEQ ID NO: 3011171 - DNA, 14 bp, Homo sapiens
ctttgtgataattc

SEQ ID NO: 3011172 - DNA, 11 bp, Homo sapiens
ctttgtggcca

SEQ ID NO: 3011173 - DNA, 12 bp, Homo sapiens
ctttgtggccaa

SEQ ID NO: 3011174 - DNA, 13 bp, Homo sapiens
ctttgtggccaag

SEQ ID NO: 3011175 - DNA, 20 bp, Homo sapiens
ctttgtggtctttttcctga

SEQ ID NO: 3011176 - DNA, 14 bp, Homo sapiens
ctttgtgtttgctt

SEQ ID NO: 3011177 - DNA, 23 bp, Homo sapiens
ctttttaagatagacttattctt

SEQ ID NO: 3011178 - DNA, 20 bp, Homo sapiens
ctttttaaggtctttcagta

SEQ ID NO: 3011179 - DNA, 14 bp, Homo sapiens
ctttttatatttta

SEQ ID NO: 3011180 - DNA, 23 bp, Homo sapiens
ctttttattgccttctcaccagc

SEQ ID NO: 3011181 - DNA, 16 bp, Homo sapiens
ctttttcaacttggaa

SEQ ID NO: 3011182 - DNA, 17 bp, Homo sapiens
ctttttcaggagaatta

SEQ ID NO: 3011183 - DNA, 20 bp, Homo sapiens
ctttttcatagtaagtgcga

SEQ ID NO: 3011184 - DNA, 23 bp, Homo sapiens
ctttttccaacttggctgcagga

SEQ ID NO: 3011185 - DNA, 22 bp, Homo sapiens
ctttttccagacacttttttga

SEQ ID NO: 3011186 - DNA, 16 bp, Homo sapiens
ctttttccttctgaaa

SEQ ID NO: 3011187 - DNA, 11 bp, Homo sapiens
ctttttctctg

SEQ ID NO: 3011188 - DNA, 12 bp, Homo sapiens
ctttttctgcta

SEQ ID NO: 3011189 - DNA, 22 bp, Homo sapiens
ctttttcttaccagtctcctcc

SEQ ID NO: 3011190 - DNA, 14 bp, Homo sapiens
ctttttcttgatct

SEQ ID NO: 3011191 - DNA, 20 bp, Homo sapiens
ctttttgagatactattttc

SEQ ID NO: 3011192 - DNA, 16 bp, Homo sapiens
ctttttgatgtataaa

SEQ ID NO: 3011193 - DNA, 20 bp, Homo sapiens
ctttttgatgtataaaactt

SEQ ID NO: 3011194 - DNA, 17 bp, Homo sapiens
ctttttgttgtaaaaca

SEQ ID NO: 3011195 - DNA, 12 bp, Homo sapiens
ctttttgtttca

SEQ ID NO: 3011196 - DNA, 15 bp, Homo sapiens
ctttttgtttcactg

SEQ ID NO: 3011197 - DNA, 17 bp, Homo sapiens
ctttttgtttcactgga

SEQ ID NO: 3011198 - DNA, 12 bp, Homo sapiens
ctttttgtttct

SEQ ID NO: 3011199 - DNA, 22 bp, Homo sapiens
cttttttaaatattttctattt

SEQ ID NO: 3011200 - DNA, 14 bp, Homo sapiens
cttttttcaaaatc

SEQ ID NO: 3011201 - DNA, 22 bp, Homo sapiens
cttttttcaaaatccaaaaaga

SEQ ID NO: 3011202 - DNA, 18 bp, Homo sapiens
cttttttcctcctttctc

SEQ ID NO: 3011203 - DNA, 15 bp, Homo sapiens
cttttttctcttctg

SEQ ID NO: 3011204 - DNA, 21 bp, Homo sapiens
cttttttgataaagtttctca

SEQ ID NO: 3011205 - DNA, 22 bp, Homo sapiens
cttttttgttttttcaaaatag

SEQ ID NO: 3011206 - DNA, 19 bp, Homo sapiens
ctttttttaaattttctcc

SEQ ID NO: 3011207 - DNA, 22 bp, Homo sapiens
ctttttttcaatttttttgtgt

SEQ ID NO: 3011208 - DNA, 20 bp, Homo sapiens
ctttttttgtgactagaaat

SEQ ID NO: 3011209 - DNA, 16 bp, Homo sapiens
ctttttttttccaaaa

SEQ ID NO: 3011210 - DNA, 18 bp, Homo sapiens
cttttttttttttttggt

SEQ ID NO: 3011211 - DNA, 21 bp, Homo sapiens
ctttttttttttttttaaaga

SEQ ID NO: 3011212 - DNA, 17 bp, Homo sapiens
gaaaaaaaaaaaagagg

SEQ ID NO: 3011213 - DNA, 22 bp, Homo sapiens
gaaaaaaaaaaaagaggaaaac

SEQ ID NO: 3011214 - DNA, 15 bp, Homo sapiens
gaaaaaaaaacagct

SEQ ID NO: 3011215 - DNA, 13 bp, Homo sapiens
gaaaaaaaaatgc

SEQ ID NO: 3011216 - DNA, 17 bp, Homo sapiens
gaaaaaaactataaata

SEQ ID NO: 3011217 - DNA, 12 bp, Homo sapiens
gaaaaaaagact

SEQ ID NO: 3011218 - DNA, 16 bp, Homo sapiens
gaaaaaaagtttctat

SEQ ID NO: 3011219 - DNA, 17 bp, Homo sapiens
gaaaaaaagtttctatt

SEQ ID NO: 3011220 - DNA, 19 bp, Homo sapiens
gaaaaaaatcgtccaggga

SEQ ID NO: 3011221 - DNA, 14 bp, Homo sapiens
gaaaaaaattacaa

SEQ ID NO: 3011222 - DNA, 14 bp, Homo sapiens
gaaaaaagaagttt

SEQ ID NO: 3011223 - DNA, 21 bp, Homo sapiens
gaaaaaagatttttaaaatga

SEQ ID NO: 3011224 - DNA, 14 bp, Homo sapiens
gaaaaaatactacc

SEQ ID NO: 3011225 - DNA, 12 bp, Homo sapiens
gaaaaacaacaa

SEQ ID NO: 3011226 - DNA, 16 bp, Homo sapiens
gaaaaacaagtttgct

SEQ ID NO: 3011227 - DNA, 19 bp, Homo sapiens
gaaaaacaagtttgctagt

SEQ ID NO: 3011228 - DNA, 23 bp, Homo sapiens
gaaaaacaccgcttctgcctttt

SEQ ID NO: 3011229 - DNA, 12 bp, Homo sapiens
gaaaaacttgtg

SEQ ID NO: 3011230 - DNA, 14 bp, Homo sapiens
gaaaaagaaagaac

SEQ ID NO: 3011231 - DNA, 19 bp, Homo sapiens
gaaaaagaacatgcagttt

SEQ ID NO: 3011232 - DNA, 18 bp, Homo sapiens
gaaaaagacgatgtttat

SEQ ID NO: 3011233 - DNA, 19 bp, Homo sapiens
gaaaaagacgatgtttatg

SEQ ID NO: 3011234 - DNA, 18 bp, Homo sapiens
gaaaaagcatgatgggaa

SEQ ID NO: 3011235 - DNA, 21 bp, Homo sapiens
gaaaaagcatgatgggaaaat

SEQ ID NO: 3011236 - DNA, 19 bp, Homo sapiens
gaaaaagttaaacattgaa

SEQ ID NO: 3011237 - DNA, 18 bp, Homo sapiens
gaaaaagttaatgcttaa

SEQ ID NO: 3011238 - DNA, 13 bp, Homo sapiens
gaaaaataaaaga

SEQ ID NO: 3011239 - DNA, 22 bp, Homo sapiens
gaaaaataaagacacctggttg

SEQ ID NO: 3011240 - DNA, 16 bp, Homo sapiens
gaaaaatagcaacttg

SEQ ID NO: 3011241 - DNA, 16 bp, Homo sapiens
gaaaaatatcttggcc

SEQ ID NO: 3011242 - DNA, 16 bp, Homo sapiens
gaaaaatatgtaccaa

SEQ ID NO: 3011243 - DNA, 19 bp, Homo sapiens
gaaaaatgaaagatgattt

SEQ ID NO: 3011244 - DNA, 23 bp, Homo sapiens
gaaaaatgaactgtattattgca

SEQ ID NO: 3011245 - DNA, 15 bp, Homo sapiens
gaaaaatgttcttta

SEQ ID NO: 3011246 - DNA, 22 bp, Homo sapiens
gaaaaattcttggttattctgc

SEQ ID NO: 3011247 - DNA, 13 bp, Homo sapiens
gaaaacaaaactg

SEQ ID NO: 3011248 - DNA, 17 bp, Homo sapiens
gaaaacaaagttctatt

SEQ ID NO: 3011249 - DNA, 14 bp, Homo sapiens
gaaaacactttcct

SEQ ID NO: 3011250 - DNA, 21 bp, Homo sapiens
gaaaacagaacatcattagaa

SEQ ID NO: 3011251 - DNA, 14 bp, Homo sapiens
gaaaacagatatta

SEQ ID NO: 3011252 - DNA, 16 bp, Homo sapiens
gaaaacattccagatg

SEQ ID NO: 3011253 - DNA, 20 bp, Homo sapiens
gaaaacattctgatttggaa

SEQ ID NO: 3011254 - DNA, 22 bp, Homo sapiens
gaaaaccatattttattgtatt

SEQ ID NO: 3011255 - DNA, 16 bp, Homo sapiens
gaaaacccaagttttt

SEQ ID NO: 3011256 - DNA, 17 bp, Homo sapiens
gaaaacccaagttttta

SEQ ID NO: 3011257 - DNA, 12 bp, Homo sapiens
gaaaacccagag

SEQ ID NO: 3011258 - DNA, 13 bp, Homo sapiens
gaaaacccagaga

SEQ ID NO: 3011259 - DNA, 15 bp, Homo sapiens
gaaaacccagagagg

SEQ ID NO: 3011260 - DNA, 22 bp, Homo sapiens
gaaaacccagagaggaatcaga

SEQ ID NO: 3011261 - DNA, 15 bp, Homo sapiens
gaaaacccctggctg

SEQ ID NO: 3011262 - DNA, 17 bp, Homo sapiens
gaaaactattccatgtt

SEQ ID NO: 3011263 - DNA, 12 bp, Homo sapiens
gaaaactggaaa

SEQ ID NO: 3011264 - DNA, 11 bp, Homo sapiens
gaaaagaaata

SEQ ID NO: 3011265 - DNA, 15 bp, Homo sapiens
gaaaagaaataataa

SEQ ID NO: 3011266 - DNA, 16 bp, Homo sapiens
gaaaagacggatggca

SEQ ID NO: 3011267 - DNA, 18 bp, Homo sapiens
gaaaagacggatggcagg

SEQ ID NO: 3011268 - DNA, 19 bp, Homo sapiens
gaaaagacggatggcagga

SEQ ID NO: 3011269 - DNA, 15 bp, Homo sapiens
gaaaagattcttctg

SEQ ID NO: 3011270 - DNA, 15 bp, Homo sapiens
gaaaagccgaaaggg

SEQ ID NO: 3011271 - DNA, 18 bp, Homo sapiens
gaaaagcgtctttaagag

SEQ ID NO: 3011272 - DNA, 21 bp, Homo sapiens
gaaaagcgtctttaagagact

SEQ ID NO: 3011273 - DNA, 13 bp, Homo sapiens
gaaaagcttccta

SEQ ID NO: 3011274 - DNA, 14 bp, Homo sapiens
gaaaagcttcctag

SEQ ID NO: 3011275 - DNA, 15 bp, Homo sapiens
gaaaagtgagagtta

SEQ ID NO: 3011276 - DNA, 20 bp, Homo sapiens
gaaaagtgcatatttatcca

SEQ ID NO: 3011277 - DNA, 10 bp, Homo sapiens
gaaaagttat

SEQ ID NO: 3011278 - DNA, 14 bp, Homo sapiens
gaaaataaaaagtt

SEQ ID NO: 3011279 - DNA, 15 bp, Homo sapiens
gaaaataaaaagtta

SEQ ID NO: 3011280 - DNA, 15 bp, Homo sapiens
gaaaataactgaacc

SEQ ID NO: 3011281 - DNA, 13 bp, Homo sapiens
gaaaataatccat

SEQ ID NO: 3011282 - DNA, 15 bp, Homo sapiens
gaagtgtgtttcctt

SEQ ID NO: 3011283 - DNA, 22 bp, Homo sapiens
gaagtgttgcatggatgtttta

SEQ ID NO: 3011284 - DNA, 18 bp, Homo sapiens
gaagttacatgcataaaa

SEQ ID NO: 3011285 - DNA, 20 bp, Homo sapiens
gaagttacatgcataaaagg

SEQ ID NO: 3011286 - DNA, 20 bp, Homo sapiens
gaagttactttcttaatgtg

SEQ ID NO: 3011287 - DNA, 22 bp, Homo sapiens
gaagttgccatgggaaacaaat

SEQ ID NO: 3011288 - DNA, 22 bp, Homo sapiens
gaagttggtcttactttgtgca

SEQ ID NO: 3011289 - DNA, 17 bp, Homo sapiens
gaagttgtaaacacagt

SEQ ID NO: 3011290 - DNA, 14 bp, Homo sapiens
gaagttgttttttt

SEQ ID NO: 3011291 - DNA, 15 bp, Homo sapiens
gaagtttttgaaata

SEQ ID NO: 3011292 - DNA, 16 bp, Homo sapiens
gaagtttttgaaatac

SEQ ID NO: 3011293 - DNA, 19 bp, Homo sapiens
gaagtttttgaaatacctt

SEQ ID NO: 3011294 - DNA, 15 bp, Homo sapiens
gaataaaatttctac

SEQ ID NO: 3011295 - DNA, 13 bp, Homo sapiens
gaataaacaaaat

SEQ ID NO: 3011296 - DNA, 17 bp, Homo sapiens
gaataaactagagaagg

SEQ ID NO: 3011297 - DNA, 11 bp, Homo sapiens
gaataaagaat

SEQ ID NO: 3011298 - DNA, 15 bp, Homo sapiens
gaataaagaatactt

SEQ ID NO: 3011299 - DNA, 12 bp, Homo sapiens
gaataaatgaag

SEQ ID NO: 3011300 - DNA, 11 bp, Homo sapiens
gaataaatgtc

SEQ ID NO: 3011301 - DNA, 12 bp, Homo sapiens
gaataagttatt

SEQ ID NO: 3011302 - DNA, 14 bp, Homo sapiens
gaataagttattgc

SEQ ID NO: 3011303 - DNA, 18 bp, Homo sapiens
gaataagttattgcagtt

SEQ ID NO: 3011304 - DNA, 23 bp, Homo sapiens
gaataataagcaggatgttggcc

SEQ ID NO: 3011305 - DNA, 21 bp, Homo sapiens
gaataatggtaccagataaaa

SEQ ID NO: 3011306 - DNA, 12 bp, Homo sapiens
gaataattgcat

SEQ ID NO: 3011307 - DNA, 13 bp, Homo sapiens
gaataattttcta

SEQ ID NO: 3011308 - DNA, 17 bp, Homo sapiens
gaatacaatgggaaaag

SEQ ID NO: 3011309 - DNA, 21 bp, Homo sapiens
gaatacagcagcaagaaaaaa

SEQ ID NO: 3011310 - DNA, 22 bp, Homo sapiens
gaatactgcttgcttacaatct

SEQ ID NO: 3011311 - DNA, 15 bp, Homo sapiens
gaatactgttttatc

SEQ ID NO: 3011312 - DNA, 19 bp, Homo sapiens
gaatacttttgccctttga

SEQ ID NO: 3011313 - DNA, 16 bp, Homo sapiens
gaatagagctgccact

SEQ ID NO: 3011314 - DNA, 20 bp, Homo sapiens
gaatagcatctgtacaaagg

SEQ ID NO: 3011315 - DNA, 18 bp, Homo sapiens
gaatagccacatttggaa

SEQ ID NO: 3011316 - DNA, 22 bp, Homo sapiens
gaatagggaagtaaaaaaacaa

SEQ ID NO: 3011317 - DNA, 16 bp, Homo sapiens
gaatatatttaagcaa

SEQ ID NO: 3011318 - DNA, 15 bp, Homo sapiens
gaatatgcattgtct

SEQ ID NO: 3011319 - DNA, 13 bp, Homo sapiens
gaatatgcctgta

SEQ ID NO: 3011320 - DNA, 18 bp, Homo sapiens
gaatatgcctgtaattca

SEQ ID NO: 3011321 - DNA, 21 bp, Homo sapiens
gaatatggacagttagcattt

SEQ ID NO: 3011322 - DNA, 15 bp, Homo sapiens
gaatatgtatgtata

SEQ ID NO: 3011323 - DNA, 23 bp, Homo sapiens
gaatattaagaaacaatttaaat

SEQ ID NO: 3011324 - DNA, 12 bp, Homo sapiens
gaatattagctt

SEQ ID NO: 3011325 - DNA, 21 bp, Homo sapiens
gaatattagctttactgtttg

SEQ ID NO: 3011326 - DNA, 18 bp, Homo sapiens
gaatattcccaagcccat

SEQ ID NO: 3011327 - DNA, 14 bp, Homo sapiens
gaatattgtttctt

SEQ ID NO: 3011328 - DNA, 17 bp, Homo sapiens
gaatatttgaatgtatg

SEQ ID NO: 3011329 - DNA, 22 bp, Homo sapiens
gaatattttttgaggctaaaga

SEQ ID NO: 3011330 - DNA, 15 bp, Homo sapiens
gaatcaaaagtgcct

SEQ ID NO: 3011331 - DNA, 16 bp, Homo sapiens
gaatcaaatcttacaa

SEQ ID NO: 3011332 - DNA, 22 bp, Homo sapiens
gaatcaaatcttacaaaatcct

SEQ ID NO: 3011333 - DNA, 22 bp, Homo sapiens
gaatcacctgaaccccagaggc

SEQ ID NO: 3011334 - DNA, 12 bp, Homo sapiens
gaatcagaagaa

SEQ ID NO: 3011335 - DNA, 15 bp, Homo sapiens
gaatcagcagaacct

SEQ ID NO: 3011336 - DNA, 16 bp, Homo sapiens
gaatcagcagaacctg

SEQ ID NO: 3011337 - DNA, 19 bp, Homo sapiens
gaatcagtttccaattatt

SEQ ID NO: 3011338 - DNA, 11 bp, Homo sapiens
gaatcatgtag

SEQ ID NO: 3011339 - DNA, 13 bp, Homo sapiens
gaatcatgtagta

SEQ ID NO: 3011340 - DNA, 17 bp, Homo sapiens
gaatccatgggtctggc

SEQ ID NO: 3011341 - DNA, 17 bp, Homo sapiens
gaatcccaaatttgatt

SEQ ID NO: 3011342 - DNA, 19 bp, Homo sapiens
gaatcccaaatttgattga

SEQ ID NO: 3011343 - DNA, 18 bp, Homo sapiens
gaatcccacccacatgtg

SEQ ID NO: 3011344 - DNA, 19 bp, Homo sapiens
gaatccgggctcccctttc

SEQ ID NO: 3011345 - DNA, 18 bp, Homo sapiens
gaatcctgctttacagga

SEQ ID NO: 3011346 - DNA, 12 bp, Homo sapiens
gaatcctggcaa

SEQ ID NO: 3011347 - DNA, 14 bp, Homo sapiens
gaatcctgggcccc

SEQ ID NO: 3011348 - DNA, 16 bp, Homo sapiens
gaatcctgggccccca

SEQ ID NO: 3011349 - DNA, 13 bp, Homo sapiens
gaatccttttgta

SEQ ID NO: 3011350 - DNA, 19 bp, Homo sapiens
gaatcggcagtattttctg

SEQ ID NO: 3011351 - DNA, 13 bp, Homo sapiens
gaatctaaaataa

SEQ ID NO: 3011352 - DNA, 13 bp, Homo sapiens
gaatctatttaag

SEQ ID NO: 3011353 - DNA, 15 bp, Homo sapiens
gaatctatttaagta

SEQ ID NO: 3011354 - DNA, 16 bp, Homo sapiens
gaatctatttaagtaa

SEQ ID NO: 3011355 - DNA, 23 bp, Homo sapiens
gaatctcagttgattttctggat

SEQ ID NO: 3011356 - DNA, 19 bp, Homo sapiens
gaatctctatgtatattct

SEQ ID NO: 3011357 - DNA, 23 bp, Homo sapiens
gaatctctgcctagaatctttat

SEQ ID NO: 3011358 - DNA, 12 bp, Homo sapiens
gaatctgccttc

SEQ ID NO: 3011359 - DNA, 16 bp, Homo sapiens
gaatctgccttccagc

SEQ ID NO: 3011360 - DNA, 12 bp, Homo sapiens
gaatctggagac

SEQ ID NO: 3011361 - DNA, 22 bp, Homo sapiens
gaatctggagaccagggagcct

SEQ ID NO: 3011362 - DNA, 21 bp, Homo sapiens
gaatcttaaggtgtagccaca

SEQ ID NO: 3011363 - DNA, 20 bp, Homo sapiens
gaatcttggtttgccttcca

SEQ ID NO: 3011364 - DNA, 22 bp, Homo sapiens
gaatctttattcaaacttttat

SEQ ID NO: 3011365 - DNA, 14 bp, Homo sapiens
gaatgaaaaatgaa

SEQ ID NO: 3011366 - DNA, 18 bp, Homo sapiens
gaatgaaaataactgaac

SEQ ID NO: 3011367 - DNA, 23 bp, Homo sapiens
gaatgaaaataactgaaccaaat

SEQ ID NO: 3011368 - DNA, 14 bp, Homo sapiens
gaatgaaaccccca

SEQ ID NO: 3011369 - DNA, 14 bp, Homo sapiens
gaatgaaagagtaa

SEQ ID NO: 3011370 - DNA, 22 bp, Homo sapiens
gaatgaaagagtaaaggaaatg

SEQ ID NO: 3011371 - DNA, 13 bp, Homo sapiens
gaatgaacactat

SEQ ID NO: 3011372 - DNA, 15 bp, Homo sapiens
gaatgaaccttctgg

SEQ ID NO: 3011373 - DNA, 16 bp, Homo sapiens
gaatgaagcttgtgta

SEQ ID NO: 3011374 - DNA, 22 bp, Homo sapiens
gaatgaatgggatattttgaaa

SEQ ID NO: 3011375 - DNA, 12 bp, Homo sapiens
gaatgacactgt

SEQ ID NO: 3011376 - DNA, 17 bp, Homo sapiens
gaatgactcatgcctct

SEQ ID NO: 3011377 - DNA, 21 bp, Homo sapiens
gaatgactcatgcctctgagc

SEQ ID NO: 3011378 - DNA, 21 bp, Homo sapiens
gaatgactgaaagaagaacag

SEQ ID NO: 3011379 - DNA, 20 bp, Homo sapiens
gaatgagcctacgctgaaga

SEQ ID NO: 3011380 - DNA, 22 bp, Homo sapiens
gaatgagcctacgctgaagatg

SEQ ID NO: 3011381 - DNA, 21 bp, Homo sapiens
gaatgagtctgttgtgtgtca

SEQ ID NO: 3011382 - DNA, 15 bp, Homo sapiens
gaatgatatgcattt

SEQ ID NO: 3011383 - DNA, 17 bp, Homo sapiens
gaatgatctcttctttt

SEQ ID NO: 3011384 - DNA, 22 bp, Homo sapiens
gaatgatttccaaagagaaaaa

SEQ ID NO: 3011385 - DNA, 16 bp, Homo sapiens
gaatgcagcactgctg

SEQ ID NO: 3011386 - DNA, 18 bp, Homo sapiens
gaatgcagcactgctgcc

SEQ ID NO: 3011387 - DNA, 13 bp, Homo sapiens
gaatgcagcccac

SEQ ID NO: 3011388 - DNA, 19 bp, Homo sapiens
gaatgcagcccaccaggag

SEQ ID NO: 3011389 - DNA, 20 bp, Homo sapiens
gaatgcagtctgtccaggct

SEQ ID NO: 3011390 - DNA, 17 bp, Homo sapiens
gaatgcatattcaacac

SEQ ID NO: 3011391 - DNA, 20 bp, Homo sapiens
gaatgcatattcaacacact

SEQ ID NO: 3011392 - DNA, 21 bp, Homo sapiens
gaatgcatattcaacacactg

SEQ ID NO: 3011393 - DNA, 12 bp, Homo sapiens
gaatgcattgat

SEQ ID NO: 3011394 - DNA, 19 bp, Homo sapiens
gaatgcattttctgggtga

SEQ ID NO: 3011395 - DNA, 20 bp, Homo sapiens
gaatgccagtgtgctgatgg

SEQ ID NO: 3011396 - DNA, 21 bp, Homo sapiens
gaatgcggccgcattccctga

SEQ ID NO: 3011397 - DNA, 14 bp, Homo sapiens
gaatgctacaagta

SEQ ID NO: 3011398 - DNA, 23 bp, Homo sapiens
gaatgctgcccagggtcagtgta

SEQ ID NO: 3011399 - DNA, 14 bp, Homo sapiens
gaatgctgtacatc

SEQ ID NO: 3011400 - DNA, 20 bp, Homo sapiens
gaatgctgtacatctatttt

SEQ ID NO: 3011401 - DNA, 11 bp, Homo sapiens
gaatgcttctg

SEQ ID NO: 3011402 - DNA, 23 bp, Homo sapiens
gaatggcaaataaacagtttgac

SEQ ID NO: 3011403 - DNA, 19 bp, Homo sapiens
gaatggctttgtcttgaaa

SEQ ID NO: 3011404 - DNA, 16 bp, Homo sapiens
gacactgggaggccag

SEQ ID NO: 3011405 - DNA, 15 bp, Homo sapiens
gacactggtgtatct

SEQ ID NO: 3011406 - DNA, 24 bp, Homo sapiens
gacactgtggttatgcagaagcag

SEQ ID NO: 3011407 - DNA, 20 bp, Homo sapiens
gacacttctttatactctct

SEQ ID NO: 3011408 - DNA, 16 bp, Homo sapiens
gacacttttaaaataa

SEQ ID NO: 3011409 - DNA, 23 bp, Homo sapiens
gacacttttaaaataaattctct

SEQ ID NO: 3011410 - DNA, 19 bp, Homo sapiens
gacacttttttgagtggat

SEQ ID NO: 3011411 - DNA, 14 bp, Homo sapiens
gacagaaccagcag

SEQ ID NO: 3011412 - DNA, 16 bp, Homo sapiens
gacagaaccagcagaa

SEQ ID NO: 3011413 - DNA, 15 bp, Homo sapiens
gacagaagcagctct

SEQ ID NO: 3011414 - DNA, 15 bp, Homo sapiens
gacagaagtttgcac

SEQ ID NO: 3011415 - DNA, 13 bp, Homo sapiens
gacagaatttttt

SEQ ID NO: 3011416 - DNA, 23 bp, Homo sapiens
gacagacaacactgggaaacaga

SEQ ID NO: 3011417 - DNA, 12 bp, Homo sapiens
gacagagaaggg

SEQ ID NO: 3011418 - DNA, 15 bp, Homo sapiens
gacagagacacctgc

SEQ ID NO: 3011419 - DNA, 17 bp, Homo sapiens
gacagagacacctgcac

SEQ ID NO: 3011420 - DNA, 22 bp, Homo sapiens
gacagagacacctgcacctccc

SEQ ID NO: 3011421 - DNA, 16 bp, Homo sapiens
gacagagccagcggct

SEQ ID NO: 3011422 - DNA, 12 bp, Homo sapiens
gacagaggaggg

SEQ ID NO: 3011423 - DNA, 15 bp, Homo sapiens
gacagaggatgagct

SEQ ID NO: 3011424 - DNA, 21 bp, Homo sapiens
gacagagggcacatgaacagc

SEQ ID NO: 3011425 - DNA, 16 bp, Homo sapiens
gacagagtatgaacac

SEQ ID NO: 3011426 - DNA, 15 bp, Homo sapiens
gacagagtctcgctc

SEQ ID NO: 3011427 - DNA, 12 bp, Homo sapiens
gacagagtgaga

SEQ ID NO: 3011428 - DNA, 19 bp, Homo sapiens
gacagatcaagctgtgaga

SEQ ID NO: 3011429 - DNA, 23 bp, Homo sapiens
gacagatcaagctgtgagacagt

SEQ ID NO: 3011430 - DNA, 18 bp, Homo sapiens
gacagatcactcctggag

SEQ ID NO: 3011431 - DNA, 20 bp, Homo sapiens
gacagatcactcctggaggc

SEQ ID NO: 3011432 - DNA, 15 bp, Homo sapiens
gacagatgaggcttt

SEQ ID NO: 3011433 - DNA, 23 bp, Homo sapiens
gacagatttcagtaatgtcttca

SEQ ID NO: 3011434 - DNA, 22 bp, Homo sapiens
gacagccacttttagctactgc

SEQ ID NO: 3011435 - DNA, 14 bp, Homo sapiens
gacagccccaccct

SEQ ID NO: 3011436 - DNA, 21 bp, Homo sapiens
gacagccccctgccccgcagg

SEQ ID NO: 3011437 - DNA, 22 bp, Homo sapiens
gacagccccctgccccgcaggc

SEQ ID NO: 3011438 - DNA, 20 bp, Homo sapiens
gacagcctccccctgtcccc

SEQ ID NO: 3011439 - DNA, 22 bp, Homo sapiens
gacagcctgtggcggtgcctgg

SEQ ID NO: 3011440 - DNA, 23 bp, Homo sapiens
gacagcctgtggcggtgcctggg

SEQ ID NO: 3011441 - DNA, 11 bp, Homo sapiens
gacagccttca

SEQ ID NO: 3011442 - DNA, 14 bp, Homo sapiens
gacagccttcagca

SEQ ID NO: 3011443 - DNA, 21 bp, Homo sapiens
gacagccttgggcctttcagt

SEQ ID NO: 3011444 - DNA, 14 bp, Homo sapiens
gacagctgctcaga

SEQ ID NO: 3011445 - DNA, 20 bp, Homo sapiens
gacagctgctcctagaggga

SEQ ID NO: 3011446 - DNA, 19 bp, Homo sapiens
gacagctgtccctgtcacc

SEQ ID NO: 3011447 - DNA, 13 bp, Homo sapiens
gacagcttggaaa

SEQ ID NO: 3011448 - DNA, 19 bp, Homo sapiens
gacaggaaaatcctctggc

SEQ ID NO: 3011449 - DNA, 17 bp, Homo sapiens
gacaggaagaccaaggc

SEQ ID NO: 3011450 - DNA, 12 bp, Homo sapiens
gacaggaagcct

SEQ ID NO: 3011451 - DNA, 22 bp, Homo sapiens
gacaggaaggtctgatttgcag

SEQ ID NO: 3011452 - DNA, 12 bp, Homo sapiens
gacaggagaaat

SEQ ID NO: 3011453 - DNA, 18 bp, Homo sapiens
gacaggagaatcacctga

SEQ ID NO: 3011454 - DNA, 16 bp, Homo sapiens
gacaggatgaggacag

SEQ ID NO: 3011455 - DNA, 18 bp, Homo sapiens
gacaggatgtgtttgctt

SEQ ID NO: 3011456 - DNA, 20 bp, Homo sapiens
gacaggatgtgtttgctttc

SEQ ID NO: 3011457 - DNA, 14 bp, Homo sapiens
gacaggcagagctg

SEQ ID NO: 3011458 - DNA, 15 bp, Homo sapiens
gacaggcgcctgcca

SEQ ID NO: 3011459 - DNA, 20 bp, Homo sapiens
gacaggctggaatgagggag

SEQ ID NO: 3011460 - DNA, 14 bp, Homo sapiens
gacaggctggctcc

SEQ ID NO: 3011461 - DNA, 14 bp, Homo sapiens
gacagggaagctac

SEQ ID NO: 3011462 - DNA, 21 bp, Homo sapiens
gacagggacatgccctgtgtg

SEQ ID NO: 3011463 - DNA, 19 bp, Homo sapiens
gacagggttttttcatttt

SEQ ID NO: 3011464 - DNA, 16 bp, Homo sapiens
gacaggtccctcccct

SEQ ID NO: 3011465 - DNA, 14 bp, Homo sapiens
gacaggtctctgag

SEQ ID NO: 3011466 - DNA, 15 bp, Homo sapiens
gacaggtctctgaga

SEQ ID NO: 3011467 - DNA, 19 bp, Homo sapiens
gacaggtctctgagacagg

SEQ ID NO: 3011468 - DNA, 19 bp, Homo sapiens
gacaggtttgggacccctg

SEQ ID NO: 3011469 - DNA, 22 bp, Homo sapiens
gacagtcgctcagtctgttcac

SEQ ID NO: 3011470 - DNA, 10 bp, Homo sapiens
gacagtctga

SEQ ID NO: 3011471 - DNA, 12 bp, Homo sapiens
gacagtctgctc

SEQ ID NO: 3011472 - DNA, 21 bp, Homo sapiens
gacagtgacgtgactcagagc

SEQ ID NO: 3011473 - DNA, 23 bp, Homo sapiens
gacagtgacgtgactcagagctt

SEQ ID NO: 3011474 - DNA, 15 bp, Homo sapiens
gacagtgcacatgaa

SEQ ID NO: 3011475 - DNA, 10 bp, Homo sapiens
gacagtgccc

SEQ ID NO: 3011476 - DNA, 20 bp, Homo sapiens
gacagtgtgggcgctctccc

SEQ ID NO: 3011477 - DNA, 15 bp, Homo sapiens
gacagtttactttgc

SEQ ID NO: 3011478 - DNA, 16 bp, Homo sapiens
gacagtttatttgttg

SEQ ID NO: 3011479 - DNA, 14 bp, Homo sapiens
gacagtttttctgt

SEQ ID NO: 3011480 - DNA, 15 bp, Homo sapiens
gacataagataaaat

SEQ ID NO: 3011481 - DNA, 19 bp, Homo sapiens
gacataagataaaatgatg

SEQ ID NO: 3011482 - DNA, 14 bp, Homo sapiens
gacatacttgaagg

SEQ ID NO: 3011483 - DNA, 23 bp, Homo sapiens
gacatacttgaagggccagagcc

SEQ ID NO: 3011484 - DNA, 21 bp, Homo sapiens
gacatagagagggagaagaag

SEQ ID NO: 3011485 - DNA, 23 bp, Homo sapiens
gacataggccatgaaaaaaatga

SEQ ID NO: 3011486 - DNA, 16 bp, Homo sapiens
gacatagtatggaagt

SEQ ID NO: 3011487 - DNA, 15 bp, Homo sapiens
gacatatcatgtgtg

SEQ ID NO: 3011488 - DNA, 11 bp, Homo sapiens
gacatatttaa

SEQ ID NO: 3011489 - DNA, 16 bp, Homo sapiens
gacatatttaatgttt

SEQ ID NO: 3011490 - DNA, 23 bp, Homo sapiens
gacatatttaatgttttaaatgt

SEQ ID NO: 3011491 - DNA, 15 bp, Homo sapiens
gacatcacagggtgg

SEQ ID NO: 3011492 - DNA, 11 bp, Homo sapiens
gacatcagcac

SEQ ID NO: 3011493 - DNA, 15 bp, Homo sapiens
gacatcagccagctg

SEQ ID NO: 3011494 - DNA, 16 bp, Homo sapiens
gacatccataaagaag

SEQ ID NO: 3011495 - DNA, 18 bp, Homo sapiens
gacatccctcccccagca

SEQ ID NO: 3011496 - DNA, 15 bp, Homo sapiens
gacatccttgcagtt

SEQ ID NO: 3011497 - DNA, 14 bp, Homo sapiens
gacatctggaatct

SEQ ID NO: 3011498 - DNA, 22 bp, Homo sapiens
gacatctggaatctggagacca

SEQ ID NO: 3011499 - DNA, 20 bp, Homo sapiens
gacatgaccctctgtcccca

SEQ ID NO: 3011500 - DNA, 22 bp, Homo sapiens
gacatgaccctctgtccccagg

SEQ ID NO: 3011501 - DNA, 23 bp, Homo sapiens
gacatgaccctctgtccccaggc

SEQ ID NO: 3011502 - DNA, 19 bp, Homo sapiens
gacatgatgcttttactga

SEQ ID NO: 3011503 - DNA, 20 bp, Homo sapiens
gacatgattagcagaagaaa

SEQ ID NO: 3011504 - DNA, 19 bp, Homo sapiens
gacatgatttccttgaatg

SEQ ID NO: 3011505 - DNA, 18 bp, Homo sapiens
gacatgcatgacacttcc

SEQ ID NO: 3011506 - DNA, 16 bp, Homo sapiens
gacatgccctgtgtgg

SEQ ID NO: 3011507 - DNA, 18 bp, Homo sapiens
gacatgctaaataactat

SEQ ID NO: 3011508 - DNA, 14 bp, Homo sapiens
gacatgctgccagg

SEQ ID NO: 3011509 - DNA, 15 bp, Homo sapiens
gacatgctgccagga

SEQ ID NO: 3011510 - DNA, 15 bp, Homo sapiens
gacatggaggttcta

SEQ ID NO: 3011511 - DNA, 20 bp, Homo sapiens
gacatggaggttctaaggcc

SEQ ID NO: 3011512 - DNA, 21 bp, Homo sapiens
gacatggaggttctaaggcct

SEQ ID NO: 3011513 - DNA, 17 bp, Homo sapiens
gacatgggtattttata

SEQ ID NO: 3011514 - DNA, 14 bp, Homo sapiens
gacatgtttcaaga

SEQ ID NO: 3011515 - DNA, 17 bp, Homo sapiens
gacatgttttccgtgaa

SEQ ID NO: 3011516 - DNA, 20 bp, Homo sapiens
gacatgttttgataaagtag

SEQ ID NO: 3011517 - DNA, 23 bp, Homo sapiens
gacatgttttgataaagtagtaa

SEQ ID NO: 3011518 - DNA, 23 bp, Homo sapiens
gacattagtaacataataaatta

SEQ ID NO: 3011519 - DNA, 21 bp, Homo sapiens
gacattcaaaacagttactta

SEQ ID NO: 3011520 - DNA, 21 bp, Homo sapiens
gacattcacctgccccaactc

SEQ ID NO: 3011521 - DNA, 23 bp, Homo sapiens
gacattccgtcctgatgattttt

SEQ ID NO: 3011522 - DNA, 13 bp, Homo sapiens
gacattctgattc

SEQ ID NO: 3011523 - DNA, 22 bp, Homo sapiens
gacattctgattcgaatgacac

SEQ ID NO: 3011524 - DNA, 22 bp, Homo sapiens
gacattctgccaggcccccaag

SEQ ID NO: 3011525 - DNA, 21 bp, Homo sapiens
gacattcttgtaaggctttga

SEQ ID NO: 3011526 - DNA, 13 bp, Homo sapiens
gacattgcagagt

SEQ ID NO: 3011527 - DNA, 12 bp, Homo sapiens
gacattgctaag

SEQ ID NO: 3011528 - DNA, 21 bp, Homo sapiens
gacattgggtctattccagct

SEQ ID NO: 3011529 - DNA, 16 bp, Homo sapiens
gacattgtaaataaat

SEQ ID NO: 3011530 - DNA, 21 bp, Homo sapiens
gacattgtctcctatatattt

SEQ ID NO: 3011531 - DNA, 21 bp, Homo sapiens
gacattgtttggatttccttt

SEQ ID NO: 3011532 - DNA, 22 bp, Homo sapiens
gacatttaataactttgctgga

SEQ ID NO: 3011533 - DNA, 15 bp, Homo sapiens
gacatttatattaaa

SEQ ID NO: 3011534 - DNA, 18 bp, Homo sapiens
gacatttatattaaataa

SEQ ID NO: 3011535 - DNA, 16 bp, Homo sapiens
gacatttatgtgttga

SEQ ID NO: 3011536 - DNA, 16 bp, Homo sapiens
gacatttctctaagag

SEQ ID NO: 3011537 - DNA, 16 bp, Homo sapiens
gacatttctttgtgct

SEQ ID NO: 3011538 - DNA, 13 bp, Homo sapiens
gacattttaaaaa

SEQ ID NO: 3011539 - DNA, 11 bp, Homo sapiens
gacattttatt

SEQ ID NO: 3011540 - DNA, 17 bp, Homo sapiens
gacattttctctttaaa

SEQ ID NO: 3011541 - DNA, 23 bp, Homo sapiens
gacatttttccgtttgcttttgt

SEQ ID NO: 3011542 - DNA, 23 bp, Homo sapiens
gaccaaaaaaggacgtaaaattt

SEQ ID NO: 3011543 - DNA, 14 bp, Homo sapiens
gaccaaaagttaca

SEQ ID NO: 3011544 - DNA, 22 bp, Homo sapiens
gaccaaacccttagcagcccag

SEQ ID NO: 3011545 - DNA, 12 bp, Homo sapiens
gaccaaaggggg

SEQ ID NO: 3011546 - DNA, 17 bp, Homo sapiens
gaccaaagtcccttcct

SEQ ID NO: 3011547 - DNA, 19 bp, Homo sapiens
gaccaaagtcccttcctgc

SEQ ID NO: 3011548 - DNA, 16 bp, Homo sapiens
gaccaacatggagaaa

SEQ ID NO: 3011549 - DNA, 17 bp, Homo sapiens
gaccaacatggagaaac

SEQ ID NO: 3011550 - DNA, 13 bp, Homo sapiens
gaccaacctgacc

SEQ ID NO: 3011551 - DNA, 12 bp, Homo sapiens
gaccaagcagga

SEQ ID NO: 3011552 - DNA, 14 bp, Homo sapiens
gaccaagcaggaag

SEQ ID NO: 3011553 - DNA, 14 bp, Homo sapiens
gaccaaggagcatc

SEQ ID NO: 3011554 - DNA, 15 bp, Homo sapiens
gaccaatacatttgt

SEQ ID NO: 3011555 - DNA, 16 bp, Homo sapiens
gaccaatacatttgta

SEQ ID NO: 3011556 - DNA, 18 bp, Homo sapiens
gaccacaccagcctcctg

SEQ ID NO: 3011557 - DNA, 20 bp, Homo sapiens
gaccacacgcaggcctccct

SEQ ID NO: 3011558 - DNA, 19 bp, Homo sapiens
gaccacgcacctccacgcc

SEQ ID NO: 3011559 - DNA, 13 bp, Homo sapiens
gaccacggctcga

SEQ ID NO: 3011560 - DNA, 15 bp, Homo sapiens
gaccactccagagaa

SEQ ID NO: 3011561 - DNA, 21 bp, Homo sapiens
gaccactgcatgagcttttat

SEQ ID NO: 3011562 - DNA, 12 bp, Homo sapiens
gaccactgggcc

SEQ ID NO: 3011563 - DNA, 18 bp, Homo sapiens
gaccactgggcccctcag

SEQ ID NO: 3011564 - DNA, 19 bp, Homo sapiens
gaccactgggcccctcagg

SEQ ID NO: 3011565 - DNA, 17 bp, Homo sapiens
gaccagaaacctgggag

SEQ ID NO: 3011566 - DNA, 18 bp, Homo sapiens
gaccagaaacctgggaga

SEQ ID NO: 3011567 - DNA, 18 bp, Homo sapiens
gaccagagcaaaaatgta

SEQ ID NO: 3011568 - DNA, 20 bp, Homo sapiens
gaccagagcaaaaatgtaaa

SEQ ID NO: 3011569 - DNA, 14 bp, Homo sapiens
gaccagagggatgg

SEQ ID NO: 3011570 - DNA, 13 bp, Homo sapiens
gaccagcagcgcc

SEQ ID NO: 3011571 - DNA, 23 bp, Homo sapiens
gaccagcagcgcctttcccaact

SEQ ID NO: 3011572 - DNA, 19 bp, Homo sapiens
gaccagcctgtccaacatg

SEQ ID NO: 3011573 - DNA, 12 bp, Homo sapiens
gaccagctcagg

SEQ ID NO: 3011574 - DNA, 18 bp, Homo sapiens
gaccaggacccagggaga

SEQ ID NO: 3011575 - DNA, 20 bp, Homo sapiens
gaccaggacccagggagagg

SEQ ID NO: 3011576 - DNA, 22 bp, Homo sapiens
gaccaggctgggcatcatagca

SEQ ID NO: 3011577 - DNA, 22 bp, Homo sapiens
gaccagggagcctttggttctg

SEQ ID NO: 3011578 - DNA, 14 bp, Homo sapiens
gaccagggcagggc

SEQ ID NO: 3011579 - DNA, 19 bp, Homo sapiens
gaccagggccttttctggc

SEQ ID NO: 3011580 - DNA, 23 bp, Homo sapiens
gaccaggtcctgctccgctgcct

SEQ ID NO: 3011581 - DNA, 15 bp, Homo sapiens
gaccagtctgaccct

SEQ ID NO: 3011582 - DNA, 11 bp, Homo sapiens
gaccagtgaag

SEQ ID NO: 3011583 - DNA, 14 bp, Homo sapiens
gaccagtggtctca

SEQ ID NO: 3011584 - DNA, 14 bp, Homo sapiens
gaccagtttcttaa

SEQ ID NO: 3011585 - DNA, 13 bp, Homo sapiens
gaccagtttcttt

SEQ ID NO: 3011586 - DNA, 13 bp, Homo sapiens
gaccatactcaga

SEQ ID NO: 3011587 - DNA, 12 bp, Homo sapiens
gaccatctgtga

SEQ ID NO: 3011588 - DNA, 14 bp, Homo sapiens
gaccatctgtgact

SEQ ID NO: 3011589 - DNA, 16 bp, Homo sapiens
gaccatctgtgactat

SEQ ID NO: 3011590 - DNA, 24 bp, Homo sapiens
gaccatgcgacactgggaggccag

SEQ ID NO: 3011591 - DNA, 12 bp, Homo sapiens
gaccatgtgaat

SEQ ID NO: 3011592 - DNA, 17 bp, Homo sapiens
gaccatgtgaatctggg

SEQ ID NO: 3011593 - DNA, 18 bp, Homo sapiens
gaccatttgtagtgagcg

SEQ ID NO: 3011594 - DNA, 14 bp, Homo sapiens
gacccaaagcagga

SEQ ID NO: 3011595 - DNA, 13 bp, Homo sapiens
gacccaaggagga

SEQ ID NO: 3011596 - DNA, 21 bp, Homo sapiens
gacccacttctcatcacacac

SEQ ID NO: 3011597 - DNA, 18 bp, Homo sapiens
gacccagcccgcggcctg

SEQ ID NO: 3011598 - DNA, 21 bp, Homo sapiens
gacccagcccgcggcctggac

SEQ ID NO: 3011599 - DNA, 20 bp, Homo sapiens
gacccaggactcctccccac

SEQ ID NO: 3011600 - DNA, 19 bp, Homo sapiens
gacccagggaacagccact

SEQ ID NO: 3011601 - DNA, 12 bp, Homo sapiens
gacccagggaga

SEQ ID NO: 3011602 - DNA, 14 bp, Homo sapiens
gacccagggagagg

SEQ ID NO: 3011603 - DNA, 18 bp, Homo sapiens
gacccagggagaggctgt

SEQ ID NO: 3011604 - DNA, 18 bp, Homo sapiens
gacccagggggctgaaac

SEQ ID NO: 3011605 - DNA, 15 bp, Homo sapiens
gacccagtccctggg

SEQ ID NO: 3011606 - DNA, 15 bp, Homo sapiens
gacccagtgccccca

SEQ ID NO: 3011607 - DNA, 20 bp, Homo sapiens
gacccagtgcccccactgac

SEQ ID NO: 3011608 - DNA, 13 bp, Homo sapiens
gacccatctctcc

SEQ ID NO: 3011609 - DNA, 22 bp, Homo sapiens
gacccatgggggctgtctttgc

SEQ ID NO: 3011610 - DNA, 13 bp, Homo sapiens
gacccatggtcat

SEQ ID NO: 3011611 - DNA, 15 bp, Homo sapiens
gaccccaggcccact

SEQ ID NO: 3011612 - DNA, 19 bp, Homo sapiens
gaccccatcactcgcagga

SEQ ID NO: 3011613 - DNA, 23 bp, Homo sapiens
gacccccactctcattccccagg

SEQ ID NO: 3011614 - DNA, 17 bp, Homo sapiens
gacccccagctccggcc

SEQ ID NO: 3011615 - DNA, 15 bp, Homo sapiens
gacccccgccccctg

SEQ ID NO: 3011616 - DNA, 18 bp, Homo sapiens
gacccccgccccctgccc

SEQ ID NO: 3011617 - DNA, 15 bp, Homo sapiens
gacccccgtggggca

SEQ ID NO: 3011618 - DNA, 20 bp, Homo sapiens
gaccccgagcctggctccaa

SEQ ID NO: 3011619 - DNA, 16 bp, Homo sapiens
gacccctaccccctca

SEQ ID NO: 3011620 - DNA, 21 bp, Homo sapiens
gacccctatgaagtaaagaac

SEQ ID NO: 3011621 - DNA, 11 bp, Homo sapiens
gacccctcctg

SEQ ID NO: 3011622 - DNA, 14 bp, Homo sapiens
gacccctcctgggg

SEQ ID NO: 3011623 - DNA, 20 bp, Homo sapiens
gacccctcctggggccaggc

SEQ ID NO: 3011624 - DNA, 22 bp, Homo sapiens
gacccctcctggggccaggccg

SEQ ID NO: 3011625 - DNA, 13 bp, Homo sapiens
gacccctggctct

SEQ ID NO: 3011626 - DNA, 16 bp, Homo sapiens
gacccctggctctggg

SEQ ID NO: 3011627 - DNA, 17 bp, Homo sapiens
gacccctggctctgggc

SEQ ID NO: 3011628 - DNA, 15 bp, Homo sapiens
gacccgaggcccaga

SEQ ID NO: 3011629 - DNA, 16 bp, Homo sapiens
gacccgaggcccagat

SEQ ID NO: 3011630 - DNA, 13 bp, Homo sapiens
gacccgccagccc

SEQ ID NO: 3011631 - DNA, 14 bp, Homo sapiens
gacccgccagcccc

SEQ ID NO: 3011632 - DNA, 20 bp, Homo sapiens
gacccggattggccctgccc

SEQ ID NO: 3011633 - DNA, 14 bp, Homo sapiens
gacccgggaaggaa

SEQ ID NO: 3011634 - DNA, 15 bp, Homo sapiens
gacccggggtctcct

SEQ ID NO: 3011635 - DNA, 11 bp, Homo sapiens
gaccctacccc

SEQ ID NO: 3011636 - DNA, 14 bp, Homo sapiens
gaccctaccccacc

SEQ ID NO: 3011637 - DNA, 22 bp, Homo sapiens
gaccctcaggtgtagctgagct

SEQ ID NO: 3011638 - DNA, 19 bp, Homo sapiens
gaccctcatctttcttcca

SEQ ID NO: 3011639 - DNA, 12 bp, Homo sapiens
gaccctctcact

SEQ ID NO: 3011640 - DNA, 16 bp, Homo sapiens
gaccctctcaggctgt

SEQ ID NO: 3011641 - DNA, 11 bp, Homo sapiens
gaccctctgct

SEQ ID NO: 3011642 - DNA, 17 bp, Homo sapiens
gaccctctgctgaagac

SEQ ID NO: 3011643 - DNA, 14 bp, Homo sapiens
gaccctctgtcccc

SEQ ID NO: 3011644 - DNA, 22 bp, Homo sapiens
gaccctctgtccccaggcctgg

SEQ ID NO: 3011645 - DNA, 16 bp, Homo sapiens
gaccctgaaggggcca

SEQ ID NO: 3011646 - DNA, 20 bp, Homo sapiens
gaccctgagctgaccagccg

SEQ ID NO: 3011647 - DNA, 12 bp, Homo sapiens
gaccctgcggcc

SEQ ID NO: 3011648 - DNA, 18 bp, Homo sapiens
gaccctggagtatttgga

SEQ ID NO: 3011649 - DNA, 16 bp, Homo sapiens
gaccctggggctggct

SEQ ID NO: 3011650 - DNA, 11 bp, Homo sapiens
gaccctggggg

SEQ ID NO: 3011651 - DNA, 17 bp, Homo sapiens
gaccctgggggcacagg

SEQ ID NO: 3011652 - DNA, 12 bp, Homo sapiens
gaccctgtaaat

SEQ ID NO: 3011653 - DNA, 15 bp, Homo sapiens
gaccctgtgccccag

SEQ ID NO: 3011654 - DNA, 20 bp, Homo sapiens
gacccttacagcctctgact

SEQ ID NO: 3011655 - DNA, 20 bp, Homo sapiens
gaccctttccttccttccct

SEQ ID NO: 3011656 - DNA, 23 bp, Homo sapiens
gaccctttccttccttccctggc

SEQ ID NO: 3011657 - DNA, 17 bp, Homo sapiens
gaccgcccttttcccct

SEQ ID NO: 3011658 - DNA, 14 bp, Homo sapiens
gaccgctgcccagg

SEQ ID NO: 3011659 - DNA, 18 bp, Homo sapiens
gaccgctgcccaggtggg

SEQ ID NO: 3011660 - DNA, 15 bp, Homo sapiens
gaccggcggctcgga

SEQ ID NO: 3011661 - DNA, 12 bp, Homo sapiens
gaccggctgccg

SEQ ID NO: 3011662 - DNA, 17 bp, Homo sapiens
gaccgggcactcccggg

SEQ ID NO: 3011663 - DNA, 15 bp, Homo sapiens
gaccggtacagaaag

SEQ ID NO: 3011664 - DNA, 21 bp, Homo sapiens
gacctacagacagacatacat

SEQ ID NO: 3011665 - DNA, 20 bp, Homo sapiens
gacctaccagggacaagcag

SEQ ID NO: 3011666 - DNA, 17 bp, Homo sapiens
gacctactgttctaaag

SEQ ID NO: 3011667 - DNA, 18 bp, Homo sapiens
gacctactgttctaaagc

SEQ ID NO: 3011668 - DNA, 17 bp, Homo sapiens
gacctcaagtgatctgc

SEQ ID NO: 3011669 - DNA, 13 bp, Homo sapiens
gacctcacctggt

SEQ ID NO: 3011670 - DNA, 13 bp, Homo sapiens
gacctcagggcac

SEQ ID NO: 3011671 - DNA, 21 bp, Homo sapiens
gacctcagggctatgtggatt

SEQ ID NO: 3011672 - DNA, 19 bp, Homo sapiens
gacctcaggtgatccgccc

SEQ ID NO: 3011673 - DNA, 17 bp, Homo sapiens
gacctccagtcctgctg

SEQ ID NO: 3011674 - DNA, 19 bp, Homo sapiens
gacctccagtcctgctggc

SEQ ID NO: 3011675 - DNA, 18 bp, Homo sapiens
gacctcccaactctaaag

SEQ ID NO: 3011676 - DNA, 18 bp, Homo sapiens
gacctcgtcctccccctg

SEQ ID NO: 3011677 - DNA, 19 bp, Homo sapiens
gacctcgtcctccccctgc

SEQ ID NO: 3011678 - DNA, 19 bp, Homo sapiens
gacctctccagctctggct

SEQ ID NO: 3011679 - DNA, 19 bp, Homo sapiens
gacctctctcagccccatc

SEQ ID NO: 3011680 - DNA, 11 bp, Homo sapiens
gacctctctcg

SEQ ID NO: 3011681 - DNA, 23 bp, Homo sapiens
gacctctggattaggtctctgtt

SEQ ID NO: 3011682 - DNA, 19 bp, Homo sapiens
gacctgaaattccaaagtc

SEQ ID NO: 3011683 - DNA, 12 bp, Homo sapiens
gacctgagcccg

SEQ ID NO: 3011684 - DNA, 22 bp, Homo sapiens
gacctgagcccgcagcccagac

SEQ ID NO: 3011685 - DNA, 14 bp, Homo sapiens
gacctgaggaagcg

SEQ ID NO: 3011686 - DNA, 14 bp, Homo sapiens
gacctgatcctgga

SEQ ID NO: 3011687 - DNA, 20 bp, Homo sapiens
gacctgcgggtcctcagctg

SEQ ID NO: 3011688 - DNA, 15 bp, Homo sapiens
gacctggcagctctg

SEQ ID NO: 3011689 - DNA, 21 bp, Homo sapiens
gacctggggttgtcagctctc

SEQ ID NO: 3011690 - DNA, 17 bp, Homo sapiens
gacctggtgctgcctct

SEQ ID NO: 3011691 - DNA, 15 bp, Homo sapiens
gacctggtgggagca

SEQ ID NO: 3011692 - DNA, 18 bp, Homo sapiens
gacctggtgggagcacct

SEQ ID NO: 3011693 - DNA, 19 bp, Homo sapiens
gacctggtttgaatggaga

SEQ ID NO: 3011694 - DNA, 18 bp, Homo sapiens
gacctgttagcagacagg

SEQ ID NO: 3011695 - DNA, 18 bp, Homo sapiens
gaccttaatttaactttc

SEQ ID NO: 3011696 - DNA, 18 bp, Homo sapiens
gaccttacgatcaggcac

SEQ ID NO: 3011697 - DNA, 18 bp, Homo sapiens
gaccttaggccttcctct

SEQ ID NO: 3011698 - DNA, 23 bp, Homo sapiens
gaccttagtgtttctgtgcatgg

SEQ ID NO: 3011699 - DNA, 12 bp, Homo sapiens
gaccttcaaatg

SEQ ID NO: 3011700 - DNA, 18 bp, Homo sapiens
gaccttcagctcacgctt

SEQ ID NO: 3011701 - DNA, 16 bp, Homo sapiens
gaccttccaagagcct

SEQ ID NO: 3011702 - DNA, 17 bp, Homo sapiens
gaccttccaagagcctg

SEQ ID NO: 3011703 - DNA, 16 bp, Homo sapiens
gaccttccaagtttga

SEQ ID NO: 3011704 - DNA, 16 bp, Homo sapiens
gaccttcgggctgtgc

SEQ ID NO: 3011705 - DNA, 15 bp, Homo sapiens
gaccttgacagagca

SEQ ID NO: 3011706 - DNA, 18 bp, Homo sapiens
gaccttgacagagcagct

SEQ ID NO: 3011707 - DNA, 12 bp, Homo sapiens
gaccttggtctg

SEQ ID NO: 3011708 - DNA, 13 bp, Homo sapiens
gaccttgtctcta

SEQ ID NO: 3011709 - DNA, 22 bp, Homo sapiens
gacctttaaaaagcaggaaata

SEQ ID NO: 3011710 - DNA, 13 bp, Homo sapiens
gacctttgcccac

SEQ ID NO: 3011711 - DNA, 18 bp, Homo sapiens
gacctttgtacagcccag

SEQ ID NO: 3011712 - DNA, 12 bp, Homo sapiens
gacgaactggct

SEQ ID NO: 3011713 - DNA, 23 bp, Homo sapiens
gacgatgccgtgtgtctcgtctc

SEQ ID NO: 3011714 - DNA, 15 bp, Homo sapiens
gacgcaggcccctct

SEQ ID NO: 3011715 - DNA, 17 bp, Homo sapiens
gacgcaggcccctctcc

SEQ ID NO: 3011716 - DNA, 17 bp, Homo sapiens
gacgctaataaaaattt

SEQ ID NO: 3011717 - DNA, 11 bp, Homo sapiens
gacggatggca

SEQ ID NO: 3011718 - DNA, 22 bp, Homo sapiens
gacggcacggtcttccctcttc

SEQ ID NO: 3011719 - DNA, 15 bp, Homo sapiens
gacggctgccattgg

SEQ ID NO: 3011720 - DNA, 18 bp, Homo sapiens
gacggctgggcacacgcc

SEQ ID NO: 3011721 - DNA, 23 bp, Homo sapiens
gacggctgggtgtttcagtttga

SEQ ID NO: 3011722 - DNA, 13 bp, Homo sapiens
gacggctgtgacg

SEQ ID NO: 3011723 - DNA, 17 bp, Homo sapiens
gacggctgtgggaccag

SEQ ID NO: 3011724 - DNA, 12 bp, Homo sapiens
gacgggccaggc

SEQ ID NO: 3011725 - DNA, 18 bp, Homo sapiens
gacgggccaggccctgga

SEQ ID NO: 3011726 - DNA, 21 bp, Homo sapiens
gacggtcagtttggtgtcaac

SEQ ID NO: 3011727 - DNA, 16 bp, Homo sapiens
gacgtagagcacagcc

SEQ ID NO: 3011728 - DNA, 11 bp, Homo sapiens
gacgtgcactg

SEQ ID NO: 3011729 - DNA, 22 bp, Homo sapiens
gacgtgcactgtgaatcctggc

SEQ ID NO: 3011730 - DNA, 14 bp, Homo sapiens
gacgtgctggcctt

SEQ ID NO: 3011731 - DNA, 14 bp, Homo sapiens
gacgtgggccctgc

SEQ ID NO: 3011732 - DNA, 23 bp, Homo sapiens
gacgtgggccctgcaggctgcag

SEQ ID NO: 3011733 - DNA, 20 bp, Homo sapiens
gacgttggcctcagggccag

SEQ ID NO: 3011734 - DNA, 23 bp, Homo sapiens
gacgtttctcatttgtttttctc

SEQ ID NO: 3011735 - DNA, 11 bp, Homo sapiens
gactaaaatgt

SEQ ID NO: 3011736 - DNA, 13 bp, Homo sapiens
gactaaaatgttt

SEQ ID NO: 3011737 - DNA, 17 bp, Homo sapiens
gactaaagttgtgccaa

SEQ ID NO: 3011738 - DNA, 23 bp, Homo sapiens
gactaactagacaccaaagttct

SEQ ID NO: 3011739 - DNA, 19 bp, Homo sapiens
gactaagaataagaagcat

SEQ ID NO: 3011740 - DNA, 14 bp, Homo sapiens
gactaagccaagct

SEQ ID NO: 3011741 - DNA, 13 bp, Homo sapiens
gactaattgtata

SEQ ID NO: 3011742 - DNA, 19 bp, Homo sapiens
gactaattgtataacaggt

SEQ ID NO: 3011743 - DNA, 18 bp, Homo sapiens
gactaattttacatgttt

SEQ ID NO: 3011744 - DNA, 23 bp, Homo sapiens
gactaattttacatgtttataaa

SEQ ID NO: 3011745 - DNA, 18 bp, Homo sapiens
gactagacaccttctgtg

SEQ ID NO: 3011746 - DNA, 16 bp, Homo sapiens
gactagatgatggatg

SEQ ID NO: 3011747 - DNA, 14 bp, Homo sapiens
gactagcctggcca

SEQ ID NO: 3011748 - DNA, 16 bp, Homo sapiens
gactagggagccatgt

SEQ ID NO: 3011749 - DNA, 23 bp, Homo sapiens
gactagggcctcggaggctcctc

SEQ ID NO: 3011750 - DNA, 21 bp, Homo sapiens
gactatcccaacagtcatgtt

SEQ ID NO: 3011751 - DNA, 19 bp, Homo sapiens
gactatggaatgtcagtgt

SEQ ID NO: 3011752 - DNA, 21 bp, Homo sapiens
gactattatgttgttagagaa

SEQ ID NO: 3011753 - DNA, 12 bp, Homo sapiens
gactatttacca

SEQ ID NO: 3011754 - DNA, 23 bp, Homo sapiens
gactcaagacttatggaacaggg

SEQ ID NO: 3011755 - DNA, 20 bp, Homo sapiens
gactcaagtttttacaaaat

SEQ ID NO: 3011756 - DNA, 15 bp, Homo sapiens
gactcacacttgtaa

SEQ ID NO: 3011757 - DNA, 15 bp, Homo sapiens
gactcacctctgcct

SEQ ID NO: 3011758 - DNA, 16 bp, Homo sapiens
gactcactggcagccc

SEQ ID NO: 3011759 - DNA, 23 bp, Homo sapiens
gactcactggcagccccagcacc

SEQ ID NO: 3011760 - DNA, 20 bp, Homo sapiens
gactcacttgatgtttcctg

SEQ ID NO: 3011761 - DNA, 18 bp, Homo sapiens
gactcagacattggcacc

SEQ ID NO: 3011762 - DNA, 12 bp, Homo sapiens
gactcagagctt

SEQ ID NO: 3011763 - DNA, 14 bp, Homo sapiens
gactcagctctgtc

SEQ ID NO: 3011764 - DNA, 17 bp, Homo sapiens
gactcagggcagcgcca

SEQ ID NO: 3011765 - DNA, 17 bp, Homo sapiens
gactcagggctcctggg

SEQ ID NO: 3011766 - DNA, 19 bp, Homo sapiens
gactcaggtggtgtccttc

SEQ ID NO: 3011767 - DNA, 14 bp, Homo sapiens
gactcatcatttgt

SEQ ID NO: 3011768 - DNA, 15 bp, Homo sapiens
gactcatcctgaaca

SEQ ID NO: 3011769 - DNA, 17 bp, Homo sapiens
gactcatcctgaacagc

SEQ ID NO: 3011770 - DNA, 19 bp, Homo sapiens
gactcatcctgaacagcat

SEQ ID NO: 3011771 - DNA, 14 bp, Homo sapiens
gactcatgcctctg

SEQ ID NO: 3011772 - DNA, 19 bp, Homo sapiens
gactcattaaatattctgt

SEQ ID NO: 3011773 - DNA, 11 bp, Homo sapiens
gactcattcac

SEQ ID NO: 3011774 - DNA, 16 bp, Homo sapiens
gactcattctgaagga

SEQ ID NO: 3011775 - DNA, 17 bp, Homo sapiens
gactcattctgaaggag

SEQ ID NO: 3011776 - DNA, 15 bp, Homo sapiens
gactccatttctttc

SEQ ID NO: 3011777 - DNA, 22 bp, Homo sapiens
gactcccattcctgaagaacca

SEQ ID NO: 3011778 - DNA, 23 bp, Homo sapiens
gactcccattcctgaagaaccag

SEQ ID NO: 3011779 - DNA, 22 bp, Homo sapiens
gactcccattttggtgtgcatc

SEQ ID NO: 3011780 - DNA, 15 bp, Homo sapiens
gactcccccaaccaa

SEQ ID NO: 3011781 - DNA, 21 bp, Homo sapiens
gactcccccaaccaaggaagg

SEQ ID NO: 3011782 - DNA, 22 bp, Homo sapiens
gactcccgccccgggctggccc

SEQ ID NO: 3011783 - DNA, 17 bp, Homo sapiens
gactccctccccaccca

SEQ ID NO: 3011784 - DNA, 18 bp, Homo sapiens
gactccctccccacccaa

SEQ ID NO: 3011785 - DNA, 19 bp, Homo sapiens
gactccctccccacccaag

SEQ ID NO: 3011786 - DNA, 21 bp, Homo sapiens
gactccctccccacccaagag

SEQ ID NO: 3011787 - DNA, 14 bp, Homo sapiens
gactcctaggccct

SEQ ID NO: 3011788 - DNA, 21 bp, Homo sapiens
gactcctccccaccctcctgg

SEQ ID NO: 3011789 - DNA, 22 bp, Homo sapiens
gactcctccccaccctcctggc

SEQ ID NO: 3011790 - DNA, 15 bp, Homo sapiens
gactcctgaagggaa

SEQ ID NO: 3011791 - DNA, 20 bp, Homo sapiens
gactcctgaggacagctgtc

SEQ ID NO: 3011792 - DNA, 21 bp, Homo sapiens
gactcctgaggacagctgtcc

SEQ ID NO: 3011793 - DNA, 20 bp, Homo sapiens
gactcgttcccatagatttg

SEQ ID NO: 3011794 - DNA, 14 bp, Homo sapiens
gactctagcaaggc

SEQ ID NO: 3011795 - DNA, 16 bp, Homo sapiens
gactctcagtctctga

SEQ ID NO: 3011796 - DNA, 18 bp, Homo sapiens
gactctctaacagggcag

SEQ ID NO: 3011797 - DNA, 19 bp, Homo sapiens
gactctctgagctggggag

SEQ ID NO: 3011798 - DNA, 13 bp, Homo sapiens
gactctctgcttg

SEQ ID NO: 3011799 - DNA, 14 bp, Homo sapiens
gactctgcacatga

SEQ ID NO: 3011800 - DNA, 15 bp, Homo sapiens
gactctgcacatgtc

SEQ ID NO: 3011801 - DNA, 16 bp, Homo sapiens
gactctggcttggcct

SEQ ID NO: 3011802 - DNA, 20 bp, Homo sapiens
gactctgtaaccacctctct

SEQ ID NO: 3011803 - DNA, 19 bp, Homo sapiens
gactcttccattcagtttt

SEQ ID NO: 3011804 - DNA, 20 bp, Homo sapiens
gactcttccattcagtttta

SEQ ID NO: 3011805 - DNA, 22 bp, Homo sapiens
gactcttctaaaaatgaagatg

SEQ ID NO: 3011806 - DNA, 14 bp, Homo sapiens
gactcttgttttca

SEQ ID NO: 3011807 - DNA, 16 bp, Homo sapiens
gactgaaaacctctcc

SEQ ID NO: 3011808 - DNA, 14 bp, Homo sapiens
gactgaaaccattt

SEQ ID NO: 3011809 - DNA, 14 bp, Homo sapiens
gactgaaagaagaa

SEQ ID NO: 3011810 - DNA, 16 bp, Homo sapiens
gactgaaagaagaaca

SEQ ID NO: 3011811 - DNA, 17 bp, Homo sapiens
gactgaaagaagaacag

SEQ ID NO: 3011812 - DNA, 15 bp, Homo sapiens
gactgagacccgttc

SEQ ID NO: 3011813 - DNA, 15 bp, Homo sapiens
gactgagcgaggaaa

SEQ ID NO: 3011814 - DNA, 19 bp, Homo sapiens
gactgagcgaggaaaaaca

SEQ ID NO: 3011815 - DNA, 24 bp, Homo sapiens
gactgagcgaggaaaaacaacaaa

SEQ ID NO: 3011816 - DNA, 14 bp, Homo sapiens
gactgagctctcca

SEQ ID NO: 3011817 - DNA, 20 bp, Homo sapiens
gactgagctctccaggccag

SEQ ID NO: 3011818 - DNA, 16 bp, Homo sapiens
gactgatccctggcca

SEQ ID NO: 3011819 - DNA, 20 bp, Homo sapiens
gactgatccctggccactga

SEQ ID NO: 3011820 - DNA, 19 bp, Homo sapiens
gactgatgacaaacccagg

SEQ ID NO: 3011821 - DNA, 21 bp, Homo sapiens
gactgatgttgagggaacaga

SEQ ID NO: 3011822 - DNA, 13 bp, Homo sapiens
gactgatttcaaa

SEQ ID NO: 3011823 - DNA, 15 bp, Homo sapiens
gactgcacccaggag

SEQ ID NO: 3011824 - DNA, 18 bp, Homo sapiens
gactgcacccaggagggg

SEQ ID NO: 3011825 - DNA, 18 bp, Homo sapiens
gactgcccagccactcca

SEQ ID NO: 3011826 - DNA, 13 bp, Homo sapiens
gactgccccagcc

SEQ ID NO: 3011827 - DNA, 15 bp, Homo sapiens
gactgccccagccaa

SEQ ID NO: 3011828 - DNA, 10 bp, Homo sapiens
gactgcctcc

SEQ ID NO: 3011829 - DNA, 13 bp, Homo sapiens
gactgcctccctc

SEQ ID NO: 3011830 - DNA, 20 bp, Homo sapiens
gactgcgctgctttttcaaa

SEQ ID NO: 3011831 - DNA, 18 bp, Homo sapiens
gactgctaaataaaattt

SEQ ID NO: 3011832 - DNA, 21 bp, Homo sapiens
gactgctacctttcaaagctt

SEQ ID NO: 3011833 - DNA, 13 bp, Homo sapiens
gactgctgctccc

SEQ ID NO: 3011834 - DNA, 22 bp, Homo sapiens
gactggaaaaatgaactgtatt

SEQ ID NO: 3011835 - DNA, 15 bp, Homo sapiens
gactggaacactaga

SEQ ID NO: 3011836 - DNA, 20 bp, Homo sapiens
gactggaggtcgaagcaatc

SEQ ID NO: 3011837 - DNA, 15 bp, Homo sapiens
gactggccagggcca

SEQ ID NO: 3011838 - DNA, 16 bp, Homo sapiens
gactggccgggcaggc

SEQ ID NO: 3011839 - DNA, 22 bp, Homo sapiens
gactggccgggcaggcgtgact

SEQ ID NO: 3011840 - DNA, 10 bp, Homo sapiens
gactggcttt

SEQ ID NO: 3011841 - DNA, 18 bp, Homo sapiens
gactgggccatgggtcct

SEQ ID NO: 3011842 - DNA, 12 bp, Homo sapiens
gactgggcccag

SEQ ID NO: 3011843 - DNA, 13 bp, Homo sapiens
gactgggcccagg

SEQ ID NO: 3011844 - DNA, 15 bp, Homo sapiens
gactgggcccaggca

SEQ ID NO: 3011845 - DNA, 17 bp, Homo sapiens
gactgggcccaggcagg

SEQ ID NO: 3011846 - DNA, 20 bp, Homo sapiens
gactgggcccaggcaggtct

SEQ ID NO: 3011847 - DNA, 21 bp, Homo sapiens
gactgggcccaggcaggtctg

SEQ ID NO: 3011848 - DNA, 13 bp, Homo sapiens
gactgggctgggt

SEQ ID NO: 3011849 - DNA, 18 bp, Homo sapiens
gactgggtctgacctggt

SEQ ID NO: 3011850 - DNA, 21 bp, Homo sapiens
gactgggtctgacctggtggg

SEQ ID NO: 3011851 - DNA, 21 bp, Homo sapiens
gactggtaggaggaggcatgg

SEQ ID NO: 3011852 - DNA, 17 bp, Homo sapiens
gactggtgagagaagaa

SEQ ID NO: 3011853 - DNA, 15 bp, Homo sapiens
gactggttatcttgt

SEQ ID NO: 3011854 - DNA, 14 bp, Homo sapiens
gactgtatttgtga

SEQ ID NO: 3011855 - DNA, 19 bp, Homo sapiens
gactgtatttgtgactaat

SEQ ID NO: 3011856 - DNA, 14 bp, Homo sapiens
gactgtattttgtt

SEQ ID NO: 3011857 - DNA, 12 bp, Homo sapiens
gactgtgacatc

SEQ ID NO: 3011858 - DNA, 19 bp, Homo sapiens
gactgtgcggcacaggaaa

SEQ ID NO: 3011859 - DNA, 21 bp, Homo sapiens
gactgtggcacttgcctgggt

SEQ ID NO: 3011860 - DNA, 17 bp, Homo sapiens
gactgtggccctgtctg

SEQ ID NO: 3011861 - DNA, 22 bp, Homo sapiens
gactgtgtatagtgccaccaca

SEQ ID NO: 3011862 - DNA, 14 bp, Homo sapiens
gacttaacttttta

SEQ ID NO: 3011863 - DNA, 15 bp, Homo sapiens
gacttaactttttaa

SEQ ID NO: 3011864 - DNA, 12 bp, Homo sapiens
gacttactctaa

SEQ ID NO: 3011865 - DNA, 14 bp, Homo sapiens
gacttactctaaga

SEQ ID NO: 3011866 - DNA, 23 bp, Homo sapiens
gacttagatattaaaatttggtg

SEQ ID NO: 3011867 - DNA, 14 bp, Homo sapiens
gacttatgaaactt

SEQ ID NO: 3011868 - DNA, 22 bp, Homo sapiens
gacttattgtggataacaaaga

SEQ ID NO: 3011869 - DNA, 23 bp, Homo sapiens
gacttattgtggataacaaagat

SEQ ID NO: 3011870 - DNA, 12 bp, Homo sapiens
gacttcaaagca

SEQ ID NO: 3011871 - DNA, 13 bp, Homo sapiens
gacttcacactgc

SEQ ID NO: 3011872 - DNA, 14 bp, Homo sapiens
gacttcacactgca

SEQ ID NO: 3011873 - DNA, 21 bp, Homo sapiens
gacttcagaacagtgtttgat

SEQ ID NO: 3011874 - DNA, 24 bp, Homo sapiens
gacttcaggtggagagcactagaa

SEQ ID NO: 3011875 - DNA, 19 bp, Homo sapiens
gacttcagtcctggtctgc

SEQ ID NO: 3011876 - DNA, 22 bp, Homo sapiens
gacttcagtcctggtctgctca

SEQ ID NO: 3011877 - DNA, 16 bp, Homo sapiens
gacttcataactagga

SEQ ID NO: 3011878 - DNA, 15 bp, Homo sapiens
gacttccacattttt

SEQ ID NO: 3011879 - DNA, 18 bp, Homo sapiens
gacttcccacggctcctc

SEQ ID NO: 3011880 - DNA, 16 bp, Homo sapiens
gacttgcctccgtgtc

SEQ ID NO: 3011881 - DNA, 17 bp, Homo sapiens
gacttgcctccgtgtca

SEQ ID NO: 3011882 - DNA, 22 bp, Homo sapiens
gacttgccttcctaagcctgtg

SEQ ID NO: 3011883 - DNA, 21 bp, Homo sapiens
gacttggagaatactgccaaa

SEQ ID NO: 3011884 - DNA, 19 bp, Homo sapiens
gacttggatcccaaagcaa

SEQ ID NO: 3011885 - DNA, 20 bp, Homo sapiens
gacttggatcccaaagcaag

SEQ ID NO: 3011886 - DNA, 20 bp, Homo sapiens
gacttggggagatggagttc

SEQ ID NO: 3011887 - DNA, 16 bp, Homo sapiens
gacttggtacagttgc

SEQ ID NO: 3011888 - DNA, 22 bp, Homo sapiens
gacttggtggtctgagctgtcc

SEQ ID NO: 3011889 - DNA, 21 bp, Homo sapiens
gacttgtaggaatctgccttc

SEQ ID NO: 3011890 - DNA, 22 bp, Homo sapiens
gacttgtaggaatctgccttcc

SEQ ID NO: 3011891 - DNA, 20 bp, Homo sapiens
gacttgtataacatcactgt

SEQ ID NO: 3011892 - DNA, 18 bp, Homo sapiens
gacttgtcccgggacacc

SEQ ID NO: 3011893 - DNA, 20 bp, Homo sapiens
gacttgtttcctgtgcccat

SEQ ID NO: 3011894 - DNA, 15 bp, Homo sapiens
gactttccaaatcca

SEQ ID NO: 3011895 - DNA, 19 bp, Homo sapiens
gactttcttctaaatgagc

SEQ ID NO: 3011896 - DNA, 14 bp, Homo sapiens
gacttttaaacaaa

SEQ ID NO: 3011897 - DNA, 15 bp, Homo sapiens
gacttttaaacaaaa

SEQ ID NO: 3011898 - DNA, 14 bp, Homo sapiens
gacttttgaagaac

SEQ ID NO: 3011899 - DNA, 16 bp, Homo sapiens
gacttttgaagaacaa

SEQ ID NO: 3011900 - DNA, 14 bp, Homo sapiens
gacttttgtaaaat

SEQ ID NO: 3011901 - DNA, 18 bp, Homo sapiens
gacttttgttctcttctg

SEQ ID NO: 3011902 - DNA, 16 bp, Homo sapiens
gactttttataaaatg

SEQ ID NO: 3011903 - DNA, 15 bp, Homo sapiens
gagaaaaaaaaacac

SEQ ID NO: 3011904 - DNA, 18 bp, Homo sapiens
gagaaaacgccagtgtgt

SEQ ID NO: 3011905 - DNA, 23 bp, Homo sapiens
gagaaaactcttctgaggatcat

SEQ ID NO: 3011906 - DNA, 18 bp, Homo sapiens
gagaaaataaaaagttaa

SEQ ID NO: 3011907 - DNA, 11 bp, Homo sapiens
gagaaaatata

SEQ ID NO: 3011908 - DNA, 16 bp, Homo sapiens
gagaaaatatatgtat

SEQ ID NO: 3011909 - DNA, 19 bp, Homo sapiens
gagaaacactatttgtgac

SEQ ID NO: 3011910 - DNA, 13 bp, Homo sapiens
gagaaacacttga

SEQ ID NO: 3011911 - DNA, 20 bp, Homo sapiens
gagaaacgtccatctctctc

SEQ ID NO: 3011912 - DNA, 22 bp, Homo sapiens
gagaaactttgagtacagatac

SEQ ID NO: 3011913 - DNA, 15 bp, Homo sapiens
gagaaagaaagggaa

SEQ ID NO: 3011914 - DNA, 15 bp, Homo sapiens
gagaaagcccacctg

SEQ ID NO: 3011915 - DNA, 20 bp, Homo sapiens
gagaaagcccacctgggctg

SEQ ID NO: 3011916 - DNA, 12 bp, Homo sapiens
gagaaaggacag

SEQ ID NO: 3011917 - DNA, 13 bp, Homo sapiens
gagaaaggacaga

SEQ ID NO: 3011918 - DNA, 14 bp, Homo sapiens
gagaaaggacagag

SEQ ID NO: 3011919 - DNA, 15 bp, Homo sapiens
gagaaagggacaatg

SEQ ID NO: 3011920 - DNA, 17 bp, Homo sapiens
gagaaaggggagcccac

SEQ ID NO: 3011921 - DNA, 23 bp, Homo sapiens
gagaaataaagtttgcttagaaa

SEQ ID NO: 3011922 - DNA, 15 bp, Homo sapiens
gagaaatacaaaaat

SEQ ID NO: 3011923 - DNA, 20 bp, Homo sapiens
gagaaatatggacacttaat

SEQ ID NO: 3011924 - DNA, 13 bp, Homo sapiens
gagaaatgattgt

SEQ ID NO: 3011925 - DNA, 14 bp, Homo sapiens
gagaaatgctgttc

SEQ ID NO: 3011926 - DNA, 17 bp, Homo sapiens
gagaaatgtaatgcgat

SEQ ID NO: 3011927 - DNA, 17 bp, Homo sapiens
gagaacaaacagatcga

SEQ ID NO: 3011928 - DNA, 19 bp, Homo sapiens
gagaacatgaatcaaaagt

SEQ ID NO: 3011929 - DNA, 14 bp, Homo sapiens
gagaaccataggac

SEQ ID NO: 3011930 - DNA, 18 bp, Homo sapiens
gagaacctaagtttcagt

SEQ ID NO: 3011931 - DNA, 22 bp, Homo sapiens
gagaacctcacgcacctcccat

SEQ ID NO: 3011932 - DNA, 20 bp, Homo sapiens
gagaacgggcgtcaggggtg

SEQ ID NO: 3011933 - DNA, 23 bp, Homo sapiens
gagaacggtgaccgcctcctgct

SEQ ID NO: 3011934 - DNA, 18 bp, Homo sapiens
gagaactccagctggtgc

SEQ ID NO: 3011935 - DNA, 15 bp, Homo sapiens
gagaactcctagggt

SEQ ID NO: 3011936 - DNA, 11 bp, Homo sapiens
gagaactgaaa

SEQ ID NO: 3011937 - DNA, 14 bp, Homo sapiens
gagaactgaggagc

SEQ ID NO: 3011938 - DNA, 22 bp, Homo sapiens
gagaactgaggagcggactcac

SEQ ID NO: 3011939 - DNA, 18 bp, Homo sapiens
gagaactgcatatgtttc

SEQ ID NO: 3011940 - DNA, 22 bp, Homo sapiens
gagaactggttcttgccttccc

SEQ ID NO: 3011941 - DNA, 15 bp, Homo sapiens
gagaactgtggccgt

SEQ ID NO: 3011942 - DNA, 23 bp, Homo sapiens
gagaagcaagaaagaaacccgac

SEQ ID NO: 3011943 - DNA, 12 bp, Homo sapiens
gagaagccagga

SEQ ID NO: 3011944 - DNA, 11 bp, Homo sapiens
gagaagccatt

SEQ ID NO: 3011945 - DNA, 19 bp, Homo sapiens
gagaagctcctctccccag

SEQ ID NO: 3011946 - DNA, 15 bp, Homo sapiens
gagaaggaaaaagaa

SEQ ID NO: 3011947 - DNA, 16 bp, Homo sapiens
gagaaggcctcccctg

SEQ ID NO: 3011948 - DNA, 14 bp, Homo sapiens
gagaaggcggaaac

SEQ ID NO: 3011949 - DNA, 15 bp, Homo sapiens
gagaagtgacaggga

SEQ ID NO: 3011950 - DNA, 21 bp, Homo sapiens
gagaagtgacagggaagctac

SEQ ID NO: 3011951 - DNA, 16 bp, Homo sapiens
gagaagttgacatgga

SEQ ID NO: 3011952 - DNA, 16 bp, Homo sapiens
gagaatactgccaaaa

SEQ ID NO: 3011953 - DNA, 19 bp, Homo sapiens
gagaatagagctgccactg

SEQ ID NO: 3011954 - DNA, 23 bp, Homo sapiens
gagaatcacctgaaccccagagg

SEQ ID NO: 3011955 - DNA, 13 bp, Homo sapiens
gagaatcagcaga

SEQ ID NO: 3011956 - DNA, 15 bp, Homo sapiens
gagaatcagcagaac

SEQ ID NO: 3011957 - DNA, 20 bp, Homo sapiens
gagaatcagcagaacctgta

SEQ ID NO: 3011958 - DNA, 15 bp, Homo sapiens
gagaatgcagcccac

SEQ ID NO: 3011959 - DNA, 18 bp, Homo sapiens
gagaatttgctttatctg

SEQ ID NO: 3011960 - DNA, 13 bp, Homo sapiens
gagacaaaagaaa

SEQ ID NO: 3011961 - DNA, 14 bp, Homo sapiens
gagacaaagcagga

SEQ ID NO: 3011962 - DNA, 21 bp, Homo sapiens
gagacaaatcctttctgcccc

SEQ ID NO: 3011963 - DNA, 22 bp, Homo sapiens
gagacaaatcctttctgccccc

SEQ ID NO: 3011964 - DNA, 13 bp, Homo sapiens
gagacacagatgt

SEQ ID NO: 3011965 - DNA, 14 bp, Homo sapiens
gagacacagatgtt

SEQ ID NO: 3011966 - DNA, 13 bp, Homo sapiens
gagacacctgcac

SEQ ID NO: 3011967 - DNA, 19 bp, Homo sapiens
gagacacctgcacctcccc

SEQ ID NO: 3011968 - DNA, 21 bp, Homo sapiens
gagacacctgcacctcccccc

SEQ ID NO: 3011969 - DNA, 16 bp, Homo sapiens
gagacacggagcccag

SEQ ID NO: 3011970 - DNA, 21 bp, Homo sapiens
gagacactcagaccagagaag

SEQ ID NO: 3011971 - DNA, 18 bp, Homo sapiens
gagacagagtctcgctct

SEQ ID NO: 3011972 - DNA, 15 bp, Homo sapiens
gagacagatcactcc

SEQ ID NO: 3011973 - DNA, 18 bp, Homo sapiens
gagacagatcactcctgg

SEQ ID NO: 3011974 - DNA, 20 bp, Homo sapiens
gagacagatcactcctggag

SEQ ID NO: 3011975 - DNA, 19 bp, Homo sapiens
gagacaggaaaatcctctg

SEQ ID NO: 3011976 - DNA, 18 bp, Homo sapiens
gagacaggaagcctcaag

SEQ ID NO: 3011977 - DNA, 12 bp, Homo sapiens
gagacaggcaga

SEQ ID NO: 3011978 - DNA, 17 bp, Homo sapiens
gagacagtgcacatgaa

SEQ ID NO: 3011979 - DNA, 21 bp, Homo sapiens
gagacatacttgaagggccag

SEQ ID NO: 3011980 - DNA, 17 bp, Homo sapiens
gagaccaacctgaccaa

SEQ ID NO: 3011981 - DNA, 23 bp, Homo sapiens
gagaccagcctgggcaacaaagt

SEQ ID NO: 3011982 - DNA, 15 bp, Homo sapiens
gagaccaggccctgg

SEQ ID NO: 3011983 - DNA, 14 bp, Homo sapiens
gagaccaggctggg

SEQ ID NO: 3011984 - DNA, 16 bp, Homo sapiens
gagaccagggagcctt

SEQ ID NO: 3011985 - DNA, 13 bp, Homo sapiens
gagacccaggagc

SEQ ID NO: 3011986 - DNA, 22 bp, Homo sapiens
gagacccgggaaggaaggctct

SEQ ID NO: 3011987 - DNA, 13 bp, Homo sapiens
gagacctcagcca

SEQ ID NO: 3011988 - DNA, 16 bp, Homo sapiens
gagacctccctgttca

SEQ ID NO: 3011989 - DNA, 20 bp, Homo sapiens
gagacctggacacaggcctg

SEQ ID NO: 3011990 - DNA, 14 bp, Homo sapiens
gagaccttcaaatg

SEQ ID NO: 3011991 - DNA, 17 bp, Homo sapiens
gagaccttcaaatgcga

SEQ ID NO: 3011992 - DNA, 18 bp, Homo sapiens
gagacctttgcccacaca

SEQ ID NO: 3011993 - DNA, 19 bp, Homo sapiens
gagacggtgtcttgttctg

SEQ ID NO: 3011994 - DNA, 18 bp, Homo sapiens
gagacggtgttttgccat

SEQ ID NO: 3011995 - DNA, 23 bp, Homo sapiens
gagactaaccccaccacaccctc

SEQ ID NO: 3011996 - DNA, 17 bp, Homo sapiens
gagactcacctctgcct

SEQ ID NO: 3011997 - DNA, 18 bp, Homo sapiens
gagactcacctctgcctc

SEQ ID NO: 3011998 - DNA, 20 bp, Homo sapiens
gagactcacctctgcctcaa

SEQ ID NO: 3011999 - DNA, 13 bp, Homo sapiens
gagactcagcctg

SEQ ID NO: 3012000 - DNA, 22 bp, Homo sapiens
gagactccactcaggtgcacac

SEQ ID NO: 3012001 - DNA, 16 bp, Homo sapiens
gagactggcaggcggg

SEQ ID NO: 3012002 - DNA, 17 bp, Homo sapiens
gagactgggctctggct

SEQ ID NO: 3012003 - DNA, 19 bp, Homo sapiens
gagactgggctctggctct

SEQ ID NO: 3012004 - DNA, 13 bp, Homo sapiens
gagactgggctga

SEQ ID NO: 3012005 - DNA, 22 bp, Homo sapiens
gagactggtaggaggaggcatg

SEQ ID NO: 3012006 - DNA, 23 bp, Homo sapiens
gagactggtaggaggaggcatgg

SEQ ID NO: 3012007 - DNA, 12 bp, Homo sapiens
gagacttgcctt

SEQ ID NO: 3012008 - DNA, 21 bp, Homo sapiens
gagacttggatgaggagtggt

SEQ ID NO: 3012009 - DNA, 12 bp, Homo sapiens
gagagaaaataa

SEQ ID NO: 3012010 - DNA, 14 bp, Homo sapiens
gagagaaaataaaa

SEQ ID NO: 3012011 - DNA, 17 bp, Homo sapiens
gagagaaaataaaaagt

SEQ ID NO: 3012012 - DNA, 19 bp, Homo sapiens
gagagaaaataaaaagtta

SEQ ID NO: 3012013 - DNA, 20 bp, Homo sapiens
gagagaaaataaaaagttaa

SEQ ID NO: 3012014 - DNA, 21 bp, Homo sapiens
gagagaaaataaaaagttaaa

SEQ ID NO: 3012015 - DNA, 20 bp, Homo sapiens
gagagaacctaactgtatct

SEQ ID NO: 3012016 - DNA, 21 bp, Homo sapiens
gagagaatagagctgccactg

SEQ ID NO: 3012017 - DNA, 15 bp, Homo sapiens
gagagaattctgttc

SEQ ID NO: 3012018 - DNA, 20 bp, Homo sapiens
gagagacccaaggaggaaaa

SEQ ID NO: 3012019 - DNA, 16 bp, Homo sapiens
gagagacccgggaagg

SEQ ID NO: 3012020 - DNA, 13 bp, Homo sapiens
gagagacgggccc

SEQ ID NO: 3012021 - DNA, 13 bp, Homo sapiens
gagagaggccatt

SEQ ID NO: 3012022 - DNA, 16 bp, Homo sapiens
gagagatagcctgtgg

SEQ ID NO: 3012023 - DNA, 18 bp, Homo sapiens
gagagatagcctgtggcc

SEQ ID NO: 3012024 - DNA, 20 bp, Homo sapiens
gagagatagcctgtggccct

SEQ ID NO: 3012025 - DNA, 15 bp, Homo sapiens
gagagcaacatttta

SEQ ID NO: 3012026 - DNA, 13 bp, Homo sapiens
gagagcagagaat

SEQ ID NO: 3012027 - DNA, 16 bp, Homo sapiens
gagagcagaggtctcc

SEQ ID NO: 3012028 - DNA, 18 bp, Homo sapiens
gagagcagtgggcaggtg

SEQ ID NO: 3012029 - DNA, 21 bp, Homo sapiens
gagagcagtgggcaggtggcc

SEQ ID NO: 3012030 - DNA, 13 bp, Homo sapiens
gagagcatgtgag

SEQ ID NO: 3012031 - DNA, 15 bp, Homo sapiens
gagagcatgtgaggg

SEQ ID NO: 3012032 - DNA, 11 bp, Homo sapiens
gagagccagcc

SEQ ID NO: 3012033 - DNA, 22 bp, Homo sapiens
gagagcctgctcccccaccccc

SEQ ID NO: 3012034 - DNA, 13 bp, Homo sapiens
gagaggagagcca

SEQ ID NO: 3012035 - DNA, 15 bp, Homo sapiens
gagaggagagccaga

SEQ ID NO: 3012036 - DNA, 20 bp, Homo sapiens
gagaggagttctttggctct

SEQ ID NO: 3012037 - DNA, 14 bp, Homo sapiens
gagaggcaatgatt

SEQ ID NO: 3012038 - DNA, 20 bp, Homo sapiens
gagaggccctctggagtggc

SEQ ID NO: 3012039 - DNA, 14 bp, Homo sapiens
gagaggctgtgtcc

SEQ ID NO: 3012040 - DNA, 16 bp, Homo sapiens
gagaggctgtgtccct

SEQ ID NO: 3012041 - DNA, 17 bp, Homo sapiens
gagagggcctctgcctg

SEQ ID NO: 3012042 - DNA, 15 bp, Homo sapiens
gagaggggacgcagg

SEQ ID NO: 3012043 - DNA, 17 bp, Homo sapiens
gagaggggacgcaggcc

SEQ ID NO: 3012044 - DNA, 21 bp, Homo sapiens
gagaggggacgcaggcccctc

SEQ ID NO: 3012045 - DNA, 17 bp, Homo sapiens
gagaggtgaaagcataa

SEQ ID NO: 3012046 - DNA, 21 bp, Homo sapiens
gagaggttaaagcaaaccagc

SEQ ID NO: 3012047 - DNA, 16 bp, Homo sapiens
gagagtacactgtgtc

SEQ ID NO: 3012048 - DNA, 22 bp, Homo sapiens
gagagtgtcaaccagacagagg

SEQ ID NO: 3012049 - DNA, 15 bp, Homo sapiens
gagagttaaaagcag

SEQ ID NO: 3012050 - DNA, 19 bp, Homo sapiens
gagagttaaaagcagcagc

SEQ ID NO: 3012051 - DNA, 17 bp, Homo sapiens
gagagttcgtgaagagg

SEQ ID NO: 3012052 - DNA, 23 bp, Homo sapiens
gagagttcgtgaagagggaagcc

SEQ ID NO: 3012053 - DNA, 15 bp, Homo sapiens
gagataatatgagaa

SEQ ID NO: 3012054 - DNA, 13 bp, Homo sapiens
gagatacatacag

SEQ ID NO: 3012055 - DNA, 16 bp, Homo sapiens
gagatacatacagaat

SEQ ID NO: 3012056 - DNA, 15 bp, Homo sapiens
gagataccagcgagg

SEQ ID NO: 3012057 - DNA, 13 bp, Homo sapiens
gagatagcagagg

SEQ ID NO: 3012058 - DNA, 12 bp, Homo sapiens
gagatagcattg

SEQ ID NO: 3012059 - DNA, 17 bp, Homo sapiens
gagatattaaattctca

SEQ ID NO: 3012060 - DNA, 16 bp, Homo sapiens
gagatattgtgaggac

SEQ ID NO: 3012061 - DNA, 19 bp, Homo sapiens
gagatatttaaaagacaaa

SEQ ID NO: 3012062 - DNA, 22 bp, Homo sapiens
gagatatttaaaagacaaacac

SEQ ID NO: 3012063 - DNA, 14 bp, Homo sapiens
gagatccagttttt

SEQ ID NO: 3012064 - DNA, 18 bp, Homo sapiens
gagatcccaacactgcca

SEQ ID NO: 3012065 - DNA, 17 bp, Homo sapiens
gagatcgtgccactgca

SEQ ID NO: 3012066 - DNA, 20 bp, Homo sapiens
gagatcgtgccactgcactc

SEQ ID NO: 3012067 - DNA, 21 bp, Homo sapiens
gagatcgtgccattgcactcc

SEQ ID NO: 3012068 - DNA, 16 bp, Homo sapiens
gagatctgaacccagc

SEQ ID NO: 3012069 - DNA, 18 bp, Homo sapiens
gagatctgcacagtcaga

SEQ ID NO: 3012070 - DNA, 12 bp, Homo sapiens
gagatgaaaacc

SEQ ID NO: 3012071 - DNA, 22 bp, Homo sapiens
gagatgacccctaccccctcat

SEQ ID NO: 3012072 - DNA, 14 bp, Homo sapiens
gagatgagaaatga

SEQ ID NO: 3012073 - DNA, 18 bp, Homo sapiens
gagatgagaaatgatgaa

SEQ ID NO: 3012074 - DNA, 18 bp, Homo sapiens
gagatgatgaaaatattt

SEQ ID NO: 3012075 - DNA, 19 bp, Homo sapiens
gagatgatgaaaatattta

SEQ ID NO: 3012076 - DNA, 15 bp, Homo sapiens
gagatgcctccaccg

SEQ ID NO: 3012077 - DNA, 19 bp, Homo sapiens
gagatgcctccaccgctgc

SEQ ID NO: 3012078 - DNA, 20 bp, Homo sapiens
gagatgcttggagcaatcag

SEQ ID NO: 3012079 - DNA, 18 bp, Homo sapiens
gagatggagttcttgtgc

SEQ ID NO: 3012080 - DNA, 15 bp, Homo sapiens
gagatggatcacata

SEQ ID NO: 3012081 - DNA, 14 bp, Homo sapiens
gagatggggtgggg

SEQ ID NO: 3012082 - DNA, 16 bp, Homo sapiens
gagatgtaattgtttt

SEQ ID NO: 3012083 - DNA, 15 bp, Homo sapiens
gagattacctcctga

SEQ ID NO: 3012084 - DNA, 13 bp, Homo sapiens
gagattgaacttt

SEQ ID NO: 3012085 - DNA, 12 bp, Homo sapiens
gagattgctaat

SEQ ID NO: 3012086 - DNA, 13 bp, Homo sapiens
gagattgctaatt

SEQ ID NO: 3012087 - DNA, 18 bp, Homo sapiens
gagatttcttgttgctca

SEQ ID NO: 3012088 - DNA, 20 bp, Homo sapiens
gagcaaaaatgtaaaaaaca

SEQ ID NO: 3012089 - DNA, 13 bp, Homo sapiens
gagcaaaactccg

SEQ ID NO: 3012090 - DNA, 13 bp, Homo sapiens
gagcaaagcgccc

SEQ ID NO: 3012091 - DNA, 22 bp, Homo sapiens
gagcaaagcgcccacccaggtc

SEQ ID NO: 3012092 - DNA, 20 bp, Homo sapiens
gagcaaaggagacaaagcag

SEQ ID NO: 3012093 - DNA, 14 bp, Homo sapiens
gagcaacctactgt

SEQ ID NO: 3012094 - DNA, 16 bp, Homo sapiens
gagcaagttgcagtct

SEQ ID NO: 3012095 - DNA, 13 bp, Homo sapiens
gagcaatcacagg

SEQ ID NO: 3012096 - DNA, 16 bp, Homo sapiens
gagcacaatctgttct

SEQ ID NO: 3012097 - DNA, 19 bp, Homo sapiens
gagcacaatctgttctact

SEQ ID NO: 3012098 - DNA, 20 bp, Homo sapiens
gagcacatactacctagaag

SEQ ID NO: 3012099 - DNA, 16 bp, Homo sapiens
gagcaccacggccaga

SEQ ID NO: 3012100 - DNA, 15 bp, Homo sapiens
gagcaccaggcacga

SEQ ID NO: 3012101 - DNA, 22 bp, Homo sapiens
gagcaccgcctgtgaaatacca

SEQ ID NO: 3012102 - DNA, 16 bp, Homo sapiens
gagcacctggaccccc

SEQ ID NO: 3012103 - DNA, 20 bp, Homo sapiens
gagcacctggaccccctgcc

SEQ ID NO: 3012104 - DNA, 15 bp, Homo sapiens
gagcagagaatataa

SEQ ID NO: 3012105 - DNA, 24 bp, Homo sapiens
gagcagagacatgactcagcctgt

SEQ ID NO: 3012106 - DNA, 15 bp, Homo sapiens
gagcagaggggctga

SEQ ID NO: 3012107 - DNA, 16 bp, Homo sapiens
gagcagaggggctgaa

SEQ ID NO: 3012108 - DNA, 18 bp, Homo sapiens
gagcagcggctctggtcc

SEQ ID NO: 3012109 - DNA, 20 bp, Homo sapiens
gagcagcttcggtgtgcaga

SEQ ID NO: 3012110 - DNA, 22 bp, Homo sapiens
gagcaggacctctgaaaccctg

SEQ ID NO: 3012111 - DNA, 17 bp, Homo sapiens
gagcaggccagcccgga

SEQ ID NO: 3012112 - DNA, 18 bp, Homo sapiens
gagcagggcggctgccga

SEQ ID NO: 3012113 - DNA, 21 bp, Homo sapiens
gagcagggcggctgccgactc

SEQ ID NO: 3012114 - DNA, 14 bp, Homo sapiens
gagcaggggctgct

SEQ ID NO: 3012115 - DNA, 18 bp, Homo sapiens
gagcaggggctgctgggg

SEQ ID NO: 3012116 - DNA, 12 bp, Homo sapiens
gagcagggtcct

SEQ ID NO: 3012117 - DNA, 18 bp, Homo sapiens
gagcagtaactgtccctg

SEQ ID NO: 3012118 - DNA, 20 bp, Homo sapiens
gagcagtaactgtccctgct

SEQ ID NO: 3012119 - DNA, 13 bp, Homo sapiens
gagcagtccctgc

SEQ ID NO: 3012120 - DNA, 15 bp, Homo sapiens
gagcagtctacttct

SEQ ID NO: 3012121 - DNA, 19 bp, Homo sapiens
gagcagtgggcaggtggcc

SEQ ID NO: 3012122 - DNA, 15 bp, Homo sapiens
gagcagtgggcctgg

SEQ ID NO: 3012123 - DNA, 17 bp, Homo sapiens
gagcagtgggcctggcc

SEQ ID NO: 3012124 - DNA, 14 bp, Homo sapiens
gagcatagagaaca

SEQ ID NO: 3012125 - DNA, 21 bp, Homo sapiens
gagcatcactagtgacaagtc

SEQ ID NO: 3012126 - DNA, 14 bp, Homo sapiens
gagcatcagagggc

SEQ ID NO: 3012127 - DNA, 17 bp, Homo sapiens
gagcatgcggagccagc

SEQ ID NO: 3012128 - DNA, 20 bp, Homo sapiens
gagcatgttgttttttcata

SEQ ID NO: 3012129 - DNA, 12 bp, Homo sapiens
gagcattaaaat

SEQ ID NO: 3012130 - DNA, 19 bp, Homo sapiens
gagcatttatgtagacatt

SEQ ID NO: 3012131 - DNA, 20 bp, Homo sapiens
gagcatttatgtagacattg

SEQ ID NO: 3012132 - DNA, 14 bp, Homo sapiens
gagccaaagccaga

SEQ ID NO: 3012133 - DNA, 18 bp, Homo sapiens
gagccaagggggcagagg

SEQ ID NO: 3012134 - DNA, 20 bp, Homo sapiens
gagccaattagacttgaaat

SEQ ID NO: 3012135 - DNA, 16 bp, Homo sapiens
gagccacatttacata

SEQ ID NO: 3012136 - DNA, 19 bp, Homo sapiens
gagccaccacacctggcta

SEQ ID NO: 3012137 - DNA, 16 bp, Homo sapiens
gagccaccccaggaaa

SEQ ID NO: 3012138 - DNA, 15 bp, Homo sapiens
gagccactccggccc

SEQ ID NO: 3012139 - DNA, 14 bp, Homo sapiens
gagccactcctctg

SEQ ID NO: 3012140 - DNA, 15 bp, Homo sapiens
gagccactcctctga

SEQ ID NO: 3012141 - DNA, 14 bp, Homo sapiens
gagccactgcgccc

SEQ ID NO: 3012142 - DNA, 13 bp, Homo sapiens
gagccagagaagt

SEQ ID NO: 3012143 - DNA, 18 bp, Homo sapiens
gagccagagaagtgacag

SEQ ID NO: 3012144 - DNA, 19 bp, Homo sapiens
gagccagagaagtgacagg

SEQ ID NO: 3012145 - DNA, 20 bp, Homo sapiens
gagccagagaagtgacaggg

SEQ ID NO: 3012146 - DNA, 22 bp, Homo sapiens
gagccagagaagtgacagggaa

SEQ ID NO: 3012147 - DNA, 12 bp, Homo sapiens
gagccagcagtg

SEQ ID NO: 3012148 - DNA, 12 bp, Homo sapiens
gagccagccctc

SEQ ID NO: 3012149 - DNA, 20 bp, Homo sapiens
gagccagccctccctgtcct

SEQ ID NO: 3012150 - DNA, 12 bp, Homo sapiens
gagccagccttg

SEQ ID NO: 3012151 - DNA, 13 bp, Homo sapiens
gagccagctccct

SEQ ID NO: 3012152 - DNA, 22 bp, Homo sapiens
gagccagttgtcctatggacaa

SEQ ID NO: 3012153 - DNA, 19 bp, Homo sapiens
gagccatataagtttgaag

SEQ ID NO: 3012154 - DNA, 18 bp, Homo sapiens
gagccatcttggcagggt

SEQ ID NO: 3012155 - DNA, 19 bp, Homo sapiens
gagccatgatttcccactg

SEQ ID NO: 3012156 - DNA, 20 bp, Homo sapiens
gagccatgatttcccactgc

SEQ ID NO: 3012157 - DNA, 19 bp, Homo sapiens
gagcccactgtcctgggcc

SEQ ID NO: 3012158 - DNA, 20 bp, Homo sapiens
gagcccagattgtgccactg

SEQ ID NO: 3012159 - DNA, 12 bp, Homo sapiens
gagcccagctcc

SEQ ID NO: 3012160 - DNA, 14 bp, Homo sapiens
gagcccagctctga

SEQ ID NO: 3012161 - DNA, 21 bp, Homo sapiens
gagcccagctctgaaaccagt

SEQ ID NO: 3012162 - DNA, 13 bp, Homo sapiens
gagcccagctctt

SEQ ID NO: 3012163 - DNA, 13 bp, Homo sapiens
gagcccagctggg

SEQ ID NO: 3012164 - DNA, 21 bp, Homo sapiens
gagcccagctgggtcaggcag

SEQ ID NO: 3012165 - DNA, 22 bp, Homo sapiens
gagcccagctgggtcaggcagg

SEQ ID NO: 3012166 - DNA, 15 bp, Homo sapiens
gagcccaggggagaa

SEQ ID NO: 3012167 - DNA, 23 bp, Homo sapiens
gagcccaggggagaatgcagccc

SEQ ID NO: 3012168 - DNA, 16 bp, Homo sapiens
gagccccattcctggg

SEQ ID NO: 3012169 - DNA, 17 bp, Homo sapiens
gagccccattcctggga

SEQ ID NO: 3012170 - DNA, 16 bp, Homo sapiens
gagcccccagctgcca

SEQ ID NO: 3012171 - DNA, 22 bp, Homo sapiens
gagcccctgaaagcctcacgta

SEQ ID NO: 3012172 - DNA, 21 bp, Homo sapiens
gagccccttctgctcagctct

SEQ ID NO: 3012173 - DNA, 15 bp, Homo sapiens
gagcccgcagcccag

SEQ ID NO: 3012174 - DNA, 18 bp, Homo sapiens
gagcccgcagcccagacc

SEQ ID NO: 3012175 - DNA, 22 bp, Homo sapiens
gagcccgtgccacccccagccc

SEQ ID NO: 3012176 - DNA, 13 bp, Homo sapiens
gagccctccccag

SEQ ID NO: 3012177 - DNA, 21 bp, Homo sapiens
gagccctgccactcaatggga

SEQ ID NO: 3012178 - DNA, 22 bp, Homo sapiens
gagccctgtggatgagccctca

SEQ ID NO: 3012179 - DNA, 20 bp, Homo sapiens
gagccctgttcctccctccc

SEQ ID NO: 3012180 - DNA, 20 bp, Homo sapiens
gagcccttagccttgctgta

SEQ ID NO: 3012181 - DNA, 18 bp, Homo sapiens
gagcccttatctgtgctc

SEQ ID NO: 3012182 - DNA, 21 bp, Homo sapiens
gagccgagggcgtcagagaga

SEQ ID NO: 3012183 - DNA, 22 bp, Homo sapiens
gagccgccgcgcctggcctaga

SEQ ID NO: 3012184 - DNA, 20 bp, Homo sapiens
gagccggacacttctcagga

SEQ ID NO: 3012185 - DNA, 16 bp, Homo sapiens
gagccggagcctccag

SEQ ID NO: 3012186 - DNA, 20 bp, Homo sapiens
gagccggcatccttgcctgt

SEQ ID NO: 3012187 - DNA, 17 bp, Homo sapiens
gagccgggaccctcagg

SEQ ID NO: 3012188 - DNA, 18 bp, Homo sapiens
gagccgggaccctcaggt

SEQ ID NO: 3012189 - DNA, 19 bp, Homo sapiens
gagccgggaccctcaggtg

SEQ ID NO: 3012190 - DNA, 21 bp, Homo sapiens
gagccgggcacattgagctgt

SEQ ID NO: 3012191 - DNA, 15 bp, Homo sapiens
gagcctacccacccc

SEQ ID NO: 3012192 - DNA, 14 bp, Homo sapiens
gagcctcagaagaa

SEQ ID NO: 3012193 - DNA, 14 bp, Homo sapiens
gagcctcgctctgt

SEQ ID NO: 3012194 - DNA, 14 bp, Homo sapiens
gagcctctttgtaa

SEQ ID NO: 3012195 - DNA, 21 bp, Homo sapiens
gagcctgaccctcatctttct

SEQ ID NO: 3012196 - DNA, 18 bp, Homo sapiens
gagcctgaggcaggagaa

SEQ ID NO: 3012197 - DNA, 13 bp, Homo sapiens
gagcctggaagca

SEQ ID NO: 3012198 - DNA, 21 bp, Homo sapiens
gagcctgtccccgccttccct

SEQ ID NO: 3012199 - DNA, 12 bp, Homo sapiens
gagcctgtttat

SEQ ID NO: 3012200 - DNA, 17 bp, Homo sapiens
gagcctgtttattgcca

SEQ ID NO: 3012201 - DNA, 23 bp, Homo sapiens
gagccttagaggtctttaatcat

SEQ ID NO: 3012202 - DNA, 19 bp, Homo sapiens
gagccttagccgcccatgc

SEQ ID NO: 3012203 - DNA, 15 bp, Homo sapiens
gagccttgctgccaa

SEQ ID NO: 3012204 - DNA, 17 bp, Homo sapiens
gagccttgctgccaagt

SEQ ID NO: 3012205 - DNA, 13 bp, Homo sapiens
gagcctttccaaa

SEQ ID NO: 3012206 - DNA, 19 bp, Homo sapiens
gagcgaggaggcgcggcct

SEQ ID NO: 3012207 - DNA, 15 bp, Homo sapiens
gagcgcaagccacag

SEQ ID NO: 3012208 - DNA, 16 bp, Homo sapiens
gagcgcaagccacagc

SEQ ID NO: 3012209 - DNA, 17 bp, Homo sapiens
gagcgcaagccacagcc

SEQ ID NO: 3012210 - DNA, 19 bp, Homo sapiens
gagcgcaagccacagcctg

SEQ ID NO: 3012211 - DNA, 20 bp, Homo sapiens
gagcgcaagccacagcctgt

SEQ ID NO: 3012212 - DNA, 18 bp, Homo sapiens
gagcgcctgcccctccca

SEQ ID NO: 3012213 - DNA, 20 bp, Homo sapiens
gagcgcctgcccctcccaga

SEQ ID NO: 3012214 - DNA, 15 bp, Homo sapiens
gagcgctagtgcctt

SEQ ID NO: 3012215 - DNA, 23 bp, Homo sapiens
gagcgctagtgccttgcccacag

SEQ ID NO: 3012216 - DNA, 13 bp, Homo sapiens
gagcggaaagcag

SEQ ID NO: 3012217 - DNA, 14 bp, Homo sapiens
gagcggaaagcagc

SEQ ID NO: 3012218 - DNA, 16 bp, Homo sapiens
gagcggaaagcagctc

SEQ ID NO: 3012219 - DNA, 20 bp, Homo sapiens
gagcggcgccctggacttgg

SEQ ID NO: 3012220 - DNA, 22 bp, Homo sapiens
gagcggctgctcgcccaggaag

SEQ ID NO: 3012221 - DNA, 23 bp, Homo sapiens
gagcggctgctcgcccaggaagg

SEQ ID NO: 3012222 - DNA, 15 bp, Homo sapiens
gagcgggcagggccg

SEQ ID NO: 3012223 - DNA, 14 bp, Homo sapiens
gagcgtgattctgt

SEQ ID NO: 3012224 - DNA, 15 bp, Homo sapiens
gagcgtttaaagtac

SEQ ID NO: 3012225 - DNA, 14 bp, Homo sapiens
gagctaaggctcta

SEQ ID NO: 3012226 - DNA, 12 bp, Homo sapiens
gagctacaaatg

SEQ ID NO: 3012227 - DNA, 14 bp, Homo sapiens
gagctacaaatgca

SEQ ID NO: 3012228 - DNA, 13 bp, Homo sapiens
gagctactcagaa

SEQ ID NO: 3012229 - DNA, 12 bp, Homo sapiens
gagctagccaga

SEQ ID NO: 3012230 - DNA, 23 bp, Homo sapiens
gagctagcgctgccgcaccccag

SEQ ID NO: 3012231 - DNA, 17 bp, Homo sapiens
gagctaggaagagtcta

SEQ ID NO: 3012232 - DNA, 16 bp, Homo sapiens
gagctatgataagatt

SEQ ID NO: 3012233 - DNA, 15 bp, Homo sapiens
gagctcagaccccca

SEQ ID NO: 3012234 - DNA, 20 bp, Homo sapiens
gagctcagacccccactctc

SEQ ID NO: 3012235 - DNA, 21 bp, Homo sapiens
gagctcagacccccactctca

SEQ ID NO: 3012236 - DNA, 21 bp, Homo sapiens
gagctcaggaaccgaggcagg

SEQ ID NO: 3012237 - DNA, 19 bp, Homo sapiens
gagctccaactcagaaggg

SEQ ID NO: 3012238 - DNA, 19 bp, Homo sapiens
gagctcccctacggaccag

SEQ ID NO: 3012239 - DNA, 20 bp, Homo sapiens
gagctccttaaggctctttt

SEQ ID NO: 3012240 - DNA, 13 bp, Homo sapiens
gagctcgcagccc

SEQ ID NO: 3012241 - DNA, 20 bp, Homo sapiens
gagctctacccagggcctgc

SEQ ID NO: 3012242 - DNA, 21 bp, Homo sapiens
gagctctacccagggcctgca

SEQ ID NO: 3012243 - DNA, 14 bp, Homo sapiens
gagctctccaggcc

SEQ ID NO: 3012244 - DNA, 18 bp, Homo sapiens
gagctctccaggccaggt

SEQ ID NO: 3012245 - DNA, 19 bp, Homo sapiens
gagctctcctgtgcattgt

SEQ ID NO: 3012246 - DNA, 13 bp, Homo sapiens
gagctctgcctca

SEQ ID NO: 3012247 - DNA, 20 bp, Homo sapiens
gagctctggtgataaggaca

SEQ ID NO: 3012248 - DNA, 16 bp, Homo sapiens
gagctctgtgggaaaa

SEQ ID NO: 3012249 - DNA, 19 bp, Homo sapiens
gagctctgtgggtctctgg

SEQ ID NO: 3012250 - DNA, 19 bp, Homo sapiens
gagctcttgggtcagagaa

SEQ ID NO: 3012251 - DNA, 22 bp, Homo sapiens
gagctgaaaaggatcgaggcat

SEQ ID NO: 3012252 - DNA, 14 bp, Homo sapiens
gagctgaccagccg

SEQ ID NO: 3012253 - DNA, 14 bp, Homo sapiens
gagctgagaagagg

SEQ ID NO: 3012254 - DNA, 12 bp, Homo sapiens
gagctgagccag

SEQ ID NO: 3012255 - DNA, 15 bp, Homo sapiens
gagctgagccaggct

SEQ ID NO: 3012256 - DNA, 22 bp, Homo sapiens
gagctgagccaggctagctgga

SEQ ID NO: 3012257 - DNA, 19 bp, Homo sapiens
gagctgaggactctgcaag

SEQ ID NO: 3012258 - DNA, 17 bp, Homo sapiens
gagctgaggccacactc

SEQ ID NO: 3012259 - DNA, 16 bp, Homo sapiens
gagctgaggcctccct

SEQ ID NO: 3012260 - DNA, 22 bp, Homo sapiens
gagctgagggagggagccatgg

SEQ ID NO: 3012261 - DNA, 14 bp, Homo sapiens
gagctgagggccct

SEQ ID NO: 3012262 - DNA, 16 bp, Homo sapiens
gagctgagggccctgt

SEQ ID NO: 3012263 - DNA, 22 bp, Homo sapiens
gagctgcacagggtttggccca

SEQ ID NO: 3012264 - DNA, 12 bp, Homo sapiens
gagctgccactg

SEQ ID NO: 3012265 - DNA, 13 bp, Homo sapiens
gagctgccactgg

SEQ ID NO: 3012266 - DNA, 21 bp, Homo sapiens
gagctgccactgggcacctgc

SEQ ID NO: 3012267 - DNA, 11 bp, Homo sapiens
gagctgccagt

SEQ ID NO: 3012268 - DNA, 15 bp, Homo sapiens
gagctgcccctctct

SEQ ID NO: 3012269 - DNA, 18 bp, Homo sapiens
gagctgcccctctctggg

SEQ ID NO: 3012270 - DNA, 16 bp, Homo sapiens
gagctgcccggcgcct

SEQ ID NO: 3012271 - DNA, 12 bp, Homo sapiens
gagctgcctccc

SEQ ID NO: 3012272 - DNA, 15 bp, Homo sapiens
gagctgcctccccaa

SEQ ID NO: 3012273 - DNA, 11 bp, Homo sapiens
gagctgcctgc

SEQ ID NO: 3012274 - DNA, 20 bp, Homo sapiens
gagctgcctgcagcacatgc

SEQ ID NO: 3012275 - DNA, 21 bp, Homo sapiens
gagctgccttggctcagacat

SEQ ID NO: 3012276 - DNA, 12 bp, Homo sapiens
gagctgcgggct

SEQ ID NO: 3012277 - DNA, 18 bp, Homo sapiens
gagctgctatagcctggg

SEQ ID NO: 3012278 - DNA, 12 bp, Homo sapiens
gagctggcccag

SEQ ID NO: 3012279 - DNA, 14 bp, Homo sapiens
gagctggccccgcc

SEQ ID NO: 3012280 - DNA, 17 bp, Homo sapiens
gagctggcttcggagat

SEQ ID NO: 3012281 - DNA, 17 bp, Homo sapiens
gagctgggaggaaaaga

SEQ ID NO: 3012282 - DNA, 15 bp, Homo sapiens
gagctgggaggtctc

SEQ ID NO: 3012283 - DNA, 19 bp, Homo sapiens
gagctgggcccgacatggc

SEQ ID NO: 3012284 - DNA, 23 bp, Homo sapiens
gagctgggcccgacatggctccg

SEQ ID NO: 3012285 - DNA, 12 bp, Homo sapiens
gagctggggagg

SEQ ID NO: 3012286 - DNA, 24 bp, Homo sapiens
gagctggggaggtgggaggccagg

SEQ ID NO: 3012287 - DNA, 16 bp, Homo sapiens
gagctggtggacccag

SEQ ID NO: 3012288 - DNA, 23 bp, Homo sapiens
gagctggtggacccagggaacag

SEQ ID NO: 3012289 - DNA, 22 bp, Homo sapiens
gagctggttcctctctcccacc

SEQ ID NO: 3012290 - DNA, 11 bp, Homo sapiens
gagctggtttc

SEQ ID NO: 3012291 - DNA, 17 bp, Homo sapiens
gagctgtcaccaaggaa

SEQ ID NO: 3012292 - DNA, 19 bp, Homo sapiens
gagctgtcaccaaggaaac

SEQ ID NO: 3012293 - DNA, 15 bp, Homo sapiens
gagctgtgacattgc

SEQ ID NO: 3012294 - DNA, 21 bp, Homo sapiens
gagctgtgacattgctggtca

SEQ ID NO: 3012295 - DNA, 18 bp, Homo sapiens
gagctgtgcaggtgggga

SEQ ID NO: 3012296 - DNA, 17 bp, Homo sapiens
gagctgtttactaggga

SEQ ID NO: 3012297 - DNA, 22 bp, Homo sapiens
gagcttcccacacctgcctgcg

SEQ ID NO: 3012298 - DNA, 23 bp, Homo sapiens
gagcttctaaactgaagctgctg

SEQ ID NO: 3012299 - DNA, 20 bp, Homo sapiens
gagcttctggggtccccagg

SEQ ID NO: 3012300 - DNA, 23 bp, Homo sapiens
gagcttctggggtccccagggct

SEQ ID NO: 3012301 - DNA, 20 bp, Homo sapiens
gagcttgggaagtcgaggct

SEQ ID NO: 3012302 - DNA, 15 bp, Homo sapiens
gagctttagacagca

SEQ ID NO: 3012303 - DNA, 16 bp, Homo sapiens
gagctttcttgtttct

SEQ ID NO: 3012304 - DNA, 19 bp, Homo sapiens
gagcttttcgaactgtgct

SEQ ID NO: 3012305 - DNA, 20 bp, Homo sapiens
gagcttttcgaactgtgctc

SEQ ID NO: 3012306 - DNA, 14 bp, Homo sapiens
gaggaaaaacaaca

SEQ ID NO: 3012307 - DNA, 15 bp, Homo sapiens
gaggaaaaacaacaa

SEQ ID NO: 3012308 - DNA, 18 bp, Homo sapiens
gaggaaaaacaacaaata

SEQ ID NO: 3012309 - DNA, 12 bp, Homo sapiens
gaggaaaactat

SEQ ID NO: 3012310 - DNA, 14 bp, Homo sapiens
gaggaaaatgagta

SEQ ID NO: 3012311 - DNA, 16 bp, Homo sapiens
gaggaaaatgagtatt

SEQ ID NO: 3012312 - DNA, 22 bp, Homo sapiens
gaggaaagacaacacaaccaac

SEQ ID NO: 3012313 - DNA, 23 bp, Homo sapiens
gaggaaaggccagctggcagcag

SEQ ID NO: 3012314 - DNA, 17 bp, Homo sapiens
gaggaactcgcctcagc

SEQ ID NO: 3012315 - DNA, 22 bp, Homo sapiens
gaggaagacgagacaggacgag

SEQ ID NO: 3012316 - DNA, 15 bp, Homo sapiens
gaggaaggacccctc

SEQ ID NO: 3012317 - DNA, 16 bp, Homo sapiens
gaggaaggcaggaaga

SEQ ID NO: 3012318 - DNA, 21 bp, Homo sapiens
gaggaaggggggccgccgctg

SEQ ID NO: 3012319 - DNA, 16 bp, Homo sapiens
gaggaagtacaaacta

SEQ ID NO: 3012320 - DNA, 19 bp, Homo sapiens
gaggaatctgtgggtctgg

SEQ ID NO: 3012321 - DNA, 21 bp, Homo sapiens
gaggacaagaccctctcaggc

SEQ ID NO: 3012322 - DNA, 12 bp, Homo sapiens
gaggacaattca

SEQ ID NO: 3012323 - DNA, 21 bp, Homo sapiens
gaggacaattcatgaacttcg

SEQ ID NO: 3012324 - DNA, 19 bp, Homo sapiens
gaggaccaacatccagtcc

SEQ ID NO: 3012325 - DNA, 14 bp, Homo sapiens
gaggaccagggtgg

SEQ ID NO: 3012326 - DNA, 15 bp, Homo sapiens
gaggaccagggtgga

SEQ ID NO: 3012327 - DNA, 19 bp, Homo sapiens
gaggacccacactgctaca

SEQ ID NO: 3012328 - DNA, 12 bp, Homo sapiens
gaggaccgggca

SEQ ID NO: 3012329 - DNA, 23 bp, Homo sapiens
gaggaccgggcactcccgggatg

SEQ ID NO: 3012330 - DNA, 22 bp, Homo sapiens
gaggagaaaagtgacagatcct

SEQ ID NO: 3012331 - DNA, 15 bp, Homo sapiens
gaggagacaggaagc

SEQ ID NO: 3012332 - DNA, 22 bp, Homo sapiens
gaggagaccagcggtccatggg

SEQ ID NO: 3012333 - DNA, 12 bp, Homo sapiens
gaggagagaaga

SEQ ID NO: 3012334 - DNA, 15 bp, Homo sapiens
gaggagagaagaatg

SEQ ID NO: 3012335 - DNA, 13 bp, Homo sapiens
gaggagagccaga

SEQ ID NO: 3012336 - DNA, 12 bp, Homo sapiens
gaggagcccagt

SEQ ID NO: 3012337 - DNA, 13 bp, Homo sapiens
gaggagcctcaga

SEQ ID NO: 3012338 - DNA, 11 bp, Homo sapiens
gaggagccttt

SEQ ID NO: 3012339 - DNA, 22 bp, Homo sapiens
gaggagctgagggagggagcca

SEQ ID NO: 3012340 - DNA, 13 bp, Homo sapiens
gaggagcttctgg

SEQ ID NO: 3012341 - DNA, 14 bp, Homo sapiens
gaggagcttctggg

SEQ ID NO: 3012342 - DNA, 12 bp, Homo sapiens
gaggaggagaaa

SEQ ID NO: 3012343 - DNA, 13 bp, Homo sapiens
gaggagggcaggc

SEQ ID NO: 3012344 - DNA, 20 bp, Homo sapiens
gaggagggcgtgactcaccc

SEQ ID NO: 3012345 - DNA, 17 bp, Homo sapiens
gaggaggggccgctgcc

SEQ ID NO: 3012346 - DNA, 15 bp, Homo sapiens
gaggagttctttggc

SEQ ID NO: 3012347 - DNA, 21 bp, Homo sapiens
gaggataaaaaggaaggagag

SEQ ID NO: 3012348 - DNA, 15 bp, Homo sapiens
gaggatcccctgtcc

SEQ ID NO: 3012349 - DNA, 18 bp, Homo sapiens
gaggatcccctgtcccct

SEQ ID NO: 3012350 - DNA, 22 bp, Homo sapiens
gaggatgatttcagaaggagaa

SEQ ID NO: 3012351 - DNA, 17 bp, Homo sapiens
gaggatgctaaaaatgt

SEQ ID NO: 3012352 - DNA, 21 bp, Homo sapiens
gaggattaggggatggggagg

SEQ ID NO: 3012353 - DNA, 13 bp, Homo sapiens
gaggcacaagaat

SEQ ID NO: 3012354 - DNA, 16 bp, Homo sapiens
gaggcactagtcaccg

SEQ ID NO: 3012355 - DNA, 21 bp, Homo sapiens
gaggcacttcctcccctcgcc

SEQ ID NO: 3012356 - DNA, 20 bp, Homo sapiens
gaggcagaaaattgcacaat

SEQ ID NO: 3012357 - DNA, 23 bp, Homo sapiens
gaggcagaagaattgaacccagg

SEQ ID NO: 3012358 - DNA, 17 bp, Homo sapiens
gaggcagagcgggaggg

SEQ ID NO: 3012359 - DNA, 20 bp, Homo sapiens
gaggcagatgtggggctgag

SEQ ID NO: 3012360 - DNA, 20 bp, Homo sapiens
gaggcaggagaatcacttga

SEQ ID NO: 3012361 - DNA, 19 bp, Homo sapiens
gaggcaggcatggccctgg

SEQ ID NO: 3012362 - DNA, 23 bp, Homo sapiens
gaattaaacccacaagctgcctc

SEQ ID NO: 3012363 - DNA, 22 bp, Homo sapiens
gaattaaactcctactgcttcc

SEQ ID NO: 3012364 - DNA, 17 bp, Homo sapiens
gaattaatgagaagata

SEQ ID NO: 3012365 - DNA, 15 bp, Homo sapiens
gaattaccaagagaa

SEQ ID NO: 3012366 - DNA, 16 bp, Homo sapiens
gaattaccaagagaag

SEQ ID NO: 3012367 - DNA, 19 bp, Homo sapiens
gaattacccttcctcatct

SEQ ID NO: 3012368 - DNA, 17 bp, Homo sapiens
gaattagatttctatag

SEQ ID NO: 3012369 - DNA, 13 bp, Homo sapiens
gaattattttaaa

SEQ ID NO: 3012370 - DNA, 16 bp, Homo sapiens
gaattcaaactggggc

SEQ ID NO: 3012371 - DNA, 23 bp, Homo sapiens
gaattcagaagacccctgactca

SEQ ID NO: 3012372 - DNA, 16 bp, Homo sapiens
gaattccaagtgtatt

SEQ ID NO: 3012373 - DNA, 18 bp, Homo sapiens
gaattcttacatgttttc

SEQ ID NO: 3012374 - DNA, 16 bp, Homo sapiens
gaattcttttggggaa

SEQ ID NO: 3012375 - DNA, 14 bp, Homo sapiens
gaattgaaacactt

SEQ ID NO: 3012376 - DNA, 15 bp, Homo sapiens
gaattgatttgcatt

SEQ ID NO: 3012377 - DNA, 17 bp, Homo sapiens
gaattgatttgcattga

SEQ ID NO: 3012378 - DNA, 23 bp, Homo sapiens
gaattgccaggggcgaggccctt

SEQ ID NO: 3012379 - DNA, 15 bp, Homo sapiens
gaattgcgttggtct

SEQ ID NO: 3012380 - DNA, 20 bp, Homo sapiens
gaattggcctgaacagatgt

SEQ ID NO: 3012381 - DNA, 13 bp, Homo sapiens
gaattggtgtata

SEQ ID NO: 3012382 - DNA, 16 bp, Homo sapiens
gaattgtagaattgtt

SEQ ID NO: 3012383 - DNA, 22 bp, Homo sapiens
gaatttaagcatgagtggcctt

SEQ ID NO: 3012384 - DNA, 19 bp, Homo sapiens
gaatttaagctgtaaatta

SEQ ID NO: 3012385 - DNA, 16 bp, Homo sapiens
gaatttaataatctgt

SEQ ID NO: 3012386 - DNA, 17 bp, Homo sapiens
gaatttaatttttaaaa

SEQ ID NO: 3012387 - DNA, 20 bp, Homo sapiens
gaatttataaaaattaagtt

SEQ ID NO: 3012388 - DNA, 13 bp, Homo sapiens
gaatttataaccc

SEQ ID NO: 3012389 - DNA, 22 bp, Homo sapiens
gaatttatatacaacctgcttg

SEQ ID NO: 3012390 - DNA, 19 bp, Homo sapiens
gaatttattgcacattgtt

SEQ ID NO: 3012391 - DNA, 12 bp, Homo sapiens
gaatttcacaag

SEQ ID NO: 3012392 - DNA, 14 bp, Homo sapiens
gaatttcactgtct

SEQ ID NO: 3012393 - DNA, 17 bp, Homo sapiens
gaatttcactgtctttt

SEQ ID NO: 3012394 - DNA, 15 bp, Homo sapiens
gaatttcccaggacc

SEQ ID NO: 3012395 - DNA, 16 bp, Homo sapiens
gaatttcccaggaccc

SEQ ID NO: 3012396 - DNA, 20 bp, Homo sapiens
gaatttcccagtgaaataaa

SEQ ID NO: 3012397 - DNA, 11 bp, Homo sapiens
gaatttgcaaa

SEQ ID NO: 3012398 - DNA, 14 bp, Homo sapiens
gaatttgcaaagta

SEQ ID NO: 3012399 - DNA, 18 bp, Homo sapiens
gaatttgcaaagtactgt

SEQ ID NO: 3012400 - DNA, 19 bp, Homo sapiens
gaatttgggaccctgcttt

SEQ ID NO: 3012401 - DNA, 20 bp, Homo sapiens
gaatttgggaccctgcttta

SEQ ID NO: 3012402 - DNA, 23 bp, Homo sapiens
gaatttgggaccctgctttagag

SEQ ID NO: 3012403 - DNA, 20 bp, Homo sapiens
gaatttgtaagcaacttgct

SEQ ID NO: 3012404 - DNA, 15 bp, Homo sapiens
gaattttaaaaatga

SEQ ID NO: 3012405 - DNA, 23 bp, Homo sapiens
gaattttaaaagatgcaatgtag

SEQ ID NO: 3012406 - DNA, 23 bp, Homo sapiens
gaattttcagaccccagcggctg

SEQ ID NO: 3012407 - DNA, 23 bp, Homo sapiens
gaattttgtttttattttcaaga

SEQ ID NO: 3012408 - DNA, 15 bp, Homo sapiens
gaatttttaactgta

SEQ ID NO: 3012409 - DNA, 21 bp, Homo sapiens
gaatttttatttctttttaat

SEQ ID NO: 3012410 - DNA, 13 bp, Homo sapiens
gaatttttgcaat

SEQ ID NO: 3012411 - DNA, 15 bp, Homo sapiens
gaatttttgcaataa

SEQ ID NO: 3012412 - DNA, 17 bp, Homo sapiens
gaatttttgcaataatg

SEQ ID NO: 3012413 - DNA, 20 bp, Homo sapiens
gaatttttgcaataatgcag

SEQ ID NO: 3012414 - DNA, 23 bp, Homo sapiens
gaatttttgcttgacttcagtta

SEQ ID NO: 3012415 - DNA, 21 bp, Homo sapiens
gaattttttttgttgtttcag

SEQ ID NO: 3012416 - DNA, 22 bp, Homo sapiens
gaattttttttgttgtttcagt

SEQ ID NO: 3012417 - DNA, 15 bp, Homo sapiens
gacaaaaacaagact

SEQ ID NO: 3012418 - DNA, 21 bp, Homo sapiens
gacaaaaacaagactgcctcc

SEQ ID NO: 3012419 - DNA, 22 bp, Homo sapiens
gacaaaaacaagactgcctccc

SEQ ID NO: 3012420 - DNA, 20 bp, Homo sapiens
gacaaaaacagcctcacaga

SEQ ID NO: 3012421 - DNA, 15 bp, Homo sapiens
gacaaaagggccagg

SEQ ID NO: 3012422 - DNA, 18 bp, Homo sapiens
gacaaaagtgacagatgt

SEQ ID NO: 3012423 - DNA, 14 bp, Homo sapiens
gacaaacagtgaat

SEQ ID NO: 3012424 - DNA, 21 bp, Homo sapiens
gacaaaccaggggtaccaggc

SEQ ID NO: 3012425 - DNA, 22 bp, Homo sapiens
gacaaaccaggggtaccaggca

SEQ ID NO: 3012426 - DNA, 13 bp, Homo sapiens
gacaaagaaaacg

SEQ ID NO: 3012427 - DNA, 16 bp, Homo sapiens
gacaaagcaggagtgg

SEQ ID NO: 3012428 - DNA, 13 bp, Homo sapiens
gacaaaggcaagc

SEQ ID NO: 3012429 - DNA, 22 bp, Homo sapiens
gacaaagtgtgtctcaaaaata

SEQ ID NO: 3012430 - DNA, 19 bp, Homo sapiens
gacaaagtgttgaaaatgt

SEQ ID NO: 3012431 - DNA, 18 bp, Homo sapiens
gacaaatactcatgtgta

SEQ ID NO: 3012432 - DNA, 15 bp, Homo sapiens
gacaaatcctttctg

SEQ ID NO: 3012433 - DNA, 11 bp, Homo sapiens
gacaaatgtga

SEQ ID NO: 3012434 - DNA, 13 bp, Homo sapiens
gacaaatgtgaag

SEQ ID NO: 3012435 - DNA, 18 bp, Homo sapiens
gacaaatgtgaagatgca

SEQ ID NO: 3012436 - DNA, 22 bp, Homo sapiens
gacaaattactgataaaaatga

SEQ ID NO: 3012437 - DNA, 19 bp, Homo sapiens
gacaacactgggaaacaga

SEQ ID NO: 3012438 - DNA, 18 bp, Homo sapiens
gacaacagaaagagggac

SEQ ID NO: 3012439 - DNA, 11 bp, Homo sapiens
gacaacatctg

SEQ ID NO: 3012440 - DNA, 13 bp, Homo sapiens
gacaacatggctt

SEQ ID NO: 3012441 - DNA, 20 bp, Homo sapiens
gacaacatgtttaataaata

SEQ ID NO: 3012442 - DNA, 12 bp, Homo sapiens
gacaacattaaa

SEQ ID NO: 3012443 - DNA, 20 bp, Homo sapiens
gacaaccacgtaccaagcca

SEQ ID NO: 3012444 - DNA, 16 bp, Homo sapiens
gacaacgaggaagccc

SEQ ID NO: 3012445 - DNA, 18 bp, Homo sapiens
gacaactggcaggcaggc

SEQ ID NO: 3012446 - DNA, 22 bp, Homo sapiens
gacaactttatgtagagaaaag

SEQ ID NO: 3012447 - DNA, 13 bp, Homo sapiens
gacaagaccctct

SEQ ID NO: 3012448 - DNA, 19 bp, Homo sapiens
gacaagaccctctcaggct

SEQ ID NO: 3012449 - DNA, 22 bp, Homo sapiens
gacaagcacaccacaattctcc

SEQ ID NO: 3012450 - DNA, 19 bp, Homo sapiens
gacaaggagaagagcaagg

SEQ ID NO: 3012451 - DNA, 14 bp, Homo sapiens
gacaaggagagcgg

SEQ ID NO: 3012452 - DNA, 16 bp, Homo sapiens
gacaaggcaggcctga

SEQ ID NO: 3012453 - DNA, 19 bp, Homo sapiens
gacaagggaggcagtggct

SEQ ID NO: 3012454 - DNA, 14 bp, Homo sapiens
gacaagtaatcact

SEQ ID NO: 3012455 - DNA, 20 bp, Homo sapiens
gacaagtggactcagggcag

SEQ ID NO: 3012456 - DNA, 14 bp, Homo sapiens
gacaataaaacatt

SEQ ID NO: 3012457 - DNA, 18 bp, Homo sapiens
gacaatcacgggcggtcc

SEQ ID NO: 3012458 - DNA, 23 bp, Homo sapiens
gacaatgactaagccaagctgtg

SEQ ID NO: 3012459 - DNA, 18 bp, Homo sapiens
gacaatgcttatggaaag

SEQ ID NO: 3012460 - DNA, 19 bp, Homo sapiens
gacaatgcttatggaaagc

SEQ ID NO: 3012461 - DNA, 17 bp, Homo sapiens
gacaatgtctgcagccc

SEQ ID NO: 3012462 - DNA, 13 bp, Homo sapiens
gacaattctgttt

SEQ ID NO: 3012463 - DNA, 13 bp, Homo sapiens
gacaattctttat

SEQ ID NO: 3012464 - DNA, 22 bp, Homo sapiens
gacaattctttatacaacagtg

SEQ ID NO: 3012465 - DNA, 16 bp, Homo sapiens
gacacagaaaatgttg

SEQ ID NO: 3012466 - DNA, 21 bp, Homo sapiens
gacacagaaaatgttgagaat

SEQ ID NO: 3012467 - DNA, 14 bp, Homo sapiens
gacacagattatca

SEQ ID NO: 3012468 - DNA, 16 bp, Homo sapiens
gacacaggtctttcct

SEQ ID NO: 3012469 - DNA, 17 bp, Homo sapiens
gacacaggtctttccta

SEQ ID NO: 3012470 - DNA, 19 bp, Homo sapiens
gacacatcagcatgttttc

SEQ ID NO: 3012471 - DNA, 15 bp, Homo sapiens
gacaccaaagttcta

SEQ ID NO: 3012472 - DNA, 12 bp, Homo sapiens
gacaccactcct

SEQ ID NO: 3012473 - DNA, 16 bp, Homo sapiens
gacaccactcctgcca

SEQ ID NO: 3012474 - DNA, 18 bp, Homo sapiens
gacaccactcctgccagc

SEQ ID NO: 3012475 - DNA, 14 bp, Homo sapiens
gaggcagggaagtc

SEQ ID NO: 3012476 - DNA, 20 bp, Homo sapiens
gaggcatcctacccttttct

SEQ ID NO: 3012477 - DNA, 17 bp, Homo sapiens
gaggccaaggtgggcgg

SEQ ID NO: 3012478 - DNA, 21 bp, Homo sapiens
gaggccacactcagcacaagg

SEQ ID NO: 3012479 - DNA, 11 bp, Homo sapiens
gaggccaggcg

SEQ ID NO: 3012480 - DNA, 17 bp, Homo sapiens
gaggccagtacctttcc

SEQ ID NO: 3012481 - DNA, 15 bp, Homo sapiens
gaggcccagccgcag

SEQ ID NO: 3012482 - DNA, 17 bp, Homo sapiens
gaggcccaggctgggaa

SEQ ID NO: 3012483 - DNA, 13 bp, Homo sapiens
gaggcccagttca

SEQ ID NO: 3012484 - DNA, 13 bp, Homo sapiens
gaggccccagcct

SEQ ID NO: 3012485 - DNA, 19 bp, Homo sapiens
gaggccccagcctccctga

SEQ ID NO: 3012486 - DNA, 14 bp, Homo sapiens
gaggccccaggggg

SEQ ID NO: 3012487 - DNA, 22 bp, Homo sapiens
gaggcccctatgtagtccgtgc

SEQ ID NO: 3012488 - DNA, 24 bp, Homo sapiens
gaggcccctatgtagtccgtgctg

SEQ ID NO: 3012489 - DNA, 19 bp, Homo sapiens
gaggccctctggagtggcc

SEQ ID NO: 3012490 - DNA, 12 bp, Homo sapiens
gaggccctgcat

SEQ ID NO: 3012491 - DNA, 22 bp, Homo sapiens
gaggccctgtgccccttgacaa

SEQ ID NO: 3012492 - DNA, 16 bp, Homo sapiens
gaggccgcggcctccc

SEQ ID NO: 3012493 - DNA, 14 bp, Homo sapiens
gaggccggccctgc

SEQ ID NO: 3012494 - DNA, 18 bp, Homo sapiens
gaggccggccctgcccct

SEQ ID NO: 3012495 - DNA, 19 bp, Homo sapiens
gaggccggccctgcccctc

SEQ ID NO: 3012496 - DNA, 10 bp, Homo sapiens
gaggcctcac

SEQ ID NO: 3012497 - DNA, 22 bp, Homo sapiens
gaggcctcactactcgagccca

SEQ ID NO: 3012498 - DNA, 12 bp, Homo sapiens
gaggcctccctt

SEQ ID NO: 3012499 - DNA, 13 bp, Homo sapiens
gaggcctgagacc

SEQ ID NO: 3012500 - DNA, 14 bp, Homo sapiens
gaggcctgagaccc

SEQ ID NO: 3012501 - DNA, 16 bp, Homo sapiens
gaggcctgcgaccctg

SEQ ID NO: 3012502 - DNA, 18 bp, Homo sapiens
gaggcctgggggacccct

SEQ ID NO: 3012503 - DNA, 15 bp, Homo sapiens
gaggcctgtctgtga

SEQ ID NO: 3012504 - DNA, 17 bp, Homo sapiens
gaggccttggggtgggg

SEQ ID NO: 3012505 - DNA, 18 bp, Homo sapiens
gaggccttgtgtgtcagg

SEQ ID NO: 3012506 - DNA, 19 bp, Homo sapiens
gaggccttgtgtgtcaggc

SEQ ID NO: 3012507 - DNA, 21 bp, Homo sapiens
gaggcgaagcgttgtcctcag

SEQ ID NO: 3012508 - DNA, 20 bp, Homo sapiens
gaggcgtcttcatctccctg

SEQ ID NO: 3012509 - DNA, 22 bp, Homo sapiens
gaggcgtcttcatctccctgcc

SEQ ID NO: 3012510 - DNA, 23 bp, Homo sapiens
gaggcgtcttcatctccctgcca

SEQ ID NO: 3012511 - DNA, 13 bp, Homo sapiens
gaggcgtgtgcag

SEQ ID NO: 3012512 - DNA, 14 bp, Homo sapiens
gaggcgtgtgcagg

SEQ ID NO: 3012513 - DNA, 17 bp, Homo sapiens
gaggcgtgtgcaggccg

SEQ ID NO: 3012514 - DNA, 21 bp, Homo sapiens
gaggctaattcagtgtcacat

SEQ ID NO: 3012515 - DNA, 18 bp, Homo sapiens
gaggctcctccctctgcc

SEQ ID NO: 3012516 - DNA, 14 bp, Homo sapiens
gaggctgagacagg

SEQ ID NO: 3012517 - DNA, 18 bp, Homo sapiens
gaggctgagacaggagaa

SEQ ID NO: 3012518 - DNA, 21 bp, Homo sapiens
gaggctgagacaggagaatca

SEQ ID NO: 3012519 - DNA, 16 bp, Homo sapiens
gaggctgaggcaagag

SEQ ID NO: 3012520 - DNA, 14 bp, Homo sapiens
gcagagcctgtccc

SEQ ID NO: 3012521 - DNA, 17 bp, Homo sapiens
gcagagctgagggccct

SEQ ID NO: 3012522 - DNA, 17 bp, Homo sapiens
gcagagctgcgggctgg

SEQ ID NO: 3012523 - DNA, 19 bp, Homo sapiens
gcagagctgcgggctgggt

SEQ ID NO: 3012524 - DNA, 14 bp, Homo sapiens
gcagaggaccaggg

SEQ ID NO: 3012525 - DNA, 13 bp, Homo sapiens
gcagaggagccca

SEQ ID NO: 3012526 - DNA, 15 bp, Homo sapiens
gcagaggagcccagt

SEQ ID NO: 3012527 - DNA, 17 bp, Homo sapiens
gcagaggagcccagtgg

SEQ ID NO: 3012528 - DNA, 21 bp, Homo sapiens
gcagaggagcccagtgggctg

SEQ ID NO: 3012529 - DNA, 16 bp, Homo sapiens
gcagaggcagtggcca

SEQ ID NO: 3012530 - DNA, 13 bp, Homo sapiens
gcagaggcctggg

SEQ ID NO: 3012531 - DNA, 21 bp, Homo sapiens
gcagaggctggaggcagggcc

SEQ ID NO: 3012532 - DNA, 12 bp, Homo sapiens
gcagagggctgg

SEQ ID NO: 3012533 - DNA, 20 bp, Homo sapiens
gcagagggctggaggcccag

SEQ ID NO: 3012534 - DNA, 19 bp, Homo sapiens
gcagagggctttcagcgcc

SEQ ID NO: 3012535 - DNA, 18 bp, Homo sapiens
gcagagtcacaagcctcg

SEQ ID NO: 3012536 - DNA, 17 bp, Homo sapiens
gcagagttctgtgaaga

SEQ ID NO: 3012537 - DNA, 20 bp, Homo sapiens
gcagagtttgtgtgttgtct

SEQ ID NO: 3012538 - DNA, 20 bp, Homo sapiens
gcagataacatttgtgtgtt

SEQ ID NO: 3012539 - DNA, 17 bp, Homo sapiens
gcagatcacctgaggtc

SEQ ID NO: 3012540 - DNA, 12 bp, Homo sapiens
gcagatgacaag

SEQ ID NO: 3012541 - DNA, 15 bp, Homo sapiens
gcagatgcaaagagg

SEQ ID NO: 3012542 - DNA, 18 bp, Homo sapiens
gcagatgcaaagaggcaa

SEQ ID NO: 3012543 - DNA, 16 bp, Homo sapiens
agctttcttgtttctt

SEQ ID NO: 3012544 - DNA, 17 bp, Homo sapiens
agctttcttgtttctta

SEQ ID NO: 3012545 - DNA, 21 bp, Homo sapiens
agctttgactggagggtccat

SEQ ID NO: 3012546 - DNA, 21 bp, Homo sapiens
agctttggctatgagggcctt

SEQ ID NO: 3012547 - DNA, 17 bp, Homo sapiens
agctttggtctgtgtgt

SEQ ID NO: 3012548 - DNA, 12 bp, Homo sapiens
agcttttaaaaa

SEQ ID NO: 3012549 - DNA, 21 bp, Homo sapiens
agcttttaaaattatttttgg

SEQ ID NO: 3012550 - DNA, 14 bp, Homo sapiens
agcttttcccagga

SEQ ID NO: 3012551 - DNA, 20 bp, Homo sapiens
agcttttcctcagggtgtcc

SEQ ID NO: 3012552 - DNA, 18 bp, Homo sapiens
agcttttcgaactgtgct

SEQ ID NO: 3012553 - DNA, 14 bp, Homo sapiens
agcttttctttctt

SEQ ID NO: 3012554 - DNA, 16 bp, Homo sapiens
agctttttgatgtata

SEQ ID NO: 3012555 - DNA, 13 bp, Homo sapiens
agctttttgtctt

SEQ ID NO: 3012556 - DNA, 10 bp, Homo sapiens
aggaaaaaaa

SEQ ID NO: 3012557 - DNA, 23 bp, Homo sapiens
aggaaaaaaattacaaagaaaat

SEQ ID NO: 3012558 - DNA, 16 bp, Homo sapiens
aggaaaaacaacaaat

SEQ ID NO: 3012559 - DNA, 15 bp, Homo sapiens
aggaaaaataatcaa

SEQ ID NO: 3012560 - DNA, 13 bp, Homo sapiens
aggaaaactacct

SEQ ID NO: 3012561 - DNA, 24 bp, Homo sapiens
aggaaaactgcatggagacgcatt

SEQ ID NO: 3012562 - DNA, 12 bp, Homo sapiens
aggaaaactgcc

SEQ ID NO: 3012563 - DNA, 20 bp, Homo sapiens
aggaaaagcacaagaaactt

SEQ ID NO: 3012564 - DNA, 13 bp, Homo sapiens
aggaaaatgaatt

SEQ ID NO: 3012565 - DNA, 17 bp, Homo sapiens
aggaaacaagggaaggg

SEQ ID NO: 3012566 - DNA, 18 bp, Homo sapiens
aggaaacaagggaagggg

SEQ ID NO: 3012567 - DNA, 22 bp, Homo sapiens
aggaaacatgaagcataatttg

SEQ ID NO: 3012568 - DNA, 12 bp, Homo sapiens
aggaaaccacaa

SEQ ID NO: 3012569 - DNA, 19 bp, Homo sapiens
aggaaaccacaaccttgca

SEQ ID NO: 3012570 - DNA, 20 bp, Homo sapiens
aggaaaccacaaccttgcag

SEQ ID NO: 3012571 - DNA, 20 bp, Homo sapiens
aggaaagaatgaaagagtaa

SEQ ID NO: 3012572 - DNA, 16 bp, Homo sapiens
aggaaagattcatgtc

SEQ ID NO: 3012573 - DNA, 18 bp, Homo sapiens
aggaaaggcatgtacaaa

SEQ ID NO: 3012574 - DNA, 15 bp, Homo sapiens
aggaaaggccagctg

SEQ ID NO: 3012575 - DNA, 16 bp, Homo sapiens
aggaaaggccagctgg

SEQ ID NO: 3012576 - DNA, 21 bp, Homo sapiens
aggaaaggccagctggcagca

SEQ ID NO: 3012577 - DNA, 24 bp, Homo sapiens
aggaaaggccagctggcagcagag

SEQ ID NO: 3012578 - DNA, 21 bp, Homo sapiens
aggaaagttcagagttttctg

SEQ ID NO: 3012579 - DNA, 17 bp, Homo sapiens
aggaaataccaactgaa

SEQ ID NO: 3012580 - DNA, 19 bp, Homo sapiens
aggaaatccagtagggaaa

SEQ ID NO: 3012581 - DNA, 16 bp, Homo sapiens
aggaaatgcaagctct

SEQ ID NO: 3012582 - DNA, 14 bp, Homo sapiens
aggaaattccaaat

SEQ ID NO: 3012583 - DNA, 21 bp, Homo sapiens
aggaacaaaaattacaaagaa

SEQ ID NO: 3012584 - DNA, 17 bp, Homo sapiens
aggaacagtcctgttca

SEQ ID NO: 3012585 - DNA, 19 bp, Homo sapiens
aggaacatatgaaaataca

SEQ ID NO: 3012586 - DNA, 15 bp, Homo sapiens
aggaaccacaccaca

SEQ ID NO: 3012587 - DNA, 18 bp, Homo sapiens
aggaacctcgagtactgt

SEQ ID NO: 3012588 - DNA, 21 bp, Homo sapiens
aggaactcgcacctgtgctgg

SEQ ID NO: 3012589 - DNA, 21 bp, Homo sapiens
aggaactgcagcaatctttga

SEQ ID NO: 3012590 - DNA, 12 bp, Homo sapiens
aggaactggaac

SEQ ID NO: 3012591 - DNA, 15 bp, Homo sapiens
aggaactggaacaca

SEQ ID NO: 3012592 - DNA, 18 bp, Homo sapiens
aggaactgtagatgatgt

SEQ ID NO: 3012593 - DNA, 21 bp, Homo sapiens
aggaagaacaccctctaaatg

SEQ ID NO: 3012594 - DNA, 15 bp, Homo sapiens
aggaagaattttaaa

SEQ ID NO: 3012595 - DNA, 23 bp, Homo sapiens
aggaagaattttaaaaatgaatc

SEQ ID NO: 3012596 - DNA, 16 bp, Homo sapiens
aggaagacaacttgct

SEQ ID NO: 3012597 - DNA, 14 bp, Homo sapiens
aggaagagacactc

SEQ ID NO: 3012598 - DNA, 14 bp, Homo sapiens
aggaagagagcatg

SEQ ID NO: 3012599 - DNA, 22 bp, Homo sapiens
aggaagcccccaccgtgggcag

SEQ ID NO: 3012600 - DNA, 20 bp, Homo sapiens
aggaagccgtgccctgcccc

SEQ ID NO: 3012601 - DNA, 13 bp, Homo sapiens
aggaagcctcaag

SEQ ID NO: 3012602 - DNA, 19 bp, Homo sapiens
aggaagctgtgttgaaaca

SEQ ID NO: 3012603 - DNA, 22 bp, Homo sapiens
aggaagctttggtgagaacctg

SEQ ID NO: 3012604 - DNA, 23 bp, Homo sapiens
aggaagctttggtgagaacctgg

SEQ ID NO: 3012605 - DNA, 17 bp, Homo sapiens
aggaaggacagactggc

SEQ ID NO: 3012606 - DNA, 18 bp, Homo sapiens
aggaaggacagactggcc

SEQ ID NO: 3012607 - DNA, 15 bp, Homo sapiens
aggaaggacccctca

SEQ ID NO: 3012608 - DNA, 13 bp, Homo sapiens
aggaaggagagat

SEQ ID NO: 3012609 - DNA, 16 bp, Homo sapiens
aggaaggagcccctga

SEQ ID NO: 3012610 - DNA, 13 bp, Homo sapiens
aggaaggagcggc

SEQ ID NO: 3012611 - DNA, 21 bp, Homo sapiens
aggaaggagcggcgccctgga

SEQ ID NO: 3012612 - DNA, 17 bp, Homo sapiens
aggaaggcaggaagaga

SEQ ID NO: 3012613 - DNA, 17 bp, Homo sapiens
aggaaggcctaggctag

SEQ ID NO: 3012614 - DNA, 15 bp, Homo sapiens
aggaagggagggagc

SEQ ID NO: 3012615 - DNA, 17 bp, Homo sapiens
aggaagggagggagctg

SEQ ID NO: 3012616 - DNA, 18 bp, Homo sapiens
aggaagggagggagctga

SEQ ID NO: 3012617 - DNA, 18 bp, Homo sapiens
aggaaggggccagaggct

SEQ ID NO: 3012618 - DNA, 20 bp, Homo sapiens
aggaaggggccagaggctcg

SEQ ID NO: 3012619 - DNA, 21 bp, Homo sapiens
aggaatactgttttatctcca

SEQ ID NO: 3012620 - DNA, 14 bp, Homo sapiens
aggaatagttttct

SEQ ID NO: 3012621 - DNA, 20 bp, Homo sapiens
aggaatcaaatcttacaaaa

SEQ ID NO: 3012622 - DNA, 16 bp, Homo sapiens
aggaatcactcttgtg

SEQ ID NO: 3012623 - DNA, 18 bp, Homo sapiens
gcaggcagatcacctgag

SEQ ID NO: 3012624 - DNA, 18 bp, Homo sapiens
gcaggcagcgcctgtccc

SEQ ID NO: 3012625 - DNA, 15 bp, Homo sapiens
gcaggcaggctccca

SEQ ID NO: 3012626 - DNA, 17 bp, Homo sapiens
gcaggcaggctcccagg

SEQ ID NO: 3012627 - DNA, 21 bp, Homo sapiens
gcaggcatcggggagccggga

SEQ ID NO: 3012628 - DNA, 23 bp, Homo sapiens
gcaggcatcggggagccgggagc

SEQ ID NO: 3012629 - DNA, 19 bp, Homo sapiens
gcaggcatggctggtgcct

SEQ ID NO: 3012630 - DNA, 20 bp, Homo sapiens
gcaggcatggctggtgcctg

SEQ ID NO: 3012631 - DNA, 21 bp, Homo sapiens
gcaggcatggctggtgcctga

SEQ ID NO: 3012632 - DNA, 16 bp, Homo sapiens
gcaggcatgtcctgga

SEQ ID NO: 3012633 - DNA, 21 bp, Homo sapiens
gcaggccagcccggacctctg

SEQ ID NO: 3012634 - DNA, 15 bp, Homo sapiens
gcaggccccctagga

SEQ ID NO: 3012635 - DNA, 16 bp, Homo sapiens
gcaggccccctaggat

SEQ ID NO: 3012636 - DNA, 21 bp, Homo sapiens
gcaggcccctctcctccgtgg

SEQ ID NO: 3012637 - DNA, 17 bp, Homo sapiens
gcaggccctgtccagcc

SEQ ID NO: 3012638 - DNA, 19 bp, Homo sapiens
gcaggccctgtccagcccc

SEQ ID NO: 3012639 - DNA, 18 bp, Homo sapiens
gcaggcctgccttctcag

SEQ ID NO: 3012640 - DNA, 21 bp, Homo sapiens
gcaggcctgccttctcaggga

SEQ ID NO: 3012641 - DNA, 21 bp, Homo sapiens
gcaggcgcctataatcccagc

SEQ ID NO: 3012642 - DNA, 23 bp, Homo sapiens
gcaggcgcggcggctctgcccac

SEQ ID NO: 3012643 - DNA, 21 bp, Homo sapiens
gcaggcggccagggcggccag

SEQ ID NO: 3012644 - DNA, 17 bp, Homo sapiens
gcaggcggccctcagtg

SEQ ID NO: 3012645 - DNA, 15 bp, Homo sapiens
gcaggcggtgggcac

SEQ ID NO: 3012646 - DNA, 20 bp, Homo sapiens
gcaggcgtgactcagcagcc

SEQ ID NO: 3012647 - DNA, 21 bp, Homo sapiens
gcaggcgtgactcagcagcct

SEQ ID NO: 3012648 - DNA, 15 bp, Homo sapiens
gcaggcgtgtggcag

SEQ ID NO: 3012649 - DNA, 17 bp, Homo sapiens
gcaggcgtgtggcagcc

SEQ ID NO: 3012650 - DNA, 18 bp, Homo sapiens
gcaggcgtgtggcagcca

SEQ ID NO: 3012651 - DNA, 16 bp, Homo sapiens
gcagtggtgcgatctc

SEQ ID NO: 3012652 - DNA, 15 bp, Homo sapiens
gcagtgtcttaagga

SEQ ID NO: 3012653 - DNA, 18 bp, Homo sapiens
gcagtgtcttaaggagac

SEQ ID NO: 3012654 - DNA, 14 bp, Homo sapiens
gcagtgtgagtgtg

SEQ ID NO: 3012655 - DNA, 16 bp, Homo sapiens
gcagtgtggccaggct

SEQ ID NO: 3012656 - DNA, 17 bp, Homo sapiens
gcagttaattagcattc

SEQ ID NO: 3012657 - DNA, 20 bp, Homo sapiens
gcagttactccctacactga

SEQ ID NO: 3012658 - DNA, 22 bp, Homo sapiens
gcagttactccctacactgatg

SEQ ID NO: 3012659 - DNA, 19 bp, Homo sapiens
gcagttcagtttgtctctt

SEQ ID NO: 3012660 - DNA, 21 bp, Homo sapiens
gcagttctagtttgcattcct

SEQ ID NO: 3012661 - DNA, 19 bp, Homo sapiens
gcagttctgggtgctccct

SEQ ID NO: 3012662 - DNA, 14 bp, Homo sapiens
gcagttcttgagtt

SEQ ID NO: 3012663 - DNA, 21 bp, Homo sapiens
gcagttgaggtggggtagtgc

SEQ ID NO: 3012664 - DNA, 18 bp, Homo sapiens
gcagtttaagatgacact

SEQ ID NO: 3012665 - DNA, 11 bp, Homo sapiens
gcagtttgaaa

SEQ ID NO: 3012666 - DNA, 14 bp, Homo sapiens
gcagtttgggaggt

SEQ ID NO: 3012667 - DNA, 20 bp, Homo sapiens
gcagttttgacatcagccag

SEQ ID NO: 3012668 - DNA, 14 bp, Homo sapiens
gcagttttgtaaat

SEQ ID NO: 3012669 - DNA, 17 bp, Homo sapiens
gcagttttgtaaatgta

SEQ ID NO: 3012670 - DNA, 21 bp, Homo sapiens
gcagttttgttttaaaactgg

SEQ ID NO: 3012671 - DNA, 14 bp, Homo sapiens
gcataaatctgaag

SEQ ID NO: 3012672 - DNA, 16 bp, Homo sapiens
gcataagaaaaagaat

SEQ ID NO: 3012673 - DNA, 14 bp, Homo sapiens
gcataagaccaatc

SEQ ID NO: 3012674 - DNA, 17 bp, Homo sapiens
gcatacagatattctaa

SEQ ID NO: 3012675 - DNA, 15 bp, Homo sapiens
gcatactttgtaaat

SEQ ID NO: 3012676 - DNA, 16 bp, Homo sapiens
gcatactttgtaaata

SEQ ID NO: 3012677 - DNA, 16 bp, Homo sapiens
gcatacttttaatcaa

SEQ ID NO: 3012678 - DNA, 13 bp, Homo sapiens
gcatagaagtaaa

SEQ ID NO: 3012679 - DNA, 16 bp, Homo sapiens
gcatagcgtcctgccc

SEQ ID NO: 3012680 - DNA, 20 bp, Homo sapiens
gcatagcgtcctgccctgcc

SEQ ID NO: 3012681 - DNA, 14 bp, Homo sapiens
gcatatacagtgaa

SEQ ID NO: 3012682 - DNA, 14 bp, Homo sapiens
gcatatagaaaaca

SEQ ID NO: 3012683 - DNA, 18 bp, Homo sapiens
gcatatcatgctttgaaa

SEQ ID NO: 3012684 - DNA, 18 bp, Homo sapiens
gcatatctctagtccctg

SEQ ID NO: 3012685 - DNA, 17 bp, Homo sapiens
gcatatgggttagatgt

SEQ ID NO: 3012686 - DNA, 13 bp, Homo sapiens
gcatatgtgagtg

SEQ ID NO: 3012687 - DNA, 14 bp, Homo sapiens
gcatattcaacaca

SEQ ID NO: 3012688 - DNA, 20 bp, Homo sapiens
gcatattgtacacttttttg

SEQ ID NO: 3012689 - DNA, 13 bp, Homo sapiens
gcatcaaaagaca

SEQ ID NO: 3012690 - DNA, 18 bp, Homo sapiens
gcatcaaacatgaaaaca

SEQ ID NO: 3012691 - DNA, 18 bp, Homo sapiens
gcatcaccttaggcaggg

SEQ ID NO: 3012692 - DNA, 15 bp, Homo sapiens
gcatcattgcagatg

SEQ ID NO: 3012693 - DNA, 13 bp, Homo sapiens
gcatccagacagt

SEQ ID NO: 3012694 - DNA, 22 bp, Homo sapiens
gcatccagagtccctgcctgga

SEQ ID NO: 3012695 - DNA, 12 bp, Homo sapiens
gcatccaggctg

SEQ ID NO: 3012696 - DNA, 13 bp, Homo sapiens
gcatccaggctgg

SEQ ID NO: 3012697 - DNA, 17 bp, Homo sapiens
gcatccagggctgccag

SEQ ID NO: 3012698 - DNA, 17 bp, Homo sapiens
gcatccatctgggctac

SEQ ID NO: 3012699 - DNA, 12 bp, Homo sapiens
gcatccattcct

SEQ ID NO: 3012700 - DNA, 15 bp, Homo sapiens
gcatccattcctcag

SEQ ID NO: 3012701 - DNA, 13 bp, Homo sapiens
gcatcccagcctt

SEQ ID NO: 3012702 - DNA, 20 bp, Homo sapiens
gcatccccacgacccctgcc

SEQ ID NO: 3012703 - DNA, 13 bp, Homo sapiens
gcatcccggctga

SEQ ID NO: 3012704 - DNA, 22 bp, Homo sapiens
gcatcccggctgaccctgtgcc

SEQ ID NO: 3012705 - DNA, 16 bp, Homo sapiens
gcatccctgcttctgg

SEQ ID NO: 3012706 - DNA, 18 bp, Homo sapiens
gcatccgtagttccctga

SEQ ID NO: 3012707 - DNA, 23 bp, Homo sapiens
gcatcctagtctctatcattaaa

SEQ ID NO: 3012708 - DNA, 14 bp, Homo sapiens
gcatcctccccacc

SEQ ID NO: 3012709 - DNA, 16 bp, Homo sapiens
gcatcctccccaccag

SEQ ID NO: 3012710 - DNA, 18 bp, Homo sapiens
gcatcctccccaccagag

SEQ ID NO: 3012711 - DNA, 17 bp, Homo sapiens
gcatcctgtgaagtcct

SEQ ID NO: 3012712 - DNA, 20 bp, Homo sapiens
gcatccttgcctgtctaaag

SEQ ID NO: 3012713 - DNA, 17 bp, Homo sapiens
gcatcggggagccggga

SEQ ID NO: 3012714 - DNA, 22 bp, Homo sapiens
gcatctaagttataagactctc

SEQ ID NO: 3012715 - DNA, 16 bp, Homo sapiens
gcatctcaaatgtttt

SEQ ID NO: 3012716 - DNA, 20 bp, Homo sapiens
gcatctctgagtgtctctgc

SEQ ID NO: 3012717 - DNA, 21 bp, Homo sapiens
gcatctctgagtgtctctgcc

SEQ ID NO: 3012718 - DNA, 22 bp, Homo sapiens
gcatctctgagtgtctctgcct

SEQ ID NO: 3012719 - DNA, 21 bp, Homo sapiens
gcatctcttcttccctgtcag

SEQ ID NO: 3012720 - DNA, 23 bp, Homo sapiens
gcatctcttcttccctgtcagcc

SEQ ID NO: 3012721 - DNA, 20 bp, Homo sapiens
gcatctgaatgaaaataact

SEQ ID NO: 3012722 - DNA, 22 bp, Homo sapiens
gcatctgaatgaaaataactga

SEQ ID NO: 3012723 - DNA, 23 bp, Homo sapiens
gcatctgaatgaaaataactgaa

SEQ ID NO: 3012724 - DNA, 20 bp, Homo sapiens
gcatctgaccagcagcgcct

SEQ ID NO: 3012725 - DNA, 14 bp, Homo sapiens
gcatctgaccatct

SEQ ID NO: 3012726 - DNA, 13 bp, Homo sapiens
gcatctgcaaagg

SEQ ID NO: 3012727 - DNA, 15 bp, Homo sapiens
gcatctgcaaaggaa

SEQ ID NO: 3012728 - DNA, 14 bp, Homo sapiens
gcatctgcaggcac

SEQ ID NO: 3012729 - DNA, 12 bp, Homo sapiens
gcatctgtacaa

SEQ ID NO: 3012730 - DNA, 15 bp, Homo sapiens
gcatctgtacaaagg

SEQ ID NO: 3012731 - DNA, 12 bp, Homo sapiens
gcatctgtgtgt

SEQ ID NO: 3012732 - DNA, 13 bp, Homo sapiens
gcatctgtttatt

SEQ ID NO: 3012733 - DNA, 17 bp, Homo sapiens
gcatcttccagaagtgt

SEQ ID NO: 3012734 - DNA, 16 bp, Homo sapiens
gcatcttgcctccagg

SEQ ID NO: 3012735 - DNA, 23 bp, Homo sapiens
gcatcttgcctccaggtgcagag

SEQ ID NO: 3012736 - DNA, 18 bp, Homo sapiens
gcatgaaaggcttttaaa

SEQ ID NO: 3012737 - DNA, 15 bp, Homo sapiens
gcatgacaaaagtga

SEQ ID NO: 3012738 - DNA, 15 bp, Homo sapiens
gcatgaccagatgcg

SEQ ID NO: 3012739 - DNA, 11 bp, Homo sapiens
gcatgacccag

SEQ ID NO: 3012740 - DNA, 17 bp, Homo sapiens
gcatgacccagtgaaga

SEQ ID NO: 3012741 - DNA, 17 bp, Homo sapiens
gcatgagaaatacaaaa

SEQ ID NO: 3012742 - DNA, 21 bp, Homo sapiens
gcatgagactcagtgcagatg

SEQ ID NO: 3012743 - DNA, 13 bp, Homo sapiens
gcatgagccacca

SEQ ID NO: 3012744 - DNA, 11 bp, Homo sapiens
gcatgagtggc

SEQ ID NO: 3012745 - DNA, 22 bp, Homo sapiens
gcatgatattgttctccaagga

SEQ ID NO: 3012746 - DNA, 18 bp, Homo sapiens
gcatgatccaagcaagac

SEQ ID NO: 3012747 - DNA, 13 bp, Homo sapiens
gcatgatgggaaa

SEQ ID NO: 3012748 - DNA, 19 bp, Homo sapiens
gcatgatgggaaaatattt

SEQ ID NO: 3012749 - DNA, 21 bp, Homo sapiens
gcatgatgggaaaatatttcc

SEQ ID NO: 3012750 - DNA, 18 bp, Homo sapiens
gcatgcaaaagaaagcaa

SEQ ID NO: 3012751 - DNA, 15 bp, Homo sapiens
gcatgcacacggctg

SEQ ID NO: 3012752 - DNA, 21 bp, Homo sapiens
gcatgcacacggctggtcact

SEQ ID NO: 3012753 - DNA, 23 bp, Homo sapiens
gcatgcacgggcatgcacacggc

SEQ ID NO: 3012754 - DNA, 21 bp, Homo sapiens
gcatgcctgtaatcccagaac

SEQ ID NO: 3012755 - DNA, 18 bp, Homo sapiens
gcatgcctgtagtctcag

SEQ ID NO: 3012756 - DNA, 21 bp, Homo sapiens
gcatgcctgtagtctcagcta

SEQ ID NO: 3012757 - DNA, 17 bp, Homo sapiens
gcatgcggagccagcag

SEQ ID NO: 3012758 - DNA, 18 bp, Homo sapiens
gcatgctctctgcagcca

SEQ ID NO: 3012759 - DNA, 22 bp, Homo sapiens
gcatgctctctgcagccagccc

SEQ ID NO: 3012760 - DNA, 23 bp, Homo sapiens
gcatgctctctgcagccagccca

SEQ ID NO: 3012761 - DNA, 21 bp, Homo sapiens
gcatgctgcctgagtattact

SEQ ID NO: 3012762 - DNA, 21 bp, Homo sapiens
gcatgcttctattagtcacct

SEQ ID NO: 3012763 - DNA, 18 bp, Homo sapiens
gcatggagatagccccac

SEQ ID NO: 3012764 - DNA, 18 bp, Homo sapiens
gcatggagttgggcgtta

SEQ ID NO: 3012765 - DNA, 14 bp, Homo sapiens
gcatggcactccct

SEQ ID NO: 3012766 - DNA, 20 bp, Homo sapiens
gcatggcactccctccagca

SEQ ID NO: 3012767 - DNA, 21 bp, Homo sapiens
gcatggcactccctccagcac

SEQ ID NO: 3012768 - DNA, 11 bp, Homo sapiens
gcatggcagct

SEQ ID NO: 3012769 - DNA, 15 bp, Homo sapiens
gcatggccctgctgc

SEQ ID NO: 3012770 - DNA, 21 bp, Homo sapiens
gcatggccctgctgcccctcc

SEQ ID NO: 3012771 - DNA, 13 bp, Homo sapiens
gcatggccctggg

SEQ ID NO: 3012772 - DNA, 17 bp, Homo sapiens
gcatggctggtgcctga

SEQ ID NO: 3012773 - DNA, 16 bp, Homo sapiens
gcatgggaatacaaaa

SEQ ID NO: 3012774 - DNA, 22 bp, Homo sapiens
gcatgggaatacaaaaggtttg

SEQ ID NO: 3012775 - DNA, 17 bp, Homo sapiens
gcatgggccagcccctc

SEQ ID NO: 3012776 - DNA, 16 bp, Homo sapiens
gcatggggcatgtcct

SEQ ID NO: 3012777 - DNA, 21 bp, Homo sapiens
gcatgggtcgggagaggggac

SEQ ID NO: 3012778 - DNA, 15 bp, Homo sapiens
gcatggtgccccagg

SEQ ID NO: 3012779 - DNA, 16 bp, Homo sapiens
gcatggtgccccagga

SEQ ID NO: 3012780 - DNA, 17 bp, Homo sapiens
gcatggtgccccaggac

SEQ ID NO: 3012781 - DNA, 18 bp, Homo sapiens
gcatggtgccccaggacc

SEQ ID NO: 3012782 - DNA, 13 bp, Homo sapiens
gcatggtggccag

SEQ ID NO: 3012783 - DNA, 23 bp, Homo sapiens
gcatgtaaaatcttcagctggtg

SEQ ID NO: 3012784 - DNA, 14 bp, Homo sapiens
gcatgtatgtcttg

SEQ ID NO: 3012785 - DNA, 15 bp, Homo sapiens
gcatgtatgtcttgg

SEQ ID NO: 3012786 - DNA, 14 bp, Homo sapiens
gcatgtcaaacatg

SEQ ID NO: 3012787 - DNA, 22 bp, Homo sapiens
gcatgtcctttccatctgtcca

SEQ ID NO: 3012788 - DNA, 14 bp, Homo sapiens
gcatgtctgcctgg

SEQ ID NO: 3012789 - DNA, 17 bp, Homo sapiens
gcatgtctgcctggagt

SEQ ID NO: 3012790 - DNA, 15 bp, Homo sapiens
gcatgtcttttaaaa

SEQ ID NO: 3012791 - DNA, 21 bp, Homo sapiens
gcatgtgaaaatcaaatacat

SEQ ID NO: 3012792 - DNA, 15 bp, Homo sapiens
gcatgtgactctgaa

SEQ ID NO: 3012793 - DNA, 17 bp, Homo sapiens
gcatgtgcgtggaagtg

SEQ ID NO: 3012794 - DNA, 20 bp, Homo sapiens
gcatgtgcgtggaagtgttc

SEQ ID NO: 3012795 - DNA, 21 bp, Homo sapiens
gcatgtgcgtggaagtgttcc

SEQ ID NO: 3012796 - DNA, 15 bp, Homo sapiens
gcatgtgggcttcaa

SEQ ID NO: 3012797 - DNA, 14 bp, Homo sapiens
gcatgtgtatatat

SEQ ID NO: 3012798 - DNA, 18 bp, Homo sapiens
gcatgtgtcatgcatgaa

SEQ ID NO: 3012799 - DNA, 20 bp, Homo sapiens
gcatgttgaccatgtctatg

SEQ ID NO: 3012800 - DNA, 15 bp, Homo sapiens
gcatgtttaattgtg

SEQ ID NO: 3012801 - DNA, 20 bp, Homo sapiens
gcatgtttaattgtgatatt

SEQ ID NO: 3012802 - DNA, 18 bp, Homo sapiens
gcatgtttattctgttcc

SEQ ID NO: 3012803 - DNA, 14 bp, Homo sapiens
gcattaaaataact

SEQ ID NO: 3012804 - DNA, 16 bp, Homo sapiens
gcattaaaataactat

SEQ ID NO: 3012805 - DNA, 23 bp, Homo sapiens
gcattaaaataactatcaggcag

SEQ ID NO: 3012806 - DNA, 17 bp, Homo sapiens
gcattaattgttccttg

SEQ ID NO: 3012807 - DNA, 14 bp, Homo sapiens
gcattataattttt

SEQ ID NO: 3012808 - DNA, 21 bp, Homo sapiens
gcattatgtccactgtgtata

SEQ ID NO: 3012809 - DNA, 16 bp, Homo sapiens
gcattcacaaagtagc

SEQ ID NO: 3012810 - DNA, 18 bp, Homo sapiens
gcattccaacaaagggtt

SEQ ID NO: 3012811 - DNA, 12 bp, Homo sapiens
gcattccacagg

SEQ ID NO: 3012812 - DNA, 22 bp, Homo sapiens
gcattccagagttaaaatgttt

SEQ ID NO: 3012813 - DNA, 12 bp, Homo sapiens
gcattccaggct

SEQ ID NO: 3012814 - DNA, 15 bp, Homo sapiens
gcattccatgaccag

SEQ ID NO: 3012815 - DNA, 14 bp, Homo sapiens
gcattccctgagtc

SEQ ID NO: 3012816 - DNA, 22 bp, Homo sapiens
gcattccctgagtcaccaggaa

SEQ ID NO: 3012817 - DNA, 23 bp, Homo sapiens
gcattcgctgtaccctttaagat

SEQ ID NO: 3012818 - DNA, 23 bp, Homo sapiens
gcattctgaatcagaatctcgca

SEQ ID NO: 3012819 - DNA, 19 bp, Homo sapiens
gcattctgataggaggggg

SEQ ID NO: 3012820 - DNA, 21 bp, Homo sapiens
gcattctgataggagggggcg

SEQ ID NO: 3012821 - DNA, 20 bp, Homo sapiens
gcattctgcctctctaggac

SEQ ID NO: 3012822 - DNA, 13 bp, Homo sapiens
gcattctttgcaa

SEQ ID NO: 3012823 - DNA, 20 bp, Homo sapiens
gcattctttgcaatactgct

SEQ ID NO: 3012824 - DNA, 16 bp, Homo sapiens
gcattgaacacaaact

SEQ ID NO: 3012825 - DNA, 22 bp, Homo sapiens
gcattgaacacaaactgtaaat

SEQ ID NO: 3012826 - DNA, 22 bp, Homo sapiens
gcattgagaactgcatatgttt

SEQ ID NO: 3012827 - DNA, 14 bp, Homo sapiens
gcattgccaagggc

SEQ ID NO: 3012828 - DNA, 22 bp, Homo sapiens
gcattgccgaagtccagctttc

SEQ ID NO: 3012829 - DNA, 20 bp, Homo sapiens
gcattgctttctgaaattag

SEQ ID NO: 3012830 - DNA, 17 bp, Homo sapiens
gcattggatacagcagt

SEQ ID NO: 3012831 - DNA, 21 bp, Homo sapiens
gcattgtaattatgtaaataa

SEQ ID NO: 3012832 - DNA, 14 bp, Homo sapiens
gcattgtttctgtg

SEQ ID NO: 3012833 - DNA, 18 bp, Homo sapiens
gcatttagaacgagcctg

SEQ ID NO: 3012834 - DNA, 22 bp, Homo sapiens
gcatttatgtagacattgtaaa

SEQ ID NO: 3012835 - DNA, 14 bp, Homo sapiens
gcatttattgcagt

SEQ ID NO: 3012836 - DNA, 20 bp, Homo sapiens
gcatttcaaagccctgcctc

SEQ ID NO: 3012837 - DNA, 17 bp, Homo sapiens
gcatttcaattcctggc

SEQ ID NO: 3012838 - DNA, 22 bp, Homo sapiens
gcatttcacaaaacagcctttg

SEQ ID NO: 3012839 - DNA, 20 bp, Homo sapiens
gcatttgggtaatttagatt

SEQ ID NO: 3012840 - DNA, 20 bp, Homo sapiens
gcatttgggtggtttttatt

SEQ ID NO: 3012841 - DNA, 20 bp, Homo sapiens
gcatttggtaggtagtgatt

SEQ ID NO: 3012842 - DNA, 17 bp, Homo sapiens
gcatttgtgctagaaat

SEQ ID NO: 3012843 - DNA, 16 bp, Homo sapiens
gcattttattgcttga

SEQ ID NO: 3012844 - DNA, 20 bp, Homo sapiens
gcattttcctccatcgcagt

SEQ ID NO: 3012845 - DNA, 18 bp, Homo sapiens
gcattttgatattgctgt

SEQ ID NO: 3012846 - DNA, 23 bp, Homo sapiens
gcattttggagagtttcctgaaa

SEQ ID NO: 3012847 - DNA, 12 bp, Homo sapiens
gcatttttctgc

SEQ ID NO: 3012848 - DNA, 16 bp, Homo sapiens
gccaaaaaggatacat

SEQ ID NO: 3012849 - DNA, 19 bp, Homo sapiens
gccaaaaaggatacataat

SEQ ID NO: 3012850 - DNA, 15 bp, Homo sapiens
gccaaaagctgctca

SEQ ID NO: 3012851 - DNA, 14 bp, Homo sapiens
gccaaacctctgtt

SEQ ID NO: 3012852 - DNA, 18 bp, Homo sapiens
gccaaagaatatttaaat

SEQ ID NO: 3012853 - DNA, 16 bp, Homo sapiens
gccaaagagcctttcc

SEQ ID NO: 3012854 - DNA, 22 bp, Homo sapiens
gccaaagagcctttccaaagag

SEQ ID NO: 3012855 - DNA, 17 bp, Homo sapiens
gccaaagttaaatgtat

SEQ ID NO: 3012856 - DNA, 19 bp, Homo sapiens
gccaacaagaatgcattga

SEQ ID NO: 3012857 - DNA, 20 bp, Homo sapiens
gccaacacgcacctgcctca

SEQ ID NO: 3012858 - DNA, 21 bp, Homo sapiens
gccaacacgcacctgcctcag

SEQ ID NO: 3012859 - DNA, 23 bp, Homo sapiens
gccaacacgcacctgcctcagga

SEQ ID NO: 3012860 - DNA, 15 bp, Homo sapiens
gccaaccagcctttg

SEQ ID NO: 3012861 - DNA, 19 bp, Homo sapiens
gccaaccccacccagctcc

SEQ ID NO: 3012862 - DNA, 17 bp, Homo sapiens
gccaacgagattgctgg

SEQ ID NO: 3012863 - DNA, 15 bp, Homo sapiens
gccaactagcccctg

SEQ ID NO: 3012864 - DNA, 17 bp, Homo sapiens
gccaactagcccctggg

SEQ ID NO: 3012865 - DNA, 17 bp, Homo sapiens
gccaactgcctccttgc

SEQ ID NO: 3012866 - DNA, 16 bp, Homo sapiens
gccaacttgccatgtt

SEQ ID NO: 3012867 - DNA, 18 bp, Homo sapiens
gccaagaaaatgaaggga

SEQ ID NO: 3012868 - DNA, 22 bp, Homo sapiens
gccaagaaaattgcctttaaaa

SEQ ID NO: 3012869 - DNA, 20 bp, Homo sapiens
gccaagaaacactgcctgcc

SEQ ID NO: 3012870 - DNA, 22 bp, Homo sapiens
gccaagaaacgtcttctaaact

SEQ ID NO: 3012871 - DNA, 13 bp, Homo sapiens
gccaagaatgtac

SEQ ID NO: 3012872 - DNA, 13 bp, Homo sapiens
gccaagaggctgc

SEQ ID NO: 3012873 - DNA, 16 bp, Homo sapiens
gccaagcacagtggtg

SEQ ID NO: 3012874 - DNA, 12 bp, Homo sapiens
gccaagctgtgt

SEQ ID NO: 3012875 - DNA, 13 bp, Homo sapiens
gccaaggagctgc

SEQ ID NO: 3012876 - DNA, 14 bp, Homo sapiens
gccaaggagctgct

SEQ ID NO: 3012877 - DNA, 21 bp, Homo sapiens
gccaaggagggtgagtgcaag

SEQ ID NO: 3012878 - DNA, 16 bp, Homo sapiens
gccaagggctttgttt

SEQ ID NO: 3012879 - DNA, 14 bp, Homo sapiens
gccaaggtgggcgg

SEQ ID NO: 3012880 - DNA, 17 bp, Homo sapiens
gccaagtcctgcctttg

SEQ ID NO: 3012881 - DNA, 17 bp, Homo sapiens
gccaagtttatatacaa

SEQ ID NO: 3012882 - DNA, 21 bp, Homo sapiens
gccaatccctcaccttctgag

SEQ ID NO: 3012883 - DNA, 20 bp, Homo sapiens
gccaatgttgtgtgttgcac

SEQ ID NO: 3012884 - DNA, 15 bp, Homo sapiens
gccaattcagacagg

SEQ ID NO: 3012885 - DNA, 15 bp, Homo sapiens
gccaatttgtctcct

SEQ ID NO: 3012886 - DNA, 15 bp, Homo sapiens
gccacaaatgtgtcc

SEQ ID NO: 3012887 - DNA, 22 bp, Homo sapiens
gccacaaattctttgacactca

SEQ ID NO: 3012888 - DNA, 19 bp, Homo sapiens
gccacaaggacttcctgtc

SEQ ID NO: 3012889 - DNA, 21 bp, Homo sapiens
gccacaaggacttcctgtcca

SEQ ID NO: 3012890 - DNA, 20 bp, Homo sapiens
gccacacacacagaaaatat

SEQ ID NO: 3012891 - DNA, 22 bp, Homo sapiens
gccacacacacagaaaatatac

SEQ ID NO: 3012892 - DNA, 23 bp, Homo sapiens
gccacacacacagaaaatatact

SEQ ID NO: 3012893 - DNA, 14 bp, Homo sapiens
gccacacatgggca

SEQ ID NO: 3012894 - DNA, 21 bp, Homo sapiens
gccacaccaggatagagactg

SEQ ID NO: 3012895 - DNA, 19 bp, Homo sapiens
gccacacctggtctgtttt

SEQ ID NO: 3012896 - DNA, 13 bp, Homo sapiens
gccacacgcaggc

SEQ ID NO: 3012897 - DNA, 14 bp, Homo sapiens
gccacacgcaggcg

SEQ ID NO: 3012898 - DNA, 13 bp, Homo sapiens
gccacactcagca

SEQ ID NO: 3012899 - DNA, 17 bp, Homo sapiens
gccacactcagcacaag

SEQ ID NO: 3012900 - DNA, 15 bp, Homo sapiens
gccacactgtgacac

SEQ ID NO: 3012901 - DNA, 15 bp, Homo sapiens
gccacagaaggtgaa

SEQ ID NO: 3012902 - DNA, 22 bp, Homo sapiens
gccacagagtgtagccaggtcc

SEQ ID NO: 3012903 - DNA, 23 bp, Homo sapiens
gccacagagtgtagccaggtccc

SEQ ID NO: 3012904 - DNA, 16 bp, Homo sapiens
gccacagcccaggcct

SEQ ID NO: 3012905 - DNA, 23 bp, Homo sapiens
gccacagcccaggcctccagctc

SEQ ID NO: 3012906 - DNA, 21 bp, Homo sapiens
gccacagcctcccctgccagg

SEQ ID NO: 3012907 - DNA, 21 bp, Homo sapiens
gccacagcctgggaaggagcg

SEQ ID NO: 3012908 - DNA, 12 bp, Homo sapiens
gccacagcctgt

SEQ ID NO: 3012909 - DNA, 14 bp, Homo sapiens
gccacagcgtgctg

SEQ ID NO: 3012910 - DNA, 18 bp, Homo sapiens
gccacaggaacggccctg

SEQ ID NO: 3012911 - DNA, 21 bp, Homo sapiens
gccacaggaacggccctgcag

SEQ ID NO: 3012912 - DNA, 15 bp, Homo sapiens
gccacaggccaaatc

SEQ ID NO: 3012913 - DNA, 22 bp, Homo sapiens
gccacagtatggatgggtggat

SEQ ID NO: 3012914 - DNA, 16 bp, Homo sapiens
gccacatgccccaggc

SEQ ID NO: 3012915 - DNA, 18 bp, Homo sapiens
gccacatggtgtggccat

SEQ ID NO: 3012916 - DNA, 17 bp, Homo sapiens
gccaccaaatctgtcta

SEQ ID NO: 3012917 - DNA, 19 bp, Homo sapiens
gccaccacccaacctgtcc

SEQ ID NO: 3012918 - DNA, 15 bp, Homo sapiens
gccaccagctctgcc

SEQ ID NO: 3012919 - DNA, 21 bp, Homo sapiens
gccaccaggtgcctttcaaat

SEQ ID NO: 3012920 - DNA, 18 bp, Homo sapiens
gccaccatcctattgcaa

SEQ ID NO: 3012921 - DNA, 22 bp, Homo sapiens
gccaccatgcctcactaatttt

SEQ ID NO: 3012922 - DNA, 18 bp, Homo sapiens
gccacccacctccctgcc

SEQ ID NO: 3012923 - DNA, 12 bp, Homo sapiens
gccacccccagc

SEQ ID NO: 3012924 - DNA, 18 bp, Homo sapiens
gccacccccagccctggc

SEQ ID NO: 3012925 - DNA, 13 bp, Homo sapiens
gccacccctgcca

SEQ ID NO: 3012926 - DNA, 17 bp, Homo sapiens
gccacccctgccactca

SEQ ID NO: 3012927 - DNA, 20 bp, Homo sapiens
gccacccctgccactcaccc

SEQ ID NO: 3012928 - DNA, 18 bp, Homo sapiens
gccaccctcccagctctg

SEQ ID NO: 3012929 - DNA, 13 bp, Homo sapiens
gccaccctgcccc

SEQ ID NO: 3012930 - DNA, 15 bp, Homo sapiens
gccacccttccctgc

SEQ ID NO: 3012931 - DNA, 15 bp, Homo sapiens
gccaccgactgccca

SEQ ID NO: 3012932 - DNA, 19 bp, Homo sapiens
gccaccgactgcccagcca

SEQ ID NO: 3012933 - DNA, 21 bp, Homo sapiens
gccaccgactgcccagccact

SEQ ID NO: 3012934 - DNA, 14 bp, Homo sapiens
gccaccgcagctgc

SEQ ID NO: 3012935 - DNA, 16 bp, Homo sapiens
gccaccgcagctgctg

SEQ ID NO: 3012936 - DNA, 21 bp, Homo sapiens
gccaccgcagctgctgccact

SEQ ID NO: 3012937 - DNA, 19 bp, Homo sapiens
gccaccgcctcctacagcc

SEQ ID NO: 3012938 - DNA, 19 bp, Homo sapiens
gccaccgggggtggctctg

SEQ ID NO: 3012939 - DNA, 20 bp, Homo sapiens
gccaccgggggtggctctgt

SEQ ID NO: 3012940 - DNA, 15 bp, Homo sapiens
gccacctcccctatc

SEQ ID NO: 3012941 - DNA, 21 bp, Homo sapiens
gccacctcccctatccaccca

SEQ ID NO: 3012942 - DNA, 20 bp, Homo sapiens
gccaccttcccaccccttca

SEQ ID NO: 3012943 - DNA, 14 bp, Homo sapiens
gccaccttgatttt

SEQ ID NO: 3012944 - DNA, 20 bp, Homo sapiens
gccaccttgattttcttctt

SEQ ID NO: 3012945 - DNA, 16 bp, Homo sapiens
gccacggcccagggag

SEQ ID NO: 3012946 - DNA, 18 bp, Homo sapiens
gccacgtgccaggcccgg

SEQ ID NO: 3012947 - DNA, 19 bp, Homo sapiens
gccacgtgccttaggaata

SEQ ID NO: 3012948 - DNA, 21 bp, Homo sapiens
gccacgtgccttaggaatact

SEQ ID NO: 3012949 - DNA, 23 bp, Homo sapiens
gccacgtgtttgtgctgtggtgt

SEQ ID NO: 3012950 - DNA, 16 bp, Homo sapiens
gccacgttcagggagg

SEQ ID NO: 3012951 - DNA, 15 bp, Homo sapiens
gccactaagcagagg

SEQ ID NO: 3012952 - DNA, 17 bp, Homo sapiens
gccactaagcagaggag

SEQ ID NO: 3012953 - DNA, 23 bp, Homo sapiens
gccactaagcagaggaggggccg

SEQ ID NO: 3012954 - DNA, 19 bp, Homo sapiens
gccactcacccttcctggc

SEQ ID NO: 3012955 - DNA, 21 bp, Homo sapiens
gccactcacccttcctggccc

SEQ ID NO: 3012956 - DNA, 23 bp, Homo sapiens
gccactcacccttcctggcccag

SEQ ID NO: 3012957 - DNA, 16 bp, Homo sapiens
gccactcccctccact

SEQ ID NO: 3012958 - DNA, 16 bp, Homo sapiens
gccactcctccctccg

SEQ ID NO: 3012959 - DNA, 14 bp, Homo sapiens
gccactcctctgac

SEQ ID NO: 3012960 - DNA, 15 bp, Homo sapiens
gccactcctctgact

SEQ ID NO: 3012961 - DNA, 22 bp, Homo sapiens
gccactctaccagtgcaggctg

SEQ ID NO: 3012962 - DNA, 15 bp, Homo sapiens
gccactctgctgcct

SEQ ID NO: 3012963 - DNA, 15 bp, Homo sapiens
gccactgaaatctgt

SEQ ID NO: 3012964 - DNA, 16 bp, Homo sapiens
gccactggaaggagca

SEQ ID NO: 3012965 - DNA, 13 bp, Homo sapiens
gccactggagggg

SEQ ID NO: 3012966 - DNA, 15 bp, Homo sapiens
gccactgggcacctg

SEQ ID NO: 3012967 - DNA, 16 bp, Homo sapiens
gccactgggcacctgc

SEQ ID NO: 3012968 - DNA, 19 bp, Homo sapiens
gccactgtgtttctgtgct

SEQ ID NO: 3012969 - DNA, 20 bp, Homo sapiens
gccactgtgtttctgtgctc

SEQ ID NO: 3012970 - DNA, 17 bp, Homo sapiens
gccacttctgtccatat

SEQ ID NO: 3012971 - DNA, 19 bp, Homo sapiens
gccacttttagctactgct

SEQ ID NO: 3012972 - DNA, 22 bp, Homo sapiens
gccactttttcagaggtgaatt

SEQ ID NO: 3012973 - DNA, 14 bp, Homo sapiens
gccagaagactcct

SEQ ID NO: 3012974 - DNA, 21 bp, Homo sapiens
gccagaagctgagcaccaggg

SEQ ID NO: 3012975 - DNA, 18 bp, Homo sapiens
gccagacatgccacaagg

SEQ ID NO: 3012976 - DNA, 21 bp, Homo sapiens
gccagacttcccacggctcct

SEQ ID NO: 3012977 - DNA, 10 bp, Homo sapiens
gccagagaag

SEQ ID NO: 3012978 - DNA, 11 bp, Homo sapiens
gccagagaagt

SEQ ID NO: 3012979 - DNA, 13 bp, Homo sapiens
gccagagaagtga

SEQ ID NO: 3012980 - DNA, 16 bp, Homo sapiens
gccagagaagtgacag

SEQ ID NO: 3012981 - DNA, 17 bp, Homo sapiens
gccagagaagtgacagg

SEQ ID NO: 3012982 - DNA, 13 bp, Homo sapiens
gccagagatccaa

SEQ ID NO: 3012983 - DNA, 23 bp, Homo sapiens
gccagagatccaaaagaagcccc

SEQ ID NO: 3012984 - DNA, 22 bp, Homo sapiens
gccagagccaaggggcttcagg

SEQ ID NO: 3012985 - DNA, 14 bp, Homo sapiens
gccagagccagggg

SEQ ID NO: 3012986 - DNA, 17 bp, Homo sapiens
gccagagctgaagagtt

SEQ ID NO: 3012987 - DNA, 20 bp, Homo sapiens
gccagaggatgctctttccc

SEQ ID NO: 3012988 - DNA, 13 bp, Homo sapiens
gccagagggtggg

SEQ ID NO: 3012989 - DNA, 16 bp, Homo sapiens
gccagagtggccacgg

SEQ ID NO: 3012990 - DNA, 22 bp, Homo sapiens
gccagagtggccacggcccagg

SEQ ID NO: 3012991 - DNA, 15 bp, Homo sapiens
gccagatccagcctg

SEQ ID NO: 3012992 - DNA, 17 bp, Homo sapiens
gccagatccagcctggg

SEQ ID NO: 3012993 - DNA, 22 bp, Homo sapiens
gccagatgcacatccctggaag

SEQ ID NO: 3012994 - DNA, 21 bp, Homo sapiens
gccagatgcggggacaggctg

SEQ ID NO: 3012995 - DNA, 22 bp, Homo sapiens
gccagatggactccagcctgcc

SEQ ID NO: 3012996 - DNA, 14 bp, Homo sapiens
gccagatttgtctt

SEQ ID NO: 3012997 - DNA, 16 bp, Homo sapiens
gccagatttgtctttt

SEQ ID NO: 3012998 - DNA, 16 bp, Homo sapiens
gccagattttttaaaa

SEQ ID NO: 3012999 - DNA, 12 bp, Homo sapiens
gccagcacacag

SEQ ID NO: 3013000 - DNA, 17 bp, Homo sapiens
gccagcacacagggcag

SEQ ID NO: 3013001 - DNA, 18 bp, Homo sapiens
gccagcacacagggcagt

SEQ ID NO: 3013002 - DNA, 21 bp, Homo sapiens
gccagcaccgccggctttcag

SEQ ID NO: 3013003 - DNA, 16 bp, Homo sapiens
gccagcacttgtatat

SEQ ID NO: 3013004 - DNA, 19 bp, Homo sapiens
gccagcacttgtccagctg

SEQ ID NO: 3013005 - DNA, 15 bp, Homo sapiens
gccagcagcgcgcag

SEQ ID NO: 3013006 - DNA, 19 bp, Homo sapiens
gccagcagcgcgcaggcct

SEQ ID NO: 3013007 - DNA, 15 bp, Homo sapiens
gccagcaggcagcgc

SEQ ID NO: 3013008 - DNA, 13 bp, Homo sapiens
gccagcaggcctc

SEQ ID NO: 3013009 - DNA, 19 bp, Homo sapiens
gccagcagttactgtgaat

SEQ ID NO: 3013010 - DNA, 14 bp, Homo sapiens
gccagccacccctg

SEQ ID NO: 3013011 - DNA, 18 bp, Homo sapiens
gccagccacccctgccac

SEQ ID NO: 3013012 - DNA, 21 bp, Homo sapiens
gccagccactctaccagtgca

SEQ ID NO: 3013013 - DNA, 14 bp, Homo sapiens
gccagccagccact

SEQ ID NO: 3013014 - DNA, 16 bp, Homo sapiens
gccagccagccactct

SEQ ID NO: 3013015 - DNA, 16 bp, Homo sapiens
gccagccaggccctgc

SEQ ID NO: 3013016 - DNA, 19 bp, Homo sapiens
gccagcccaaaccttgggc

SEQ ID NO: 3013017 - DNA, 16 bp, Homo sapiens
gccagccccgctccca

SEQ ID NO: 3013018 - DNA, 20 bp, Homo sapiens
gccagccccgctcccaccta

SEQ ID NO: 3013019 - DNA, 13 bp, Homo sapiens
gccagcccctcca

SEQ ID NO: 3013020 - DNA, 15 bp, Homo sapiens
gccagcccctgctgg

SEQ ID NO: 3013021 - DNA, 24 bp, Homo sapiens
gccagcccctgctggctggtgcct

SEQ ID NO: 3013022 - DNA, 19 bp, Homo sapiens
gccagcccctggccccagg

SEQ ID NO: 3013023 - DNA, 20 bp, Homo sapiens
gccagcccggctcggcccag

SEQ ID NO: 3013024 - DNA, 16 bp, Homo sapiens
gccagcccgtcctcct

SEQ ID NO: 3013025 - DNA, 18 bp, Homo sapiens
gccagccgctctcctgcc

SEQ ID NO: 3013026 - DNA, 15 bp, Homo sapiens
gccagcgccagggcc

SEQ ID NO: 3013027 - DNA, 18 bp, Homo sapiens
gccagcgccagggcccag

SEQ ID NO: 3013028 - DNA, 12 bp, Homo sapiens
gccagcgtcctc

SEQ ID NO: 3013029 - DNA, 13 bp, Homo sapiens
gccagctccctct

SEQ ID NO: 3013030 - DNA, 16 bp, Homo sapiens
gccagctctgtcaccc

SEQ ID NO: 3013031 - DNA, 18 bp, Homo sapiens
gccagctgccccagccag

SEQ ID NO: 3013032 - DNA, 19 bp, Homo sapiens
gccaggaatttcccaggac

SEQ ID NO: 3013033 - DNA, 22 bp, Homo sapiens
gccaggacccgccagccccgct

SEQ ID NO: 3013034 - DNA, 12 bp, Homo sapiens
gccaggagggac

SEQ ID NO: 3013035 - DNA, 19 bp, Homo sapiens
gccaggcccccaagcctgc

SEQ ID NO: 3013036 - DNA, 17 bp, Homo sapiens
gccaggcccggggctgg

SEQ ID NO: 3013037 - DNA, 18 bp, Homo sapiens
gccaggcccggggctggc

SEQ ID NO: 3013038 - DNA, 19 bp, Homo sapiens
gccaggccctggagggcag

SEQ ID NO: 3013039 - DNA, 21 bp, Homo sapiens
gccaggccctggagggcagag

SEQ ID NO: 3013040 - DNA, 20 bp, Homo sapiens
gccaggccggcgagccctgt

SEQ ID NO: 3013041 - DNA, 23 bp, Homo sapiens
gccaggccggcgagccctgtgga

SEQ ID NO: 3013042 - DNA, 15 bp, Homo sapiens
gccaggcctcgcctg

SEQ ID NO: 3013043 - DNA, 18 bp, Homo sapiens
gccaggcctcgcctgccc

SEQ ID NO: 3013044 - DNA, 20 bp, Homo sapiens
gccaggcctcgcctgccctc

SEQ ID NO: 3013045 - DNA, 17 bp, Homo sapiens
gccaggcctcttggcag

SEQ ID NO: 3013046 - DNA, 16 bp, Homo sapiens
gccaggcgagatgggg

SEQ ID NO: 3013047 - DNA, 19 bp, Homo sapiens
gccaggcgagcctgactct

SEQ ID NO: 3013048 - DNA, 20 bp, Homo sapiens
gccaggcgagcctgactctg

SEQ ID NO: 3013049 - DNA, 21 bp, Homo sapiens
gccaggcgagcctgactctgt

SEQ ID NO: 3013050 - DNA, 14 bp, Homo sapiens
gccaggcgctgcag

SEQ ID NO: 3013051 - DNA, 19 bp, Homo sapiens
gccaggctgaccacagcac

SEQ ID NO: 3013052 - DNA, 20 bp, Homo sapiens
gccaggctgaccacagcaca

SEQ ID NO: 3013053 - DNA, 18 bp, Homo sapiens
gccaggctgcctggcctt

SEQ ID NO: 3013054 - DNA, 20 bp, Homo sapiens
gccaggctgcggtgggcagc

SEQ ID NO: 3013055 - DNA, 21 bp, Homo sapiens
gccaggctgcggtgggcagcc

SEQ ID NO: 3013056 - DNA, 15 bp, Homo sapiens
gccaggctgggccgc

SEQ ID NO: 3013057 - DNA, 17 bp, Homo sapiens
gccaggctggtctaaaa

SEQ ID NO: 3013058 - DNA, 12 bp, Homo sapiens
gccagggaccca

SEQ ID NO: 3013059 - DNA, 14 bp, Homo sapiens
gccagggagaagct

SEQ ID NO: 3013060 - DNA, 16 bp, Homo sapiens
gccagggagaagctcc

SEQ ID NO: 3013061 - DNA, 22 bp, Homo sapiens
gccagggagacctggacacagg

SEQ ID NO: 3013062 - DNA, 13 bp, Homo sapiens
gccagggaggcag

SEQ ID NO: 3013063 - DNA, 23 bp, Homo sapiens
gccagggatgggcagcccaacag

SEQ ID NO: 3013064 - DNA, 20 bp, Homo sapiens
gccagggcaatgatgaatga

SEQ ID NO: 3013065 - DNA, 21 bp, Homo sapiens
gccagggcagagtgagaccca

SEQ ID NO: 3013066 - DNA, 15 bp, Homo sapiens
gccagggccacgctc

SEQ ID NO: 3013067 - DNA, 14 bp, Homo sapiens
gccagggcccaggc

SEQ ID NO: 3013068 - DNA, 19 bp, Homo sapiens
gccagggcccaggccatgt

SEQ ID NO: 3013069 - DNA, 15 bp, Homo sapiens
gccagggcggccagg

SEQ ID NO: 3013070 - DNA, 21 bp, Homo sapiens
gccagggcggccagggaccca

SEQ ID NO: 3013071 - DNA, 23 bp, Homo sapiens
gccagggctcctgtggcagctgc

SEQ ID NO: 3013072 - DNA, 18 bp, Homo sapiens
gccagggctctgggggca

SEQ ID NO: 3013073 - DNA, 21 bp, Homo sapiens
gccagggctctgggggcagat

SEQ ID NO: 3013074 - DNA, 14 bp, Homo sapiens
gccagggctgggtc

SEQ ID NO: 3013075 - DNA, 23 bp, Homo sapiens
gccagggcttcctcttccgggca

SEQ ID NO: 3013076 - DNA, 19 bp, Homo sapiens
gccaggggcgaggcccttc

SEQ ID NO: 3013077 - DNA, 15 bp, Homo sapiens
gccagggggatgcca

SEQ ID NO: 3013078 - DNA, 21 bp, Homo sapiens
gccaggggggtgaggagctgg

SEQ ID NO: 3013079 - DNA, 15 bp, Homo sapiens
gccaggtaatgtgaa

SEQ ID NO: 3013080 - DNA, 21 bp, Homo sapiens
gccaggtgcggcctgggggga

SEQ ID NO: 3013081 - DNA, 18 bp, Homo sapiens
gccaggttaggaaggcag

SEQ ID NO: 3013082 - DNA, 16 bp, Homo sapiens
gccagtagtaccttgt

SEQ ID NO: 3013083 - DNA, 18 bp, Homo sapiens
gccagtcctggtcctggc

SEQ ID NO: 3013084 - DNA, 21 bp, Homo sapiens
gccagtcgggagagccaggct

SEQ ID NO: 3013085 - DNA, 13 bp, Homo sapiens
gccagtcttcctc

SEQ ID NO: 3013086 - DNA, 22 bp, Homo sapiens
gccagtcttcctcttagcctct

SEQ ID NO: 3013087 - DNA, 17 bp, Homo sapiens
gccagtgacctgaggaa

SEQ ID NO: 3013088 - DNA, 20 bp, Homo sapiens
gccagtgacctgaggaagcg

SEQ ID NO: 3013089 - DNA, 23 bp, Homo sapiens
gccagtgaggttcttaaagtttg

SEQ ID NO: 3013090 - DNA, 21 bp, Homo sapiens
gccagtgtgttactcatcttt

SEQ ID NO: 3013091 - DNA, 22 bp, Homo sapiens
gccagtgtttctgaatgtttgt

SEQ ID NO: 3013092 - DNA, 20 bp, Homo sapiens
gccagttttcggaaacactg

SEQ ID NO: 3013093 - DNA, 17 bp, Homo sapiens
gccagttttctgttcag

SEQ ID NO: 3013094 - DNA, 21 bp, Homo sapiens
gccagttttctgttcagcttt

SEQ ID NO: 3013095 - DNA, 22 bp, Homo sapiens
gccataaaacaggtaatataaa

SEQ ID NO: 3013096 - DNA, 21 bp, Homo sapiens
gccatacatgttattgttttc

SEQ ID NO: 3013097 - DNA, 13 bp, Homo sapiens
gccataggccaag

SEQ ID NO: 3013098 - DNA, 17 bp, Homo sapiens
gccataggccaaggtgc

SEQ ID NO: 3013099 - DNA, 15 bp, Homo sapiens
gccataggtgcagtt

SEQ ID NO: 3013100 - DNA, 18 bp, Homo sapiens
gccatataagtttgaagg

SEQ ID NO: 3013101 - DNA, 19 bp, Homo sapiens
gccatatactcttcaagga

SEQ ID NO: 3013102 - DNA, 21 bp, Homo sapiens
gccatatcatgctaaaattct

SEQ ID NO: 3013103 - DNA, 16 bp, Homo sapiens
gccatatggacactgt

SEQ ID NO: 3013104 - DNA, 18 bp, Homo sapiens
gccatatggacactgtga

SEQ ID NO: 3013105 - DNA, 21 bp, Homo sapiens
gccatatggacactgtgacaa

SEQ ID NO: 3013106 - DNA, 15 bp, Homo sapiens
gccatcaaaatgctt

SEQ ID NO: 3013107 - DNA, 16 bp, Homo sapiens
gccatcaagagactga

SEQ ID NO: 3013108 - DNA, 18 bp, Homo sapiens
gccatcaagcacttccca

SEQ ID NO: 3013109 - DNA, 14 bp, Homo sapiens
gccatcactcagcc

SEQ ID NO: 3013110 - DNA, 16 bp, Homo sapiens
gccatcactcagcccc

SEQ ID NO: 3013111 - DNA, 18 bp, Homo sapiens
gccatcagccatggccct

SEQ ID NO: 3013112 - DNA, 23 bp, Homo sapiens
gccatcatctcctgccttcctcc

SEQ ID NO: 3013113 - DNA, 14 bp, Homo sapiens
gccatcattgctgt

SEQ ID NO: 3013114 - DNA, 19 bp, Homo sapiens
gccatccacattttaacag

SEQ ID NO: 3013115 - DNA, 17 bp, Homo sapiens
gccatcccaagcccagt

SEQ ID NO: 3013116 - DNA, 20 bp, Homo sapiens
gccatccccctctcacgcca

SEQ ID NO: 3013117 - DNA, 15 bp, Homo sapiens
gccatcgggtgccaa

SEQ ID NO: 3013118 - DNA, 17 bp, Homo sapiens
gccatcgggtgccaaat

SEQ ID NO: 3013119 - DNA, 19 bp, Homo sapiens
gccatctaatgcttgttta

SEQ ID NO: 3013120 - DNA, 18 bp, Homo sapiens
gccatctgcgcagggtgg

SEQ ID NO: 3013121 - DNA, 18 bp, Homo sapiens
gccatctggggctccttc

SEQ ID NO: 3013122 - DNA, 20 bp, Homo sapiens
gccatcttcccgcctcagcc

SEQ ID NO: 3013123 - DNA, 23 bp, Homo sapiens
gccatcttctccccgaggctgcc

SEQ ID NO: 3013124 - DNA, 18 bp, Homo sapiens
gccatcttgcttttcttt

SEQ ID NO: 3013125 - DNA, 14 bp, Homo sapiens
gccatcttggtaaa

SEQ ID NO: 3013126 - DNA, 15 bp, Homo sapiens
gccatcttggtaaat

SEQ ID NO: 3013127 - DNA, 22 bp, Homo sapiens
gccatcttggtaaatttcccca

SEQ ID NO: 3013128 - DNA, 15 bp, Homo sapiens
gccatgaaaccagag

SEQ ID NO: 3013129 - DNA, 19 bp, Homo sapiens
gccatgatgcctctgtctt

SEQ ID NO: 3013130 - DNA, 19 bp, Homo sapiens
gccatgatggcaacagatc

SEQ ID NO: 3013131 - DNA, 14 bp, Homo sapiens
gccatgcaagaact

SEQ ID NO: 3013132 - DNA, 13 bp, Homo sapiens
gccatgcctcagc

SEQ ID NO: 3013133 - DNA, 21 bp, Homo sapiens
gccatgcctcagccctgaccc

SEQ ID NO: 3013134 - DNA, 20 bp, Homo sapiens
gccatgcgcgcgctctctct

SEQ ID NO: 3013135 - DNA, 17 bp, Homo sapiens
gccatggaaggtgccag

SEQ ID NO: 3013136 - DNA, 14 bp, Homo sapiens
gccatggcctctgc

SEQ ID NO: 3013137 - DNA, 17 bp, Homo sapiens
gccatggctttcatcct

SEQ ID NO: 3013138 - DNA, 20 bp, Homo sapiens
gccatggctttcatcctgtg

SEQ ID NO: 3013139 - DNA, 23 bp, Homo sapiens
gccatggctttcatcctgtgtcc

SEQ ID NO: 3013140 - DNA, 21 bp, Homo sapiens
gccatgggcacaaagggccca

SEQ ID NO: 3013141 - DNA, 17 bp, Homo sapiens
gccatgggtcctcggcc

SEQ ID NO: 3013142 - DNA, 15 bp, Homo sapiens
gccatgtagcagaca

SEQ ID NO: 3013143 - DNA, 15 bp, Homo sapiens
gccatgtgactctgg

SEQ ID NO: 3013144 - DNA, 16 bp, Homo sapiens
gccatgtggcctgccc

SEQ ID NO: 3013145 - DNA, 17 bp, Homo sapiens
gccatgtggcctgccca

SEQ ID NO: 3013146 - DNA, 18 bp, Homo sapiens
gccatgtggcctgcccag

SEQ ID NO: 3013147 - DNA, 18 bp, Homo sapiens
gccattctcctgcctcag

SEQ ID NO: 3013148 - DNA, 18 bp, Homo sapiens
gccattgtactccagcct

SEQ ID NO: 3013149 - DNA, 22 bp, Homo sapiens
gccattgtactccagcctgggc

SEQ ID NO: 3013150 - DNA, 11 bp, Homo sapiens
gccatttttag

SEQ ID NO: 3013151 - DNA, 13 bp, Homo sapiens
gccatttttagtt

SEQ ID NO: 3013152 - DNA, 20 bp, Homo sapiens
gcccaaaccttgggccctgg

SEQ ID NO: 3013153 - DNA, 17 bp, Homo sapiens
gcccaaagcttgtaaat

SEQ ID NO: 3013154 - DNA, 23 bp, Homo sapiens
gcccaaatggctctgtgaaatca

SEQ ID NO: 3013155 - DNA, 16 bp, Homo sapiens
gcccaacccttccctc

SEQ ID NO: 3013156 - DNA, 22 bp, Homo sapiens
gcccacaatccctttctaagga

SEQ ID NO: 3013157 - DNA, 17 bp, Homo sapiens
gcccacacacactcctt

SEQ ID NO: 3013158 - DNA, 12 bp, Homo sapiens
gcccacacacag

SEQ ID NO: 3013159 - DNA, 11 bp, Homo sapiens
gcccacagagc

SEQ ID NO: 3013160 - DNA, 15 bp, Homo sapiens
gcccacagagcctga

SEQ ID NO: 3013161 - DNA, 16 bp, Homo sapiens
gcccacagcccccacc

SEQ ID NO: 3013162 - DNA, 17 bp, Homo sapiens
gcccacagcccccaccc

SEQ ID NO: 3013163 - DNA, 20 bp, Homo sapiens
gcccacagccgccggaagtg

SEQ ID NO: 3013164 - DNA, 14 bp, Homo sapiens
gcccacagctccca

SEQ ID NO: 3013165 - DNA, 16 bp, Homo sapiens
gcccacagggtaccag

SEQ ID NO: 3013166 - DNA, 19 bp, Homo sapiens
gcccacagtctgacttccc

SEQ ID NO: 3013167 - DNA, 17 bp, Homo sapiens
gcccaccaacatcccat

SEQ ID NO: 3013168 - DNA, 13 bp, Homo sapiens
gcccaccaggagc

SEQ ID NO: 3013169 - DNA, 22 bp, Homo sapiens
gcccaccaggagcacctggacc

SEQ ID NO: 3013170 - DNA, 23 bp, Homo sapiens
gcccaccaggagcacctggaccc

SEQ ID NO: 3013171 - DNA, 13 bp, Homo sapiens
gcccacccaggtc

SEQ ID NO: 3013172 - DNA, 15 bp, Homo sapiens
gcccacccaggtccc

SEQ ID NO: 3013173 - DNA, 23 bp, Homo sapiens
gcccacccagtccatgctccagg

SEQ ID NO: 3013174 - DNA, 19 bp, Homo sapiens
gcccacccccctccccaac

SEQ ID NO: 3013175 - DNA, 21 bp, Homo sapiens
gcccacccccgggatcctgcc

SEQ ID NO: 3013176 - DNA, 20 bp, Homo sapiens
gcccaccctgctgctggtgc

SEQ ID NO: 3013177 - DNA, 23 bp, Homo sapiens
gcccaccggatgctgtgcctggc

SEQ ID NO: 3013178 - DNA, 22 bp, Homo sapiens
gcccacctcggccctccctgcg

SEQ ID NO: 3013179 - DNA, 23 bp, Homo sapiens
gcccacctctcttttcctctctg

SEQ ID NO: 3013180 - DNA, 10 bp, Homo sapiens
gcccacctga

SEQ ID NO: 3013181 - DNA, 16 bp, Homo sapiens
gcccacctgaaagcct

SEQ ID NO: 3013182 - DNA, 20 bp, Homo sapiens
gcccacctgaaagcctgtct

SEQ ID NO: 3013183 - DNA, 12 bp, Homo sapiens
gcccacctgcct

SEQ ID NO: 3013184 - DNA, 13 bp, Homo sapiens
gcccacctgcctg

SEQ ID NO: 3013185 - DNA, 15 bp, Homo sapiens
gcccacctgcctggc

SEQ ID NO: 3013186 - DNA, 16 bp, Homo sapiens
gcccacctgcctggcc

SEQ ID NO: 3013187 - DNA, 22 bp, Homo sapiens
gcccacctgcctggccggccag

SEQ ID NO: 3013188 - DNA, 13 bp, Homo sapiens
gcccacctgggct

SEQ ID NO: 3013189 - DNA, 16 bp, Homo sapiens
gcccacctgggctggg

SEQ ID NO: 3013190 - DNA, 17 bp, Homo sapiens
gcccacgatggaatgta

SEQ ID NO: 3013191 - DNA, 15 bp, Homo sapiens
gcccactgcctcctc

SEQ ID NO: 3013192 - DNA, 19 bp, Homo sapiens
gcccactgcctcctccctg

SEQ ID NO: 3013193 - DNA, 13 bp, Homo sapiens
gcccactgctggc

SEQ ID NO: 3013194 - DNA, 17 bp, Homo sapiens
gcccactgtcctgggcc

SEQ ID NO: 3013195 - DNA, 22 bp, Homo sapiens
gcccacttgtcccactatctgg

SEQ ID NO: 3013196 - DNA, 18 bp, Homo sapiens
gcccagacccactctgcg

SEQ ID NO: 3013197 - DNA, 21 bp, Homo sapiens
gcccagacccactctgcggcc

SEQ ID NO: 3013198 - DNA, 17 bp, Homo sapiens
gcccagacccccagtgt

SEQ ID NO: 3013199 - DNA, 16 bp, Homo sapiens
gcccagaccggcttct

SEQ ID NO: 3013200 - DNA, 17 bp, Homo sapiens
gcccagaccggcttctc

SEQ ID NO: 3013201 - DNA, 21 bp, Homo sapiens
gcccagacttgcggggggtgg

SEQ ID NO: 3013202 - DNA, 20 bp, Homo sapiens
gcccagagacatacttgaag

SEQ ID NO: 3013203 - DNA, 20 bp, Homo sapiens
gcccagagatgcctccaccg

SEQ ID NO: 3013204 - DNA, 19 bp, Homo sapiens
gcccagaggagcccagcgg

SEQ ID NO: 3013205 - DNA, 21 bp, Homo sapiens
gcccagatgttttacgtctgg

SEQ ID NO: 3013206 - DNA, 22 bp, Homo sapiens
gcccagattaaagtctttatcc

SEQ ID NO: 3013207 - DNA, 13 bp, Homo sapiens
gcccagcagcctg

SEQ ID NO: 3013208 - DNA, 14 bp, Homo sapiens
gcccagcagcctgc

SEQ ID NO: 3013209 - DNA, 21 bp, Homo sapiens
gcccagcaggggccctcactc

SEQ ID NO: 3013210 - DNA, 12 bp, Homo sapiens
gcccagccaccc

SEQ ID NO: 3013211 - DNA, 15 bp, Homo sapiens
gcccagccacccctc

SEQ ID NO: 3013212 - DNA, 13 bp, Homo sapiens
gcccagccactcc

SEQ ID NO: 3013213 - DNA, 21 bp, Homo sapiens
gcccagccactccaagccccc

SEQ ID NO: 3013214 - DNA, 21 bp, Homo sapiens
gcccagccagccacccctgcc

SEQ ID NO: 3013215 - DNA, 16 bp, Homo sapiens
gcccagccaggcccca

SEQ ID NO: 3013216 - DNA, 15 bp, Homo sapiens
gcccagcccagctgg

SEQ ID NO: 3013217 - DNA, 12 bp, Homo sapiens
gcccagccctcc

SEQ ID NO: 3013218 - DNA, 17 bp, Homo sapiens
gcccagcgctctcctgg

SEQ ID NO: 3013219 - DNA, 18 bp, Homo sapiens
gcccagcgctctcctgga

SEQ ID NO: 3013220 - DNA, 19 bp, Homo sapiens
gcccagcgctctcctggac

SEQ ID NO: 3013221 - DNA, 14 bp, Homo sapiens
gcccagcggcccaa

SEQ ID NO: 3013222 - DNA, 17 bp, Homo sapiens
gcccagcggcccaagag

SEQ ID NO: 3013223 - DNA, 18 bp, Homo sapiens
gcccagcggcccaagagc

SEQ ID NO: 3013224 - DNA, 12 bp, Homo sapiens
gcccagctcttg

SEQ ID NO: 3013225 - DNA, 15 bp, Homo sapiens
gcccagctcttgctc

SEQ ID NO: 3013226 - DNA, 20 bp, Homo sapiens
gcccagctgggtcaggcagg

SEQ ID NO: 3013227 - DNA, 23 bp, Homo sapiens
gcccaggaactcgcacctgtgct

SEQ ID NO: 3013228 - DNA, 13 bp, Homo sapiens
gcccaggaaggcc

SEQ ID NO: 3013229 - DNA, 21 bp, Homo sapiens
gcccctgagtccgcctgcgcc

SEQ ID NO: 3013230 - DNA, 11 bp, Homo sapiens
gcccctgcaga

SEQ ID NO: 3013231 - DNA, 21 bp, Homo sapiens
gcccctgcagacgtctggccc

SEQ ID NO: 3013232 - DNA, 18 bp, Homo sapiens
gcccctgctgtctctctg

SEQ ID NO: 3013233 - DNA, 21 bp, Homo sapiens
gcccctgctgtctctctgggc

SEQ ID NO: 3013234 - DNA, 21 bp, Homo sapiens
gcccctggaacctttcccttg

SEQ ID NO: 3013235 - DNA, 20 bp, Homo sapiens
gcccctggcccaggaggagg

SEQ ID NO: 3013236 - DNA, 14 bp, Homo sapiens
gcccctggccccag

SEQ ID NO: 3013237 - DNA, 21 bp, Homo sapiens
gcccctggggtggccaccagt

SEQ ID NO: 3013238 - DNA, 19 bp, Homo sapiens
gcccctgtctagagaggga

SEQ ID NO: 3013239 - DNA, 21 bp, Homo sapiens
gcccctgtcttcggccgagct

SEQ ID NO: 3013240 - DNA, 15 bp, Homo sapiens
gcccctgtgcctctg

SEQ ID NO: 3013241 - DNA, 19 bp, Homo sapiens
gcccctgtgcctctgtcct

SEQ ID NO: 3013242 - DNA, 23 bp, Homo sapiens
gccccttctgctcagctctgggc

SEQ ID NO: 3013243 - DNA, 20 bp, Homo sapiens
gccccttcttccaaggagca

SEQ ID NO: 3013244 - DNA, 19 bp, Homo sapiens
gccccttgacaactggcag

SEQ ID NO: 3013245 - DNA, 22 bp, Homo sapiens
gcccctttacggacaccccctc

SEQ ID NO: 3013246 - DNA, 16 bp, Homo sapiens
gcccctttgggccctg

SEQ ID NO: 3013247 - DNA, 18 bp, Homo sapiens
gcccctttgggccctgca

SEQ ID NO: 3013248 - DNA, 19 bp, Homo sapiens
gcccctttgggccctgcat

SEQ ID NO: 3013249 - DNA, 20 bp, Homo sapiens
gcccctttgggccctgcatg

SEQ ID NO: 3013250 - DNA, 21 bp, Homo sapiens
gcccctttgggccctgcatgt

SEQ ID NO: 3013251 - DNA, 16 bp, Homo sapiens
gcccgacatggctccg

SEQ ID NO: 3013252 - DNA, 16 bp, Homo sapiens
gcccgaggtggctgcc

SEQ ID NO: 3013253 - DNA, 22 bp, Homo sapiens
gcccgaggtggctgcctggagc

SEQ ID NO: 3013254 - DNA, 20 bp, Homo sapiens
gcccgagtgcggcgtggaga

SEQ ID NO: 3013255 - DNA, 22 bp, Homo sapiens
gcccgagtggtctcctctcagc

SEQ ID NO: 3013256 - DNA, 17 bp, Homo sapiens
gcccgcagacctctgga

SEQ ID NO: 3013257 - DNA, 16 bp, Homo sapiens
gcccgcagcccagacc

SEQ ID NO: 3013258 - DNA, 18 bp, Homo sapiens
gcccgcctgcccacctgc

SEQ ID NO: 3013259 - DNA, 13 bp, Homo sapiens
gcccgcggcctgc

SEQ ID NO: 3013260 - DNA, 17 bp, Homo sapiens
gcccgcggcctgcaccg

SEQ ID NO: 3013261 - DNA, 16 bp, Homo sapiens
gcccgcggcctggacc

SEQ ID NO: 3013262 - DNA, 14 bp, Homo sapiens
gcccgcgggcacag

SEQ ID NO: 3013263 - DNA, 23 bp, Homo sapiens
gcccggagctgcccctctctggg

SEQ ID NO: 3013264 - DNA, 15 bp, Homo sapiens
gcccggcagggcggg

SEQ ID NO: 3013265 - DNA, 13 bp, Homo sapiens
gcccggcccctca

SEQ ID NO: 3013266 - DNA, 21 bp, Homo sapiens
gcccggcgcctggcctccagg

SEQ ID NO: 3013267 - DNA, 22 bp, Homo sapiens
gcccggcgcctggcctccaggc

SEQ ID NO: 3013268 - DNA, 16 bp, Homo sapiens
gcccggctacatcagc

SEQ ID NO: 3013269 - DNA, 20 bp, Homo sapiens
gcccggctacatcagccttc

SEQ ID NO: 3013270 - DNA, 15 bp, Homo sapiens
gcccgggagctcagg

SEQ ID NO: 3013271 - DNA, 19 bp, Homo sapiens
gcccgggagctcaggaacc

SEQ ID NO: 3013272 - DNA, 22 bp, Homo sapiens
gcccgggccgaccctgcggcct

SEQ ID NO: 3013273 - DNA, 13 bp, Homo sapiens
gcccggggtgggg

SEQ ID NO: 3013274 - DNA, 15 bp, Homo sapiens
gcccggtggcggcag

SEQ ID NO: 3013275 - DNA, 22 bp, Homo sapiens
gcccggtggcggcagggccagg

SEQ ID NO: 3013276 - DNA, 18 bp, Homo sapiens
gcccgtaatcccagctac

SEQ ID NO: 3013277 - DNA, 19 bp, Homo sapiens
gcccgtaatcccagctact

SEQ ID NO: 3013278 - DNA, 22 bp, Homo sapiens
gcccgtaatcccagctactcag

SEQ ID NO: 3013279 - DNA, 15 bp, Homo sapiens
gcccgtcctcctcta

SEQ ID NO: 3013280 - DNA, 14 bp, Homo sapiens
gcccgtcggagctg

SEQ ID NO: 3013281 - DNA, 21 bp, Homo sapiens
gcccgtcggagctgcctgcag

SEQ ID NO: 3013282 - DNA, 14 bp, Homo sapiens
gcccgtctgtccat

SEQ ID NO: 3013283 - DNA, 22 bp, Homo sapiens
gcccgtctgtgtgtgacccctc

SEQ ID NO: 3013284 - DNA, 13 bp, Homo sapiens
gcccgtgacagac

SEQ ID NO: 3013285 - DNA, 17 bp, Homo sapiens
gcccgtgccacccccag

SEQ ID NO: 3013286 - DNA, 20 bp, Homo sapiens
gcccgtggcctggcatctgt

SEQ ID NO: 3013287 - DNA, 14 bp, Homo sapiens
gcccgtgtacatag

SEQ ID NO: 3013288 - DNA, 15 bp, Homo sapiens
gccctaacctgacag

SEQ ID NO: 3013289 - DNA, 16 bp, Homo sapiens
gccctaacctgacaga

SEQ ID NO: 3013290 - DNA, 14 bp, Homo sapiens
gccctaagggactt

SEQ ID NO: 3013291 - DNA, 16 bp, Homo sapiens
gccctaagtttgtact

SEQ ID NO: 3013292 - DNA, 18 bp, Homo sapiens
gccctaattcatctttta

SEQ ID NO: 3013293 - DNA, 14 bp, Homo sapiens
gccctactattcag

SEQ ID NO: 3013294 - DNA, 23 bp, Homo sapiens
gccctagtatgaaagctgggggt

SEQ ID NO: 3013295 - DNA, 15 bp, Homo sapiens
gctagggaggaccaa

SEQ ID NO: 3013296 - DNA, 23 bp, Homo sapiens
gctaggggaaggactggccgtgg

SEQ ID NO: 3013297 - DNA, 16 bp, Homo sapiens
gctagtcaagctcctc

SEQ ID NO: 3013298 - DNA, 21 bp, Homo sapiens
gctagtcaagctcctcctccc

SEQ ID NO: 3013299 - DNA, 23 bp, Homo sapiens
gctagtcaagctcctcctccctg

SEQ ID NO: 3013300 - DNA, 18 bp, Homo sapiens
gctagtcctagtgaacct

SEQ ID NO: 3013301 - DNA, 19 bp, Homo sapiens
gctagtcctagtgaacctc

SEQ ID NO: 3013302 - DNA, 13 bp, Homo sapiens
gctagtgccttgc

SEQ ID NO: 3013303 - DNA, 14 bp, Homo sapiens
gctagtgccttgcc

SEQ ID NO: 3013304 - DNA, 16 bp, Homo sapiens
gctagtgccttgccca

SEQ ID NO: 3013305 - DNA, 20 bp, Homo sapiens
gctagtggggtgaacagctg

SEQ ID NO: 3013306 - DNA, 21 bp, Homo sapiens
gctagtggggtgaacagctgg

SEQ ID NO: 3013307 - DNA, 20 bp, Homo sapiens
gctagttctcagcttgcagc

SEQ ID NO: 3013308 - DNA, 15 bp, Homo sapiens
gctagtttaagactt

SEQ ID NO: 3013309 - DNA, 20 bp, Homo sapiens
gctataatcattagttttag

SEQ ID NO: 3013310 - DNA, 16 bp, Homo sapiens
gctataattctatact

SEQ ID NO: 3013311 - DNA, 16 bp, Homo sapiens
gctatacctgtgcctc

SEQ ID NO: 3013312 - DNA, 18 bp, Homo sapiens
gctatactggaaatgtaa

SEQ ID NO: 3013313 - DNA, 22 bp, Homo sapiens
gctatatgttatggcttattgt

SEQ ID NO: 3013314 - DNA, 20 bp, Homo sapiens
gctatcaaagaataagaaaa

SEQ ID NO: 3013315 - DNA, 13 bp, Homo sapiens
gctatcaagaggc

SEQ ID NO: 3013316 - DNA, 19 bp, Homo sapiens
gctatcaagaggctgagac

SEQ ID NO: 3013317 - DNA, 15 bp, Homo sapiens
gctatcggcagatga

SEQ ID NO: 3013318 - DNA, 22 bp, Homo sapiens
gctatctactaagtttcctttt

SEQ ID NO: 3013319 - DNA, 17 bp, Homo sapiens
gctatctggtcaacctc

SEQ ID NO: 3013320 - DNA, 19 bp, Homo sapiens
gctcctcctcctgggctat

SEQ ID NO: 3013321 - DNA, 16 bp, Homo sapiens
gctcctctccccagcc

SEQ ID NO: 3013322 - DNA, 20 bp, Homo sapiens
gctcctctccccagcccaga

SEQ ID NO: 3013323 - DNA, 14 bp, Homo sapiens
gctcctctgtggtg

SEQ ID NO: 3013324 - DNA, 19 bp, Homo sapiens
gctcctctgtggtgtctgc

SEQ ID NO: 3013325 - DNA, 15 bp, Homo sapiens
gctcctctttcccct

SEQ ID NO: 3013326 - DNA, 17 bp, Homo sapiens
gctcctctttcccctcc

SEQ ID NO: 3013327 - DNA, 19 bp, Homo sapiens
gctcctgagggagctccaa

SEQ ID NO: 3013328 - DNA, 15 bp, Homo sapiens
gctcctgcccagcca

SEQ ID NO: 3013329 - DNA, 16 bp, Homo sapiens
gctcctgcccagccac

SEQ ID NO: 3013330 - DNA, 15 bp, Homo sapiens
gctcctggggagaaa

SEQ ID NO: 3013331 - DNA, 22 bp, Homo sapiens
gctcctggggagaaagaggggc

SEQ ID NO: 3013332 - DNA, 17 bp, Homo sapiens
gctcctgttagctcctc

SEQ ID NO: 3013333 - DNA, 22 bp, Homo sapiens
gctccttaccaatattattaaa

SEQ ID NO: 3013334 - DNA, 14 bp, Homo sapiens
gctccttcctggag

SEQ ID NO: 3013335 - DNA, 23 bp, Homo sapiens
gctccttgaagacatatcatgtg

SEQ ID NO: 3013336 - DNA, 14 bp, Homo sapiens
gctccttgggaggc

SEQ ID NO: 3013337 - DNA, 22 bp, Homo sapiens
gctccttgggaggccccactgg

SEQ ID NO: 3013338 - DNA, 12 bp, Homo sapiens
gctccttttctg

SEQ ID NO: 3013339 - DNA, 21 bp, Homo sapiens
gctccttttctgtgaagccct

SEQ ID NO: 3013340 - DNA, 14 bp, Homo sapiens
gctcgatgcctttg

SEQ ID NO: 3013341 - DNA, 15 bp, Homo sapiens
gctcgatgcctttgc

SEQ ID NO: 3013342 - DNA, 16 bp, Homo sapiens
gctcgcccaggaaggc

SEQ ID NO: 3013343 - DNA, 20 bp, Homo sapiens
gctcggcaggaaggagcggc

SEQ ID NO: 3013344 - DNA, 13 bp, Homo sapiens
gctcgggaaggga

SEQ ID NO: 3013345 - DNA, 18 bp, Homo sapiens
gctcgggaagggagggga

SEQ ID NO: 3013346 - DNA, 21 bp, Homo sapiens
gctcgggtctccctcctgcag

SEQ ID NO: 3013347 - DNA, 13 bp, Homo sapiens
gctctaaaacaga

SEQ ID NO: 3013348 - DNA, 22 bp, Homo sapiens
gctctaaaacatagactgaaga

SEQ ID NO: 3013349 - DNA, 14 bp, Homo sapiens
gctctacccagggc

SEQ ID NO: 3013350 - DNA, 22 bp, Homo sapiens
gctctaccctgtgctaagcacg

SEQ ID NO: 3013351 - DNA, 17 bp, Homo sapiens
gctctagatgagctggg

SEQ ID NO: 3013352 - DNA, 18 bp, Homo sapiens
gctctagatgagctgggc

SEQ ID NO: 3013353 - DNA, 14 bp, Homo sapiens
gctctagtgggaag

SEQ ID NO: 3013354 - DNA, 18 bp, Homo sapiens
gctctatgagtctagatg

SEQ ID NO: 3013355 - DNA, 21 bp, Homo sapiens
gctctatttacttctaatctt

SEQ ID NO: 3013356 - DNA, 16 bp, Homo sapiens
gctctcaaatccctct

SEQ ID NO: 3013357 - DNA, 14 bp, Homo sapiens
gctctcatctgagg

SEQ ID NO: 3013358 - DNA, 15 bp, Homo sapiens
gctctcatctgaggc

SEQ ID NO: 3013359 - DNA, 22 bp, Homo sapiens
gctctcatctgaggcatccagc

SEQ ID NO: 3013360 - DNA, 15 bp, Homo sapiens
gctctccaagcccag

SEQ ID NO: 3013361 - DNA, 20 bp, Homo sapiens
gctctccacctcagccttgg

SEQ ID NO: 3013362 - DNA, 17 bp, Homo sapiens
gctctccagcctgggag

SEQ ID NO: 3013363 - DNA, 17 bp, Homo sapiens
gctctccaggccaggtg

SEQ ID NO: 3013364 - DNA, 18 bp, Homo sapiens
gctctccaggccaggtgg

SEQ ID NO: 3013365 - DNA, 21 bp, Homo sapiens
gctctcccacatcccactgga

SEQ ID NO: 3013366 - DNA, 11 bp, Homo sapiens
gctctccctct

SEQ ID NO: 3013367 - DNA, 16 bp, Homo sapiens
gctctcctttctttct

SEQ ID NO: 3013368 - DNA, 21 bp, Homo sapiens
gctctcgggtgggggagccag

SEQ ID NO: 3013369 - DNA, 16 bp, Homo sapiens
gctctctctctttctc

SEQ ID NO: 3013370 - DNA, 15 bp, Homo sapiens
gctctctgcagccag

SEQ ID NO: 3013371 - DNA, 17 bp, Homo sapiens
gctctctgcagccagcc

SEQ ID NO: 3013372 - DNA, 20 bp, Homo sapiens
gctctctgcagccagcccag

SEQ ID NO: 3013373 - DNA, 22 bp, Homo sapiens
gctctctgcagccagcccagcc

SEQ ID NO: 3013374 - DNA, 23 bp, Homo sapiens
gctctcttgtgacgtgcactgtg

SEQ ID NO: 3013375 - DNA, 19 bp, Homo sapiens
gctctgaagcaaggcggtg

SEQ ID NO: 3013376 - DNA, 15 bp, Homo sapiens
gctctgacccacagc

SEQ ID NO: 3013377 - DNA, 23 bp, Homo sapiens
gctctgatccctctacagagctt

SEQ ID NO: 3013378 - DNA, 13 bp, Homo sapiens
gctctgcccacct

SEQ ID NO: 3013379 - DNA, 17 bp, Homo sapiens
gctctgcccacctctct

SEQ ID NO: 3013380 - DNA, 22 bp, Homo sapiens
gctctgcccacctctcttttcc

SEQ ID NO: 3013381 - DNA, 23 bp, Homo sapiens
gctctgcccaggaactcgcacct

SEQ ID NO: 3013382 - DNA, 17 bp, Homo sapiens
gctctgcctcaactcca

SEQ ID NO: 3013383 - DNA, 22 bp, Homo sapiens
gctctgccttcgaggtcagagg

SEQ ID NO: 3013384 - DNA, 13 bp, Homo sapiens
gctctgcgccagg

SEQ ID NO: 3013385 - DNA, 16 bp, Homo sapiens
gctctgcgccaggcag

SEQ ID NO: 3013386 - DNA, 22 bp, Homo sapiens
gctctgcgtgtcacctgtgctt

SEQ ID NO: 3013387 - DNA, 18 bp, Homo sapiens
gctctgctctaccatgtt

SEQ ID NO: 3013388 - DNA, 21 bp, Homo sapiens
gctctgctctaccatgtttaa

SEQ ID NO: 3013389 - DNA, 21 bp, Homo sapiens
gctctgcttgacaacatctga

SEQ ID NO: 3013390 - DNA, 20 bp, Homo sapiens
gctctggacagccccaccct

SEQ ID NO: 3013391 - DNA, 22 bp, Homo sapiens
gctctggacagccccaccctgg

SEQ ID NO: 3013392 - DNA, 14 bp, Homo sapiens
gctctggacgtgaa

SEQ ID NO: 3013393 - DNA, 14 bp, Homo sapiens
gctctgggggcaga

SEQ ID NO: 3013394 - DNA, 23 bp, Homo sapiens
gctctgtatcaggacccagagga

SEQ ID NO: 3013395 - DNA, 22 bp, Homo sapiens
gctctgtcctacctccactctc

SEQ ID NO: 3013396 - DNA, 13 bp, Homo sapiens
gctctgtctgctc

SEQ ID NO: 3013397 - DNA, 15 bp, Homo sapiens
gctctgtggaggggc

SEQ ID NO: 3013398 - DNA, 17 bp, Homo sapiens
gctctgtgggtctctgg

SEQ ID NO: 3013399 - DNA, 18 bp, Homo sapiens
gctctgtgggtctctgga

SEQ ID NO: 3013400 - DNA, 22 bp, Homo sapiens
gctcttagattgggccatggct

SEQ ID NO: 3013401 - DNA, 19 bp, Homo sapiens
gctcttcaatgctaccggg

SEQ ID NO: 3013402 - DNA, 14 bp, Homo sapiens
gctcttcacttcct

SEQ ID NO: 3013403 - DNA, 18 bp, Homo sapiens
gctcttcacttcctccag

SEQ ID NO: 3013404 - DNA, 19 bp, Homo sapiens
gctcttcagtgggagaaaa

SEQ ID NO: 3013405 - DNA, 13 bp, Homo sapiens
gctcttcatctgc

SEQ ID NO: 3013406 - DNA, 22 bp, Homo sapiens
gctcttccaggagccaccttgc

SEQ ID NO: 3013407 - DNA, 20 bp, Homo sapiens
gctcttccgaaaaccaggcc

SEQ ID NO: 3013408 - DNA, 22 bp, Homo sapiens
gctcttctccttggaggacagt

SEQ ID NO: 3013409 - DNA, 14 bp, Homo sapiens
gctcttctgccggc

SEQ ID NO: 3013410 - DNA, 11 bp, Homo sapiens
gctcttctggg

SEQ ID NO: 3013411 - DNA, 14 bp, Homo sapiens
gctcttctgggcag

SEQ ID NO: 3013412 - DNA, 20 bp, Homo sapiens
gctcttctgggcagagcctg

SEQ ID NO: 3013413 - DNA, 21 bp, Homo sapiens
gctcttctgggcagagcctgt

SEQ ID NO: 3013414 - DNA, 12 bp, Homo sapiens
gctcttgctctc

SEQ ID NO: 3013415 - DNA, 23 bp, Homo sapiens
gctcttgggcctgacctccagtc

SEQ ID NO: 3013416 - DNA, 21 bp, Homo sapiens
gctcttgtagcccaggctgga

SEQ ID NO: 3013417 - DNA, 16 bp, Homo sapiens
gctcttgttctgttcc

SEQ ID NO: 3013418 - DNA, 13 bp, Homo sapiens
gctcttgtttctg

SEQ ID NO: 3013419 - DNA, 16 bp, Homo sapiens
gctcttgtttctgttt

SEQ ID NO: 3013420 - DNA, 18 bp, Homo sapiens
gctcttgtttctgtttag

SEQ ID NO: 3013421 - DNA, 12 bp, Homo sapiens
gctctttcccag

SEQ ID NO: 3013422 - DNA, 12 bp, Homo sapiens
gctcttttacta

SEQ ID NO: 3013423 - DNA, 19 bp, Homo sapiens
gctcttttctaagtggcgt

SEQ ID NO: 3013424 - DNA, 21 bp, Homo sapiens
gctgaacacacaccagtttac

SEQ ID NO: 3013425 - DNA, 18 bp, Homo sapiens
gctgaacagtgctctgcc

SEQ ID NO: 3013426 - DNA, 20 bp, Homo sapiens
gctgaacagtgctctgcctc

SEQ ID NO: 3013427 - DNA, 21 bp, Homo sapiens
gctgaacagtgctctgcctct

SEQ ID NO: 3013428 - DNA, 17 bp, Homo sapiens
gctgaactaagttttgt

SEQ ID NO: 3013429 - DNA, 14 bp, Homo sapiens
gctgaagagcaagg

SEQ ID NO: 3013430 - DNA, 13 bp, Homo sapiens
gctgaagatggca

SEQ ID NO: 3013431 - DNA, 19 bp, Homo sapiens
gctgaagcggtcagactgg

SEQ ID NO: 3013432 - DNA, 22 bp, Homo sapiens
gctgaagcggtcagactggagg

SEQ ID NO: 3013433 - DNA, 15 bp, Homo sapiens
gctgaagctgctgca

SEQ ID NO: 3013434 - DNA, 17 bp, Homo sapiens
gctgaataaatgtcttt

SEQ ID NO: 3013435 - DNA, 22 bp, Homo sapiens
gctgacacttcaaggtgacaga

SEQ ID NO: 3013436 - DNA, 23 bp, Homo sapiens
gctggtcactctgccctctgctg

SEQ ID NO: 3013437 - DNA, 16 bp, Homo sapiens
gctggtcatccttggt

SEQ ID NO: 3013438 - DNA, 18 bp, Homo sapiens
gctggtcatccttggtgc

SEQ ID NO: 3013439 - DNA, 12 bp, Homo sapiens
gctggtcccctc

SEQ ID NO: 3013440 - DNA, 20 bp, Homo sapiens
gctggtcctcattcaaaggg

SEQ ID NO: 3013441 - DNA, 20 bp, Homo sapiens
gctggtctcaaactcctgac

SEQ ID NO: 3013442 - DNA, 14 bp, Homo sapiens
gctggtctctggct

SEQ ID NO: 3013443 - DNA, 15 bp, Homo sapiens
gctggtgacagcctt

SEQ ID NO: 3013444 - DNA, 17 bp, Homo sapiens
gctggtgacagccttgg

SEQ ID NO: 3013445 - DNA, 23 bp, Homo sapiens
gctggtgacagccttgggccttt

SEQ ID NO: 3013446 - DNA, 12 bp, Homo sapiens
gctggtgaggcc

SEQ ID NO: 3013447 - DNA, 13 bp, Homo sapiens
gctggtgaggccg

SEQ ID NO: 3013448 - DNA, 19 bp, Homo sapiens
gctggtgaggccggccctg

SEQ ID NO: 3013449 - DNA, 20 bp, Homo sapiens
gctggtgaggccggccctgc

SEQ ID NO: 3013450 - DNA, 21 bp, Homo sapiens
gctggtgaggccggccctgcc

SEQ ID NO: 3013451 - DNA, 22 bp, Homo sapiens
gctggtgaggccggccctgccc

SEQ ID NO: 3013452 - DNA, 12 bp, Homo sapiens
gctggtgcacag

SEQ ID NO: 3013453 - DNA, 19 bp, Homo sapiens
gctggtgccaaatagcccc

SEQ ID NO: 3013454 - DNA, 22 bp, Homo sapiens
gctggtgccaaatagccccaga

SEQ ID NO: 3013455 - DNA, 13 bp, Homo sapiens
gctggtgccccca

SEQ ID NO: 3013456 - DNA, 17 bp, Homo sapiens
gctggtgcctgctttga

SEQ ID NO: 3013457 - DNA, 16 bp, Homo sapiens
gctggtggacccaggg

SEQ ID NO: 3013458 - DNA, 21 bp, Homo sapiens
gctggtggacccagggaacag

SEQ ID NO: 3013459 - DNA, 16 bp, Homo sapiens
gctggtggatggtgac

SEQ ID NO: 3013460 - DNA, 15 bp, Homo sapiens
gctggtggcccagga

SEQ ID NO: 3013461 - DNA, 21 bp, Homo sapiens
gctggtgggaagcgtctgtcc

SEQ ID NO: 3013462 - DNA, 15 bp, Homo sapiens
gctggttcctctctc

SEQ ID NO: 3013463 - DNA, 23 bp, Homo sapiens
gctggttcctctctcccacccta

SEQ ID NO: 3013464 - DNA, 22 bp, Homo sapiens
gctgtaactggtagtgttcagt

SEQ ID NO: 3013465 - DNA, 13 bp, Homo sapiens
gctgtaagaaatc

SEQ ID NO: 3013466 - DNA, 17 bp, Homo sapiens
gctgtaaggctctagat

SEQ ID NO: 3013467 - DNA, 12 bp, Homo sapiens
gctgtacatcta

SEQ ID NO: 3013468 - DNA, 16 bp, Homo sapiens
gctgtacatctatttt

SEQ ID NO: 3013469 - DNA, 17 bp, Homo sapiens
gctgtaccctttaagat

SEQ ID NO: 3013470 - DNA, 18 bp, Homo sapiens
gctgtacctgttcctccc

SEQ ID NO: 3013471 - DNA, 23 bp, Homo sapiens
gctgtagtaggcatttttaccat

SEQ ID NO: 3013472 - DNA, 22 bp, Homo sapiens
gctgtatccatgtaatgatctt

SEQ ID NO: 3013473 - DNA, 16 bp, Homo sapiens
gctgtatcttgttttt

SEQ ID NO: 3013474 - DNA, 15 bp, Homo sapiens
gctgtatgctgatca

SEQ ID NO: 3013475 - DNA, 16 bp, Homo sapiens
gctgtatttacagaca

SEQ ID NO: 3013476 - DNA, 15 bp, Homo sapiens
gctgtcacctctccc

SEQ ID NO: 3013477 - DNA, 16 bp, Homo sapiens
gctgtcatctgtgcac

SEQ ID NO: 3013478 - DNA, 14 bp, Homo sapiens
gctgtcccaagctc

SEQ ID NO: 3013479 - DNA, 15 bp, Homo sapiens
gctgtccctgtcacc

SEQ ID NO: 3013480 - DNA, 20 bp, Homo sapiens
gctgtcccttggaactcttg

SEQ ID NO: 3013481 - DNA, 20 bp, Homo sapiens
gctgtcctcaggtggccatg

SEQ ID NO: 3013482 - DNA, 21 bp, Homo sapiens
gctgtcctcaggtggccatgc

SEQ ID NO: 3013483 - DNA, 23 bp, Homo sapiens
gctgtcctggtggctgggcccag

SEQ ID NO: 3013484 - DNA, 19 bp, Homo sapiens
gctgtcgggggccactgtg

SEQ ID NO: 3013485 - DNA, 20 bp, Homo sapiens
gctgtcgggggccactgtgt

SEQ ID NO: 3013486 - DNA, 14 bp, Homo sapiens
gctgtctagcctta

SEQ ID NO: 3013487 - DNA, 12 bp, Homo sapiens
gctgtctctctg

SEQ ID NO: 3013488 - DNA, 13 bp, Homo sapiens
gctgtctctctgg

SEQ ID NO: 3013489 - DNA, 19 bp, Homo sapiens
gctgtctcttaaatctctt

SEQ ID NO: 3013490 - DNA, 15 bp, Homo sapiens
gctgtctgcagcctt

SEQ ID NO: 3013491 - DNA, 21 bp, Homo sapiens
gctgtctggatccttcccaag

SEQ ID NO: 3013492 - DNA, 13 bp, Homo sapiens
gctgtctggccag

SEQ ID NO: 3013493 - DNA, 16 bp, Homo sapiens
gctgtctttgcagggc

SEQ ID NO: 3013494 - DNA, 12 bp, Homo sapiens
gctgtctttgtg

SEQ ID NO: 3013495 - DNA, 22 bp, Homo sapiens
gctgtctttgtggactgtgggt

SEQ ID NO: 3013496 - DNA, 18 bp, Homo sapiens
gctgtgaagggagaaagg

SEQ ID NO: 3013497 - DNA, 16 bp, Homo sapiens
gctgtgacattgctgg

SEQ ID NO: 3013498 - DNA, 15 bp, Homo sapiens
gctgtgacgcagccg

SEQ ID NO: 3013499 - DNA, 16 bp, Homo sapiens
gctgtgactctgggca

SEQ ID NO: 3013500 - DNA, 14 bp, Homo sapiens
gctgtgccaggagg

SEQ ID NO: 3013501 - DNA, 13 bp, Homo sapiens
gctgtgcctgggc

SEQ ID NO: 3013502 - DNA, 19 bp, Homo sapiens
gctgtgctacgtgtgaaat

SEQ ID NO: 3013503 - DNA, 21 bp, Homo sapiens
gctgtgctacgtgtgaaatct

SEQ ID NO: 3013504 - DNA, 14 bp, Homo sapiens
gctgtgctagcttt

SEQ ID NO: 3013505 - DNA, 16 bp, Homo sapiens
gctgtgctatggtgct

SEQ ID NO: 3013506 - DNA, 12 bp, Homo sapiens
gctgtgctcaga

SEQ ID NO: 3013507 - DNA, 15 bp, Homo sapiens
gctgtgctggttctg

SEQ ID NO: 3013508 - DNA, 17 bp, Homo sapiens
gctgtggagcccattgt

SEQ ID NO: 3013509 - DNA, 14 bp, Homo sapiens
gctgtgtaaagtta

SEQ ID NO: 3013510 - DNA, 18 bp, Homo sapiens
gctgtgtaaagttagtct

SEQ ID NO: 3013511 - DNA, 21 bp, Homo sapiens
gctgtgtatatggtatatata

SEQ ID NO: 3013512 - DNA, 24 bp, Homo sapiens
gctgtgtcacactctgtgttttgt

SEQ ID NO: 3013513 - DNA, 15 bp, Homo sapiens
gctgtgtcctccctc

SEQ ID NO: 3013514 - DNA, 11 bp, Homo sapiens
gctgtgtctct

SEQ ID NO: 3013515 - DNA, 14 bp, Homo sapiens
gctgtgtgagacca

SEQ ID NO: 3013516 - DNA, 22 bp, Homo sapiens
gctgtgtgagaccaggggacca

SEQ ID NO: 3013517 - DNA, 15 bp, Homo sapiens
gctgtgtgtcccagg

SEQ ID NO: 3013518 - DNA, 19 bp, Homo sapiens
gctgtgttgaaacagaaaa

SEQ ID NO: 3013519 - DNA, 19 bp, Homo sapiens
gctgtgttgactgctgctc

SEQ ID NO: 3013520 - DNA, 21 bp, Homo sapiens
gctgttaaagatatttttatt

SEQ ID NO: 3013521 - DNA, 18 bp, Homo sapiens
gctgttcaacatcactga

SEQ ID NO: 3013522 - DNA, 21 bp, Homo sapiens
gctgttcctgttcagtaataa

SEQ ID NO: 3013523 - DNA, 14 bp, Homo sapiens
gctgttctagcact

SEQ ID NO: 3013524 - DNA, 13 bp, Homo sapiens
gctgttgaaagca

SEQ ID NO: 3013525 - DNA, 19 bp, Homo sapiens
gctgttgaaagcaaaaatg

SEQ ID NO: 3013526 - DNA, 13 bp, Homo sapiens
gctgttgaacttt

SEQ ID NO: 3013527 - DNA, 14 bp, Homo sapiens
gctgttgacatatt

SEQ ID NO: 3013528 - DNA, 23 bp, Homo sapiens
gctgttgacatatttaatgtttt

SEQ ID NO: 3013529 - DNA, 19 bp, Homo sapiens
gctgttgattgctaaatgt

SEQ ID NO: 3013530 - DNA, 20 bp, Homo sapiens
gctgttgattgctaaatgta

SEQ ID NO: 3013531 - DNA, 16 bp, Homo sapiens
gctgttgcaggcagtg

SEQ ID NO: 3013532 - DNA, 17 bp, Homo sapiens
gctgttgcaggcagtgt

SEQ ID NO: 3013533 - DNA, 16 bp, Homo sapiens
gctgttgctatttgta

SEQ ID NO: 3013534 - DNA, 18 bp, Homo sapiens
gctgttgctatttgtatt

SEQ ID NO: 3013535 - DNA, 21 bp, Homo sapiens
gctgttgtggtttttagtgca

SEQ ID NO: 3013536 - DNA, 15 bp, Homo sapiens
gctgtttactaggga

SEQ ID NO: 3013537 - DNA, 13 bp, Homo sapiens
gctgtttagattt

SEQ ID NO: 3013538 - DNA, 22 bp, Homo sapiens
gctgtttagcttcctccagagg

SEQ ID NO: 3013539 - DNA, 20 bp, Homo sapiens
gctgtttcttgtctgttatg

SEQ ID NO: 3013540 - DNA, 21 bp, Homo sapiens
gctgtttgtttgacaaagaaa

SEQ ID NO: 3013541 - DNA, 22 bp, Homo sapiens
gctgttttaaattgcatttcta

SEQ ID NO: 3013542 - DNA, 16 bp, Homo sapiens
gctgttttcctccctt

SEQ ID NO: 3013543 - DNA, 21 bp, Homo sapiens
gctgttttcctcccttctgct

SEQ ID NO: 3013544 - DNA, 15 bp, Homo sapiens
gcttaaaagaaacta

SEQ ID NO: 3013545 - DNA, 16 bp, Homo sapiens
gcttaaaagaaactat

SEQ ID NO: 3013546 - DNA, 20 bp, Homo sapiens
gcttaagaaatctagtattt

SEQ ID NO: 3013547 - DNA, 16 bp, Homo sapiens
gcttaagggagtttaa

SEQ ID NO: 3013548 - DNA, 15 bp, Homo sapiens
gcttacaatctttat

SEQ ID NO: 3013549 - DNA, 18 bp, Homo sapiens
gcttacaatctttattat

SEQ ID NO: 3013550 - DNA, 14 bp, Homo sapiens
gcttacaatttttt

SEQ ID NO: 3013551 - DNA, 22 bp, Homo sapiens
gcttacaatttttttaattttg

SEQ ID NO: 3013552 - DNA, 23 bp, Homo sapiens
gcttacaatttttttaattttgt

SEQ ID NO: 3013553 - DNA, 17 bp, Homo sapiens
gcttagaacccttctgc

SEQ ID NO: 3013554 - DNA, 22 bp, Homo sapiens
gcttagaacccttctgctttct

SEQ ID NO: 3013555 - DNA, 11 bp, Homo sapiens
gcttagcagga

SEQ ID NO: 3013556 - DNA, 16 bp, Homo sapiens
gcttagcaggagagga

SEQ ID NO: 3013557 - DNA, 18 bp, Homo sapiens
gcttagcaggagaggaga

SEQ ID NO: 3013558 - DNA, 21 bp, Homo sapiens
gcttagcaggagaggagagcc

SEQ ID NO: 3013559 - DNA, 15 bp, Homo sapiens
gcttagcgctctgga

SEQ ID NO: 3013560 - DNA, 21 bp, Homo sapiens
gcttatattttcagcaaagaa

SEQ ID NO: 3013561 - DNA, 14 bp, Homo sapiens
gcttatcctgctag

SEQ ID NO: 3013562 - DNA, 17 bp, Homo sapiens
gcttatgaatatattta

SEQ ID NO: 3013563 - DNA, 21 bp, Homo sapiens
gcttatgatgggctccccagg

SEQ ID NO: 3013564 - DNA, 16 bp, Homo sapiens
gcttatggtaccagat

SEQ ID NO: 3013565 - DNA, 13 bp, Homo sapiens
gcttatgtttctt

SEQ ID NO: 3013566 - DNA, 13 bp, Homo sapiens
gcttattgtgtga

SEQ ID NO: 3013567 - DNA, 14 bp, Homo sapiens
gcttattgtgtgaa

SEQ ID NO: 3013568 - DNA, 19 bp, Homo sapiens
gctttggacccaaggaaaa

SEQ ID NO: 3013569 - DNA, 20 bp, Homo sapiens
gctttggggtcctagcccag

SEQ ID NO: 3013570 - DNA, 14 bp, Homo sapiens
gctttgtcccctgc

SEQ ID NO: 3013571 - DNA, 14 bp, Homo sapiens
gctttgtcttgaaa

SEQ ID NO: 3013572 - DNA, 15 bp, Homo sapiens
gctttgtcttgaaaa

SEQ ID NO: 3013573 - DNA, 22 bp, Homo sapiens
gctttgtggcactggggcaggg

SEQ ID NO: 3013574 - DNA, 22 bp, Homo sapiens
gctttgttactgaaatgagcct

SEQ ID NO: 3013575 - DNA, 14 bp, Homo sapiens
gctttgttcttgtc

SEQ ID NO: 3013576 - DNA, 16 bp, Homo sapiens
gctttgttgttctgcc

SEQ ID NO: 3013577 - DNA, 15 bp, Homo sapiens
gcttttaagtttttc

SEQ ID NO: 3013578 - DNA, 21 bp, Homo sapiens
gcttttactgaagcctttctt

SEQ ID NO: 3013579 - DNA, 14 bp, Homo sapiens
gcttttactttatt

SEQ ID NO: 3013580 - DNA, 21 bp, Homo sapiens
gcttttaggcttgaaatctcc

SEQ ID NO: 3013581 - DNA, 15 bp, Homo sapiens
gctgacctccacagc

SEQ ID NO: 3013582 - DNA, 16 bp, Homo sapiens
gctgacctccacagct

SEQ ID NO: 3013583 - DNA, 17 bp, Homo sapiens
gctgacgaacttccatg

SEQ ID NO: 3013584 - DNA, 23 bp, Homo sapiens
gctgactatttgacccccacaac

SEQ ID NO: 3013585 - DNA, 23 bp, Homo sapiens
gctgactctaggtgcccttggag

SEQ ID NO: 3013586 - DNA, 15 bp, Homo sapiens
gctgactctctgagc

SEQ ID NO: 3013587 - DNA, 19 bp, Homo sapiens
gctgacttcatctcccacc

SEQ ID NO: 3013588 - DNA, 13 bp, Homo sapiens
gctgagaagagga

SEQ ID NO: 3013589 - DNA, 16 bp, Homo sapiens
gctgagaagaggagga

SEQ ID NO: 3013590 - DNA, 23 bp, Homo sapiens
gctgagaagaggaggaggtgggg

SEQ ID NO: 3013591 - DNA, 14 bp, Homo sapiens
gctgagacaggaga

SEQ ID NO: 3013592 - DNA, 22 bp, Homo sapiens
gctgagacaggagaatcacctg

SEQ ID NO: 3013593 - DNA, 18 bp, Homo sapiens
gctgagccaaagccagag

SEQ ID NO: 3013594 - DNA, 19 bp, Homo sapiens
gctgagccaaagccagagt

SEQ ID NO: 3013595 - DNA, 13 bp, Homo sapiens
gctgagcccctgt

SEQ ID NO: 3013596 - DNA, 15 bp, Homo sapiens
gctgagcccctgtct

SEQ ID NO: 3013597 - DNA, 16 bp, Homo sapiens
gctgagcctgcaggga

SEQ ID NO: 3013598 - DNA, 14 bp, Homo sapiens
gctgagcgccagga

SEQ ID NO: 3013599 - DNA, 14 bp, Homo sapiens
gctgagctggcttc

SEQ ID NO: 3013600 - DNA, 14 bp, Homo sapiens
gctgagctgtgaca

SEQ ID NO: 3013601 - DNA, 16 bp, Homo sapiens
gctgaggaaaggccag

SEQ ID NO: 3013602 - DNA, 22 bp, Homo sapiens
gctgaggaaaggccagctggca

SEQ ID NO: 3013603 - DNA, 17 bp, Homo sapiens
gctgaggatgggctctg

SEQ ID NO: 3013604 - DNA, 12 bp, Homo sapiens
gctgaggcacaa

SEQ ID NO: 3013605 - DNA, 23 bp, Homo sapiens
gctgaggcagcagtgtgaggcca

SEQ ID NO: 3013606 - DNA, 21 bp, Homo sapiens
gctgaggccacactcagcaca

SEQ ID NO: 3013607 - DNA, 12 bp, Homo sapiens
gctgaggcctcc

SEQ ID NO: 3013608 - DNA, 15 bp, Homo sapiens
gctgaggctgagaaa

SEQ ID NO: 3013609 - DNA, 16 bp, Homo sapiens
gctgaggctggcacag

SEQ ID NO: 3013610 - DNA, 13 bp, Homo sapiens
gctgagggcatct

SEQ ID NO: 3013611 - DNA, 16 bp, Homo sapiens
gctgagggcatctctg

SEQ ID NO: 3013612 - DNA, 20 bp, Homo sapiens
gctgagggcatctctgagtg

SEQ ID NO: 3013613 - DNA, 19 bp, Homo sapiens
gctgagggtgtttcttcct

SEQ ID NO: 3013614 - DNA, 15 bp, Homo sapiens
gctgaggtgtctggc

SEQ ID NO: 3013615 - DNA, 18 bp, Homo sapiens
gctgagtccctccatgca

SEQ ID NO: 3013616 - DNA, 14 bp, Homo sapiens
gctgagtctccagg

SEQ ID NO: 3013617 - DNA, 18 bp, Homo sapiens
gctgagtctccagggccc

SEQ ID NO: 3013618 - DNA, 17 bp, Homo sapiens
gctgagtgacagctttc

SEQ ID NO: 3013619 - DNA, 16 bp, Homo sapiens
gctgatcaatgaaatg

SEQ ID NO: 3013620 - DNA, 18 bp, Homo sapiens
gctgatcatcgccagagg

SEQ ID NO: 3013621 - DNA, 16 bp, Homo sapiens
gctgatgctgaaataa

SEQ ID NO: 3013622 - DNA, 14 bp, Homo sapiens
gctgatgtggactg

SEQ ID NO: 3013623 - DNA, 13 bp, Homo sapiens
gctgatgttcagt

SEQ ID NO: 3013624 - DNA, 14 bp, Homo sapiens
gctgatgttcagtg

SEQ ID NO: 3013625 - DNA, 13 bp, Homo sapiens
gctgatttctagg

SEQ ID NO: 3013626 - DNA, 14 bp, Homo sapiens
gctgcaaagtatgc

SEQ ID NO: 3013627 - DNA, 12 bp, Homo sapiens
gctgcaaagtgt

SEQ ID NO: 3013628 - DNA, 12 bp, Homo sapiens
gctgcaaggttt

SEQ ID NO: 3013629 - DNA, 17 bp, Homo sapiens
gctgcacatagcagact

SEQ ID NO: 3013630 - DNA, 18 bp, Homo sapiens
gctgcacatagcagacta

SEQ ID NO: 3013631 - DNA, 15 bp, Homo sapiens
gctgcacgctcccct

SEQ ID NO: 3013632 - DNA, 20 bp, Homo sapiens
gctgcagagcagtgggcctg

SEQ ID NO: 3013633 - DNA, 21 bp, Homo sapiens
gctgcagagcagtgggcctgg

SEQ ID NO: 3013634 - DNA, 12 bp, Homo sapiens
gctgcagccagg

SEQ ID NO: 3013635 - DNA, 15 bp, Homo sapiens
gctgcagccaggcca

SEQ ID NO: 3013636 - DNA, 23 bp, Homo sapiens
gctgcagccaggccactggcccc

SEQ ID NO: 3013637 - DNA, 18 bp, Homo sapiens
gctgcagccaggcctcgc

SEQ ID NO: 3013638 - DNA, 20 bp, Homo sapiens
gctgcagccaggcctcgcct

SEQ ID NO: 3013639 - DNA, 21 bp, Homo sapiens
gctgcagcctgcgccaccgcc

SEQ ID NO: 3013640 - DNA, 13 bp, Homo sapiens
gctgcaggagggc

SEQ ID NO: 3013641 - DNA, 14 bp, Homo sapiens
gctgcaggagggca

SEQ ID NO: 3013642 - DNA, 16 bp, Homo sapiens
gctgcaggagggcact

SEQ ID NO: 3013643 - DNA, 12 bp, Homo sapiens
gctgcagggagc

SEQ ID NO: 3013644 - DNA, 12 bp, Homo sapiens
gctgcaggtgct

SEQ ID NO: 3013645 - DNA, 16 bp, Homo sapiens
gctgcagtaggggagg

SEQ ID NO: 3013646 - DNA, 20 bp, Homo sapiens
gctgcagtaggggaggagca

SEQ ID NO: 3013647 - DNA, 14 bp, Homo sapiens
gctgcagtcatcta

SEQ ID NO: 3013648 - DNA, 15 bp, Homo sapiens
gctgcagttgaagag

SEQ ID NO: 3013649 - DNA, 14 bp, Homo sapiens
gctgcatccagagg

SEQ ID NO: 3013650 - DNA, 19 bp, Homo sapiens
gctgcatgttgtttggaat

SEQ ID NO: 3013651 - DNA, 22 bp, Homo sapiens
gctgcatttcacatgccttgca

SEQ ID NO: 3013652 - DNA, 14 bp, Homo sapiens
gctgccacccacct

SEQ ID NO: 3013653 - DNA, 17 bp, Homo sapiens
gctgccacccacctccc

SEQ ID NO: 3013654 - DNA, 20 bp, Homo sapiens
gctgccacccacctccctgc

SEQ ID NO: 3013655 - DNA, 16 bp, Homo sapiens
gctgccactctgctgc

SEQ ID NO: 3013656 - DNA, 18 bp, Homo sapiens
gctgccactctgctgcct

SEQ ID NO: 3013657 - DNA, 10 bp, Homo sapiens
gctgccactg

SEQ ID NO: 3013658 - DNA, 15 bp, Homo sapiens
gctgccactgggcac

SEQ ID NO: 3013659 - DNA, 19 bp, Homo sapiens
gctgccaggaaacaaggga

SEQ ID NO: 3013660 - DNA, 14 bp, Homo sapiens
gctgccagggcttc

SEQ ID NO: 3013661 - DNA, 17 bp, Homo sapiens
gctgccattggtccacc

SEQ ID NO: 3013662 - DNA, 22 bp, Homo sapiens
gctgcccaggcctctcggtgct

SEQ ID NO: 3013663 - DNA, 14 bp, Homo sapiens
gctgcccatgagca

SEQ ID NO: 3013664 - DNA, 12 bp, Homo sapiens
gctgccccagcc

SEQ ID NO: 3013665 - DNA, 12 bp, Homo sapiens
gctgccccaggc

SEQ ID NO: 3013666 - DNA, 20 bp, Homo sapiens
gctgccccaggccggagccc

SEQ ID NO: 3013667 - DNA, 23 bp, Homo sapiens
gctgccccatgaagccacagccc

SEQ ID NO: 3013668 - DNA, 15 bp, Homo sapiens
gctgccccggcccct

SEQ ID NO: 3013669 - DNA, 16 bp, Homo sapiens
gctgccccggcccctc

SEQ ID NO: 3013670 - DNA, 23 bp, Homo sapiens
gctgccccggcccctccccctga

SEQ ID NO: 3013671 - DNA, 24 bp, Homo sapiens
gctgcccctccctgcctccaccca

SEQ ID NO: 3013672 - DNA, 18 bp, Homo sapiens
gctgcccctcctggagca

SEQ ID NO: 3013673 - DNA, 20 bp, Homo sapiens
gctgcccctcctggagcaga

SEQ ID NO: 3013674 - DNA, 14 bp, Homo sapiens
gctgcccctctctg

SEQ ID NO: 3013675 - DNA, 15 bp, Homo sapiens
gctgcccctctctgg

SEQ ID NO: 3013676 - DNA, 15 bp, Homo sapiens
gctgcccctggcacc

SEQ ID NO: 3013677 - DNA, 17 bp, Homo sapiens
gctgcccctggctctga

SEQ ID NO: 3013678 - DNA, 17 bp, Homo sapiens
gctgcccggcgcctgcc

SEQ ID NO: 3013679 - DNA, 20 bp, Homo sapiens
gctgcccggggtggggtgca

SEQ ID NO: 3013680 - DNA, 14 bp, Homo sapiens
gctgccctgaagaa

SEQ ID NO: 3013681 - DNA, 14 bp, Homo sapiens
gctgccctgagggg

SEQ ID NO: 3013682 - DNA, 17 bp, Homo sapiens
gctgccctgggtcctgc

SEQ ID NO: 3013683 - DNA, 16 bp, Homo sapiens
gctgcccttggtttct

SEQ ID NO: 3013684 - DNA, 13 bp, Homo sapiens
gctgccgactccc

SEQ ID NO: 3013685 - DNA, 22 bp, Homo sapiens
gctgccgagacagaccctctgc

SEQ ID NO: 3013686 - DNA, 21 bp, Homo sapiens
gctgcctcccctctccttcct

SEQ ID NO: 3013687 - DNA, 21 bp, Homo sapiens
gctgcctctacctgacactcc

SEQ ID NO: 3013688 - DNA, 22 bp, Homo sapiens
gctgcctctgacagcagcctgt

SEQ ID NO: 3013689 - DNA, 13 bp, Homo sapiens
gctgcctgcccgt

SEQ ID NO: 3013690 - DNA, 22 bp, Homo sapiens
gctgcctggaacaccagcagca

SEQ ID NO: 3013691 - DNA, 14 bp, Homo sapiens
gctgcctggagccc

SEQ ID NO: 3013692 - DNA, 17 bp, Homo sapiens
gctgcctggagccccac

SEQ ID NO: 3013693 - DNA, 18 bp, Homo sapiens
gctgcctggccaggccct

SEQ ID NO: 3013694 - DNA, 19 bp, Homo sapiens
gctgcctggccaggccctg

SEQ ID NO: 3013695 - DNA, 19 bp, Homo sapiens
gctgcctggccatgctgtc

SEQ ID NO: 3013696 - DNA, 20 bp, Homo sapiens
gctgcctggccatgctgtcc

SEQ ID NO: 3013697 - DNA, 21 bp, Homo sapiens
gctgcctgggtaggccccaca

SEQ ID NO: 3013698 - DNA, 12 bp, Homo sapiens
gctgccttagct

SEQ ID NO: 3013699 - DNA, 14 bp, Homo sapiens
gctgccttggctca

SEQ ID NO: 3013700 - DNA, 19 bp, Homo sapiens
gctgccttggctcagacat

SEQ ID NO: 3013701 - DNA, 23 bp, Homo sapiens
gctgccttggctcagacatgttt

SEQ ID NO: 3013702 - DNA, 20 bp, Homo sapiens
gctgcctttggacttgtccc

SEQ ID NO: 3013703 - DNA, 22 bp, Homo sapiens
gctgcgctaacccccagcccac

SEQ ID NO: 3013704 - DNA, 22 bp, Homo sapiens
ggaagcctgaactgaggccttg

SEQ ID NO: 3013705 - DNA, 13 bp, Homo sapiens
ggaagcctgtcct

SEQ ID NO: 3013706 - DNA, 16 bp, Homo sapiens
ggaagctaatttgcat

SEQ ID NO: 3013707 - DNA, 15 bp, Homo sapiens
ggaagctacaggtta

SEQ ID NO: 3013708 - DNA, 21 bp, Homo sapiens
ggaagctacaggttacaacag

SEQ ID NO: 3013709 - DNA, 23 bp, Homo sapiens
ggaagctacaggttacaacagat

SEQ ID NO: 3013710 - DNA, 16 bp, Homo sapiens
ggaagctgctagggga

SEQ ID NO: 3013711 - DNA, 17 bp, Homo sapiens
ggaagctgtgtccttgc

SEQ ID NO: 3013712 - DNA, 19 bp, Homo sapiens
ggaagctgtgttgaaacag

SEQ ID NO: 3013713 - DNA, 20 bp, Homo sapiens
ggaagctgtgttgaaacaga

SEQ ID NO: 3013714 - DNA, 23 bp, Homo sapiens
ggaagctttatttatagaaatga

SEQ ID NO: 3013715 - DNA, 21 bp, Homo sapiens
ggaagctttgtcccctgcttc

SEQ ID NO: 3013716 - DNA, 14 bp, Homo sapiens
ggaaggaaaggcag

SEQ ID NO: 3013717 - DNA, 11 bp, Homo sapiens
ggaaggaagcc

SEQ ID NO: 3013718 - DNA, 19 bp, Homo sapiens
ggaaggacaatcccaggaa

SEQ ID NO: 3013719 - DNA, 15 bp, Homo sapiens
ggaaggacagactgg

SEQ ID NO: 3013720 - DNA, 21 bp, Homo sapiens
ggaaggagactcacctctgcc

SEQ ID NO: 3013721 - DNA, 19 bp, Homo sapiens
ggaaggagagatgacccct

SEQ ID NO: 3013722 - DNA, 17 bp, Homo sapiens
ggaaggatcccatgagc

SEQ ID NO: 3013723 - DNA, 22 bp, Homo sapiens
ggaaggatgggaaaaactgcag

SEQ ID NO: 3013724 - DNA, 20 bp, Homo sapiens
ggaaggcaaaggcagaggaa

SEQ ID NO: 3013725 - DNA, 14 bp, Homo sapiens
ggaaggccgaggtc

SEQ ID NO: 3013726 - DNA, 19 bp, Homo sapiens
ggaagggagggagctgagg

SEQ ID NO: 3013727 - DNA, 20 bp, Homo sapiens
ggaagggaggggaaggggcc

SEQ ID NO: 3013728 - DNA, 16 bp, Homo sapiens
ggaaggggacccccgc

SEQ ID NO: 3013729 - DNA, 17 bp, Homo sapiens
ggaaggggacccccgcc

SEQ ID NO: 3013730 - DNA, 15 bp, Homo sapiens
ggaaggggccagagg

SEQ ID NO: 3013731 - DNA, 17 bp, Homo sapiens
ggaaggggccagaggct

SEQ ID NO: 3013732 - DNA, 12 bp, Homo sapiens
ggaaggggctag

SEQ ID NO: 3013733 - DNA, 16 bp, Homo sapiens
ggaaggggcttctgga

SEQ ID NO: 3013734 - DNA, 13 bp, Homo sapiens
ggaaggtgccaga

SEQ ID NO: 3013735 - DNA, 18 bp, Homo sapiens
ggaaggttggcgggggca

SEQ ID NO: 3013736 - DNA, 15 bp, Homo sapiens
ggaagtaaaaaaaca

SEQ ID NO: 3013737 - DNA, 16 bp, Homo sapiens
ggaagtacttccctca

SEQ ID NO: 3013738 - DNA, 13 bp, Homo sapiens
ggaagtcaaagca

SEQ ID NO: 3013739 - DNA, 12 bp, Homo sapiens
ggaagtcatggg

SEQ ID NO: 3013740 - DNA, 21 bp, Homo sapiens
ggaagtccccaggccccagga

SEQ ID NO: 3013741 - DNA, 15 bp, Homo sapiens
ggaagtccctcagag

SEQ ID NO: 3013742 - DNA, 19 bp, Homo sapiens
ggaagtctcaaagatcttt

SEQ ID NO: 3013743 - DNA, 20 bp, Homo sapiens
ggaagtgaagactggaagct

SEQ ID NO: 3013744 - DNA, 18 bp, Homo sapiens
ggaagtgacattgtgtca

SEQ ID NO: 3013745 - DNA, 14 bp, Homo sapiens
ggaagtgaggaagc

SEQ ID NO: 3013746 - DNA, 16 bp, Homo sapiens
ggaagtgaggaagcca

SEQ ID NO: 3013747 - DNA, 13 bp, Homo sapiens
ggaagtgttcctg

SEQ ID NO: 3013748 - DNA, 19 bp, Homo sapiens
ggaagttcttttttgtaca

SEQ ID NO: 3013749 - DNA, 22 bp, Homo sapiens
ggaagttcttttttgtacagta

SEQ ID NO: 3013750 - DNA, 20 bp, Homo sapiens
ggaagttggggcactgggcg

SEQ ID NO: 3013751 - DNA, 18 bp, Homo sapiens
ggaataaactagagaagg

SEQ ID NO: 3013752 - DNA, 18 bp, Homo sapiens
ggaatcacatcttttaag

SEQ ID NO: 3013753 - DNA, 18 bp, Homo sapiens
ggaatcactcttgtggat

SEQ ID NO: 3013754 - DNA, 20 bp, Homo sapiens
ggaatctgccttccagccca

SEQ ID NO: 3013755 - DNA, 23 bp, Homo sapiens
ggaatctggcattctacacctgg

SEQ ID NO: 3013756 - DNA, 13 bp, Homo sapiens
ggaatgagggagg

SEQ ID NO: 3013757 - DNA, 19 bp, Homo sapiens
ggaatgcacacagcggctg

SEQ ID NO: 3013758 - DNA, 15 bp, Homo sapiens
ggaatgggcaggtgg

SEQ ID NO: 3013759 - DNA, 16 bp, Homo sapiens
ggaatgggcaggtggc

SEQ ID NO: 3013760 - DNA, 16 bp, Homo sapiens
ggaatgttaaagtcag

SEQ ID NO: 3013761 - DNA, 16 bp, Homo sapiens
ggaattactccaaaaa

SEQ ID NO: 3013762 - DNA, 18 bp, Homo sapiens
ggaattccaattaaattt

SEQ ID NO: 3013763 - DNA, 17 bp, Homo sapiens
ggaattgattgtcagcc

SEQ ID NO: 3013764 - DNA, 18 bp, Homo sapiens
ggaattgatttgcattga

SEQ ID NO: 3013765 - DNA, 19 bp, Homo sapiens
ggaattgatttgcattgaa

SEQ ID NO: 3013766 - DNA, 17 bp, Homo sapiens
ggaatttcccaggaccc

SEQ ID NO: 3013767 - DNA, 19 bp, Homo sapiens
ggaatttcccaggaccctg

SEQ ID NO: 3013768 - DNA, 18 bp, Homo sapiens
ggacaaaagggccaggtg

SEQ ID NO: 3013769 - DNA, 21 bp, Homo sapiens
ggacaaacagtgaatttaagc

SEQ ID NO: 3013770 - DNA, 14 bp, Homo sapiens
ggacaaagaaaacg

SEQ ID NO: 3013771 - DNA, 15 bp, Homo sapiens
ggacaacttatttaa

SEQ ID NO: 3013772 - DNA, 13 bp, Homo sapiens
ggacaagaccctc

SEQ ID NO: 3013773 - DNA, 14 bp, Homo sapiens
ggacaagggaggca

SEQ ID NO: 3013774 - DNA, 16 bp, Homo sapiens
ggacaccccgactttt

SEQ ID NO: 3013775 - DNA, 22 bp, Homo sapiens
ggacaccgtggggaaggggtgc

SEQ ID NO: 3013776 - DNA, 19 bp, Homo sapiens
ggacacctgggagaaatct

SEQ ID NO: 3013777 - DNA, 21 bp, Homo sapiens
ggacacgcgcccccctcccag

SEQ ID NO: 3013778 - DNA, 22 bp, Homo sapiens
ggacacgcgcccccctcccaga

SEQ ID NO: 3013779 - DNA, 13 bp, Homo sapiens
ggacactggcccc

SEQ ID NO: 3013780 - DNA, 16 bp, Homo sapiens
ggacactggccccaca

SEQ ID NO: 3013781 - DNA, 17 bp, Homo sapiens
ggacactggccccacag

SEQ ID NO: 3013782 - DNA, 16 bp, Homo sapiens
ggacacttaatactac

SEQ ID NO: 3013783 - DNA, 14 bp, Homo sapiens
ggacacttctcagg

SEQ ID NO: 3013784 - DNA, 16 bp, Homo sapiens
ggacacttctcaggaa

SEQ ID NO: 3013785 - DNA, 18 bp, Homo sapiens
ggacacttctcaggaaat

SEQ ID NO: 3013786 - DNA, 17 bp, Homo sapiens
ggacagaagcagctctt

SEQ ID NO: 3013787 - DNA, 19 bp, Homo sapiens
ggacagaccaaaaatcaac

SEQ ID NO: 3013788 - DNA, 23 bp, Homo sapiens
ggacagactcacaacctgaacct

SEQ ID NO: 3013789 - DNA, 14 bp, Homo sapiens
ggacagactggccg

SEQ ID NO: 3013790 - DNA, 21 bp, Homo sapiens
ggacagactggccgggcaggc

SEQ ID NO: 3013791 - DNA, 17 bp, Homo sapiens
ggacagagaagatgact

SEQ ID NO: 3013792 - DNA, 11 bp, Homo sapiens
ggacagagcca

SEQ ID NO: 3013793 - DNA, 14 bp, Homo sapiens
ggacagaggcccca

SEQ ID NO: 3013794 - DNA, 15 bp, Homo sapiens
ggacagaggccccag

SEQ ID NO: 3013795 - DNA, 16 bp, Homo sapiens
ggacagaggccccagc

SEQ ID NO: 3013796 - DNA, 17 bp, Homo sapiens
ggacagaggccccagcc

SEQ ID NO: 3013797 - DNA, 20 bp, Homo sapiens
ggacagaggccccagcctcc

SEQ ID NO: 3013798 - DNA, 18 bp, Homo sapiens
ggacagagggcacatgaa

SEQ ID NO: 3013799 - DNA, 17 bp, Homo sapiens
ggacagagggtggctgg

SEQ ID NO: 3013800 - DNA, 18 bp, Homo sapiens
ggacagatggacgcaggc

SEQ ID NO: 3013801 - DNA, 12 bp, Homo sapiens
ggacagcaacaa

SEQ ID NO: 3013802 - DNA, 15 bp, Homo sapiens
ggacagccccaccct

SEQ ID NO: 3013803 - DNA, 16 bp, Homo sapiens
ggacagccccaccctg

SEQ ID NO: 3013804 - DNA, 17 bp, Homo sapiens
ggacagccccaccctgg

SEQ ID NO: 3013805 - DNA, 12 bp, Homo sapiens
ggacagcttgtg

SEQ ID NO: 3013806 - DNA, 22 bp, Homo sapiens
ggacagcttgtggcaagtgaat

SEQ ID NO: 3013807 - DNA, 22 bp, Homo sapiens
ggacaggaaggtctgatttgca

SEQ ID NO: 3013808 - DNA, 23 bp, Homo sapiens
ggacaggaaggtctgatttgcag

SEQ ID NO: 3013809 - DNA, 16 bp, Homo sapiens
ggacaggatgaggaca

SEQ ID NO: 3013810 - DNA, 18 bp, Homo sapiens
ggacaggatgaggacaga

SEQ ID NO: 3013811 - DNA, 23 bp, Homo sapiens
ggacaggatgaggacagagggca

SEQ ID NO: 3013812 - DNA, 20 bp, Homo sapiens
ggacaggctggaatgaggga

SEQ ID NO: 3013813 - DNA, 23 bp, Homo sapiens
ggacaggctggctccagatgcag

SEQ ID NO: 3013814 - DNA, 15 bp, Homo sapiens
ggacagtcagctctt

SEQ ID NO: 3013815 - DNA, 19 bp, Homo sapiens
ggacagtctgctctagatg

SEQ ID NO: 3013816 - DNA, 12 bp, Homo sapiens
ggacagttgctg

SEQ ID NO: 3013817 - DNA, 20 bp, Homo sapiens
ggacatagagagggagaaga

SEQ ID NO: 3013818 - DNA, 15 bp, Homo sapiens
ggacatctctttgaa

SEQ ID NO: 3013819 - DNA, 17 bp, Homo sapiens
ggacatggtctgtcctg

SEQ ID NO: 3013820 - DNA, 12 bp, Homo sapiens
ggacattcttgt

SEQ ID NO: 3013821 - DNA, 15 bp, Homo sapiens
ggaccaaattgcttc

SEQ ID NO: 3013822 - DNA, 19 bp, Homo sapiens
ggaccaaattgcttctagg

SEQ ID NO: 3013823 - DNA, 20 bp, Homo sapiens
ggaccacaactattttcaga

SEQ ID NO: 3013824 - DNA, 21 bp, Homo sapiens
ggaccactgcatgagctttta

SEQ ID NO: 3013825 - DNA, 19 bp, Homo sapiens
ggaccactgggcccctcag

SEQ ID NO: 3013826 - DNA, 21 bp, Homo sapiens
ggaccagaaacctgggagaga

SEQ ID NO: 3013827 - DNA, 19 bp, Homo sapiens
ggaccagctcaggacagat

SEQ ID NO: 3013828 - DNA, 14 bp, Homo sapiens
ggaccaggacccag

SEQ ID NO: 3013829 - DNA, 17 bp, Homo sapiens
ggaccaggacccaggga

SEQ ID NO: 3013830 - DNA, 18 bp, Homo sapiens
ggaccaggacccagggag

SEQ ID NO: 3013831 - DNA, 14 bp, Homo sapiens
ggaccagggtggag

SEQ ID NO: 3013832 - DNA, 17 bp, Homo sapiens
ggaccaggtatagagaa

SEQ ID NO: 3013833 - DNA, 23 bp, Homo sapiens
ggaccatgcgacactgggaggcc

SEQ ID NO: 3013834 - DNA, 14 bp, Homo sapiens
ggaccatggggagg

SEQ ID NO: 3013835 - DNA, 18 bp, Homo sapiens
ggacccaaagcaggatga

SEQ ID NO: 3013836 - DNA, 22 bp, Homo sapiens
ggacccagggaacagccactcc

SEQ ID NO: 3013837 - DNA, 14 bp, Homo sapiens
ggacccagggagag

SEQ ID NO: 3013838 - DNA, 19 bp, Homo sapiens
ggacccatggtcatctctg

SEQ ID NO: 3013839 - DNA, 12 bp, Homo sapiens
ggaccccaggcc

SEQ ID NO: 3013840 - DNA, 19 bp, Homo sapiens
ggacccccgccccctgccc

SEQ ID NO: 3013841 - DNA, 20 bp, Homo sapiens
ggacccccgccccctgccct

SEQ ID NO: 3013842 - DNA, 23 bp, Homo sapiens
ggacccccgccccctgccctccc

SEQ ID NO: 3013843 - DNA, 12 bp, Homo sapiens
ggacccctcacc

SEQ ID NO: 3013844 - DNA, 14 bp, Homo sapiens
ggacccctggctct

SEQ ID NO: 3013845 - DNA, 12 bp, Homo sapiens
ggacccgccagc

SEQ ID NO: 3013846 - DNA, 21 bp, Homo sapiens
ggacccgccagccccgctccc

SEQ ID NO: 3013847 - DNA, 19 bp, Homo sapiens
ggacccggcggccctgctg

SEQ ID NO: 3013848 - DNA, 21 bp, Homo sapiens
ggacccggggtctcctggacc

SEQ ID NO: 3013849 - DNA, 21 bp, Homo sapiens
ggaccctgtaaatacatcctt

SEQ ID NO: 3013850 - DNA, 23 bp, Homo sapiens
ggaccctttccttccttccctgg

SEQ ID NO: 3013851 - DNA, 14 bp, Homo sapiens
ggaccgaggaacaa

SEQ ID NO: 3013852 - DNA, 13 bp, Homo sapiens
ggaccgctttgcg

SEQ ID NO: 3013853 - DNA, 17 bp, Homo sapiens
ggaccggtacagaaagg

SEQ ID NO: 3013854 - DNA, 15 bp, Homo sapiens
ggacctctcccaggg

SEQ ID NO: 3013855 - DNA, 15 bp, Homo sapiens
ggacctctcttgtga

SEQ ID NO: 3013856 - DNA, 19 bp, Homo sapiens
ggacctgaaattccaaagt

SEQ ID NO: 3013857 - DNA, 16 bp, Homo sapiens
ggacctgagcccgcag

SEQ ID NO: 3013858 - DNA, 16 bp, Homo sapiens
ggacctgatggagagt

SEQ ID NO: 3013859 - DNA, 23 bp, Homo sapiens
ggacctgcatctaagcatctggg

SEQ ID NO: 3013860 - DNA, 16 bp, Homo sapiens
ggacctggactagggc

SEQ ID NO: 3013861 - DNA, 20 bp, Homo sapiens
ggacctggactagggcctcg

SEQ ID NO: 3013862 - DNA, 11 bp, Homo sapiens
ggacctggcag

SEQ ID NO: 3013863 - DNA, 21 bp, Homo sapiens
ggaccttacgatcaggcacag

SEQ ID NO: 3013864 - DNA, 18 bp, Homo sapiens
ggaccttgacagagcagc

SEQ ID NO: 3013865 - DNA, 19 bp, Homo sapiens
ggaccttgacagagcagct

SEQ ID NO: 3013866 - DNA, 20 bp, Homo sapiens
ggacgaagaagagccacagt

SEQ ID NO: 3013867 - DNA, 22 bp, Homo sapiens
ggacgcaggcccctctcctccg

SEQ ID NO: 3013868 - DNA, 15 bp, Homo sapiens
ggacgcaggccctgt

SEQ ID NO: 3013869 - DNA, 14 bp, Homo sapiens
ggacgcaggtgctg

SEQ ID NO: 3013870 - DNA, 19 bp, Homo sapiens
ggacgctccgctgccgtgc

SEQ ID NO: 3013871 - DNA, 14 bp, Homo sapiens
ggacgtgaaatact

SEQ ID NO: 3013872 - DNA, 14 bp, Homo sapiens
ggacgtgctggcct

SEQ ID NO: 3013873 - DNA, 13 bp, Homo sapiens
ggacgtgggctgg

SEQ ID NO: 3013874 - DNA, 23 bp, Homo sapiens
ggacgttggcctcagggccagga

SEQ ID NO: 3013875 - DNA, 17 bp, Homo sapiens
ggactacattttgctct

SEQ ID NO: 3013876 - DNA, 18 bp, Homo sapiens
ggactagagggacctctc

SEQ ID NO: 3013877 - DNA, 17 bp, Homo sapiens
ggactagggcctcggag

SEQ ID NO: 3013878 - DNA, 23 bp, Homo sapiens
ggactagggcctcggaggctcct

SEQ ID NO: 3013879 - DNA, 18 bp, Homo sapiens
ggactagtgagtcagcac

SEQ ID NO: 3013880 - DNA, 18 bp, Homo sapiens
ggactcaccctccacaaa

SEQ ID NO: 3013881 - DNA, 15 bp, Homo sapiens
ggactcactggcagc

SEQ ID NO: 3013882 - DNA, 23 bp, Homo sapiens
ggactcactggcagccccagcac

SEQ ID NO: 3013883 - DNA, 22 bp, Homo sapiens
ggactcacttgatgtttcctgg

SEQ ID NO: 3013884 - DNA, 23 bp, Homo sapiens
ggactcacttgatgtttcctgga

SEQ ID NO: 3013885 - DNA, 18 bp, Homo sapiens
ggactcagaagcctctgg

SEQ ID NO: 3013886 - DNA, 14 bp, Homo sapiens
ggactcagagaaaa

SEQ ID NO: 3013887 - DNA, 13 bp, Homo sapiens
ggactcagggcag

SEQ ID NO: 3013888 - DNA, 22 bp, Homo sapiens
ggactcagggcagcgccaggct

SEQ ID NO: 3013889 - DNA, 14 bp, Homo sapiens
ggactccaggccag

SEQ ID NO: 3013890 - DNA, 22 bp, Homo sapiens
ggactccaggcccaaggctccc

SEQ ID NO: 3013891 - DNA, 23 bp, Homo sapiens
ggactccaggcccaaggctcccg

SEQ ID NO: 3013892 - DNA, 17 bp, Homo sapiens
ggactcctgccaccagc

SEQ ID NO: 3013893 - DNA, 18 bp, Homo sapiens
ggactcggcccagggccg

SEQ ID NO: 3013894 - DNA, 17 bp, Homo sapiens
ggactctcagtctctga

SEQ ID NO: 3013895 - DNA, 18 bp, Homo sapiens
ggactctcagtctctgag

SEQ ID NO: 3013896 - DNA, 22 bp, Homo sapiens
ggactctgcaagtgtctggagc

SEQ ID NO: 3013897 - DNA, 23 bp, Homo sapiens
ggactctgcaagtgtctggagcg

SEQ ID NO: 3013898 - DNA, 15 bp, Homo sapiens
ggactctgcacatga

SEQ ID NO: 3013899 - DNA, 20 bp, Homo sapiens
ggactctgcacatgtcttgt

SEQ ID NO: 3013900 - DNA, 21 bp, Homo sapiens
ggactctgcacatgtcttgta

SEQ ID NO: 3013901 - DNA, 17 bp, Homo sapiens
ggactctggggttttta

SEQ ID NO: 3013902 - DNA, 17 bp, Homo sapiens
ggactctggtgcctcca

SEQ ID NO: 3013903 - DNA, 17 bp, Homo sapiens
ggactgaaaacctctcc

SEQ ID NO: 3013904 - DNA, 22 bp, Homo sapiens
ggactgagcgaggaaaaacaac

SEQ ID NO: 3013905 - DNA, 21 bp, Homo sapiens
ggactgagcggccgcagagac

SEQ ID NO: 3013906 - DNA, 23 bp, Homo sapiens
ggactgagcggccgcagagactg

SEQ ID NO: 3013907 - DNA, 22 bp, Homo sapiens
ggactgcacagcgtcctgtcca

SEQ ID NO: 3013908 - DNA, 23 bp, Homo sapiens
ggactgcagtcggcatgccagga

SEQ ID NO: 3013909 - DNA, 18 bp, Homo sapiens
ggactgctaaataaaatt

SEQ ID NO: 3013910 - DNA, 14 bp, Homo sapiens
ggactgctgaccca

SEQ ID NO: 3013911 - DNA, 15 bp, Homo sapiens
ggactgctgacccac

SEQ ID NO: 3013912 - DNA, 12 bp, Homo sapiens
ggactgctggct

SEQ ID NO: 3013913 - DNA, 19 bp, Homo sapiens
ggactgctggctcacgccc

SEQ ID NO: 3013914 - DNA, 18 bp, Homo sapiens
ggactggccgtggctcca

SEQ ID NO: 3013915 - DNA, 21 bp, Homo sapiens
ggactggccgtggctccagaa

SEQ ID NO: 3013916 - DNA, 17 bp, Homo sapiens
ggactgggtctgacctg

SEQ ID NO: 3013917 - DNA, 19 bp, Homo sapiens
ggacttcaaagcaagctgg

SEQ ID NO: 3013918 - DNA, 11 bp, Homo sapiens
ggacttcctgt

SEQ ID NO: 3013919 - DNA, 19 bp, Homo sapiens
ggacttcctgtccagctcc

SEQ ID NO: 3013920 - DNA, 11 bp, Homo sapiens
ggacttctttt

SEQ ID NO: 3013921 - DNA, 19 bp, Homo sapiens
ggacttgaactttcctgga

SEQ ID NO: 3013922 - DNA, 18 bp, Homo sapiens
ggacttggagacttggtg

SEQ ID NO: 3013923 - DNA, 22 bp, Homo sapiens
ggacttgtaggaatctgccttc

SEQ ID NO: 3013924 - DNA, 17 bp, Homo sapiens
ggacttgttttaatttt

SEQ ID NO: 3013925 - DNA, 18 bp, Homo sapiens
ggagaaaacgccagtgtg

SEQ ID NO: 3013926 - DNA, 15 bp, Homo sapiens
ggagaaagaaaactg

SEQ ID NO: 3013927 - DNA, 22 bp, Homo sapiens
ggagaaagggcagaggaagaga

SEQ ID NO: 3013928 - DNA, 15 bp, Homo sapiens
ggagaaatgaaaagt

SEQ ID NO: 3013929 - DNA, 20 bp, Homo sapiens
ggagaaatgcatccattcct

SEQ ID NO: 3013930 - DNA, 23 bp, Homo sapiens
ggagaaatgcatccattcctcag

SEQ ID NO: 3013931 - DNA, 21 bp, Homo sapiens
ggagaactcctagggtggctg

SEQ ID NO: 3013932 - DNA, 13 bp, Homo sapiens
ggagaagaagtca

SEQ ID NO: 3013933 - DNA, 15 bp, Homo sapiens
ggagaagcagtgagc

SEQ ID NO: 3013934 - DNA, 14 bp, Homo sapiens
ggagaagccacctt

SEQ ID NO: 3013935 - DNA, 17 bp, Homo sapiens
ggagaaggaaggagact

SEQ ID NO: 3013936 - DNA, 13 bp, Homo sapiens
ggagaaggcctcc

SEQ ID NO: 3013937 - DNA, 14 bp, Homo sapiens
ggagaaggcctccc

SEQ ID NO: 3013938 - DNA, 18 bp, Homo sapiens
ggagaaggcctcccctga

SEQ ID NO: 3013939 - DNA, 17 bp, Homo sapiens
ggagaagggaagttgaa

SEQ ID NO: 3013940 - DNA, 14 bp, Homo sapiens
ggagaagggctggg

SEQ ID NO: 3013941 - DNA, 13 bp, Homo sapiens
ggagaatcagcag

SEQ ID NO: 3013942 - DNA, 14 bp, Homo sapiens
ggagaatcagcaga

SEQ ID NO: 3013943 - DNA, 20 bp, Homo sapiens
ggagaatcgcttgaacctgg

SEQ ID NO: 3013944 - DNA, 13 bp, Homo sapiens
ggagacaaagcag

SEQ ID NO: 3013945 - DNA, 15 bp, Homo sapiens
ggagacaaagcagga

SEQ ID NO: 3013946 - DNA, 19 bp, Homo sapiens
ggagacagatcactcctgg

SEQ ID NO: 3013947 - DNA, 23 bp, Homo sapiens
ggagacagatcactcctggaggc

SEQ ID NO: 3013948 - DNA, 12 bp, Homo sapiens
ggagacaggcag

SEQ ID NO: 3013949 - DNA, 15 bp, Homo sapiens
ggagacattgtttgg

SEQ ID NO: 3013950 - DNA, 15 bp, Homo sapiens
ggagacctgctctcc

SEQ ID NO: 3013951 - DNA, 19 bp, Homo sapiens
ggagactcacctctgcctc

SEQ ID NO: 3013952 - DNA, 14 bp, Homo sapiens
ggagactggcaggc

SEQ ID NO: 3013953 - DNA, 17 bp, Homo sapiens
ggagactgggctgaggg

SEQ ID NO: 3013954 - DNA, 16 bp, Homo sapiens
ggagactgtcttcccg

SEQ ID NO: 3013955 - DNA, 14 bp, Homo sapiens
ggagagaaaatata

SEQ ID NO: 3013956 - DNA, 15 bp, Homo sapiens
ggagagaaaatatat

SEQ ID NO: 3013957 - DNA, 18 bp, Homo sapiens
ggagagaacgggcgtcag

SEQ ID NO: 3013958 - DNA, 23 bp, Homo sapiens
ggagagaactgagcatctccagc

SEQ ID NO: 3013959 - DNA, 12 bp, Homo sapiens
ggagagaagaat

SEQ ID NO: 3013960 - DNA, 18 bp, Homo sapiens
ggagagatagcctgtggc

SEQ ID NO: 3013961 - DNA, 20 bp, Homo sapiens
ggagagatgacccctacccc

SEQ ID NO: 3013962 - DNA, 11 bp, Homo sapiens
ggagagccagc

SEQ ID NO: 3013963 - DNA, 12 bp, Homo sapiens
ggagagccagcc

SEQ ID NO: 3013964 - DNA, 18 bp, Homo sapiens
ggagagccagccctccct

SEQ ID NO: 3013965 - DNA, 22 bp, Homo sapiens
ggagagcgcctgcccctcccag

SEQ ID NO: 3013966 - DNA, 17 bp, Homo sapiens
ggagagcggaggaggaa

SEQ ID NO: 3013967 - DNA, 14 bp, Homo sapiens
ggagagctgagcca

SEQ ID NO: 3013968 - DNA, 12 bp, Homo sapiens
ggagaggagagc

SEQ ID NO: 3013969 - DNA, 22 bp, Homo sapiens
ggagaggccctctggagtggcc

SEQ ID NO: 3013970 - DNA, 14 bp, Homo sapiens
ggagaggctgtgtc

SEQ ID NO: 3013971 - DNA, 20 bp, Homo sapiens
ggagagggtctggagaagca

SEQ ID NO: 3013972 - DNA, 22 bp, Homo sapiens
ggagagtgtcaaccagacagag

SEQ ID NO: 3013973 - DNA, 13 bp, Homo sapiens
ggagatgaaaacc

SEQ ID NO: 3013974 - DNA, 15 bp, Homo sapiens
ggagatgctccttgg

SEQ ID NO: 3013975 - DNA, 14 bp, Homo sapiens
ggagattgaacttt

SEQ ID NO: 3013976 - DNA, 16 bp, Homo sapiens
ggagcaaaaggcggtg

SEQ ID NO: 3013977 - DNA, 15 bp, Homo sapiens
ggagcaatcacagga

SEQ ID NO: 3013978 - DNA, 13 bp, Homo sapiens
ggagcaatcagaa

SEQ ID NO: 3013979 - DNA, 17 bp, Homo sapiens
ggagcacacccagcccc

SEQ ID NO: 3013980 - DNA, 15 bp, Homo sapiens
ggagcaccacggcca

SEQ ID NO: 3013981 - DNA, 16 bp, Homo sapiens
ggagcaccacggccag

SEQ ID NO: 3013982 - DNA, 17 bp, Homo sapiens
ggagcaccacggccaga

SEQ ID NO: 3013983 - DNA, 20 bp, Homo sapiens
ggagcaccacggccagaagt

SEQ ID NO: 3013984 - DNA, 15 bp, Homo sapiens
ggagcacctggaccc

SEQ ID NO: 3013985 - DNA, 22 bp, Homo sapiens
ggagcacctggaccccctgccc

SEQ ID NO: 3013986 - DNA, 15 bp, Homo sapiens
ggagcagaaagtgcc

SEQ ID NO: 3013987 - DNA, 18 bp, Homo sapiens
ggagcagagaggtggcca

SEQ ID NO: 3013988 - DNA, 17 bp, Homo sapiens
ggagcagcggctctggt

SEQ ID NO: 3013989 - DNA, 12 bp, Homo sapiens
ggagcagggcgg

SEQ ID NO: 3013990 - DNA, 21 bp, Homo sapiens
ggagcatcagctgtctgtcat

SEQ ID NO: 3013991 - DNA, 14 bp, Homo sapiens
ggagcatggacagt

SEQ ID NO: 3013992 - DNA, 15 bp, Homo sapiens
ggagcatggacagtg

SEQ ID NO: 3013993 - DNA, 15 bp, Homo sapiens
ggagcattaagccca

SEQ ID NO: 3013994 - DNA, 22 bp, Homo sapiens
ggagcatttatgtagacattgt

SEQ ID NO: 3013995 - DNA, 23 bp, Homo sapiens
ggagccaaaggcatccaggccag

SEQ ID NO: 3013996 - DNA, 17 bp, Homo sapiens
ggagccacaggcagggg

SEQ ID NO: 3013997 - DNA, 22 bp, Homo sapiens
ggagccacaggcaggggtgaga

SEQ ID NO: 3013998 - DNA, 20 bp, Homo sapiens
gcccaggagagccagccctc

SEQ ID NO: 3013999 - DNA, 21 bp, Homo sapiens
gcccaggagagccagccctcc

SEQ ID NO: 3014000 - DNA, 20 bp, Homo sapiens
gcccaggagctctgcgccag

SEQ ID NO: 3014001 - DNA, 22 bp, Homo sapiens
gcccaggcaggtctgcaagggc

SEQ ID NO: 3014002 - DNA, 16 bp, Homo sapiens
gcccaggccatgtggc

SEQ ID NO: 3014003 - DNA, 19 bp, Homo sapiens
gcccaggccggggctggag

SEQ ID NO: 3014004 - DNA, 15 bp, Homo sapiens
gcccaggcctccagc

SEQ ID NO: 3014005 - DNA, 16 bp, Homo sapiens
gcccaggcctccagct

SEQ ID NO: 3014006 - DNA, 17 bp, Homo sapiens
gcccaggcctccagctc

SEQ ID NO: 3014007 - DNA, 13 bp, Homo sapiens
gcccaggcctgga

SEQ ID NO: 3014008 - DNA, 14 bp, Homo sapiens
gcccaggcctggag

SEQ ID NO: 3014009 - DNA, 15 bp, Homo sapiens
gcccaggcctggagc

SEQ ID NO: 3014010 - DNA, 11 bp, Homo sapiens
gcccaggctgg

SEQ ID NO: 3014011 - DNA, 12 bp, Homo sapiens
gcccaggctgga

SEQ ID NO: 3014012 - DNA, 20 bp, Homo sapiens
gcccaggctggagggcagtg

SEQ ID NO: 3014013 - DNA, 24 bp, Homo sapiens
gcccaggctggtcttgaagtcctg

SEQ ID NO: 3014014 - DNA, 16 bp, Homo sapiens
gcccaggctggtttcg

SEQ ID NO: 3014015 - DNA, 15 bp, Homo sapiens
gcccagggagggtga

SEQ ID NO: 3014016 - DNA, 14 bp, Homo sapiens
gcccagggcccaga

SEQ ID NO: 3014017 - DNA, 13 bp, Homo sapiens
gcccaggggagaa

SEQ ID NO: 3014018 - DNA, 22 bp, Homo sapiens
gcccaggggagaatgcagccca

SEQ ID NO: 3014019 - DNA, 22 bp, Homo sapiens
gcccaggggaggcggcactcca

SEQ ID NO: 3014020 - DNA, 21 bp, Homo sapiens
gcccaggtggggtttcctgca

SEQ ID NO: 3014021 - DNA, 14 bp, Homo sapiens
gcccagtccttcca

SEQ ID NO: 3014022 - DNA, 14 bp, Homo sapiens
gcccagtgcttctc

SEQ ID NO: 3014023 - DNA, 23 bp, Homo sapiens
gcccagtgcttctccaacactga

SEQ ID NO: 3014024 - DNA, 23 bp, Homo sapiens
gcccagtgggctgcacgctcccc

SEQ ID NO: 3014025 - DNA, 20 bp, Homo sapiens
gcccatacccgtgacagtgg

SEQ ID NO: 3014026 - DNA, 23 bp, Homo sapiens
gcccatacccgtgacagtggctg

SEQ ID NO: 3014027 - DNA, 16 bp, Homo sapiens
gcccatcagtgccagc

SEQ ID NO: 3014028 - DNA, 19 bp, Homo sapiens
gcccatcgggaccagaaac

SEQ ID NO: 3014029 - DNA, 17 bp, Homo sapiens
gcccatgagtccttgaa

SEQ ID NO: 3014030 - DNA, 13 bp, Homo sapiens
gcccatggaggag

SEQ ID NO: 3014031 - DNA, 18 bp, Homo sapiens
gcccattcttttcacttc

SEQ ID NO: 3014032 - DNA, 23 bp, Homo sapiens
gcccattgtggaggcggtggggg

SEQ ID NO: 3014033 - DNA, 14 bp, Homo sapiens
gcccatttctccag

SEQ ID NO: 3014034 - DNA, 15 bp, Homo sapiens
gccccaactcctgga

SEQ ID NO: 3014035 - DNA, 18 bp, Homo sapiens
gccccaactcctggaagc

SEQ ID NO: 3014036 - DNA, 21 bp, Homo sapiens
gccccaactctcccctgacct

SEQ ID NO: 3014037 - DNA, 19 bp, Homo sapiens
gccccaatccctttattac

SEQ ID NO: 3014038 - DNA, 15 bp, Homo sapiens
gccccacaaggcctg

SEQ ID NO: 3014039 - DNA, 20 bp, Homo sapiens
gccccacaaggcctggtctg

SEQ ID NO: 3014040 - DNA, 21 bp, Homo sapiens
gccccacaaggcctggtctgg

SEQ ID NO: 3014041 - DNA, 14 bp, Homo sapiens
gccccaccacctag

SEQ ID NO: 3014042 - DNA, 12 bp, Homo sapiens
gccccactgccc

SEQ ID NO: 3014043 - DNA, 14 bp, Homo sapiens
gccccactggggaa

SEQ ID NO: 3014044 - DNA, 18 bp, Homo sapiens
gccccagacagttctttt

SEQ ID NO: 3014045 - DNA, 19 bp, Homo sapiens
gccccagacagttcttttc

SEQ ID NO: 3014046 - DNA, 21 bp, Homo sapiens
gccccagacagttcttttcta

SEQ ID NO: 3014047 - DNA, 18 bp, Homo sapiens
gccccagactgagctctc

SEQ ID NO: 3014048 - DNA, 20 bp, Homo sapiens
gccccagactgagctctcca

SEQ ID NO: 3014049 - DNA, 22 bp, Homo sapiens
gccccagactgagctctccagg

SEQ ID NO: 3014050 - DNA, 23 bp, Homo sapiens
gccccagactgagctctccaggc

SEQ ID NO: 3014051 - DNA, 18 bp, Homo sapiens
gccccagcaccaccaggt

SEQ ID NO: 3014052 - DNA, 19 bp, Homo sapiens
gccccagcacctcagcctg

SEQ ID NO: 3014053 - DNA, 16 bp, Homo sapiens
gccccagcctccctga

SEQ ID NO: 3014054 - DNA, 18 bp, Homo sapiens
gccccagcctccctgaag

SEQ ID NO: 3014055 - DNA, 15 bp, Homo sapiens
gccccaggaaaggcc

SEQ ID NO: 3014056 - DNA, 22 bp, Homo sapiens
gccccaggaaaggcccagccac

SEQ ID NO: 3014057 - DNA, 23 bp, Homo sapiens
gccccaggaccagctcaggacag

SEQ ID NO: 3014058 - DNA, 24 bp, Homo sapiens
gccccaggaccagctcaggacaga

SEQ ID NO: 3014059 - DNA, 14 bp, Homo sapiens
gccccatcagtgct

SEQ ID NO: 3014060 - DNA, 20 bp, Homo sapiens
gccccatcgccccaactcca

SEQ ID NO: 3014061 - DNA, 17 bp, Homo sapiens
gccccatcgccccaccg

SEQ ID NO: 3014062 - DNA, 19 bp, Homo sapiens
gccccatcggtcaccttgt

SEQ ID NO: 3014063 - DNA, 12 bp, Homo sapiens
gccccattcctg

SEQ ID NO: 3014064 - DNA, 20 bp, Homo sapiens
gccccattcttttgtaattt

SEQ ID NO: 3014065 - DNA, 19 bp, Homo sapiens
gcccccaaagcccatgccc

SEQ ID NO: 3014066 - DNA, 11 bp, Homo sapiens
gcccccaagtc

SEQ ID NO: 3014067 - DNA, 22 bp, Homo sapiens
gcccccacatttgtgccgacac

SEQ ID NO: 3014068 - DNA, 15 bp, Homo sapiens
gcccccaccacacat

SEQ ID NO: 3014069 - DNA, 23 bp, Homo sapiens
gcccccaccacacatcccagccc

SEQ ID NO: 3014070 - DNA, 13 bp, Homo sapiens
gggagaaagcaat

SEQ ID NO: 3014071 - DNA, 13 bp, Homo sapiens
gggagacctggac

SEQ ID NO: 3014072 - DNA, 22 bp, Homo sapiens
gggagacggtttccagggaggg

SEQ ID NO: 3014073 - DNA, 19 bp, Homo sapiens
gggagactgggctgaggga

SEQ ID NO: 3014074 - DNA, 22 bp, Homo sapiens
gggagagacttggatgaggagt

SEQ ID NO: 3014075 - DNA, 22 bp, Homo sapiens
gggagagctgagccagttgtcc

SEQ ID NO: 3014076 - DNA, 14 bp, Homo sapiens
gggagaggggacgc

SEQ ID NO: 3014077 - DNA, 15 bp, Homo sapiens
gggagagggtctgga

SEQ ID NO: 3014078 - DNA, 18 bp, Homo sapiens
gggagagtgtcaaccaga

SEQ ID NO: 3014079 - DNA, 20 bp, Homo sapiens
gggagagtgtcaaccagaca

SEQ ID NO: 3014080 - DNA, 19 bp, Homo sapiens
gggagatggagttcttgtg

SEQ ID NO: 3014081 - DNA, 17 bp, Homo sapiens
gggagcaccacggccag

SEQ ID NO: 3014082 - DNA, 18 bp, Homo sapiens
gggagcaccacggccaga

SEQ ID NO: 3014083 - DNA, 21 bp, Homo sapiens
gggagcaggcggtgggcaccc

SEQ ID NO: 3014084 - DNA, 11 bp, Homo sapiens
gggagccaggg

SEQ ID NO: 3014085 - DNA, 10 bp, Homo sapiens
gggagcccac

SEQ ID NO: 3014086 - DNA, 20 bp, Homo sapiens
gggagcccactgtcctgggc

SEQ ID NO: 3014087 - DNA, 20 bp, Homo sapiens
gggagcctgaggcaggagaa

SEQ ID NO: 3014088 - DNA, 23 bp, Homo sapiens
gggagctcaggaaccgaggcagg

SEQ ID NO: 3014089 - DNA, 19 bp, Homo sapiens
gggagctgaggcctccctt

SEQ ID NO: 3014090 - DNA, 10 bp, Homo sapiens
gggagctggt

SEQ ID NO: 3014091 - DNA, 13 bp, Homo sapiens
gggagctggtgac

SEQ ID NO: 3014092 - DNA, 12 bp, Homo sapiens
gggaggaagaga

SEQ ID NO: 3014093 - DNA, 12 bp, Homo sapiens
gggaggcagagc

SEQ ID NO: 3014094 - DNA, 20 bp, Homo sapiens
gggaggccaggcgagcctga

SEQ ID NO: 3014095 - DNA, 16 bp, Homo sapiens
gggaggccccactggg

SEQ ID NO: 3014096 - DNA, 16 bp, Homo sapiens
gggaggctgaggcaca

SEQ ID NO: 3014097 - DNA, 17 bp, Homo sapiens
gggaggctgaggcagga

SEQ ID NO: 3014098 - DNA, 17 bp, Homo sapiens
gggaggctgcagccagg

SEQ ID NO: 3014099 - DNA, 20 bp, Homo sapiens
gggagggactgctgacccac

SEQ ID NO: 3014100 - DNA, 15 bp, Homo sapiens
gggagggagccatgg

SEQ ID NO: 3014101 - DNA, 16 bp, Homo sapiens
gggagggagccatgga

SEQ ID NO: 3014102 - DNA, 22 bp, Homo sapiens
gggagggagccatggaaggtgc

SEQ ID NO: 3014103 - DNA, 18 bp, Homo sapiens
gggagggagctgaggcct

SEQ ID NO: 3014104 - DNA, 11 bp, Homo sapiens
gggagggaggg

SEQ ID NO: 3014105 - DNA, 22 bp, Homo sapiens
gggagggatgaagggcgagtga

SEQ ID NO: 3014106 - DNA, 13 bp, Homo sapiens
gggagggatggcc

SEQ ID NO: 3014107 - DNA, 16 bp, Homo sapiens
gggagggccagggagg

SEQ ID NO: 3014108 - DNA, 17 bp, Homo sapiens
gggccagggaggcagag

SEQ ID NO: 3014109 - DNA, 23 bp, Homo sapiens
gggccagggaggcagagcgggag

SEQ ID NO: 3014110 - DNA, 13 bp, Homo sapiens
gggccatgggtcc

SEQ ID NO: 3014111 - DNA, 14 bp, Homo sapiens
gggccatgggtcct

SEQ ID NO: 3014112 - DNA, 15 bp, Homo sapiens
gggcccacagccccc

SEQ ID NO: 3014113 - DNA, 17 bp, Homo sapiens
gggcccacagcccccac

SEQ ID NO: 3014114 - DNA, 17 bp, Homo sapiens
gggcccagagcccagct

SEQ ID NO: 3014115 - DNA, 12 bp, Homo sapiens
gggcccaggcag

SEQ ID NO: 3014116 - DNA, 14 bp, Homo sapiens
gggcccaggcaggt

SEQ ID NO: 3014117 - DNA, 17 bp, Homo sapiens
gggcccaggcaggtctg

SEQ ID NO: 3014118 - DNA, 14 bp, Homo sapiens
gggcccaggcctgg

SEQ ID NO: 3014119 - DNA, 18 bp, Homo sapiens
gggcccaggcctggagcg

SEQ ID NO: 3014120 - DNA, 11 bp, Homo sapiens
gggcccaggga

SEQ ID NO: 3014121 - DNA, 14 bp, Homo sapiens
gggcccagggacat

SEQ ID NO: 3014122 - DNA, 21 bp, Homo sapiens
gggcccatggaggagacagga

SEQ ID NO: 3014123 - DNA, 22 bp, Homo sapiens
gggcccatggaggagacaggaa

SEQ ID NO: 3014124 - DNA, 23 bp, Homo sapiens
gggcccccaccgccggggtcctg

SEQ ID NO: 3014125 - DNA, 17 bp, Homo sapiens
gggcccccctgccctgt

SEQ ID NO: 3014126 - DNA, 22 bp, Homo sapiens
gggcccctcacctggtacctgg

SEQ ID NO: 3014127 - DNA, 23 bp, Homo sapiens
gggcccctcacctggtacctgga

SEQ ID NO: 3014128 - DNA, 14 bp, Homo sapiens
gggcccctcccctc

SEQ ID NO: 3014129 - DNA, 16 bp, Homo sapiens
gggcccctcccctcag

SEQ ID NO: 3014130 - DNA, 19 bp, Homo sapiens
gggcccctcccctcagagc

SEQ ID NO: 3014131 - DNA, 15 bp, Homo sapiens
gggcccctgaccctc

SEQ ID NO: 3014132 - DNA, 12 bp, Homo sapiens
gggcccctggca

SEQ ID NO: 3014133 - DNA, 14 bp, Homo sapiens
gggcccctggccca

SEQ ID NO: 3014134 - DNA, 13 bp, Homo sapiens
gggcccggccagc

SEQ ID NO: 3014135 - DNA, 18 bp, Homo sapiens
gggcccggtggcggcagg

SEQ ID NO: 3014136 - DNA, 11 bp, Homo sapiens
gggccctgcat

SEQ ID NO: 3014137 - DNA, 17 bp, Homo sapiens
gggccctttgagtgcag

SEQ ID NO: 3014138 - DNA, 17 bp, Homo sapiens
gggccgaccctgcggcc

SEQ ID NO: 3014139 - DNA, 16 bp, Homo sapiens
gggccgcaagggcctg

SEQ ID NO: 3014140 - DNA, 19 bp, Homo sapiens
ggggagaatgcagcccacc

SEQ ID NO: 3014141 - DNA, 17 bp, Homo sapiens
ggggagactgggctgag

SEQ ID NO: 3014142 - DNA, 18 bp, Homo sapiens
ggggagactgggctgagg

SEQ ID NO: 3014143 - DNA, 21 bp, Homo sapiens
ggggaggaagagagagactgt

SEQ ID NO: 3014144 - DNA, 16 bp, Homo sapiens
ggggaggcggcactcc

SEQ ID NO: 3014145 - DNA, 14 bp, Homo sapiens
ggggagggatgaag

SEQ ID NO: 3014146 - DNA, 10 bp, Homo sapiens
ggggagggcg

SEQ ID NO: 3014147 - DNA, 22 bp, Homo sapiens
ggggaggggcctttgctgccct

SEQ ID NO: 3014148 - DNA, 16 bp, Homo sapiens
ggggagtctgaagcag

SEQ ID NO: 3014149 - DNA, 17 bp, Homo sapiens
ggggagttaagacctgg

SEQ ID NO: 3014150 - DNA, 21 bp, Homo sapiens
ggggagttaagacctggcagc

SEQ ID NO: 3014151 - DNA, 17 bp, Homo sapiens
ggggataccataaaaag

SEQ ID NO: 3014152 - DNA, 13 bp, Homo sapiens
ggggatatgctta

SEQ ID NO: 3014153 - DNA, 16 bp, Homo sapiens
ggggatctgggagggt

SEQ ID NO: 3014154 - DNA, 20 bp, Homo sapiens
ggggatgagagggtgctatc

SEQ ID NO: 3014155 - DNA, 13 bp, Homo sapiens
ggggatggatctt

SEQ ID NO: 3014156 - DNA, 13 bp, Homo sapiens
ggggcacggcagg

SEQ ID NO: 3014157 - DNA, 18 bp, Homo sapiens
ggggcagagggcagaggc

SEQ ID NO: 3014158 - DNA, 10 bp, Homo sapiens
ggggcaggca

SEQ ID NO: 3014159 - DNA, 16 bp, Homo sapiens
ggggcaggggcaggag

SEQ ID NO: 3014160 - DNA, 20 bp, Homo sapiens
ggggcaggtcaggaccagga

SEQ ID NO: 3014161 - DNA, 22 bp, Homo sapiens
ggggcaggtcaggaccaggacc

SEQ ID NO: 3014162 - DNA, 17 bp, Homo sapiens
ggggcatgaccagatgc

SEQ ID NO: 3014163 - DNA, 14 bp, Homo sapiens
ggggccactgtgtt

SEQ ID NO: 3014164 - DNA, 13 bp, Homo sapiens
ggggccagaggct

SEQ ID NO: 3014165 - DNA, 17 bp, Homo sapiens
ggggccagatccagcct

SEQ ID NO: 3014166 - DNA, 19 bp, Homo sapiens
ggggccagatccagcctgg

SEQ ID NO: 3014167 - DNA, 17 bp, Homo sapiens
ggggcccaggggaggcg

SEQ ID NO: 3014168 - DNA, 17 bp, Homo sapiens
ggggcccatgaaagagg

SEQ ID NO: 3014169 - DNA, 16 bp, Homo sapiens
ggggcccatggaggag

SEQ ID NO: 3014170 - DNA, 21 bp, Homo sapiens
ggggcccatggaggagacagg

SEQ ID NO: 3014171 - DNA, 15 bp, Homo sapiens
ggggcccccctgccc

SEQ ID NO: 3014172 - DNA, 18 bp, Homo sapiens
ggggccgccgctgaccct

SEQ ID NO: 3014173 - DNA, 20 bp, Homo sapiens
ggggccgccgctgaccctgg

SEQ ID NO: 3014174 - DNA, 14 bp, Homo sapiens
ggggccgctgccac

SEQ ID NO: 3014175 - DNA, 20 bp, Homo sapiens
ggggccggccctgtgtgcag

SEQ ID NO: 3014176 - DNA, 22 bp, Homo sapiens
ggggccggctggcctggaggct

SEQ ID NO: 3014177 - DNA, 15 bp, Homo sapiens
ggggcctgggcagga

SEQ ID NO: 3014178 - DNA, 12 bp, Homo sapiens
ggggcctgtctc

SEQ ID NO: 3014179 - DNA, 17 bp, Homo sapiens
ggggcctgtctcagtga

SEQ ID NO: 3014180 - DNA, 21 bp, Homo sapiens
ggggcgatcgcggcggagctg

SEQ ID NO: 3014181 - DNA, 22 bp, Homo sapiens
ggggcgccgcaaaccacactgg

SEQ ID NO: 3014182 - DNA, 17 bp, Homo sapiens
ggggcgcctagagcgcg

SEQ ID NO: 3014183 - DNA, 14 bp, Homo sapiens
ggggcggtgtcagg

SEQ ID NO: 3014184 - DNA, 17 bp, Homo sapiens
ggggcggtgtcaggtcc

SEQ ID NO: 3014185 - DNA, 18 bp, Homo sapiens
ggggcgtctgttccccct

SEQ ID NO: 3014186 - DNA, 20 bp, Homo sapiens
ggggcgtctgttcccccttc

SEQ ID NO: 3014187 - DNA, 19 bp, Homo sapiens
ggggctccccgggtctctc

SEQ ID NO: 3014188 - DNA, 18 bp, Homo sapiens
ggggctgaacggggagaa

SEQ ID NO: 3014189 - DNA, 14 bp, Homo sapiens
ggggctgagctggg

SEQ ID NO: 3014190 - DNA, 12 bp, Homo sapiens
ggggctgctggg

SEQ ID NO: 3014191 - DNA, 21 bp, Homo sapiens
ggggctgctgggggctcccct

SEQ ID NO: 3014192 - DNA, 22 bp, Homo sapiens
ggggctgctgggggctcccctt

SEQ ID NO: 3014193 - DNA, 11 bp, Homo sapiens
ggggctgctgt

SEQ ID NO: 3014194 - DNA, 12 bp, Homo sapiens
ggggctggaggt

SEQ ID NO: 3014195 - DNA, 18 bp, Homo sapiens
ggggctggggaaggaagc

SEQ ID NO: 3014196 - DNA, 20 bp, Homo sapiens
ggggctgtgactctgggcag

SEQ ID NO: 3014197 - DNA, 22 bp, Homo sapiens
ggggcttagggtcggaacccaa

SEQ ID NO: 3014198 - DNA, 14 bp, Homo sapiens
ggggcttgaatttg

SEQ ID NO: 3014199 - DNA, 17 bp, Homo sapiens
ggggcttgaatttgcat

SEQ ID NO: 3014200 - DNA, 16 bp, Homo sapiens
ggggctttcggggagg

SEQ ID NO: 3014201 - DNA, 19 bp, Homo sapiens
ggggctttcggggagggcg

SEQ ID NO: 3014202 - DNA, 20 bp, Homo sapiens
ggggctttcgtccacagctt

SEQ ID NO: 3014203 - DNA, 22 bp, Homo sapiens
ggggctttcgtccacagcttcc

SEQ ID NO: 3014204 - DNA, 18 bp, Homo sapiens
gggggagaaggcctcccc

SEQ ID NO: 3014205 - DNA, 17 bp, Homo sapiens
gggggagtctgaagcag

SEQ ID NO: 3014206 - DNA, 21 bp, Homo sapiens
gggggatgccactcctccctc

SEQ ID NO: 3014207 - DNA, 13 bp, Homo sapiens
gggggcagagggc

SEQ ID NO: 3014208 - DNA, 13 bp, Homo sapiens
gggggccaggcct

SEQ ID NO: 3014209 - DNA, 14 bp, Homo sapiens
gggggccttgaaga

SEQ ID NO: 3014210 - DNA, 17 bp, Homo sapiens
gggggccttgaagactc

SEQ ID NO: 3014211 - DNA, 14 bp, Homo sapiens
gggggcgcctggag

SEQ ID NO: 3014212 - DNA, 13 bp, Homo sapiens
gggggtccggaag

SEQ ID NO: 3014213 - DNA, 15 bp, Homo sapiens
gggggtcggaagcct

SEQ ID NO: 3014214 - DNA, 23 bp, Homo sapiens
gggggtggagagaccagcctttc

SEQ ID NO: 3014215 - DNA, 21 bp, Homo sapiens
ggggtaccagccactggaggg

SEQ ID NO: 3014216 - DNA, 13 bp, Homo sapiens
ggggtccagtgca

SEQ ID NO: 3014217 - DNA, 15 bp, Homo sapiens
ggggtcctagcccag

SEQ ID NO: 3014218 - DNA, 12 bp, Homo sapiens
ggggtcctggga

SEQ ID NO: 3014219 - DNA, 13 bp, Homo sapiens
ggggtcctgggag

SEQ ID NO: 3014220 - DNA, 17 bp, Homo sapiens
ggggtcctgggaggctg

SEQ ID NO: 3014221 - DNA, 17 bp, Homo sapiens
ggggtcggacggggcag

SEQ ID NO: 3014222 - DNA, 22 bp, Homo sapiens
ggggtctttgtgagagtgagct

SEQ ID NO: 3014223 - DNA, 20 bp, Homo sapiens
ggggtgaacagctggtgcca

SEQ ID NO: 3014224 - DNA, 16 bp, Homo sapiens
ggggtgatggccagag

SEQ ID NO: 3014225 - DNA, 21 bp, Homo sapiens
ggggtgatggccagaggaatg

SEQ ID NO: 3014226 - DNA, 15 bp, Homo sapiens
ggggtgcactcgcca

SEQ ID NO: 3014227 - DNA, 16 bp, Homo sapiens
ggggtgcccacaggcc

SEQ ID NO: 3014228 - DNA, 17 bp, Homo sapiens
ggggtggcgcgcctgcc

SEQ ID NO: 3014229 - DNA, 17 bp, Homo sapiens
ggggtgggccaggctga

SEQ ID NO: 3014230 - DNA, 18 bp, Homo sapiens
ggggtgttagtggcaccg

SEQ ID NO: 3014231 - DNA, 15 bp, Homo sapiens
ggggttaatttatca

SEQ ID NO: 3014232 - DNA, 17 bp, Homo sapiens
ggggttcagcccctcct

SEQ ID NO: 3014233 - DNA, 21 bp, Homo sapiens
ggggttcagggaactgcttgc

SEQ ID NO: 3014234 - DNA, 17 bp, Homo sapiens
ggggttcataggggcag

SEQ ID NO: 3014235 - DNA, 14 bp, Homo sapiens
ggggttctcagtgc

SEQ ID NO: 3014236 - DNA, 18 bp, Homo sapiens
ggggttgggggacagcct

SEQ ID NO: 3014237 - DNA, 16 bp, Homo sapiens
gggtaaggccccctct

SEQ ID NO: 3014238 - DNA, 21 bp, Homo sapiens
gggtaagggatttcttagggg

SEQ ID NO: 3014239 - DNA, 13 bp, Homo sapiens
gggtaaggtgcct

SEQ ID NO: 3014240 - DNA, 20 bp, Homo sapiens
gggtaatttagattgtaaac

SEQ ID NO: 3014241 - DNA, 17 bp, Homo sapiens
gggtacctgcaagcaga

SEQ ID NO: 3014242 - DNA, 21 bp, Homo sapiens
gggtagaagccacccttccct

SEQ ID NO: 3014243 - DNA, 23 bp, Homo sapiens
gggtagaagccacccttccctgc

SEQ ID NO: 3014244 - DNA, 22 bp, Homo sapiens
gggtagcaggtaccactgattt

SEQ ID NO: 3014245 - DNA, 16 bp, Homo sapiens
gggtagctagaggaac

SEQ ID NO: 3014246 - DNA, 23 bp, Homo sapiens
gggtatatttttgataccttcaa

SEQ ID NO: 3014247 - DNA, 16 bp, Homo sapiens
gggtcaagctgagctg

SEQ ID NO: 3014248 - DNA, 18 bp, Homo sapiens
gggtcaagctgagctggc

SEQ ID NO: 3014249 - DNA, 15 bp, Homo sapiens
gggtcacaggaagga

SEQ ID NO: 3014250 - DNA, 14 bp, Homo sapiens
gggtcaccctgtga

SEQ ID NO: 3014251 - DNA, 22 bp, Homo sapiens
gggtcactccaaggatcagaag

SEQ ID NO: 3014252 - DNA, 23 bp, Homo sapiens
gggtcactgaggcctgagaccca

SEQ ID NO: 3014253 - DNA, 16 bp, Homo sapiens
gggtcaggtgtcaggc

SEQ ID NO: 3014254 - DNA, 18 bp, Homo sapiens
gggtcaggtgtcaggccc

SEQ ID NO: 3014255 - DNA, 15 bp, Homo sapiens
gggtcatccttgccc

SEQ ID NO: 3014256 - DNA, 13 bp, Homo sapiens
gggtcatttttaa

SEQ ID NO: 3014257 - DNA, 15 bp, Homo sapiens
gggtccacttgccag

SEQ ID NO: 3014258 - DNA, 18 bp, Homo sapiens
gggtccacttgccagggc

SEQ ID NO: 3014259 - DNA, 19 bp, Homo sapiens
gggtccacttgccagggct

SEQ ID NO: 3014260 - DNA, 12 bp, Homo sapiens
gggtccatgggc

SEQ ID NO: 3014261 - DNA, 17 bp, Homo sapiens
gggtccctagcagccca

SEQ ID NO: 3014262 - DNA, 22 bp, Homo sapiens
gggtcctcacctggttgaccca

SEQ ID NO: 3014263 - DNA, 13 bp, Homo sapiens
gggtcctcttctg

SEQ ID NO: 3014264 - DNA, 13 bp, Homo sapiens
gggtcctgcctgc

SEQ ID NO: 3014265 - DNA, 15 bp, Homo sapiens
gggtcctgcctgcag

SEQ ID NO: 3014266 - DNA, 16 bp, Homo sapiens
gggtcctgggaggctg

SEQ ID NO: 3014267 - DNA, 21 bp, Homo sapiens
gggtcctgggaggctgcagcc

SEQ ID NO: 3014268 - DNA, 24 bp, Homo sapiens
gggtcctgggaggctgcagccagg

SEQ ID NO: 3014269 - DNA, 23 bp, Homo sapiens
gggtcctgggcaggtgggagctg

SEQ ID NO: 3014270 - DNA, 16 bp, Homo sapiens
gggtcggaagcctgtc

SEQ ID NO: 3014271 - DNA, 19 bp, Homo sapiens
gggtcggaagcctgtcctc

SEQ ID NO: 3014272 - DNA, 22 bp, Homo sapiens
gggtctaaggagcgctagtgcc

SEQ ID NO: 3014273 - DNA, 19 bp, Homo sapiens
gggtctagccgctgccctg

SEQ ID NO: 3014274 - DNA, 14 bp, Homo sapiens
gggtctcactctgt

SEQ ID NO: 3014275 - DNA, 17 bp, Homo sapiens
gggtctcactctgttgc

SEQ ID NO: 3014276 - DNA, 16 bp, Homo sapiens
gggtctccctctcctg

SEQ ID NO: 3014277 - DNA, 21 bp, Homo sapiens
gggtctctcactgttgcagtg

SEQ ID NO: 3014278 - DNA, 12 bp, Homo sapiens
gggtctctggaa

SEQ ID NO: 3014279 - DNA, 18 bp, Homo sapiens
gggtctggactaaccctg

SEQ ID NO: 3014280 - DNA, 20 bp, Homo sapiens
gggtctggagttgatctgga

SEQ ID NO: 3014281 - DNA, 19 bp, Homo sapiens
gggtctggctagagggccc

SEQ ID NO: 3014282 - DNA, 17 bp, Homo sapiens
gggtctttttctcttct

SEQ ID NO: 3014283 - DNA, 18 bp, Homo sapiens
gggtctttttctcttctg

SEQ ID NO: 3014284 - DNA, 14 bp, Homo sapiens
gggtgaacagctgg

SEQ ID NO: 3014285 - DNA, 14 bp, Homo sapiens
gggtgaaggcagga

SEQ ID NO: 3014286 - DNA, 14 bp, Homo sapiens
gggtgaaggctggc

SEQ ID NO: 3014287 - DNA, 21 bp, Homo sapiens
gggtgacaagatagagagcta

SEQ ID NO: 3014288 - DNA, 14 bp, Homo sapiens
gggtgacacagact

SEQ ID NO: 3014289 - DNA, 15 bp, Homo sapiens
gggtgagagcaccca

SEQ ID NO: 3014290 - DNA, 16 bp, Homo sapiens
gggtgagagcacccac

SEQ ID NO: 3014291 - DNA, 17 bp, Homo sapiens
gggtgagaggaagggtg

SEQ ID NO: 3014292 - DNA, 12 bp, Homo sapiens
gggtgcaggtgg

SEQ ID NO: 3014293 - DNA, 18 bp, Homo sapiens
gggtgccaaataaatgct

SEQ ID NO: 3014294 - DNA, 23 bp, Homo sapiens
gggtgcccgtaatcccagctact

SEQ ID NO: 3014295 - DNA, 11 bp, Homo sapiens
gggtgccctga

SEQ ID NO: 3014296 - DNA, 18 bp, Homo sapiens
gggtgctaggcccctgtg

SEQ ID NO: 3014297 - DNA, 14 bp, Homo sapiens
gggtggcaggtcac

SEQ ID NO: 3014298 - DNA, 14 bp, Homo sapiens
gggtggcgcgcctg

SEQ ID NO: 3014299 - DNA, 20 bp, Homo sapiens
gggtgggaaggggctaggga

SEQ ID NO: 3014300 - DNA, 14 bp, Homo sapiens
gggtgggaggggcc

SEQ ID NO: 3014301 - DNA, 13 bp, Homo sapiens
gggtgggccaggc

SEQ ID NO: 3014302 - DNA, 11 bp, Homo sapiens
gggtgggcctc

SEQ ID NO: 3014303 - DNA, 14 bp, Homo sapiens
gggtggggagagac

SEQ ID NO: 3014304 - DNA, 19 bp, Homo sapiens
gggtggggggcttcataca

SEQ ID NO: 3014305 - DNA, 22 bp, Homo sapiens
gggtggtctcttcttggggccc

SEQ ID NO: 3014306 - DNA, 19 bp, Homo sapiens
gggtggtttttatttttat

SEQ ID NO: 3014307 - DNA, 16 bp, Homo sapiens
gggtgtgggaggcccg

SEQ ID NO: 3014308 - DNA, 15 bp, Homo sapiens
gggtgtggtggcctg

SEQ ID NO: 3014309 - DNA, 20 bp, Homo sapiens
gggttaagtgggcattttga

SEQ ID NO: 3014310 - DNA, 22 bp, Homo sapiens
gggttacagtatgcttgctcta

SEQ ID NO: 3014311 - DNA, 20 bp, Homo sapiens
gggttcacgccattctcctg

SEQ ID NO: 3014312 - DNA, 16 bp, Homo sapiens
gggttcagcccctcct

SEQ ID NO: 3014313 - DNA, 19 bp, Homo sapiens
gggttcagcccctcctctg

SEQ ID NO: 3014314 - DNA, 21 bp, Homo sapiens
gggttcagcccctcctctgcc

SEQ ID NO: 3014315 - DNA, 22 bp, Homo sapiens
gggttcagcccctcctctgcca

SEQ ID NO: 3014316 - DNA, 18 bp, Homo sapiens
gggttcataggggcaggt

SEQ ID NO: 3014317 - DNA, 17 bp, Homo sapiens
gggttctccccctcctg

SEQ ID NO: 3014318 - DNA, 20 bp, Homo sapiens
gggttctgcctgccagctgc

SEQ ID NO: 3014319 - DNA, 21 bp, Homo sapiens
gggttctgcctgccagctgca

SEQ ID NO: 3014320 - DNA, 16 bp, Homo sapiens
gggttcttgagccagc

SEQ ID NO: 3014321 - DNA, 21 bp, Homo sapiens
gggttggagcagtagctggag

SEQ ID NO: 3014322 - DNA, 19 bp, Homo sapiens
gggttgtggcccccgcccc

SEQ ID NO: 3014323 - DNA, 20 bp, Homo sapiens
gggtttcaccatgttagccg

SEQ ID NO: 3014324 - DNA, 16 bp, Homo sapiens
gggtttcttaaatata

SEQ ID NO: 3014325 - DNA, 14 bp, Homo sapiens
gggtttgagcacaa

SEQ ID NO: 3014326 - DNA, 12 bp, Homo sapiens
gggttttggcct

SEQ ID NO: 3014327 - DNA, 14 bp, Homo sapiens
gggttttggcctgc

SEQ ID NO: 3014328 - DNA, 13 bp, Homo sapiens
ggtaaaaaaaaga

SEQ ID NO: 3014329 - DNA, 14 bp, Homo sapiens
ggtaaaacaaaaca

SEQ ID NO: 3014330 - DNA, 19 bp, Homo sapiens
ggtaaagaaaagcctcagc

SEQ ID NO: 3014331 - DNA, 21 bp, Homo sapiens
ggtaaagaaaagcctcagctc

SEQ ID NO: 3014332 - DNA, 16 bp, Homo sapiens
ggtaaagactggcttt

SEQ ID NO: 3014333 - DNA, 14 bp, Homo sapiens
ggtaaaggatgagg

SEQ ID NO: 3014334 - DNA, 20 bp, Homo sapiens
ggtaaatgccacacaccttt

SEQ ID NO: 3014335 - DNA, 18 bp, Homo sapiens
ggtaaatttccccaacag

SEQ ID NO: 3014336 - DNA, 16 bp, Homo sapiens
ggtaagcggaataaac

SEQ ID NO: 3014337 - DNA, 21 bp, Homo sapiens
ggtaagctagagagaaaaaga

SEQ ID NO: 3014338 - DNA, 23 bp, Homo sapiens
ggtaataagcataagaccaatct

SEQ ID NO: 3014339 - DNA, 13 bp, Homo sapiens
ggtaatatatata

SEQ ID NO: 3014340 - DNA, 12 bp, Homo sapiens
ggtaattgtaca

SEQ ID NO: 3014341 - DNA, 14 bp, Homo sapiens
ggtacaaaaataaa

SEQ ID NO: 3014342 - DNA, 21 bp, Homo sapiens
ggtacaacctttattcttttc

SEQ ID NO: 3014343 - DNA, 14 bp, Homo sapiens
ggtacaacggaggc

SEQ ID NO: 3014344 - DNA, 16 bp, Homo sapiens
ggtacaacggaggcct

SEQ ID NO: 3014345 - DNA, 18 bp, Homo sapiens
ggtacagctgtatataaa

SEQ ID NO: 3014346 - DNA, 15 bp, Homo sapiens
ggtacagttgcagga

SEQ ID NO: 3014347 - DNA, 16 bp, Homo sapiens
ggtacagttgcaggag

SEQ ID NO: 3014348 - DNA, 17 bp, Homo sapiens
ggtacatttttcaactt

SEQ ID NO: 3014349 - DNA, 16 bp, Homo sapiens
ggtacccaattcaatt

SEQ ID NO: 3014350 - DNA, 13 bp, Homo sapiens
ggtaccctgggtg

SEQ ID NO: 3014351 - DNA, 14 bp, Homo sapiens
ggtacgcacagaca

SEQ ID NO: 3014352 - DNA, 16 bp, Homo sapiens
ggtacgcacagacagg

SEQ ID NO: 3014353 - DNA, 15 bp, Homo sapiens
ggtactaaggagaat

SEQ ID NO: 3014354 - DNA, 15 bp, Homo sapiens
ggtacttcttgaagg

SEQ ID NO: 3014355 - DNA, 16 bp, Homo sapiens
ggtacttggagggctc

SEQ ID NO: 3014356 - DNA, 17 bp, Homo sapiens
ggtactttttgtgaaga

SEQ ID NO: 3014357 - DNA, 15 bp, Homo sapiens
ggtagaaggaaagca

SEQ ID NO: 3014358 - DNA, 15 bp, Homo sapiens
ggtagaatgtaaagc

SEQ ID NO: 3014359 - DNA, 18 bp, Homo sapiens
ggtagagcaaaggagaca

SEQ ID NO: 3014360 - DNA, 12 bp, Homo sapiens
ggtagaggaaga

SEQ ID NO: 3014361 - DNA, 18 bp, Homo sapiens
ggtagagtttacagctct

SEQ ID NO: 3014362 - DNA, 22 bp, Homo sapiens
ggtagagtttatttttttgatg

SEQ ID NO: 3014363 - DNA, 14 bp, Homo sapiens
ggtagcagcaaata

SEQ ID NO: 3014364 - DNA, 16 bp, Homo sapiens
ggtagccagcacacag

SEQ ID NO: 3014365 - DNA, 21 bp, Homo sapiens
ggtagccagcacacagggcag

SEQ ID NO: 3014366 - DNA, 17 bp, Homo sapiens
ggtagctagaggaacca

SEQ ID NO: 3014367 - DNA, 15 bp, Homo sapiens
ggtagctgcccctgg

SEQ ID NO: 3014368 - DNA, 18 bp, Homo sapiens
ggtagctgcccctggctc

SEQ ID NO: 3014369 - DNA, 14 bp, Homo sapiens
ggtaggaggaggca

SEQ ID NO: 3014370 - DNA, 21 bp, Homo sapiens
ggtaggaggaggcatggaaac

SEQ ID NO: 3014371 - DNA, 21 bp, Homo sapiens
ggtaggccccacaaggcctgg

SEQ ID NO: 3014372 - DNA, 19 bp, Homo sapiens
ggtagtgctttaagaatga

SEQ ID NO: 3014373 - DNA, 21 bp, Homo sapiens
ggtataaagctctcaaatgtg

SEQ ID NO: 3014374 - DNA, 18 bp, Homo sapiens
ggtatatatccgcctggc

SEQ ID NO: 3014375 - DNA, 22 bp, Homo sapiens
ggtatatcattataactgaagg

SEQ ID NO: 3014376 - DNA, 18 bp, Homo sapiens
ggtattctgtaatttggc

SEQ ID NO: 3014377 - DNA, 13 bp, Homo sapiens
ggtatttgtttgt

SEQ ID NO: 3014378 - DNA, 18 bp, Homo sapiens
ggtatttttgccctgagt

SEQ ID NO: 3014379 - DNA, 11 bp, Homo sapiens
ggtcaacagaa

SEQ ID NO: 3014380 - DNA, 18 bp, Homo sapiens
ggtcaacagaatgaaaaa

SEQ ID NO: 3014381 - DNA, 20 bp, Homo sapiens
ggtcaacagagaaggcagga

SEQ ID NO: 3014382 - DNA, 22 bp, Homo sapiens
ggtcaacagttttcctatgctt

SEQ ID NO: 3014383 - DNA, 17 bp, Homo sapiens
ggtcaagctgagctggc

SEQ ID NO: 3014384 - DNA, 19 bp, Homo sapiens
ggtcaagctgagctggctt

SEQ ID NO: 3014385 - DNA, 23 bp, Homo sapiens
ggtcaataaacttagaggaaaat

SEQ ID NO: 3014386 - DNA, 21 bp, Homo sapiens
ggtcacccagactagacacct

SEQ ID NO: 3014387 - DNA, 24 bp, Homo sapiens
ggtcactgaggcctgagacccagg

SEQ ID NO: 3014388 - DNA, 13 bp, Homo sapiens
ggtcactgtcact

SEQ ID NO: 3014389 - DNA, 14 bp, Homo sapiens
ggtcactgtcactg

SEQ ID NO: 3014390 - DNA, 17 bp, Homo sapiens
ggtcagaaacaggaccg

SEQ ID NO: 3014391 - DNA, 18 bp, Homo sapiens
ggtcagaaacaggaccgg

SEQ ID NO: 3014392 - DNA, 18 bp, Homo sapiens
ggtcagacccatctctcc

SEQ ID NO: 3014393 - DNA, 22 bp, Homo sapiens
ggtcagagaaaatgagaaagga

SEQ ID NO: 3014394 - DNA, 22 bp, Homo sapiens
ggtcagagtggcgtgagctgcc

SEQ ID NO: 3014395 - DNA, 23 bp, Homo sapiens
ggtcagagtggcgtgagctgccc

SEQ ID NO: 3014396 - DNA, 13 bp, Homo sapiens
ggtcagcgagaag

SEQ ID NO: 3014397 - DNA, 17 bp, Homo sapiens
ggtcaggtgtcaggccc

SEQ ID NO: 3014398 - DNA, 14 bp, Homo sapiens
ggtcatccttgccc

SEQ ID NO: 3014399 - DNA, 20 bp, Homo sapiens
ggtcatccttggtgctcttg

SEQ ID NO: 3014400 - DNA, 15 bp, Homo sapiens
ggtcatgccctcctc

SEQ ID NO: 3014401 - DNA, 20 bp, Homo sapiens
ggtcattcctaatgcattag

SEQ ID NO: 3014402 - DNA, 19 bp, Homo sapiens
ggtccaaaaaaaggaaaaa

SEQ ID NO: 3014403 - DNA, 20 bp, Homo sapiens
ggtccaaaaaaaggaaaaat

SEQ ID NO: 3014404 - DNA, 17 bp, Homo sapiens
ggtccaacgccgccttg

SEQ ID NO: 3014405 - DNA, 15 bp, Homo sapiens
ggtccacttgccagg

SEQ ID NO: 3014406 - DNA, 16 bp, Homo sapiens
ggtccacttgccaggg

SEQ ID NO: 3014407 - DNA, 20 bp, Homo sapiens
ggtccagaaggagacaggca

SEQ ID NO: 3014408 - DNA, 21 bp, Homo sapiens
ggtccagaaggagacaggcag

SEQ ID NO: 3014409 - DNA, 12 bp, Homo sapiens
ggtccagggagc

SEQ ID NO: 3014410 - DNA, 16 bp, Homo sapiens
ggtccatgggcagagc

SEQ ID NO: 3014411 - DNA, 18 bp, Homo sapiens
ggtcccagcgagccacag

SEQ ID NO: 3014412 - DNA, 20 bp, Homo sapiens
ggtcccagcgagccacagga

SEQ ID NO: 3014413 - DNA, 18 bp, Homo sapiens
ggtcccaggaagcaggga

SEQ ID NO: 3014414 - DNA, 20 bp, Homo sapiens
ggtcccaggaagcagggaga

SEQ ID NO: 3014415 - DNA, 21 bp, Homo sapiens
ggtcccattgttggcgctgag

SEQ ID NO: 3014416 - DNA, 16 bp, Homo sapiens
ggtccccacagactgc

SEQ ID NO: 3014417 - DNA, 22 bp, Homo sapiens
ggtccccacagactgccccagc

SEQ ID NO: 3014418 - DNA, 17 bp, Homo sapiens
ggtccccgccctctctc

SEQ ID NO: 3014419 - DNA, 12 bp, Homo sapiens
ggtcccctgcca

SEQ ID NO: 3014420 - DNA, 14 bp, Homo sapiens
ggtcccctggcagt

SEQ ID NO: 3014421 - DNA, 20 bp, Homo sapiens
ggtccctccagaaccacccc

SEQ ID NO: 3014422 - DNA, 15 bp, Homo sapiens
ggtccgcatccctgc

SEQ ID NO: 3014423 - DNA, 16 bp, Homo sapiens
ggtccgcatccctgct

SEQ ID NO: 3014424 - DNA, 17 bp, Homo sapiens
ggtccgcatccctgctt

SEQ ID NO: 3014425 - DNA, 14 bp, Homo sapiens
ggtccgcggcctgc

SEQ ID NO: 3014426 - DNA, 15 bp, Homo sapiens
ggtccgcggcctgca

SEQ ID NO: 3014427 - DNA, 15 bp, Homo sapiens
ggtccggaagggtga

SEQ ID NO: 3014428 - DNA, 21 bp, Homo sapiens
ggtcctagcccagtgcttctc

SEQ ID NO: 3014429 - DNA, 19 bp, Homo sapiens
ggtcctagtcgggcagggc

SEQ ID NO: 3014430 - DNA, 14 bp, Homo sapiens
ggtcctcagctgct

SEQ ID NO: 3014431 - DNA, 17 bp, Homo sapiens
ggtcctcagctgctccc

SEQ ID NO: 3014432 - DNA, 16 bp, Homo sapiens
ggtcctccgcctactg

SEQ ID NO: 3014433 - DNA, 20 bp, Homo sapiens
ggtcctcggcccatctgtcc

SEQ ID NO: 3014434 - DNA, 17 bp, Homo sapiens
ggtcctgaaagtaactc

SEQ ID NO: 3014435 - DNA, 23 bp, Homo sapiens
ggtcctgcacagattcccaggcc

SEQ ID NO: 3014436 - DNA, 12 bp, Homo sapiens
ggtcctgcctgc

SEQ ID NO: 3014437 - DNA, 15 bp, Homo sapiens
ggtcctgcctgcagt

SEQ ID NO: 3014438 - DNA, 20 bp, Homo sapiens
ggtcctgctccgctgcctgg

SEQ ID NO: 3014439 - DNA, 23 bp, Homo sapiens
ggtcctgctccgctgcctggaac

SEQ ID NO: 3014440 - DNA, 21 bp, Homo sapiens
ggtcctggccatcccacaagt

SEQ ID NO: 3014441 - DNA, 15 bp, Homo sapiens
ggtcctggctgcact

SEQ ID NO: 3014442 - DNA, 16 bp, Homo sapiens
ggtcctgggaggctgc

SEQ ID NO: 3014443 - DNA, 21 bp, Homo sapiens
ggtcctgggaggctgcagcca

SEQ ID NO: 3014444 - DNA, 23 bp, Homo sapiens
ggtcctgggcaggtgggagctga

SEQ ID NO: 3014445 - DNA, 23 bp, Homo sapiens
ggtccttcactggcgccttctcg

SEQ ID NO: 3014446 - DNA, 14 bp, Homo sapiens
ggtccttgggcctg

SEQ ID NO: 3014447 - DNA, 19 bp, Homo sapiens
ggtctaaataggatcctgg

SEQ ID NO: 3014448 - DNA, 19 bp, Homo sapiens
ggtctagccgctgccctgg

SEQ ID NO: 3014449 - DNA, 23 bp, Homo sapiens
ggtctatgtcgagagctggccaa

SEQ ID NO: 3014450 - DNA, 18 bp, Homo sapiens
ggtctattccagctcatt

SEQ ID NO: 3014451 - DNA, 20 bp, Homo sapiens
ggtctattccagctcattca

SEQ ID NO: 3014452 - DNA, 16 bp, Homo sapiens
ggtctcacactcctcc

SEQ ID NO: 3014453 - DNA, 21 bp, Homo sapiens
ggtctcacactcctcctgcca

SEQ ID NO: 3014454 - DNA, 23 bp, Homo sapiens
ggtctcacccatgcaagcagagg

SEQ ID NO: 3014455 - DNA, 19 bp, Homo sapiens
ggtctcactctgttgccca

SEQ ID NO: 3014456 - DNA, 14 bp, Homo sapiens
ggtctccctctcct

SEQ ID NO: 3014457 - DNA, 16 bp, Homo sapiens
ggtctcgaactcctga

SEQ ID NO: 3014458 - DNA, 11 bp, Homo sapiens
ggtctctcctt

SEQ ID NO: 3014459 - DNA, 13 bp, Homo sapiens
ggtctctggctct

SEQ ID NO: 3014460 - DNA, 21 bp, Homo sapiens
ggtctcttcttggggcccagt

SEQ ID NO: 3014461 - DNA, 21 bp, Homo sapiens
ggtctgaaaagaggagccaga

SEQ ID NO: 3014462 - DNA, 15 bp, Homo sapiens
ggtctgagctgtccc

SEQ ID NO: 3014463 - DNA, 19 bp, Homo sapiens
ggtctgagctgtcccaagt

SEQ ID NO: 3014464 - DNA, 15 bp, Homo sapiens
ggtctgatttgcagg

SEQ ID NO: 3014465 - DNA, 17 bp, Homo sapiens
ggtctgcaagggcccag

SEQ ID NO: 3014466 - DNA, 20 bp, Homo sapiens
ggtctgcaagggcccagagt

SEQ ID NO: 3014467 - DNA, 13 bp, Homo sapiens
ggtctgcaggcag

SEQ ID NO: 3014468 - DNA, 23 bp, Homo sapiens
ggtctgcaggcagggctgactct

SEQ ID NO: 3014469 - DNA, 17 bp, Homo sapiens
ggtctgccaggccccca

SEQ ID NO: 3014470 - DNA, 12 bp, Homo sapiens
ggtctggctaga

SEQ ID NO: 3014471 - DNA, 20 bp, Homo sapiens
ggtctggctagagggcccaa

SEQ ID NO: 3014472 - DNA, 16 bp, Homo sapiens
ggtctgtcctgacagc

SEQ ID NO: 3014473 - DNA, 13 bp, Homo sapiens
ggtctgttcttga

SEQ ID NO: 3014474 - DNA, 18 bp, Homo sapiens
ggtctgttcttgaagcag

SEQ ID NO: 3014475 - DNA, 14 bp, Homo sapiens
ggtcttaagaaatg

SEQ ID NO: 3014476 - DNA, 18 bp, Homo sapiens
ggtcttagctctttctct

SEQ ID NO: 3014477 - DNA, 18 bp, Homo sapiens
ggtcttcctgtggctccc

SEQ ID NO: 3014478 - DNA, 19 bp, Homo sapiens
ggtcttcctgtggctccct

SEQ ID NO: 3014479 - DNA, 20 bp, Homo sapiens
ggtcttgggaaatatgaatg

SEQ ID NO: 3014480 - DNA, 12 bp, Homo sapiens
ggtctttgtaag

SEQ ID NO: 3014481 - DNA, 17 bp, Homo sapiens
ggtctttttctcttctg

SEQ ID NO: 3014482 - DNA, 21 bp, Homo sapiens
ggtctttttctcttctgttct

SEQ ID NO: 3014483 - DNA, 14 bp, Homo sapiens
ggtgaaacccccat

SEQ ID NO: 3014484 - DNA, 18 bp, Homo sapiens
ggtgaacaaagcagccac

SEQ ID NO: 3014485 - DNA, 18 bp, Homo sapiens
ggtgaacagctggtgcca

SEQ ID NO: 3014486 - DNA, 13 bp, Homo sapiens
ggtgaatatggaa

SEQ ID NO: 3014487 - DNA, 15 bp, Homo sapiens
ggtgacacagactca

SEQ ID NO: 3014488 - DNA, 20 bp, Homo sapiens
ggtgacacagactcatcctg

SEQ ID NO: 3014489 - DNA, 12 bp, Homo sapiens
ggtgactctgtc

SEQ ID NO: 3014490 - DNA, 13 bp, Homo sapiens
ggtgactctgtcc

SEQ ID NO: 3014491 - DNA, 21 bp, Homo sapiens
ggtgacttcaggtggagagca

SEQ ID NO: 3014492 - DNA, 13 bp, Homo sapiens
ggtgactttctga

SEQ ID NO: 3014493 - DNA, 18 bp, Homo sapiens
ggtgagcagacaggacag

SEQ ID NO: 3014494 - DNA, 16 bp, Homo sapiens
ggtgagcagtaactgt

SEQ ID NO: 3014495 - DNA, 13 bp, Homo sapiens
ggtgagctggtgc

SEQ ID NO: 3014496 - DNA, 21 bp, Homo sapiens
ggtgaggccggccctgcccct

SEQ ID NO: 3014497 - DNA, 23 bp, Homo sapiens
ggtgaggccggccctgcccctcc

SEQ ID NO: 3014498 - DNA, 12 bp, Homo sapiens
ggtgaggcctgt

SEQ ID NO: 3014499 - DNA, 19 bp, Homo sapiens
ggtgaggcctgtctgtgac

SEQ ID NO: 3014500 - DNA, 19 bp, Homo sapiens
ggtgaggcgttctcctgct

SEQ ID NO: 3014501 - DNA, 16 bp, Homo sapiens
ggtgagtaaggcatgt

SEQ ID NO: 3014502 - DNA, 16 bp, Homo sapiens
ggtgatggaaaaagcg

SEQ ID NO: 3014503 - DNA, 22 bp, Homo sapiens
ggtgatggaaaaagcgctgttt

SEQ ID NO: 3014504 - DNA, 18 bp, Homo sapiens
ggtgatgtagcccatcct

SEQ ID NO: 3014505 - DNA, 22 bp, Homo sapiens
ggtgattacataatctgtacaa

SEQ ID NO: 3014506 - DNA, 16 bp, Homo sapiens
ggtgcactttgtaaat

SEQ ID NO: 3014507 - DNA, 23 bp, Homo sapiens
ggtgcagagggtttgtgcccagt

SEQ ID NO: 3014508 - DNA, 17 bp, Homo sapiens
ggtgcagccagaggcac

SEQ ID NO: 3014509 - DNA, 18 bp, Homo sapiens
ggtgcagtttgaggggcc

SEQ ID NO: 3014510 - DNA, 16 bp, Homo sapiens
ggtgcatgcaggtctc

SEQ ID NO: 3014511 - DNA, 21 bp, Homo sapiens
ggtgccaaatagccccagact

SEQ ID NO: 3014512 - DNA, 17 bp, Homo sapiens
ggtgccagaaggaaggt

SEQ ID NO: 3014513 - DNA, 22 bp, Homo sapiens
ggtgcccagctatacctgtgcc

SEQ ID NO: 3014514 - DNA, 14 bp, Homo sapiens
ggtgccccaggacc

SEQ ID NO: 3014515 - DNA, 14 bp, Homo sapiens
ggtgcccccagaca

SEQ ID NO: 3014516 - DNA, 19 bp, Homo sapiens
ggtgcccgtaatcccagct

SEQ ID NO: 3014517 - DNA, 16 bp, Homo sapiens
ggtgccctgaaagggc

SEQ ID NO: 3014518 - DNA, 22 bp, Homo sapiens
ggtgcccttggaggccagccag

SEQ ID NO: 3014519 - DNA, 16 bp, Homo sapiens
ggtgcctgagcccctc

SEQ ID NO: 3014520 - DNA, 17 bp, Homo sapiens
ggtgcctgagcccctca

SEQ ID NO: 3014521 - DNA, 18 bp, Homo sapiens
ggtgcctgtgaggcaggg

SEQ ID NO: 3014522 - DNA, 23 bp, Homo sapiens
ggtgccttcttattctcactcca

SEQ ID NO: 3014523 - DNA, 19 bp, Homo sapiens
ggtgcctttcaaatttaga

SEQ ID NO: 3014524 - DNA, 16 bp, Homo sapiens
ggtgcgtttttacagt

SEQ ID NO: 3014525 - DNA, 21 bp, Homo sapiens
ggtgctaaagccaaccagcct

SEQ ID NO: 3014526 - DNA, 16 bp, Homo sapiens
ggtgctaatattttat

SEQ ID NO: 3014527 - DNA, 20 bp, Homo sapiens
ggtgctaatattttatttga

SEQ ID NO: 3014528 - DNA, 15 bp, Homo sapiens
ggtgctaggcccctg

SEQ ID NO: 3014529 - DNA, 20 bp, Homo sapiens
ggtgctaggcccctgtgtag

SEQ ID NO: 3014530 - DNA, 22 bp, Homo sapiens
ggtgctaggcccctgtgtagta

SEQ ID NO: 3014531 - DNA, 17 bp, Homo sapiens
ggtgctccatctccgcc

SEQ ID NO: 3014532 - DNA, 15 bp, Homo sapiens
ggtgctccctctgtc

SEQ ID NO: 3014533 - DNA, 19 bp, Homo sapiens
ggtgctcctgcccagccac

SEQ ID NO: 3014534 - DNA, 15 bp, Homo sapiens
ggtgctcgggaaggg

SEQ ID NO: 3014535 - DNA, 12 bp, Homo sapiens
ggtgctctgtct

SEQ ID NO: 3014536 - DNA, 15 bp, Homo sapiens
ggtgctgcccaggcc

SEQ ID NO: 3014537 - DNA, 14 bp, Homo sapiens
ggtgctggcccagc

SEQ ID NO: 3014538 - DNA, 20 bp, Homo sapiens
ggtgctggggagccaaaggc

SEQ ID NO: 3014539 - DNA, 15 bp, Homo sapiens
ggtgctggtagctga

SEQ ID NO: 3014540 - DNA, 19 bp, Homo sapiens
ggtgctggtagctgagggg

SEQ ID NO: 3014541 - DNA, 20 bp, Homo sapiens
ggtgctgtcctcaggtggcc

SEQ ID NO: 3014542 - DNA, 23 bp, Homo sapiens
ggtgctgtcctcaggtggccatg

SEQ ID NO: 3014543 - DNA, 16 bp, Homo sapiens
ggtggaaaacagggtg

SEQ ID NO: 3014544 - DNA, 15 bp, Homo sapiens
ggtggaacaagcaca

SEQ ID NO: 3014545 - DNA, 14 bp, Homo sapiens
ggtggaagagctca

SEQ ID NO: 3014546 - DNA, 19 bp, Homo sapiens
ggtggaagccctccttcca

SEQ ID NO: 3014547 - DNA, 20 bp, Homo sapiens
ggtggaagccctccttccac

SEQ ID NO: 3014548 - DNA, 15 bp, Homo sapiens
ggtggactcgcctgt

SEQ ID NO: 3014549 - DNA, 13 bp, Homo sapiens
ggtggagaagcca

SEQ ID NO: 3014550 - DNA, 20 bp, Homo sapiens
ggtggaggagctgagggagg

SEQ ID NO: 3014551 - DNA, 21 bp, Homo sapiens
ggtggaggagctgagggaggg

SEQ ID NO: 3014552 - DNA, 22 bp, Homo sapiens
ggtggatggtgacttttgaaga

SEQ ID NO: 3014553 - DNA, 14 bp, Homo sapiens
ggtggatgtgagca

SEQ ID NO: 3014554 - DNA, 17 bp, Homo sapiens
ggtggatgtgagcagaa

SEQ ID NO: 3014555 - DNA, 22 bp, Homo sapiens
ggtggattctccctgggcctca

SEQ ID NO: 3014556 - DNA, 18 bp, Homo sapiens
ggtggcacatctgtcctg

SEQ ID NO: 3014557 - DNA, 23 bp, Homo sapiens
ggtggcaccagcgaagggagtgc

SEQ ID NO: 3014558 - DNA, 14 bp, Homo sapiens
ggtggcactaggga

SEQ ID NO: 3014559 - DNA, 19 bp, Homo sapiens
ggtggcaggcgcctataat

SEQ ID NO: 3014560 - DNA, 21 bp, Homo sapiens
ggtggcatgcacctgcaatcc

SEQ ID NO: 3014561 - DNA, 16 bp, Homo sapiens
ggtggccacagcgtgc

SEQ ID NO: 3014562 - DNA, 17 bp, Homo sapiens
ggtggccacagcgtgct

SEQ ID NO: 3014563 - DNA, 22 bp, Homo sapiens
ggtggcccctgctgtctctctg

SEQ ID NO: 3014564 - DNA, 20 bp, Homo sapiens
ggtggccctgactgtcaggg

SEQ ID NO: 3014565 - DNA, 16 bp, Homo sapiens
ggtggcgcgcctgcct

SEQ ID NO: 3014566 - DNA, 12 bp, Homo sapiens
ggtggcggcagg

SEQ ID NO: 3014567 - DNA, 16 bp, Homo sapiens
ggtggctagtcagaga

SEQ ID NO: 3014568 - DNA, 19 bp, Homo sapiens
ggtggctcacacctgtaat

SEQ ID NO: 3014569 - DNA, 22 bp, Homo sapiens
ggtggctgacccagtccctggg

SEQ ID NO: 3014570 - DNA, 17 bp, Homo sapiens
ggtggctgggcccagca

SEQ ID NO: 3014571 - DNA, 23 bp, Homo sapiens
ggtggctgggcccagcaggggcc

SEQ ID NO: 3014572 - DNA, 17 bp, Homo sapiens
ggtggcttcagctccag

SEQ ID NO: 3014573 - DNA, 15 bp, Homo sapiens
ggtgggaggccaggc

SEQ ID NO: 3014574 - DNA, 17 bp, Homo sapiens
ggtgggcacccaccctg

SEQ ID NO: 3014575 - DNA, 23 bp, Homo sapiens
ggtgggcagcagcatcccagcct

SEQ ID NO: 3014576 - DNA, 17 bp, Homo sapiens
ggtgggcttcagggcag

SEQ ID NO: 3014577 - DNA, 17 bp, Homo sapiens
ggtggggctgctcctcc

SEQ ID NO: 3014578 - DNA, 21 bp, Homo sapiens
ggtgggggagaaaaaatcact

SEQ ID NO: 3014579 - DNA, 13 bp, Homo sapiens
ggtgggggccagg

SEQ ID NO: 3014580 - DNA, 14 bp, Homo sapiens
ggtgggggccaggc

SEQ ID NO: 3014581 - DNA, 15 bp, Homo sapiens
ggtgggggccaggcc

SEQ ID NO: 3014582 - DNA, 15 bp, Homo sapiens
ggtgggggctggagg

SEQ ID NO: 3014583 - DNA, 15 bp, Homo sapiens
ggtggggtcatgccc

SEQ ID NO: 3014584 - DNA, 18 bp, Homo sapiens
ggtggggtgatggccaga

SEQ ID NO: 3014585 - DNA, 15 bp, Homo sapiens
ggtggggtgcactcg

SEQ ID NO: 3014586 - DNA, 10 bp, Homo sapiens
ggtgggtcca

SEQ ID NO: 3014587 - DNA, 20 bp, Homo sapiens
ggtgggtccgcatccctgct

SEQ ID NO: 3014588 - DNA, 15 bp, Homo sapiens
ggtgggtggtgggct

SEQ ID NO: 3014589 - DNA, 18 bp, Homo sapiens
ggtggtagatttcctcct

SEQ ID NO: 3014590 - DNA, 17 bp, Homo sapiens
ggtggtctgcaggcagg

SEQ ID NO: 3014591 - DNA, 14 bp, Homo sapiens
ggtggtggcctggt

SEQ ID NO: 3014592 - DNA, 21 bp, Homo sapiens
ggtggttgctgttttcctccc

SEQ ID NO: 3014593 - DNA, 11 bp, Homo sapiens
ggtgtcacccc

SEQ ID NO: 3014594 - DNA, 13 bp, Homo sapiens
ggtgtcaccccag

SEQ ID NO: 3014595 - DNA, 16 bp, Homo sapiens
ggtgtcaccccagagc

SEQ ID NO: 3014596 - DNA, 18 bp, Homo sapiens
ggtgtcaggtcccagcga

SEQ ID NO: 3014597 - DNA, 14 bp, Homo sapiens
ggtgtccctgcctt

SEQ ID NO: 3014598 - DNA, 16 bp, Homo sapiens
ggtgtccgagaggctg

SEQ ID NO: 3014599 - DNA, 24 bp, Homo sapiens
ggtgtgccatgctatgtgcacagc

SEQ ID NO: 3014600 - DNA, 20 bp, Homo sapiens
ggtgtggccatcactcagcc

SEQ ID NO: 3014601 - DNA, 11 bp, Homo sapiens
ggtgttctaag

SEQ ID NO: 3014602 - DNA, 13 bp, Homo sapiens
ggtgtttatacag

SEQ ID NO: 3014603 - DNA, 22 bp, Homo sapiens
ggtgtttttcttgtaaatgtgt

SEQ ID NO: 3014604 - DNA, 17 bp, Homo sapiens
ggttaaagcaaaccagc

SEQ ID NO: 3014605 - DNA, 17 bp, Homo sapiens
ggttaaaggaaaagcac

SEQ ID NO: 3014606 - DNA, 22 bp, Homo sapiens
ggttaaggctgaggaaaggcca

SEQ ID NO: 3014607 - DNA, 17 bp, Homo sapiens
ggttaatcatatttgaa

SEQ ID NO: 3014608 - DNA, 23 bp, Homo sapiens
ggttaatccaatcaatttaaatg

SEQ ID NO: 3014609 - DNA, 19 bp, Homo sapiens
ggttacaacagatttgtga

SEQ ID NO: 3014610 - DNA, 21 bp, Homo sapiens
ggttacaacagatttgtgaac

SEQ ID NO: 3014611 - DNA, 22 bp, Homo sapiens
ggttaccaaaaatatccctttt

SEQ ID NO: 3014612 - DNA, 16 bp, Homo sapiens
ggttaccaagaagcct

SEQ ID NO: 3014613 - DNA, 13 bp, Homo sapiens
ggttagatgttgc

SEQ ID NO: 3014614 - DNA, 19 bp, Homo sapiens
ggttattttatatttgagt

SEQ ID NO: 3014615 - DNA, 14 bp, Homo sapiens
ggttcaacttatta

SEQ ID NO: 3014616 - DNA, 19 bp, Homo sapiens
ggttcaagcaatcctccta

SEQ ID NO: 3014617 - DNA, 15 bp, Homo sapiens
ggttcacacagccca

SEQ ID NO: 3014618 - DNA, 16 bp, Homo sapiens
ggttcacacagcccag

SEQ ID NO: 3014619 - DNA, 17 bp, Homo sapiens
ggttcacgccattctcc

SEQ ID NO: 3014620 - DNA, 21 bp, Homo sapiens
ggttcacgccattctcctgcc

SEQ ID NO: 3014621 - DNA, 19 bp, Homo sapiens
ggttcactcttggagcctg

SEQ ID NO: 3014622 - DNA, 17 bp, Homo sapiens
ggttcagcccctcctct

SEQ ID NO: 3014623 - DNA, 19 bp, Homo sapiens
ggttcagcccctcctctgc

SEQ ID NO: 3014624 - DNA, 21 bp, Homo sapiens
ggttcagcccctcctctgcca

SEQ ID NO: 3014625 - DNA, 13 bp, Homo sapiens
ggttcaggcccgg

SEQ ID NO: 3014626 - DNA, 13 bp, Homo sapiens
ggttcaggcctgg

SEQ ID NO: 3014627 - DNA, 18 bp, Homo sapiens
ggttcagggaactgcttg

SEQ ID NO: 3014628 - DNA, 14 bp, Homo sapiens
ggttcataggggca

SEQ ID NO: 3014629 - DNA, 17 bp, Homo sapiens
ggttcatcatccctccc

SEQ ID NO: 3014630 - DNA, 20 bp, Homo sapiens
ggttcatccatcatctgctg

SEQ ID NO: 3014631 - DNA, 12 bp, Homo sapiens
ggttcattccac

SEQ ID NO: 3014632 - DNA, 15 bp, Homo sapiens
ggttcattccacagg

SEQ ID NO: 3014633 - DNA, 13 bp, Homo sapiens
ggttccacagagt

SEQ ID NO: 3014634 - DNA, 20 bp, Homo sapiens
ggttccagcaattctcctgc

SEQ ID NO: 3014635 - DNA, 15 bp, Homo sapiens
ggttccagcctgcca

SEQ ID NO: 3014636 - DNA, 16 bp, Homo sapiens
ggttcccaagctcaga

SEQ ID NO: 3014637 - DNA, 23 bp, Homo sapiens
ggttccgccaggcgctgcagggc

SEQ ID NO: 3014638 - DNA, 23 bp, Homo sapiens
ggttccgcttggagcagaggggc

SEQ ID NO: 3014639 - DNA, 15 bp, Homo sapiens
ggttcctctctccca

SEQ ID NO: 3014640 - DNA, 15 bp, Homo sapiens
ggttcctgctgtcct

SEQ ID NO: 3014641 - DNA, 16 bp, Homo sapiens
ggttcggctgctttta

SEQ ID NO: 3014642 - DNA, 14 bp, Homo sapiens
ggttctaaagttct

SEQ ID NO: 3014643 - DNA, 15 bp, Homo sapiens
ggttctaaagttcta

SEQ ID NO: 3014644 - DNA, 16 bp, Homo sapiens
ggttctatttggaatt

SEQ ID NO: 3014645 - DNA, 13 bp, Homo sapiens
ggttctcaatgaa

SEQ ID NO: 3014646 - DNA, 14 bp, Homo sapiens
ggttctcaatgaaa

SEQ ID NO: 3014647 - DNA, 12 bp, Homo sapiens
ggttctcaattt

SEQ ID NO: 3014648 - DNA, 18 bp, Homo sapiens
ggttctcaatttatttgg

SEQ ID NO: 3014649 - DNA, 17 bp, Homo sapiens
ggttctccccctcctga

SEQ ID NO: 3014650 - DNA, 13 bp, Homo sapiens
ggttctcctgatt

SEQ ID NO: 3014651 - DNA, 19 bp, Homo sapiens
ggttctgcctgccagctgc

SEQ ID NO: 3014652 - DNA, 20 bp, Homo sapiens
ggttctgtctagactggcct

SEQ ID NO: 3014653 - DNA, 16 bp, Homo sapiens
ggttgaactctggtgg

SEQ ID NO: 3014654 - DNA, 19 bp, Homo sapiens
ggttgaggtggaagccctc

SEQ ID NO: 3014655 - DNA, 17 bp, Homo sapiens
ggttgataactttgctt

SEQ ID NO: 3014656 - DNA, 14 bp, Homo sapiens
ggttgattgtgcat

SEQ ID NO: 3014657 - DNA, 16 bp, Homo sapiens
ggttgcaaggccgctg

SEQ ID NO: 3014658 - DNA, 15 bp, Homo sapiens
ggttgctaactgaac

SEQ ID NO: 3014659 - DNA, 18 bp, Homo sapiens
ggttgctgttttcctccc

SEQ ID NO: 3014660 - DNA, 19 bp, Homo sapiens
ggttgctgttttcctccct

SEQ ID NO: 3014661 - DNA, 20 bp, Homo sapiens
ggttgctgttttcctccctt

SEQ ID NO: 3014662 - DNA, 11 bp, Homo sapiens
ggttgcttctg

SEQ ID NO: 3014663 - DNA, 14 bp, Homo sapiens
ggttggagaaggag

SEQ ID NO: 3014664 - DNA, 20 bp, Homo sapiens
ggttggcatttgctggcctg

SEQ ID NO: 3014665 - DNA, 11 bp, Homo sapiens
ggttggcttat

SEQ ID NO: 3014666 - DNA, 16 bp, Homo sapiens
ggttgggctgtgcctg

SEQ ID NO: 3014667 - DNA, 15 bp, Homo sapiens
ggttgtattctttga

SEQ ID NO: 3014668 - DNA, 12 bp, Homo sapiens
ggttgtgatatt

SEQ ID NO: 3014669 - DNA, 14 bp, Homo sapiens
ggttgtggggaggc

SEQ ID NO: 3014670 - DNA, 18 bp, Homo sapiens
ggttgtggggaggctgca

SEQ ID NO: 3014671 - DNA, 19 bp, Homo sapiens
ggttgtttgctgttttttg

SEQ ID NO: 3014672 - DNA, 15 bp, Homo sapiens
ggtttacaacaaaca

SEQ ID NO: 3014673 - DNA, 17 bp, Homo sapiens
ggtttactttcaaaaga

SEQ ID NO: 3014674 - DNA, 19 bp, Homo sapiens
ggtttcaccatgttgccca

SEQ ID NO: 3014675 - DNA, 17 bp, Homo sapiens
ggtttcactattcctat

SEQ ID NO: 3014676 - DNA, 23 bp, Homo sapiens
ggtttcttttttctttcttcctt

SEQ ID NO: 3014677 - DNA, 21 bp, Homo sapiens
ggtttgccaaaattcatttct

SEQ ID NO: 3014678 - DNA, 16 bp, Homo sapiens
ggtttgctgtcttggg

SEQ ID NO: 3014679 - DNA, 22 bp, Homo sapiens
ggtttggcccaagactgggctg

SEQ ID NO: 3014680 - DNA, 20 bp, Homo sapiens
ggtttgtcagcctttctcct

SEQ ID NO: 3014681 - DNA, 22 bp, Homo sapiens
ggtttgttattcttttccagaa

SEQ ID NO: 3014682 - DNA, 17 bp, Homo sapiens
ggtttgttggtcacatg

SEQ ID NO: 3014683 - DNA, 15 bp, Homo sapiens
ggttttaggttctaa

SEQ ID NO: 3014684 - DNA, 21 bp, Homo sapiens
ggttttcacataaatgcagcc

SEQ ID NO: 3014685 - DNA, 22 bp, Homo sapiens
ggttttcacataaatgcagccc

SEQ ID NO: 3014686 - DNA, 13 bp, Homo sapiens
ggttttgactgga

SEQ ID NO: 3014687 - DNA, 14 bp, Homo sapiens
ggttttggcctgcc

SEQ ID NO: 3014688 - DNA, 14 bp, Homo sapiens
ggtttttaagggcc

SEQ ID NO: 3014689 - DNA, 14 bp, Homo sapiens
ggtttttactgtta

SEQ ID NO: 3014690 - DNA, 13 bp, Homo sapiens
ggtttttgctctc

SEQ ID NO: 3014691 - DNA, 19 bp, Homo sapiens
ggtttttttcctgtttctg

SEQ ID NO: 3014692 - DNA, 18 bp, Homo sapiens
gtaaaaaaaaaaaagtta

SEQ ID NO: 3014693 - DNA, 13 bp, Homo sapiens
gtaaaaaaaagaa

SEQ ID NO: 3014694 - DNA, 15 bp, Homo sapiens
gtaaaaaacaaaaaa

SEQ ID NO: 3014695 - DNA, 15 bp, Homo sapiens
gtaaaaaacaaaaac

SEQ ID NO: 3014696 - DNA, 18 bp, Homo sapiens
gtaaaaacagcattgctt

SEQ ID NO: 3014697 - DNA, 12 bp, Homo sapiens
gtaaaaatacaa

SEQ ID NO: 3014698 - DNA, 15 bp, Homo sapiens
gtaaaaatgatttca

SEQ ID NO: 3014699 - DNA, 21 bp, Homo sapiens
gtaaaacacatacaaaagaat

SEQ ID NO: 3014700 - DNA, 19 bp, Homo sapiens
gtaaaagaaagaaagaaaa

SEQ ID NO: 3014701 - DNA, 17 bp, Homo sapiens
gtaaaagattaaactgc

SEQ ID NO: 3014702 - DNA, 19 bp, Homo sapiens
gtaaaatattttgaatcaa

SEQ ID NO: 3014703 - DNA, 14 bp, Homo sapiens
gtaaaatcttcagc

SEQ ID NO: 3014704 - DNA, 17 bp, Homo sapiens
gtaaacagaataaaagt

SEQ ID NO: 3014705 - DNA, 20 bp, Homo sapiens
gtaaacagaataaaagttcc

SEQ ID NO: 3014706 - DNA, 14 bp, Homo sapiens
gtaaacagtgcctg

SEQ ID NO: 3014707 - DNA, 17 bp, Homo sapiens
gtaaacagtgcctgctg

SEQ ID NO: 3014708 - DNA, 22 bp, Homo sapiens
gtaaacagtgcctgctgaatga

SEQ ID NO: 3014709 - DNA, 19 bp, Homo sapiens
gtaaacataccaacatgtt

SEQ ID NO: 3014710 - DNA, 15 bp, Homo sapiens
gtaaaccaatttttt

SEQ ID NO: 3014711 - DNA, 19 bp, Homo sapiens
gtaaaccaattttttgttc

SEQ ID NO: 3014712 - DNA, 20 bp, Homo sapiens
gtaaacgctgtccctagtaa

SEQ ID NO: 3014713 - DNA, 16 bp, Homo sapiens
gtaaactatttatctg

SEQ ID NO: 3014714 - DNA, 21 bp, Homo sapiens
gtaaactatttatctgtgttt

SEQ ID NO: 3014715 - DNA, 13 bp, Homo sapiens
gtaaactcttcac

SEQ ID NO: 3014716 - DNA, 24 bp, Homo sapiens
gtaaactgtgcaccaagcaggaaa

SEQ ID NO: 3014717 - DNA, 18 bp, Homo sapiens
gtaaagaaaagcctcagc

SEQ ID NO: 3014718 - DNA, 14 bp, Homo sapiens
gtaaagaaagagag

SEQ ID NO: 3014719 - DNA, 15 bp, Homo sapiens
gtaaagaaagagaga

SEQ ID NO: 3014720 - DNA, 18 bp, Homo sapiens
gtaaagaaagagagaaaa

SEQ ID NO: 3014721 - DNA, 23 bp, Homo sapiens
gtaaagaaagagagaaaataaaa

SEQ ID NO: 3014722 - DNA, 12 bp, Homo sapiens
gtaaagaattta

SEQ ID NO: 3014723 - DNA, 15 bp, Homo sapiens
gtaaagactggcttt

SEQ ID NO: 3014724 - DNA, 19 bp, Homo sapiens
gtaaagactggcttttatt

SEQ ID NO: 3014725 - DNA, 23 bp, Homo sapiens
gtaaagctatttatgggcccctg

SEQ ID NO: 3014726 - DNA, 16 bp, Homo sapiens
gtaaagcttgtctgat

SEQ ID NO: 3014727 - DNA, 15 bp, Homo sapiens
gtaaaggcattccac

SEQ ID NO: 3014728 - DNA, 19 bp, Homo sapiens
gtaaaggcattccacagga

SEQ ID NO: 3014729 - DNA, 20 bp, Homo sapiens
gtaaagggcgcaaagggcat

SEQ ID NO: 3014730 - DNA, 12 bp, Homo sapiens
gtaaataaattt

SEQ ID NO: 3014731 - DNA, 16 bp, Homo sapiens
gtaaatacatcactgt

SEQ ID NO: 3014732 - DNA, 23 bp, Homo sapiens
gtaaatatgaatctgctcacttt

SEQ ID NO: 3014733 - DNA, 12 bp, Homo sapiens
gtaaatattcat

SEQ ID NO: 3014734 - DNA, 22 bp, Homo sapiens
gtaaatcagatgttgaattctt

SEQ ID NO: 3014735 - DNA, 16 bp, Homo sapiens
gtaaatgaactgattt

SEQ ID NO: 3014736 - DNA, 16 bp, Homo sapiens
gtaaatgaagatcttt

SEQ ID NO: 3014737 - DNA, 18 bp, Homo sapiens
gtaaatgaagatctttat

SEQ ID NO: 3014738 - DNA, 23 bp, Homo sapiens
gtaaatgtactggtaattgtaca

SEQ ID NO: 3014739 - DNA, 17 bp, Homo sapiens
gtaaatgtgacaaaatt

SEQ ID NO: 3014740 - DNA, 20 bp, Homo sapiens
gtaaatttccccaacagtgt

SEQ ID NO: 3014741 - DNA, 23 bp, Homo sapiens
gtaaatttccccaacagtgtgaa

SEQ ID NO: 3014742 - DNA, 14 bp, Homo sapiens
gtaacaagccagat

SEQ ID NO: 3014743 - DNA, 22 bp, Homo sapiens
gtaacagaaagggcaacaataa

SEQ ID NO: 3014744 - DNA, 16 bp, Homo sapiens
gtaacatttatagaag

SEQ ID NO: 3014745 - DNA, 21 bp, Homo sapiens
gtaaccacctctctgtctttt

SEQ ID NO: 3014746 - DNA, 20 bp, Homo sapiens
gtaaccattttataaagtgc

SEQ ID NO: 3014747 - DNA, 15 bp, Homo sapiens
gtaacctttaaaaat

SEQ ID NO: 3014748 - DNA, 20 bp, Homo sapiens
gtaactataacaaaaaaaga

SEQ ID NO: 3014749 - DNA, 19 bp, Homo sapiens
gtaactatttcttcagagt

SEQ ID NO: 3014750 - DNA, 12 bp, Homo sapiens
gtaactccacca

SEQ ID NO: 3014751 - DNA, 15 bp, Homo sapiens
gtaactcccactcct

SEQ ID NO: 3014752 - DNA, 13 bp, Homo sapiens
gtaactgacatga

SEQ ID NO: 3014753 - DNA, 18 bp, Homo sapiens
gtaactgcattgagaact

SEQ ID NO: 3014754 - DNA, 22 bp, Homo sapiens
gtaactggtagtgttcagtaaa

SEQ ID NO: 3014755 - DNA, 14 bp, Homo sapiens
gtaactttatgtgt

SEQ ID NO: 3014756 - DNA, 17 bp, Homo sapiens
gtaagaaaagtggttgt

SEQ ID NO: 3014757 - DNA, 15 bp, Homo sapiens
gtaagaagaggagcc

SEQ ID NO: 3014758 - DNA, 17 bp, Homo sapiens
gtaagaattcagaagac

SEQ ID NO: 3014759 - DNA, 13 bp, Homo sapiens
gtaagaggctgga

SEQ ID NO: 3014760 - DNA, 19 bp, Homo sapiens
gtaagcactgtttttccat

SEQ ID NO: 3014761 - DNA, 15 bp, Homo sapiens
gtaagcatctacttc

SEQ ID NO: 3014762 - DNA, 18 bp, Homo sapiens
gtaagcatctacttcagg

SEQ ID NO: 3014763 - DNA, 13 bp, Homo sapiens
gtaagcggaataa

SEQ ID NO: 3014764 - DNA, 15 bp, Homo sapiens
gtaagcggaataaac

SEQ ID NO: 3014765 - DNA, 23 bp, Homo sapiens
gtaagggaggaggagcttctggg

SEQ ID NO: 3014766 - DNA, 16 bp, Homo sapiens
gtaaggtctttgtaaa

SEQ ID NO: 3014767 - DNA, 18 bp, Homo sapiens
gtaaggtctttgtaaaat

SEQ ID NO: 3014768 - DNA, 20 bp, Homo sapiens
gtaaggtctttgtaaaatct

SEQ ID NO: 3014769 - DNA, 21 bp, Homo sapiens
gtaaggtctttgtaaaatctt

SEQ ID NO: 3014770 - DNA, 14 bp, Homo sapiens
gtaataaactattt

SEQ ID NO: 3014771 - DNA, 17 bp, Homo sapiens
gtaataatgtaacatga

SEQ ID NO: 3014772 - DNA, 20 bp, Homo sapiens
gtaatacctgagtacccatg

SEQ ID NO: 3014773 - DNA, 13 bp, Homo sapiens
gtaatagctcaga

SEQ ID NO: 3014774 - DNA, 20 bp, Homo sapiens
gtaataggcgtaactaattt

SEQ ID NO: 3014775 - DNA, 13 bp, Homo sapiens
gtaatcccagcag

SEQ ID NO: 3014776 - DNA, 14 bp, Homo sapiens
gtaatctatgttta

SEQ ID NO: 3014777 - DNA, 16 bp, Homo sapiens
gtaatctatgtttata

SEQ ID NO: 3014778 - DNA, 20 bp, Homo sapiens
gtaatctatgtttataatac

SEQ ID NO: 3014779 - DNA, 15 bp, Homo sapiens
gtaatctcaatgcaa

SEQ ID NO: 3014780 - DNA, 16 bp, Homo sapiens
gtaatctgtgtacaaa

SEQ ID NO: 3014781 - DNA, 16 bp, Homo sapiens
gtaatgaaacttggat

SEQ ID NO: 3014782 - DNA, 20 bp, Homo sapiens
gtaatgagtttaaaaatcaa

SEQ ID NO: 3014783 - DNA, 14 bp, Homo sapiens
gtaatgatcttgga

SEQ ID NO: 3014784 - DNA, 16 bp, Homo sapiens
gtaatgcctctgtcta

SEQ ID NO: 3014785 - DNA, 19 bp, Homo sapiens
gtaatgcgattttattact

SEQ ID NO: 3014786 - DNA, 22 bp, Homo sapiens
gtaatgctaaatgtgtaataat

SEQ ID NO: 3014787 - DNA, 18 bp, Homo sapiens
gtaatgctacgtgtgatt

SEQ ID NO: 3014788 - DNA, 11 bp, Homo sapiens
gtaatggtgct

SEQ ID NO: 3014789 - DNA, 12 bp, Homo sapiens
gtaatgtcacca

SEQ ID NO: 3014790 - DNA, 20 bp, Homo sapiens
gtaatgtcaccaccttccca

SEQ ID NO: 3014791 - DNA, 16 bp, Homo sapiens
gtaatgtgaataaatt

SEQ ID NO: 3014792 - DNA, 13 bp, Homo sapiens
gtaattatcagtt

SEQ ID NO: 3014793 - DNA, 16 bp, Homo sapiens
gtaattattatttaac

SEQ ID NO: 3014794 - DNA, 19 bp, Homo sapiens
gtaattattatttaactct

SEQ ID NO: 3014795 - DNA, 18 bp, Homo sapiens
gtaattgtactaaagcca

SEQ ID NO: 3014796 - DNA, 14 bp, Homo sapiens
gtaattgtgaaaaa

SEQ ID NO: 3014797 - DNA, 17 bp, Homo sapiens
gtaattgtgtaaaaaat

SEQ ID NO: 3014798 - DNA, 14 bp, Homo sapiens
gtaattgttccttt

SEQ ID NO: 3014799 - DNA, 15 bp, Homo sapiens
gtaatttgtaaaatg

SEQ ID NO: 3014800 - DNA, 19 bp, Homo sapiens
gtaattttgttcctgttta

SEQ ID NO: 3014801 - DNA, 12 bp, Homo sapiens
gtacaaaaataa

SEQ ID NO: 3014802 - DNA, 15 bp, Homo sapiens
gtacaaaagagaagc

SEQ ID NO: 3014803 - DNA, 23 bp, Homo sapiens
gtacaagctcttgtttctgttta

SEQ ID NO: 3014804 - DNA, 18 bp, Homo sapiens
gtacaaggtatgtacagt

SEQ ID NO: 3014805 - DNA, 16 bp, Homo sapiens
gtacaattcattgttt

SEQ ID NO: 3014806 - DNA, 23 bp, Homo sapiens
gtacacaaaggatttgatgcttt

SEQ ID NO: 3014807 - DNA, 18 bp, Homo sapiens
gtacacagcaccagaatg

SEQ ID NO: 3014808 - DNA, 15 bp, Homo sapiens
gtacacgtgtcctgt

SEQ ID NO: 3014809 - DNA, 18 bp, Homo sapiens
gtacactgtgtctctatg

SEQ ID NO: 3014810 - DNA, 17 bp, Homo sapiens
gtacagacatatttaac

SEQ ID NO: 3014811 - DNA, 16 bp, Homo sapiens
gtacagatactgtgag

SEQ ID NO: 3014812 - DNA, 18 bp, Homo sapiens
gtacaggagtcagccatg

SEQ ID NO: 3014813 - DNA, 17 bp, Homo sapiens
gtacaggcagcacagag

SEQ ID NO: 3014814 - DNA, 14 bp, Homo sapiens
gtacagttgcagga

SEQ ID NO: 3014815 - DNA, 14 bp, Homo sapiens
gtacagttttattt

SEQ ID NO: 3014816 - DNA, 15 bp, Homo sapiens
gtacatagtaaagta

SEQ ID NO: 3014817 - DNA, 21 bp, Homo sapiens
gtacatcccatgtaacagaaa

SEQ ID NO: 3014818 - DNA, 23 bp, Homo sapiens
gtacatcccatgtaacagaaagg

SEQ ID NO: 3014819 - DNA, 15 bp, Homo sapiens
gtacatctgcaatat

SEQ ID NO: 3014820 - DNA, 18 bp, Homo sapiens
gtacatctgcaatatgaa

SEQ ID NO: 3014821 - DNA, 20 bp, Homo sapiens
gtacatgaaatttttgtaaa

SEQ ID NO: 3014822 - DNA, 19 bp, Homo sapiens
gtacatgtgtagcctgtgc

SEQ ID NO: 3014823 - DNA, 17 bp, Homo sapiens
gtacattgaaggcctgg

SEQ ID NO: 3014824 - DNA, 18 bp, Homo sapiens
gtcaataaacttagagga

SEQ ID NO: 3014825 - DNA, 21 bp, Homo sapiens
gtcaataaacttagaggaaaa

SEQ ID NO: 3014826 - DNA, 22 bp, Homo sapiens
gtcaatccagatggtgggatgt

SEQ ID NO: 3014827 - DNA, 16 bp, Homo sapiens
gtcaatcccctcattc

SEQ ID NO: 3014828 - DNA, 17 bp, Homo sapiens
gtcaatcccctcattca

SEQ ID NO: 3014829 - DNA, 22 bp, Homo sapiens
gtcaatcccctcattcaggaaa

SEQ ID NO: 3014830 - DNA, 17 bp, Homo sapiens
gtcaattcagtgatggc

SEQ ID NO: 3014831 - DNA, 21 bp, Homo sapiens
gtcacaagcctcgaggtgcct

SEQ ID NO: 3014832 - DNA, 15 bp, Homo sapiens
gtcacaatgttcttt

SEQ ID NO: 3014833 - DNA, 21 bp, Homo sapiens
gtcacaatgttctttatatac

SEQ ID NO: 3014834 - DNA, 13 bp, Homo sapiens
gtcacactctgtg

SEQ ID NO: 3014835 - DNA, 13 bp, Homo sapiens
gtcacagattctt

SEQ ID NO: 3014836 - DNA, 15 bp, Homo sapiens
gtcacagattctttt

SEQ ID NO: 3014837 - DNA, 21 bp, Homo sapiens
gtcacagtgtttacactttgg

SEQ ID NO: 3014838 - DNA, 16 bp, Homo sapiens
gtcacatcaagcatca

SEQ ID NO: 3014839 - DNA, 17 bp, Homo sapiens
gtcaccaagctcacagt

SEQ ID NO: 3014840 - DNA, 14 bp, Homo sapiens
gtcaccaaggaaac

SEQ ID NO: 3014841 - DNA, 11 bp, Homo sapiens
gtcaccacctt

SEQ ID NO: 3014842 - DNA, 15 bp, Homo sapiens
gtcaccatgcaaggg

SEQ ID NO: 3014843 - DNA, 15 bp, Homo sapiens
gtcacccaaaagcac

SEQ ID NO: 3014844 - DNA, 15 bp, Homo sapiens
gtcacccaaagcctg

SEQ ID NO: 3014845 - DNA, 19 bp, Homo sapiens
gtcacccaaagcctgtccc

SEQ ID NO: 3014846 - DNA, 22 bp, Homo sapiens
gtcacccaaagcctgtcccagg

SEQ ID NO: 3014847 - DNA, 15 bp, Homo sapiens
gtcaccccagagcca

SEQ ID NO: 3014848 - DNA, 19 bp, Homo sapiens
gtcaccccagagccacaca

SEQ ID NO: 3014849 - DNA, 20 bp, Homo sapiens
gtcaccccagagccacacat

SEQ ID NO: 3014850 - DNA, 15 bp, Homo sapiens
gtcacccctccagga

SEQ ID NO: 3014851 - DNA, 14 bp, Homo sapiens
gtcaccctagccct

SEQ ID NO: 3014852 - DNA, 20 bp, Homo sapiens
gtcaccctagccctctccct

SEQ ID NO: 3014853 - DNA, 13 bp, Homo sapiens
gtcaccctgtgac

SEQ ID NO: 3014854 - DNA, 17 bp, Homo sapiens
gtcacccttggtagagt

SEQ ID NO: 3014855 - DNA, 21 bp, Homo sapiens
gtcaccgacagcggccttgaa

SEQ ID NO: 3014856 - DNA, 13 bp, Homo sapiens
gtcacctgtgctt

SEQ ID NO: 3014857 - DNA, 23 bp, Homo sapiens
gtcacgtgcgctgggcacttccc

SEQ ID NO: 3014858 - DNA, 13 bp, Homo sapiens
gtcactcaaggcg

SEQ ID NO: 3014859 - DNA, 14 bp, Homo sapiens
gtcactcaggctgg

SEQ ID NO: 3014860 - DNA, 19 bp, Homo sapiens
gtcactcattgctgagcct

SEQ ID NO: 3014861 - DNA, 20 bp, Homo sapiens
gtcactcattgctgagcctc

SEQ ID NO: 3014862 - DNA, 22 bp, Homo sapiens
gtcactcattgctgagcctctg

SEQ ID NO: 3014863 - DNA, 23 bp, Homo sapiens
gtcactcattgctgagcctctgc

SEQ ID NO: 3014864 - DNA, 14 bp, Homo sapiens
gtcactctgccctc

SEQ ID NO: 3014865 - DNA, 14 bp, Homo sapiens
gtcactctttttta

SEQ ID NO: 3014866 - DNA, 19 bp, Homo sapiens
gtcactgcttttggcctgg

SEQ ID NO: 3014867 - DNA, 15 bp, Homo sapiens
gtcactggcagcctg

SEQ ID NO: 3014868 - DNA, 24 bp, Homo sapiens
gtcactgtccaggtaggaaacaat

SEQ ID NO: 3014869 - DNA, 14 bp, Homo sapiens
gtcactgtccctcc

SEQ ID NO: 3014870 - DNA, 15 bp, Homo sapiens
gtcactgtccctcct

SEQ ID NO: 3014871 - DNA, 12 bp, Homo sapiens
gtcacttctcca

SEQ ID NO: 3014872 - DNA, 16 bp, Homo sapiens
gtcagaaagtgtaaat

SEQ ID NO: 3014873 - DNA, 18 bp, Homo sapiens
gtcagaaccggcctggag

SEQ ID NO: 3014874 - DNA, 14 bp, Homo sapiens
gtcagaagttctgg

SEQ ID NO: 3014875 - DNA, 23 bp, Homo sapiens
gtcagaatgggtgcagtttgagg

SEQ ID NO: 3014876 - DNA, 18 bp, Homo sapiens
gtcagaatttttaactgt

SEQ ID NO: 3014877 - DNA, 19 bp, Homo sapiens
gtcagaatttttaactgta

SEQ ID NO: 3014878 - DNA, 20 bp, Homo sapiens
gtcagacccatctctccctt

SEQ ID NO: 3014879 - DNA, 17 bp, Homo sapiens
gtcagacgcctgaggaa

SEQ ID NO: 3014880 - DNA, 23 bp, Homo sapiens
gtcagactggaggtcgaagcaat

SEQ ID NO: 3014881 - DNA, 16 bp, Homo sapiens
gtcagagaaaacactt

SEQ ID NO: 3014882 - DNA, 16 bp, Homo sapiens
gtcagagaaaatgaga

SEQ ID NO: 3014883 - DNA, 18 bp, Homo sapiens
gtcagagcccaggggaga

SEQ ID NO: 3014884 - DNA, 22 bp, Homo sapiens
gtcagatttatttgtttgattt

SEQ ID NO: 3014885 - DNA, 14 bp, Homo sapiens
gtcagcaaatgtaa

SEQ ID NO: 3014886 - DNA, 11 bp, Homo sapiens
gtcagcatctg

SEQ ID NO: 3014887 - DNA, 12 bp, Homo sapiens
gtcagcatctga

SEQ ID NO: 3014888 - DNA, 21 bp, Homo sapiens
gtcagcatctgaccatctgtg

SEQ ID NO: 3014889 - DNA, 17 bp, Homo sapiens
gtcagccatcagccatg

SEQ ID NO: 3014890 - DNA, 23 bp, Homo sapiens
gtcagccatcagccatggccctc

SEQ ID NO: 3014891 - DNA, 23 bp, Homo sapiens
gtcagccattgcacccagcccag

SEQ ID NO: 3014892 - DNA, 16 bp, Homo sapiens
gtcagcgagaaggagt

SEQ ID NO: 3014893 - DNA, 16 bp, Homo sapiens
gtcagctctcatctga

SEQ ID NO: 3014894 - DNA, 17 bp, Homo sapiens
gtcagctgctgttgaac

SEQ ID NO: 3014895 - DNA, 21 bp, Homo sapiens
gtcagctggccagatttcctc

SEQ ID NO: 3014896 - DNA, 22 bp, Homo sapiens
gtcagctggccagatttcctca

SEQ ID NO: 3014897 - DNA, 22 bp, Homo sapiens
gtcagctgggacaccccgactt

SEQ ID NO: 3014898 - DNA, 15 bp, Homo sapiens
gtcaggacctggctt

SEQ ID NO: 3014899 - DNA, 15 bp, Homo sapiens
gtcaggccaggtggg

SEQ ID NO: 3014900 - DNA, 16 bp, Homo sapiens
gtcaggccaggtgggc

SEQ ID NO: 3014901 - DNA, 17 bp, Homo sapiens
gtcaggcccgtcggagc

SEQ ID NO: 3014902 - DNA, 18 bp, Homo sapiens
gtcaggcccgtcggagct

SEQ ID NO: 3014903 - DNA, 23 bp, Homo sapiens
gtcaggcccgtcggagctgcctg

SEQ ID NO: 3014904 - DNA, 13 bp, Homo sapiens
gtcaggccctctg

SEQ ID NO: 3014905 - DNA, 15 bp, Homo sapiens
gtcaggccctctgcc

SEQ ID NO: 3014906 - DNA, 16 bp, Homo sapiens
gtcaggccctctgcct

SEQ ID NO: 3014907 - DNA, 18 bp, Homo sapiens
gtcaggccctctgcctgc

SEQ ID NO: 3014908 - DNA, 21 bp, Homo sapiens
gtcaggccctctgcctgcact

SEQ ID NO: 3014909 - DNA, 16 bp, Homo sapiens
gtcaggcggagctgct

SEQ ID NO: 3014910 - DNA, 13 bp, Homo sapiens
gtcaggctgccag

SEQ ID NO: 3014911 - DNA, 17 bp, Homo sapiens
gtcaggggcaaggtctc

SEQ ID NO: 3014912 - DNA, 13 bp, Homo sapiens
gtcaggtcccagc

SEQ ID NO: 3014913 - DNA, 16 bp, Homo sapiens
gtcaggtcccagcgag

SEQ ID NO: 3014914 - DNA, 22 bp, Homo sapiens
gtcaggtcccagcgagccacag

SEQ ID NO: 3014915 - DNA, 17 bp, Homo sapiens
gtcaggtgtcaggcccg

SEQ ID NO: 3014916 - DNA, 22 bp, Homo sapiens
gtcagtaccttcaaactagggc

SEQ ID NO: 3014917 - DNA, 22 bp, Homo sapiens
gtcagtactaaggtgactttct

SEQ ID NO: 3014918 - DNA, 13 bp, Homo sapiens
gtcagtcacagcc

SEQ ID NO: 3014919 - DNA, 16 bp, Homo sapiens
gtcataccaatgaaaa

SEQ ID NO: 3014920 - DNA, 16 bp, Homo sapiens
gtcatagattcttgag

SEQ ID NO: 3014921 - DNA, 19 bp, Homo sapiens
gtcatcaacaatgattaat

SEQ ID NO: 3014922 - DNA, 23 bp, Homo sapiens
gtcatcaatttgtaattttagta

SEQ ID NO: 3014923 - DNA, 19 bp, Homo sapiens
gtcatcagaggggagcagc

SEQ ID NO: 3014924 - DNA, 14 bp, Homo sapiens
gtcatcagccacca

SEQ ID NO: 3014925 - DNA, 19 bp, Homo sapiens
gtcatcatgaactggcttg

SEQ ID NO: 3014926 - DNA, 23 bp, Homo sapiens
gtcatcatgaactggcttgtaca

SEQ ID NO: 3014927 - DNA, 16 bp, Homo sapiens
gtcatccttggtgctc

SEQ ID NO: 3014928 - DNA, 16 bp, Homo sapiens
gtcatcgttccccacc

SEQ ID NO: 3014929 - DNA, 23 bp, Homo sapiens
gtcatctagcgcaattgaaggat

SEQ ID NO: 3014930 - DNA, 18 bp, Homo sapiens
gtcatctcattccactgt

SEQ ID NO: 3014931 - DNA, 13 bp, Homo sapiens
gtcatctctgttc

SEQ ID NO: 3014932 - DNA, 22 bp, Homo sapiens
gtcatcttgaccaagcaggaag

SEQ ID NO: 3014933 - DNA, 20 bp, Homo sapiens
gtcatgacaagatgggacag

SEQ ID NO: 3014934 - DNA, 20 bp, Homo sapiens
gtcatgatctccctgccgcc

SEQ ID NO: 3014935 - DNA, 14 bp, Homo sapiens
gtcatgcaaagatt

SEQ ID NO: 3014936 - DNA, 20 bp, Homo sapiens
gtcatggccacactgtgaca

SEQ ID NO: 3014937 - DNA, 21 bp, Homo sapiens
gtcatggccacactgtgacac

SEQ ID NO: 3014938 - DNA, 22 bp, Homo sapiens
gtcatggccacactgtgacaca

SEQ ID NO: 3014939 - DNA, 18 bp, Homo sapiens
gtcatgggaacgcagcct

SEQ ID NO: 3014940 - DNA, 15 bp, Homo sapiens
gtcatgtaaatactg

SEQ ID NO: 3014941 - DNA, 22 bp, Homo sapiens
gtcatgtgtgtattttttcata

SEQ ID NO: 3014942 - DNA, 12 bp, Homo sapiens
gtcattaaactg

SEQ ID NO: 3014943 - DNA, 17 bp, Homo sapiens
gtcattaacacattgtt

SEQ ID NO: 3014944 - DNA, 19 bp, Homo sapiens
gtcattatccttgctatga

SEQ ID NO: 3014945 - DNA, 15 bp, Homo sapiens
gtcattattccatct

SEQ ID NO: 3014946 - DNA, 21 bp, Homo sapiens
gtcattatttgataacatttt

SEQ ID NO: 3014947 - DNA, 18 bp, Homo sapiens
gtcattgcacctatctca

SEQ ID NO: 3014948 - DNA, 22 bp, Homo sapiens
gtcattgcacctatctcagcca

SEQ ID NO: 3014949 - DNA, 21 bp, Homo sapiens
gtcattgtaacctcgtgtcta

SEQ ID NO: 3014950 - DNA, 23 bp, Homo sapiens
gtcatttaactgaagatgttgag

SEQ ID NO: 3014951 - DNA, 23 bp, Homo sapiens
gtcatttccgtccccccccaggc

SEQ ID NO: 3014952 - DNA, 15 bp, Homo sapiens
gtcatttctcttttt

SEQ ID NO: 3014953 - DNA, 22 bp, Homo sapiens
gtcatttgctgtgaactgaaat

SEQ ID NO: 3014954 - DNA, 16 bp, Homo sapiens
gtcatttgttaaaata

SEQ ID NO: 3014955 - DNA, 19 bp, Homo sapiens
gtcattttggcatctgcaa

SEQ ID NO: 3014956 - DNA, 12 bp, Homo sapiens
gtcatttttgtt

SEQ ID NO: 3014957 - DNA, 19 bp, Homo sapiens
gtcatttttgtttttggtt

SEQ ID NO: 3014958 - DNA, 19 bp, Homo sapiens
gtccaaaaaaaggaaaaat

SEQ ID NO: 3014959 - DNA, 17 bp, Homo sapiens
tggagttgatctggaac

SEQ ID NO: 3014960 - DNA, 17 bp, Homo sapiens
tggagtttacaaagata

SEQ ID NO: 3014961 - DNA, 21 bp, Homo sapiens
tggagtttcatgtacaagatg

SEQ ID NO: 3014962 - DNA, 17 bp, Homo sapiens
tggagttttttgtacca

SEQ ID NO: 3014963 - DNA, 15 bp, Homo sapiens
gaaaatgagaaagga

SEQ ID NO: 3014964 - DNA, 18 bp, Homo sapiens
gaaaatgagaaaggacag

SEQ ID NO: 3014965 - DNA, 24 bp, Homo sapiens
gaaaatgagaaaggacagagccag

SEQ ID NO: 3014966 - DNA, 14 bp, Homo sapiens
gaaaatgcagcagg

SEQ ID NO: 3014967 - DNA, 17 bp, Homo sapiens
gaaaatgtatattttga

SEQ ID NO: 3014968 - DNA, 18 bp, Homo sapiens
gaaaatgtatccagagga

SEQ ID NO: 3014969 - DNA, 18 bp, Homo sapiens
gaaaatgtatttcctgaa

SEQ ID NO: 3014970 - DNA, 13 bp, Homo sapiens
gaaaatgtgtctg

SEQ ID NO: 3014971 - DNA, 21 bp, Homo sapiens
gaaaatgtgtctgcaacatgg

SEQ ID NO: 3014972 - DNA, 22 bp, Homo sapiens
gaaaatgtgtctgcaacatgga

SEQ ID NO: 3014973 - DNA, 16 bp, Homo sapiens
gaaaattgcctttaaa

SEQ ID NO: 3014974 - DNA, 21 bp, Homo sapiens
gaaaatttgttattttgcaac

SEQ ID NO: 3014975 - DNA, 13 bp, Homo sapiens
gaaaattttatgt

SEQ ID NO: 3014976 - DNA, 23 bp, Homo sapiens
gaaacaaaaattgtctttatgag

SEQ ID NO: 3014977 - DNA, 20 bp, Homo sapiens
gaaacaaacaaaactcttaa

SEQ ID NO: 3014978 - DNA, 22 bp, Homo sapiens
gaaacaaagcttagcaggagag

SEQ ID NO: 3014979 - DNA, 15 bp, Homo sapiens
gaaacaataaagaaa

SEQ ID NO: 3014980 - DNA, 15 bp, Homo sapiens
gaaacacaataccta

SEQ ID NO: 3014981 - DNA, 20 bp, Homo sapiens
gaaacacactgaggcaggga

SEQ ID NO: 3014982 - DNA, 23 bp, Homo sapiens
gaaacacactgaggcagggaagt

SEQ ID NO: 3014983 - DNA, 14 bp, Homo sapiens
gaaacacagaaacc

SEQ ID NO: 3014984 - DNA, 13 bp, Homo sapiens
gaaacaccattca

SEQ ID NO: 3014985 - DNA, 23 bp, Homo sapiens
gaaacactatttgtgacttttta

SEQ ID NO: 3014986 - DNA, 21 bp, Homo sapiens
gaaacactcaacaataaagac

SEQ ID NO: 3014987 - DNA, 17 bp, Homo sapiens
gaaacactccttgcatc

SEQ ID NO: 3014988 - DNA, 13 bp, Homo sapiens
gaaacactgactt

SEQ ID NO: 3014989 - DNA, 13 bp, Homo sapiens
gaaacactgcctt

SEQ ID NO: 3014990 - DNA, 14 bp, Homo sapiens
gaaacactgccttt

SEQ ID NO: 3014991 - DNA, 17 bp, Homo sapiens
gaaacactgccttttta

SEQ ID NO: 3014992 - DNA, 22 bp, Homo sapiens
gaaacactgcttctcggccagc

SEQ ID NO: 3014993 - DNA, 14 bp, Homo sapiens
gaaacactttctct

SEQ ID NO: 3014994 - DNA, 13 bp, Homo sapiens
gaaacactttttt

SEQ ID NO: 3014995 - DNA, 22 bp, Homo sapiens
gaaacagaaaaatatgtaccaa

SEQ ID NO: 3014996 - DNA, 15 bp, Homo sapiens
gaaacagaggtaaaa

SEQ ID NO: 3014997 - DNA, 20 bp, Homo sapiens
gaaacagaggtaaaaaaaag

SEQ ID NO: 3014998 - DNA, 22 bp, Homo sapiens
gaaacagaggtaaaaaaaagaa

SEQ ID NO: 3014999 - DNA, 23 bp, Homo sapiens
gaaacagaggtaaaaaaaagaag

SEQ ID NO: 3015000 - DNA, 12 bp, Homo sapiens
gaaacagctgcc

SEQ ID NO: 3015001 - DNA, 17 bp, Homo sapiens
gaaacagggacaaagaa

SEQ ID NO: 3015002 - DNA, 18 bp, Homo sapiens
gaaacagggacaaagaaa

SEQ ID NO: 3015003 - DNA, 20 bp, Homo sapiens
gaaacagtgtttgccctttg

SEQ ID NO: 3015004 - DNA, 20 bp, Homo sapiens
gaaacatcagttactctgaa

SEQ ID NO: 3015005 - DNA, 18 bp, Homo sapiens
gaaacatgaagcataatt

SEQ ID NO: 3015006 - DNA, 18 bp, Homo sapiens
gaaacatgggctgtgatt

SEQ ID NO: 3015007 - DNA, 18 bp, Homo sapiens
gaaacattattttaattg

SEQ ID NO: 3015008 - DNA, 18 bp, Homo sapiens
gaaaccaagtcaggccag

SEQ ID NO: 3015009 - DNA, 20 bp, Homo sapiens
gaaaccaagtcaggccaggt

SEQ ID NO: 3015010 - DNA, 21 bp, Homo sapiens
gaaaccaagtcaggccaggtg

SEQ ID NO: 3015011 - DNA, 22 bp, Homo sapiens
gaaaccaagtcaggccaggtgg

SEQ ID NO: 3015012 - DNA, 18 bp, Homo sapiens
gaaaccaagtgggctggt

SEQ ID NO: 3015013 - DNA, 18 bp, Homo sapiens
gaaaccacaaccttgcag

SEQ ID NO: 3015014 - DNA, 17 bp, Homo sapiens
gaaaccacagtttcatt

SEQ ID NO: 3015015 - DNA, 16 bp, Homo sapiens
gaaacccataggccca

SEQ ID NO: 3015016 - DNA, 18 bp, Homo sapiens
gaaacccataggcccaca

SEQ ID NO: 3015017 - DNA, 16 bp, Homo sapiens
gaaacccgacagaggg

SEQ ID NO: 3015018 - DNA, 18 bp, Homo sapiens
gaaacccgagggttgatt

SEQ ID NO: 3015019 - DNA, 13 bp, Homo sapiens
gaaacctactgcc

SEQ ID NO: 3015020 - DNA, 18 bp, Homo sapiens
gaaacctgtataaccctg

SEQ ID NO: 3015021 - DNA, 23 bp, Homo sapiens
gaaacctgtatctttctatgctg

SEQ ID NO: 3015022 - DNA, 19 bp, Homo sapiens
gaaaccttagtttcaagag

SEQ ID NO: 3015023 - DNA, 16 bp, Homo sapiens
gaaacctttaagaaaa

SEQ ID NO: 3015024 - DNA, 22 bp, Homo sapiens
gaaacctttgcttaccttgttt

SEQ ID NO: 3015025 - DNA, 13 bp, Homo sapiens
gaaacgctacctc

SEQ ID NO: 3015026 - DNA, 13 bp, Homo sapiens
gaaactaaagcaa

SEQ ID NO: 3015027 - DNA, 21 bp, Homo sapiens
gaaactaattgactttagaaa

SEQ ID NO: 3015028 - DNA, 17 bp, Homo sapiens
gaaactataaagtttta

SEQ ID NO: 3015029 - DNA, 18 bp, Homo sapiens
gaaactcccatgtatgga

SEQ ID NO: 3015030 - DNA, 18 bp, Homo sapiens
gaaactcccttgtgttcc

SEQ ID NO: 3015031 - DNA, 19 bp, Homo sapiens
gaaactcccttgtgttcct

SEQ ID NO: 3015032 - DNA, 18 bp, Homo sapiens
gaaactccgtcttagaag

SEQ ID NO: 3015033 - DNA, 15 bp, Homo sapiens
gaaactctaccctga

SEQ ID NO: 3015034 - DNA, 13 bp, Homo sapiens
gaaactgatgcca

SEQ ID NO: 3015035 - DNA, 22 bp, Homo sapiens
gaaactgatgccaaggggctga

SEQ ID NO: 3015036 - DNA, 11 bp, Homo sapiens
gaaactggctg

SEQ ID NO: 3015037 - DNA, 16 bp, Homo sapiens
gaaactgtgaatgctt

SEQ ID NO: 3015038 - DNA, 21 bp, Homo sapiens
gaaactgttcccacctgctgg

SEQ ID NO: 3015039 - DNA, 18 bp, Homo sapiens
gaaacttacctgagaacc

SEQ ID NO: 3015040 - DNA, 13 bp, Homo sapiens
gaaacttctcagt

SEQ ID NO: 3015041 - DNA, 15 bp, Homo sapiens
gaaacttctgtaagg

SEQ ID NO: 3015042 - DNA, 11 bp, Homo sapiens
gaaacttggat

SEQ ID NO: 3015043 - DNA, 16 bp, Homo sapiens
gaaacttgtcacttgc

SEQ ID NO: 3015044 - DNA, 19 bp, Homo sapiens
gaaactttgagtacagata

SEQ ID NO: 3015045 - DNA, 14 bp, Homo sapiens
gaaactttggaagc

SEQ ID NO: 3015046 - DNA, 18 bp, Homo sapiens
gaaagacactgcctgggc

SEQ ID NO: 3015047 - DNA, 19 bp, Homo sapiens
gaaagacaggaagaccaag

SEQ ID NO: 3015048 - DNA, 16 bp, Homo sapiens
gaaagacttccaaaga

SEQ ID NO: 3015049 - DNA, 19 bp, Homo sapiens
gaaagagaagtcacaacaa

SEQ ID NO: 3015050 - DNA, 13 bp, Homo sapiens
gaaagagagaaaa

SEQ ID NO: 3015051 - DNA, 22 bp, Homo sapiens
gaaagagagaaaataaaaagtt

SEQ ID NO: 3015052 - DNA, 13 bp, Homo sapiens
gaaagagggacaa

SEQ ID NO: 3015053 - DNA, 16 bp, Homo sapiens
gaaagataaaatagtg

SEQ ID NO: 3015054 - DNA, 14 bp, Homo sapiens
gaaagataactagg

SEQ ID NO: 3015055 - DNA, 17 bp, Homo sapiens
gaaagatgatttgcaat

SEQ ID NO: 3015056 - DNA, 14 bp, Homo sapiens
gaaagatggataaa

SEQ ID NO: 3015057 - DNA, 16 bp, Homo sapiens
gaaagatggataaact

SEQ ID NO: 3015058 - DNA, 22 bp, Homo sapiens
gaaagatggataaactgagcct

SEQ ID NO: 3015059 - DNA, 13 bp, Homo sapiens
gaaagattattta

SEQ ID NO: 3015060 - DNA, 13 bp, Homo sapiens
gaaagcaaaaatg

SEQ ID NO: 3015061 - DNA, 14 bp, Homo sapiens
gaaagcaaaaatgc

SEQ ID NO: 3015062 - DNA, 17 bp, Homo sapiens
gaaagcaaaaatgctaa

SEQ ID NO: 3015063 - DNA, 18 bp, Homo sapiens
gaaagcaaaaatgctaat

SEQ ID NO: 3015064 - DNA, 23 bp, Homo sapiens
gaaagcaaaaatgctaatattaa

SEQ ID NO: 3015065 - DNA, 12 bp, Homo sapiens
gaaagcaacttt

SEQ ID NO: 3015066 - DNA, 19 bp, Homo sapiens
gaaagcacttaaacagaag

SEQ ID NO: 3015067 - DNA, 21 bp, Homo sapiens
gaaagcagcgctagtggaggg

SEQ ID NO: 3015068 - DNA, 15 bp, Homo sapiens
gaaagcagttgaaat

SEQ ID NO: 3015069 - DNA, 22 bp, Homo sapiens
gaaagcatgtctctgcttccat

SEQ ID NO: 3015070 - DNA, 15 bp, Homo sapiens
gaaagcctgtctctt

SEQ ID NO: 3015071 - DNA, 19 bp, Homo sapiens
gaaagcctgtctctttcca

SEQ ID NO: 3015072 - DNA, 19 bp, Homo sapiens
gaaaggaaaagattcctgt

SEQ ID NO: 3015073 - DNA, 14 bp, Homo sapiens
gaaaggaacatttt

SEQ ID NO: 3015074 - DNA, 23 bp, Homo sapiens
gaaaggactctggggtttttact

SEQ ID NO: 3015075 - DNA, 16 bp, Homo sapiens
gaaaggagaaattttg

SEQ ID NO: 3015076 - DNA, 22 bp, Homo sapiens
gaaaggatgtaaacagtgcctg

SEQ ID NO: 3015077 - DNA, 13 bp, Homo sapiens
gaaaggcaaggga

SEQ ID NO: 3015078 - DNA, 14 bp, Homo sapiens
gaaaggcagatgta

SEQ ID NO: 3015079 - DNA, 17 bp, Homo sapiens
gaaaggcattctctgaa

SEQ ID NO: 3015080 - DNA, 14 bp, Homo sapiens
gaaaggccagctgg

SEQ ID NO: 3015081 - DNA, 19 bp, Homo sapiens
gaaaggccagctggcagca

SEQ ID NO: 3015082 - DNA, 21 bp, Homo sapiens
gaaaggccagctggcagcaga

SEQ ID NO: 3015083 - DNA, 22 bp, Homo sapiens
gaaaggccagctggcagcagag

SEQ ID NO: 3015084 - DNA, 17 bp, Homo sapiens
gaaaggccctgcacagg

SEQ ID NO: 3015085 - DNA, 20 bp, Homo sapiens
gaaaggcctgtggggagccg

SEQ ID NO: 3015086 - DNA, 22 bp, Homo sapiens
gaaaggcctgtggggagccgag

SEQ ID NO: 3015087 - DNA, 14 bp, Homo sapiens
gaaaggcttttaaa

SEQ ID NO: 3015088 - DNA, 14 bp, Homo sapiens
gaaagggcctggcc

SEQ ID NO: 3015089 - DNA, 22 bp, Homo sapiens
gaaaggggaaacgtctcccaga

SEQ ID NO: 3015090 - DNA, 23 bp, Homo sapiens
gaaaggggaaacgtctcccagat

SEQ ID NO: 3015091 - DNA, 23 bp, Homo sapiens
gaaagggtgtttttctgttttat

SEQ ID NO: 3015092 - DNA, 23 bp, Homo sapiens
gaaagggttaatcatatttgaaa

SEQ ID NO: 3015093 - DNA, 17 bp, Homo sapiens
gaaaggtaaatacaagt

SEQ ID NO: 3015094 - DNA, 17 bp, Homo sapiens
gaaaggtgcagctgcgt

SEQ ID NO: 3015095 - DNA, 14 bp, Homo sapiens
gaaaggtgccatgt

SEQ ID NO: 3015096 - DNA, 16 bp, Homo sapiens
gaaaggtgccatgtct

SEQ ID NO: 3015097 - DNA, 17 bp, Homo sapiens
gaaaggtggtgtttctg

SEQ ID NO: 3015098 - DNA, 14 bp, Homo sapiens
gaaaggtttcaaga

SEQ ID NO: 3015099 - DNA, 21 bp, Homo sapiens
gaaaggtttcaagacttgata

SEQ ID NO: 3015100 - DNA, 17 bp, Homo sapiens
gaaagtatgttgtatat

SEQ ID NO: 3015101 - DNA, 17 bp, Homo sapiens
gaaagtcaattcagtga

SEQ ID NO: 3015102 - DNA, 19 bp, Homo sapiens
gaaagtcaattcagtgatg

SEQ ID NO: 3015103 - DNA, 18 bp, Homo sapiens
gaaagtgggtttcaattt

SEQ ID NO: 3015104 - DNA, 19 bp, Homo sapiens
gaaagtggtcttaagaaat

SEQ ID NO: 3015105 - DNA, 20 bp, Homo sapiens
gaaagtggtgctcagttgta

SEQ ID NO: 3015106 - DNA, 15 bp, Homo sapiens
gaaagtgtaaagcat

SEQ ID NO: 3015107 - DNA, 18 bp, Homo sapiens
gaaagttgtacatgaaat

SEQ ID NO: 3015108 - DNA, 16 bp, Homo sapiens
gaaataaaaggaagcc

SEQ ID NO: 3015109 - DNA, 19 bp, Homo sapiens
gaaataaaaggaagccaaa

SEQ ID NO: 3015110 - DNA, 19 bp, Homo sapiens
gaaataaagttaagtttgt

SEQ ID NO: 3015111 - DNA, 13 bp, Homo sapiens
gaaataaatgttt

SEQ ID NO: 3015112 - DNA, 18 bp, Homo sapiens
gaaataacaagtcgatga

SEQ ID NO: 3015113 - DNA, 17 bp, Homo sapiens
gaaataatcagtgactg

SEQ ID NO: 3015114 - DNA, 18 bp, Homo sapiens
gaaatacaaaaatactca

SEQ ID NO: 3015115 - DNA, 23 bp, Homo sapiens
gaaatagccgaactccaggctgg

SEQ ID NO: 3015116 - DNA, 23 bp, Homo sapiens
gaaatagctggtttccaactctc

SEQ ID NO: 3015117 - DNA, 18 bp, Homo sapiens
gaaataggaaacaagtga

SEQ ID NO: 3015118 - DNA, 15 bp, Homo sapiens
gaaataggttagagt

SEQ ID NO: 3015119 - DNA, 20 bp, Homo sapiens
gaaatatcagttactcagcc

SEQ ID NO: 3015120 - DNA, 21 bp, Homo sapiens
gaaatatcagttactcagccc

SEQ ID NO: 3015121 - DNA, 22 bp, Homo sapiens
gaaatatcagttactcagccct

SEQ ID NO: 3015122 - DNA, 18 bp, Homo sapiens
gaaatatgctcttttgtt

SEQ ID NO: 3015123 - DNA, 10 bp, Homo sapiens
gaaatattaa

SEQ ID NO: 3015124 - DNA, 19 bp, Homo sapiens
gaaatattaaaccctggat

SEQ ID NO: 3015125 - DNA, 13 bp, Homo sapiens
gaaatattaacta

SEQ ID NO: 3015126 - DNA, 14 bp, Homo sapiens
gaaatattgctgta

SEQ ID NO: 3015127 - DNA, 13 bp, Homo sapiens
gaaatattgtaaa

SEQ ID NO: 3015128 - DNA, 14 bp, Homo sapiens
gaaatattgtaaat

SEQ ID NO: 3015129 - DNA, 15 bp, Homo sapiens
gaaatattgtaaatg

SEQ ID NO: 3015130 - DNA, 22 bp, Homo sapiens
gaaatattgtaaatgctattat

SEQ ID NO: 3015131 - DNA, 15 bp, Homo sapiens
gaaatattttgaata

SEQ ID NO: 3015132 - DNA, 23 bp, Homo sapiens
gaaatcaagtcatctatagttga

SEQ ID NO: 3015133 - DNA, 17 bp, Homo sapiens
gaaatcgccttatgaga

SEQ ID NO: 3015134 - DNA, 18 bp, Homo sapiens
gaaatctcccatgtgcat

SEQ ID NO: 3015135 - DNA, 13 bp, Homo sapiens
gaaatctgtcttt

SEQ ID NO: 3015136 - DNA, 24 bp, Homo sapiens
gaaatgaccttcattctgagacca

SEQ ID NO: 3015137 - DNA, 17 bp, Homo sapiens
gaaatgatagatttgac

SEQ ID NO: 3015138 - DNA, 14 bp, Homo sapiens
gaaatgcacaattt

SEQ ID NO: 3015139 - DNA, 23 bp, Homo sapiens
gaaatgcatccattcctcaggga

SEQ ID NO: 3015140 - DNA, 19 bp, Homo sapiens
gaaatgccaagtgcctgct

SEQ ID NO: 3015141 - DNA, 15 bp, Homo sapiens
gaaatgctgggctga

SEQ ID NO: 3015142 - DNA, 14 bp, Homo sapiens
gaaatggaaatttt

SEQ ID NO: 3015143 - DNA, 17 bp, Homo sapiens
gaaatggcttttcccaa

SEQ ID NO: 3015144 - DNA, 20 bp, Homo sapiens
gaaatggcttttcccaaccc

SEQ ID NO: 3015145 - DNA, 21 bp, Homo sapiens
gaaatggtttcacttgctctt

SEQ ID NO: 3015146 - DNA, 22 bp, Homo sapiens
gaaatgtattttgaaaacactt

SEQ ID NO: 3015147 - DNA, 16 bp, Homo sapiens
gaaattcgcatgttta

SEQ ID NO: 3015148 - DNA, 14 bp, Homo sapiens
gaaattctgaattt

SEQ ID NO: 3015149 - DNA, 17 bp, Homo sapiens
gaaattctgaatttgca

SEQ ID NO: 3015150 - DNA, 19 bp, Homo sapiens
gaaattctgaatttgcaaa

SEQ ID NO: 3015151 - DNA, 16 bp, Homo sapiens
gaaattgtattacaaa

SEQ ID NO: 3015152 - DNA, 21 bp, Homo sapiens
gaaatttaattcatgtttctt

SEQ ID NO: 3015153 - DNA, 23 bp, Homo sapiens
gaaatttaattcatgtttcttaa

SEQ ID NO: 3015154 - DNA, 20 bp, Homo sapiens
gaaatttactgtgagactgt

SEQ ID NO: 3015155 - DNA, 22 bp, Homo sapiens
gaaatttttcagatgcttctgg

SEQ ID NO: 3015156 - DNA, 14 bp, Homo sapiens
gaaatttttccaca

SEQ ID NO: 3015157 - DNA, 23 bp, Homo sapiens
gaaatttttccacactatgtgtg

SEQ ID NO: 3015158 - DNA, 19 bp, Homo sapiens
gaacaaaaattacaaagaa

SEQ ID NO: 3015159 - DNA, 15 bp, Homo sapiens
gaacaaatggccttt

SEQ ID NO: 3015160 - DNA, 17 bp, Homo sapiens
gaacaaccctgaagcag

SEQ ID NO: 3015161 - DNA, 18 bp, Homo sapiens
gaacaagacagccttcac

SEQ ID NO: 3015162 - DNA, 15 bp, Homo sapiens
gaacacaaatgaaaa

SEQ ID NO: 3015163 - DNA, 15 bp, Homo sapiens
gaacacaagaaaaag

SEQ ID NO: 3015164 - DNA, 14 bp, Homo sapiens
gaacacactccatc

SEQ ID NO: 3015165 - DNA, 17 bp, Homo sapiens
gaacacagagtgtgttt

SEQ ID NO: 3015166 - DNA, 21 bp, Homo sapiens
gaacaccagagacctcaaatt

SEQ ID NO: 3015167 - DNA, 18 bp, Homo sapiens
gaacaccagcagcactgg

SEQ ID NO: 3015168 - DNA, 23 bp, Homo sapiens
gaacacctggccgggtcaccctg

SEQ ID NO: 3015169 - DNA, 16 bp, Homo sapiens
gaacacgcgtatttac

SEQ ID NO: 3015170 - DNA, 19 bp, Homo sapiens
gaacactagacaagccaga

SEQ ID NO: 3015171 - DNA, 20 bp, Homo sapiens
gaacactagacaagccagaa

SEQ ID NO: 3015172 - DNA, 16 bp, Homo sapiens
gaacactcttttgctt

SEQ ID NO: 3015173 - DNA, 17 bp, Homo sapiens
gaacactgccctcgcac

SEQ ID NO: 3015174 - DNA, 12 bp, Homo sapiens
gaacagaaattg

SEQ ID NO: 3015175 - DNA, 13 bp, Homo sapiens
gaacagaagaaaa

SEQ ID NO: 3015176 - DNA, 17 bp, Homo sapiens
gaacagaggcatttaaa

SEQ ID NO: 3015177 - DNA, 22 bp, Homo sapiens
gaacagatcttttactttggcc

SEQ ID NO: 3015178 - DNA, 19 bp, Homo sapiens
gaacagcatggcactccct

SEQ ID NO: 3015179 - DNA, 13 bp, Homo sapiens
gaacagccatttt

SEQ ID NO: 3015180 - DNA, 18 bp, Homo sapiens
gaacagcccgccagaggc

SEQ ID NO: 3015181 - DNA, 14 bp, Homo sapiens
gaacagctggtgcc

SEQ ID NO: 3015182 - DNA, 19 bp, Homo sapiens
gaacagctgttcctgtgtt

SEQ ID NO: 3015183 - DNA, 14 bp, Homo sapiens
gaacagtgctctgc

SEQ ID NO: 3015184 - DNA, 18 bp, Homo sapiens
gaacagtgtttgattttt

SEQ ID NO: 3015185 - DNA, 15 bp, Homo sapiens
gaacatcattagaac

SEQ ID NO: 3015186 - DNA, 15 bp, Homo sapiens
gaacatccctgccag

SEQ ID NO: 3015187 - DNA, 16 bp, Homo sapiens
gaacatcttcatataa

SEQ ID NO: 3015188 - DNA, 18 bp, Homo sapiens
gaacatcttcatataaac

SEQ ID NO: 3015189 - DNA, 12 bp, Homo sapiens
gaacatgcagtt

SEQ ID NO: 3015190 - DNA, 15 bp, Homo sapiens
gaacatgcagtttga

SEQ ID NO: 3015191 - DNA, 19 bp, Homo sapiens
gaacatgcagtttgaaatt

SEQ ID NO: 3015192 - DNA, 15 bp, Homo sapiens
gaacatgcctgattt

SEQ ID NO: 3015193 - DNA, 19 bp, Homo sapiens
gaacatgcctgattttaaa

SEQ ID NO: 3015194 - DNA, 18 bp, Homo sapiens
gaacatggtgtgtgtctc

SEQ ID NO: 3015195 - DNA, 22 bp, Homo sapiens
gaacatggtgtgtgtctctgac

SEQ ID NO: 3015196 - DNA, 18 bp, Homo sapiens
gaacatttattttatgag

SEQ ID NO: 3015197 - DNA, 19 bp, Homo sapiens
gaacatttattttatgaga

SEQ ID NO: 3015198 - DNA, 22 bp, Homo sapiens
gaacatttattttatgagaaat

SEQ ID NO: 3015199 - DNA, 13 bp, Homo sapiens
gaacatttgtgat

SEQ ID NO: 3015200 - DNA, 19 bp, Homo sapiens
gaaccaaattgcactgaag

SEQ ID NO: 3015201 - DNA, 19 bp, Homo sapiens
gaaccaacaagtaaatatt

SEQ ID NO: 3015202 - DNA, 13 bp, Homo sapiens
gaaccaaccccca

SEQ ID NO: 3015203 - DNA, 15 bp, Homo sapiens
gaaccagcagaacag

SEQ ID NO: 3015204 - DNA, 22 bp, Homo sapiens
gaaccagcagaagccagagggt

SEQ ID NO: 3015205 - DNA, 19 bp, Homo sapiens
gaaccagtccccccaccct

SEQ ID NO: 3015206 - DNA, 19 bp, Homo sapiens
gaaccataggactgtggca

SEQ ID NO: 3015207 - DNA, 22 bp, Homo sapiens
gaaccatgcaggaaggaaaact

SEQ ID NO: 3015208 - DNA, 16 bp, Homo sapiens
gaacccaggaggtgga

SEQ ID NO: 3015209 - DNA, 20 bp, Homo sapiens
gaaccccggggtgcccacag

SEQ ID NO: 3015210 - DNA, 13 bp, Homo sapiens
gaaccgcaggaag

SEQ ID NO: 3015211 - DNA, 16 bp, Homo sapiens
gaaccgcaggaagctg

SEQ ID NO: 3015212 - DNA, 17 bp, Homo sapiens
gaaccgttttgaagcta

SEQ ID NO: 3015213 - DNA, 20 bp, Homo sapiens
gaacctaactgtatcttgag

SEQ ID NO: 3015214 - DNA, 21 bp, Homo sapiens
gaacctcaccccgaggccctg

SEQ ID NO: 3015215 - DNA, 14 bp, Homo sapiens
gaacctcagcctgg

SEQ ID NO: 3015216 - DNA, 21 bp, Homo sapiens
gaacctcagcctggccagaca

SEQ ID NO: 3015217 - DNA, 13 bp, Homo sapiens
gaacctcctctgt

SEQ ID NO: 3015218 - DNA, 14 bp, Homo sapiens
gaacctcctctgtg

SEQ ID NO: 3015219 - DNA, 15 bp, Homo sapiens
gaacctcctctgtga

SEQ ID NO: 3015220 - DNA, 15 bp, Homo sapiens
gaacctcgagtactg

SEQ ID NO: 3015221 - DNA, 19 bp, Homo sapiens
gaacctcggggtgggggtg

SEQ ID NO: 3015222 - DNA, 20 bp, Homo sapiens
gaacctgacatccactgttt

SEQ ID NO: 3015223 - DNA, 13 bp, Homo sapiens
gaacctgcaagcc

SEQ ID NO: 3015224 - DNA, 19 bp, Homo sapiens
gaacctgtaggatcttatt

SEQ ID NO: 3015225 - DNA, 18 bp, Homo sapiens
gaaccttctggcctccca

SEQ ID NO: 3015226 - DNA, 22 bp, Homo sapiens
gaaccttgaagaagtggctgcc

SEQ ID NO: 3015227 - DNA, 13 bp, Homo sapiens
gaaccttgttatt

SEQ ID NO: 3015228 - DNA, 15 bp, Homo sapiens
gaacctttcccttgt

SEQ ID NO: 3015229 - DNA, 16 bp, Homo sapiens
gaacctttcccttgtg

SEQ ID NO: 3015230 - DNA, 14 bp, Homo sapiens
gaacctttctgtgt

SEQ ID NO: 3015231 - DNA, 19 bp, Homo sapiens
gaacgaacacaagaaaaag

SEQ ID NO: 3015232 - DNA, 21 bp, Homo sapiens
gaacggccctgcaggagcagg

SEQ ID NO: 3015233 - DNA, 16 bp, Homo sapiens
gaacgtggctctgctg

SEQ ID NO: 3015234 - DNA, 17 bp, Homo sapiens
gaactaaactcatttat

SEQ ID NO: 3015235 - DNA, 19 bp, Homo sapiens
gaactaagttttgtgtgta

SEQ ID NO: 3015236 - DNA, 19 bp, Homo sapiens
gaactaatttcttctcctg

SEQ ID NO: 3015237 - DNA, 20 bp, Homo sapiens
gaactaccttggttccccca

SEQ ID NO: 3015238 - DNA, 17 bp, Homo sapiens
gaactagagatgtgcaa

SEQ ID NO: 3015239 - DNA, 21 bp, Homo sapiens
gaactagagcttgcagtgaag

SEQ ID NO: 3015240 - DNA, 22 bp, Homo sapiens
gaactaggtagattgttttgtt

SEQ ID NO: 3015241 - DNA, 21 bp, Homo sapiens
gaactattccatcaataggca

SEQ ID NO: 3015242 - DNA, 19 bp, Homo sapiens
gaactcaaatggggccaga

SEQ ID NO: 3015243 - DNA, 20 bp, Homo sapiens
gaactcaaatggggccagat

SEQ ID NO: 3015244 - DNA, 22 bp, Homo sapiens
gaactcaaatggggccagatcc

SEQ ID NO: 3015245 - DNA, 13 bp, Homo sapiens
gaactcagatcca

SEQ ID NO: 3015246 - DNA, 16 bp, Homo sapiens
gaactcagatccaggg

SEQ ID NO: 3015247 - DNA, 15 bp, Homo sapiens
gaactcagccaagca

SEQ ID NO: 3015248 - DNA, 14 bp, Homo sapiens
gaactcatcactgt

SEQ ID NO: 3015249 - DNA, 19 bp, Homo sapiens
gaactccagctggtgcccc

SEQ ID NO: 3015250 - DNA, 13 bp, Homo sapiens
gaactccaggctg

SEQ ID NO: 3015251 - DNA, 22 bp, Homo sapiens
gaactcccccgaagaaggacca

SEQ ID NO: 3015252 - DNA, 16 bp, Homo sapiens
gaactccttccccact

SEQ ID NO: 3015253 - DNA, 17 bp, Homo sapiens
gaactccttccccactt

SEQ ID NO: 3015254 - DNA, 15 bp, Homo sapiens
gaactcgcacctgtg

SEQ ID NO: 3015255 - DNA, 13 bp, Homo sapiens
gaactctctgtct

SEQ ID NO: 3015256 - DNA, 18 bp, Homo sapiens
gaactctggtggcacagg

SEQ ID NO: 3015257 - DNA, 19 bp, Homo sapiens
gaactctggtggcacagga

SEQ ID NO: 3015258 - DNA, 13 bp, Homo sapiens
gaactgaaaagag

SEQ ID NO: 3015259 - DNA, 14 bp, Homo sapiens
gaactgaaaagaga

SEQ ID NO: 3015260 - DNA, 19 bp, Homo sapiens
gaactgaaaagagagcaga

SEQ ID NO: 3015261 - DNA, 21 bp, Homo sapiens
gaactgaaaagagagcagaga

SEQ ID NO: 3015262 - DNA, 14 bp, Homo sapiens
gaactgagaccttg

SEQ ID NO: 3015263 - DNA, 22 bp, Homo sapiens
gaactgaggagcggactcactt

SEQ ID NO: 3015264 - DNA, 15 bp, Homo sapiens
gaactgaggccttgt

SEQ ID NO: 3015265 - DNA, 20 bp, Homo sapiens
gaactgcacatgaagaaata

SEQ ID NO: 3015266 - DNA, 19 bp, Homo sapiens
gaactgcagcaatctttga

SEQ ID NO: 3015267 - DNA, 21 bp, Homo sapiens
gaactgcagcaatctttgaaa

SEQ ID NO: 3015268 - DNA, 14 bp, Homo sapiens
gaactgctggggct

SEQ ID NO: 3015269 - DNA, 23 bp, Homo sapiens
gaactgctggggctggtgaggcc

SEQ ID NO: 3015270 - DNA, 15 bp, Homo sapiens
gaactggaacacaca

SEQ ID NO: 3015271 - DNA, 23 bp, Homo sapiens
gaactggttcaagagacactgct

SEQ ID NO: 3015272 - DNA, 14 bp, Homo sapiens
gaactgtactgttt

SEQ ID NO: 3015273 - DNA, 15 bp, Homo sapiens
gaactgtactgtttt

SEQ ID NO: 3015274 - DNA, 16 bp, Homo sapiens
gaactgtattattgca

SEQ ID NO: 3015275 - DNA, 12 bp, Homo sapiens
gaactgtcccag

SEQ ID NO: 3015276 - DNA, 14 bp, Homo sapiens
gaactgttggttat

SEQ ID NO: 3015277 - DNA, 20 bp, Homo sapiens
gaacttcacctgcaaagctc

SEQ ID NO: 3015278 - DNA, 22 bp, Homo sapiens
gaacttcaggtgtgactctagc

SEQ ID NO: 3015279 - DNA, 18 bp, Homo sapiens
gaacttcgcatcaaaaga

SEQ ID NO: 3015280 - DNA, 23 bp, Homo sapiens
gaacttcgcatcaaaagacaatt

SEQ ID NO: 3015281 - DNA, 16 bp, Homo sapiens
gaacttctccgtcctc

SEQ ID NO: 3015282 - DNA, 20 bp, Homo sapiens
gaactttcctggatgtctga

SEQ ID NO: 3015283 - DNA, 14 bp, Homo sapiens
gaactttgggaagc

SEQ ID NO: 3015284 - DNA, 22 bp, Homo sapiens
gaactttgtgcttcaaggacat

SEQ ID NO: 3015285 - DNA, 14 bp, Homo sapiens
gaagaaaacaaagt

SEQ ID NO: 3015286 - DNA, 23 bp, Homo sapiens
gaagaaaatggaaccaggcttgg

SEQ ID NO: 3015287 - DNA, 12 bp, Homo sapiens
gaagaaacaaaa

SEQ ID NO: 3015288 - DNA, 15 bp, Homo sapiens
gaagaaagtggaaaa

SEQ ID NO: 3015289 - DNA, 17 bp, Homo sapiens
gaagaaatactgcactt

SEQ ID NO: 3015290 - DNA, 22 bp, Homo sapiens
gaagaaattataaagataaagc

SEQ ID NO: 3015291 - DNA, 22 bp, Homo sapiens
gaagaaccagtccccccaccct

SEQ ID NO: 3015292 - DNA, 18 bp, Homo sapiens
gaagaaccgacccacccc

SEQ ID NO: 3015293 - DNA, 14 bp, Homo sapiens
gaagaagccctgtt

SEQ ID NO: 3015294 - DNA, 16 bp, Homo sapiens
gaagaatctttcttct

SEQ ID NO: 3015295 - DNA, 18 bp, Homo sapiens
gaagaattgaacccagga

SEQ ID NO: 3015296 - DNA, 19 bp, Homo sapiens
gaagaattgaacccaggag

SEQ ID NO: 3015297 - DNA, 20 bp, Homo sapiens
gaagaattgaacccaggagg

SEQ ID NO: 3015298 - DNA, 13 bp, Homo sapiens
gaagaattttaaa

SEQ ID NO: 3015299 - DNA, 15 bp, Homo sapiens
gaagaattttaaaaa

SEQ ID NO: 3015300 - DNA, 17 bp, Homo sapiens
gaagaattttcagaccc

SEQ ID NO: 3015301 - DNA, 13 bp, Homo sapiens
gaagacaacagaa

SEQ ID NO: 3015302 - DNA, 14 bp, Homo sapiens
gaagacaattgaca

SEQ ID NO: 3015303 - DNA, 14 bp, Homo sapiens
gaagacatatatta

SEQ ID NO: 3015304 - DNA, 21 bp, Homo sapiens
gaagacatatattatatatag

SEQ ID NO: 3015305 - DNA, 23 bp, Homo sapiens
gaagacatatattatatatagaa

SEQ ID NO: 3015306 - DNA, 12 bp, Homo sapiens
gaagacatgttt

SEQ ID NO: 3015307 - DNA, 19 bp, Homo sapiens
gaagacattttttgctata

SEQ ID NO: 3015308 - DNA, 22 bp, Homo sapiens
gaagaccaaggcctcggcagaa

SEQ ID NO: 3015309 - DNA, 21 bp, Homo sapiens
gaagaccccagatgtgagggc

SEQ ID NO: 3015310 - DNA, 19 bp, Homo sapiens
gaagacctcacctagaaat

SEQ ID NO: 3015311 - DNA, 20 bp, Homo sapiens
gaagacctcacctagaaatt

SEQ ID NO: 3015312 - DNA, 16 bp, Homo sapiens
gaagacgtcaggggca

SEQ ID NO: 3015313 - DNA, 19 bp, Homo sapiens
gaagactgctaaatgcact

SEQ ID NO: 3015314 - DNA, 15 bp, Homo sapiens
gaagactggaagcta

SEQ ID NO: 3015315 - DNA, 16 bp, Homo sapiens
gaagactggaagctaa

SEQ ID NO: 3015316 - DNA, 15 bp, Homo sapiens
gaagactggagaaat

SEQ ID NO: 3015317 - DNA, 15 bp, Homo sapiens
gaagactgtgacatc

SEQ ID NO: 3015318 - DNA, 13 bp, Homo sapiens
gaagagagaactt

SEQ ID NO: 3015319 - DNA, 17 bp, Homo sapiens
gaagagatccaaagact

SEQ ID NO: 3015320 - DNA, 18 bp, Homo sapiens
gaagagcaggactccagg

SEQ ID NO: 3015321 - DNA, 16 bp, Homo sapiens
gaagagccggagcctc

SEQ ID NO: 3015322 - DNA, 21 bp, Homo sapiens
gaagagctcaagggacaagga

SEQ ID NO: 3015323 - DNA, 23 bp, Homo sapiens
gaagagctcaagggacaaggaca

SEQ ID NO: 3015324 - DNA, 17 bp, Homo sapiens
gaagaggaaaaggctgg

SEQ ID NO: 3015325 - DNA, 14 bp, Homo sapiens
gaagaggaacagtg

SEQ ID NO: 3015326 - DNA, 19 bp, Homo sapiens
gaagaggagcctcagaaga

SEQ ID NO: 3015327 - DNA, 20 bp, Homo sapiens
gaagaggaggaggtgggggc

SEQ ID NO: 3015328 - DNA, 15 bp, Homo sapiens
gaagagggggagggg

SEQ ID NO: 3015329 - DNA, 23 bp, Homo sapiens
gaagaggggtggtggggggcagg

SEQ ID NO: 3015330 - DNA, 14 bp, Homo sapiens
gaagagtcctctga

SEQ ID NO: 3015331 - DNA, 21 bp, Homo sapiens
gaagagttgccccgtctctgt

SEQ ID NO: 3015332 - DNA, 14 bp, Homo sapiens
gaagatcctgtgag

SEQ ID NO: 3015333 - DNA, 20 bp, Homo sapiens
gaagatctacctgcaacaca

SEQ ID NO: 3015334 - DNA, 21 bp, Homo sapiens
gaagatctacctgcaacacaa

SEQ ID NO: 3015335 - DNA, 21 bp, Homo sapiens
gaagatctcactctgcccccc

SEQ ID NO: 3015336 - DNA, 19 bp, Homo sapiens
gaagatctctgcagggccg

SEQ ID NO: 3015337 - DNA, 16 bp, Homo sapiens
gaagatctgcaaacat

SEQ ID NO: 3015338 - DNA, 13 bp, Homo sapiens
gaagatctgtaat

SEQ ID NO: 3015339 - DNA, 21 bp, Homo sapiens
gaagatcttgatggtgtttct

SEQ ID NO: 3015340 - DNA, 19 bp, Homo sapiens
gaagatgaaaccgtccctg

SEQ ID NO: 3015341 - DNA, 20 bp, Homo sapiens
gaagatgaaaccgtccctga

SEQ ID NO: 3015342 - DNA, 15 bp, Homo sapiens
gaagatgaatggcgt

SEQ ID NO: 3015343 - DNA, 22 bp, Homo sapiens
gaagatgcaggtttgaccagga

SEQ ID NO: 3015344 - DNA, 20 bp, Homo sapiens
gaagatggcatcctgtgaag

SEQ ID NO: 3015345 - DNA, 19 bp, Homo sapiens
gaagattgaaaaaaataaa

SEQ ID NO: 3015346 - DNA, 17 bp, Homo sapiens
gaagattttggtaatga

SEQ ID NO: 3015347 - DNA, 17 bp, Homo sapiens
gaagcaacgtgttaatt

SEQ ID NO: 3015348 - DNA, 17 bp, Homo sapiens
gaagcaagctgtgttac

SEQ ID NO: 3015349 - DNA, 18 bp, Homo sapiens
gaagcaagctgtgttact

SEQ ID NO: 3015350 - DNA, 22 bp, Homo sapiens
gaagcaatcagcaaacacaata

SEQ ID NO: 3015351 - DNA, 19 bp, Homo sapiens
gaagcaattatttaaagaa

SEQ ID NO: 3015352 - DNA, 15 bp, Homo sapiens
gaagcagagagcaca

SEQ ID NO: 3015353 - DNA, 21 bp, Homo sapiens
gaagcagatgcaaagaggcaa

SEQ ID NO: 3015354 - DNA, 12 bp, Homo sapiens
gaagcagctctg

SEQ ID NO: 3015355 - DNA, 14 bp, Homo sapiens
gaagcagctctgcc

SEQ ID NO: 3015356 - DNA, 15 bp, Homo sapiens
gaagcagctctgcct

SEQ ID NO: 3015357 - DNA, 17 bp, Homo sapiens
gaagcagctctgccttc

SEQ ID NO: 3015358 - DNA, 15 bp, Homo sapiens
gaagcataatttgtt

SEQ ID NO: 3015359 - DNA, 18 bp, Homo sapiens
gaagcataatttgtttaa

SEQ ID NO: 3015360 - DNA, 22 bp, Homo sapiens
gaagcataatttgtttaaaatt

SEQ ID NO: 3015361 - DNA, 13 bp, Homo sapiens
gaagcatcctccc

SEQ ID NO: 3015362 - DNA, 17 bp, Homo sapiens
gaagcatcctccccacc

SEQ ID NO: 3015363 - DNA, 22 bp, Homo sapiens
gaagcatcctccccaccagagc

SEQ ID NO: 3015364 - DNA, 14 bp, Homo sapiens
gaagcattcacaaa

SEQ ID NO: 3015365 - DNA, 22 bp, Homo sapiens
gaagcatttcaaagccctgcct

SEQ ID NO: 3015366 - DNA, 19 bp, Homo sapiens
gaagcatttgtttctactt

SEQ ID NO: 3015367 - DNA, 13 bp, Homo sapiens
gaagccaaagagt

SEQ ID NO: 3015368 - DNA, 12 bp, Homo sapiens
gaagccacagaa

SEQ ID NO: 3015369 - DNA, 19 bp, Homo sapiens
gaagccacagcccaggcct

SEQ ID NO: 3015370 - DNA, 18 bp, Homo sapiens
gaagccaccctcccagct

SEQ ID NO: 3015371 - DNA, 22 bp, Homo sapiens
gaagccaccctcccagctctga

SEQ ID NO: 3015372 - DNA, 18 bp, Homo sapiens
gaagccacccttccctgc

SEQ ID NO: 3015373 - DNA, 19 bp, Homo sapiens
gaagccacccttccctgcc

SEQ ID NO: 3015374 - DNA, 21 bp, Homo sapiens
gaagccacccttccctgcctc

SEQ ID NO: 3015375 - DNA, 14 bp, Homo sapiens
gaagccaccttccc

SEQ ID NO: 3015376 - DNA, 19 bp, Homo sapiens
gaagccagagggtgggagg

SEQ ID NO: 3015377 - DNA, 24 bp, Homo sapiens
gaagccaggaatttcccaggaccc

SEQ ID NO: 3015378 - DNA, 18 bp, Homo sapiens
gaagcccactgcctcctc

SEQ ID NO: 3015379 - DNA, 23 bp, Homo sapiens
gaagcccactgcctcctccctgg

SEQ ID NO: 3015380 - DNA, 17 bp, Homo sapiens
gaagccccacatgtcca

SEQ ID NO: 3015381 - DNA, 23 bp, Homo sapiens
gaagccccacatgtccagcacct

SEQ ID NO: 3015382 - DNA, 14 bp, Homo sapiens
gaagcccccagcta

SEQ ID NO: 3015383 - DNA, 21 bp, Homo sapiens
gaagcccccagctaagaacct

SEQ ID NO: 3015384 - DNA, 13 bp, Homo sapiens
gaagccctcccag

SEQ ID NO: 3015385 - DNA, 15 bp, Homo sapiens
gaagccctcccaggt

SEQ ID NO: 3015386 - DNA, 14 bp, Homo sapiens
gaagccctccttcc

SEQ ID NO: 3015387 - DNA, 15 bp, Homo sapiens
gaagccctccttcca

SEQ ID NO: 3015388 - DNA, 11 bp, Homo sapiens
gaagccctgga

SEQ ID NO: 3015389 - DNA, 18 bp, Homo sapiens
gaagccctggatttcaga

SEQ ID NO: 3015390 - DNA, 19 bp, Homo sapiens
gaagccctggatttcagaa

SEQ ID NO: 3015391 - DNA, 11 bp, Homo sapiens
gaagccctgtt

SEQ ID NO: 3015392 - DNA, 14 bp, Homo sapiens
gaagccctgttctc

SEQ ID NO: 3015393 - DNA, 15 bp, Homo sapiens
gaagcctccttacat

SEQ ID NO: 3015394 - DNA, 17 bp, Homo sapiens
gaagcctccttacatta

SEQ ID NO: 3015395 - DNA, 19 bp, Homo sapiens
gaagcctccttacattaaa

SEQ ID NO: 3015396 - DNA, 15 bp, Homo sapiens
gaagcctgaactgag

SEQ ID NO: 3015397 - DNA, 18 bp, Homo sapiens
gaagcctgaactgaggcc

SEQ ID NO: 3015398 - DNA, 16 bp, Homo sapiens
gaagcctgtcctcacc

SEQ ID NO: 3015399 - DNA, 19 bp, Homo sapiens
gaagcctttactgaccctg

SEQ ID NO: 3015400 - DNA, 15 bp, Homo sapiens
gaagcctttcctgta

SEQ ID NO: 3015401 - DNA, 15 bp, Homo sapiens
gaagcgaacatcttc

SEQ ID NO: 3015402 - DNA, 16 bp, Homo sapiens
gaagcgaacatcttca

SEQ ID NO: 3015403 - DNA, 22 bp, Homo sapiens
gaagcgaacatcttcatataaa

SEQ ID NO: 3015404 - DNA, 16 bp, Homo sapiens
gaagcggtcagactgg

SEQ ID NO: 3015405 - DNA, 19 bp, Homo sapiens
gaagcgttgtcctcagccc

SEQ ID NO: 3015406 - DNA, 14 bp, Homo sapiens
gaagctaatttgca

SEQ ID NO: 3015407 - DNA, 14 bp, Homo sapiens
gaagctacaggtta

SEQ ID NO: 3015408 - DNA, 19 bp, Homo sapiens
gaagctacaggttacaaca

SEQ ID NO: 3015409 - DNA, 15 bp, Homo sapiens
gaagctactgtgtgt

SEQ ID NO: 3015410 - DNA, 20 bp, Homo sapiens
gaagctactgtgtgtgtgaa

SEQ ID NO: 3015411 - DNA, 19 bp, Homo sapiens
gaagctataaattcctctt

SEQ ID NO: 3015412 - DNA, 20 bp, Homo sapiens
gaagctcacctgttgcttac

SEQ ID NO: 3015413 - DNA, 14 bp, Homo sapiens
gaagctcagactgg

SEQ ID NO: 3015414 - DNA, 19 bp, Homo sapiens
gaagctcctctccccagcc

SEQ ID NO: 3015415 - DNA, 20 bp, Homo sapiens
gaagctcctctccccagccc

SEQ ID NO: 3015416 - DNA, 23 bp, Homo sapiens
gaagctcctctccccagcccaga

SEQ ID NO: 3015417 - DNA, 20 bp, Homo sapiens
gaagctcgcatccagacagt

SEQ ID NO: 3015418 - DNA, 19 bp, Homo sapiens
gaagctctcgggctaggaa

SEQ ID NO: 3015419 - DNA, 18 bp, Homo sapiens
gaagctgacgaacttcca

SEQ ID NO: 3015420 - DNA, 19 bp, Homo sapiens
gaagctgacgaacttccat

SEQ ID NO: 3015421 - DNA, 14 bp, Homo sapiens
gaagctgagcacca

SEQ ID NO: 3015422 - DNA, 17 bp, Homo sapiens
gaagctgagcaccaggg

SEQ ID NO: 3015423 - DNA, 14 bp, Homo sapiens
gaagctgctgcagc

SEQ ID NO: 3015424 - DNA, 14 bp, Homo sapiens
gaagctggagtgct

SEQ ID NO: 3015425 - DNA, 22 bp, Homo sapiens
gaagctgtgtccttgcacctgc

SEQ ID NO: 3015426 - DNA, 16 bp, Homo sapiens
gaagctgttgggagaa

SEQ ID NO: 3015427 - DNA, 21 bp, Homo sapiens
gaagctgttgggagaaagcaa

SEQ ID NO: 3015428 - DNA, 16 bp, Homo sapiens
gaagcttatgtttctt

SEQ ID NO: 3015429 - DNA, 18 bp, Homo sapiens
gaagcttatgtttcttat

SEQ ID NO: 3015430 - DNA, 22 bp, Homo sapiens
gaagctttatttatagaaatga

SEQ ID NO: 3015431 - DNA, 21 bp, Homo sapiens
gaaggaaaaaattatgttttt

SEQ ID NO: 3015432 - DNA, 14 bp, Homo sapiens
gaaggaaaggcaga

SEQ ID NO: 3015433 - DNA, 15 bp, Homo sapiens
gaaggaaatgagtgg

SEQ ID NO: 3015434 - DNA, 13 bp, Homo sapiens
gaaggaacagtta

SEQ ID NO: 3015435 - DNA, 20 bp, Homo sapiens
gaaggaagccggggaagaga

SEQ ID NO: 3015436 - DNA, 23 bp, Homo sapiens
gaaggaaggagactcacctctgc

SEQ ID NO: 3015437 - DNA, 21 bp, Homo sapiens
gaaggacattttctctttaaa

SEQ ID NO: 3015438 - DNA, 12 bp, Homo sapiens
gaaggacccctc

SEQ ID NO: 3015439 - DNA, 16 bp, Homo sapiens
gaaggacccctcacca

SEQ ID NO: 3015440 - DNA, 17 bp, Homo sapiens
gaaggacccctcaccac

SEQ ID NO: 3015441 - DNA, 17 bp, Homo sapiens
gaaggacttagccgact

SEQ ID NO: 3015442 - DNA, 16 bp, Homo sapiens
gaaggagacaggcaga

SEQ ID NO: 3015443 - DNA, 17 bp, Homo sapiens
gaaggagactcacctct

SEQ ID NO: 3015444 - DNA, 20 bp, Homo sapiens
gaaggagactcacctctgcc

SEQ ID NO: 3015445 - DNA, 15 bp, Homo sapiens
gaaggagagatgacc

SEQ ID NO: 3015446 - DNA, 13 bp, Homo sapiens
gaaggagcccctg

SEQ ID NO: 3015447 - DNA, 22 bp, Homo sapiens
gaaggagcggcgccctggactt

SEQ ID NO: 3015448 - DNA, 23 bp, Homo sapiens
gaaggagcggcgccctggacttg

SEQ ID NO: 3015449 - DNA, 14 bp, Homo sapiens
gaaggaggctggct

SEQ ID NO: 3015450 - DNA, 20 bp, Homo sapiens
gaaggaggtaaaggatgagg

SEQ ID NO: 3015451 - DNA, 21 bp, Homo sapiens
gaaggaggtaaaggatgaggg

SEQ ID NO: 3015452 - DNA, 19 bp, Homo sapiens
gaaggatcccatgagctcc

SEQ ID NO: 3015453 - DNA, 18 bp, Homo sapiens
gaaggcaacttgaagaaa

SEQ ID NO: 3015454 - DNA, 12 bp, Homo sapiens
gaaggcagaata

SEQ ID NO: 3015455 - DNA, 14 bp, Homo sapiens
gaaggcagcattcc

SEQ ID NO: 3015456 - DNA, 21 bp, Homo sapiens
gaaggcaggagttgggggcag

SEQ ID NO: 3015457 - DNA, 17 bp, Homo sapiens
gaaggcatttgcagggt

SEQ ID NO: 3015458 - DNA, 19 bp, Homo sapiens
gaaggcatttgcagggtcc

SEQ ID NO: 3015459 - DNA, 12 bp, Homo sapiens
gaaggcccatga

SEQ ID NO: 3015460 - DNA, 18 bp, Homo sapiens
gaaggccgagaagcaaga

SEQ ID NO: 3015461 - DNA, 13 bp, Homo sapiens
gaaggcctcccct

SEQ ID NO: 3015462 - DNA, 21 bp, Homo sapiens
gaaggctcatttacttgaaat

SEQ ID NO: 3015463 - DNA, 14 bp, Homo sapiens
gaaggctggcatga

SEQ ID NO: 3015464 - DNA, 12 bp, Homo sapiens
gaaggctgtcct

SEQ ID NO: 3015465 - DNA, 16 bp, Homo sapiens
gaaggcttctctctgt

SEQ ID NO: 3015466 - DNA, 19 bp, Homo sapiens
gaaggcttgttgtgctttt

SEQ ID NO: 3015467 - DNA, 18 bp, Homo sapiens
gaagggagagggcctctg

SEQ ID NO: 3015468 - DNA, 15 bp, Homo sapiens
gaagggagggagctg

SEQ ID NO: 3015469 - DNA, 17 bp, Homo sapiens
gaagggaggggaagggg

SEQ ID NO: 3015470 - DNA, 18 bp, Homo sapiens
gaagggcatcatgcatct

SEQ ID NO: 3015471 - DNA, 17 bp, Homo sapiens
gaagggcatgcacgggc

SEQ ID NO: 3015472 - DNA, 18 bp, Homo sapiens
gaagggccagagccaggg

SEQ ID NO: 3015473 - DNA, 23 bp, Homo sapiens
gaagggctggggccggggctgag

SEQ ID NO: 3015474 - DNA, 20 bp, Homo sapiens
gaagggcttacaggcatgga

SEQ ID NO: 3015475 - DNA, 21 bp, Homo sapiens
gaaggggacccccgccccctg

SEQ ID NO: 3015476 - DNA, 17 bp, Homo sapiens
gaaggggccagaggctc

SEQ ID NO: 3015477 - DNA, 20 bp, Homo sapiens
gaaggggccggggagggggc

SEQ ID NO: 3015478 - DNA, 14 bp, Homo sapiens
gaaggggcctccct

SEQ ID NO: 3015479 - DNA, 21 bp, Homo sapiens
gaaggggcgtctgttccccct

SEQ ID NO: 3015480 - DNA, 17 bp, Homo sapiens
gaaggggttggattgca

SEQ ID NO: 3015481 - DNA, 20 bp, Homo sapiens
gaaggtactgtcatgggcta

SEQ ID NO: 3015482 - DNA, 13 bp, Homo sapiens
gaaggtcagcaaa

SEQ ID NO: 3015483 - DNA, 17 bp, Homo sapiens
gaaggtcccctggcagt

SEQ ID NO: 3015484 - DNA, 20 bp, Homo sapiens
gaaggtcccctggcagtgct

SEQ ID NO: 3015485 - DNA, 16 bp, Homo sapiens
gaaggtcctagcttta

SEQ ID NO: 3015486 - DNA, 21 bp, Homo sapiens
gaaggtctgatttgcaggatt

SEQ ID NO: 3015487 - DNA, 19 bp, Homo sapiens
gaaggtgaactttgtgctt

SEQ ID NO: 3015488 - DNA, 15 bp, Homo sapiens
gaaggtgccagaagg

SEQ ID NO: 3015489 - DNA, 15 bp, Homo sapiens
gaaggtggacctggc

SEQ ID NO: 3015490 - DNA, 17 bp, Homo sapiens
gaaggtggacctggcag

SEQ ID NO: 3015491 - DNA, 14 bp, Homo sapiens
gaaggtgtgctaca

SEQ ID NO: 3015492 - DNA, 15 bp, Homo sapiens
gaaggttaaaggaaa

SEQ ID NO: 3015493 - DNA, 16 bp, Homo sapiens
gaaggtttgtgttttt

SEQ ID NO: 3015494 - DNA, 15 bp, Homo sapiens
gaagtaaagaactgc

SEQ ID NO: 3015495 - DNA, 17 bp, Homo sapiens
gaagtaagaagaggagc

SEQ ID NO: 3015496 - DNA, 20 bp, Homo sapiens
gaagtaagaagaggagcctc

SEQ ID NO: 3015497 - DNA, 23 bp, Homo sapiens
gaagtacttgccagaagttgtgg

SEQ ID NO: 3015498 - DNA, 14 bp, Homo sapiens
gaagtattgtttac

SEQ ID NO: 3015499 - DNA, 15 bp, Homo sapiens
gaagtatttgagaga

SEQ ID NO: 3015500 - DNA, 14 bp, Homo sapiens
gaagtattttcctc

SEQ ID NO: 3015501 - DNA, 16 bp, Homo sapiens
gaagtattttcctcca

SEQ ID NO: 3015502 - DNA, 19 bp, Homo sapiens
gaagtcacaacaaaaggaa

SEQ ID NO: 3015503 - DNA, 20 bp, Homo sapiens
gaagtcacaacaaaaggaag

SEQ ID NO: 3015504 - DNA, 19 bp, Homo sapiens
gaagtcagagaaaacactt

SEQ ID NO: 3015505 - DNA, 18 bp, Homo sapiens
gaagtcataccaatgaaa

SEQ ID NO: 3015506 - DNA, 15 bp, Homo sapiens
gaagtcattaaactg

SEQ ID NO: 3015507 - DNA, 17 bp, Homo sapiens
gaagtcattaaactggt

SEQ ID NO: 3015508 - DNA, 13 bp, Homo sapiens
gaagtccaggact

SEQ ID NO: 3015509 - DNA, 20 bp, Homo sapiens
gaagtccaggactgggtctg

SEQ ID NO: 3015510 - DNA, 16 bp, Homo sapiens
gaagtccccaggcccc

SEQ ID NO: 3015511 - DNA, 23 bp, Homo sapiens
gaagtccccaggccccaggaagc

SEQ ID NO: 3015512 - DNA, 12 bp, Homo sapiens
gaagtccctcag

SEQ ID NO: 3015513 - DNA, 23 bp, Homo sapiens
gaagtcctaagaagtggggcaga

SEQ ID NO: 3015514 - DNA, 16 bp, Homo sapiens
gaagtcctgggaggat

SEQ ID NO: 3015515 - DNA, 15 bp, Homo sapiens
gaagtctaggagctg

SEQ ID NO: 3015516 - DNA, 20 bp, Homo sapiens
gaagtctaggagctgggagg

SEQ ID NO: 3015517 - DNA, 20 bp, Homo sapiens
gaagtctgatggtgagcagt

SEQ ID NO: 3015518 - DNA, 12 bp, Homo sapiens
gaagtgacaggg

SEQ ID NO: 3015519 - DNA, 18 bp, Homo sapiens
gaagtgcaaatttgatac

SEQ ID NO: 3015520 - DNA, 20 bp, Homo sapiens
gaagtgctcccctctgaaag

SEQ ID NO: 3015521 - DNA, 14 bp, Homo sapiens
gaagtgctgctcca

SEQ ID NO: 3015522 - DNA, 16 bp, Homo sapiens
gaagtggaccaggaca

SEQ ID NO: 3015523 - DNA, 16 bp, Homo sapiens
gaagtggccttgcccg

SEQ ID NO: 3015524 - DNA, 18 bp, Homo sapiens
gaagtgggccaggacagg

SEQ ID NO: 3015525 - DNA, 21 bp, Homo sapiens
gaagtgggccaggacaggccc

SEQ ID NO: 3015526 - DNA, 21 bp, Homo sapiens
gaagtggggaccccacccctc

SEQ ID NO: 3015527 - DNA, 16 bp, Homo sapiens
gaagtggttcagtcta

SEQ ID NO: 3015528 - DNA, 14 bp, Homo sapiens
gaagtgtcatgttt

SEQ ID NO: 3015529 - DNA, 20 bp, Homo sapiens
gaagtgtgattgggaataaa

SEQ ID NO: 3015530 - DNA, 17 bp, Homo sapiens
gaagtgttaatactagt

SEQ ID NO: 3015531 - DNA, 15 bp, Homo sapiens
gaagtgttcctgtct

SEQ ID NO: 3015532 - DNA, 17 bp, Homo sapiens
gaagtgttcctgtctca

SEQ ID NO: 3015533 - DNA, 18 bp, Homo sapiens
gaagtgttcctgtctcaa

SEQ ID NO: 3015534 - DNA, 17 bp, Homo sapiens
gaagttacatgcataaa

SEQ ID NO: 3015535 - DNA, 16 bp, Homo sapiens
gaagttactttcttaa

SEQ ID NO: 3015536 - DNA, 14 bp, Homo sapiens
gaagttagaattcc

SEQ ID NO: 3015537 - DNA, 21 bp, Homo sapiens
gaagttagaattccttcaggg

SEQ ID NO: 3015538 - DNA, 19 bp, Homo sapiens
gaagttcaccattaaaagg

SEQ ID NO: 3015539 - DNA, 14 bp, Homo sapiens
gaagttcattttta

SEQ ID NO: 3015540 - DNA, 21 bp, Homo sapiens
gaagttggtcttactttgtgc

SEQ ID NO: 3015541 - DNA, 19 bp, Homo sapiens
gaagttgtggatttcagtt

SEQ ID NO: 3015542 - DNA, 19 bp, Homo sapiens
gaagtttgggctaacattt

SEQ ID NO: 3015543 - DNA, 18 bp, Homo sapiens
gaagtttttgaaatacct

SEQ ID NO: 3015544 - DNA, 17 bp, Homo sapiens
gaataaaagctgtggaa

SEQ ID NO: 3015545 - DNA, 12 bp, Homo sapiens
gaataaaccaag

SEQ ID NO: 3015546 - DNA, 22 bp, Homo sapiens
gaataaacgcagaagaggggga

SEQ ID NO: 3015547 - DNA, 17 bp, Homo sapiens
gaataaagcctgctttt

SEQ ID NO: 3015548 - DNA, 15 bp, Homo sapiens
gaataaatacccatt

SEQ ID NO: 3015549 - DNA, 12 bp, Homo sapiens
gaataaatatgc

SEQ ID NO: 3015550 - DNA, 21 bp, Homo sapiens
gaataaatatgcctctccttt

SEQ ID NO: 3015551 - DNA, 11 bp, Homo sapiens
gaataagaaaa

SEQ ID NO: 3015552 - DNA, 12 bp, Homo sapiens
gaataagagacc

SEQ ID NO: 3015553 - DNA, 13 bp, Homo sapiens
gaataagttattg

SEQ ID NO: 3015554 - DNA, 19 bp, Homo sapiens
gaataagttattgcagttt

SEQ ID NO: 3015555 - DNA, 22 bp, Homo sapiens
gaataataaaatcaaaaacttt

SEQ ID NO: 3015556 - DNA, 16 bp, Homo sapiens
gaataataagcaggat

SEQ ID NO: 3015557 - DNA, 20 bp, Homo sapiens
gaataatcctaaacatatga

SEQ ID NO: 3015558 - DNA, 19 bp, Homo sapiens
gaataatttatagtaatga

SEQ ID NO: 3015559 - DNA, 22 bp, Homo sapiens
gaataatttatagtaatgagtt

SEQ ID NO: 3015560 - DNA, 19 bp, Homo sapiens
gaataatttttaattgctt

SEQ ID NO: 3015561 - DNA, 16 bp, Homo sapiens
gaatacagcagcaaga

SEQ ID NO: 3015562 - DNA, 16 bp, Homo sapiens
gaatactgcttgctta

SEQ ID NO: 3015563 - DNA, 13 bp, Homo sapiens
gaatacttgaagt

SEQ ID NO: 3015564 - DNA, 23 bp, Homo sapiens
gaatagaaataaaggatgtgatt

SEQ ID NO: 3015565 - DNA, 18 bp, Homo sapiens
gaatagcatctgtacaaa

SEQ ID NO: 3015566 - DNA, 15 bp, Homo sapiens
gaatagccacatttg

SEQ ID NO: 3015567 - DNA, 17 bp, Homo sapiens
gaataggaaataaaatt

SEQ ID NO: 3015568 - DNA, 14 bp, Homo sapiens
gaatagtcctaaaa

SEQ ID NO: 3015569 - DNA, 23 bp, Homo sapiens
gaatagtctagatggctcctctc

SEQ ID NO: 3015570 - DNA, 13 bp, Homo sapiens
gaatagtctctgg

SEQ ID NO: 3015571 - DNA, 13 bp, Homo sapiens
gaatataaatatt

SEQ ID NO: 3015572 - DNA, 15 bp, Homo sapiens
gaatataacatgaaa

SEQ ID NO: 3015573 - DNA, 21 bp, Homo sapiens
gaatatatagtgtatagaagc

SEQ ID NO: 3015574 - DNA, 20 bp, Homo sapiens
gaatatcaatataatgtttt

SEQ ID NO: 3015575 - DNA, 14 bp, Homo sapiens
gaatatgacagctg

SEQ ID NO: 3015576 - DNA, 13 bp, Homo sapiens
gaatatggacata

SEQ ID NO: 3015577 - DNA, 14 bp, Homo sapiens
gaatattttatctt

SEQ ID NO: 3015578 - DNA, 14 bp, Homo sapiens
gaatcaaaagtgcc

SEQ ID NO: 3015579 - DNA, 23 bp, Homo sapiens
gaatcaaaagtgcctcaagagga

SEQ ID NO: 3015580 - DNA, 17 bp, Homo sapiens
gaatcaaatcttacaaa

SEQ ID NO: 3015581 - DNA, 23 bp, Homo sapiens
gaatcaacaccaccgagctctgt

SEQ ID NO: 3015582 - DNA, 17 bp, Homo sapiens
gaatcacctgaacccca

SEQ ID NO: 3015583 - DNA, 18 bp, Homo sapiens
gaatcactcttgtggatg

SEQ ID NO: 3015584 - DNA, 19 bp, Homo sapiens
gaatcactcttgtggatgt

SEQ ID NO: 3015585 - DNA, 11 bp, Homo sapiens
gaatcactgtt

SEQ ID NO: 3015586 - DNA, 14 bp, Homo sapiens
gaatcactgttttt

SEQ ID NO: 3015587 - DNA, 16 bp, Homo sapiens
gaatcactgtttttag

SEQ ID NO: 3015588 - DNA, 19 bp, Homo sapiens
gaatcagaacagatgctga

SEQ ID NO: 3015589 - DNA, 16 bp, Homo sapiens
gaatcagaagaaaggc

SEQ ID NO: 3015590 - DNA, 22 bp, Homo sapiens
gaatcagaccctaccccaccac

SEQ ID NO: 3015591 - DNA, 23 bp, Homo sapiens
gaatcagaccctaccccaccacg

SEQ ID NO: 3015592 - DNA, 22 bp, Homo sapiens
gaatcagtttccaattatttga

SEQ ID NO: 3015593 - DNA, 21 bp, Homo sapiens
gaatccaaatctgtcctctgt

SEQ ID NO: 3015594 - DNA, 20 bp, Homo sapiens
gaatccacatcatattggag

SEQ ID NO: 3015595 - DNA, 23 bp, Homo sapiens
gaatccacgtattccccttccca

SEQ ID NO: 3015596 - DNA, 14 bp, Homo sapiens
gaatccatgggtct

SEQ ID NO: 3015597 - DNA, 18 bp, Homo sapiens
gaatccatgggtctggct

SEQ ID NO: 3015598 - DNA, 20 bp, Homo sapiens
gaatccatgggtctggctag

SEQ ID NO: 3015599 - DNA, 20 bp, Homo sapiens
gaatccctagactttaggct

SEQ ID NO: 3015600 - DNA, 12 bp, Homo sapiens
gaatcctgcttt

SEQ ID NO: 3015601 - DNA, 17 bp, Homo sapiens
gaatcctgggcccccag

SEQ ID NO: 3015602 - DNA, 17 bp, Homo sapiens
gaatcgttcaactccac

SEQ ID NO: 3015603 - DNA, 23 bp, Homo sapiens
gaatctaaggataatgaaataat

SEQ ID NO: 3015604 - DNA, 22 bp, Homo sapiens
gaatctacatttgtttgtattc

SEQ ID NO: 3015605 - DNA, 22 bp, Homo sapiens
gaatctacccccagatccaagc

SEQ ID NO: 3015606 - DNA, 16 bp, Homo sapiens
gaatctatgaacctga

SEQ ID NO: 3015607 - DNA, 21 bp, Homo sapiens
gaatctcccagacttgtttcc

SEQ ID NO: 3015608 - DNA, 21 bp, Homo sapiens
gaatctctatgtatattctat

SEQ ID NO: 3015609 - DNA, 20 bp, Homo sapiens
gaatctctcaaacggcaaca

SEQ ID NO: 3015610 - DNA, 18 bp, Homo sapiens
gaatctctgaatttgaga

SEQ ID NO: 3015611 - DNA, 21 bp, Homo sapiens
gaatctgcaattcaaaagttc

SEQ ID NO: 3015612 - DNA, 21 bp, Homo sapiens
gaatctgccttccagcccaga

SEQ ID NO: 3015613 - DNA, 16 bp, Homo sapiens
gaatctgctcacttta

SEQ ID NO: 3015614 - DNA, 19 bp, Homo sapiens
gaatctgtgggtctgggag

SEQ ID NO: 3015615 - DNA, 13 bp, Homo sapiens
gaatctttcttct

SEQ ID NO: 3015616 - DNA, 14 bp, Homo sapiens
gaatctttgttaag

SEQ ID NO: 3015617 - DNA, 17 bp, Homo sapiens
gaatgaaaaatgaaaga

SEQ ID NO: 3015618 - DNA, 16 bp, Homo sapiens
gaatgaaacccccaca

SEQ ID NO: 3015619 - DNA, 21 bp, Homo sapiens
gaatgaaacccccacacacac

SEQ ID NO: 3015620 - DNA, 15 bp, Homo sapiens
gaatgaaccactgcc

SEQ ID NO: 3015621 - DNA, 17 bp, Homo sapiens
gaatgaaccttctggcc

SEQ ID NO: 3015622 - DNA, 18 bp, Homo sapiens
gaatgaagcttgtgtatc

SEQ ID NO: 3015623 - DNA, 20 bp, Homo sapiens
gaatgaagcttgtgtatcca

SEQ ID NO: 3015624 - DNA, 19 bp, Homo sapiens
gaatgagaagtagccacag

SEQ ID NO: 3015625 - DNA, 15 bp, Homo sapiens
gaatgaggaacaatc

SEQ ID NO: 3015626 - DNA, 14 bp, Homo sapiens
gaatgagggaggcg

SEQ ID NO: 3015627 - DNA, 21 bp, Homo sapiens
gaatgatagtaataggataca

SEQ ID NO: 3015628 - DNA, 22 bp, Homo sapiens
gaatgatgggcttttgttctga

SEQ ID NO: 3015629 - DNA, 16 bp, Homo sapiens
gaatgatttccaaaga

SEQ ID NO: 3015630 - DNA, 23 bp, Homo sapiens
gaatgcagcactgctgcctcagc

SEQ ID NO: 3015631 - DNA, 15 bp, Homo sapiens
gaatgcagcccacca

SEQ ID NO: 3015632 - DNA, 18 bp, Homo sapiens
gaatgcagcccaccagga

SEQ ID NO: 3015633 - DNA, 17 bp, Homo sapiens
gaatgccacccacatct

SEQ ID NO: 3015634 - DNA, 21 bp, Homo sapiens
gaatgctgcaggacttgagaa

SEQ ID NO: 3015635 - DNA, 13 bp, Homo sapiens
gaatgctgtacat

SEQ ID NO: 3015636 - DNA, 14 bp, Homo sapiens
gaatgcttctgatt

SEQ ID NO: 3015637 - DNA, 14 bp, Homo sapiens
gaatggaggcaggg

SEQ ID NO: 3015638 - DNA, 18 bp, Homo sapiens
gaatggctttgtcttgaa

SEQ ID NO: 3015639 - DNA, 21 bp, Homo sapiens
gaatgggatcatgaaagtaga

SEQ ID NO: 3015640 - DNA, 16 bp, Homo sapiens
gaatgggcagttacat

SEQ ID NO: 3015641 - DNA, 16 bp, Homo sapiens
gaatggtgcgtggctt

SEQ ID NO: 3015642 - DNA, 22 bp, Homo sapiens
gaatgtaatatactgagctgct

SEQ ID NO: 3015643 - DNA, 21 bp, Homo sapiens
gaatgtatgcttcatacaggg

SEQ ID NO: 3015644 - DNA, 12 bp, Homo sapiens
gaatgtattgta

SEQ ID NO: 3015645 - DNA, 15 bp, Homo sapiens
gaatgtattgtacct

SEQ ID NO: 3015646 - DNA, 21 bp, Homo sapiens
gaatgtattgtaccttttaac

SEQ ID NO: 3015647 - DNA, 13 bp, Homo sapiens
gaatgtcagtgtt

SEQ ID NO: 3015648 - DNA, 18 bp, Homo sapiens
gaatgtccaaaatttata

SEQ ID NO: 3015649 - DNA, 19 bp, Homo sapiens
gaatgtgatcatctttgct

SEQ ID NO: 3015650 - DNA, 21 bp, Homo sapiens
gaatgtgatcatctttgctga

SEQ ID NO: 3015651 - DNA, 13 bp, Homo sapiens
gaatgtgctgcct

SEQ ID NO: 3015652 - DNA, 13 bp, Homo sapiens
gaatgtgtttcaa

SEQ ID NO: 3015653 - DNA, 19 bp, Homo sapiens
gaatgttaacaggtatttt

SEQ ID NO: 3015654 - DNA, 13 bp, Homo sapiens
gaatgttaatttt

SEQ ID NO: 3015655 - DNA, 22 bp, Homo sapiens
gaatgttaattttttggtacaa

SEQ ID NO: 3015656 - DNA, 13 bp, Homo sapiens
gaatgtttccggg

SEQ ID NO: 3015657 - DNA, 13 bp, Homo sapiens
gaatgtttgtgtc

SEQ ID NO: 3015658 - DNA, 18 bp, Homo sapiens
gaatgtttgtgtctgtgg

SEQ ID NO: 3015659 - DNA, 19 bp, Homo sapiens
gaatgtttgtgtctgtggt

SEQ ID NO: 3015660 - DNA, 11 bp, Homo sapiens
gaattaaaagt

SEQ ID NO: 3015661 - DNA, 18 bp, Homo sapiens
gaattaaaagtcatttaa

SEQ ID NO: 3015662 - DNA, 15 bp, Homo sapiens
gaattaaaataaaac

SEQ ID NO: 3015663 - DNA, 11 bp, Homo sapiens
gaattaaaatt

SEQ ID NO: 3015664 - DNA, 20 bp, Homo sapiens
gaattaaattaggaataaat

SEQ ID NO: 3015665 - DNA, 21 bp, Homo sapiens
gaattaaattaggaataaata

SEQ ID NO: 3015666 - DNA, 17 bp, Homo sapiens
gaattaatggtcatttg

SEQ ID NO: 3015667 - DNA, 14 bp, Homo sapiens
gaattacccttcct

SEQ ID NO: 3015668 - DNA, 14 bp, Homo sapiens
gaattactccaaaa

SEQ ID NO: 3015669 - DNA, 20 bp, Homo sapiens
gaattactccaaaaagacaa

SEQ ID NO: 3015670 - DNA, 23 bp, Homo sapiens
gaattactccaaaaagacaagtg

SEQ ID NO: 3015671 - DNA, 18 bp, Homo sapiens
gaattattttaaaagata

SEQ ID NO: 3015672 - DNA, 15 bp, Homo sapiens
gaattcatactctgt

SEQ ID NO: 3015673 - DNA, 20 bp, Homo sapiens
gaattcatactctgttgcct

SEQ ID NO: 3015674 - DNA, 22 bp, Homo sapiens
gaattcatactctgttgcctcc

SEQ ID NO: 3015675 - DNA, 17 bp, Homo sapiens
gaattccaattaaattt

SEQ ID NO: 3015676 - DNA, 23 bp, Homo sapiens
gaattccacgcccgggagtgggg

SEQ ID NO: 3015677 - DNA, 19 bp, Homo sapiens
gaattcttacatgttttct

SEQ ID NO: 3015678 - DNA, 20 bp, Homo sapiens
gaattcttggttgaggaaac

SEQ ID NO: 3015679 - DNA, 14 bp, Homo sapiens
gaattcttttgcca

SEQ ID NO: 3015680 - DNA, 20 bp, Homo sapiens
gaattgaaacacttttttgg

SEQ ID NO: 3015681 - DNA, 15 bp, Homo sapiens
gaattgaacccagga

SEQ ID NO: 3015682 - DNA, 16 bp, Homo sapiens
gaattgaacccaggag

SEQ ID NO: 3015683 - DNA, 18 bp, Homo sapiens
gaattgaacccaggaggt

SEQ ID NO: 3015684 - DNA, 22 bp, Homo sapiens
gaattgaagataggagagatac

SEQ ID NO: 3015685 - DNA, 15 bp, Homo sapiens
gaattgaagatgtaa

SEQ ID NO: 3015686 - DNA, 15 bp, Homo sapiens
gaattgattcatgtt

SEQ ID NO: 3015687 - DNA, 21 bp, Homo sapiens
gaattgattcatgttcatcaa

SEQ ID NO: 3015688 - DNA, 12 bp, Homo sapiens
gaattgatttgc

SEQ ID NO: 3015689 - DNA, 14 bp, Homo sapiens
gaattgatttgcat

SEQ ID NO: 3015690 - DNA, 18 bp, Homo sapiens
gaattgatttgcattgaa

SEQ ID NO: 3015691 - DNA, 22 bp, Homo sapiens
gaattgatttgcattgaacaca

SEQ ID NO: 3015692 - DNA, 13 bp, Homo sapiens
gaattgcattgac

SEQ ID NO: 3015693 - DNA, 16 bp, Homo sapiens
gaattgggcggctctg

SEQ ID NO: 3015694 - DNA, 17 bp, Homo sapiens
gaattgggcggctctga

SEQ ID NO: 3015695 - DNA, 20 bp, Homo sapiens
gaattgggcggctctgaagc

SEQ ID NO: 3015696 - DNA, 22 bp, Homo sapiens
gaattgggtggggggcttcata

SEQ ID NO: 3015697 - DNA, 14 bp, Homo sapiens
gaattggtgtatat

SEQ ID NO: 3015698 - DNA, 15 bp, Homo sapiens
gaattggtgtatatc

SEQ ID NO: 3015699 - DNA, 16 bp, Homo sapiens
gaattgtcacatctat

SEQ ID NO: 3015700 - DNA, 22 bp, Homo sapiens
gaattgtggaaggattgtaaca

SEQ ID NO: 3015701 - DNA, 18 bp, Homo sapiens
gaatttaaaattaagtag

SEQ ID NO: 3015702 - DNA, 20 bp, Homo sapiens
gaatttaaaattaagtagaa

SEQ ID NO: 3015703 - DNA, 21 bp, Homo sapiens
gaatttaaaattaagtagaac

SEQ ID NO: 3015704 - DNA, 13 bp, Homo sapiens
gaatttaagcatg

SEQ ID NO: 3015705 - DNA, 14 bp, Homo sapiens
gaatttagtcatta

SEQ ID NO: 3015706 - DNA, 13 bp, Homo sapiens
gaatttataattc

SEQ ID NO: 3015707 - DNA, 16 bp, Homo sapiens
gaatttataattcagt

SEQ ID NO: 3015708 - DNA, 16 bp, Homo sapiens
gaatttcactgtcttt

SEQ ID NO: 3015709 - DNA, 18 bp, Homo sapiens
gaatttcactgtctttta

SEQ ID NO: 3015710 - DNA, 17 bp, Homo sapiens
gaatttcttcttttcct

SEQ ID NO: 3015711 - DNA, 20 bp, Homo sapiens
gaatttcttcttttcctgca

SEQ ID NO: 3015712 - DNA, 16 bp, Homo sapiens
gaatttcttgattttt

SEQ ID NO: 3015713 - DNA, 14 bp, Homo sapiens
gaatttgactggtt

SEQ ID NO: 3015714 - DNA, 23 bp, Homo sapiens
gaatttgatcgttccagttccca

SEQ ID NO: 3015715 - DNA, 17 bp, Homo sapiens
gaatttgcaaagtactg

SEQ ID NO: 3015716 - DNA, 10 bp, Homo sapiens
gaatttgcat

SEQ ID NO: 3015717 - DNA, 14 bp, Homo sapiens
gaatttgccctggg

SEQ ID NO: 3015718 - DNA, 17 bp, Homo sapiens
gaatttgggatggaagc

SEQ ID NO: 3015719 - DNA, 12 bp, Homo sapiens
gaattttaaaag

SEQ ID NO: 3015720 - DNA, 13 bp, Homo sapiens
gaattttaatgtg

SEQ ID NO: 3015721 - DNA, 16 bp, Homo sapiens
gaattttaatgtgaag

SEQ ID NO: 3015722 - DNA, 17 bp, Homo sapiens
gaattttaatgtgaaga

SEQ ID NO: 3015723 - DNA, 15 bp, Homo sapiens
gaattttatctgtgg

SEQ ID NO: 3015724 - DNA, 12 bp, Homo sapiens
gaattttctgtt

SEQ ID NO: 3015725 - DNA, 19 bp, Homo sapiens
gaatttttgcaataatgca

SEQ ID NO: 3015726 - DNA, 21 bp, Homo sapiens
gaatttttgcaataatgcagt

SEQ ID NO: 3015727 - DNA, 23 bp, Homo sapiens
gaattttttttgttgtttcagtg

SEQ ID NO: 3015728 - DNA, 14 bp, Homo sapiens
gacaaaagaaaaaa

SEQ ID NO: 3015729 - DNA, 14 bp, Homo sapiens
gacaaaagggccag

SEQ ID NO: 3015730 - DNA, 20 bp, Homo sapiens
gacaaacccggaagatcaga

SEQ ID NO: 3015731 - DNA, 23 bp, Homo sapiens
gacaaagatgatttaaaagggaa

SEQ ID NO: 3015732 - DNA, 13 bp, Homo sapiens
gacaaagcaggag

SEQ ID NO: 3015733 - DNA, 15 bp, Homo sapiens
gacaaagtcaagcca

SEQ ID NO: 3015734 - DNA, 12 bp, Homo sapiens
gacaaagtgcca

SEQ ID NO: 3015735 - DNA, 16 bp, Homo sapiens
gacaaagtgccaaaga

SEQ ID NO: 3015736 - DNA, 18 bp, Homo sapiens
gacaaagtgccaaagaaa

SEQ ID NO: 3015737 - DNA, 19 bp, Homo sapiens
gacaaagtgccaaagaaag

SEQ ID NO: 3015738 - DNA, 11 bp, Homo sapiens
gacaaagtgtg

SEQ ID NO: 3015739 - DNA, 19 bp, Homo sapiens
gacaaatactcatgtgtat

SEQ ID NO: 3015740 - DNA, 20 bp, Homo sapiens
gacaaatactcatgtgtatg

SEQ ID NO: 3015741 - DNA, 20 bp, Homo sapiens
gacaaatcctttctgccccc

SEQ ID NO: 3015742 - DNA, 21 bp, Homo sapiens
gacaaatcctttctgcccccc

SEQ ID NO: 3015743 - DNA, 16 bp, Homo sapiens
gacaaatgtaaacatt

SEQ ID NO: 3015744 - DNA, 16 bp, Homo sapiens
gacaaatgtgaagatg

SEQ ID NO: 3015745 - DNA, 14 bp, Homo sapiens
gacaaattctgttt

SEQ ID NO: 3015746 - DNA, 16 bp, Homo sapiens
gacaaattctgtttct

SEQ ID NO: 3015747 - DNA, 19 bp, Homo sapiens
gacaaattgagacagtgca

SEQ ID NO: 3015748 - DNA, 15 bp, Homo sapiens
gacaaattgcacaga

SEQ ID NO: 3015749 - DNA, 20 bp, Homo sapiens
gacaacatggcttctccttt

SEQ ID NO: 3015750 - DNA, 21 bp, Homo sapiens
gacaacatggcttctcctttg

SEQ ID NO: 3015751 - DNA, 14 bp, Homo sapiens
gacaacgaggaagc

SEQ ID NO: 3015752 - DNA, 15 bp, Homo sapiens
gacaacgaggaagcc

SEQ ID NO: 3015753 - DNA, 23 bp, Homo sapiens
gacaactcattttcatattgtaa

SEQ ID NO: 3015754 - DNA, 12 bp, Homo sapiens
gacaactggcag

SEQ ID NO: 3015755 - DNA, 13 bp, Homo sapiens
gacaactggcagg

SEQ ID NO: 3015756 - DNA, 21 bp, Homo sapiens
gacaacttatttaaaaatatt

SEQ ID NO: 3015757 - DNA, 15 bp, Homo sapiens
gacaagacccccagc

SEQ ID NO: 3015758 - DNA, 15 bp, Homo sapiens
gacaagatgggacag

SEQ ID NO: 3015759 - DNA, 22 bp, Homo sapiens
gacaaggttcttcccttttaca

SEQ ID NO: 3015760 - DNA, 23 bp, Homo sapiens
gacaagtaatcactaacccgttt

SEQ ID NO: 3015761 - DNA, 15 bp, Homo sapiens
gacaatactgctgcc

SEQ ID NO: 3015762 - DNA, 19 bp, Homo sapiens
gacaatatgtgagtgcctt

SEQ ID NO: 3015763 - DNA, 20 bp, Homo sapiens
gacaatgactaagccaagct

SEQ ID NO: 3015764 - DNA, 17 bp, Homo sapiens
gacaatgttgtagtgtc

SEQ ID NO: 3015765 - DNA, 13 bp, Homo sapiens
gacaattcatgaa

SEQ ID NO: 3015766 - DNA, 18 bp, Homo sapiens
gacaatttccaagaatga

SEQ ID NO: 3015767 - DNA, 19 bp, Homo sapiens
gacacaaacacacacaaaa

SEQ ID NO: 3015768 - DNA, 17 bp, Homo sapiens
gacacaacccaatagga

SEQ ID NO: 3015769 - DNA, 20 bp, Homo sapiens
gacacaatgacacatttgtt

SEQ ID NO: 3015770 - DNA, 21 bp, Homo sapiens
gacacactacaccacacacaa

SEQ ID NO: 3015771 - DNA, 19 bp, Homo sapiens
gacacagaaaatgttgaga

SEQ ID NO: 3015772 - DNA, 20 bp, Homo sapiens
gacacagactcatcctgaac

SEQ ID NO: 3015773 - DNA, 13 bp, Homo sapiens
gacacaggccctc

SEQ ID NO: 3015774 - DNA, 22 bp, Homo sapiens
gacacaggtctttcctaaggct

SEQ ID NO: 3015775 - DNA, 21 bp, Homo sapiens
gacacagtttctattgtaaat

SEQ ID NO: 3015776 - DNA, 20 bp, Homo sapiens
gacacatcagcatgttttct

SEQ ID NO: 3015777 - DNA, 21 bp, Homo sapiens
gacacatcagcatgttttctg

SEQ ID NO: 3015778 - DNA, 17 bp, Homo sapiens
gacaccactcctgccag

SEQ ID NO: 3015779 - DNA, 17 bp, Homo sapiens
gacaccactgagctctg

SEQ ID NO: 3015780 - DNA, 13 bp, Homo sapiens
gacacccaggact

SEQ ID NO: 3015781 - DNA, 13 bp, Homo sapiens
gacaccccctcgc

SEQ ID NO: 3015782 - DNA, 13 bp, Homo sapiens
gacaccctggcag

SEQ ID NO: 3015783 - DNA, 19 bp, Homo sapiens
gacaccgggccagtatcta

SEQ ID NO: 3015784 - DNA, 16 bp, Homo sapiens
gacaccgtggggaagg

SEQ ID NO: 3015785 - DNA, 19 bp, Homo sapiens
gacaccgtggggaaggggt

SEQ ID NO: 3015786 - DNA, 21 bp, Homo sapiens
gacaccgtggggaaggggtgc

SEQ ID NO: 3015787 - DNA, 20 bp, Homo sapiens
gacacctaggctagggtggg

SEQ ID NO: 3015788 - DNA, 13 bp, Homo sapiens
gacacctgcacct

SEQ ID NO: 3015789 - DNA, 22 bp, Homo sapiens
gacacctgcacctccccccact

SEQ ID NO: 3015790 - DNA, 18 bp, Homo sapiens
gacacctgggagaaatct

SEQ ID NO: 3015791 - DNA, 19 bp, Homo sapiens
gacaccttttttcaacagt

SEQ ID NO: 3015792 - DNA, 22 bp, Homo sapiens
gacacgcgcccccctcccagag

SEQ ID NO: 3015793 - DNA, 12 bp, Homo sapiens
gacactcagggc

SEQ ID NO: 3015794 - DNA, 14 bp, Homo sapiens
gacactcagggcag

SEQ ID NO: 3015795 - DNA, 17 bp, Homo sapiens
gacactcagggcagctg

SEQ ID NO: 3015796 - DNA, 20 bp, Homo sapiens
gacactcagggcagctgcct

SEQ ID NO: 3015797 - DNA, 16 bp, Homo sapiens
gacactcccacccagt

SEQ ID NO: 3015798 - DNA, 15 bp, Homo sapiens
gacactcccttgggc

SEQ ID NO: 3015799 - DNA, 14 bp, Homo sapiens
gacactctccttgc

SEQ ID NO: 3015800 - DNA, 16 bp, Homo sapiens
gacactgcgccccgcc

SEQ ID NO: 3015801 - DNA, 12 bp, Homo sapiens
gacactggcccc

SEQ ID NO: 3015802 - DNA, 16 bp, Homo sapiens
gacactggtgtatctc

SEQ ID NO: 3015803 - DNA, 18 bp, Homo sapiens
gacactgtgacaatgact

SEQ ID NO: 3015804 - DNA, 12 bp, Homo sapiens
gacacttctcag

SEQ ID NO: 3015805 - DNA, 13 bp, Homo sapiens
gacacttctcagg

SEQ ID NO: 3015806 - DNA, 16 bp, Homo sapiens
gacacttctcaggaaa

SEQ ID NO: 3015807 - DNA, 17 bp, Homo sapiens
gacacttctcaggaaat

SEQ ID NO: 3015808 - DNA, 14 bp, Homo sapiens
gacacttgtcccca

SEQ ID NO: 3015809 - DNA, 21 bp, Homo sapiens
gacacttttatatttgaaaaa

SEQ ID NO: 3015810 - DNA, 16 bp, Homo sapiens
gacagaagcagctctt

SEQ ID NO: 3015811 - DNA, 22 bp, Homo sapiens
gacagaagtttgcactatcttt

SEQ ID NO: 3015812 - DNA, 23 bp, Homo sapiens
gacagactcacaacctgaaccta

SEQ ID NO: 3015813 - DNA, 23 bp, Homo sapiens
gacagactcctgaggacagctgt

SEQ ID NO: 3015814 - DNA, 12 bp, Homo sapiens
gacagactggcc

SEQ ID NO: 3015815 - DNA, 16 bp, Homo sapiens
gacagactggccgggc

SEQ ID NO: 3015816 - DNA, 22 bp, Homo sapiens
gacagagaatatgtctgctcct

SEQ ID NO: 3015817 - DNA, 18 bp, Homo sapiens
gacagagacacctgcacc

SEQ ID NO: 3015818 - DNA, 21 bp, Homo sapiens
gacagagacacctgcacctcc

SEQ ID NO: 3015819 - DNA, 17 bp, Homo sapiens
gacagagcaaagcgccc

SEQ ID NO: 3015820 - DNA, 13 bp, Homo sapiens
gacagagggaaga

SEQ ID NO: 3015821 - DNA, 16 bp, Homo sapiens
gacagagggaagaaaa

SEQ ID NO: 3015822 - DNA, 19 bp, Homo sapiens
gacagagggaagaaaagag

SEQ ID NO: 3015823 - DNA, 12 bp, Homo sapiens
gacagagggcac

SEQ ID NO: 3015824 - DNA, 17 bp, Homo sapiens
gacagagggtggctgga

SEQ ID NO: 3015825 - DNA, 14 bp, Homo sapiens
gacagatcaagctg

SEQ ID NO: 3015826 - DNA, 20 bp, Homo sapiens
gacagatcaagctgtgagac

SEQ ID NO: 3015827 - DNA, 19 bp, Homo sapiens
gacagatcctccatttttg

SEQ ID NO: 3015828 - DNA, 16 bp, Homo sapiens
gacagatgaggctttc

SEQ ID NO: 3015829 - DNA, 16 bp, Homo sapiens
gacagatggacgcagg

SEQ ID NO: 3015830 - DNA, 20 bp, Homo sapiens
gacagatggacgcaggccct

SEQ ID NO: 3015831 - DNA, 21 bp, Homo sapiens
gacagatggacgcaggccctg

SEQ ID NO: 3015832 - DNA, 19 bp, Homo sapiens
gacagcactcctcggcagg

SEQ ID NO: 3015833 - DNA, 12 bp, Homo sapiens
gacagcagcctg

SEQ ID NO: 3015834 - DNA, 13 bp, Homo sapiens
gacagcagcctgt

SEQ ID NO: 3015835 - DNA, 16 bp, Homo sapiens
gacagcagcctgtgag

SEQ ID NO: 3015836 - DNA, 14 bp, Homo sapiens
gacagccccctgcc

SEQ ID NO: 3015837 - DNA, 18 bp, Homo sapiens
gacagcctccccctgtcc

SEQ ID NO: 3015838 - DNA, 12 bp, Homo sapiens
gacagccttcag

SEQ ID NO: 3015839 - DNA, 18 bp, Homo sapiens
gacagctacacagagctt

SEQ ID NO: 3015840 - DNA, 12 bp, Homo sapiens
gacagctccacc

SEQ ID NO: 3015841 - DNA, 18 bp, Homo sapiens
gacagctccaccctggcc

SEQ ID NO: 3015842 - DNA, 12 bp, Homo sapiens
gacagctcttga

SEQ ID NO: 3015843 - DNA, 20 bp, Homo sapiens
gacagctctttttgtgaagt

SEQ ID NO: 3015844 - DNA, 11 bp, Homo sapiens
gacagctgctc

SEQ ID NO: 3015845 - DNA, 17 bp, Homo sapiens
gacagctgctcagagcc

SEQ ID NO: 3015846 - DNA, 14 bp, Homo sapiens
gacagctgctccta

SEQ ID NO: 3015847 - DNA, 21 bp, Homo sapiens
gacagctgctcctagagggag

SEQ ID NO: 3015848 - DNA, 18 bp, Homo sapiens
gacagcttactgcagcac

SEQ ID NO: 3015849 - DNA, 21 bp, Homo sapiens
gacagcttgtggcaagtgaat

SEQ ID NO: 3015850 - DNA, 13 bp, Homo sapiens
gacaggaaagaat

SEQ ID NO: 3015851 - DNA, 20 bp, Homo sapiens
gacaggagaaacacttgaac

SEQ ID NO: 3015852 - DNA, 17 bp, Homo sapiens
gacaggaggattgcctg

SEQ ID NO: 3015853 - DNA, 19 bp, Homo sapiens
gacaggatgaggacagagg

SEQ ID NO: 3015854 - DNA, 22 bp, Homo sapiens
gacaggatgaggacagagggca

SEQ ID NO: 3015855 - DNA, 15 bp, Homo sapiens
gacaggcagcctgga

SEQ ID NO: 3015856 - DNA, 22 bp, Homo sapiens
gacaggctggaatgagggaggc

SEQ ID NO: 3015857 - DNA, 12 bp, Homo sapiens
gacaggctggct

SEQ ID NO: 3015858 - DNA, 22 bp, Homo sapiens
gacaggctggctccagatgcag

SEQ ID NO: 3015859 - DNA, 20 bp, Homo sapiens
gacaggggcaggaggaaggg

SEQ ID NO: 3015860 - DNA, 21 bp, Homo sapiens
gacaggtacttggagggctca

SEQ ID NO: 3015861 - DNA, 22 bp, Homo sapiens
gacaggtttgggacccctggtg

SEQ ID NO: 3015862 - DNA, 19 bp, Homo sapiens
gacaggttttcacataaat

SEQ ID NO: 3015863 - DNA, 19 bp, Homo sapiens
gacagtcggaaaagcgtct

SEQ ID NO: 3015864 - DNA, 21 bp, Homo sapiens
gacagtcggtgaccccatcac

SEQ ID NO: 3015865 - DNA, 23 bp, Homo sapiens
gacagtctgctctagatgagctg

SEQ ID NO: 3015866 - DNA, 18 bp, Homo sapiens
gacagtgacgtgactcag

SEQ ID NO: 3015867 - DNA, 15 bp, Homo sapiens
gacagtgatgcctgc

SEQ ID NO: 3015868 - DNA, 16 bp, Homo sapiens
gacagtgcacatgaac

SEQ ID NO: 3015869 - DNA, 13 bp, Homo sapiens
gacagtgggaaat

SEQ ID NO: 3015870 - DNA, 15 bp, Homo sapiens
gacagtgggaaatat

SEQ ID NO: 3015871 - DNA, 14 bp, Homo sapiens
gacagtgttttgca

SEQ ID NO: 3015872 - DNA, 20 bp, Homo sapiens
gacagtgttttgcacatcat

SEQ ID NO: 3015873 - DNA, 15 bp, Homo sapiens
gacagtttgtttcct

SEQ ID NO: 3015874 - DNA, 12 bp, Homo sapiens
gacagtttttga

SEQ ID NO: 3015875 - DNA, 19 bp, Homo sapiens
gacagtttttgacatttat

SEQ ID NO: 3015876 - DNA, 19 bp, Homo sapiens
gacataaaatttacattta

SEQ ID NO: 3015877 - DNA, 14 bp, Homo sapiens
gacataagataaaa

SEQ ID NO: 3015878 - DNA, 18 bp, Homo sapiens
gacatacttgaagggcca

SEQ ID NO: 3015879 - DNA, 21 bp, Homo sapiens
gacatagcatccaagtggcat

SEQ ID NO: 3015880 - DNA, 15 bp, Homo sapiens
gacatatattatata

SEQ ID NO: 3015881 - DNA, 16 bp, Homo sapiens
gacatatattatatat

SEQ ID NO: 3015882 - DNA, 18 bp, Homo sapiens
gacatatattatatatag

SEQ ID NO: 3015883 - DNA, 17 bp, Homo sapiens
gacatatttaatgtttt

SEQ ID NO: 3015884 - DNA, 18 bp, Homo sapiens
gacatatttaatgtttta

SEQ ID NO: 3015885 - DNA, 20 bp, Homo sapiens
gacatatttaatgttttaaa

SEQ ID NO: 3015886 - DNA, 21 bp, Homo sapiens
gacatatttaatgttttaaat

SEQ ID NO: 3015887 - DNA, 16 bp, Homo sapiens
gacatcacagggtggg

SEQ ID NO: 3015888 - DNA, 11 bp, Homo sapiens
gacatcactgt

SEQ ID NO: 3015889 - DNA, 22 bp, Homo sapiens
gacatcagaagtaactcccact

SEQ ID NO: 3015890 - DNA, 12 bp, Homo sapiens
gacatcagccag

SEQ ID NO: 3015891 - DNA, 13 bp, Homo sapiens
gacatcagccagc

SEQ ID NO: 3015892 - DNA, 14 bp, Homo sapiens
gacatcagccagct

SEQ ID NO: 3015893 - DNA, 16 bp, Homo sapiens
gacatcagccagctgc

SEQ ID NO: 3015894 - DNA, 17 bp, Homo sapiens
gacatcagccagctgcc

SEQ ID NO: 3015895 - DNA, 16 bp, Homo sapiens
gacatcaggagactgg

SEQ ID NO: 3015896 - DNA, 17 bp, Homo sapiens
gacatccataaagaagc

SEQ ID NO: 3015897 - DNA, 19 bp, Homo sapiens
gacatccataaagaagcaa

SEQ ID NO: 3015898 - DNA, 23 bp, Homo sapiens
gacatccatgttccgagaagaac

SEQ ID NO: 3015899 - DNA, 13 bp, Homo sapiens
gacatctttctct

SEQ ID NO: 3015900 - DNA, 16 bp, Homo sapiens
gacatgaaaagttatt

SEQ ID NO: 3015901 - DNA, 16 bp, Homo sapiens
gacatgaccctctgtc

SEQ ID NO: 3015902 - DNA, 17 bp, Homo sapiens
gacatgaccctctgtcc

SEQ ID NO: 3015903 - DNA, 14 bp, Homo sapiens
gacatgatttcctt

SEQ ID NO: 3015904 - DNA, 17 bp, Homo sapiens
gacatgatttccttgaa

SEQ ID NO: 3015905 - DNA, 24 bp, Homo sapiens
gacatgatttccttgaatgtggct

SEQ ID NO: 3015906 - DNA, 14 bp, Homo sapiens
gacatgcactcagc

SEQ ID NO: 3015907 - DNA, 17 bp, Homo sapiens
gacatgcaggtcaaaag

SEQ ID NO: 3015908 - DNA, 22 bp, Homo sapiens
gacatgcggtagccagcacaca

SEQ ID NO: 3015909 - DNA, 16 bp, Homo sapiens
gacatgctaaataact

SEQ ID NO: 3015910 - DNA, 14 bp, Homo sapiens
gacatggaggttct

SEQ ID NO: 3015911 - DNA, 16 bp, Homo sapiens
gacatggaggttctaa

SEQ ID NO: 3015912 - DNA, 19 bp, Homo sapiens
gacatggctccggcctctg

SEQ ID NO: 3015913 - DNA, 19 bp, Homo sapiens
gacatgtaccccctttccc

SEQ ID NO: 3015914 - DNA, 22 bp, Homo sapiens
gacattagagagatttttcatt

SEQ ID NO: 3015915 - DNA, 20 bp, Homo sapiens
gacattagtaacataataaa

SEQ ID NO: 3015916 - DNA, 14 bp, Homo sapiens
gacattatagacat

SEQ ID NO: 3015917 - DNA, 15 bp, Homo sapiens
gacattatagacatt

SEQ ID NO: 3015918 - DNA, 17 bp, Homo sapiens
gacattatgtggtttta

SEQ ID NO: 3015919 - DNA, 14 bp, Homo sapiens
gacattcacctgcc

SEQ ID NO: 3015920 - DNA, 16 bp, Homo sapiens
gacattcacctgcccc

SEQ ID NO: 3015921 - DNA, 19 bp, Homo sapiens
gacattctctattgtaatt

SEQ ID NO: 3015922 - DNA, 23 bp, Homo sapiens
gacattctgattcgaatgacact

SEQ ID NO: 3015923 - DNA, 24 bp, Homo sapiens
gacattcttgtaaggctttgatta

SEQ ID NO: 3015924 - DNA, 15 bp, Homo sapiens
gacattgaggacctc

SEQ ID NO: 3015925 - DNA, 18 bp, Homo sapiens
gacattgctaagatgctc

SEQ ID NO: 3015926 - DNA, 22 bp, Homo sapiens
gacattgctccaagatgttctc

SEQ ID NO: 3015927 - DNA, 14 bp, Homo sapiens
gacattgctggtca

SEQ ID NO: 3015928 - DNA, 23 bp, Homo sapiens
gacattggcacctaatccaggca

SEQ ID NO: 3015929 - DNA, 15 bp, Homo sapiens
gacattgtaaataaa

SEQ ID NO: 3015930 - DNA, 23 bp, Homo sapiens
gacatttacaccacactttcaaa

SEQ ID NO: 3015931 - DNA, 11 bp, Homo sapiens
gacatttccca

SEQ ID NO: 3015932 - DNA, 14 bp, Homo sapiens
gacattttaacaag

SEQ ID NO: 3015933 - DNA, 16 bp, Homo sapiens
gacattttaacaagaa

SEQ ID NO: 3015934 - DNA, 20 bp, Homo sapiens
gacattttaacaagaagatg

SEQ ID NO: 3015935 - DNA, 13 bp, Homo sapiens
gacatttttcctc

SEQ ID NO: 3015936 - DNA, 20 bp, Homo sapiens
gacattttttcagtcatata

SEQ ID NO: 3015937 - DNA, 19 bp, Homo sapiens
gaccaaacccttagcagcc

SEQ ID NO: 3015938 - DNA, 23 bp, Homo sapiens
gaccaaacccttagcagcccagc

SEQ ID NO: 3015939 - DNA, 14 bp, Homo sapiens
gaccaaattgcttc

SEQ ID NO: 3015940 - DNA, 16 bp, Homo sapiens
gaccaaattgcttcta

SEQ ID NO: 3015941 - DNA, 15 bp, Homo sapiens
gaccaacatccagtc

SEQ ID NO: 3015942 - DNA, 14 bp, Homo sapiens
gaccaacctgacca

SEQ ID NO: 3015943 - DNA, 17 bp, Homo sapiens
gaccaagcaggaagctc

SEQ ID NO: 3015944 - DNA, 20 bp, Homo sapiens
gaccaagcaggaagctcaga

SEQ ID NO: 3015945 - DNA, 21 bp, Homo sapiens
gaccacgcacctccacgccac

SEQ ID NO: 3015946 - DNA, 14 bp, Homo sapiens
gaccactccagaga

SEQ ID NO: 3015947 - DNA, 17 bp, Homo sapiens
gaccagaaacagggaca

SEQ ID NO: 3015948 - DNA, 19 bp, Homo sapiens
gaccagaaacctgggagag

SEQ ID NO: 3015949 - DNA, 19 bp, Homo sapiens
gaccagaggagccttttta

SEQ ID NO: 3015950 - DNA, 20 bp, Homo sapiens
gaccagcagcgcctttccca

SEQ ID NO: 3015951 - DNA, 18 bp, Homo sapiens
gaccagcctggccaacat

SEQ ID NO: 3015952 - DNA, 14 bp, Homo sapiens
gaccagcctgtcca

SEQ ID NO: 3015953 - DNA, 15 bp, Homo sapiens
gaccaggacccaggg

SEQ ID NO: 3015954 - DNA, 16 bp, Homo sapiens
gaccaggacccaggga

SEQ ID NO: 3015955 - DNA, 17 bp, Homo sapiens
gaccaggatccagcctc

SEQ ID NO: 3015956 - DNA, 14 bp, Homo sapiens
gaccaggctgggca

SEQ ID NO: 3015957 - DNA, 15 bp, Homo sapiens
gaccaggctgggcat

SEQ ID NO: 3015958 - DNA, 14 bp, Homo sapiens
gaccagggagcctt

SEQ ID NO: 3015959 - DNA, 15 bp, Homo sapiens
gaccagggagccttt

SEQ ID NO: 3015960 - DNA, 11 bp, Homo sapiens
gaccagggcct

SEQ ID NO: 3015961 - DNA, 16 bp, Homo sapiens
gaccagggtggagctg

SEQ ID NO: 3015962 - DNA, 23 bp, Homo sapiens
gaccagggtggagctgagaagag

SEQ ID NO: 3015963 - DNA, 17 bp, Homo sapiens
gaccagtcaacctgggc

SEQ ID NO: 3015964 - DNA, 18 bp, Homo sapiens
gaccagtcaacctgggca

SEQ ID NO: 3015965 - DNA, 13 bp, Homo sapiens
gaccagtttctta

SEQ ID NO: 3015966 - DNA, 21 bp, Homo sapiens
gaccatctgtgactataaagc

SEQ ID NO: 3015967 - DNA, 16 bp, Homo sapiens
gaccatgaggtggggg

SEQ ID NO: 3015968 - DNA, 22 bp, Homo sapiens
gaccatggttaagagtccaaga

SEQ ID NO: 3015969 - DNA, 21 bp, Homo sapiens
gaccatgtgcggagcagcctt

SEQ ID NO: 3015970 - DNA, 22 bp, Homo sapiens
gaccatgtgcggagcagccttt

SEQ ID NO: 3015971 - DNA, 18 bp, Homo sapiens
gacccaaggaaaactgca

SEQ ID NO: 3015972 - DNA, 17 bp, Homo sapiens
gacccaagtagctgcta

SEQ ID NO: 3015973 - DNA, 17 bp, Homo sapiens
gacccacactgctacac

SEQ ID NO: 3015974 - DNA, 16 bp, Homo sapiens
gacccactctgcggcc

SEQ ID NO: 3015975 - DNA, 22 bp, Homo sapiens
gacccacttctcatcacacaca

SEQ ID NO: 3015976 - DNA, 21 bp, Homo sapiens
gacccagagggtgggtgttca

SEQ ID NO: 3015977 - DNA, 19 bp, Homo sapiens
gacccagcccgcggcctgg

SEQ ID NO: 3015978 - DNA, 16 bp, Homo sapiens
gacccagccctcatcc

SEQ ID NO: 3015979 - DNA, 20 bp, Homo sapiens
gacccagctactgaaccagc

SEQ ID NO: 3015980 - DNA, 23 bp, Homo sapiens
gacccagctactgaaccagccac

SEQ ID NO: 3015981 - DNA, 13 bp, Homo sapiens
gacccaggactcc

SEQ ID NO: 3015982 - DNA, 20 bp, Homo sapiens
gacccagggaacagccactc

SEQ ID NO: 3015983 - DNA, 13 bp, Homo sapiens
gacccaggtggct

SEQ ID NO: 3015984 - DNA, 16 bp, Homo sapiens
gacccagtgcccccac

SEQ ID NO: 3015985 - DNA, 15 bp, Homo sapiens
gacccatctctccct

SEQ ID NO: 3015986 - DNA, 21 bp, Homo sapiens
gacccatctctcccttaccca

SEQ ID NO: 3015987 - DNA, 18 bp, Homo sapiens
gacccatgggggctgtct

SEQ ID NO: 3015988 - DNA, 14 bp, Homo sapiens
gaccccacccctca

SEQ ID NO: 3015989 - DNA, 18 bp, Homo sapiens
gaccccagatgtgagggc

SEQ ID NO: 3015990 - DNA, 18 bp, Homo sapiens
gaccccagcggctgagtc

SEQ ID NO: 3015991 - DNA, 19 bp, Homo sapiens
gaccccagcggctgagtca

SEQ ID NO: 3015992 - DNA, 22 bp, Homo sapiens
gaccccatcactcgcaggacca

SEQ ID NO: 3015993 - DNA, 14 bp, Homo sapiens
gacccccacaacaa

SEQ ID NO: 3015994 - DNA, 13 bp, Homo sapiens
gacccccagctcc

SEQ ID NO: 3015995 - DNA, 23 bp, Homo sapiens
gacccccagctccggcctgtcct

SEQ ID NO: 3015996 - DNA, 17 bp, Homo sapiens
gacccccgcagaggcag

SEQ ID NO: 3015997 - DNA, 13 bp, Homo sapiens
gaccccctccccc

SEQ ID NO: 3015998 - DNA, 17 bp, Homo sapiens
gacccctaccccctcat

SEQ ID NO: 3015999 - DNA, 24 bp, Homo sapiens
gacccctaccccctcatcccccag

SEQ ID NO: 3016000 - DNA, 11 bp, Homo sapiens
gacccctcacc

SEQ ID NO: 3016001 - DNA, 16 bp, Homo sapiens
gacccctcaccacccc

SEQ ID NO: 3016002 - DNA, 20 bp, Homo sapiens
gacccctcaccacccccact

SEQ ID NO: 3016003 - DNA, 16 bp, Homo sapiens
gacccctcctggggcc

SEQ ID NO: 3016004 - DNA, 19 bp, Homo sapiens
gacccctcctggggccagg

SEQ ID NO: 3016005 - DNA, 23 bp, Homo sapiens
gacccctcctggggccaggccgg

SEQ ID NO: 3016006 - DNA, 15 bp, Homo sapiens
gacccgccagccccg

SEQ ID NO: 3016007 - DNA, 16 bp, Homo sapiens
gacccgccagccccgc

SEQ ID NO: 3016008 - DNA, 17 bp, Homo sapiens
gacccgccagccccgct

SEQ ID NO: 3016009 - DNA, 19 bp, Homo sapiens
gacccgccagccccgctcc

SEQ ID NO: 3016010 - DNA, 19 bp, Homo sapiens
gacccggattggccctgcc

SEQ ID NO: 3016011 - DNA, 21 bp, Homo sapiens
gacccggattggccctgcccc

SEQ ID NO: 3016012 - DNA, 22 bp, Homo sapiens
gacccggattggccctgcccct

SEQ ID NO: 3016013 - DNA, 23 bp, Homo sapiens
gacccggattggccctgcccctc

SEQ ID NO: 3016014 - DNA, 16 bp, Homo sapiens
gaccctaaatcttgac

SEQ ID NO: 3016015 - DNA, 23 bp, Homo sapiens
gaccctcaggtgtagctgagctg

SEQ ID NO: 3016016 - DNA, 15 bp, Homo sapiens
gaccctcatctttct

SEQ ID NO: 3016017 - DNA, 14 bp, Homo sapiens
gaccctctcacttt

SEQ ID NO: 3016018 - DNA, 15 bp, Homo sapiens
gaccctctgtcccca

SEQ ID NO: 3016019 - DNA, 16 bp, Homo sapiens
gaccctctgtccccag

SEQ ID NO: 3016020 - DNA, 19 bp, Homo sapiens
ccctgactcattctgaagg

SEQ ID NO: 3016021 - DNA, 21 bp, Homo sapiens
ccctgactgtcagggagggcc

SEQ ID NO: 3016022 - DNA, 22 bp, Homo sapiens
ccctgagagagaatagagctgc

SEQ ID NO: 3016023 - DNA, 16 bp, Homo sapiens
ccctgagctgaggcag

SEQ ID NO: 3016024 - DNA, 15 bp, Homo sapiens
ccctgaggggctggg

SEQ ID NO: 3016025 - DNA, 18 bp, Homo sapiens
ccctgagtccgcctgcgc

SEQ ID NO: 3016026 - DNA, 19 bp, Homo sapiens
ccctgagtccgcctgcgcc

SEQ ID NO: 3016027 - DNA, 15 bp, Homo sapiens
ccctgagtctgggca

SEQ ID NO: 3016028 - DNA, 14 bp, Homo sapiens
ccctgatcccagac

SEQ ID NO: 3016029 - DNA, 15 bp, Homo sapiens
ccctgatcccagacc

SEQ ID NO: 3016030 - DNA, 20 bp, Homo sapiens
ccctgatgttcgccgtctgg

SEQ ID NO: 3016031 - DNA, 19 bp, Homo sapiens
ccctgattgtgccagtgca

SEQ ID NO: 3016032 - DNA, 23 bp, Homo sapiens
ccctgatttaggagaagccagga

SEQ ID NO: 3016033 - DNA, 17 bp, Homo sapiens
ccctgcagctagtccta

SEQ ID NO: 3016034 - DNA, 15 bp, Homo sapiens
ccctgcaggagcagg

SEQ ID NO: 3016035 - DNA, 16 bp, Homo sapiens
ccctgcaggagcaggg

SEQ ID NO: 3016036 - DNA, 19 bp, Homo sapiens
ccctgcatctgaccagcag

SEQ ID NO: 3016037 - DNA, 14 bp, Homo sapiens
ccctgcatgggcca

SEQ ID NO: 3016038 - DNA, 20 bp, Homo sapiens
ccctgcatgggccagcccct

SEQ ID NO: 3016039 - DNA, 22 bp, Homo sapiens
ccctgcatgggccagcccctcc

SEQ ID NO: 3016040 - DNA, 14 bp, Homo sapiens
ccctgccagggcag

SEQ ID NO: 3016041 - DNA, 14 bp, Homo sapiens
ccctgccagtgcct

SEQ ID NO: 3016042 - DNA, 16 bp, Homo sapiens
ccctgccatccccctc

SEQ ID NO: 3016043 - DNA, 21 bp, Homo sapiens
ccctgcccaagtgaccaggga

SEQ ID NO: 3016044 - DNA, 13 bp, Homo sapiens
ccctgcccacccc

SEQ ID NO: 3016045 - DNA, 14 bp, Homo sapiens
ccctgcccaccccc

SEQ ID NO: 3016046 - DNA, 23 bp, Homo sapiens
ccctgcccacccccgggatcctg

SEQ ID NO: 3016047 - DNA, 12 bp, Homo sapiens
ccctgcccctcc

SEQ ID NO: 3016048 - DNA, 13 bp, Homo sapiens
ccctgcccctccc

SEQ ID NO: 3016049 - DNA, 15 bp, Homo sapiens
ccctgccccttgcca

SEQ ID NO: 3016050 - DNA, 12 bp, Homo sapiens
ccctgcccgcca

SEQ ID NO: 3016051 - DNA, 14 bp, Homo sapiens
ccctgccctcccct

SEQ ID NO: 3016052 - DNA, 15 bp, Homo sapiens
ccctgccctgctcct

SEQ ID NO: 3016053 - DNA, 16 bp, Homo sapiens
ccctgccctgctccta

SEQ ID NO: 3016054 - DNA, 13 bp, Homo sapiens
ccctgccgcctca

SEQ ID NO: 3016055 - DNA, 14 bp, Homo sapiens
ccctgccgcctcaa

SEQ ID NO: 3016056 - DNA, 22 bp, Homo sapiens
ccctgccggaatgaactgtccg

SEQ ID NO: 3016057 - DNA, 18 bp, Homo sapiens
ccctgcctcacatctccc

SEQ ID NO: 3016058 - DNA, 16 bp, Homo sapiens
ccctgcctcagtggct

SEQ ID NO: 3016059 - DNA, 14 bp, Homo sapiens
ccctgcctccagct

SEQ ID NO: 3016060 - DNA, 18 bp, Homo sapiens
ccctgcctccagctgtca

SEQ ID NO: 3016061 - DNA, 22 bp, Homo sapiens
ccctgcctcggttgattgtgca

SEQ ID NO: 3016062 - DNA, 12 bp, Homo sapiens
ccctgcctctgt

SEQ ID NO: 3016063 - DNA, 11 bp, Homo sapiens
ccctgcctgct

SEQ ID NO: 3016064 - DNA, 12 bp, Homo sapiens
ccctgcctgctg

SEQ ID NO: 3016065 - DNA, 21 bp, Homo sapiens
ccctgcctgctgtggagccca

SEQ ID NO: 3016066 - DNA, 13 bp, Homo sapiens
ccctgcctggacc

SEQ ID NO: 3016067 - DNA, 16 bp, Homo sapiens
ccctgcgcttcctgag

SEQ ID NO: 3016068 - DNA, 12 bp, Homo sapiens
ccctgcgggcca

SEQ ID NO: 3016069 - DNA, 18 bp, Homo sapiens
ccctgctatttcaggccc

SEQ ID NO: 3016070 - DNA, 21 bp, Homo sapiens
ccctgctatttcaggccctca

SEQ ID NO: 3016071 - DNA, 11 bp, Homo sapiens
ccctgctccct

SEQ ID NO: 3016072 - DNA, 12 bp, Homo sapiens
ccctgctccctc

SEQ ID NO: 3016073 - DNA, 18 bp, Homo sapiens
ccctgctgaagctgctgc

SEQ ID NO: 3016074 - DNA, 19 bp, Homo sapiens
ccctgctgaagctgctgca

SEQ ID NO: 3016075 - DNA, 21 bp, Homo sapiens
ccctgctgaagctgctgcagc

SEQ ID NO: 3016076 - DNA, 18 bp, Homo sapiens
ccctgctgcccctccctg

SEQ ID NO: 3016077 - DNA, 19 bp, Homo sapiens
ccctgctgcccctccctgc

SEQ ID NO: 3016078 - DNA, 16 bp, Homo sapiens
ccctgctgctggtgca

SEQ ID NO: 3016079 - DNA, 19 bp, Homo sapiens
ccctgctgctgtcacctct

SEQ ID NO: 3016080 - DNA, 22 bp, Homo sapiens
ccctgctggggtctcaggtcca

SEQ ID NO: 3016081 - DNA, 15 bp, Homo sapiens
ccctgctgtctctct

SEQ ID NO: 3016082 - DNA, 18 bp, Homo sapiens
ccctgctgtctctctggg

SEQ ID NO: 3016083 - DNA, 21 bp, Homo sapiens
ccctgcttagaacccttctgc

SEQ ID NO: 3016084 - DNA, 22 bp, Homo sapiens
ccctgcttcagatgtggagcca

SEQ ID NO: 3016085 - DNA, 22 bp, Homo sapiens
ccctgcttcatatctctccctt

SEQ ID NO: 3016086 - DNA, 15 bp, Homo sapiens
ccctgcttctggcgc

SEQ ID NO: 3016087 - DNA, 18 bp, Homo sapiens
ccctgctttagagctagg

SEQ ID NO: 3016088 - DNA, 12 bp, Homo sapiens
ccctgctttctg

SEQ ID NO: 3016089 - DNA, 22 bp, Homo sapiens
ccctgctttgcctcgaaagtgt

SEQ ID NO: 3016090 - DNA, 17 bp, Homo sapiens
ccctggaacctttccct

SEQ ID NO: 3016091 - DNA, 13 bp, Homo sapiens
ccctggagggcag

SEQ ID NO: 3016092 - DNA, 24 bp, Homo sapiens
ccctggagtgtgtcagagcccagg

SEQ ID NO: 3016093 - DNA, 14 bp, Homo sapiens
ccctggcagtgctg

SEQ ID NO: 3016094 - DNA, 12 bp, Homo sapiens
ccctggccacca

SEQ ID NO: 3016095 - DNA, 13 bp, Homo sapiens
ccctggccaccac

SEQ ID NO: 3016096 - DNA, 14 bp, Homo sapiens
ccctggccaccacc

SEQ ID NO: 3016097 - DNA, 20 bp, Homo sapiens
ccctggccaccacccaacct

SEQ ID NO: 3016098 - DNA, 13 bp, Homo sapiens
ccctggccactga

SEQ ID NO: 3016099 - DNA, 14 bp, Homo sapiens
ccctggcccaggag

SEQ ID NO: 3016100 - DNA, 12 bp, Homo sapiens
ccctggccccct

SEQ ID NO: 3016101 - DNA, 13 bp, Homo sapiens
ccctggcccctcc

SEQ ID NO: 3016102 - DNA, 13 bp, Homo sapiens
ccctggcctctgt

SEQ ID NO: 3016103 - DNA, 15 bp, Homo sapiens
ccctggcctctgtgc

SEQ ID NO: 3016104 - DNA, 21 bp, Homo sapiens
ccctggcctgctgggctctcc

SEQ ID NO: 3016105 - DNA, 19 bp, Homo sapiens
ccctggctgaacagtgctc

SEQ ID NO: 3016106 - DNA, 20 bp, Homo sapiens
ccctggcttgtaactccacc

SEQ ID NO: 3016107 - DNA, 19 bp, Homo sapiens
ccctgggagcaagttgcag

SEQ ID NO: 3016108 - DNA, 21 bp, Homo sapiens
ccctggggcactcccccagga

SEQ ID NO: 3016109 - DNA, 14 bp, Homo sapiens
ccctggggctgagt

SEQ ID NO: 3016110 - DNA, 16 bp, Homo sapiens
ccctggggctgagtct

SEQ ID NO: 3016111 - DNA, 22 bp, Homo sapiens
ccctggggctgagtctccaggg

SEQ ID NO: 3016112 - DNA, 13 bp, Homo sapiens
ccctggggctggt

SEQ ID NO: 3016113 - DNA, 19 bp, Homo sapiens
ccctggggctggtggattg

SEQ ID NO: 3016114 - DNA, 18 bp, Homo sapiens
ccctgggggaagccctgg

SEQ ID NO: 3016115 - DNA, 20 bp, Homo sapiens
ccctgggtcctgcctgcagt

SEQ ID NO: 3016116 - DNA, 20 bp, Homo sapiens
ccctgggtgtccccgctgct

SEQ ID NO: 3016117 - DNA, 18 bp, Homo sapiens
ccctggtaagcagaggct

SEQ ID NO: 3016118 - DNA, 12 bp, Homo sapiens
ccctggtgctcc

SEQ ID NO: 3016119 - DNA, 13 bp, Homo sapiens
ccctggtgctcct

SEQ ID NO: 3016120 - DNA, 14 bp, Homo sapiens
ccctggttcctgct

SEQ ID NO: 3016121 - DNA, 18 bp, Homo sapiens
ccctgtatatagcccagc

SEQ ID NO: 3016122 - DNA, 14 bp, Homo sapiens
ccctgtcccctgga

SEQ ID NO: 3016123 - DNA, 20 bp, Homo sapiens
ccctgtctagagagggaggc

SEQ ID NO: 3016124 - DNA, 23 bp, Homo sapiens
ccctgtgcaattcagtctgctct

SEQ ID NO: 3016125 - DNA, 22 bp, Homo sapiens
ccctgtgcagccgctgagcgag

SEQ ID NO: 3016126 - DNA, 18 bp, Homo sapiens
ccctgtgcaggagctagt

SEQ ID NO: 3016127 - DNA, 14 bp, Homo sapiens
ccctgtgccccagt

SEQ ID NO: 3016128 - DNA, 22 bp, Homo sapiens
ccctgtgcctctgtcctagact

SEQ ID NO: 3016129 - DNA, 20 bp, Homo sapiens
ccctgtggagtccagctcta

SEQ ID NO: 3016130 - DNA, 16 bp, Homo sapiens
ccctgtgggaccccag

SEQ ID NO: 3016131 - DNA, 19 bp, Homo sapiens
ccctgtgggaccccaggcc

SEQ ID NO: 3016132 - DNA, 13 bp, Homo sapiens
ccctgtgtgcagg

SEQ ID NO: 3016133 - DNA, 17 bp, Homo sapiens
ccctgtgttctgcacat

SEQ ID NO: 3016134 - DNA, 17 bp, Homo sapiens
ccctgttcagctactcc

SEQ ID NO: 3016135 - DNA, 16 bp, Homo sapiens
ccctgttcatgttttt

SEQ ID NO: 3016136 - DNA, 21 bp, Homo sapiens
ccctgttcttgaggtctcttt

SEQ ID NO: 3016137 - DNA, 15 bp, Homo sapiens
cccttacagcctctg

SEQ ID NO: 3016138 - DNA, 18 bp, Homo sapiens
cccttacagcctctgact

SEQ ID NO: 3016139 - DNA, 19 bp, Homo sapiens
cccttacagcctctgactt

SEQ ID NO: 3016140 - DNA, 16 bp, Homo sapiens
cccttagcagcccagc

SEQ ID NO: 3016141 - DNA, 16 bp, Homo sapiens
cccttatctgtgctca

SEQ ID NO: 3016142 - DNA, 17 bp, Homo sapiens
cccttcaatctcgttta

SEQ ID NO: 3016143 - DNA, 22 bp, Homo sapiens
cccttcaatctcgtttagtgcc

SEQ ID NO: 3016144 - DNA, 13 bp, Homo sapiens
cccttcacaaagc

SEQ ID NO: 3016145 - DNA, 19 bp, Homo sapiens
cccttcagaacagaggcat

SEQ ID NO: 3016146 - DNA, 16 bp, Homo sapiens
cccttcagtcttaata

SEQ ID NO: 3016147 - DNA, 12 bp, Homo sapiens
cccttccagtgg

SEQ ID NO: 3016148 - DNA, 14 bp, Homo sapiens
cccttcccaggggc

SEQ ID NO: 3016149 - DNA, 19 bp, Homo sapiens
cccttccctgcctccagct

SEQ ID NO: 3016150 - DNA, 23 bp, Homo sapiens
cccttccgcagtgtggccaggct

SEQ ID NO: 3016151 - DNA, 16 bp, Homo sapiens
cccttccggtgcgtgt

SEQ ID NO: 3016152 - DNA, 22 bp, Homo sapiens
cccttcctactcctcatagcat

SEQ ID NO: 3016153 - DNA, 12 bp, Homo sapiens
ccggtgttctaa

SEQ ID NO: 3016154 - DNA, 13 bp, Homo sapiens
ccggtgttctaag

SEQ ID NO: 3016155 - DNA, 14 bp, Homo sapiens
ccggtgttctaaga

SEQ ID NO: 3016156 - DNA, 14 bp, Homo sapiens
ccggttcccacaag

SEQ ID NO: 3016157 - DNA, 17 bp, Homo sapiens
ccgtaggacccaagcag

SEQ ID NO: 3016158 - DNA, 22 bp, Homo sapiens
ccgtcaaggaaagggcagtgga

SEQ ID NO: 3016159 - DNA, 23 bp, Homo sapiens
ccgtcaaggaaagggcagtggac

SEQ ID NO: 3016160 - DNA, 20 bp, Homo sapiens
ccgtcaccacgactggccag

SEQ ID NO: 3016161 - DNA, 19 bp, Homo sapiens
ccgtcagccatcagccatg

SEQ ID NO: 3016162 - DNA, 12 bp, Homo sapiens
ccgtcagtgctg

SEQ ID NO: 3016163 - DNA, 14 bp, Homo sapiens
ccgtccagagccgg

SEQ ID NO: 3016164 - DNA, 16 bp, Homo sapiens
ccgtccccccccaggc

SEQ ID NO: 3016165 - DNA, 19 bp, Homo sapiens
ccgtccccccccaggccct

SEQ ID NO: 3016166 - DNA, 19 bp, Homo sapiens
ccgtctagttaacatttca

SEQ ID NO: 3016167 - DNA, 14 bp, Homo sapiens
ccgtctctgtcctc

SEQ ID NO: 3016168 - DNA, 17 bp, Homo sapiens
ccgtctggcgagccctt

SEQ ID NO: 3016169 - DNA, 21 bp, Homo sapiens
ccgtctggggttcagcccctc

SEQ ID NO: 3016170 - DNA, 23 bp, Homo sapiens
ccgtctggggttcagcccctcct

SEQ ID NO: 3016171 - DNA, 22 bp, Homo sapiens
ccgtctgtccatctgcccgcct

SEQ ID NO: 3016172 - DNA, 11 bp, Homo sapiens
ccgtctgtctg

SEQ ID NO: 3016173 - DNA, 13 bp, Homo sapiens
ccgtctgtgaatt

SEQ ID NO: 3016174 - DNA, 19 bp, Homo sapiens
ccgtgaatggtctctgtca

SEQ ID NO: 3016175 - DNA, 22 bp, Homo sapiens
ccgtgacagactcctgaggaca

SEQ ID NO: 3016176 - DNA, 15 bp, Homo sapiens
ccgtgacgaggctca

SEQ ID NO: 3016177 - DNA, 20 bp, Homo sapiens
ccgtgagtgacatagcctca

SEQ ID NO: 3016178 - DNA, 22 bp, Homo sapiens
ccgtgccaaccccacccagctc

SEQ ID NO: 3016179 - DNA, 17 bp, Homo sapiens
ccgtgccactttccacc

SEQ ID NO: 3016180 - DNA, 14 bp, Homo sapiens
ccgtgccgcctgca

SEQ ID NO: 3016181 - DNA, 16 bp, Homo sapiens
ccgtgctgacagctgc

SEQ ID NO: 3016182 - DNA, 17 bp, Homo sapiens
ccgtgctgacagctgct

SEQ ID NO: 3016183 - DNA, 20 bp, Homo sapiens
ccgtgctgacagctgctcct

SEQ ID NO: 3016184 - DNA, 22 bp, Homo sapiens
ccgtgcttgtttgctcacctgg

SEQ ID NO: 3016185 - DNA, 23 bp, Homo sapiens
ccgtgcttgtttgctcacctggg

SEQ ID NO: 3016186 - DNA, 14 bp, Homo sapiens
ccgtggatgctctt

SEQ ID NO: 3016187 - DNA, 11 bp, Homo sapiens
ccgtggcacat

SEQ ID NO: 3016188 - DNA, 21 bp, Homo sapiens
ccgtggcctggcatctgtgcg

SEQ ID NO: 3016189 - DNA, 12 bp, Homo sapiens
ccgtggcctggg

SEQ ID NO: 3016190 - DNA, 17 bp, Homo sapiens
ccgtggcctgggcttgg

SEQ ID NO: 3016191 - DNA, 18 bp, Homo sapiens
ccgtggcttggcatctgt

SEQ ID NO: 3016192 - DNA, 15 bp, Homo sapiens
ccgtgggttgctaac

SEQ ID NO: 3016193 - DNA, 19 bp, Homo sapiens
ccgtgtacatagtgcattg

SEQ ID NO: 3016194 - DNA, 19 bp, Homo sapiens
ccgtgtgtttagaagccta

SEQ ID NO: 3016195 - DNA, 14 bp, Homo sapiens
ccgttaaatgtcaa

SEQ ID NO: 3016196 - DNA, 17 bp, Homo sapiens
ccgttacatctgtgcag

SEQ ID NO: 3016197 - DNA, 23 bp, Homo sapiens
ccgttacatctgtgcagggctgg

SEQ ID NO: 3016198 - DNA, 14 bp, Homo sapiens
ccgttactctccaa

SEQ ID NO: 3016199 - DNA, 22 bp, Homo sapiens
ccgttcaagaggcgtgtgcagg

SEQ ID NO: 3016200 - DNA, 15 bp, Homo sapiens
ccgttcagcctgtct

SEQ ID NO: 3016201 - DNA, 12 bp, Homo sapiens
ccgtttttcaag

SEQ ID NO: 3016202 - DNA, 14 bp, Homo sapiens
ccgtttttcaagaa

SEQ ID NO: 3016203 - DNA, 17 bp, Homo sapiens
cctaaaacataagatca

SEQ ID NO: 3016204 - DNA, 22 bp, Homo sapiens
cctaaaagtgggcttgattctg

SEQ ID NO: 3016205 - DNA, 13 bp, Homo sapiens
cctaaacctcagt

SEQ ID NO: 3016206 - DNA, 20 bp, Homo sapiens
cctaaagaaaaatatcttgg

SEQ ID NO: 3016207 - DNA, 22 bp, Homo sapiens
cctaaagaaaaatatcttggcc

SEQ ID NO: 3016208 - DNA, 21 bp, Homo sapiens
cctaaagtgctgggattacag

SEQ ID NO: 3016209 - DNA, 17 bp, Homo sapiens
cctaaatattttcaaga

SEQ ID NO: 3016210 - DNA, 19 bp, Homo sapiens
cctaacaattttttattaa

SEQ ID NO: 3016211 - DNA, 12 bp, Homo sapiens
cctaacctgccg

SEQ ID NO: 3016212 - DNA, 17 bp, Homo sapiens
cctaacctgtgtctgcg

SEQ ID NO: 3016213 - DNA, 18 bp, Homo sapiens
cctaacctgtgtctgcga

SEQ ID NO: 3016214 - DNA, 16 bp, Homo sapiens
cctaactgtatcttga

SEQ ID NO: 3016215 - DNA, 15 bp, Homo sapiens
cctaagaagtggggc

SEQ ID NO: 3016216 - DNA, 17 bp, Homo sapiens
cctaagaatttcactgt

SEQ ID NO: 3016217 - DNA, 20 bp, Homo sapiens
cctaagaatttcactgtctt

SEQ ID NO: 3016218 - DNA, 16 bp, Homo sapiens
cctaagcatctaagtt

SEQ ID NO: 3016219 - DNA, 19 bp, Homo sapiens
cctaagcctgtggctgtgg

SEQ ID NO: 3016220 - DNA, 12 bp, Homo sapiens
cctaaggaagct

SEQ ID NO: 3016221 - DNA, 12 bp, Homo sapiens
cctaaggctgca

SEQ ID NO: 3016222 - DNA, 22 bp, Homo sapiens
cctaaggctgcaaggtttaggc

SEQ ID NO: 3016223 - DNA, 13 bp, Homo sapiens
cctaagggcagcc

SEQ ID NO: 3016224 - DNA, 14 bp, Homo sapiens
cctaagggcagccc

SEQ ID NO: 3016225 - DNA, 16 bp, Homo sapiens
cctaagggcagccctc

SEQ ID NO: 3016226 - DNA, 22 bp, Homo sapiens
cctaagggcagccctccatggt

SEQ ID NO: 3016227 - DNA, 19 bp, Homo sapiens
cctaagggctcaccgtggc

SEQ ID NO: 3016228 - DNA, 23 bp, Homo sapiens
cctaagggtagaaaactccaggg

SEQ ID NO: 3016229 - DNA, 15 bp, Homo sapiens
cctaagtggctgctg

SEQ ID NO: 3016230 - DNA, 16 bp, Homo sapiens
cctaataaagttctgt

SEQ ID NO: 3016231 - DNA, 21 bp, Homo sapiens
cctaataaagttctgtactca

SEQ ID NO: 3016232 - DNA, 15 bp, Homo sapiens
cctaatcaagagtct

SEQ ID NO: 3016233 - DNA, 17 bp, Homo sapiens
cctaatcacatgtgctg

SEQ ID NO: 3016234 - DNA, 21 bp, Homo sapiens
cctaatccctgggcattgctt

SEQ ID NO: 3016235 - DNA, 16 bp, Homo sapiens
cctaatgctctgaaag

SEQ ID NO: 3016236 - DNA, 20 bp, Homo sapiens
cctaattcagccatgtacag

SEQ ID NO: 3016237 - DNA, 13 bp, Homo sapiens
cctaattcatctt

SEQ ID NO: 3016238 - DNA, 17 bp, Homo sapiens
cctaattcatcttttaa

SEQ ID NO: 3016239 - DNA, 15 bp, Homo sapiens
cctaattcttctgtc

SEQ ID NO: 3016240 - DNA, 15 bp, Homo sapiens
cctaattgtcacatc

SEQ ID NO: 3016241 - DNA, 16 bp, Homo sapiens
cctacaagtttaagta

SEQ ID NO: 3016242 - DNA, 14 bp, Homo sapiens
cctacacactgtca

SEQ ID NO: 3016243 - DNA, 15 bp, Homo sapiens
cctacacactgtcat

SEQ ID NO: 3016244 - DNA, 22 bp, Homo sapiens
cctacacactgtcatgcttcat

SEQ ID NO: 3016245 - DNA, 21 bp, Homo sapiens
cctacaccattatcttggaaa

SEQ ID NO: 3016246 - DNA, 20 bp, Homo sapiens
cctacagacagacatacata

SEQ ID NO: 3016247 - DNA, 17 bp, Homo sapiens
cctacagctttgatccc

SEQ ID NO: 3016248 - DNA, 11 bp, Homo sapiens
cctaccccacc

SEQ ID NO: 3016249 - DNA, 16 bp, Homo sapiens
cctaccccctcatccc

SEQ ID NO: 3016250 - DNA, 15 bp, Homo sapiens
cctacccctgccctg

SEQ ID NO: 3016251 - DNA, 18 bp, Homo sapiens
cctaccgcatggcagctg

SEQ ID NO: 3016252 - DNA, 19 bp, Homo sapiens
cctaccgcatggcagctgg

SEQ ID NO: 3016253 - DNA, 21 bp, Homo sapiens
cctaccgcatggcagctgggc

SEQ ID NO: 3016254 - DNA, 22 bp, Homo sapiens
cctaccgcatggcagctgggcc

SEQ ID NO: 3016255 - DNA, 15 bp, Homo sapiens
cctacctccactctc

SEQ ID NO: 3016256 - DNA, 14 bp, Homo sapiens
cctaccttccccag

SEQ ID NO: 3016257 - DNA, 16 bp, Homo sapiens
cctaccttccccagac

SEQ ID NO: 3016258 - DNA, 13 bp, Homo sapiens
cctaccttgcctc

SEQ ID NO: 3016259 - DNA, 21 bp, Homo sapiens
cctaccttttgataaaatgtt

SEQ ID NO: 3016260 - DNA, 22 bp, Homo sapiens
cctacgtttgcaccgcctgccc

SEQ ID NO: 3016261 - DNA, 12 bp, Homo sapiens
cctactctgtgt

SEQ ID NO: 3016262 - DNA, 13 bp, Homo sapiens
cctactgcccagg

SEQ ID NO: 3016263 - DNA, 16 bp, Homo sapiens
cctactgcccaggcac

SEQ ID NO: 3016264 - DNA, 16 bp, Homo sapiens
cctactggtgtaatct

SEQ ID NO: 3016265 - DNA, 12 bp, Homo sapiens
cctactgtccct

SEQ ID NO: 3016266 - DNA, 22 bp, Homo sapiens
cctactgtccctctcagtgcct

SEQ ID NO: 3016267 - DNA, 23 bp, Homo sapiens
cctactgttctaaagctctgaca

SEQ ID NO: 3016268 - DNA, 18 bp, Homo sapiens
cctacttcattttcagag

SEQ ID NO: 3016269 - DNA, 13 bp, Homo sapiens
cctactttctatt

SEQ ID NO: 3016270 - DNA, 16 bp, Homo sapiens
cctagaaatgtagcag

SEQ ID NO: 3016271 - DNA, 19 bp, Homo sapiens
cctagaaatgtagcagcag

SEQ ID NO: 3016272 - DNA, 20 bp, Homo sapiens
cctagaagtaagaagaggag

SEQ ID NO: 3016273 - DNA, 14 bp, Homo sapiens
cctagaatctttat

SEQ ID NO: 3016274 - DNA, 15 bp, Homo sapiens
cctagaatctttatt

SEQ ID NO: 3016275 - DNA, 22 bp, Homo sapiens
cctagactctgtaaccacctct

SEQ ID NO: 3016276 - DNA, 22 bp, Homo sapiens
cctagagcactctcaccccaag

SEQ ID NO: 3016277 - DNA, 22 bp, Homo sapiens
cctagagcgcggctggctctgt

SEQ ID NO: 3016278 - DNA, 15 bp, Homo sapiens
cctagaggagacagc

SEQ ID NO: 3016279 - DNA, 13 bp, Homo sapiens
cctagagggaggg

SEQ ID NO: 3016280 - DNA, 13 bp, Homo sapiens
cctagatccaggc

SEQ ID NO: 3016281 - DNA, 16 bp, Homo sapiens
cctagatcctaagggt

SEQ ID NO: 3016282 - DNA, 11 bp, Homo sapiens
cctagattata

SEQ ID NO: 3016283 - DNA, 16 bp, Homo sapiens
cctagcacatgcttca

SEQ ID NO: 3016284 - DNA, 12 bp, Homo sapiens
cctagcagcacc

SEQ ID NO: 3016285 - DNA, 23 bp, Homo sapiens
cctagcagcccaccctgctgctg

SEQ ID NO: 3016286 - DNA, 19 bp, Homo sapiens
ccaggggggtgaggagctg

SEQ ID NO: 3016287 - DNA, 18 bp, Homo sapiens
ccagggggtctcacccat

SEQ ID NO: 3016288 - DNA, 20 bp, Homo sapiens
ccaggggtaccaggcacatg

SEQ ID NO: 3016289 - DNA, 21 bp, Homo sapiens
ccaggggtaccaggcacatgg

SEQ ID NO: 3016290 - DNA, 18 bp, Homo sapiens
ccagggtcagaaacagga

SEQ ID NO: 3016291 - DNA, 14 bp, Homo sapiens
ccagggtcaggcgg

SEQ ID NO: 3016292 - DNA, 13 bp, Homo sapiens
ccagggtccctgg

SEQ ID NO: 3016293 - DNA, 17 bp, Homo sapiens
ccagggtggagctgaga

SEQ ID NO: 3016294 - DNA, 18 bp, Homo sapiens
ccagggttgaccccagag

SEQ ID NO: 3016295 - DNA, 16 bp, Homo sapiens
ccaggtaactttgaag

SEQ ID NO: 3016296 - DNA, 18 bp, Homo sapiens
ccaggtacgcacagacag

SEQ ID NO: 3016297 - DNA, 19 bp, Homo sapiens
ccaggtacgcacagacagg

SEQ ID NO: 3016298 - DNA, 14 bp, Homo sapiens
ccaggtcaacagaa

SEQ ID NO: 3016299 - DNA, 20 bp, Homo sapiens
ccaggtcaacagaatgaaaa

SEQ ID NO: 3016300 - DNA, 21 bp, Homo sapiens
ccaggtcaacagaatgaaaaa

SEQ ID NO: 3016301 - DNA, 17 bp, Homo sapiens
ccaggtccattttgcct

SEQ ID NO: 3016302 - DNA, 16 bp, Homo sapiens
ccaggtccccctgcag

SEQ ID NO: 3016303 - DNA, 18 bp, Homo sapiens
ccaggtccccctgcagct

SEQ ID NO: 3016304 - DNA, 13 bp, Homo sapiens
ccaggtctcccgg

SEQ ID NO: 3016305 - DNA, 19 bp, Homo sapiens
ccaggtgagtgtgagggca

SEQ ID NO: 3016306 - DNA, 20 bp, Homo sapiens
ccaggtgagtgtgagggcag

SEQ ID NO: 3016307 - DNA, 22 bp, Homo sapiens
ccaggtgagtgtgagggcagca

SEQ ID NO: 3016308 - DNA, 14 bp, Homo sapiens
ccaggtgcagaggt

SEQ ID NO: 3016309 - DNA, 17 bp, Homo sapiens
ccaggtgcatctgcagg

SEQ ID NO: 3016310 - DNA, 16 bp, Homo sapiens
ccaggtgcctttcaaa

SEQ ID NO: 3016311 - DNA, 13 bp, Homo sapiens
ccaggtgcggcct

SEQ ID NO: 3016312 - DNA, 22 bp, Homo sapiens
ccaggtgctacacccttttcca

SEQ ID NO: 3016313 - DNA, 16 bp, Homo sapiens
ccaggtggctgaccca

SEQ ID NO: 3016314 - DNA, 23 bp, Homo sapiens
ccaggtgttaacattccaagact

SEQ ID NO: 3016315 - DNA, 15 bp, Homo sapiens
ccaggttctatttgg

SEQ ID NO: 3016316 - DNA, 16 bp, Homo sapiens
ccaggttctatttgga

SEQ ID NO: 3016317 - DNA, 22 bp, Homo sapiens
ccaggttctatttggaatttat

SEQ ID NO: 3016318 - DNA, 14 bp, Homo sapiens
ccagtagctgggat

SEQ ID NO: 3016319 - DNA, 23 bp, Homo sapiens
ccagtatcctgctggttcactct

SEQ ID NO: 3016320 - DNA, 18 bp, Homo sapiens
ccagtatctatatatgtg

SEQ ID NO: 3016321 - DNA, 17 bp, Homo sapiens
ccagtcaaatctgggct

SEQ ID NO: 3016322 - DNA, 22 bp, Homo sapiens
ccagtcaaatctgggctcactc

SEQ ID NO: 3016323 - DNA, 14 bp, Homo sapiens
ccagtcaacctggg

SEQ ID NO: 3016324 - DNA, 21 bp, Homo sapiens
ccagtcactgtgagctcccag

SEQ ID NO: 3016325 - DNA, 18 bp, Homo sapiens
ccagtcatcatctcttga

SEQ ID NO: 3016326 - DNA, 15 bp, Homo sapiens
ccagtccatgctcca

SEQ ID NO: 3016327 - DNA, 20 bp, Homo sapiens
ccagtccccaacctgcactc

SEQ ID NO: 3016328 - DNA, 20 bp, Homo sapiens
ccagtccccagaagcagaga

SEQ ID NO: 3016329 - DNA, 23 bp, Homo sapiens
ccagtccctgggagcaagttgca

SEQ ID NO: 3016330 - DNA, 13 bp, Homo sapiens
ccagtccctgggg

SEQ ID NO: 3016331 - DNA, 14 bp, Homo sapiens
ccagtcctctgcct

SEQ ID NO: 3016332 - DNA, 13 bp, Homo sapiens
ccagtcctgctgg

SEQ ID NO: 3016333 - DNA, 15 bp, Homo sapiens
ccagtcctgctggcc

SEQ ID NO: 3016334 - DNA, 18 bp, Homo sapiens
ccagtcctgctggcctgc

SEQ ID NO: 3016335 - DNA, 19 bp, Homo sapiens
ccagtcctgctggcctgct

SEQ ID NO: 3016336 - DNA, 15 bp, Homo sapiens
ccagtcctggtcctg

SEQ ID NO: 3016337 - DNA, 19 bp, Homo sapiens
ccagtcctggtcctggctg

SEQ ID NO: 3016338 - DNA, 11 bp, Homo sapiens
ccagtccttgg

SEQ ID NO: 3016339 - DNA, 20 bp, Homo sapiens
ccagtcgggagagccaggct

SEQ ID NO: 3016340 - DNA, 13 bp, Homo sapiens
ccagtctcctccc

SEQ ID NO: 3016341 - DNA, 13 bp, Homo sapiens
ccagtctgttctc

SEQ ID NO: 3016342 - DNA, 14 bp, Homo sapiens
ccagtctgttgctg

SEQ ID NO: 3016343 - DNA, 18 bp, Homo sapiens
ccagtgaatttttgcaat

SEQ ID NO: 3016344 - DNA, 20 bp, Homo sapiens
ccagtgaatttttgcaataa

SEQ ID NO: 3016345 - DNA, 21 bp, Homo sapiens
ccagtgaatttttgcaataat

SEQ ID NO: 3016346 - DNA, 12 bp, Homo sapiens
ccagtgacagct

SEQ ID NO: 3016347 - DNA, 17 bp, Homo sapiens
ccagtgacctgaggaag

SEQ ID NO: 3016348 - DNA, 16 bp, Homo sapiens
ccagtgacgtggttca

SEQ ID NO: 3016349 - DNA, 23 bp, Homo sapiens
ccagtgagggacgtcagacttgg

SEQ ID NO: 3016350 - DNA, 23 bp, Homo sapiens
ccagtgagttcagcctttaagat

SEQ ID NO: 3016351 - DNA, 15 bp, Homo sapiens
ccagtgcagaatgta

SEQ ID NO: 3016352 - DNA, 13 bp, Homo sapiens
ccagtgcaggctg

SEQ ID NO: 3016353 - DNA, 17 bp, Homo sapiens
ccagtgcaggctggcca

SEQ ID NO: 3016354 - DNA, 22 bp, Homo sapiens
ccagtgcaggctggccagccgc

SEQ ID NO: 3016355 - DNA, 19 bp, Homo sapiens
ccagtgcatggtggccaga

SEQ ID NO: 3016356 - DNA, 18 bp, Homo sapiens
ccagtgcattttgtttct

SEQ ID NO: 3016357 - DNA, 14 bp, Homo sapiens
ccagtgcccccact

SEQ ID NO: 3016358 - DNA, 15 bp, Homo sapiens
ccagtgccgaggaca

SEQ ID NO: 3016359 - DNA, 16 bp, Homo sapiens
ccagtgccgaggacat

SEQ ID NO: 3016360 - DNA, 20 bp, Homo sapiens
ccagtgccgaggacatgcat

SEQ ID NO: 3016361 - DNA, 21 bp, Homo sapiens
ccagtgccttacctcctgccc

SEQ ID NO: 3016362 - DNA, 23 bp, Homo sapiens
ccagtgccttacctcctgcccag

SEQ ID NO: 3016363 - DNA, 19 bp, Homo sapiens
ccagtgcgctcgttccggt

SEQ ID NO: 3016364 - DNA, 12 bp, Homo sapiens
ccagtgcttctc

SEQ ID NO: 3016365 - DNA, 21 bp, Homo sapiens
ccagtgcttctccaacactga

SEQ ID NO: 3016366 - DNA, 18 bp, Homo sapiens
ccagtgtaaattcagtct

SEQ ID NO: 3016367 - DNA, 19 bp, Homo sapiens
ccagtgtgctgatgggcgt

SEQ ID NO: 3016368 - DNA, 23 bp, Homo sapiens
ccagtgttacaatcagtgtgaat

SEQ ID NO: 3016369 - DNA, 17 bp, Homo sapiens
ccagttaaaaaaaattt

SEQ ID NO: 3016370 - DNA, 13 bp, Homo sapiens
ccagttaaggaaa

SEQ ID NO: 3016371 - DNA, 16 bp, Homo sapiens
ccagttagttagaatt

SEQ ID NO: 3016372 - DNA, 13 bp, Homo sapiens
ccagttcaccctg

SEQ ID NO: 3016373 - DNA, 15 bp, Homo sapiens
ccagttcagcttggg

SEQ ID NO: 3016374 - DNA, 14 bp, Homo sapiens
ccagttccaggaca

SEQ ID NO: 3016375 - DNA, 20 bp, Homo sapiens
ccagttcgcctggagccctc

SEQ ID NO: 3016376 - DNA, 15 bp, Homo sapiens
ccagttggagttttt

SEQ ID NO: 3016377 - DNA, 21 bp, Homo sapiens
ccagttgtagcaggtttcact

SEQ ID NO: 3016378 - DNA, 15 bp, Homo sapiens
ccagtttcccatgca

SEQ ID NO: 3016379 - DNA, 10 bp, Homo sapiens
ccagtttctt

SEQ ID NO: 3016380 - DNA, 13 bp, Homo sapiens
ccagtttctttgt

SEQ ID NO: 3016381 - DNA, 20 bp, Homo sapiens
ccagtttcttttcttttgtt

SEQ ID NO: 3016382 - DNA, 19 bp, Homo sapiens
ccagttttcggaaacactg

SEQ ID NO: 3016383 - DNA, 17 bp, Homo sapiens
ccataaaatgatcctgc

SEQ ID NO: 3016384 - DNA, 14 bp, Homo sapiens
ccataaagataatg

SEQ ID NO: 3016385 - DNA, 18 bp, Homo sapiens
ccataagaggagtaggcc

SEQ ID NO: 3016386 - DNA, 23 bp, Homo sapiens
ccataagaggagtaggccctggt

SEQ ID NO: 3016387 - DNA, 22 bp, Homo sapiens
ccataagtggagaaatgaaaag

SEQ ID NO: 3016388 - DNA, 12 bp, Homo sapiens
ccataatacaaa

SEQ ID NO: 3016389 - DNA, 15 bp, Homo sapiens
ccataatgttcctta

SEQ ID NO: 3016390 - DNA, 14 bp, Homo sapiens
ccatacaccccctc

SEQ ID NO: 3016391 - DNA, 13 bp, Homo sapiens
ccatactttggat

SEQ ID NO: 3016392 - DNA, 21 bp, Homo sapiens
ccatagagatatttaaaagac

SEQ ID NO: 3016393 - DNA, 12 bp, Homo sapiens
ccatagagcagt

SEQ ID NO: 3016394 - DNA, 23 bp, Homo sapiens
ccatagcaccctgccctcatggg

SEQ ID NO: 3016395 - DNA, 19 bp, Homo sapiens
ccataggcccacacacagg

SEQ ID NO: 3016396 - DNA, 15 bp, Homo sapiens
ccatagtaactgaca

SEQ ID NO: 3016397 - DNA, 18 bp, Homo sapiens
ccatagtttgggtatttt

SEQ ID NO: 3016398 - DNA, 19 bp, Homo sapiens
ccatagtttgggtattttt

SEQ ID NO: 3016399 - DNA, 15 bp, Homo sapiens
ccatatatccttttc

SEQ ID NO: 3016400 - DNA, 13 bp, Homo sapiens
ccatatgaatgaa

SEQ ID NO: 3016401 - DNA, 15 bp, Homo sapiens
ccatatggacactgt

SEQ ID NO: 3016402 - DNA, 18 bp, Homo sapiens
ccatatggacactgtgac

SEQ ID NO: 3016403 - DNA, 16 bp, Homo sapiens
ccatattacgttgttt

SEQ ID NO: 3016404 - DNA, 14 bp, Homo sapiens
ccatatttgaattg

SEQ ID NO: 3016405 - DNA, 19 bp, Homo sapiens
ccatattttattgtatttt

SEQ ID NO: 3016406 - DNA, 16 bp, Homo sapiens
ccatcaaaatgctttt

SEQ ID NO: 3016407 - DNA, 18 bp, Homo sapiens
aagagtctccttctcttc

SEQ ID NO: 3016408 - DNA, 16 bp, Homo sapiens
aagagtctctccagcc

SEQ ID NO: 3016409 - DNA, 13 bp, Homo sapiens
aagagtctctggc

SEQ ID NO: 3016410 - DNA, 18 bp, Homo sapiens
aagagtctctggctcagc

SEQ ID NO: 3016411 - DNA, 19 bp, Homo sapiens
aagagtctctggctcagct

SEQ ID NO: 3016412 - DNA, 21 bp, Homo sapiens
aagagtctctggctcagctgt

SEQ ID NO: 3016413 - DNA, 15 bp, Homo sapiens
aagagttaaagagta

SEQ ID NO: 3016414 - DNA, 14 bp, Homo sapiens
aagataaaatgatg

SEQ ID NO: 3016415 - DNA, 17 bp, Homo sapiens
aagataaacctggagat

SEQ ID NO: 3016416 - DNA, 23 bp, Homo sapiens
aagatactgctgatgctgaaata

SEQ ID NO: 3016417 - DNA, 17 bp, Homo sapiens
aagatagcttcacccca

SEQ ID NO: 3016418 - DNA, 21 bp, Homo sapiens
aagatatatattcaccaatgt

SEQ ID NO: 3016419 - DNA, 20 bp, Homo sapiens
aagatatccatctttttctt

SEQ ID NO: 3016420 - DNA, 15 bp, Homo sapiens
aagatattctttagt

SEQ ID NO: 3016421 - DNA, 22 bp, Homo sapiens
aagatcctagatcctaagggtc

SEQ ID NO: 3016422 - DNA, 19 bp, Homo sapiens
aagatcgcaccactgcact

SEQ ID NO: 3016423 - DNA, 14 bp, Homo sapiens
aagatcgcatggca

SEQ ID NO: 3016424 - DNA, 17 bp, Homo sapiens
aagatcgttctctgcct

SEQ ID NO: 3016425 - DNA, 20 bp, Homo sapiens
aagatctacctgcaacacaa

SEQ ID NO: 3016426 - DNA, 21 bp, Homo sapiens
aagatctcactctgccccccc

SEQ ID NO: 3016427 - DNA, 20 bp, Homo sapiens
aagatctgtcctcagccttg

SEQ ID NO: 3016428 - DNA, 22 bp, Homo sapiens
aagatctgttttgaaggcaaaa

SEQ ID NO: 3016429 - DNA, 14 bp, Homo sapiens
aagatcttagattc

SEQ ID NO: 3016430 - DNA, 17 bp, Homo sapiens
aagatcttagattctct

SEQ ID NO: 3016431 - DNA, 23 bp, Homo sapiens
aagatcttagattctctgtgtct

SEQ ID NO: 3016432 - DNA, 17 bp, Homo sapiens
aagatcttcaaaagtaa

SEQ ID NO: 3016433 - DNA, 20 bp, Homo sapiens
aagatctttatatttcaata

SEQ ID NO: 3016434 - DNA, 15 bp, Homo sapiens
aagatgacattgcta

SEQ ID NO: 3016435 - DNA, 23 bp, Homo sapiens
aagatgacattgctaagatgctc

SEQ ID NO: 3016436 - DNA, 20 bp, Homo sapiens
aagatgatttaatgttgatt

SEQ ID NO: 3016437 - DNA, 22 bp, Homo sapiens
aagatgcagagtaagtattatg

SEQ ID NO: 3016438 - DNA, 22 bp, Homo sapiens
aagatgcattgtagtttaacca

SEQ ID NO: 3016439 - DNA, 19 bp, Homo sapiens
aagatgctcatctgagcca

SEQ ID NO: 3016440 - DNA, 17 bp, Homo sapiens
aagatggagtttctaag

SEQ ID NO: 3016441 - DNA, 20 bp, Homo sapiens
aagatggagtttctaaggtc

SEQ ID NO: 3016442 - DNA, 21 bp, Homo sapiens
aagatggataaactgagcctc

SEQ ID NO: 3016443 - DNA, 15 bp, Homo sapiens
aagatggcttttcct

SEQ ID NO: 3016444 - DNA, 18 bp, Homo sapiens
aagatgggtgaaggctgg

SEQ ID NO: 3016445 - DNA, 16 bp, Homo sapiens
aagatggtacaacctt

SEQ ID NO: 3016446 - DNA, 13 bp, Homo sapiens
aagatgtaaggaa

SEQ ID NO: 3016447 - DNA, 21 bp, Homo sapiens
aagatgtaaggaattgaagat

SEQ ID NO: 3016448 - DNA, 22 bp, Homo sapiens
aagatgtaataatcattttaga

SEQ ID NO: 3016449 - DNA, 15 bp, Homo sapiens
aagatgtgaaaactc

SEQ ID NO: 3016450 - DNA, 16 bp, Homo sapiens
aagatgttgattttta

SEQ ID NO: 3016451 - DNA, 21 bp, Homo sapiens
aagatgttgatttttactgtg

SEQ ID NO: 3016452 - DNA, 15 bp, Homo sapiens
aagattatagattct

SEQ ID NO: 3016453 - DNA, 13 bp, Homo sapiens
aaggaatctggca

SEQ ID NO: 3016454 - DNA, 14 bp, Homo sapiens
aaggacaaagtgcc

SEQ ID NO: 3016455 - DNA, 21 bp, Homo sapiens
aaggacattttctctttaaaa

SEQ ID NO: 3016456 - DNA, 22 bp, Homo sapiens
aaggacattttctctttaaaag

SEQ ID NO: 3016457 - DNA, 14 bp, Homo sapiens
aaggaccagccctt

SEQ ID NO: 3016458 - DNA, 22 bp, Homo sapiens
aaggactaatccaatacctctt

SEQ ID NO: 3016459 - DNA, 15 bp, Homo sapiens
aaggactccaatgtc

SEQ ID NO: 3016460 - DNA, 21 bp, Homo sapiens
aaggactggccgtggctccag

SEQ ID NO: 3016461 - DNA, 17 bp, Homo sapiens
aaggacttcctgtccag

SEQ ID NO: 3016462 - DNA, 20 bp, Homo sapiens
aaggacttcctgtccagctc

SEQ ID NO: 3016463 - DNA, 22 bp, Homo sapiens
aaggacttcctgtccagctcca

SEQ ID NO: 3016464 - DNA, 19 bp, Homo sapiens
aaggactttccaaatccag

SEQ ID NO: 3016465 - DNA, 18 bp, Homo sapiens
aaggagaaggaaaaagaa

SEQ ID NO: 3016466 - DNA, 15 bp, Homo sapiens
aaggagaaggaagga

SEQ ID NO: 3016467 - DNA, 16 bp, Homo sapiens
aaggagaatatgataa

SEQ ID NO: 3016468 - DNA, 14 bp, Homo sapiens
aaggagaattgaat

SEQ ID NO: 3016469 - DNA, 14 bp, Homo sapiens
aaggagacacagat

SEQ ID NO: 3016470 - DNA, 16 bp, Homo sapiens
aaggagactcacctct

SEQ ID NO: 3016471 - DNA, 20 bp, Homo sapiens
aaggagactcacctctgcct

SEQ ID NO: 3016472 - DNA, 18 bp, Homo sapiens
aaggagactggtaggagg

SEQ ID NO: 3016473 - DNA, 14 bp, Homo sapiens
aaggagagatgacc

SEQ ID NO: 3016474 - DNA, 17 bp, Homo sapiens
aaggagagatgacccct

SEQ ID NO: 3016475 - DNA, 16 bp, Homo sapiens
aaggagaggagttctt

SEQ ID NO: 3016476 - DNA, 20 bp, Homo sapiens
aaggagaggttaaagcaaac

SEQ ID NO: 3016477 - DNA, 15 bp, Homo sapiens
aaggagagtggccat

SEQ ID NO: 3016478 - DNA, 23 bp, Homo sapiens
aaggagatatatcagtgttgtct

SEQ ID NO: 3016479 - DNA, 15 bp, Homo sapiens
aaggagcacatacta

SEQ ID NO: 3016480 - DNA, 15 bp, Homo sapiens
aaggagcgctagtgc

SEQ ID NO: 3016481 - DNA, 17 bp, Homo sapiens
aaggagcgctagtgcct

SEQ ID NO: 3016482 - DNA, 20 bp, Homo sapiens
aaggagcggcgccctggact

SEQ ID NO: 3016483 - DNA, 16 bp, Homo sapiens
aaggagcgggcagggc

SEQ ID NO: 3016484 - DNA, 12 bp, Homo sapiens
aaggagctgcta

SEQ ID NO: 3016485 - DNA, 11 bp, Homo sapiens
aaggaggaaaa

SEQ ID NO: 3016486 - DNA, 23 bp, Homo sapiens
aaggaggattccatttggcagag

SEQ ID NO: 3016487 - DNA, 17 bp, Homo sapiens
aaggagggaaggattta

SEQ ID NO: 3016488 - DNA, 16 bp, Homo sapiens
aaggagggagaaagga

SEQ ID NO: 3016489 - DNA, 18 bp, Homo sapiens
aaggaggggaaaaaaatg

SEQ ID NO: 3016490 - DNA, 22 bp, Homo sapiens
aaggagtgtatgagtgtgagtg

SEQ ID NO: 3016491 - DNA, 15 bp, Homo sapiens
aaggatagatgctgg

SEQ ID NO: 3016492 - DNA, 20 bp, Homo sapiens
aaggatctttgtggccaagg

SEQ ID NO: 3016493 - DNA, 13 bp, Homo sapiens
aaggatgagggtt

SEQ ID NO: 3016494 - DNA, 15 bp, Homo sapiens
aaggatgtacatttc

SEQ ID NO: 3016495 - DNA, 16 bp, Homo sapiens
aaggatgtacatttcc

SEQ ID NO: 3016496 - DNA, 22 bp, Homo sapiens
aaggatgtagcttttcaccttt

SEQ ID NO: 3016497 - DNA, 15 bp, Homo sapiens
aaggatgtgattgtg

SEQ ID NO: 3016498 - DNA, 12 bp, Homo sapiens
aaggattacaga

SEQ ID NO: 3016499 - DNA, 17 bp, Homo sapiens
aaggattacagaaactg

SEQ ID NO: 3016500 - DNA, 18 bp, Homo sapiens
aaggattctgaagtttta

SEQ ID NO: 3016501 - DNA, 18 bp, Homo sapiens
aaggatttcttgtattgg

SEQ ID NO: 3016502 - DNA, 15 bp, Homo sapiens
aaggcaaaaatgtaa

SEQ ID NO: 3016503 - DNA, 15 bp, Homo sapiens
aaggcaaaattgcaa

SEQ ID NO: 3016504 - DNA, 20 bp, Homo sapiens
aaggcaaacccatcaacaaa

SEQ ID NO: 3016505 - DNA, 13 bp, Homo sapiens
aaggcaaaggcag

SEQ ID NO: 3016506 - DNA, 17 bp, Homo sapiens
aaggcaaaggcagagga

SEQ ID NO: 3016507 - DNA, 18 bp, Homo sapiens
aaggcaaatgtgtacatg

SEQ ID NO: 3016508 - DNA, 16 bp, Homo sapiens
aaggcaacttgaagaa

SEQ ID NO: 3016509 - DNA, 19 bp, Homo sapiens
aaggcaacttgaagaaacg

SEQ ID NO: 3016510 - DNA, 14 bp, Homo sapiens
aaggcaagccagca

SEQ ID NO: 3016511 - DNA, 14 bp, Homo sapiens
aaggcactctagat

SEQ ID NO: 3016512 - DNA, 16 bp, Homo sapiens
aaggcactctagattc

SEQ ID NO: 3016513 - DNA, 15 bp, Homo sapiens
aaggcagtcccggga

SEQ ID NO: 3016514 - DNA, 16 bp, Homo sapiens
aaggcagtcccgggag

SEQ ID NO: 3016515 - DNA, 19 bp, Homo sapiens
aaggcatccaggccagggc

SEQ ID NO: 3016516 - DNA, 15 bp, Homo sapiens
aaggcatgtgtgaaa

SEQ ID NO: 3016517 - DNA, 18 bp, Homo sapiens
aaggcatgtgtgaaacat

SEQ ID NO: 3016518 - DNA, 14 bp, Homo sapiens
aaggcattctctga

SEQ ID NO: 3016519 - DNA, 13 bp, Homo sapiens
aaggcattttatt

SEQ ID NO: 3016520 - DNA, 17 bp, Homo sapiens
aaggccaaacctctgtt

SEQ ID NO: 3016521 - DNA, 23 bp, Homo sapiens
aaggccacgtatagtcctagctg

SEQ ID NO: 3016522 - DNA, 24 bp, Homo sapiens
aaggccacgtatagtcctagctga

SEQ ID NO: 3016523 - DNA, 20 bp, Homo sapiens
aaggccactgttttaaaaga

SEQ ID NO: 3016524 - DNA, 18 bp, Homo sapiens
aaggcccatgaaggaaat

SEQ ID NO: 3016525 - DNA, 15 bp, Homo sapiens
aaggccctttttcct

SEQ ID NO: 3016526 - DNA, 16 bp, Homo sapiens
aaggccctttttccta

SEQ ID NO: 3016527 - DNA, 22 bp, Homo sapiens
aaggccgtgtgtttagaagcct

SEQ ID NO: 3016528 - DNA, 15 bp, Homo sapiens
aaggcctaggattct

SEQ ID NO: 3016529 - DNA, 17 bp, Homo sapiens
aaggcctaggctaggac

SEQ ID NO: 3016530 - DNA, 12 bp, Homo sapiens
aaggcctcccct

SEQ ID NO: 3016531 - DNA, 19 bp, Homo sapiens
aaggcctccctagccagca

SEQ ID NO: 3016532 - DNA, 16 bp, Homo sapiens
aaggcctcggcagaac

SEQ ID NO: 3016533 - DNA, 19 bp, Homo sapiens
aaggccttgcctggcctga

SEQ ID NO: 3016534 - DNA, 21 bp, Homo sapiens
aaggctaattttttatccttt

SEQ ID NO: 3016535 - DNA, 21 bp, Homo sapiens
aaggctcagaaggaatggtgc

SEQ ID NO: 3016536 - DNA, 16 bp, Homo sapiens
aaggctccatatatat

SEQ ID NO: 3016537 - DNA, 12 bp, Homo sapiens
aaggctctagat

SEQ ID NO: 3016538 - DNA, 13 bp, Homo sapiens
aaggctctagatc

SEQ ID NO: 3016539 - DNA, 21 bp, Homo sapiens
aaggctctatgagtctagatg

SEQ ID NO: 3016540 - DNA, 20 bp, Homo sapiens
aaggctctgagagtctagat

SEQ ID NO: 3016541 - DNA, 14 bp, Homo sapiens
aaggctcttttgta

SEQ ID NO: 3016542 - DNA, 19 bp, Homo sapiens
aaggctgaggaaaggccag

SEQ ID NO: 3016543 - DNA, 17 bp, Homo sapiens
aaggctgtgctgccctg

SEQ ID NO: 3016544 - DNA, 21 bp, Homo sapiens
aaggctgtgctgccctgaaga

SEQ ID NO: 3016545 - DNA, 20 bp, Homo sapiens
aaggctgtgtttagattgta

SEQ ID NO: 3016546 - DNA, 21 bp, Homo sapiens
aaggctgtgtttagattgtat

SEQ ID NO: 3016547 - DNA, 13 bp, Homo sapiens
aaggcttcagtct

SEQ ID NO: 3016548 - DNA, 17 bp, Homo sapiens
aaggcttgttgtgcttt

SEQ ID NO: 3016549 - DNA, 23 bp, Homo sapiens
aaggctttgattagttttcttgt

SEQ ID NO: 3016550 - DNA, 17 bp, Homo sapiens
aaggctttggcaacaga

SEQ ID NO: 3016551 - DNA, 13 bp, Homo sapiens
aagggaaaaaata

SEQ ID NO: 3016552 - DNA, 16 bp, Homo sapiens
aagggaaaaaataaaa

SEQ ID NO: 3016553 - DNA, 16 bp, Homo sapiens
aagggaaaagtctctt

SEQ ID NO: 3016554 - DNA, 14 bp, Homo sapiens
aagggaaactggct

SEQ ID NO: 3016555 - DNA, 15 bp, Homo sapiens
aagggaaactggctg

SEQ ID NO: 3016556 - DNA, 22 bp, Homo sapiens
aagggaaggggcctccctccga

SEQ ID NO: 3016557 - DNA, 20 bp, Homo sapiens
ccattctcctgcctcagcct

SEQ ID NO: 3016558 - DNA, 20 bp, Homo sapiens
ccattctctctcctgtccaa

SEQ ID NO: 3016559 - DNA, 15 bp, Homo sapiens
ccattctgtttaaat

SEQ ID NO: 3016560 - DNA, 12 bp, Homo sapiens
ccattcttcccg

SEQ ID NO: 3016561 - DNA, 11 bp, Homo sapiens
aaaaaaaaact

SEQ ID NO: 3016562 - DNA, 11 bp, Homo sapiens
aaaaaaaagaa

SEQ ID NO: 3016563 - DNA, 12 bp, Homo sapiens
aaaaaaacatta

SEQ ID NO: 3016564 - DNA, 10 bp, Homo sapiens
aaaaaaagac

SEQ ID NO: 3016565 - DNA, 14 bp, Homo sapiens
aaaaaaagatctgt

SEQ ID NO: 3016566 - DNA, 13 bp, Homo sapiens
aaaaaaagcatgt

SEQ ID NO: 3016567 - DNA, 9 bp, Homo sapiens
aaaaaaagt

SEQ ID NO: 3016568 - DNA, 11 bp, Homo sapiens
aaaaaaagttt

SEQ ID NO: 3016569 - DNA, 13 bp, Homo sapiens
aaaaaaatgtgaa

SEQ ID NO: 3016570 - DNA, 14 bp, Homo sapiens
aaaaaaatgtgaaa

SEQ ID NO: 3016571 - DNA, 13 bp, Homo sapiens
aaaaaaattacaa

SEQ ID NO: 3016572 - DNA, 12 bp, Homo sapiens
aaaaaaattttt

SEQ ID NO: 3016573 - DNA, 20 bp, Homo sapiens
aaaaaagaaaacattccaga

SEQ ID NO: 3016574 - DNA, 13 bp, Homo sapiens
aaaaaagaagtgt

SEQ ID NO: 3016575 - DNA, 13 bp, Homo sapiens
aaaaaagtttcta

SEQ ID NO: 3016576 - DNA, 13 bp, Homo sapiens
aaaaaataaaaag

SEQ ID NO: 3016577 - DNA, 12 bp, Homo sapiens
aaaaaatgtgaa

SEQ ID NO: 3016578 - DNA, 20 bp, Homo sapiens
aaaaaatgtgaaatttttcc

SEQ ID NO: 3016579 - DNA, 11 bp, Homo sapiens
aaaaaattaaa

SEQ ID NO: 3016580 - DNA, 13 bp, Homo sapiens
aaaaaattacaaa

SEQ ID NO: 3016581 - DNA, 11 bp, Homo sapiens
aaaaacaaaaa

SEQ ID NO: 3016582 - DNA, 11 bp, Homo sapiens
aaaaacaacaa

SEQ ID NO: 3016583 - DNA, 14 bp, Homo sapiens
aaaaacaattaact

SEQ ID NO: 3016584 - DNA, 22 bp, Homo sapiens
aaaaacaattggttgtatataa

SEQ ID NO: 3016585 - DNA, 21 bp, Homo sapiens
aaaaacagcattgctttctga

SEQ ID NO: 3016586 - DNA, 16 bp, Homo sapiens
aaaaacataaaaagca

SEQ ID NO: 3016587 - DNA, 11 bp, Homo sapiens
aaaaacattat

SEQ ID NO: 3016588 - DNA, 15 bp, Homo sapiens
aaaaacattgccttt

SEQ ID NO: 3016589 - DNA, 11 bp, Homo sapiens
aaaaacatttt

SEQ ID NO: 3016590 - DNA, 24 bp, Homo sapiens
aaaaaccctatttaaatgaaagga

SEQ ID NO: 3016591 - DNA, 14 bp, Homo sapiens
aaaaaccgttcaaa

SEQ ID NO: 3016592 - DNA, 13 bp, Homo sapiens
aaaaactacacat

SEQ ID NO: 3016593 - DNA, 12 bp, Homo sapiens
aaaaactattaa

SEQ ID NO: 3016594 - DNA, 21 bp, Homo sapiens
aaaaactcgaggactgtattt

SEQ ID NO: 3016595 - DNA, 15 bp, Homo sapiens
aaaaactctctccca

SEQ ID NO: 3016596 - DNA, 18 bp, Homo sapiens
aaaaactctctcccagga

SEQ ID NO: 3016597 - DNA, 19 bp, Homo sapiens
aaaaacttccattctttct

SEQ ID NO: 3016598 - DNA, 19 bp, Homo sapiens
aaaaactttgccagccatt

SEQ ID NO: 3016599 - DNA, 11 bp, Homo sapiens
aaaaagaaatt

SEQ ID NO: 3016600 - DNA, 22 bp, Homo sapiens
aaaaagaatcggcagtattttc

SEQ ID NO: 3016601 - DNA, 20 bp, Homo sapiens
aaaaagatgacttaaggtga

SEQ ID NO: 3016602 - DNA, 12 bp, Homo sapiens
aaaaagattttt

SEQ ID NO: 3016603 - DNA, 10 bp, Homo sapiens
aaaaagcaaa

SEQ ID NO: 3016604 - DNA, 22 bp, Homo sapiens
aaaaagcagaattttaatgtga

SEQ ID NO: 3016605 - DNA, 18 bp, Homo sapiens
aaaaagcatgatgggaaa

SEQ ID NO: 3016606 - DNA, 15 bp, Homo sapiens
aaaaagcatgtgtca

SEQ ID NO: 3016607 - DNA, 19 bp, Homo sapiens
aaaaagcttccatgattct

SEQ ID NO: 3016608 - DNA, 12 bp, Homo sapiens
aaaaaggaaaaa

SEQ ID NO: 3016609 - DNA, 17 bp, Homo sapiens
aaaaaggaaaaaaagac

SEQ ID NO: 3016610 - DNA, 13 bp, Homo sapiens
aaaaaggaaaaat

SEQ ID NO: 3016611 - DNA, 17 bp, Homo sapiens
aaaaaggaactgcagca

SEQ ID NO: 3016612 - DNA, 13 bp, Homo sapiens
aaaaaggaaggag

SEQ ID NO: 3016613 - DNA, 23 bp, Homo sapiens
aaaaaggactggaaaaatgaact

SEQ ID NO: 3016614 - DNA, 22 bp, Homo sapiens
aaacccataggcccacacacag

SEQ ID NO: 3016615 - DNA, 23 bp, Homo sapiens
aaacccataggcccacacacagg

SEQ ID NO: 3016616 - DNA, 22 bp, Homo sapiens
aaacccccacacacacacacat

SEQ ID NO: 3016617 - DNA, 13 bp, Homo sapiens
aaaccccttccca

SEQ ID NO: 3016618 - DNA, 18 bp, Homo sapiens
aaacccgacagagggaag

SEQ ID NO: 3016619 - DNA, 19 bp, Homo sapiens
aaacccgacagagggaaga

SEQ ID NO: 3016620 - DNA, 15 bp, Homo sapiens
aaacccgagggttga

SEQ ID NO: 3016621 - DNA, 19 bp, Homo sapiens
aaacctaagtcctttatgt

SEQ ID NO: 3016622 - DNA, 18 bp, Homo sapiens
aaacctacacactgtcat

SEQ ID NO: 3016623 - DNA, 13 bp, Homo sapiens
aaacctacagcat

SEQ ID NO: 3016624 - DNA, 11 bp, Homo sapiens
aaacctctcct

SEQ ID NO: 3016625 - DNA, 16 bp, Homo sapiens
aaacctctgttcagtg

SEQ ID NO: 3016626 - DNA, 23 bp, Homo sapiens
aaacctgatgtcagctgctgttg

SEQ ID NO: 3016627 - DNA, 16 bp, Homo sapiens
aaacctgtatctttct

SEQ ID NO: 3016628 - DNA, 16 bp, Homo sapiens
aaaccttgggccctgg

SEQ ID NO: 3016629 - DNA, 22 bp, Homo sapiens
aaaccttggtgtagttgaactg

SEQ ID NO: 3016630 - DNA, 15 bp, Homo sapiens
aaacctttaagaaaa

SEQ ID NO: 3016631 - DNA, 15 bp, Homo sapiens
aaacctttccatttt

SEQ ID NO: 3016632 - DNA, 20 bp, Homo sapiens
aaacctttgcttaccttgtt

SEQ ID NO: 3016633 - DNA, 19 bp, Homo sapiens
aaacgagtcaatcccctca

SEQ ID NO: 3016634 - DNA, 17 bp, Homo sapiens
aaacgatttaattctct

SEQ ID NO: 3016635 - DNA, 21 bp, Homo sapiens
aaacgatttaattctcttgaa

SEQ ID NO: 3016636 - DNA, 14 bp, Homo sapiens
aaacgcgcagatgt

SEQ ID NO: 3016637 - DNA, 15 bp, Homo sapiens
aaacgcgcagatgtg

SEQ ID NO: 3016638 - DNA, 21 bp, Homo sapiens
aaacgcgcagatgtgcagcag

SEQ ID NO: 3016639 - DNA, 12 bp, Homo sapiens
aaacgctacctc

SEQ ID NO: 3016640 - DNA, 16 bp, Homo sapiens
aaacgctacctctctg

SEQ ID NO: 3016641 - DNA, 21 bp, Homo sapiens
aaacgctacctctctgtccct

SEQ ID NO: 3016642 - DNA, 12 bp, Homo sapiens
aaacgctgcctg

SEQ ID NO: 3016643 - DNA, 14 bp, Homo sapiens
aaacggttcagttt

SEQ ID NO: 3016644 - DNA, 20 bp, Homo sapiens
aaacgtatggaatgcttctt

SEQ ID NO: 3016645 - DNA, 16 bp, Homo sapiens
aaacgttaaaagtgta

SEQ ID NO: 3016646 - DNA, 19 bp, Homo sapiens
aaacgttaaaagtgtacaa

SEQ ID NO: 3016647 - DNA, 16 bp, Homo sapiens
aaactaaagcaataga

SEQ ID NO: 3016648 - DNA, 17 bp, Homo sapiens
aaactaaagcaatagaa

SEQ ID NO: 3016649 - DNA, 14 bp, Homo sapiens
aaactaaatgtgta

SEQ ID NO: 3016650 - DNA, 16 bp, Homo sapiens
aaactaaggtgctaaa

SEQ ID NO: 3016651 - DNA, 14 bp, Homo sapiens
aaactacaaacaaa

SEQ ID NO: 3016652 - DNA, 21 bp, Homo sapiens
aaactacctgtatttaaaaat

SEQ ID NO: 3016653 - DNA, 17 bp, Homo sapiens
aaactactatttttctt

SEQ ID NO: 3016654 - DNA, 21 bp, Homo sapiens
aaactactatttttctttcca

SEQ ID NO: 3016655 - DNA, 22 bp, Homo sapiens
aaactactatttttctttccaa

SEQ ID NO: 3016656 - DNA, 20 bp, Homo sapiens
aaactacttgattttattgt

SEQ ID NO: 3016657 - DNA, 12 bp, Homo sapiens
aaactagatgac

SEQ ID NO: 3016658 - DNA, 15 bp, Homo sapiens
aaactagatgacctc

SEQ ID NO: 3016659 - DNA, 20 bp, Homo sapiens
aaactagatgacctcattaa

SEQ ID NO: 3016660 - DNA, 22 bp, Homo sapiens
aaactagatgacctcattaacc

SEQ ID NO: 3016661 - DNA, 14 bp, Homo sapiens
aaactagtagttct

SEQ ID NO: 3016662 - DNA, 15 bp, Homo sapiens
aaactagtagttctc

SEQ ID NO: 3016663 - DNA, 19 bp, Homo sapiens
aaactatgaaacctttttc

SEQ ID NO: 3016664 - DNA, 14 bp, Homo sapiens
aaactattaaggat

SEQ ID NO: 3016665 - DNA, 16 bp, Homo sapiens
aaactattccatgttt

SEQ ID NO: 3016666 - DNA, 18 bp, Homo sapiens
aaactattccatgtttta

SEQ ID NO: 3016667 - DNA, 22 bp, Homo sapiens
aaactatttatctgtgtttttg

SEQ ID NO: 3016668 - DNA, 18 bp, Homo sapiens
aaactcaaagaatgtgta

SEQ ID NO: 3016669 - DNA, 16 bp, Homo sapiens
aaactccctggctgtt

SEQ ID NO: 3016670 - DNA, 18 bp, Homo sapiens
aaactcccttgtgttcct

SEQ ID NO: 3016671 - DNA, 19 bp, Homo sapiens
aaactccgtcttagaagtg

SEQ ID NO: 3016672 - DNA, 11 bp, Homo sapiens
aaactcctgac

SEQ ID NO: 3016673 - DNA, 16 bp, Homo sapiens
aaactcctgacttcag

SEQ ID NO: 3016674 - DNA, 20 bp, Homo sapiens
aaactctatcggagaacatg

SEQ ID NO: 3016675 - DNA, 16 bp, Homo sapiens
aaactctcttcttcca

SEQ ID NO: 3016676 - DNA, 19 bp, Homo sapiens
aaactctgttgcaagtgca

SEQ ID NO: 3016677 - DNA, 11 bp, Homo sapiens
aaactcttcag

SEQ ID NO: 3016678 - DNA, 19 bp, Homo sapiens
aaactcttcagttaattct

SEQ ID NO: 3016679 - DNA, 18 bp, Homo sapiens
aaactctttttgggtcca

SEQ ID NO: 3016680 - DNA, 16 bp, Homo sapiens
aaactgaatgaaaccc

SEQ ID NO: 3016681 - DNA, 22 bp, Homo sapiens
aaactgagatccttccttttga

SEQ ID NO: 3016682 - DNA, 22 bp, Homo sapiens
aaactgagcctcacttgccctc

SEQ ID NO: 3016683 - DNA, 17 bp, Homo sapiens
aaactgcaaatgtgcag

SEQ ID NO: 3016684 - DNA, 23 bp, Homo sapiens
aaactgcataagtgaaaatctta

SEQ ID NO: 3016685 - DNA, 14 bp, Homo sapiens
aaactgcatctgga

SEQ ID NO: 3016686 - DNA, 15 bp, Homo sapiens
aaactgcgtcttgga

SEQ ID NO: 3016687 - DNA, 11 bp, Homo sapiens
aaactgctgtc

SEQ ID NO: 3016688 - DNA, 19 bp, Homo sapiens
aaactggaaatctggattt

SEQ ID NO: 3016689 - DNA, 14 bp, Homo sapiens
aaactggctttggc

SEQ ID NO: 3016690 - DNA, 23 bp, Homo sapiens
aaactgggatgaaactaaagcaa

SEQ ID NO: 3016691 - DNA, 17 bp, Homo sapiens
aaactggggcctccaga

SEQ ID NO: 3016692 - DNA, 20 bp, Homo sapiens
aaactggtatgaataattgc

SEQ ID NO: 3016693 - DNA, 16 bp, Homo sapiens
aaactgtagaaatgat

SEQ ID NO: 3016694 - DNA, 16 bp, Homo sapiens
aaactgtgaatgcttc

SEQ ID NO: 3016695 - DNA, 18 bp, Homo sapiens
aaactgtgaatgcttctg

SEQ ID NO: 3016696 - DNA, 20 bp, Homo sapiens
aaactgtgaatgcttctgat

SEQ ID NO: 3016697 - DNA, 21 bp, Homo sapiens
aaactgtgaatgcttctgatt

SEQ ID NO: 3016698 - DNA, 21 bp, Homo sapiens
aaacttacctataaattaaga

SEQ ID NO: 3016699 - DNA, 15 bp, Homo sapiens
aaacttagaggaaaa

SEQ ID NO: 3016700 - DNA, 16 bp, Homo sapiens
aaacttagaggaaaat

SEQ ID NO: 3016701 - DNA, 16 bp, Homo sapiens
aaacttatgaatgttt

SEQ ID NO: 3016702 - DNA, 17 bp, Homo sapiens
aaacttatgaatgtttc

SEQ ID NO: 3016703 - DNA, 18 bp, Homo sapiens
aaacttattttatatttt

SEQ ID NO: 3016704 - DNA, 22 bp, Homo sapiens
aaacttattttatattttccct

SEQ ID NO: 3016705 - DNA, 17 bp, Homo sapiens
aaacttgataaatggaa

SEQ ID NO: 3016706 - DNA, 20 bp, Homo sapiens
aaacttgtaatttttttaat

SEQ ID NO: 3016707 - DNA, 18 bp, Homo sapiens
aaactttactaagatgac

SEQ ID NO: 3016708 - DNA, 15 bp, Homo sapiens
aaactttgattcttt

SEQ ID NO: 3016709 - DNA, 21 bp, Homo sapiens
aaactttttgaccagtttctt

SEQ ID NO: 3016710 - DNA, 16 bp, Homo sapiens
aaagaaaacattccag

SEQ ID NO: 3016711 - DNA, 18 bp, Homo sapiens
aaagaaaatgtaaaaaac

SEQ ID NO: 3016712 - DNA, 18 bp, Homo sapiens
aaagaaaattcttggaat

SEQ ID NO: 3016713 - DNA, 13 bp, Homo sapiens
aaagaaagaaaca

SEQ ID NO: 3016714 - DNA, 11 bp, Homo sapiens
aaagaaagaac

SEQ ID NO: 3016715 - DNA, 14 bp, Homo sapiens
aaagaaagagagaa

SEQ ID NO: 3016716 - DNA, 15 bp, Homo sapiens
aaagaaagagagaaa

SEQ ID NO: 3016717 - DNA, 18 bp, Homo sapiens
aaagaaagagagaaaata

SEQ ID NO: 3016718 - DNA, 12 bp, Homo sapiens
aaagaaagtggt

SEQ ID NO: 3016719 - DNA, 12 bp, Homo sapiens
aaagaaatatga

SEQ ID NO: 3016720 - DNA, 14 bp, Homo sapiens
aaagaaatcaattt

SEQ ID NO: 3016721 - DNA, 23 bp, Homo sapiens
aaagaaatccccccttcagaaca

SEQ ID NO: 3016722 - DNA, 16 bp, Homo sapiens
aaagaaattatcttta

SEQ ID NO: 3016723 - DNA, 21 bp, Homo sapiens
aaagaaattatctttagttga

SEQ ID NO: 3016724 - DNA, 11 bp, Homo sapiens
aaagaaattcg

SEQ ID NO: 3016725 - DNA, 19 bp, Homo sapiens
aaagaaattcgcatgttta

SEQ ID NO: 3016726 - DNA, 20 bp, Homo sapiens
aaagaacatgcagtttgaaa

SEQ ID NO: 3016727 - DNA, 21 bp, Homo sapiens
aaagaacatgcagtttgaaat

SEQ ID NO: 3016728 - DNA, 21 bp, Homo sapiens
aaagaaccatgcaggaaggaa

SEQ ID NO: 3016729 - DNA, 21 bp, Homo sapiens
aaagaactgtccgtccccctt

SEQ ID NO: 3016730 - DNA, 16 bp, Homo sapiens
aaagaagaacagctgt

SEQ ID NO: 3016731 - DNA, 15 bp, Homo sapiens
aaagaagacacagaa

SEQ ID NO: 3016732 - DNA, 14 bp, Homo sapiens
aaagaagacatgtt

SEQ ID NO: 3016733 - DNA, 18 bp, Homo sapiens
aaagaagacatgttttag

SEQ ID NO: 3016734 - DNA, 13 bp, Homo sapiens
aaagaagccacag

SEQ ID NO: 3016735 - DNA, 22 bp, Homo sapiens
aaagaaggtttgtgtttttctg

SEQ ID NO: 3016736 - DNA, 23 bp, Homo sapiens
aaagaagtttgggctaacattta

SEQ ID NO: 3016737 - DNA, 15 bp, Homo sapiens
aaagaatacttgaac

SEQ ID NO: 3016738 - DNA, 18 bp, Homo sapiens
aaagaatatttaaataaa

SEQ ID NO: 3016739 - DNA, 21 bp, Homo sapiens
aaagaatatttaaataaacgt

SEQ ID NO: 3016740 - DNA, 19 bp, Homo sapiens
aaagaatctactatacttt

SEQ ID NO: 3016741 - DNA, 16 bp, Homo sapiens
aaagaatgaaagagta

SEQ ID NO: 3016742 - DNA, 12 bp, Homo sapiens
aaagaatgggca

SEQ ID NO: 3016743 - DNA, 23 bp, Homo sapiens
aaagaatgggcagttacatgcat

SEQ ID NO: 3016744 - DNA, 16 bp, Homo sapiens
aaagaatttaaattct

SEQ ID NO: 3016745 - DNA, 19 bp, Homo sapiens
aaagaatttaagctgtaaa

SEQ ID NO: 3016746 - DNA, 16 bp, Homo sapiens
aaatgcacaatttttt

SEQ ID NO: 3016747 - DNA, 23 bp, Homo sapiens
aaatgcacctaaaatctaattag

SEQ ID NO: 3016748 - DNA, 22 bp, Homo sapiens
aaatgcagcccatttctccaga

SEQ ID NO: 3016749 - DNA, 22 bp, Homo sapiens
aaatgcagggattgctgccact

SEQ ID NO: 3016750 - DNA, 18 bp, Homo sapiens
aaatgcattcatgtttta

SEQ ID NO: 3016751 - DNA, 17 bp, Homo sapiens
aaatgcattctatcgtt

SEQ ID NO: 3016752 - DNA, 19 bp, Homo sapiens
aaatgcattctatcgttat

SEQ ID NO: 3016753 - DNA, 12 bp, Homo sapiens
aaatgcattgta

SEQ ID NO: 3016754 - DNA, 13 bp, Homo sapiens
aaatgcattgtat

SEQ ID NO: 3016755 - DNA, 14 bp, Homo sapiens
aaatgcatttctaa

SEQ ID NO: 3016756 - DNA, 22 bp, Homo sapiens
aaatgccatgatgcctctgtct

SEQ ID NO: 3016757 - DNA, 22 bp, Homo sapiens
aaatgccatttatttattgatt

SEQ ID NO: 3016758 - DNA, 14 bp, Homo sapiens
aaatgcccaaggat

SEQ ID NO: 3016759 - DNA, 11 bp, Homo sapiens
aaatgcccagt

SEQ ID NO: 3016760 - DNA, 18 bp, Homo sapiens
aaatgctaatattaaaag

SEQ ID NO: 3016761 - DNA, 20 bp, Homo sapiens
aaatgctcccacctgaattt

SEQ ID NO: 3016762 - DNA, 13 bp, Homo sapiens
aaatgctctgatt

SEQ ID NO: 3016763 - DNA, 14 bp, Homo sapiens
aaatgctctgatta

SEQ ID NO: 3016764 - DNA, 11 bp, Homo sapiens
aaatgcttctt

SEQ ID NO: 3016765 - DNA, 18 bp, Homo sapiens
aaatgctttatgcaaacc

SEQ ID NO: 3016766 - DNA, 13 bp, Homo sapiens
aaatgctttgctt

SEQ ID NO: 3016767 - DNA, 18 bp, Homo sapiens
aaatgctttttatttctg

SEQ ID NO: 3016768 - DNA, 16 bp, Homo sapiens
aaatggaaaagagaga

SEQ ID NO: 3016769 - DNA, 16 bp, Homo sapiens
aaatggaattactcca

SEQ ID NO: 3016770 - DNA, 18 bp, Homo sapiens
aaatggacaaagaaaacg

SEQ ID NO: 3016771 - DNA, 19 bp, Homo sapiens
aaatggacataggactcaa

SEQ ID NO: 3016772 - DNA, 17 bp, Homo sapiens
aaatggagctttctgta

SEQ ID NO: 3016773 - DNA, 17 bp, Homo sapiens
aaatggatgccttgaat

SEQ ID NO: 3016774 - DNA, 23 bp, Homo sapiens
aaatggctgcatcccccccacct

SEQ ID NO: 3016775 - DNA, 21 bp, Homo sapiens
aaatggctgtaatcatttgtt

SEQ ID NO: 3016776 - DNA, 15 bp, Homo sapiens
aaatgggacttcttt

SEQ ID NO: 3016777 - DNA, 16 bp, Homo sapiens
aaatgggacttctttt

SEQ ID NO: 3016778 - DNA, 17 bp, Homo sapiens
aaatgggagacagcctc

SEQ ID NO: 3016779 - DNA, 16 bp, Homo sapiens
aaatggggccagatcc

SEQ ID NO: 3016780 - DNA, 22 bp, Homo sapiens
aaatggtcctatttttgtgaag

SEQ ID NO: 3016781 - DNA, 22 bp, Homo sapiens
aaatggtggcttcagctccagc

SEQ ID NO: 3016782 - DNA, 16 bp, Homo sapiens
aaatggtttcctctgg

SEQ ID NO: 3016783 - DNA, 13 bp, Homo sapiens
aaatgtaaaaaac

SEQ ID NO: 3016784 - DNA, 15 bp, Homo sapiens
aaatgtaaaaaacaa

SEQ ID NO: 3016785 - DNA, 16 bp, Homo sapiens
aaatgtaacagtctga

SEQ ID NO: 3016786 - DNA, 21 bp, Homo sapiens
aaatgtaagattatagattct

SEQ ID NO: 3016787 - DNA, 17 bp, Homo sapiens
aaatgtacagacatatt

SEQ ID NO: 3016788 - DNA, 14 bp, Homo sapiens
aaatgtactggtaa

SEQ ID NO: 3016789 - DNA, 17 bp, Homo sapiens
aaatgtactggtaattg

SEQ ID NO: 3016790 - DNA, 21 bp, Homo sapiens
aaatgtactggtaattgtaca

SEQ ID NO: 3016791 - DNA, 14 bp, Homo sapiens
aaatgtacttatat

SEQ ID NO: 3016792 - DNA, 16 bp, Homo sapiens
aaatgtacttatatta

SEQ ID NO: 3016793 - DNA, 14 bp, Homo sapiens
aaatgtatatgcac

SEQ ID NO: 3016794 - DNA, 14 bp, Homo sapiens
aaatgtattttgaa

SEQ ID NO: 3016795 - DNA, 16 bp, Homo sapiens
aaatgtctattattat

SEQ ID NO: 3016796 - DNA, 23 bp, Homo sapiens
aaatgtcttgtgtatttctctgt

SEQ ID NO: 3016797 - DNA, 22 bp, Homo sapiens
aaatgtcttttttttaatgtgc

SEQ ID NO: 3016798 - DNA, 11 bp, Homo sapiens
aaatgtgaaat

SEQ ID NO: 3016799 - DNA, 18 bp, Homo sapiens
aaatgtgaaatttttcca

SEQ ID NO: 3016800 - DNA, 22 bp, Homo sapiens
aaatgtgaaatttttccacact

SEQ ID NO: 3016801 - DNA, 15 bp, Homo sapiens
aaatgtgaagatgca

SEQ ID NO: 3016802 - DNA, 17 bp, Homo sapiens
aaatgtgaagatgcatt

SEQ ID NO: 3016803 - DNA, 10 bp, Homo sapiens
aaatgtgaat

SEQ ID NO: 3016804 - DNA, 13 bp, Homo sapiens
aaatgtgaatttt

SEQ ID NO: 3016805 - DNA, 15 bp, Homo sapiens
aaatgtgatgttcta

SEQ ID NO: 3016806 - DNA, 18 bp, Homo sapiens
aaatgtgatgttctaagg

SEQ ID NO: 3016807 - DNA, 11 bp, Homo sapiens
aaatgtgcagt

SEQ ID NO: 3016808 - DNA, 17 bp, Homo sapiens
aaatgtggtcctattta

SEQ ID NO: 3016809 - DNA, 21 bp, Homo sapiens
aaatgtgttggacaaatgtga

SEQ ID NO: 3016810 - DNA, 12 bp, Homo sapiens
aaatgttagttc

SEQ ID NO: 3016811 - DNA, 13 bp, Homo sapiens
aaatgttcacttt

SEQ ID NO: 3016812 - DNA, 17 bp, Homo sapiens
aaatgttcccttgacca

SEQ ID NO: 3016813 - DNA, 13 bp, Homo sapiens
aaatgttctaagt

SEQ ID NO: 3016814 - DNA, 13 bp, Homo sapiens
aaatgtttactgt

SEQ ID NO: 3016815 - DNA, 16 bp, Homo sapiens
aaatgtttactgtaaa

SEQ ID NO: 3016816 - DNA, 16 bp, Homo sapiens
aaatgtttcccccact

SEQ ID NO: 3016817 - DNA, 14 bp, Homo sapiens
aaatgtttctgtgt

SEQ ID NO: 3016818 - DNA, 12 bp, Homo sapiens
aaatgtttggat

SEQ ID NO: 3016819 - DNA, 16 bp, Homo sapiens
aaattaaaaatttttt

SEQ ID NO: 3016820 - DNA, 16 bp, Homo sapiens
aaattaaagtgctgtt

SEQ ID NO: 3016821 - DNA, 13 bp, Homo sapiens
aaattaagaagag

SEQ ID NO: 3016822 - DNA, 17 bp, Homo sapiens
aaattaagatgttcaga

SEQ ID NO: 3016823 - DNA, 14 bp, Homo sapiens
aaattaagtagaac

SEQ ID NO: 3016824 - DNA, 20 bp, Homo sapiens
aaattaatagcttttgatta

SEQ ID NO: 3016825 - DNA, 14 bp, Homo sapiens
aaattaatatttgt

SEQ ID NO: 3016826 - DNA, 14 bp, Homo sapiens
aaattaatgattct

SEQ ID NO: 3016827 - DNA, 16 bp, Homo sapiens
aaattaattgaatcta

SEQ ID NO: 3016828 - DNA, 17 bp, Homo sapiens
aaattaatttgttaatt

SEQ ID NO: 3016829 - DNA, 13 bp, Homo sapiens
aaattacaatttt

SEQ ID NO: 3016830 - DNA, 14 bp, Homo sapiens
aaattacaatttta

SEQ ID NO: 3016831 - DNA, 15 bp, Homo sapiens
aaattacaattttat

SEQ ID NO: 3016832 - DNA, 17 bp, Homo sapiens
aaattactttgtgaata

SEQ ID NO: 3016833 - DNA, 14 bp, Homo sapiens
aaattacttttctg

SEQ ID NO: 3016834 - DNA, 16 bp, Homo sapiens
aaattagatgcatgtt

SEQ ID NO: 3016835 - DNA, 16 bp, Homo sapiens
aaattaggaataaata

SEQ ID NO: 3016836 - DNA, 18 bp, Homo sapiens
aaattaggaataaataaa

SEQ ID NO: 3016837 - DNA, 23 bp, Homo sapiens
aaattagggttggttcctttcca

SEQ ID NO: 3016838 - DNA, 22 bp, Homo sapiens
aaattagtgtacctattaaaag

SEQ ID NO: 3016839 - DNA, 20 bp, Homo sapiens
aaattatagatgggaatgaa

SEQ ID NO: 3016840 - DNA, 13 bp, Homo sapiens
aaattatctttag

SEQ ID NO: 3016841 - DNA, 18 bp, Homo sapiens
aaattattaatttatgca

SEQ ID NO: 3016842 - DNA, 22 bp, Homo sapiens
aaattcaaccccagaaattgac

SEQ ID NO: 3016843 - DNA, 14 bp, Homo sapiens
aaattcacaaactt

SEQ ID NO: 3016844 - DNA, 15 bp, Homo sapiens
aaattcacaaacttt

SEQ ID NO: 3016845 - DNA, 17 bp, Homo sapiens
aaattcacaaactttta

SEQ ID NO: 3016846 - DNA, 18 bp, Homo sapiens
aaattcacaaacttttat

SEQ ID NO: 3016847 - DNA, 21 bp, Homo sapiens
aaattcactgtttcactgaaa

SEQ ID NO: 3016848 - DNA, 12 bp, Homo sapiens
aaattccaaagt

SEQ ID NO: 3016849 - DNA, 14 bp, Homo sapiens
aaattccaaagtct

SEQ ID NO: 3016850 - DNA, 17 bp, Homo sapiens
aaattccaaagtctcta

SEQ ID NO: 3016851 - DNA, 18 bp, Homo sapiens
aaattccaaagtctctaa

SEQ ID NO: 3016852 - DNA, 21 bp, Homo sapiens
aaattccaaagtctctaattc

SEQ ID NO: 3016853 - DNA, 22 bp, Homo sapiens
aaattccaaagtctctaattct

SEQ ID NO: 3016854 - DNA, 20 bp, Homo sapiens
aaattccagttgcaattcat

SEQ ID NO: 3016855 - DNA, 19 bp, Homo sapiens
aaattccatcacatcacat

SEQ ID NO: 3016856 - DNA, 19 bp, Homo sapiens
aaattccccatatttgtgt

SEQ ID NO: 3016857 - DNA, 14 bp, Homo sapiens
aaattcctctttgc

SEQ ID NO: 3016858 - DNA, 19 bp, Homo sapiens
aaattcctctttgctttgc

SEQ ID NO: 3016859 - DNA, 14 bp, Homo sapiens
aaattcgcatgttt

SEQ ID NO: 3016860 - DNA, 15 bp, Homo sapiens
aaattcgcatgttta

SEQ ID NO: 3016861 - DNA, 19 bp, Homo sapiens
aaattctactaagttattt

SEQ ID NO: 3016862 - DNA, 22 bp, Homo sapiens
aaattctataggaacatatgaa

SEQ ID NO: 3016863 - DNA, 13 bp, Homo sapiens
aaattctctccta

SEQ ID NO: 3016864 - DNA, 14 bp, Homo sapiens
aaattctcttcttt

SEQ ID NO: 3016865 - DNA, 15 bp, Homo sapiens
aaattctcttctttt

SEQ ID NO: 3016866 - DNA, 21 bp, Homo sapiens
aaattctgaatttgcaaagta

SEQ ID NO: 3016867 - DNA, 15 bp, Homo sapiens
aaattctgctcagat

SEQ ID NO: 3016868 - DNA, 13 bp, Homo sapiens
aaattctgctgtt

SEQ ID NO: 3016869 - DNA, 15 bp, Homo sapiens
aaattctgtttcttg

SEQ ID NO: 3016870 - DNA, 21 bp, Homo sapiens
aaattcttctaattgctgtgt

SEQ ID NO: 3016871 - DNA, 15 bp, Homo sapiens
aaattctttttcaaa

SEQ ID NO: 3016872 - DNA, 13 bp, Homo sapiens
aaattgaataatg

SEQ ID NO: 3016873 - DNA, 15 bp, Homo sapiens
aaattgacttagata

SEQ ID NO: 3016874 - DNA, 21 bp, Homo sapiens
aaattgacttagatattaaaa

SEQ ID NO: 3016875 - DNA, 19 bp, Homo sapiens
aaattgatcattcataatt

SEQ ID NO: 3016876 - DNA, 12 bp, Homo sapiens
aaattgcacaat

SEQ ID NO: 3016877 - DNA, 14 bp, Homo sapiens
aaattgcactgaag

SEQ ID NO: 3016878 - DNA, 21 bp, Homo sapiens
aaattgcattcattgacttca

SEQ ID NO: 3016879 - DNA, 19 bp, Homo sapiens
aaattgggactagtttata

SEQ ID NO: 3016880 - DNA, 19 bp, Homo sapiens
aactatcttctttggactt

SEQ ID NO: 3016881 - DNA, 22 bp, Homo sapiens
aactatgcatggtgccccagga

SEQ ID NO: 3016882 - DNA, 22 bp, Homo sapiens
aactattaagaggcagaaaatt

SEQ ID NO: 3016883 - DNA, 24 bp, Homo sapiens
aactattaaggatgtagcttttca

SEQ ID NO: 3016884 - DNA, 12 bp, Homo sapiens
aactattcagtt

SEQ ID NO: 3016885 - DNA, 16 bp, Homo sapiens
aactattcagttgtgt

SEQ ID NO: 3016886 - DNA, 17 bp, Homo sapiens
aactattcagttgtgtt

SEQ ID NO: 3016887 - DNA, 16 bp, Homo sapiens
aactattccatgtttt

SEQ ID NO: 3016888 - DNA, 18 bp, Homo sapiens
aactattccatgttttaa

SEQ ID NO: 3016889 - DNA, 15 bp, Homo sapiens
aactattgtgttttt

SEQ ID NO: 3016890 - DNA, 20 bp, Homo sapiens
aactatttatctgtgttttt

SEQ ID NO: 3016891 - DNA, 14 bp, Homo sapiens
aactatttcttcag

SEQ ID NO: 3016892 - DNA, 12 bp, Homo sapiens
aactattttcag

SEQ ID NO: 3016893 - DNA, 23 bp, Homo sapiens
aactcaaagaatgtgtatggtat

SEQ ID NO: 3016894 - DNA, 14 bp, Homo sapiens
aactcagaatgggg

SEQ ID NO: 3016895 - DNA, 14 bp, Homo sapiens
aactcagatccagg

SEQ ID NO: 3016896 - DNA, 15 bp, Homo sapiens
aactcagatccaggg

SEQ ID NO: 3016897 - DNA, 22 bp, Homo sapiens
aactcagatccagggacagagg

SEQ ID NO: 3016898 - DNA, 21 bp, Homo sapiens
aactcaggttcacagcagctt

SEQ ID NO: 3016899 - DNA, 22 bp, Homo sapiens
aactcatctttagagcaacagt

SEQ ID NO: 3016900 - DNA, 23 bp, Homo sapiens
aactcattagactggaacttgaa

SEQ ID NO: 3016901 - DNA, 18 bp, Homo sapiens
aactcattttcatattgt

SEQ ID NO: 3016902 - DNA, 15 bp, Homo sapiens
aactccaacctctcg

SEQ ID NO: 3016903 - DNA, 15 bp, Homo sapiens
aactccaccaaccca

SEQ ID NO: 3016904 - DNA, 21 bp, Homo sapiens
aactccagctggtgcccccag

SEQ ID NO: 3016905 - DNA, 13 bp, Homo sapiens
aactccaggctgg

SEQ ID NO: 3016906 - DNA, 17 bp, Homo sapiens
aactccagggtcccctg

SEQ ID NO: 3016907 - DNA, 19 bp, Homo sapiens
aactccagggtcccctgcc

SEQ ID NO: 3016908 - DNA, 18 bp, Homo sapiens
aactccatctgacaaatt

SEQ ID NO: 3016909 - DNA, 23 bp, Homo sapiens
aactccccttcctcactgcccaa

SEQ ID NO: 3016910 - DNA, 11 bp, Homo sapiens
aactccctcct

SEQ ID NO: 3016911 - DNA, 15 bp, Homo sapiens
aactcccttctgctt

SEQ ID NO: 3016912 - DNA, 17 bp, Homo sapiens
aactcccttctgcttgt

SEQ ID NO: 3016913 - DNA, 15 bp, Homo sapiens
aactcccttgtgttc

SEQ ID NO: 3016914 - DNA, 16 bp, Homo sapiens
aactcccttgtgttcc

SEQ ID NO: 3016915 - DNA, 23 bp, Homo sapiens
aactcctcgacatcactgttcat

SEQ ID NO: 3016916 - DNA, 20 bp, Homo sapiens
aactccttccatccttgact

SEQ ID NO: 3016917 - DNA, 22 bp, Homo sapiens
aactcgaggactgtatttgtga

SEQ ID NO: 3016918 - DNA, 15 bp, Homo sapiens
aactcgcacctgtgc

SEQ ID NO: 3016919 - DNA, 14 bp, Homo sapiens
aactcgcctcagcc

SEQ ID NO: 3016920 - DNA, 21 bp, Homo sapiens
aactcgtatagcatgcatctg

SEQ ID NO: 3016921 - DNA, 19 bp, Homo sapiens
aactcgtgtctggcacagc

SEQ ID NO: 3016922 - DNA, 21 bp, Homo sapiens
aactctaaccaaggctgtgtt

SEQ ID NO: 3016923 - DNA, 14 bp, Homo sapiens
aactctacatttaa

SEQ ID NO: 3016924 - DNA, 13 bp, Homo sapiens
aactctaccctga

SEQ ID NO: 3016925 - DNA, 12 bp, Homo sapiens
aactctagctgg

SEQ ID NO: 3016926 - DNA, 19 bp, Homo sapiens
aactctagctgggggtggg

SEQ ID NO: 3016927 - DNA, 17 bp, Homo sapiens
aactctcccctccccat

SEQ ID NO: 3016928 - DNA, 18 bp, Homo sapiens
aactctcttcttccatta

SEQ ID NO: 3016929 - DNA, 23 bp, Homo sapiens
aactctgcaactgaatacttgaa

SEQ ID NO: 3016930 - DNA, 12 bp, Homo sapiens
aactctgggctc

SEQ ID NO: 3016931 - DNA, 23 bp, Homo sapiens
aactcttcactcttcaaatgcct

SEQ ID NO: 3016932 - DNA, 23 bp, Homo sapiens
aactcttcagttaattcttagat

SEQ ID NO: 3016933 - DNA, 16 bp, Homo sapiens
aactcttctgaggatc

SEQ ID NO: 3016934 - DNA, 16 bp, Homo sapiens
aactcttctttgctgc

SEQ ID NO: 3016935 - DNA, 11 bp, Homo sapiens
aactcttgatt

SEQ ID NO: 3016936 - DNA, 13 bp, Homo sapiens
aactgaaaagaga

SEQ ID NO: 3016937 - DNA, 15 bp, Homo sapiens
aactgaaaagagagc

SEQ ID NO: 3016938 - DNA, 22 bp, Homo sapiens
aactgaaaagagagcagagaat

SEQ ID NO: 3016939 - DNA, 19 bp, Homo sapiens
aactgaaagctttaatgtt

SEQ ID NO: 3016940 - DNA, 13 bp, Homo sapiens
aactgaaagtgaa

SEQ ID NO: 3016941 - DNA, 14 bp, Homo sapiens
aactgaaataaaaa

SEQ ID NO: 3016942 - DNA, 17 bp, Homo sapiens
aactgaaattaaaacta

SEQ ID NO: 3016943 - DNA, 16 bp, Homo sapiens
aactgaaattacatat

SEQ ID NO: 3016944 - DNA, 18 bp, Homo sapiens
aactgaaccaaattgcac

SEQ ID NO: 3016945 - DNA, 17 bp, Homo sapiens
aactgaagatgttgaga

SEQ ID NO: 3016946 - DNA, 14 bp, Homo sapiens
aactgaagctgctg

SEQ ID NO: 3016947 - DNA, 18 bp, Homo sapiens
aactgaatgaaaccccca

SEQ ID NO: 3016948 - DNA, 12 bp, Homo sapiens
aactgaatgaga

SEQ ID NO: 3016949 - DNA, 21 bp, Homo sapiens
aactgacaggcagcctggaca

SEQ ID NO: 3016950 - DNA, 15 bp, Homo sapiens
aactgactaaccatt

SEQ ID NO: 3016951 - DNA, 20 bp, Homo sapiens
aactgactcccattttggtg

SEQ ID NO: 3016952 - DNA, 18 bp, Homo sapiens
aactgagatccttccttt

SEQ ID NO: 3016953 - DNA, 18 bp, Homo sapiens
aactgagctcgcagcccc

SEQ ID NO: 3016954 - DNA, 17 bp, Homo sapiens
aactgagcttggaagct

SEQ ID NO: 3016955 - DNA, 21 bp, Homo sapiens
aactgaggccttgtgtgtcag

SEQ ID NO: 3016956 - DNA, 23 bp, Homo sapiens
aactgaggccttgtgtgtcaggc

SEQ ID NO: 3016957 - DNA, 16 bp, Homo sapiens
aactgatagttactgt

SEQ ID NO: 3016958 - DNA, 23 bp, Homo sapiens
aactgatagttactgttgtgacc

SEQ ID NO: 3016959 - DNA, 19 bp, Homo sapiens
aactgattttacaaattaa

SEQ ID NO: 3016960 - DNA, 19 bp, Homo sapiens
aactgcacatgaagaaata

SEQ ID NO: 3016961 - DNA, 22 bp, Homo sapiens
aactgcagcaatctttgaaaga

SEQ ID NO: 3016962 - DNA, 23 bp, Homo sapiens
aactgcagggaaaattatttgca

SEQ ID NO: 3016963 - DNA, 17 bp, Homo sapiens
aactgcctaaggccctt

SEQ ID NO: 3016964 - DNA, 17 bp, Homo sapiens
aactgcctccttgccag

SEQ ID NO: 3016965 - DNA, 17 bp, Homo sapiens
aactgctacttgctctg

SEQ ID NO: 3016966 - DNA, 19 bp, Homo sapiens
aactgctgatcaatgaaat

SEQ ID NO: 3016967 - DNA, 16 bp, Homo sapiens
aactggaaatctggat

SEQ ID NO: 3016968 - DNA, 17 bp, Homo sapiens
aactggacctgtatatt

SEQ ID NO: 3016969 - DNA, 14 bp, Homo sapiens
aactggcaggcagg

SEQ ID NO: 3016970 - DNA, 11 bp, Homo sapiens
aactggctggc

SEQ ID NO: 3016971 - DNA, 16 bp, Homo sapiens
aactggcttgtacatt

SEQ ID NO: 3016972 - DNA, 17 bp, Homo sapiens
aactggcttgtacattt

SEQ ID NO: 3016973 - DNA, 22 bp, Homo sapiens
aactggcttgtacatttttaaa

SEQ ID NO: 3016974 - DNA, 16 bp, Homo sapiens
aactgggggaaaagat

SEQ ID NO: 3016975 - DNA, 18 bp, Homo sapiens
aactggtgcactttgtaa

SEQ ID NO: 3016976 - DNA, 21 bp, Homo sapiens
aactggtgcactttgtaaatt

SEQ ID NO: 3016977 - DNA, 22 bp, Homo sapiens
aactggttcaagagacactgct

SEQ ID NO: 3016978 - DNA, 12 bp, Homo sapiens
aactgtaaatca

SEQ ID NO: 3016979 - DNA, 14 bp, Homo sapiens
aactgtagaaatga

SEQ ID NO: 3016980 - DNA, 19 bp, Homo sapiens
aactgtagaaatgatgatg

SEQ ID NO: 3016981 - DNA, 11 bp, Homo sapiens
aactgtatctt

SEQ ID NO: 3016982 - DNA, 14 bp, Homo sapiens
aactgtcccagcta

SEQ ID NO: 3016983 - DNA, 14 bp, Homo sapiens
aactgtgctcccac

SEQ ID NO: 3016984 - DNA, 20 bp, Homo sapiens
aactgtggccgttatctgga

SEQ ID NO: 3016985 - DNA, 18 bp, Homo sapiens
aactgtggtagctccagc

SEQ ID NO: 3016986 - DNA, 21 bp, Homo sapiens
aactgtgtgtaattgttcctt

SEQ ID NO: 3016987 - DNA, 22 bp, Homo sapiens
aactgtgtgtaattgttccttt

SEQ ID NO: 3016988 - DNA, 17 bp, Homo sapiens
aactgttgcacttttga

SEQ ID NO: 3016989 - DNA, 18 bp, Homo sapiens
aactgttgcacttttgaa

SEQ ID NO: 3016990 - DNA, 13 bp, Homo sapiens
aactgttgctcga

SEQ ID NO: 3016991 - DNA, 14 bp, Homo sapiens
aacttaaataataa

SEQ ID NO: 3016992 - DNA, 19 bp, Homo sapiens
aacttaaattttagttctt

SEQ ID NO: 3016993 - DNA, 14 bp, Homo sapiens
aacttatgaatgtt

SEQ ID NO: 3016994 - DNA, 15 bp, Homo sapiens
aacttatggccacag

SEQ ID NO: 3016995 - DNA, 13 bp, Homo sapiens
aacttattctgta

SEQ ID NO: 3016996 - DNA, 18 bp, Homo sapiens
aacttatttaaaaatatt

SEQ ID NO: 3016997 - DNA, 19 bp, Homo sapiens
aacttatttatatgaagca

SEQ ID NO: 3016998 - DNA, 17 bp, Homo sapiens
aacttcaaaagcttttt

SEQ ID NO: 3016999 - DNA, 20 bp, Homo sapiens
aacttcaagggacaagtatt

SEQ ID NO: 3017000 - DNA, 22 bp, Homo sapiens
aacttcaagtgcatgctctctg

SEQ ID NO: 3017001 - DNA, 15 bp, Homo sapiens
aacttccattctttc

SEQ ID NO: 3017002 - DNA, 17 bp, Homo sapiens
aacttccattctttctt

SEQ ID NO: 3017003 - DNA, 16 bp, Homo sapiens
aacttcccaacttccc

SEQ ID NO: 3017004 - DNA, 15 bp, Homo sapiens
aacttccctgttctt

SEQ ID NO: 3017005 - DNA, 15 bp, Homo sapiens
aacttcgtatttttt

SEQ ID NO: 3017006 - DNA, 16 bp, Homo sapiens
aacttctatattttaa

SEQ ID NO: 3017007 - DNA, 16 bp, Homo sapiens
aacttcttatggaatt

SEQ ID NO: 3017008 - DNA, 17 bp, Homo sapiens
aacttcttatggaattg

SEQ ID NO: 3017009 - DNA, 15 bp, Homo sapiens
aacttgaaaatagta

SEQ ID NO: 3017010 - DNA, 12 bp, Homo sapiens
aacttgaagaaa

SEQ ID NO: 3017011 - DNA, 13 bp, Homo sapiens
aacttgaagaaac

SEQ ID NO: 3017012 - DNA, 19 bp, Homo sapiens
aacttgaccctgagctgac

SEQ ID NO: 3017013 - DNA, 17 bp, Homo sapiens
aagccagaagctgagca

SEQ ID NO: 3017014 - DNA, 14 bp, Homo sapiens
aagccagcgtcctc

SEQ ID NO: 3017015 - DNA, 22 bp, Homo sapiens
aagccaggaatttcccaggacc

SEQ ID NO: 3017016 - DNA, 23 bp, Homo sapiens
aagccaggaatttcccaggaccc

SEQ ID NO: 3017017 - DNA, 18 bp, Homo sapiens
aagccatctcaggttggc

SEQ ID NO: 3017018 - DNA, 16 bp, Homo sapiens
aagccatcttggtaaa

SEQ ID NO: 3017019 - DNA, 13 bp, Homo sapiens
aagccatgctgga

SEQ ID NO: 3017020 - DNA, 15 bp, Homo sapiens
aagccatgctggaaa

SEQ ID NO: 3017021 - DNA, 21 bp, Homo sapiens
aagccatgctggaaaataata

SEQ ID NO: 3017022 - DNA, 22 bp, Homo sapiens
aagccatggagtgagacccagg

SEQ ID NO: 3017023 - DNA, 14 bp, Homo sapiens
aagcccaaatggct

SEQ ID NO: 3017024 - DNA, 20 bp, Homo sapiens
aagcccaaatggctctgtga

SEQ ID NO: 3017025 - DNA, 22 bp, Homo sapiens
aagcccacctcggccctccctg

SEQ ID NO: 3017026 - DNA, 11 bp, Homo sapiens
aagcccacctg

SEQ ID NO: 3017027 - DNA, 12 bp, Homo sapiens
aagcccacctga

SEQ ID NO: 3017028 - DNA, 21 bp, Homo sapiens
aagcccacctgaaagcctgtc

SEQ ID NO: 3017029 - DNA, 14 bp, Homo sapiens
aagcccactgcctc

SEQ ID NO: 3017030 - DNA, 23 bp, Homo sapiens
aagcccagcactgcttgaggaaa

SEQ ID NO: 3017031 - DNA, 11 bp, Homo sapiens
aagcccagctc

SEQ ID NO: 3017032 - DNA, 16 bp, Homo sapiens
aagcccccagctaaga

SEQ ID NO: 3017033 - DNA, 23 bp, Homo sapiens
aagcccccagctaagaacctgga

SEQ ID NO: 3017034 - DNA, 23 bp, Homo sapiens
aagcccccccttatagtttgggc

SEQ ID NO: 3017035 - DNA, 16 bp, Homo sapiens
aagccccctggcagct

SEQ ID NO: 3017036 - DNA, 20 bp, Homo sapiens
aagccctcccaggtgttaac

SEQ ID NO: 3017037 - DNA, 22 bp, Homo sapiens
aagccctgaatttcttcttttc

SEQ ID NO: 3017038 - DNA, 13 bp, Homo sapiens
aagccctgcctct

SEQ ID NO: 3017039 - DNA, 22 bp, Homo sapiens
aagccctgttgacacaggtctt

SEQ ID NO: 3017040 - DNA, 22 bp, Homo sapiens
aagccctgttgtgccacagagt

SEQ ID NO: 3017041 - DNA, 15 bp, Homo sapiens
aagccgaccttagat

SEQ ID NO: 3017042 - DNA, 21 bp, Homo sapiens
aagccggcctgagaaacacta

SEQ ID NO: 3017043 - DNA, 23 bp, Homo sapiens
aagcctaaaagtgggcttgattc

SEQ ID NO: 3017044 - DNA, 20 bp, Homo sapiens
aagcctaacttcatagaaac

SEQ ID NO: 3017045 - DNA, 22 bp, Homo sapiens
aagcctcaaagagagaaagttt

SEQ ID NO: 3017046 - DNA, 11 bp, Homo sapiens
aagcctcagct

SEQ ID NO: 3017047 - DNA, 15 bp, Homo sapiens
aagcctcgacacaga

SEQ ID NO: 3017048 - DNA, 16 bp, Homo sapiens
aagcctgaactgaggc

SEQ ID NO: 3017049 - DNA, 17 bp, Homo sapiens
aagcctgaactgaggcc

SEQ ID NO: 3017050 - DNA, 23 bp, Homo sapiens
aagcctgaactgaggccttgtgt

SEQ ID NO: 3017051 - DNA, 22 bp, Homo sapiens
aagcctgcctcgccttgtgtta

SEQ ID NO: 3017052 - DNA, 21 bp, Homo sapiens
aagcctggcttgggttgaaaa

SEQ ID NO: 3017053 - DNA, 17 bp, Homo sapiens
aagcctgtaatcccagc

SEQ ID NO: 3017054 - DNA, 15 bp, Homo sapiens
aagcctgtcccagga

SEQ ID NO: 3017055 - DNA, 13 bp, Homo sapiens
aagcctgtctctt

SEQ ID NO: 3017056 - DNA, 17 bp, Homo sapiens
aagcctgtctctttcca

SEQ ID NO: 3017057 - DNA, 11 bp, Homo sapiens
aagccttacag

SEQ ID NO: 3017058 - DNA, 13 bp, Homo sapiens
aagccttacagtt

SEQ ID NO: 3017059 - DNA, 19 bp, Homo sapiens
aagccttcttatatctgaa

SEQ ID NO: 3017060 - DNA, 17 bp, Homo sapiens
aagcctttactgaccct

SEQ ID NO: 3017061 - DNA, 13 bp, Homo sapiens
aagcgaacatctt

SEQ ID NO: 3017062 - DNA, 15 bp, Homo sapiens
aagcgaacatcttca

SEQ ID NO: 3017063 - DNA, 22 bp, Homo sapiens
aagcgacatcccagtagtgttt

SEQ ID NO: 3017064 - DNA, 17 bp, Homo sapiens
aagcgattctcctgcct

SEQ ID NO: 3017065 - DNA, 22 bp, Homo sapiens
aagcggccgatgggagtctccc

SEQ ID NO: 3017066 - DNA, 12 bp, Homo sapiens
aagcgtctttaa

SEQ ID NO: 3017067 - DNA, 18 bp, Homo sapiens
aagcgtctttaagagact

SEQ ID NO: 3017068 - DNA, 17 bp, Homo sapiens
aagctaagatgggtgga

SEQ ID NO: 3017069 - DNA, 22 bp, Homo sapiens
aagctaatttgcattaaattca

SEQ ID NO: 3017070 - DNA, 14 bp, Homo sapiens
aagctacaggttac

SEQ ID NO: 3017071 - DNA, 18 bp, Homo sapiens
aagctacaggttacaaca

SEQ ID NO: 3017072 - DNA, 19 bp, Homo sapiens
aagctacaggttacaacag

SEQ ID NO: 3017073 - DNA, 20 bp, Homo sapiens
aagctacaggttacaacaga

SEQ ID NO: 3017074 - DNA, 14 bp, Homo sapiens
aagctacagttgtc

SEQ ID NO: 3017075 - DNA, 18 bp, Homo sapiens
aagctacagttgtccaga

SEQ ID NO: 3017076 - DNA, 17 bp, Homo sapiens
aagctagagagaaaaag

SEQ ID NO: 3017077 - DNA, 14 bp, Homo sapiens
aagctagagatatg

SEQ ID NO: 3017078 - DNA, 20 bp, Homo sapiens
aagctatagacccgaggaaa

SEQ ID NO: 3017079 - DNA, 21 bp, Homo sapiens
aagctatggtgagatgcagct

SEQ ID NO: 3017080 - DNA, 17 bp, Homo sapiens
aagctatttatctgtag

SEQ ID NO: 3017081 - DNA, 17 bp, Homo sapiens
aagctatttatgggccc

SEQ ID NO: 3017082 - DNA, 22 bp, Homo sapiens
aagctcacagttcctcgccctg

SEQ ID NO: 3017083 - DNA, 23 bp, Homo sapiens
aagctcacctgttgcttacaatt

SEQ ID NO: 3017084 - DNA, 22 bp, Homo sapiens
aagctcccaagagcttccagag

SEQ ID NO: 3017085 - DNA, 18 bp, Homo sapiens
aagctcctcctccctgca

SEQ ID NO: 3017086 - DNA, 19 bp, Homo sapiens
aagctcctcctccctgcat

SEQ ID NO: 3017087 - DNA, 16 bp, Homo sapiens
aagctcctctccccag

SEQ ID NO: 3017088 - DNA, 22 bp, Homo sapiens
aagctcctctccccagcccaga

SEQ ID NO: 3017089 - DNA, 19 bp, Homo sapiens
aagctcgcatccagacagt

SEQ ID NO: 3017090 - DNA, 16 bp, Homo sapiens
aagctcttgtttctgt

SEQ ID NO: 3017091 - DNA, 23 bp, Homo sapiens
aagctgaatacattctgctttca

SEQ ID NO: 3017092 - DNA, 17 bp, Homo sapiens
aagctgacgaacttcca

SEQ ID NO: 3017093 - DNA, 20 bp, Homo sapiens
aagctgacgaacttccatgg

SEQ ID NO: 3017094 - DNA, 18 bp, Homo sapiens
aagctgagagtgctatga

SEQ ID NO: 3017095 - DNA, 15 bp, Homo sapiens
aagctgagctggctt

SEQ ID NO: 3017096 - DNA, 22 bp, Homo sapiens
aagctgcctctgacagcagcct

SEQ ID NO: 3017097 - DNA, 13 bp, Homo sapiens
aagctgctgcagc

SEQ ID NO: 3017098 - DNA, 11 bp, Homo sapiens
aagctgctgta

SEQ ID NO: 3017099 - DNA, 12 bp, Homo sapiens
aagctggctggg

SEQ ID NO: 3017100 - DNA, 20 bp, Homo sapiens
aagctggctggggtggcctg

SEQ ID NO: 3017101 - DNA, 16 bp, Homo sapiens
aagctggctttcatcc

SEQ ID NO: 3017102 - DNA, 17 bp, Homo sapiens
aagctggtggccttggc

SEQ ID NO: 3017103 - DNA, 22 bp, Homo sapiens
aagctgtgagacagtgggaaat

SEQ ID NO: 3017104 - DNA, 14 bp, Homo sapiens
aagctgtgtctctg

SEQ ID NO: 3017105 - DNA, 16 bp, Homo sapiens
aagctgtgtctctgta

SEQ ID NO: 3017106 - DNA, 21 bp, Homo sapiens
aagctgtgtgctctccaagcc

SEQ ID NO: 3017107 - DNA, 18 bp, Homo sapiens
aagctgtgttacttgaag

SEQ ID NO: 3017108 - DNA, 20 bp, Homo sapiens
aagctgtgttacttgaagta

SEQ ID NO: 3017109 - DNA, 15 bp, Homo sapiens
aagctgtgttgaaac

SEQ ID NO: 3017110 - DNA, 21 bp, Homo sapiens
aagctgttattcttgttatac

SEQ ID NO: 3017111 - DNA, 18 bp, Homo sapiens
aagctgttctcattcctg

SEQ ID NO: 3017112 - DNA, 20 bp, Homo sapiens
aagctgttgggagaaagcaa

SEQ ID NO: 3017113 - DNA, 10 bp, Homo sapiens
aagcttagaa

SEQ ID NO: 3017114 - DNA, 11 bp, Homo sapiens
aagcttagaac

SEQ ID NO: 3017115 - DNA, 15 bp, Homo sapiens
aagcttatgtttctt

SEQ ID NO: 3017116 - DNA, 17 bp, Homo sapiens
aagcttatgtttcttat

SEQ ID NO: 3017117 - DNA, 17 bp, Homo sapiens
aagcttcaaagccatat

SEQ ID NO: 3017118 - DNA, 16 bp, Homo sapiens
aagcttcaatattttt

SEQ ID NO: 3017119 - DNA, 16 bp, Homo sapiens
aagcttccatgattct

SEQ ID NO: 3017120 - DNA, 23 bp, Homo sapiens
aagcttgagtctcaagggtggca

SEQ ID NO: 3017121 - DNA, 12 bp, Homo sapiens
aagcttgtgtat

SEQ ID NO: 3017122 - DNA, 16 bp, Homo sapiens
aagcttgtgtatccat

SEQ ID NO: 3017123 - DNA, 20 bp, Homo sapiens
aagctttatttatagaaatg

SEQ ID NO: 3017124 - DNA, 22 bp, Homo sapiens
aagctttcatgtaaactgtgca

SEQ ID NO: 3017125 - DNA, 18 bp, Homo sapiens
aagctttgtcccctgctt

SEQ ID NO: 3017126 - DNA, 19 bp, Homo sapiens
aagctttgtcccctgcttc

SEQ ID NO: 3017127 - DNA, 14 bp, Homo sapiens
aagctttttaatgc

SEQ ID NO: 3017128 - DNA, 15 bp, Homo sapiens
aaggaaaaaaagact

SEQ ID NO: 3017129 - DNA, 16 bp, Homo sapiens
aaggaaaaaagatttt

SEQ ID NO: 3017130 - DNA, 19 bp, Homo sapiens
aaggaaaaaataacaatga

SEQ ID NO: 3017131 - DNA, 15 bp, Homo sapiens
aaggaaaaaattatg

SEQ ID NO: 3017132 - DNA, 14 bp, Homo sapiens
aaggaaaaataatc

SEQ ID NO: 3017133 - DNA, 15 bp, Homo sapiens
aaggaaaaataatca

SEQ ID NO: 3017134 - DNA, 16 bp, Homo sapiens
aaggaaaaataatcaa

SEQ ID NO: 3017135 - DNA, 19 bp, Homo sapiens
aaggaaaaataatcaagat

SEQ ID NO: 3017136 - DNA, 16 bp, Homo sapiens
aaggaaaactacctgt

SEQ ID NO: 3017137 - DNA, 23 bp, Homo sapiens
aaggaaaactacctgtatttaaa

SEQ ID NO: 3017138 - DNA, 16 bp, Homo sapiens
aaggaaaactgcatgg

SEQ ID NO: 3017139 - DNA, 13 bp, Homo sapiens
aaggaaaagcaca

SEQ ID NO: 3017140 - DNA, 16 bp, Homo sapiens
aaggaaacgctacctc

SEQ ID NO: 3017141 - DNA, 16 bp, Homo sapiens
aaggaaagcaataaat

SEQ ID NO: 3017142 - DNA, 14 bp, Homo sapiens
aaggaaaggcctga

SEQ ID NO: 3017143 - DNA, 14 bp, Homo sapiens
aaggaaatgagtgg

SEQ ID NO: 3017144 - DNA, 19 bp, Homo sapiens
aaggaaatgagtggccagc

SEQ ID NO: 3017145 - DNA, 12 bp, Homo sapiens
aataaacgattt

SEQ ID NO: 3017146 - DNA, 20 bp, Homo sapiens
aataaactagagaagggaga

SEQ ID NO: 3017147 - DNA, 14 bp, Homo sapiens
aataaactgcaaat

SEQ ID NO: 3017148 - DNA, 15 bp, Homo sapiens
aataaactgcaaatg

SEQ ID NO: 3017149 - DNA, 11 bp, Homo sapiens
aataaactggt

SEQ ID NO: 3017150 - DNA, 23 bp, Homo sapiens
aataaactggtatgaataattgc

SEQ ID NO: 3017151 - DNA, 24 bp, Homo sapiens
aataaactggtatgaataattgca

SEQ ID NO: 3017152 - DNA, 20 bp, Homo sapiens
aataaacttagaggaaaatg

SEQ ID NO: 3017153 - DNA, 17 bp, Homo sapiens
aataaagatgtgaaaac

SEQ ID NO: 3017154 - DNA, 22 bp, Homo sapiens
aataaagcactattgtttagat

SEQ ID NO: 3017155 - DNA, 18 bp, Homo sapiens
aataaaggatgtgattgt

SEQ ID NO: 3017156 - DNA, 14 bp, Homo sapiens
aataaagtacttga

SEQ ID NO: 3017157 - DNA, 23 bp, Homo sapiens
aataaataaaattcatttctaca

SEQ ID NO: 3017158 - DNA, 21 bp, Homo sapiens
aataaataccaattatggaaa

SEQ ID NO: 3017159 - DNA, 21 bp, Homo sapiens
aataaatatagttgtctttct

SEQ ID NO: 3017160 - DNA, 18 bp, Homo sapiens
aataaatcagtgtttaca

SEQ ID NO: 3017161 - DNA, 19 bp, Homo sapiens
aataaatctcttctttgct

SEQ ID NO: 3017162 - DNA, 21 bp, Homo sapiens
aataaatgtttcccccactcc

SEQ ID NO: 3017163 - DNA, 17 bp, Homo sapiens
aataaattaatattgta

SEQ ID NO: 3017164 - DNA, 12 bp, Homo sapiens
aataaattacac

SEQ ID NO: 3017165 - DNA, 14 bp, Homo sapiens
aataaattctctcc

SEQ ID NO: 3017166 - DNA, 17 bp, Homo sapiens
aataaatttactgaaat

SEQ ID NO: 3017167 - DNA, 18 bp, Homo sapiens
aataaatttttaaaaaga

SEQ ID NO: 3017168 - DNA, 12 bp, Homo sapiens
aataacatgttt

SEQ ID NO: 3017169 - DNA, 20 bp, Homo sapiens
aataacattcccactgccag

SEQ ID NO: 3017170 - DNA, 17 bp, Homo sapiens
aataaccggatatatac

SEQ ID NO: 3017171 - DNA, 15 bp, Homo sapiens
aataacgataaaaga

SEQ ID NO: 3017172 - DNA, 15 bp, Homo sapiens
aataactgaaccaaa

SEQ ID NO: 3017173 - DNA, 24 bp, Homo sapiens
aataactgaaccaaattgcactga

SEQ ID NO: 3017174 - DNA, 21 bp, Homo sapiens
aataactggaacaaattattt

SEQ ID NO: 3017175 - DNA, 14 bp, Homo sapiens
aataactttgctgg

SEQ ID NO: 3017176 - DNA, 12 bp, Homo sapiens
aataagaaggta

SEQ ID NO: 3017177 - DNA, 13 bp, Homo sapiens
aataagattctaa

SEQ ID NO: 3017178 - DNA, 22 bp, Homo sapiens
aataaggacaagcctaacttca

SEQ ID NO: 3017179 - DNA, 23 bp, Homo sapiens
aataaggattctgaagttttatt

SEQ ID NO: 3017180 - DNA, 21 bp, Homo sapiens
aataagtatttctgattttgt

SEQ ID NO: 3017181 - DNA, 22 bp, Homo sapiens
aataagtcaaaaggaacaaaaa

SEQ ID NO: 3017182 - DNA, 15 bp, Homo sapiens
aataagtcattgaaa

SEQ ID NO: 3017183 - DNA, 23 bp, Homo sapiens
aataagttaaaggcagtccagag

SEQ ID NO: 3017184 - DNA, 16 bp, Homo sapiens
aataagttgatgtttt

SEQ ID NO: 3017185 - DNA, 18 bp, Homo sapiens
aataagttgatgttttct

SEQ ID NO: 3017186 - DNA, 14 bp, Homo sapiens
aataataatataat

SEQ ID NO: 3017187 - DNA, 12 bp, Homo sapiens
aataataatatc

SEQ ID NO: 3017188 - DNA, 16 bp, Homo sapiens
aataatactgctgaga

SEQ ID NO: 3017189 - DNA, 17 bp, Homo sapiens
aataatagtatgagtaa

SEQ ID NO: 3017190 - DNA, 20 bp, Homo sapiens
aataatatgtaaatttttca

SEQ ID NO: 3017191 - DNA, 15 bp, Homo sapiens
aataatcaagatttt

SEQ ID NO: 3017192 - DNA, 16 bp, Homo sapiens
aataatcggcccacag

SEQ ID NO: 3017193 - DNA, 18 bp, Homo sapiens
aataatctggtgttcttg

SEQ ID NO: 3017194 - DNA, 10 bp, Homo sapiens
aataatgcag

SEQ ID NO: 3017195 - DNA, 21 bp, Homo sapiens
aataatggtaccagataaaat

SEQ ID NO: 3017196 - DNA, 17 bp, Homo sapiens
aataatgtaacatgatt

SEQ ID NO: 3017197 - DNA, 20 bp, Homo sapiens
aataattatttttaatttaa

SEQ ID NO: 3017198 - DNA, 13 bp, Homo sapiens
aataattgaagaa

SEQ ID NO: 3017199 - DNA, 14 bp, Homo sapiens
aataatttaagttg

SEQ ID NO: 3017200 - DNA, 20 bp, Homo sapiens
aataatttacaggttcttag

SEQ ID NO: 3017201 - DNA, 18 bp, Homo sapiens
aataatttattttgctct

SEQ ID NO: 3017202 - DNA, 14 bp, Homo sapiens
aataattttaaaaa

SEQ ID NO: 3017203 - DNA, 11 bp, Homo sapiens
aataattttat

SEQ ID NO: 3017204 - DNA, 18 bp, Homo sapiens
aatacaaaaatcagccag

SEQ ID NO: 3017205 - DNA, 23 bp, Homo sapiens
aatacaaaaatcagccagacatg

SEQ ID NO: 3017206 - DNA, 20 bp, Homo sapiens
aatacaaaaattagccgggc

SEQ ID NO: 3017207 - DNA, 11 bp, Homo sapiens
aatacaaaagg

SEQ ID NO: 3017208 - DNA, 16 bp, Homo sapiens
aatacaaaaggctcca

SEQ ID NO: 3017209 - DNA, 18 bp, Homo sapiens
aatacaaatctgtataaa

SEQ ID NO: 3017210 - DNA, 13 bp, Homo sapiens
aatacaaatgtta

SEQ ID NO: 3017211 - DNA, 20 bp, Homo sapiens
aatacacaaggagctttctt

SEQ ID NO: 3017212 - DNA, 15 bp, Homo sapiens
aatacagcagcaaga

SEQ ID NO: 3017213 - DNA, 21 bp, Homo sapiens
aatacagcctgaataaaccaa

SEQ ID NO: 3017214 - DNA, 13 bp, Homo sapiens
aatacagctttct

SEQ ID NO: 3017215 - DNA, 14 bp, Homo sapiens
aatacagctttctg

SEQ ID NO: 3017216 - DNA, 16 bp, Homo sapiens
aatacagctttctgac

SEQ ID NO: 3017217 - DNA, 19 bp, Homo sapiens
aatacagctttctgacctt

SEQ ID NO: 3017218 - DNA, 18 bp, Homo sapiens
aatacagtacaggcagca

SEQ ID NO: 3017219 - DNA, 23 bp, Homo sapiens
aatacagtttataaagccaagaa

SEQ ID NO: 3017220 - DNA, 18 bp, Homo sapiens
aatacatcctttttctgc

SEQ ID NO: 3017221 - DNA, 19 bp, Homo sapiens
aatacatcctttttctgct

SEQ ID NO: 3017222 - DNA, 14 bp, Homo sapiens
aatacattgttcag

SEQ ID NO: 3017223 - DNA, 23 bp, Homo sapiens
aatacattgttcaggtgaataat

SEQ ID NO: 3017224 - DNA, 15 bp, Homo sapiens
aatacatttgtattt

SEQ ID NO: 3017225 - DNA, 17 bp, Homo sapiens
aatacatttgtattttg

SEQ ID NO: 3017226 - DNA, 20 bp, Homo sapiens
aatacatttgtattttgtga

SEQ ID NO: 3017227 - DNA, 17 bp, Homo sapiens
aataccaattatggaaa

SEQ ID NO: 3017228 - DNA, 21 bp, Homo sapiens
aataccccgactcaccttgtg

SEQ ID NO: 3017229 - DNA, 17 bp, Homo sapiens
aatacgtaattcttcct

SEQ ID NO: 3017230 - DNA, 13 bp, Homo sapiens
aatacgtttgata

SEQ ID NO: 3017231 - DNA, 15 bp, Homo sapiens
aatacgtttgtgttt

SEQ ID NO: 3017232 - DNA, 13 bp, Homo sapiens
aatactacctata

SEQ ID NO: 3017233 - DNA, 18 bp, Homo sapiens
aatactaccttgaaaata

SEQ ID NO: 3017234 - DNA, 19 bp, Homo sapiens
aatactcataatgtgaagt

SEQ ID NO: 3017235 - DNA, 14 bp, Homo sapiens
aatactcatgtgta

SEQ ID NO: 3017236 - DNA, 16 bp, Homo sapiens
aatactcatgtgtatg

SEQ ID NO: 3017237 - DNA, 13 bp, Homo sapiens
aatactctctgag

SEQ ID NO: 3017238 - DNA, 20 bp, Homo sapiens
aatactgccaaaacatttat

SEQ ID NO: 3017239 - DNA, 20 bp, Homo sapiens
aatactgcttaattgctgat

SEQ ID NO: 3017240 - DNA, 18 bp, Homo sapiens
aatactgttttatctcca

SEQ ID NO: 3017241 - DNA, 16 bp, Homo sapiens
aatacttacattctct

SEQ ID NO: 3017242 - DNA, 17 bp, Homo sapiens
aatacttcgatgatgat

SEQ ID NO: 3017243 - DNA, 13 bp, Homo sapiens
aatacttgaactt

SEQ ID NO: 3017244 - DNA, 14 bp, Homo sapiens
aatacttgaacttg

SEQ ID NO: 3017245 - DNA, 13 bp, Homo sapiens
aatacttttcctt

SEQ ID NO: 3017246 - DNA, 10 bp, Homo sapiens
aatacttttt

SEQ ID NO: 3017247 - DNA, 14 bp, Homo sapiens
aatagaaataaatt

SEQ ID NO: 3017248 - DNA, 19 bp, Homo sapiens
aatagaaataaattcctaa

SEQ ID NO: 3017249 - DNA, 18 bp, Homo sapiens
aatagaagtgctcccctc

SEQ ID NO: 3017250 - DNA, 19 bp, Homo sapiens
aatagaagtgctcccctct

SEQ ID NO: 3017251 - DNA, 14 bp, Homo sapiens
aatagaatttccta

SEQ ID NO: 3017252 - DNA, 22 bp, Homo sapiens
aatagacactccccgaagtctt

SEQ ID NO: 3017253 - DNA, 16 bp, Homo sapiens
aatagagcctgaggga

SEQ ID NO: 3017254 - DNA, 13 bp, Homo sapiens
aatagagtgtttt

SEQ ID NO: 3017255 - DNA, 20 bp, Homo sapiens
aatagataagagtagaaact

SEQ ID NO: 3017256 - DNA, 14 bp, Homo sapiens
aatagatacttttg

SEQ ID NO: 3017257 - DNA, 16 bp, Homo sapiens
aatagatacttttgat

SEQ ID NO: 3017258 - DNA, 11 bp, Homo sapiens
aatagatggac

SEQ ID NO: 3017259 - DNA, 23 bp, Homo sapiens
aatagatggacagtttgtttcct

SEQ ID NO: 3017260 - DNA, 22 bp, Homo sapiens
aatagccacatttggaatactt

SEQ ID NO: 3017261 - DNA, 12 bp, Homo sapiens
aatagccccaga

SEQ ID NO: 3017262 - DNA, 14 bp, Homo sapiens
aatagccccagact

SEQ ID NO: 3017263 - DNA, 21 bp, Homo sapiens
aatagccgaactccaggctgg

SEQ ID NO: 3017264 - DNA, 22 bp, Homo sapiens
aatagccgaactccaggctggg

SEQ ID NO: 3017265 - DNA, 17 bp, Homo sapiens
aatagctccaagctgtt

SEQ ID NO: 3017266 - DNA, 18 bp, Homo sapiens
aataggaaagactttctc

SEQ ID NO: 3017267 - DNA, 15 bp, Homo sapiens
aataggatttttaga

SEQ ID NO: 3017268 - DNA, 16 bp, Homo sapiens
aataggatttttagaa

SEQ ID NO: 3017269 - DNA, 20 bp, Homo sapiens
aatagtctagatggctcctc

SEQ ID NO: 3017270 - DNA, 22 bp, Homo sapiens
aatagtctctgggtttacaaca

SEQ ID NO: 3017271 - DNA, 19 bp, Homo sapiens
aatagtgttaatcaattta

SEQ ID NO: 3017272 - DNA, 22 bp, Homo sapiens
aatagtgttaatcaatttaaac

SEQ ID NO: 3017273 - DNA, 12 bp, Homo sapiens
aatagttcaagg

SEQ ID NO: 3017274 - DNA, 14 bp, Homo sapiens
aatataaaaggcaa

SEQ ID NO: 3017275 - DNA, 14 bp, Homo sapiens
aatataaaatatga

SEQ ID NO: 3017276 - DNA, 21 bp, Homo sapiens
aatataaacaaagattcatga

SEQ ID NO: 3017277 - DNA, 21 bp, Homo sapiens
aatataaagatggctgacttt

SEQ ID NO: 3017278 - DNA, 18 bp, Homo sapiens
aatgtatttcctgaaata

SEQ ID NO: 3017279 - DNA, 13 bp, Homo sapiens
aatgtattttaat

SEQ ID NO: 3017280 - DNA, 17 bp, Homo sapiens
aatgtattttgaaaaca

SEQ ID NO: 3017281 - DNA, 21 bp, Homo sapiens
aatgtattttgaaaacactta

SEQ ID NO: 3017282 - DNA, 20 bp, Homo sapiens
aatgtattttggaagacata

SEQ ID NO: 3017283 - DNA, 21 bp, Homo sapiens
aatgtcaactgtgtctctgaa

SEQ ID NO: 3017284 - DNA, 15 bp, Homo sapiens
aatgtcaccatgctt

SEQ ID NO: 3017285 - DNA, 17 bp, Homo sapiens
aatgtcagatacaatgt

SEQ ID NO: 3017286 - DNA, 17 bp, Homo sapiens
aatgtcagcaaatgtaa

SEQ ID NO: 3017287 - DNA, 12 bp, Homo sapiens
aatgtcattatt

SEQ ID NO: 3017288 - DNA, 22 bp, Homo sapiens
aatgtcattatttgataacatt

SEQ ID NO: 3017289 - DNA, 16 bp, Homo sapiens
aatgtccaaaatttat

SEQ ID NO: 3017290 - DNA, 18 bp, Homo sapiens
aatgtccaaaatttatat

SEQ ID NO: 3017291 - DNA, 23 bp, Homo sapiens
aatgtccaactaaaaacaaaccc

SEQ ID NO: 3017292 - DNA, 16 bp, Homo sapiens
aatgtcctgcctttta

SEQ ID NO: 3017293 - DNA, 23 bp, Homo sapiens
aatgtcgctgtaaattttatggc

SEQ ID NO: 3017294 - DNA, 18 bp, Homo sapiens
aatgtctattattatgaa

SEQ ID NO: 3017295 - DNA, 14 bp, Homo sapiens
aatgtctgtaaata

SEQ ID NO: 3017296 - DNA, 15 bp, Homo sapiens
aatgtcttcaaggct

SEQ ID NO: 3017297 - DNA, 19 bp, Homo sapiens
aatgtcttccttttctttc

SEQ ID NO: 3017298 - DNA, 11 bp, Homo sapiens
aatgtcttgtg

SEQ ID NO: 3017299 - DNA, 12 bp, Homo sapiens
aatgtcttgtgt

SEQ ID NO: 3017300 - DNA, 14 bp, Homo sapiens
aatgtcttgtgtat

SEQ ID NO: 3017301 - DNA, 21 bp, Homo sapiens
aatgtcttttttttaatgtgc

SEQ ID NO: 3017302 - DNA, 19 bp, Homo sapiens
aatgtgaacagcggctgga

SEQ ID NO: 3017303 - DNA, 19 bp, Homo sapiens
aatgtgaactctcccctcc

SEQ ID NO: 3017304 - DNA, 12 bp, Homo sapiens
aatgtgaagatg

SEQ ID NO: 3017305 - DNA, 12 bp, Homo sapiens
aatgtgaatttt

SEQ ID NO: 3017306 - DNA, 14 bp, Homo sapiens
aatgtgacatttac

SEQ ID NO: 3017307 - DNA, 18 bp, Homo sapiens
aatgtgaccatgtgaatc

SEQ ID NO: 3017308 - DNA, 14 bp, Homo sapiens
aatgtgatgttcta

SEQ ID NO: 3017309 - DNA, 17 bp, Homo sapiens
aatgtgatgttctaagg

SEQ ID NO: 3017310 - DNA, 12 bp, Homo sapiens
aatgtgattttg

SEQ ID NO: 3017311 - DNA, 20 bp, Homo sapiens
aatgtgcctggctctgattc

SEQ ID NO: 3017312 - DNA, 12 bp, Homo sapiens
aatgtgctgtgt

SEQ ID NO: 3017313 - DNA, 17 bp, Homo sapiens
aatgtgctgtgtaaagt

SEQ ID NO: 3017314 - DNA, 18 bp, Homo sapiens
aatgtgctgtgtaaagtt

SEQ ID NO: 3017315 - DNA, 19 bp, Homo sapiens
aatgtggagaactaaaggt

SEQ ID NO: 3017316 - DNA, 12 bp, Homo sapiens
aatgtggcttga

SEQ ID NO: 3017317 - DNA, 16 bp, Homo sapiens
aatgtggcttgagaaa

SEQ ID NO: 3017318 - DNA, 17 bp, Homo sapiens
aatgtggttttcctgaa

SEQ ID NO: 3017319 - DNA, 16 bp, Homo sapiens
aatgtgtgagaaaaac

SEQ ID NO: 3017320 - DNA, 12 bp, Homo sapiens
aatgtgttctcg

SEQ ID NO: 3017321 - DNA, 19 bp, Homo sapiens
aatgtgttggacaaatgtg

SEQ ID NO: 3017322 - DNA, 21 bp, Homo sapiens
aatgtgttggacaaatgtgaa

SEQ ID NO: 3017323 - DNA, 23 bp, Homo sapiens
aatgtgttggacaaatgtgaaga

SEQ ID NO: 3017324 - DNA, 22 bp, Homo sapiens
aatgtgttttgtttattaaata

SEQ ID NO: 3017325 - DNA, 15 bp, Homo sapiens
aatgttaaactcttt

SEQ ID NO: 3017326 - DNA, 22 bp, Homo sapiens
aatgttaattttttggtacaaa

SEQ ID NO: 3017327 - DNA, 17 bp, Homo sapiens
aatgttatatcatatgt

SEQ ID NO: 3017328 - DNA, 17 bp, Homo sapiens
aatgttctaagtttcta

SEQ ID NO: 3017329 - DNA, 19 bp, Homo sapiens
aatgttctaagtttctaag

SEQ ID NO: 3017330 - DNA, 22 bp, Homo sapiens
aatgttctaagtttctaagatt

SEQ ID NO: 3017331 - DNA, 18 bp, Homo sapiens
aatgttgagaatcccaaa

SEQ ID NO: 3017332 - DNA, 18 bp, Homo sapiens
aatgttgcactgaaaacc

SEQ ID NO: 3017333 - DNA, 21 bp, Homo sapiens
aatgttgggactgctaaataa

SEQ ID NO: 3017334 - DNA, 17 bp, Homo sapiens
aatgttggtgcaattaa

SEQ ID NO: 3017335 - DNA, 13 bp, Homo sapiens
aatgtttaaaaca

SEQ ID NO: 3017336 - DNA, 21 bp, Homo sapiens
aatgtttacatcatcagatga

SEQ ID NO: 3017337 - DNA, 13 bp, Homo sapiens
aatgtttactgta

SEQ ID NO: 3017338 - DNA, 14 bp, Homo sapiens
aatgtttactgtaa

SEQ ID NO: 3017339 - DNA, 18 bp, Homo sapiens
aatgtttactgtaaattt

SEQ ID NO: 3017340 - DNA, 14 bp, Homo sapiens
aatgtttatacaga

SEQ ID NO: 3017341 - DNA, 13 bp, Homo sapiens
aatgtttctgtgt

SEQ ID NO: 3017342 - DNA, 12 bp, Homo sapiens
aatgtttgttga

SEQ ID NO: 3017343 - DNA, 17 bp, Homo sapiens
aatgttttatactgttt

SEQ ID NO: 3017344 - DNA, 13 bp, Homo sapiens
aatgttttctgca

SEQ ID NO: 3017345 - DNA, 13 bp, Homo sapiens
aatgttttctttg

SEQ ID NO: 3017346 - DNA, 16 bp, Homo sapiens
aatgttttctttgcaa

SEQ ID NO: 3017347 - DNA, 22 bp, Homo sapiens
aatgttttctttgcaaagtatt

SEQ ID NO: 3017348 - DNA, 14 bp, Homo sapiens
aatgtttttgtgta

SEQ ID NO: 3017349 - DNA, 21 bp, Homo sapiens
aattaaaaaaaaagatctgtt

SEQ ID NO: 3017350 - DNA, 14 bp, Homo sapiens
aattaaaaaagaaa

SEQ ID NO: 3017351 - DNA, 18 bp, Homo sapiens
aattaaaaacgaaaacct

SEQ ID NO: 3017352 - DNA, 17 bp, Homo sapiens
aattaaaaactagtagt

SEQ ID NO: 3017353 - DNA, 19 bp, Homo sapiens
aattaaaactattcatgct

SEQ ID NO: 3017354 - DNA, 17 bp, Homo sapiens
aattaaaataaaacaca

SEQ ID NO: 3017355 - DNA, 14 bp, Homo sapiens
aattaaaattttat

SEQ ID NO: 3017356 - DNA, 15 bp, Homo sapiens
aattaaagtgctgtt

SEQ ID NO: 3017357 - DNA, 16 bp, Homo sapiens
aattaaagtgctgttt

SEQ ID NO: 3017358 - DNA, 17 bp, Homo sapiens
aattaaatatttcttaa

SEQ ID NO: 3017359 - DNA, 22 bp, Homo sapiens
aattaaatgacttagaaacaat

SEQ ID NO: 3017360 - DNA, 14 bp, Homo sapiens
aattaaattaggaa

SEQ ID NO: 3017361 - DNA, 13 bp, Homo sapiens
aattaagtgttga

SEQ ID NO: 3017362 - DNA, 18 bp, Homo sapiens
aattaagtttgtgaatgt

SEQ ID NO: 3017363 - DNA, 19 bp, Homo sapiens
aattaatatttgtgctttg

SEQ ID NO: 3017364 - DNA, 13 bp, Homo sapiens
aattaatcaagta

SEQ ID NO: 3017365 - DNA, 21 bp, Homo sapiens
aattaatgatgaggatctgaa

SEQ ID NO: 3017366 - DNA, 22 bp, Homo sapiens
aattaatgttctgacagttgtg

SEQ ID NO: 3017367 - DNA, 24 bp, Homo sapiens
aattaatgttctgacagttgtgat

SEQ ID NO: 3017368 - DNA, 16 bp, Homo sapiens
aattaattgctattgt

SEQ ID NO: 3017369 - DNA, 16 bp, Homo sapiens
aattacaaagaaaata

SEQ ID NO: 3017370 - DNA, 14 bp, Homo sapiens
aattacaaagaacc

SEQ ID NO: 3017371 - DNA, 14 bp, Homo sapiens
aattacaactaagt

SEQ ID NO: 3017372 - DNA, 15 bp, Homo sapiens
aattacgataaggaa

SEQ ID NO: 3017373 - DNA, 22 bp, Homo sapiens
aattacttatcatccacattgt

SEQ ID NO: 3017374 - DNA, 18 bp, Homo sapiens
aattacttgtgttacttg

SEQ ID NO: 3017375 - DNA, 13 bp, Homo sapiens
aattagatgttta

SEQ ID NO: 3017376 - DNA, 15 bp, Homo sapiens
aattagatgtttata

SEQ ID NO: 3017377 - DNA, 19 bp, Homo sapiens
aattagatgtttatatcaa

SEQ ID NO: 3017378 - DNA, 22 bp, Homo sapiens
aattagctttttcatcccctta

SEQ ID NO: 3017379 - DNA, 13 bp, Homo sapiens
aattaggaaaaaa

SEQ ID NO: 3017380 - DNA, 19 bp, Homo sapiens
aattagtggatttttttgt

SEQ ID NO: 3017381 - DNA, 23 bp, Homo sapiens
aattagtggatttttttgtcatt

SEQ ID NO: 3017382 - DNA, 13 bp, Homo sapiens
aattataaacagc

SEQ ID NO: 3017383 - DNA, 16 bp, Homo sapiens
aattataaacagcagg

SEQ ID NO: 3017384 - DNA, 18 bp, Homo sapiens
aattataaagataaagct

SEQ ID NO: 3017385 - DNA, 20 bp, Homo sapiens
aattataagaatttctaaca

SEQ ID NO: 3017386 - DNA, 13 bp, Homo sapiens
aattatagctttt

SEQ ID NO: 3017387 - DNA, 14 bp, Homo sapiens
aattatagtagctt

SEQ ID NO: 3017388 - DNA, 20 bp, Homo sapiens
aattatagtagcttataaga

SEQ ID NO: 3017389 - DNA, 13 bp, Homo sapiens
aattatatagcaa

SEQ ID NO: 3017390 - DNA, 17 bp, Homo sapiens
aattatatagcaaagat

SEQ ID NO: 3017391 - DNA, 22 bp, Homo sapiens
aattatatcagtcctctttcaa

SEQ ID NO: 3017392 - DNA, 21 bp, Homo sapiens
aattatattgttagtggactt

SEQ ID NO: 3017393 - DNA, 23 bp, Homo sapiens
aattatatttgtgctatagtatt

SEQ ID NO: 3017394 - DNA, 14 bp, Homo sapiens
aattatcctatttc

SEQ ID NO: 3017395 - DNA, 17 bp, Homo sapiens
aattatcctatttcagt

SEQ ID NO: 3017396 - DNA, 19 bp, Homo sapiens
aattatctttagttgaatt

SEQ ID NO: 3017397 - DNA, 22 bp, Homo sapiens
aattatgatggaagacaggaaa

SEQ ID NO: 3017398 - DNA, 15 bp, Homo sapiens
aattatgcatctgct

SEQ ID NO: 3017399 - DNA, 12 bp, Homo sapiens
aattatggaaat

SEQ ID NO: 3017400 - DNA, 17 bp, Homo sapiens
aattatgtaaataactc

SEQ ID NO: 3017401 - DNA, 22 bp, Homo sapiens
aattatgtttttattaagatta

SEQ ID NO: 3017402 - DNA, 17 bp, Homo sapiens
aattattaatgaaaata

SEQ ID NO: 3017403 - DNA, 20 bp, Homo sapiens
aattattattattattttcc

SEQ ID NO: 3017404 - DNA, 17 bp, Homo sapiens
aattattatttaactct

SEQ ID NO: 3017405 - DNA, 17 bp, Homo sapiens
aattatttaaagaaagt

SEQ ID NO: 3017406 - DNA, 21 bp, Homo sapiens
aattatttgactttaatttat

SEQ ID NO: 3017407 - DNA, 12 bp, Homo sapiens
aattatttgcat

SEQ ID NO: 3017408 - DNA, 11 bp, Homo sapiens
aattattttaa

SEQ ID NO: 3017409 - DNA, 19 bp, Homo sapiens
aattattttaaaatattta

SEQ ID NO: 3017410 - DNA, 16 bp, Homo sapiens
aattatttttaattta

SEQ ID NO: 3017411 - DNA, 15 bp, Homo sapiens
acaatattgtttcta

SEQ ID NO: 3017412 - DNA, 14 bp, Homo sapiens
acaatcaaaggaaa

SEQ ID NO: 3017413 - DNA, 18 bp, Homo sapiens
acaatcagctccttcctg

SEQ ID NO: 3017414 - DNA, 22 bp, Homo sapiens
acaatcagctccttcctggaga

SEQ ID NO: 3017415 - DNA, 22 bp, Homo sapiens
acaatccaaatgcattcatgtt

SEQ ID NO: 3017416 - DNA, 15 bp, Homo sapiens
acaatcctagtgctt

SEQ ID NO: 3017417 - DNA, 23 bp, Homo sapiens
acaatcctagtgctttccttttt

SEQ ID NO: 3017418 - DNA, 18 bp, Homo sapiens
acaatctgacattctcag

SEQ ID NO: 3017419 - DNA, 18 bp, Homo sapiens
acaatgactaagccaagc

SEQ ID NO: 3017420 - DNA, 19 bp, Homo sapiens
acaatgactaagccaagct

SEQ ID NO: 3017421 - DNA, 20 bp, Homo sapiens
acaatgactaagccaagctg

SEQ ID NO: 3017422 - DNA, 14 bp, Homo sapiens
acaatgattaatca

SEQ ID NO: 3017423 - DNA, 16 bp, Homo sapiens
acaatgattaatcagc

SEQ ID NO: 3017424 - DNA, 20 bp, Homo sapiens
acaatgattaatcagctgtt

SEQ ID NO: 3017425 - DNA, 15 bp, Homo sapiens
acaatgggaaaagag

SEQ ID NO: 3017426 - DNA, 20 bp, Homo sapiens
acaatggtgtggtgaatgtg

SEQ ID NO: 3017427 - DNA, 23 bp, Homo sapiens
acaatggtgtggtgaatgtgtga

SEQ ID NO: 3017428 - DNA, 17 bp, Homo sapiens
acaatgtatttatttaa

SEQ ID NO: 3017429 - DNA, 19 bp, Homo sapiens
acaatgtatttatttaaaa

SEQ ID NO: 3017430 - DNA, 20 bp, Homo sapiens
acaatgtatttatttaaaag

SEQ ID NO: 3017431 - DNA, 13 bp, Homo sapiens
acaatgtattttg

SEQ ID NO: 3017432 - DNA, 15 bp, Homo sapiens
acaatgtattttgga

SEQ ID NO: 3017433 - DNA, 18 bp, Homo sapiens
acaatgtattttggaaga

SEQ ID NO: 3017434 - DNA, 21 bp, Homo sapiens
acaatgtattttggaagacat

SEQ ID NO: 3017435 - DNA, 17 bp, Homo sapiens
acaatgttctttatata

SEQ ID NO: 3017436 - DNA, 23 bp, Homo sapiens
acaatgtttgcttttcactggca

SEQ ID NO: 3017437 - DNA, 13 bp, Homo sapiens
acaattaactgcc

SEQ ID NO: 3017438 - DNA, 21 bp, Homo sapiens
acaattaactgccctctgaaa

SEQ ID NO: 3017439 - DNA, 19 bp, Homo sapiens
acaattctccctatcttgt

SEQ ID NO: 3017440 - DNA, 21 bp, Homo sapiens
acaattctgtttttaatgcta

SEQ ID NO: 3017441 - DNA, 15 bp, Homo sapiens
acaattctttataca

SEQ ID NO: 3017442 - DNA, 16 bp, Homo sapiens
acaattggttgtatat

SEQ ID NO: 3017443 - DNA, 12 bp, Homo sapiens
acaattgtttgt

SEQ ID NO: 3017444 - DNA, 19 bp, Homo sapiens
acaatttccaagaatgatg

SEQ ID NO: 3017445 - DNA, 21 bp, Homo sapiens
acaattttttattaaatttat

SEQ ID NO: 3017446 - DNA, 14 bp, Homo sapiens
acaatttttttaat

SEQ ID NO: 3017447 - DNA, 21 bp, Homo sapiens
acaatttttttaattttgtat

SEQ ID NO: 3017448 - DNA, 12 bp, Homo sapiens
acacaaatgaaa

SEQ ID NO: 3017449 - DNA, 14 bp, Homo sapiens
acacaaatgcaggg

SEQ ID NO: 3017450 - DNA, 18 bp, Homo sapiens
acacaacagccaacagct

SEQ ID NO: 3017451 - DNA, 19 bp, Homo sapiens
acacaacagccaacagcta

SEQ ID NO: 3017452 - DNA, 13 bp, Homo sapiens
acacaacatttgt

SEQ ID NO: 3017453 - DNA, 16 bp, Homo sapiens
acacaactatcaaaat

SEQ ID NO: 3017454 - DNA, 15 bp, Homo sapiens
acacaagaaaactca

SEQ ID NO: 3017455 - DNA, 19 bp, Homo sapiens
acacaaggatagatgctgg

SEQ ID NO: 3017456 - DNA, 20 bp, Homo sapiens
acacaaggtcatggccacac

SEQ ID NO: 3017457 - DNA, 15 bp, Homo sapiens
acacaagtaagagac

SEQ ID NO: 3017458 - DNA, 19 bp, Homo sapiens
acacaagtaagagactcag

SEQ ID NO: 3017459 - DNA, 22 bp, Homo sapiens
acacaataagagtctccttctc

SEQ ID NO: 3017460 - DNA, 22 bp, Homo sapiens
acacaatggtttttaaattttg

SEQ ID NO: 3017461 - DNA, 23 bp, Homo sapiens
acacaatggtttttaaattttgt

SEQ ID NO: 3017462 - DNA, 16 bp, Homo sapiens
acacaatttatactgc

SEQ ID NO: 3017463 - DNA, 14 bp, Homo sapiens
acacacacaagtaa

SEQ ID NO: 3017464 - DNA, 10 bp, Homo sapiens
acacacacac

SEQ ID NO: 3017465 - DNA, 14 bp, Homo sapiens
acacacacacacac

SEQ ID NO: 3017466 - DNA, 15 bp, Homo sapiens
acacacacacacaca

SEQ ID NO: 3017467 - DNA, 16 bp, Homo sapiens
acacacacacacacac

SEQ ID NO: 3017468 - DNA, 13 bp, Homo sapiens
acacacacagaaa

SEQ ID NO: 3017469 - DNA, 12 bp, Homo sapiens
acacacacatgc

SEQ ID NO: 3017470 - DNA, 15 bp, Homo sapiens
acacacacgcacata

SEQ ID NO: 3017471 - DNA, 18 bp, Homo sapiens
acacacactccttcccct

SEQ ID NO: 3017472 - DNA, 13 bp, Homo sapiens
acacacagaaaat

SEQ ID NO: 3017473 - DNA, 14 bp, Homo sapiens
acacacagaaaata

SEQ ID NO: 3017474 - DNA, 16 bp, Homo sapiens
acacacagaaaatata

SEQ ID NO: 3017475 - DNA, 21 bp, Homo sapiens
acacacagaaaatatactgta

SEQ ID NO: 3017476 - DNA, 22 bp, Homo sapiens
acacacagccacacacacagaa

SEQ ID NO: 3017477 - DNA, 21 bp, Homo sapiens
acacacaggtggtgtcactgt

SEQ ID NO: 3017478 - DNA, 19 bp, Homo sapiens
acacacatgcatacacaca

SEQ ID NO: 3017479 - DNA, 21 bp, Homo sapiens
acacacatgcatacacacaca

SEQ ID NO: 3017480 - DNA, 17 bp, Homo sapiens
acacacctaagggacat

SEQ ID NO: 3017481 - DNA, 22 bp, Homo sapiens
acacacctaagggacatgtttt

SEQ ID NO: 3017482 - DNA, 17 bp, Homo sapiens
acacactacaccacaca

SEQ ID NO: 3017483 - DNA, 19 bp, Homo sapiens
acacactacaccacacaca

SEQ ID NO: 3017484 - DNA, 15 bp, Homo sapiens
acacactccttcccc

SEQ ID NO: 3017485 - DNA, 15 bp, Homo sapiens
acacactgaggcagg

SEQ ID NO: 3017486 - DNA, 17 bp, Homo sapiens
acacactgatgcttaga

SEQ ID NO: 3017487 - DNA, 14 bp, Homo sapiens
acacactgccttat

SEQ ID NO: 3017488 - DNA, 22 bp, Homo sapiens
acacactgtcatgcttcatcat

SEQ ID NO: 3017489 - DNA, 16 bp, Homo sapiens
acacactttctcttca

SEQ ID NO: 3017490 - DNA, 12 bp, Homo sapiens
acacagaaaata

SEQ ID NO: 3017491 - DNA, 13 bp, Homo sapiens
acacagaaaatat

SEQ ID NO: 3017492 - DNA, 15 bp, Homo sapiens
acacagaaaatatac

SEQ ID NO: 3017493 - DNA, 17 bp, Homo sapiens
acacagaaaatatactg

SEQ ID NO: 3017494 - DNA, 18 bp, Homo sapiens
acacagaaaatatactgt

SEQ ID NO: 3017495 - DNA, 19 bp, Homo sapiens
acacagaaaatatactgta

SEQ ID NO: 3017496 - DNA, 20 bp, Homo sapiens
acacagaaaatatactgtaa

SEQ ID NO: 3017497 - DNA, 21 bp, Homo sapiens
acacagaaaatatactgtaaa

SEQ ID NO: 3017498 - DNA, 20 bp, Homo sapiens
acacagaaaatgttgagaat

SEQ ID NO: 3017499 - DNA, 17 bp, Homo sapiens
acacagaaacactgcct

SEQ ID NO: 3017500 - DNA, 14 bp, Homo sapiens
acacagaaaccaat

SEQ ID NO: 3017501 - DNA, 18 bp, Homo sapiens
acacagccacacacacag

SEQ ID NO: 3017502 - DNA, 19 bp, Homo sapiens
acacagccacacacacaga

SEQ ID NO: 3017503 - DNA, 20 bp, Homo sapiens
acacagccacacacacagaa

SEQ ID NO: 3017504 - DNA, 15 bp, Homo sapiens
acacagcggctgcct

SEQ ID NO: 3017505 - DNA, 23 bp, Homo sapiens
acacagctactctccccacgagg

SEQ ID NO: 3017506 - DNA, 16 bp, Homo sapiens
acacaggcctgctctc

SEQ ID NO: 3017507 - DNA, 11 bp, Homo sapiens
acacagggcag

SEQ ID NO: 3017508 - DNA, 18 bp, Homo sapiens
acacaggtggtgtcactg

SEQ ID NO: 3017509 - DNA, 21 bp, Homo sapiens
acacaggtggtgtcactgtcc

SEQ ID NO: 3017510 - DNA, 16 bp, Homo sapiens
acacaggttcacgtgc

SEQ ID NO: 3017511 - DNA, 15 bp, Homo sapiens
acacagtacctaaga

SEQ ID NO: 3017512 - DNA, 15 bp, Homo sapiens
acacagtctgcaaga

SEQ ID NO: 3017513 - DNA, 16 bp, Homo sapiens
acacagtctgcaagat

SEQ ID NO: 3017514 - DNA, 21 bp, Homo sapiens
acacagtgtttttgtaaagtg

SEQ ID NO: 3017515 - DNA, 23 bp, Homo sapiens
acacagttttgacctaacatacc

SEQ ID NO: 3017516 - DNA, 13 bp, Homo sapiens
acacataaattat

SEQ ID NO: 3017517 - DNA, 15 bp, Homo sapiens
acacataaattatga

SEQ ID NO: 3017518 - DNA, 14 bp, Homo sapiens
acacataacttctt

SEQ ID NO: 3017519 - DNA, 19 bp, Homo sapiens
acacatctgggtgccctga

SEQ ID NO: 3017520 - DNA, 13 bp, Homo sapiens
acacatgcataca

SEQ ID NO: 3017521 - DNA, 14 bp, Homo sapiens
acacatgcatacac

SEQ ID NO: 3017522 - DNA, 15 bp, Homo sapiens
acacatgcatacaca

SEQ ID NO: 3017523 - DNA, 17 bp, Homo sapiens
acacatgcatacacaca

SEQ ID NO: 3017524 - DNA, 18 bp, Homo sapiens
acacatggaaacccatag

SEQ ID NO: 3017525 - DNA, 12 bp, Homo sapiens
acacatgtgtgc

SEQ ID NO: 3017526 - DNA, 21 bp, Homo sapiens
acacattaaaagacaaatatg

SEQ ID NO: 3017527 - DNA, 15 bp, Homo sapiens
acacattctcgttgc

SEQ ID NO: 3017528 - DNA, 14 bp, Homo sapiens
acacattgtgcttg

SEQ ID NO: 3017529 - DNA, 14 bp, Homo sapiens
acacattgttattt

SEQ ID NO: 3017530 - DNA, 14 bp, Homo sapiens
acacattttgtata

SEQ ID NO: 3017531 - DNA, 16 bp, Homo sapiens
acacattttgtataat

SEQ ID NO: 3017532 - DNA, 21 bp, Homo sapiens
acacattttgtataattgtat

SEQ ID NO: 3017533 - DNA, 19 bp, Homo sapiens
acaccaagcacagcagcct

SEQ ID NO: 3017534 - DNA, 20 bp, Homo sapiens
acaccaagcacagcagcctg

SEQ ID NO: 3017535 - DNA, 16 bp, Homo sapiens
acaccacactttcaaa

SEQ ID NO: 3017536 - DNA, 19 bp, Homo sapiens
acaccaccgagctctgtgg

SEQ ID NO: 3017537 - DNA, 17 bp, Homo sapiens
acaccactcctgccagc

SEQ ID NO: 3017538 - DNA, 18 bp, Homo sapiens
acaccactcctgccagcc

SEQ ID NO: 3017539 - DNA, 20 bp, Homo sapiens
acaccactcctgccagcccg

SEQ ID NO: 3017540 - DNA, 21 bp, Homo sapiens
acaccactgccattacccagt

SEQ ID NO: 3017541 - DNA, 19 bp, Homo sapiens
acaccagcattccttttga

SEQ ID NO: 3017542 - DNA, 22 bp, Homo sapiens
acaccagccctgctgcttccta

SEQ ID NO: 3017543 - DNA, 22 bp, Homo sapiens
acataatgggccactgaaatct

SEQ ID NO: 3017544 - DNA, 23 bp, Homo sapiens
acataatgggccactgaaatctg

SEQ ID NO: 3017545 - DNA, 17 bp, Homo sapiens
acataatggggtcctgg

SEQ ID NO: 3017546 - DNA, 18 bp, Homo sapiens
acataattcactctgagt

SEQ ID NO: 3017547 - DNA, 17 bp, Homo sapiens
acataattgattaaaat

SEQ ID NO: 3017548 - DNA, 21 bp, Homo sapiens
acataattgattaaaatctct

SEQ ID NO: 3017549 - DNA, 22 bp, Homo sapiens
acataattgattaaaatctctt

SEQ ID NO: 3017550 - DNA, 13 bp, Homo sapiens
acataattgtgac

SEQ ID NO: 3017551 - DNA, 15 bp, Homo sapiens
acatacaaaagaatt

SEQ ID NO: 3017552 - DNA, 22 bp, Homo sapiens
acatacaattatttttacagtt

SEQ ID NO: 3017553 - DNA, 20 bp, Homo sapiens
acatacagaattactgtaac

SEQ ID NO: 3017554 - DNA, 23 bp, Homo sapiens
acatactccttaatttacctgtt

SEQ ID NO: 3017555 - DNA, 20 bp, Homo sapiens
acatacttgaagggccagag

SEQ ID NO: 3017556 - DNA, 22 bp, Homo sapiens
acatacttgaagggccagagcc

SEQ ID NO: 3017557 - DNA, 22 bp, Homo sapiens
acatagaaaaatgatgtcttta

SEQ ID NO: 3017558 - DNA, 20 bp, Homo sapiens
acatagaaatggaaattttg

SEQ ID NO: 3017559 - DNA, 22 bp, Homo sapiens
acatagaaatggaaattttgct

SEQ ID NO: 3017560 - DNA, 22 bp, Homo sapiens
acatagaccctctttcttgttt

SEQ ID NO: 3017561 - DNA, 14 bp, Homo sapiens
acatagactgaaga

SEQ ID NO: 3017562 - DNA, 18 bp, Homo sapiens
acatagactgaagattta

SEQ ID NO: 3017563 - DNA, 20 bp, Homo sapiens
acatagagagggagaagaag

SEQ ID NO: 3017564 - DNA, 20 bp, Homo sapiens
acatagcatccaagtggcat

SEQ ID NO: 3017565 - DNA, 19 bp, Homo sapiens
acatagcatgacatttctt

SEQ ID NO: 3017566 - DNA, 21 bp, Homo sapiens
acatagccctggtgctcctgc

SEQ ID NO: 3017567 - DNA, 12 bp, Homo sapiens
acatagcctcat

SEQ ID NO: 3017568 - DNA, 21 bp, Homo sapiens
acataggtaggtatctttata

SEQ ID NO: 3017569 - DNA, 13 bp, Homo sapiens
acatagtaaagta

SEQ ID NO: 3017570 - DNA, 14 bp, Homo sapiens
acatagtaaagtat

SEQ ID NO: 3017571 - DNA, 15 bp, Homo sapiens
acatagtaaagtatt

SEQ ID NO: 3017572 - DNA, 18 bp, Homo sapiens
acatagtaaagtattttt

SEQ ID NO: 3017573 - DNA, 19 bp, Homo sapiens
acatagtattcatgactat

SEQ ID NO: 3017574 - DNA, 21 bp, Homo sapiens
acatagttgaaaaaagaagtt

SEQ ID NO: 3017575 - DNA, 14 bp, Homo sapiens
acatataactattg

SEQ ID NO: 3017576 - DNA, 14 bp, Homo sapiens
acatatacacacac

SEQ ID NO: 3017577 - DNA, 15 bp, Homo sapiens
acatatatatatata

SEQ ID NO: 3017578 - DNA, 10 bp, Homo sapiens
acatatatta

SEQ ID NO: 3017579 - DNA, 13 bp, Homo sapiens
acatatattatat

SEQ ID NO: 3017580 - DNA, 15 bp, Homo sapiens
acatatcaaaatagg

SEQ ID NO: 3017581 - DNA, 17 bp, Homo sapiens
acatatcatgtgtgaga

SEQ ID NO: 3017582 - DNA, 20 bp, Homo sapiens
acatatgcaccttgtgtctg

SEQ ID NO: 3017583 - DNA, 16 bp, Homo sapiens
acatatgtagaaacat

SEQ ID NO: 3017584 - DNA, 19 bp, Homo sapiens
acatatgtagaaacattta

SEQ ID NO: 3017585 - DNA, 13 bp, Homo sapiens
acatatgtgaata

SEQ ID NO: 3017586 - DNA, 23 bp, Homo sapiens
acatatgttaataaactgcaaat

SEQ ID NO: 3017587 - DNA, 18 bp, Homo sapiens
acatattgaaaaaatcaa

SEQ ID NO: 3017588 - DNA, 14 bp, Homo sapiens
acatatttaactgg

SEQ ID NO: 3017589 - DNA, 15 bp, Homo sapiens
acatatttaactggt

SEQ ID NO: 3017590 - DNA, 20 bp, Homo sapiens
acatatttaatgttttaaat

SEQ ID NO: 3017591 - DNA, 13 bp, Homo sapiens
acatattttacat

SEQ ID NO: 3017592 - DNA, 17 bp, Homo sapiens
acatattttacatctga

SEQ ID NO: 3017593 - DNA, 17 bp, Homo sapiens
acatattttattaagaa

SEQ ID NO: 3017594 - DNA, 14 bp, Homo sapiens
acatcaagcatcat

SEQ ID NO: 3017595 - DNA, 15 bp, Homo sapiens
acatcacagggtggg

SEQ ID NO: 3017596 - DNA, 16 bp, Homo sapiens
acatcaccaggtgcat

SEQ ID NO: 3017597 - DNA, 17 bp, Homo sapiens
acatcacgaaggaaaac

SEQ ID NO: 3017598 - DNA, 19 bp, Homo sapiens
acatcactctcaccttcca

SEQ ID NO: 3017599 - DNA, 13 bp, Homo sapiens
acatcactgtata

SEQ ID NO: 3017600 - DNA, 12 bp, Homo sapiens
acatcacttcct

SEQ ID NO: 3017601 - DNA, 17 bp, Homo sapiens
acatcagaactgaaata

SEQ ID NO: 3017602 - DNA, 21 bp, Homo sapiens
acatcagaagtaactcccact

SEQ ID NO: 3017603 - DNA, 13 bp, Homo sapiens
acatcagcatgtt

SEQ ID NO: 3017604 - DNA, 16 bp, Homo sapiens
acatcagcatgttttc

SEQ ID NO: 3017605 - DNA, 17 bp, Homo sapiens
acatcagcatgttttct

SEQ ID NO: 3017606 - DNA, 24 bp, Homo sapiens
acatcagcatgttttctgctttaa

SEQ ID NO: 3017607 - DNA, 13 bp, Homo sapiens
acatcagccagct

SEQ ID NO: 3017608 - DNA, 15 bp, Homo sapiens
acatcagccagctgc

SEQ ID NO: 3017609 - DNA, 18 bp, Homo sapiens
acatcagccatttttaga

SEQ ID NO: 3017610 - DNA, 20 bp, Homo sapiens
acatcagcctccttctttca

SEQ ID NO: 3017611 - DNA, 12 bp, Homo sapiens
acatcagccttc

SEQ ID NO: 3017612 - DNA, 20 bp, Homo sapiens
acatcagccttcaagaatca

SEQ ID NO: 3017613 - DNA, 21 bp, Homo sapiens
acatcatcaggaagcctgtgg

SEQ ID NO: 3017614 - DNA, 18 bp, Homo sapiens
acatccaaagcagacagc

SEQ ID NO: 3017615 - DNA, 17 bp, Homo sapiens
acatccataaagaagca

SEQ ID NO: 3017616 - DNA, 16 bp, Homo sapiens
acatcccactggatct

SEQ ID NO: 3017617 - DNA, 20 bp, Homo sapiens
acatcccactggatctggct

SEQ ID NO: 3017618 - DNA, 17 bp, Homo sapiens
acatcccattgccctgg

SEQ ID NO: 3017619 - DNA, 18 bp, Homo sapiens
acatcccattgccctggt

SEQ ID NO: 3017620 - DNA, 15 bp, Homo sapiens
acatccccagagccc

SEQ ID NO: 3017621 - DNA, 20 bp, Homo sapiens
acatccccagagcccagctc

SEQ ID NO: 3017622 - DNA, 13 bp, Homo sapiens
acatccctccccc

SEQ ID NO: 3017623 - DNA, 17 bp, Homo sapiens
acatccgcgtgtgcctg

SEQ ID NO: 3017624 - DNA, 23 bp, Homo sapiens
acatcctgtgtttctagggaaat

SEQ ID NO: 3017625 - DNA, 12 bp, Homo sapiens
acatctaaattg

SEQ ID NO: 3017626 - DNA, 18 bp, Homo sapiens
acatctaaattgatcatt

SEQ ID NO: 3017627 - DNA, 16 bp, Homo sapiens
acatctaacctcatct

SEQ ID NO: 3017628 - DNA, 13 bp, Homo sapiens
acatctaagcctg

SEQ ID NO: 3017629 - DNA, 15 bp, Homo sapiens
acatctaagcctgaa

SEQ ID NO: 3017630 - DNA, 22 bp, Homo sapiens
acatctcccccatagcaccctg

SEQ ID NO: 3017631 - DNA, 12 bp, Homo sapiens
acatctgtgcag

SEQ ID NO: 3017632 - DNA, 19 bp, Homo sapiens
acatctgtgcagggctggt

SEQ ID NO: 3017633 - DNA, 17 bp, Homo sapiens
acatctgtgtctctgga

SEQ ID NO: 3017634 - DNA, 14 bp, Homo sapiens
acatcttcatataa

SEQ ID NO: 3017635 - DNA, 16 bp, Homo sapiens
acatcttcatataaac

SEQ ID NO: 3017636 - DNA, 17 bp, Homo sapiens
acatcttcatataaact

SEQ ID NO: 3017637 - DNA, 24 bp, Homo sapiens
acatcttccatttccatgtcccct

SEQ ID NO: 3017638 - DNA, 15 bp, Homo sapiens
acatcttttttcaca

SEQ ID NO: 3017639 - DNA, 12 bp, Homo sapiens
acatgaaaacat

SEQ ID NO: 3017640 - DNA, 15 bp, Homo sapiens
acatgaaaacattga

SEQ ID NO: 3017641 - DNA, 14 bp, Homo sapiens
acatgaaaagttat

SEQ ID NO: 3017642 - DNA, 20 bp, Homo sapiens
acatgaaacctacacactgt

SEQ ID NO: 3017643 - DNA, 23 bp, Homo sapiens
acatgaaacctacacactgtcat

SEQ ID NO: 3017644 - DNA, 22 bp, Homo sapiens
acatgaaagaacccaagacatc

SEQ ID NO: 3017645 - DNA, 17 bp, Homo sapiens
acatgaagattctttcc

SEQ ID NO: 3017646 - DNA, 18 bp, Homo sapiens
acatgaatcaaaagtgcc

SEQ ID NO: 3017647 - DNA, 20 bp, Homo sapiens
acatgaatcccacccacatg

SEQ ID NO: 3017648 - DNA, 19 bp, Homo sapiens
acatgaccctaaatcttga

SEQ ID NO: 3017649 - DNA, 14 bp, Homo sapiens
acatgaccctctgt

SEQ ID NO: 3017650 - DNA, 15 bp, Homo sapiens
acatgaccctctgtc

SEQ ID NO: 3017651 - DNA, 22 bp, Homo sapiens
acatgaccctctgtccccaggc

SEQ ID NO: 3017652 - DNA, 22 bp, Homo sapiens
acatgagaaagggagaggaaga

SEQ ID NO: 3017653 - DNA, 23 bp, Homo sapiens
acatgagatgtgtggactgtggc

SEQ ID NO: 3017654 - DNA, 18 bp, Homo sapiens
acatgaggaagtagctgt

SEQ ID NO: 3017655 - DNA, 18 bp, Homo sapiens
acatgatgaaaaattata

SEQ ID NO: 3017656 - DNA, 13 bp, Homo sapiens
acatgatttcctt

SEQ ID NO: 3017657 - DNA, 23 bp, Homo sapiens
acatgatttccttgaatgtggct

SEQ ID NO: 3017658 - DNA, 16 bp, Homo sapiens
acatgcagctctgcag

SEQ ID NO: 3017659 - DNA, 19 bp, Homo sapiens
acatgcagtttgaaattct

SEQ ID NO: 3017660 - DNA, 22 bp, Homo sapiens
acatgcagtttgaaattctgaa

SEQ ID NO: 3017661 - DNA, 23 bp, Homo sapiens
acatgcagtttgaaattctgaat

SEQ ID NO: 3017662 - DNA, 14 bp, Homo sapiens
acatgcatacacac

SEQ ID NO: 3017663 - DNA, 21 bp, Homo sapiens
acatgcatacttcaaaagtat

SEQ ID NO: 3017664 - DNA, 16 bp, Homo sapiens
acatgccctgtgtggc

SEQ ID NO: 3017665 - DNA, 17 bp, Homo sapiens
acatgccctgtgtggct

SEQ ID NO: 3017666 - DNA, 23 bp, Homo sapiens
acatgcctgattttaaaaggttg

SEQ ID NO: 3017667 - DNA, 13 bp, Homo sapiens
acatgcgggctcg

SEQ ID NO: 3017668 - DNA, 16 bp, Homo sapiens
acatgcgggctcgccc

SEQ ID NO: 3017669 - DNA, 17 bp, Homo sapiens
acatgcggtagccagca

SEQ ID NO: 3017670 - DNA, 23 bp, Homo sapiens
acatgcggtagccagcacacagg

SEQ ID NO: 3017671 - DNA, 15 bp, Homo sapiens
acatgctaaataact

SEQ ID NO: 3017672 - DNA, 17 bp, Homo sapiens
acatgctaaataactat

SEQ ID NO: 3017673 - DNA, 15 bp, Homo sapiens
acatgcttgaatgga

SEQ ID NO: 3017674 - DNA, 15 bp, Homo sapiens
acatggaaacccata

SEQ ID NO: 3017675 - DNA, 18 bp, Homo sapiens
accttccccagacttgca

SEQ ID NO: 3017676 - DNA, 13 bp, Homo sapiens
accttcctttttt

SEQ ID NO: 3017677 - DNA, 17 bp, Homo sapiens
accttcgggctgtgccc

SEQ ID NO: 3017678 - DNA, 18 bp, Homo sapiens
accttcgggctgtgcccg

SEQ ID NO: 3017679 - DNA, 21 bp, Homo sapiens
accttcgtttactatgcctgt

SEQ ID NO: 3017680 - DNA, 23 bp, Homo sapiens
accttcgtttactatgcctgtgt

SEQ ID NO: 3017681 - DNA, 15 bp, Homo sapiens
accttctgagtacag

SEQ ID NO: 3017682 - DNA, 18 bp, Homo sapiens
accttcttcaggctgcct

SEQ ID NO: 3017683 - DNA, 14 bp, Homo sapiens
accttgaaggtctg

SEQ ID NO: 3017684 - DNA, 17 bp, Homo sapiens
accttgaaggtctgtca

SEQ ID NO: 3017685 - DNA, 13 bp, Homo sapiens
accttgacagagc

SEQ ID NO: 3017686 - DNA, 16 bp, Homo sapiens
accttgacagagcagc

SEQ ID NO: 3017687 - DNA, 15 bp, Homo sapiens
accttgaggagaagt

SEQ ID NO: 3017688 - DNA, 12 bp, Homo sapiens
accttgattttc

SEQ ID NO: 3017689 - DNA, 16 bp, Homo sapiens
accttgattttcttct

SEQ ID NO: 3017690 - DNA, 17 bp, Homo sapiens
accttgccaattagtaa

SEQ ID NO: 3017691 - DNA, 21 bp, Homo sapiens
accttgccacccattcttccc

SEQ ID NO: 3017692 - DNA, 18 bp, Homo sapiens
accttgctgcagtgtcca

SEQ ID NO: 3017693 - DNA, 22 bp, Homo sapiens
accttgcttcttactgataatt

SEQ ID NO: 3017694 - DNA, 18 bp, Homo sapiens
accttggagcatttatgt

SEQ ID NO: 3017695 - DNA, 22 bp, Homo sapiens
accttggagcatttatgtagac

SEQ ID NO: 3017696 - DNA, 14 bp, Homo sapiens
accttggcccagga

SEQ ID NO: 3017697 - DNA, 16 bp, Homo sapiens
accttggcttgttatt

SEQ ID NO: 3017698 - DNA, 15 bp, Homo sapiens
accttgggaccaaag

SEQ ID NO: 3017699 - DNA, 14 bp, Homo sapiens
accttgggccctgg

SEQ ID NO: 3017700 - DNA, 15 bp, Homo sapiens
accttgtaaaagaca

SEQ ID NO: 3017701 - DNA, 18 bp, Homo sapiens
accttgtgagggagagaa

SEQ ID NO: 3017702 - DNA, 12 bp, Homo sapiens
accttgtgcctg

SEQ ID NO: 3017703 - DNA, 12 bp, Homo sapiens
accttgtggtct

SEQ ID NO: 3017704 - DNA, 12 bp, Homo sapiens
accttgtgtctg

SEQ ID NO: 3017705 - DNA, 13 bp, Homo sapiens
accttgtgtggcg

SEQ ID NO: 3017706 - DNA, 23 bp, Homo sapiens
accttgtgtggcgcacttcagaa

SEQ ID NO: 3017707 - DNA, 16 bp, Homo sapiens
accttgtttctttctg

SEQ ID NO: 3017708 - DNA, 14 bp, Homo sapiens
accttgttttgcca

SEQ ID NO: 3017709 - DNA, 21 bp, Homo sapiens
acctttaaaaagcaggaaata

SEQ ID NO: 3017710 - DNA, 15 bp, Homo sapiens
acctttaaaaatgta

SEQ ID NO: 3017711 - DNA, 16 bp, Homo sapiens
acctttaaaaatgtat

SEQ ID NO: 3017712 - DNA, 19 bp, Homo sapiens
acctttaaaaatgtataat

SEQ ID NO: 3017713 - DNA, 18 bp, Homo sapiens
acctttaccccatccctg

SEQ ID NO: 3017714 - DNA, 21 bp, Homo sapiens
acctttagaaactcaaaaact

SEQ ID NO: 3017715 - DNA, 20 bp, Homo sapiens
acctttatcacctcattctg

SEQ ID NO: 3017716 - DNA, 15 bp, Homo sapiens
acctttatccctgct

SEQ ID NO: 3017717 - DNA, 18 bp, Homo sapiens
acctttatccctgcttat

SEQ ID NO: 3017718 - DNA, 13 bp, Homo sapiens
acctttatgaggt

SEQ ID NO: 3017719 - DNA, 17 bp, Homo sapiens
acctttattcttttcca

SEQ ID NO: 3017720 - DNA, 18 bp, Homo sapiens
acctttcataatctttgc

SEQ ID NO: 3017721 - DNA, 23 bp, Homo sapiens
acctttccaaagttaacagattt

SEQ ID NO: 3017722 - DNA, 22 bp, Homo sapiens
acctttcccactttcttctacc

SEQ ID NO: 3017723 - DNA, 14 bp, Homo sapiens
acctttcccatttc

SEQ ID NO: 3017724 - DNA, 15 bp, Homo sapiens
acctttctagttgaa

SEQ ID NO: 3017725 - DNA, 16 bp, Homo sapiens
acctttctccactggg

SEQ ID NO: 3017726 - DNA, 23 bp, Homo sapiens
acctttctcctttgtactttgtg

SEQ ID NO: 3017727 - DNA, 18 bp, Homo sapiens
acctttctgacatcagca

SEQ ID NO: 3017728 - DNA, 15 bp, Homo sapiens
acctttgcccacaca

SEQ ID NO: 3017729 - DNA, 18 bp, Homo sapiens
acctttgctatgtaaggg

SEQ ID NO: 3017730 - DNA, 22 bp, Homo sapiens
acctttgtagcactcaggctct

SEQ ID NO: 3017731 - DNA, 15 bp, Homo sapiens
accttttatcaataa

SEQ ID NO: 3017732 - DNA, 16 bp, Homo sapiens
accttttattgacaca

SEQ ID NO: 3017733 - DNA, 22 bp, Homo sapiens
accttttgataaaatgttcctt

SEQ ID NO: 3017734 - DNA, 20 bp, Homo sapiens
acctttttatattttatact

SEQ ID NO: 3017735 - DNA, 14 bp, Homo sapiens
acctttttccttcc

SEQ ID NO: 3017736 - DNA, 15 bp, Homo sapiens
acctttttccttcct

SEQ ID NO: 3017737 - DNA, 18 bp, Homo sapiens
accttttttcaacagtga

SEQ ID NO: 3017738 - DNA, 14 bp, Homo sapiens
acgaagtgttgcat

SEQ ID NO: 3017739 - DNA, 19 bp, Homo sapiens
acgaatgcatattcaacac

SEQ ID NO: 3017740 - DNA, 16 bp, Homo sapiens
acgaattccatcttgt

SEQ ID NO: 3017741 - DNA, 14 bp, Homo sapiens
acgacccctgcctc

SEQ ID NO: 3017742 - DNA, 20 bp, Homo sapiens
acgaggaatctgtgggtctg

SEQ ID NO: 3017743 - DNA, 14 bp, Homo sapiens
acgagggctggctg

SEQ ID NO: 3017744 - DNA, 20 bp, Homo sapiens
acgagggctggctggcctca

SEQ ID NO: 3017745 - DNA, 10 bp, Homo sapiens
acgaggggac

SEQ ID NO: 3017746 - DNA, 17 bp, Homo sapiens
acgagtcaatcccctca

SEQ ID NO: 3017747 - DNA, 14 bp, Homo sapiens
acgataaggaagaa

SEQ ID NO: 3017748 - DNA, 17 bp, Homo sapiens
acgataaggaagaaaca

SEQ ID NO: 3017749 - DNA, 19 bp, Homo sapiens
acgatatttcgtttggtct

SEQ ID NO: 3017750 - DNA, 14 bp, Homo sapiens
acgatcaggcacag

SEQ ID NO: 3017751 - DNA, 17 bp, Homo sapiens
acgatcaggcacaggtc

SEQ ID NO: 3017752 - DNA, 18 bp, Homo sapiens
acgatcaggcacaggtca

SEQ ID NO: 3017753 - DNA, 16 bp, Homo sapiens
acgatgtggccctggc

SEQ ID NO: 3017754 - DNA, 15 bp, Homo sapiens
acgattatgactaaa

SEQ ID NO: 3017755 - DNA, 17 bp, Homo sapiens
acgatttaattctcttg

SEQ ID NO: 3017756 - DNA, 18 bp, Homo sapiens
acgcaaactttgagcctt

SEQ ID NO: 3017757 - DNA, 12 bp, Homo sapiens
acgcaaggaagg

SEQ ID NO: 3017758 - DNA, 13 bp, Homo sapiens
acgcaaggaagga

SEQ ID NO: 3017759 - DNA, 14 bp, Homo sapiens
acgcaaggaaggac

SEQ ID NO: 3017760 - DNA, 19 bp, Homo sapiens
acgcacatatacacacaca

SEQ ID NO: 3017761 - DNA, 12 bp, Homo sapiens
acgcacctccac

SEQ ID NO: 3017762 - DNA, 16 bp, Homo sapiens
acgcacctccacgcca

SEQ ID NO: 3017763 - DNA, 22 bp, Homo sapiens
acgcacctccacgccactgcct

SEQ ID NO: 3017764 - DNA, 19 bp, Homo sapiens
acgcacctcccatcctaat

SEQ ID NO: 3017765 - DNA, 14 bp, Homo sapiens
acgcacctgtagtc

SEQ ID NO: 3017766 - DNA, 17 bp, Homo sapiens
acgcacctgtagtccca

SEQ ID NO: 3017767 - DNA, 14 bp, Homo sapiens
acgcagaagagggg

SEQ ID NO: 3017768 - DNA, 14 bp, Homo sapiens
acgcagagattttc

SEQ ID NO: 3017769 - DNA, 20 bp, Homo sapiens
acgcagagattttcatctat

SEQ ID NO: 3017770 - DNA, 21 bp, Homo sapiens
acgcagagattttcatctatt

SEQ ID NO: 3017771 - DNA, 14 bp, Homo sapiens
acgcagcaggaggc

SEQ ID NO: 3017772 - DNA, 21 bp, Homo sapiens
acgcagcaggaggccaggccg

SEQ ID NO: 3017773 - DNA, 15 bp, Homo sapiens
acgcaggaagcctac

SEQ ID NO: 3017774 - DNA, 19 bp, Homo sapiens
acgcaggcccctctcctcc

SEQ ID NO: 3017775 - DNA, 21 bp, Homo sapiens
acgcaggcccctctcctccgt

SEQ ID NO: 3017776 - DNA, 16 bp, Homo sapiens
acgcaggccctgtcca

SEQ ID NO: 3017777 - DNA, 17 bp, Homo sapiens
acgcaggccctgtccag

SEQ ID NO: 3017778 - DNA, 14 bp, Homo sapiens
acgcaggcggccag

SEQ ID NO: 3017779 - DNA, 15 bp, Homo sapiens
acgcaggcggccagg

SEQ ID NO: 3017780 - DNA, 16 bp, Homo sapiens
acgcaggcggccaggg

SEQ ID NO: 3017781 - DNA, 18 bp, Homo sapiens
acgcaggcggccagggcg

SEQ ID NO: 3017782 - DNA, 17 bp, Homo sapiens
acgccaataataaaaaa

SEQ ID NO: 3017783 - DNA, 20 bp, Homo sapiens
acgccacccccgcccccacc

SEQ ID NO: 3017784 - DNA, 16 bp, Homo sapiens
acgccagacttcccac

SEQ ID NO: 3017785 - DNA, 22 bp, Homo sapiens
acgccattctcctgcctcagcc

SEQ ID NO: 3017786 - DNA, 19 bp, Homo sapiens
acgccattgtactccagcc

SEQ ID NO: 3017787 - DNA, 20 bp, Homo sapiens
acgccattgtactccagcct

SEQ ID NO: 3017788 - DNA, 14 bp, Homo sapiens
acgcccccccccac

SEQ ID NO: 3017789 - DNA, 23 bp, Homo sapiens
acgcccccccccacccctggggg

SEQ ID NO: 3017790 - DNA, 22 bp, Homo sapiens
acgccccgctgtgtcctccctc

SEQ ID NO: 3017791 - DNA, 16 bp, Homo sapiens
acgccgccttggcctt

SEQ ID NO: 3017792 - DNA, 20 bp, Homo sapiens
acgccgccttggccttgcag

SEQ ID NO: 3017793 - DNA, 19 bp, Homo sapiens
acgccgggagaagccacct

SEQ ID NO: 3017794 - DNA, 14 bp, Homo sapiens
acgcctcccactgg

SEQ ID NO: 3017795 - DNA, 14 bp, Homo sapiens
acgcctgcaaacgc

SEQ ID NO: 3017796 - DNA, 19 bp, Homo sapiens
acgcctgcaaacgctgcct

SEQ ID NO: 3017797 - DNA, 20 bp, Homo sapiens
acgcctgcaaacgctgcctg

SEQ ID NO: 3017798 - DNA, 19 bp, Homo sapiens
acgcctgtaatcccagcac

SEQ ID NO: 3017799 - DNA, 16 bp, Homo sapiens
acgcctgttgttttgg

SEQ ID NO: 3017800 - DNA, 19 bp, Homo sapiens
acgcgaaaccaattcctca

SEQ ID NO: 3017801 - DNA, 19 bp, Homo sapiens
acgcgcagatgtgcagcag

SEQ ID NO: 3017802 - DNA, 20 bp, Homo sapiens
acgcgcccccctcccagagg

SEQ ID NO: 3017803 - DNA, 13 bp, Homo sapiens
acgcggttttttc

SEQ ID NO: 3017804 - DNA, 12 bp, Homo sapiens
acgcgtatttac

SEQ ID NO: 3017805 - DNA, 16 bp, Homo sapiens
acgctagattaaaata

SEQ ID NO: 3017806 - DNA, 11 bp, Homo sapiens
acgctccagct

SEQ ID NO: 3017807 - DNA, 11 bp, Homo sapiens
acgctcccctc

SEQ ID NO: 3017808 - DNA, 21 bp, Homo sapiens
actcagacgtgtgacctccat

SEQ ID NO: 3017809 - DNA, 24 bp, Homo sapiens
actcagacgtgtgacctccatact

SEQ ID NO: 3017810 - DNA, 20 bp, Homo sapiens
actcagagaaccagtgcaga

SEQ ID NO: 3017811 - DNA, 14 bp, Homo sapiens
actcagagctgcgg

SEQ ID NO: 3017812 - DNA, 15 bp, Homo sapiens
actcagagctgcggg

SEQ ID NO: 3017813 - DNA, 16 bp, Homo sapiens
actcagatccagggac

SEQ ID NO: 3017814 - DNA, 17 bp, Homo sapiens
actcagatccagggaca

SEQ ID NO: 3017815 - DNA, 19 bp, Homo sapiens
actcagatccagggacaga

SEQ ID NO: 3017816 - DNA, 13 bp, Homo sapiens
actcagcagaggc

SEQ ID NO: 3017817 - DNA, 18 bp, Homo sapiens
actcagcagaggcagtgg

SEQ ID NO: 3017818 - DNA, 14 bp, Homo sapiens
actcagcagcagag

SEQ ID NO: 3017819 - DNA, 16 bp, Homo sapiens
actcagcagcagagag

SEQ ID NO: 3017820 - DNA, 17 bp, Homo sapiens
actcagcagcagagagc

SEQ ID NO: 3017821 - DNA, 13 bp, Homo sapiens
actcagcagccct

SEQ ID NO: 3017822 - DNA, 20 bp, Homo sapiens
actcagcagccctcctcacc

SEQ ID NO: 3017823 - DNA, 14 bp, Homo sapiens
actcagcagcctgc

SEQ ID NO: 3017824 - DNA, 17 bp, Homo sapiens
actcagcagcctgcgct

SEQ ID NO: 3017825 - DNA, 15 bp, Homo sapiens
actcagccaagcaca

SEQ ID NO: 3017826 - DNA, 18 bp, Homo sapiens
actcagccaagcacagtg

SEQ ID NO: 3017827 - DNA, 15 bp, Homo sapiens
actcagccctgggcc

SEQ ID NO: 3017828 - DNA, 16 bp, Homo sapiens
actcagcctgcagtta

SEQ ID NO: 3017829 - DNA, 17 bp, Homo sapiens
actcagcctgcagttaa

SEQ ID NO: 3017830 - DNA, 19 bp, Homo sapiens
actcagctctgacattctg

SEQ ID NO: 3017831 - DNA, 20 bp, Homo sapiens
actcaggaggctgaggcaga

SEQ ID NO: 3017832 - DNA, 21 bp, Homo sapiens
actcaggcctgtgtgactcca

SEQ ID NO: 3017833 - DNA, 13 bp, Homo sapiens
actcagggcagct

SEQ ID NO: 3017834 - DNA, 16 bp, Homo sapiens
actcagggcagctgcc

SEQ ID NO: 3017835 - DNA, 18 bp, Homo sapiens
actcagggcagctgcctg

SEQ ID NO: 3017836 - DNA, 19 bp, Homo sapiens
actcagggcagctgcctgg

SEQ ID NO: 3017837 - DNA, 17 bp, Homo sapiens
actcataaatactaact

SEQ ID NO: 3017838 - DNA, 15 bp, Homo sapiens
actcataatgtgaag

SEQ ID NO: 3017839 - DNA, 19 bp, Homo sapiens
actcataatgtgaagtgtt

SEQ ID NO: 3017840 - DNA, 18 bp, Homo sapiens
actcatcctgaacagcat

SEQ ID NO: 3017841 - DNA, 23 bp, Homo sapiens
actcatgactgagtctggcaaac

SEQ ID NO: 3017842 - DNA, 14 bp, Homo sapiens
actcatgaggaggg

SEQ ID NO: 3017843 - DNA, 13 bp, Homo sapiens
actcatgtgtatg

SEQ ID NO: 3017844 - DNA, 19 bp, Homo sapiens
actcattaaatattctgta

SEQ ID NO: 3017845 - DNA, 23 bp, Homo sapiens
actcattaaatattctgtacatt

SEQ ID NO: 3017846 - DNA, 13 bp, Homo sapiens
actcattagactg

SEQ ID NO: 3017847 - DNA, 15 bp, Homo sapiens
actcattagactgga

SEQ ID NO: 3017848 - DNA, 17 bp, Homo sapiens
actcattcacatttcaa

SEQ ID NO: 3017849 - DNA, 15 bp, Homo sapiens
actcattgaaatgta

SEQ ID NO: 3017850 - DNA, 23 bp, Homo sapiens
actcattgctgagcctctgctcc

SEQ ID NO: 3017851 - DNA, 18 bp, Homo sapiens
actccaaaatctggcttt

SEQ ID NO: 3017852 - DNA, 15 bp, Homo sapiens
actccaacctaacct

SEQ ID NO: 3017853 - DNA, 23 bp, Homo sapiens
actccaacctaacctgtgtctgc

SEQ ID NO: 3017854 - DNA, 18 bp, Homo sapiens
actccaacctctcggccc

SEQ ID NO: 3017855 - DNA, 19 bp, Homo sapiens
actccaagatatggacaca

SEQ ID NO: 3017856 - DNA, 20 bp, Homo sapiens
actccaccaacccatcagaa

SEQ ID NO: 3017857 - DNA, 12 bp, Homo sapiens
actccagagaag

SEQ ID NO: 3017858 - DNA, 12 bp, Homo sapiens
actccagcctgg

SEQ ID NO: 3017859 - DNA, 13 bp, Homo sapiens
actccagcctggg

SEQ ID NO: 3017860 - DNA, 15 bp, Homo sapiens
actccagcctgggca

SEQ ID NO: 3017861 - DNA, 16 bp, Homo sapiens
actccagcctgggcaa

SEQ ID NO: 3017862 - DNA, 14 bp, Homo sapiens
actccagcctgggt

SEQ ID NO: 3017863 - DNA, 17 bp, Homo sapiens
actccagctggtgcccc

SEQ ID NO: 3017864 - DNA, 14 bp, Homo sapiens
actccaggccagct

SEQ ID NO: 3017865 - DNA, 14 bp, Homo sapiens
actccaggcccaag

SEQ ID NO: 3017866 - DNA, 15 bp, Homo sapiens
actccaggctgggct

SEQ ID NO: 3017867 - DNA, 19 bp, Homo sapiens
actccaggctgggctgagc

SEQ ID NO: 3017868 - DNA, 19 bp, Homo sapiens
actccagggtcccctgcca

SEQ ID NO: 3017869 - DNA, 18 bp, Homo sapiens
actccagttaaaaaaaat

SEQ ID NO: 3017870 - DNA, 20 bp, Homo sapiens
actccagttaaaaaaaattt

SEQ ID NO: 3017871 - DNA, 11 bp, Homo sapiens
actccatctct

SEQ ID NO: 3017872 - DNA, 21 bp, Homo sapiens
actccatctctcatcctccag

SEQ ID NO: 3017873 - DNA, 16 bp, Homo sapiens
actccatctgacaaat

SEQ ID NO: 3017874 - DNA, 14 bp, Homo sapiens
actccatggttctc

SEQ ID NO: 3017875 - DNA, 22 bp, Homo sapiens
actcccacccagtctctgctcc

SEQ ID NO: 3017876 - DNA, 22 bp, Homo sapiens
actcccattcctgaagaaccag

SEQ ID NO: 3017877 - DNA, 17 bp, Homo sapiens
actccccgaagtctttt

SEQ ID NO: 3017878 - DNA, 23 bp, Homo sapiens
actcccctgtttcaatcactgtc

SEQ ID NO: 3017879 - DNA, 22 bp, Homo sapiens
actcccgccccgggctggccct

SEQ ID NO: 3017880 - DNA, 22 bp, Homo sapiens
actcccggggtccccgccctct

SEQ ID NO: 3017881 - DNA, 14 bp, Homo sapiens
actccctaggccca

SEQ ID NO: 3017882 - DNA, 16 bp, Homo sapiens
actccctaggcccaag

SEQ ID NO: 3017883 - DNA, 17 bp, Homo sapiens
actccctaggcccaagt

SEQ ID NO: 3017884 - DNA, 13 bp, Homo sapiens
actccctccagca

SEQ ID NO: 3017885 - DNA, 16 bp, Homo sapiens
actccctccagcacaa

SEQ ID NO: 3017886 - DNA, 16 bp, Homo sapiens
actccctccccaccca

SEQ ID NO: 3017887 - DNA, 10 bp, Homo sapiens
actccctcct

SEQ ID NO: 3017888 - DNA, 13 bp, Homo sapiens
actccctcctcac

SEQ ID NO: 3017889 - DNA, 20 bp, Homo sapiens
actccctcctcacactccag

SEQ ID NO: 3017890 - DNA, 12 bp, Homo sapiens
actccctggcct

SEQ ID NO: 3017891 - DNA, 23 bp, Homo sapiens
actcccttccctctctcccattt

SEQ ID NO: 3017892 - DNA, 13 bp, Homo sapiens
actcccttctgct

SEQ ID NO: 3017893 - DNA, 17 bp, Homo sapiens
actcccttgtgttcctt

SEQ ID NO: 3017894 - DNA, 17 bp, Homo sapiens
actccgctcactgaact

SEQ ID NO: 3017895 - DNA, 14 bp, Homo sapiens
actccggccctcct

SEQ ID NO: 3017896 - DNA, 19 bp, Homo sapiens
actccgtgaggctgctgcc

SEQ ID NO: 3017897 - DNA, 20 bp, Homo sapiens
actccgtgaggctgctgcca

SEQ ID NO: 3017898 - DNA, 18 bp, Homo sapiens
actcctaacctcaagtga

SEQ ID NO: 3017899 - DNA, 19 bp, Homo sapiens
actcctccccaccctcctg

SEQ ID NO: 3017900 - DNA, 20 bp, Homo sapiens
actcctccccaccctcctgg

SEQ ID NO: 3017901 - DNA, 13 bp, Homo sapiens
actcctccctccg

SEQ ID NO: 3017902 - DNA, 14 bp, Homo sapiens
actcctcctagcca

SEQ ID NO: 3017903 - DNA, 14 bp, Homo sapiens
actcctcctgccag

SEQ ID NO: 3017904 - DNA, 18 bp, Homo sapiens
actcctcctgccagctct

SEQ ID NO: 3017905 - DNA, 20 bp, Homo sapiens
actcctctgactcagggctc

SEQ ID NO: 3017906 - DNA, 22 bp, Homo sapiens
actcctgaaatgccaagtgcct

SEQ ID NO: 3017907 - DNA, 15 bp, Homo sapiens
actcctgacctcaag

SEQ ID NO: 3017908 - DNA, 18 bp, Homo sapiens
actcctgacctcaagtga

SEQ ID NO: 3017909 - DNA, 19 bp, Homo sapiens
actcctgaggacagctgtc

SEQ ID NO: 3017910 - DNA, 11 bp, Homo sapiens
actcctgccag

SEQ ID NO: 3017911 - DNA, 16 bp, Homo sapiens
actcctgccagcccgg

SEQ ID NO: 3017912 - DNA, 12 bp, Homo sapiens
actcctggaaat

SEQ ID NO: 3017913 - DNA, 14 bp, Homo sapiens
actcctggaggctg

SEQ ID NO: 3017914 - DNA, 21 bp, Homo sapiens
actccttccccttgtccctgg

SEQ ID NO: 3017915 - DNA, 12 bp, Homo sapiens
actccttgcatc

SEQ ID NO: 3017916 - DNA, 19 bp, Homo sapiens
actcgaggactgtatttgt

SEQ ID NO: 3017917 - DNA, 17 bp, Homo sapiens
actcgcttgctagaagt

SEQ ID NO: 3017918 - DNA, 19 bp, Homo sapiens
actcgtatagcatgcatct

SEQ ID NO: 3017919 - DNA, 23 bp, Homo sapiens
actcgtgtctggcacagcctggc

SEQ ID NO: 3017920 - DNA, 20 bp, Homo sapiens
actctagagtccaaggttta

SEQ ID NO: 3017921 - DNA, 13 bp, Homo sapiens
actctagattcca

SEQ ID NO: 3017922 - DNA, 14 bp, Homo sapiens
actctagattccat

SEQ ID NO: 3017923 - DNA, 20 bp, Homo sapiens
actctatagtaggcatgtta

SEQ ID NO: 3017924 - DNA, 22 bp, Homo sapiens
actctcacactggttctcaatg

SEQ ID NO: 3017925 - DNA, 20 bp, Homo sapiens
actctcaccccaagcggcct

SEQ ID NO: 3017926 - DNA, 22 bp, Homo sapiens
actctcaggaccaaagctttca

SEQ ID NO: 3017927 - DNA, 16 bp, Homo sapiens
actctcagtctctgag

SEQ ID NO: 3017928 - DNA, 14 bp, Homo sapiens
actctcattcccca

SEQ ID NO: 3017929 - DNA, 21 bp, Homo sapiens
actctcattccccaggtggct

SEQ ID NO: 3017930 - DNA, 14 bp, Homo sapiens
actctccaacctgg

SEQ ID NO: 3017931 - DNA, 20 bp, Homo sapiens
actctccccacgagggctgg

SEQ ID NO: 3017932 - DNA, 21 bp, Homo sapiens
actctccccacgagggctggc

SEQ ID NO: 3017933 - DNA, 22 bp, Homo sapiens
actctccccacgagggctggct

SEQ ID NO: 3017934 - DNA, 19 bp, Homo sapiens
actctcccctccccatctg

SEQ ID NO: 3017935 - DNA, 21 bp, Homo sapiens
actctcccctccccatctgtg

SEQ ID NO: 3017936 - DNA, 16 bp, Homo sapiens
actctcctatgccttt

SEQ ID NO: 3017937 - DNA, 18 bp, Homo sapiens
actctcgcatcttcccaa

SEQ ID NO: 3017938 - DNA, 14 bp, Homo sapiens
actctctaccagat

SEQ ID NO: 3017939 - DNA, 18 bp, Homo sapiens
actctctgaacccctccc

SEQ ID NO: 3017940 - DNA, 19 bp, Homo sapiens
actctctgaacccctccct

SEQ ID NO: 3017941 - DNA, 15 bp, Homo sapiens
acttgtatctgaaga

SEQ ID NO: 3017942 - DNA, 18 bp, Homo sapiens
acttgtcaagcctgtgca

SEQ ID NO: 3017943 - DNA, 14 bp, Homo sapiens
acttgtcacgaatt

SEQ ID NO: 3017944 - DNA, 18 bp, Homo sapiens
acttgtcacttgcatgtc

SEQ ID NO: 3017945 - DNA, 15 bp, Homo sapiens
acttgtcttgctctt

SEQ ID NO: 3017946 - DNA, 16 bp, Homo sapiens
acttgtgccagcccgg

SEQ ID NO: 3017947 - DNA, 17 bp, Homo sapiens
acttgtgtcattgatgt

SEQ ID NO: 3017948 - DNA, 14 bp, Homo sapiens
acttgttcatttct

SEQ ID NO: 3017949 - DNA, 21 bp, Homo sapiens
acttgttctcagagcactgtg

SEQ ID NO: 3017950 - DNA, 16 bp, Homo sapiens
actttaaaactgtatt

SEQ ID NO: 3017951 - DNA, 14 bp, Homo sapiens
actttaagaggaca

SEQ ID NO: 3017952 - DNA, 10 bp, Homo sapiens
actttaattt

SEQ ID NO: 3017953 - DNA, 18 bp, Homo sapiens
actttacactcggctttg

SEQ ID NO: 3017954 - DNA, 19 bp, Homo sapiens
actttaccagaggcataaa

SEQ ID NO: 3017955 - DNA, 16 bp, Homo sapiens
actttagaaagccagc

SEQ ID NO: 3017956 - DNA, 17 bp, Homo sapiens
actttagaaagctgaca

SEQ ID NO: 3017957 - DNA, 21 bp, Homo sapiens
actttagaagcacagtaaata

SEQ ID NO: 3017958 - DNA, 21 bp, Homo sapiens
actttagaagtagaattgaca

SEQ ID NO: 3017959 - DNA, 16 bp, Homo sapiens
actttagtgattgctt

SEQ ID NO: 3017960 - DNA, 18 bp, Homo sapiens
actttagtgattgctttt

SEQ ID NO: 3017961 - DNA, 17 bp, Homo sapiens
actttagtgtattttct

SEQ ID NO: 3017962 - DNA, 19 bp, Homo sapiens
actttatagttgttttata

SEQ ID NO: 3017963 - DNA, 17 bp, Homo sapiens
actttatgtagagaaaa

SEQ ID NO: 3017964 - DNA, 16 bp, Homo sapiens
actttatgtgtaaata

SEQ ID NO: 3017965 - DNA, 16 bp, Homo sapiens
actttattgcaatgca

SEQ ID NO: 3017966 - DNA, 18 bp, Homo sapiens
actttattgcaatgcaga

SEQ ID NO: 3017967 - DNA, 21 bp, Homo sapiens
actttattgccttttaatttt

SEQ ID NO: 3017968 - DNA, 21 bp, Homo sapiens
actttatttctgagcaaagca

SEQ ID NO: 3017969 - DNA, 23 bp, Homo sapiens
actttatttctgagcaaagcatc

SEQ ID NO: 3017970 - DNA, 12 bp, Homo sapiens
actttcagtttt

SEQ ID NO: 3017971 - DNA, 19 bp, Homo sapiens
actttcctcctgaggcttt

SEQ ID NO: 3017972 - DNA, 18 bp, Homo sapiens
actttcctggatgtctga

SEQ ID NO: 3017973 - DNA, 14 bp, Homo sapiens
actttcggagaaat

SEQ ID NO: 3017974 - DNA, 22 bp, Homo sapiens
actttcggagaaattctcttta

SEQ ID NO: 3017975 - DNA, 19 bp, Homo sapiens
actttcgtaatagctcaga

SEQ ID NO: 3017976 - DNA, 15 bp, Homo sapiens
actttctcttgttta

SEQ ID NO: 3017977 - DNA, 18 bp, Homo sapiens
actttcttctgaatattt

SEQ ID NO: 3017978 - DNA, 23 bp, Homo sapiens
actttctttaaattatgttttta

SEQ ID NO: 3017979 - DNA, 12 bp, Homo sapiens
actttgaataaa

SEQ ID NO: 3017980 - DNA, 19 bp, Homo sapiens
actttgaataaagaatact

SEQ ID NO: 3017981 - DNA, 20 bp, Homo sapiens
actttgaataaagaatactt

SEQ ID NO: 3017982 - DNA, 23 bp, Homo sapiens
actttgaataaagaatacttgaa

SEQ ID NO: 3017983 - DNA, 18 bp, Homo sapiens
actttgaatagtcctaaa

SEQ ID NO: 3017984 - DNA, 20 bp, Homo sapiens
actttgaatagtcctaaaaa

SEQ ID NO: 3017985 - DNA, 23 bp, Homo sapiens
actttgacaaaaatggttttgaa

SEQ ID NO: 3017986 - DNA, 21 bp, Homo sapiens
actttgcaggcggccctcagt

SEQ ID NO: 3017987 - DNA, 15 bp, Homo sapiens
actttgctctttctt

SEQ ID NO: 3017988 - DNA, 22 bp, Homo sapiens
actttgctggaaaatctgtaaa

SEQ ID NO: 3017989 - DNA, 20 bp, Homo sapiens
actttgcttgcagtagattt

SEQ ID NO: 3017990 - DNA, 20 bp, Homo sapiens
actttggatgacttgttcat

SEQ ID NO: 3017991 - DNA, 13 bp, Homo sapiens
actttggctgatt

SEQ ID NO: 3017992 - DNA, 21 bp, Homo sapiens
actttggctgatttaaaaagt

SEQ ID NO: 3017993 - DNA, 20 bp, Homo sapiens
actttggtcacccagactag

SEQ ID NO: 3017994 - DNA, 15 bp, Homo sapiens
actttgtcagaggca

SEQ ID NO: 3017995 - DNA, 20 bp, Homo sapiens
actttgtcgcccaggctgga

SEQ ID NO: 3017996 - DNA, 14 bp, Homo sapiens
actttgtctgaaaa

SEQ ID NO: 3017997 - DNA, 17 bp, Homo sapiens
actttgtctgaaaaatt

SEQ ID NO: 3017998 - DNA, 10 bp, Homo sapiens
actttgtgct

SEQ ID NO: 3017999 - DNA, 18 bp, Homo sapiens
actttgttggcccttcca

SEQ ID NO: 3018000 - DNA, 16 bp, Homo sapiens
actttgttgtttttaa

SEQ ID NO: 3018001 - DNA, 21 bp, Homo sapiens
actttgttttaaaaagcatca

SEQ ID NO: 3018002 - DNA, 15 bp, Homo sapiens
acttttaaaatttgt

SEQ ID NO: 3018003 - DNA, 20 bp, Homo sapiens
acttttaacgtatgtatttc

SEQ ID NO: 3018004 - DNA, 21 bp, Homo sapiens
acttttaacgtatgtatttca

SEQ ID NO: 3018005 - DNA, 21 bp, Homo sapiens
acttttaatccctatgtttgt

SEQ ID NO: 3018006 - DNA, 17 bp, Homo sapiens
acttttatatttgaaaa

SEQ ID NO: 3018007 - DNA, 22 bp, Homo sapiens
acttttatatttgaaaaaatta

SEQ ID NO: 3018008 - DNA, 21 bp, Homo sapiens
acttttatctattctgagaaa

SEQ ID NO: 3018009 - DNA, 20 bp, Homo sapiens
acttttattttacacagaaa

SEQ ID NO: 3018010 - DNA, 22 bp, Homo sapiens
acttttattttacacagaaaca

SEQ ID NO: 3018011 - DNA, 21 bp, Homo sapiens
acttttctcctgcatgtgtat

SEQ ID NO: 3018012 - DNA, 11 bp, Homo sapiens
acttttgcaag

SEQ ID NO: 3018013 - DNA, 15 bp, Homo sapiens
acttttgcaatctta

SEQ ID NO: 3018014 - DNA, 21 bp, Homo sapiens
acttttgcaatcttaagcaga

SEQ ID NO: 3018015 - DNA, 16 bp, Homo sapiens
actttttaaacagtgt

SEQ ID NO: 3018016 - DNA, 17 bp, Homo sapiens
actttttaaacagtgtt

SEQ ID NO: 3018017 - DNA, 13 bp, Homo sapiens
actttttattgcc

SEQ ID NO: 3018018 - DNA, 14 bp, Homo sapiens
actttttattgcct

SEQ ID NO: 3018019 - DNA, 23 bp, Homo sapiens
actttttggtaatatatatattt

SEQ ID NO: 3018020 - DNA, 15 bp, Homo sapiens
actttttgtgaagac

SEQ ID NO: 3018021 - DNA, 18 bp, Homo sapiens
actttttgtgaagacggc

SEQ ID NO: 3018022 - DNA, 17 bp, Homo sapiens
actttttgttccagagc

SEQ ID NO: 3018023 - DNA, 14 bp, Homo sapiens
actttttgtttctt

SEQ ID NO: 3018024 - DNA, 18 bp, Homo sapiens
acttttttaaatattttc

SEQ ID NO: 3018025 - DNA, 19 bp, Homo sapiens
acttttttaaatattttct

SEQ ID NO: 3018026 - DNA, 22 bp, Homo sapiens
actttttttttccaaaaaaata

SEQ ID NO: 3018027 - DNA, 15 bp, Homo sapiens
agaaaaaaaaatgcc

SEQ ID NO: 3018028 - DNA, 16 bp, Homo sapiens
agaaaaaggatgtttt

SEQ ID NO: 3018029 - DNA, 17 bp, Homo sapiens
agaaaaataagtcaaaa

SEQ ID NO: 3018030 - DNA, 13 bp, Homo sapiens
agaaaaatgcttt

SEQ ID NO: 3018031 - DNA, 15 bp, Homo sapiens
agaaaacaaagttct

SEQ ID NO: 3018032 - DNA, 22 bp, Homo sapiens
agaaaacaagcaagttctgaga

SEQ ID NO: 3018033 - DNA, 23 bp, Homo sapiens
agaaaacaattgttctgggtgat

SEQ ID NO: 3018034 - DNA, 12 bp, Homo sapiens
agaaaacacttt

SEQ ID NO: 3018035 - DNA, 14 bp, Homo sapiens
agaaaacattccag

SEQ ID NO: 3018036 - DNA, 23 bp, Homo sapiens
agaaaaccactttattgcaatgc

SEQ ID NO: 3018037 - DNA, 22 bp, Homo sapiens
agaaaactccagggtcccctgc

SEQ ID NO: 3018038 - DNA, 14 bp, Homo sapiens
agaaaactgcacaa

SEQ ID NO: 3018039 - DNA, 12 bp, Homo sapiens
agaaaactggaa

SEQ ID NO: 3018040 - DNA, 13 bp, Homo sapiens
agaaaactggaaa

SEQ ID NO: 3018041 - DNA, 19 bp, Homo sapiens
agaaaagacggatggcagg

SEQ ID NO: 3018042 - DNA, 14 bp, Homo sapiens
agaaaagcctcagc

SEQ ID NO: 3018043 - DNA, 15 bp, Homo sapiens
agaaaagcctcagct

SEQ ID NO: 3018044 - DNA, 13 bp, Homo sapiens
agaaaaggagggg

SEQ ID NO: 3018045 - DNA, 12 bp, Homo sapiens
agaaaagttatt

SEQ ID NO: 3018046 - DNA, 17 bp, Homo sapiens
agaaaatactatttcaa

SEQ ID NO: 3018047 - DNA, 10 bp, Homo sapiens
agaaaatata

SEQ ID NO: 3018048 - DNA, 12 bp, Homo sapiens
agaaaatatact

SEQ ID NO: 3018049 - DNA, 14 bp, Homo sapiens
agaaaatatactgt

SEQ ID NO: 3018050 - DNA, 22 bp, Homo sapiens
agaaaatatactgtaaagaaag

SEQ ID NO: 3018051 - DNA, 14 bp, Homo sapiens
agaaaatatatgta

SEQ ID NO: 3018052 - DNA, 21 bp, Homo sapiens
agaaaatgaatttgactggtt

SEQ ID NO: 3018053 - DNA, 19 bp, Homo sapiens
agaaaatggaaccaggctt

SEQ ID NO: 3018054 - DNA, 21 bp, Homo sapiens
agaaaatggaattactccaaa

SEQ ID NO: 3018055 - DNA, 22 bp, Homo sapiens
agaaaatggaattactccaaaa

SEQ ID NO: 3018056 - DNA, 24 bp, Homo sapiens
agaaaatgtgtctgcaacatggat

SEQ ID NO: 3018057 - DNA, 16 bp, Homo sapiens
agaaaatgttgagaat

SEQ ID NO: 3018058 - DNA, 16 bp, Homo sapiens
agaaacaaacaaaact

SEQ ID NO: 3018059 - DNA, 18 bp, Homo sapiens
agaaacaacaatttctac

SEQ ID NO: 3018060 - DNA, 17 bp, Homo sapiens
agaaacaactctttgag

SEQ ID NO: 3018061 - DNA, 21 bp, Homo sapiens
agaaacaatatttaaccaaag

SEQ ID NO: 3018062 - DNA, 20 bp, Homo sapiens
agaaacacactgaggcaggg

SEQ ID NO: 3018063 - DNA, 15 bp, Homo sapiens
agaaacaccattcat

SEQ ID NO: 3018064 - DNA, 18 bp, Homo sapiens
agaaacactatttgtgac

SEQ ID NO: 3018065 - DNA, 11 bp, Homo sapiens
agaaacactgc

SEQ ID NO: 3018066 - DNA, 13 bp, Homo sapiens
agaaacactgcct

SEQ ID NO: 3018067 - DNA, 15 bp, Homo sapiens
agaaacactttctct

SEQ ID NO: 3018068 - DNA, 13 bp, Homo sapiens
agaaacaggaccg

SEQ ID NO: 3018069 - DNA, 17 bp, Homo sapiens
agaaacatttagattta

SEQ ID NO: 3018070 - DNA, 17 bp, Homo sapiens
agaaaccaagtgggctg

SEQ ID NO: 3018071 - DNA, 19 bp, Homo sapiens
agaaaccaagtgggctggt

SEQ ID NO: 3018072 - DNA, 18 bp, Homo sapiens
agaaaccacttctggtca

SEQ ID NO: 3018073 - DNA, 19 bp, Homo sapiens
agagagcagagaatataac

SEQ ID NO: 3018074 - DNA, 22 bp, Homo sapiens
agagagccctgggtgacttcag

SEQ ID NO: 3018075 - DNA, 16 bp, Homo sapiens
agagaggcctgctttg

SEQ ID NO: 3018076 - DNA, 15 bp, Homo sapiens
agagagggagaagaa

SEQ ID NO: 3018077 - DNA, 19 bp, Homo sapiens
agagagggagaagaagtca

SEQ ID NO: 3018078 - DNA, 18 bp, Homo sapiens
agagagggaggcaagccc

SEQ ID NO: 3018079 - DNA, 23 bp, Homo sapiens
agagatatttaaaagacaaacac

SEQ ID NO: 3018080 - DNA, 18 bp, Homo sapiens
agagatattttgggcatg

SEQ ID NO: 3018081 - DNA, 16 bp, Homo sapiens
agagatccaaagactc

SEQ ID NO: 3018082 - DNA, 22 bp, Homo sapiens
agagatcctacttctctgagtc

SEQ ID NO: 3018083 - DNA, 16 bp, Homo sapiens
agagatgcctccaccg

SEQ ID NO: 3018084 - DNA, 17 bp, Homo sapiens
agagatgcctccaccgc

SEQ ID NO: 3018085 - DNA, 23 bp, Homo sapiens
agagatgcctccaccgctgccta

SEQ ID NO: 3018086 - DNA, 22 bp, Homo sapiens
agagatgcttggagcaatcaga

SEQ ID NO: 3018087 - DNA, 22 bp, Homo sapiens
agagatgggggtgtattggaat

SEQ ID NO: 3018088 - DNA, 20 bp, Homo sapiens
agagattattaaatcgttta

SEQ ID NO: 3018089 - DNA, 17 bp, Homo sapiens
agagattgtttttagag

SEQ ID NO: 3018090 - DNA, 17 bp, Homo sapiens
agagatttttgtttgtt

SEQ ID NO: 3018091 - DNA, 18 bp, Homo sapiens
agagcaaaaatgtaaaaa

SEQ ID NO: 3018092 - DNA, 15 bp, Homo sapiens
agagcaaaatgctct

SEQ ID NO: 3018093 - DNA, 22 bp, Homo sapiens
agagcaaaatgctcttgtccct

SEQ ID NO: 3018094 - DNA, 13 bp, Homo sapiens
agagcaaaggaga

SEQ ID NO: 3018095 - DNA, 14 bp, Homo sapiens
agagcaaaggagac

SEQ ID NO: 3018096 - DNA, 23 bp, Homo sapiens
agagcaatgcattctggagacag

SEQ ID NO: 3018097 - DNA, 15 bp, Homo sapiens
agagcacgcctgcca

SEQ ID NO: 3018098 - DNA, 22 bp, Homo sapiens
agagcacgcctgccatcttctc

SEQ ID NO: 3018099 - DNA, 13 bp, Homo sapiens
agagcactctcac

SEQ ID NO: 3018100 - DNA, 12 bp, Homo sapiens
agagcactgcca

SEQ ID NO: 3018101 - DNA, 14 bp, Homo sapiens
agagcactgccacc

SEQ ID NO: 3018102 - DNA, 13 bp, Homo sapiens
agagcaggactcc

SEQ ID NO: 3018103 - DNA, 22 bp, Homo sapiens
agagcaggactccaggcccaag

SEQ ID NO: 3018104 - DNA, 16 bp, Homo sapiens
agagcaggccagcccg

SEQ ID NO: 3018105 - DNA, 23 bp, Homo sapiens
agagcaggccagcccggacctct

SEQ ID NO: 3018106 - DNA, 16 bp, Homo sapiens
agagcaggggctgctg

SEQ ID NO: 3018107 - DNA, 19 bp, Homo sapiens
agagcaggggctgctgggg

SEQ ID NO: 3018108 - DNA, 20 bp, Homo sapiens
agagcaggggctgctggggg

SEQ ID NO: 3018109 - DNA, 19 bp, Homo sapiens
agagcattaaaataactat

SEQ ID NO: 3018110 - DNA, 16 bp, Homo sapiens
agagccaagggggcag

SEQ ID NO: 3018111 - DNA, 11 bp, Homo sapiens
agagccacaca

SEQ ID NO: 3018112 - DNA, 13 bp, Homo sapiens
agagccagccctc

SEQ ID NO: 3018113 - DNA, 16 bp, Homo sapiens
agagccagccctccct

SEQ ID NO: 3018114 - DNA, 21 bp, Homo sapiens
agagccagccctccctgtcct

SEQ ID NO: 3018115 - DNA, 11 bp, Homo sapiens
agagccagccg

SEQ ID NO: 3018116 - DNA, 13 bp, Homo sapiens
agagccagccttg

SEQ ID NO: 3018117 - DNA, 20 bp, Homo sapiens
agagccatataagtttgaag

SEQ ID NO: 3018118 - DNA, 16 bp, Homo sapiens
agagcccagcccagga

SEQ ID NO: 3018119 - DNA, 12 bp, Homo sapiens
agagcccagctc

SEQ ID NO: 3018120 - DNA, 15 bp, Homo sapiens
agagcccagctcttg

SEQ ID NO: 3018121 - DNA, 12 bp, Homo sapiens
agagcccagggg

SEQ ID NO: 3018122 - DNA, 16 bp, Homo sapiens
agagcccaggggagaa

SEQ ID NO: 3018123 - DNA, 13 bp, Homo sapiens
agagcctgaggga

SEQ ID NO: 3018124 - DNA, 16 bp, Homo sapiens
agagcctgctccccca

SEQ ID NO: 3018125 - DNA, 18 bp, Homo sapiens
agagcctgctcccccacc

SEQ ID NO: 3018126 - DNA, 12 bp, Homo sapiens
agagcctgtccc

SEQ ID NO: 3018127 - DNA, 16 bp, Homo sapiens
agagcctgtccccgcc

SEQ ID NO: 3018128 - DNA, 18 bp, Homo sapiens
agagcctgtccccgcctt

SEQ ID NO: 3018129 - DNA, 22 bp, Homo sapiens
agagcctgtccccgccttccct

SEQ ID NO: 3018130 - DNA, 17 bp, Homo sapiens
agagcgagattccgtct

SEQ ID NO: 3018131 - DNA, 20 bp, Homo sapiens
agagcgcctgcccctcccag

SEQ ID NO: 3018132 - DNA, 22 bp, Homo sapiens
agagcgggagggagtctcagga

SEQ ID NO: 3018133 - DNA, 21 bp, Homo sapiens
agagctaataaatctcttctt

SEQ ID NO: 3018134 - DNA, 14 bp, Homo sapiens
agagctactcagaa

SEQ ID NO: 3018135 - DNA, 19 bp, Homo sapiens
agagctactcagaaatgga

SEQ ID NO: 3018136 - DNA, 16 bp, Homo sapiens
agagctagcgctgccg

SEQ ID NO: 3018137 - DNA, 21 bp, Homo sapiens
agagctcaagggacaaggaca

SEQ ID NO: 3018138 - DNA, 15 bp, Homo sapiens
agagctctgacccac

SEQ ID NO: 3018139 - DNA, 21 bp, Homo sapiens
agagctctggtgataaggaca

SEQ ID NO: 3018140 - DNA, 22 bp, Homo sapiens
agagctctggtgataaggacat

SEQ ID NO: 3018141 - DNA, 21 bp, Homo sapiens
agagctgaagagttgccccgt

SEQ ID NO: 3018142 - DNA, 12 bp, Homo sapiens
agagctgagcca

SEQ ID NO: 3018143 - DNA, 13 bp, Homo sapiens
agagctgcacagg

SEQ ID NO: 3018144 - DNA, 13 bp, Homo sapiens
agagctgccactg

SEQ ID NO: 3018145 - DNA, 14 bp, Homo sapiens
agagctgccactgg

SEQ ID NO: 3018146 - DNA, 16 bp, Homo sapiens
agagctgcctccccaa

SEQ ID NO: 3018147 - DNA, 18 bp, Homo sapiens
agagctgggatcccacag

SEQ ID NO: 3018148 - DNA, 19 bp, Homo sapiens
agagctgggatcccacagc

SEQ ID NO: 3018149 - DNA, 22 bp, Homo sapiens
agagctgggatcccacagccct

SEQ ID NO: 3018150 - DNA, 18 bp, Homo sapiens
agagcttctgtattttca

SEQ ID NO: 3018151 - DNA, 20 bp, Homo sapiens
agagcttctgtattttcaaa

SEQ ID NO: 3018152 - DNA, 21 bp, Homo sapiens
agagcttctgtattttcaaag

SEQ ID NO: 3018153 - DNA, 22 bp, Homo sapiens
agagcttcttccaggtgcccag

SEQ ID NO: 3018154 - DNA, 23 bp, Homo sapiens
agagcttcttccaggtgcccagc

SEQ ID NO: 3018155 - DNA, 21 bp, Homo sapiens
agagcttgcagtgaagtgttc

SEQ ID NO: 3018156 - DNA, 13 bp, Homo sapiens
agaggaaaaaaat

SEQ ID NO: 3018157 - DNA, 23 bp, Homo sapiens
agaggaaaactattccatgtttt

SEQ ID NO: 3018158 - DNA, 13 bp, Homo sapiens
agaggaaaatgag

SEQ ID NO: 3018159 - DNA, 18 bp, Homo sapiens
agaggaagacgagacagg

SEQ ID NO: 3018160 - DNA, 24 bp, Homo sapiens
agaggaatcagacttcacactgca

SEQ ID NO: 3018161 - DNA, 15 bp, Homo sapiens
agaggaatgaaaaaa

SEQ ID NO: 3018162 - DNA, 14 bp, Homo sapiens
agaggaccagggcc

SEQ ID NO: 3018163 - DNA, 15 bp, Homo sapiens
agaggaccagtgagt

SEQ ID NO: 3018164 - DNA, 22 bp, Homo sapiens
agaggacgtgttacccactgcc

SEQ ID NO: 3018165 - DNA, 18 bp, Homo sapiens
agaggagacagcctgtct

SEQ ID NO: 3018166 - DNA, 12 bp, Homo sapiens
agaggagagcca

SEQ ID NO: 3018167 - DNA, 16 bp, Homo sapiens
agaggagcccagcggc

SEQ ID NO: 3018168 - DNA, 13 bp, Homo sapiens
agaggagcccagt

SEQ ID NO: 3018169 - DNA, 17 bp, Homo sapiens
agaggagcctcagaaga

SEQ ID NO: 3018170 - DNA, 14 bp, Homo sapiens
agaggagccttttt

SEQ ID NO: 3018171 - DNA, 17 bp, Homo sapiens
agaggaggaggtggggg

SEQ ID NO: 3018172 - DNA, 23 bp, Homo sapiens
agaggaggcaaatggcactgcag

SEQ ID NO: 3018173 - DNA, 19 bp, Homo sapiens
agaggatccgtgctgtctc

SEQ ID NO: 3018174 - DNA, 13 bp, Homo sapiens
agaggatgatttc

SEQ ID NO: 3018175 - DNA, 16 bp, Homo sapiens
agaggatgatttcaga

SEQ ID NO: 3018176 - DNA, 18 bp, Homo sapiens
agaggatgctctttccca

SEQ ID NO: 3018177 - DNA, 20 bp, Homo sapiens
agaggatgctctttcccagg

SEQ ID NO: 3018178 - DNA, 15 bp, Homo sapiens
agaggcattgttagt

SEQ ID NO: 3018179 - DNA, 17 bp, Homo sapiens
agaggccagacatggtg

SEQ ID NO: 3018180 - DNA, 14 bp, Homo sapiens
agaggccccagcct

SEQ ID NO: 3018181 - DNA, 23 bp, Homo sapiens
agaggccccagcctccctgaagc

SEQ ID NO: 3018182 - DNA, 19 bp, Homo sapiens
agaggccctcgctgccagc

SEQ ID NO: 3018183 - DNA, 18 bp, Homo sapiens
agaggccctctggagtgg

SEQ ID NO: 3018184 - DNA, 22 bp, Homo sapiens
agaggccctctggagtggccac

SEQ ID NO: 3018185 - DNA, 23 bp, Homo sapiens
agaggccctctggagtggccact

SEQ ID NO: 3018186 - DNA, 20 bp, Homo sapiens
agaggcctcttttcctgaag

SEQ ID NO: 3018187 - DNA, 21 bp, Homo sapiens
agaggctaaattactcaggaa

SEQ ID NO: 3018188 - DNA, 21 bp, Homo sapiens
agaggctaattcagtgtcaca

SEQ ID NO: 3018189 - DNA, 16 bp, Homo sapiens
agaggctgagacagga

SEQ ID NO: 3018190 - DNA, 21 bp, Homo sapiens
agaggctgaggctggcacagg

SEQ ID NO: 3018191 - DNA, 16 bp, Homo sapiens
agaggctgcctccgca

SEQ ID NO: 3018192 - DNA, 16 bp, Homo sapiens
agaggctggaggcagg

SEQ ID NO: 3018193 - DNA, 22 bp, Homo sapiens
agaggctggtgtatgcactgct

SEQ ID NO: 3018194 - DNA, 23 bp, Homo sapiens
agaggctgtgtccctgctggggt

SEQ ID NO: 3018195 - DNA, 17 bp, Homo sapiens
agaggctttggggtcct

SEQ ID NO: 3018196 - DNA, 14 bp, Homo sapiens
agagggaagaaaag

SEQ ID NO: 3018197 - DNA, 15 bp, Homo sapiens
agagggaagaaaaga

SEQ ID NO: 3018198 - DNA, 19 bp, Homo sapiens
agagggacctctcccaggg

SEQ ID NO: 3018199 - DNA, 21 bp, Homo sapiens
agagggacgcctgggggtgcc

SEQ ID NO: 3018200 - DNA, 20 bp, Homo sapiens
agagggacggccaagaatgt

SEQ ID NO: 3018201 - DNA, 15 bp, Homo sapiens
agagggagaagaagt

SEQ ID NO: 3018202 - DNA, 14 bp, Homo sapiens
agagggagaagact

SEQ ID NO: 3018203 - DNA, 21 bp, Homo sapiens
agagggaggaatgtgtgcctt

SEQ ID NO: 3018204 - DNA, 20 bp, Homo sapiens
agagggaggggcctaggcct

SEQ ID NO: 3018205 - DNA, 15 bp, Homo sapiens
agcaggaagctcaga

SEQ ID NO: 3018206 - DNA, 22 bp, Homo sapiens
agcaggacctctgaaaccctgg

SEQ ID NO: 3018207 - DNA, 22 bp, Homo sapiens
agcaggactccaggcccaaggc

SEQ ID NO: 3018208 - DNA, 14 bp, Homo sapiens
agcaggagaggaga

SEQ ID NO: 3018209 - DNA, 22 bp, Homo sapiens
agcaggagaggagagccagaga

SEQ ID NO: 3018210 - DNA, 23 bp, Homo sapiens
agcaggagaggagagccagagaa

SEQ ID NO: 3018211 - DNA, 20 bp, Homo sapiens
agcaggcacggcccgcagcc

SEQ ID NO: 3018212 - DNA, 15 bp, Homo sapiens
agcaggcagcgcctg

SEQ ID NO: 3018213 - DNA, 15 bp, Homo sapiens
agcaggccagcccgg

SEQ ID NO: 3018214 - DNA, 17 bp, Homo sapiens
agcaggccagcccggac

SEQ ID NO: 3018215 - DNA, 17 bp, Homo sapiens
agcaggcgctgtgctat

SEQ ID NO: 3018216 - DNA, 21 bp, Homo sapiens
agcagggaaaatgcagcaggg

SEQ ID NO: 3018217 - DNA, 15 bp, Homo sapiens
agcagggcggctgcc

SEQ ID NO: 3018218 - DNA, 23 bp, Homo sapiens
agcagggctaccctgagctgagg

SEQ ID NO: 3018219 - DNA, 13 bp, Homo sapiens
agcaggggctgct

SEQ ID NO: 3018220 - DNA, 14 bp, Homo sapiens
agcaggggctgctg

SEQ ID NO: 3018221 - DNA, 15 bp, Homo sapiens
agcaggggctgctgg

SEQ ID NO: 3018222 - DNA, 23 bp, Homo sapiens
agcagggtcttttcatctgggaa

SEQ ID NO: 3018223 - DNA, 17 bp, Homo sapiens
agcagggtttgagcaca

SEQ ID NO: 3018224 - DNA, 13 bp, Homo sapiens
agcaggttagaga

SEQ ID NO: 3018225 - DNA, 14 bp, Homo sapiens
agcaggttagagaa

SEQ ID NO: 3018226 - DNA, 17 bp, Homo sapiens
agcagtaactgacaact

SEQ ID NO: 3018227 - DNA, 13 bp, Homo sapiens
agcagtagacatt

SEQ ID NO: 3018228 - DNA, 14 bp, Homo sapiens
agcagtagacattt

SEQ ID NO: 3018229 - DNA, 14 bp, Homo sapiens
agcagtcatcatct

SEQ ID NO: 3018230 - DNA, 15 bp, Homo sapiens
agcagtccctgctta

SEQ ID NO: 3018231 - DNA, 15 bp, Homo sapiens
agcagtctacttctg

SEQ ID NO: 3018232 - DNA, 14 bp, Homo sapiens
agcagtctctgcct

SEQ ID NO: 3018233 - DNA, 14 bp, Homo sapiens
agcagtgagccgca

SEQ ID NO: 3018234 - DNA, 14 bp, Homo sapiens
agcagtgagtgacc

SEQ ID NO: 3018235 - DNA, 21 bp, Homo sapiens
agcagtgcacatttcatagtt

SEQ ID NO: 3018236 - DNA, 17 bp, Homo sapiens
agcagtgggcaggtggc

SEQ ID NO: 3018237 - DNA, 18 bp, Homo sapiens
agcagtgggcaggtggcc

SEQ ID NO: 3018238 - DNA, 14 bp, Homo sapiens
agcagtgggcctgg

SEQ ID NO: 3018239 - DNA, 21 bp, Homo sapiens
agcagttactccctacactga

SEQ ID NO: 3018240 - DNA, 23 bp, Homo sapiens
agcagttactccctacactgatg

SEQ ID NO: 3018241 - DNA, 18 bp, Homo sapiens
agcagttttgtaaatgta

SEQ ID NO: 3018242 - DNA, 14 bp, Homo sapiens
agcataaatttaat

SEQ ID NO: 3018243 - DNA, 15 bp, Homo sapiens
agcataaatttaatg

SEQ ID NO: 3018244 - DNA, 13 bp, Homo sapiens
agcataagaccaa

SEQ ID NO: 3018245 - DNA, 15 bp, Homo sapiens
agcatacttctagga

SEQ ID NO: 3018246 - DNA, 21 bp, Homo sapiens
agcatatatagtatttaattg

SEQ ID NO: 3018247 - DNA, 21 bp, Homo sapiens
agcatattttgtggcatttga

SEQ ID NO: 3018248 - DNA, 16 bp, Homo sapiens
agcatcaaacatgaaa

SEQ ID NO: 3018249 - DNA, 21 bp, Homo sapiens
agcatcaagccccacagttct

SEQ ID NO: 3018250 - DNA, 14 bp, Homo sapiens
agcatcacagaatg

SEQ ID NO: 3018251 - DNA, 15 bp, Homo sapiens
agcatcaccttccta

SEQ ID NO: 3018252 - DNA, 12 bp, Homo sapiens
agcatcattgtc

SEQ ID NO: 3018253 - DNA, 14 bp, Homo sapiens
agcatccaggctgg

SEQ ID NO: 3018254 - DNA, 14 bp, Homo sapiens
agcatccattaatt

SEQ ID NO: 3018255 - DNA, 20 bp, Homo sapiens
agcatccctaattcttcata

SEQ ID NO: 3018256 - DNA, 21 bp, Homo sapiens
agcatccgcaggtgctggtcc

SEQ ID NO: 3018257 - DNA, 15 bp, Homo sapiens
agcatcctcagaagc

SEQ ID NO: 3018258 - DNA, 13 bp, Homo sapiens
agcatcctcccca

SEQ ID NO: 3018259 - DNA, 22 bp, Homo sapiens
agcatcctccccaccagagctg

SEQ ID NO: 3018260 - DNA, 19 bp, Homo sapiens
agcatcggtcatgtgtgta

SEQ ID NO: 3018261 - DNA, 12 bp, Homo sapiens
agcatctaagtt

SEQ ID NO: 3018262 - DNA, 22 bp, Homo sapiens
agcatctaagttataagactct

SEQ ID NO: 3018263 - DNA, 23 bp, Homo sapiens
agcatctaagttataagactctc

SEQ ID NO: 3018264 - DNA, 18 bp, Homo sapiens
agcatctcagtggtgtgt

SEQ ID NO: 3018265 - DNA, 17 bp, Homo sapiens
agcatctgaccatctgt

SEQ ID NO: 3018266 - DNA, 19 bp, Homo sapiens
agcatctgaccatctgtga

SEQ ID NO: 3018267 - DNA, 21 bp, Homo sapiens
agcatctgaccatctgtgact

SEQ ID NO: 3018268 - DNA, 17 bp, Homo sapiens
agcatctgcattgccca

SEQ ID NO: 3018269 - DNA, 13 bp, Homo sapiens
agcatctgtacaa

SEQ ID NO: 3018270 - DNA, 17 bp, Homo sapiens
agcatcttccagaagtg

SEQ ID NO: 3018271 - DNA, 20 bp, Homo sapiens
agcatcttccagaagtgtga

SEQ ID NO: 3018272 - DNA, 21 bp, Homo sapiens
agcatgaaaggcttttaaatt

SEQ ID NO: 3018273 - DNA, 20 bp, Homo sapiens
agcatgaagtcttaaggaca

SEQ ID NO: 3018274 - DNA, 20 bp, Homo sapiens
agcatgaatttttttcatct

SEQ ID NO: 3018275 - DNA, 20 bp, Homo sapiens
agcatgacaaaagtgacaga

SEQ ID NO: 3018276 - DNA, 18 bp, Homo sapiens
agcatgatattgttctcc

SEQ ID NO: 3018277 - DNA, 14 bp, Homo sapiens
agcatgatgggaaa

SEQ ID NO: 3018278 - DNA, 20 bp, Homo sapiens
agcatgatgggaaaatattt

SEQ ID NO: 3018279 - DNA, 19 bp, Homo sapiens
agcatgccaacaagaatgc

SEQ ID NO: 3018280 - DNA, 20 bp, Homo sapiens
agcatgcggagccagcaggc

SEQ ID NO: 3018281 - DNA, 22 bp, Homo sapiens
agcatggatgaaacctttgagt

SEQ ID NO: 3018282 - DNA, 21 bp, Homo sapiens
agcatggcactccctccagca

SEQ ID NO: 3018283 - DNA, 21 bp, Homo sapiens
agcatggccctgctgcccctc

SEQ ID NO: 3018284 - DNA, 23 bp, Homo sapiens
agcatggttccaattttttttaa

SEQ ID NO: 3018285 - DNA, 13 bp, Homo sapiens
agcatgtaatggt

SEQ ID NO: 3018286 - DNA, 17 bp, Homo sapiens
agcatgtcgtcaaagct

SEQ ID NO: 3018287 - DNA, 15 bp, Homo sapiens
agcatgtctctgctt

SEQ ID NO: 3018288 - DNA, 16 bp, Homo sapiens
agcatgtgtcatgcat

SEQ ID NO: 3018289 - DNA, 22 bp, Homo sapiens
agcatgttgttttttcatagtg

SEQ ID NO: 3018290 - DNA, 22 bp, Homo sapiens
agcatgttttctgctttaaatt

SEQ ID NO: 3018291 - DNA, 15 bp, Homo sapiens
agcattaagcccaat

SEQ ID NO: 3018292 - DNA, 21 bp, Homo sapiens
agcattattttttgttgaata

SEQ ID NO: 3018293 - DNA, 20 bp, Homo sapiens
agcattcaggcagcactgac

SEQ ID NO: 3018294 - DNA, 19 bp, Homo sapiens
agcattccaacaaagggtt

SEQ ID NO: 3018295 - DNA, 14 bp, Homo sapiens
agcattccttttga

SEQ ID NO: 3018296 - DNA, 13 bp, Homo sapiens
agcattgctttct

SEQ ID NO: 3018297 - DNA, 14 bp, Homo sapiens
agcattgctttctg

SEQ ID NO: 3018298 - DNA, 21 bp, Homo sapiens
agcattgtaattatgtaaata

SEQ ID NO: 3018299 - DNA, 18 bp, Homo sapiens
agcattgtcttaattttt

SEQ ID NO: 3018300 - DNA, 17 bp, Homo sapiens
agcattgtgaactgaca

SEQ ID NO: 3018301 - DNA, 21 bp, Homo sapiens
agcattgtgaactgacaggca

SEQ ID NO: 3018302 - DNA, 18 bp, Homo sapiens
agcattgttgagctgtca

SEQ ID NO: 3018303 - DNA, 16 bp, Homo sapiens
agcatttaatccaaac

SEQ ID NO: 3018304 - DNA, 17 bp, Homo sapiens
agcatttaccaacatgt

SEQ ID NO: 3018305 - DNA, 17 bp, Homo sapiens
agcatttatgtagacat

SEQ ID NO: 3018306 - DNA, 18 bp, Homo sapiens
agcatttatgtagacatt

SEQ ID NO: 3018307 - DNA, 18 bp, Homo sapiens
agcatttcaaagccctgc

SEQ ID NO: 3018308 - DNA, 19 bp, Homo sapiens
agcatttcaaagccctgcc

SEQ ID NO: 3018309 - DNA, 22 bp, Homo sapiens
agcatttcaaagccctgcctct

SEQ ID NO: 3018310 - DNA, 17 bp, Homo sapiens
agcatttcccttccttc

SEQ ID NO: 3018311 - DNA, 13 bp, Homo sapiens
agcattttcagca

SEQ ID NO: 3018312 - DNA, 15 bp, Homo sapiens
agcattttttaaaaa

SEQ ID NO: 3018313 - DNA, 15 bp, Homo sapiens
agccaaacccctaga

SEQ ID NO: 3018314 - DNA, 22 bp, Homo sapiens
agccaaacccctagagacagtg

SEQ ID NO: 3018315 - DNA, 20 bp, Homo sapiens
agccaaagaatatttaaata

SEQ ID NO: 3018316 - DNA, 14 bp, Homo sapiens
agccaaagccagag

SEQ ID NO: 3018317 - DNA, 17 bp, Homo sapiens
agccaaagttaaatgta

SEQ ID NO: 3018318 - DNA, 14 bp, Homo sapiens
agccaacagctaca

SEQ ID NO: 3018319 - DNA, 17 bp, Homo sapiens
agccaactagcccctgg

SEQ ID NO: 3018320 - DNA, 21 bp, Homo sapiens
agccaagaaacactgcctgcc

SEQ ID NO: 3018321 - DNA, 14 bp, Homo sapiens
agccaagaggctgc

SEQ ID NO: 3018322 - DNA, 18 bp, Homo sapiens
agccaagcacagtggtgg

SEQ ID NO: 3018323 - DNA, 13 bp, Homo sapiens
agccaagcagcca

SEQ ID NO: 3018324 - DNA, 16 bp, Homo sapiens
agccaagcagccaagc

SEQ ID NO: 3018325 - DNA, 14 bp, Homo sapiens
agccaagctgtgtt

SEQ ID NO: 3018326 - DNA, 17 bp, Homo sapiens
agccaagctgtgttcat

SEQ ID NO: 3018327 - DNA, 16 bp, Homo sapiens
agccaaggggcttcag

SEQ ID NO: 3018328 - DNA, 14 bp, Homo sapiens
agccaagggggcag

SEQ ID NO: 3018329 - DNA, 17 bp, Homo sapiens
agccaatccctggccat

SEQ ID NO: 3018330 - DNA, 22 bp, Homo sapiens
agccaatctggacacttcttta

SEQ ID NO: 3018331 - DNA, 16 bp, Homo sapiens
agccaattcagacagg

SEQ ID NO: 3018332 - DNA, 16 bp, Homo sapiens
agccacacacacagaa

SEQ ID NO: 3018333 - DNA, 21 bp, Homo sapiens
agccacacacacagaaaatat

SEQ ID NO: 3018334 - DNA, 17 bp, Homo sapiens
agccacaccaggataga

SEQ ID NO: 3018335 - DNA, 18 bp, Homo sapiens
agccacacgcaggcggcc

SEQ ID NO: 3018336 - DNA, 21 bp, Homo sapiens
agccacacgcaggcggccagg

SEQ ID NO: 3018337 - DNA, 20 bp, Homo sapiens
agctcttgggtcagagaaaa

SEQ ID NO: 3018338 - DNA, 17 bp, Homo sapiens
agctctttttgtgaagt

SEQ ID NO: 3018339 - DNA, 14 bp, Homo sapiens
agctgaaaaaacta

SEQ ID NO: 3018340 - DNA, 19 bp, Homo sapiens
agctgaaaaaactatattt

SEQ ID NO: 3018341 - DNA, 18 bp, Homo sapiens
agctgaaatatgctggct

SEQ ID NO: 3018342 - DNA, 14 bp, Homo sapiens
agctgaagagcaag

SEQ ID NO: 3018343 - DNA, 19 bp, Homo sapiens
agctgaagagttgccccgt

SEQ ID NO: 3018344 - DNA, 16 bp, Homo sapiens
agctgaccagccgtga

SEQ ID NO: 3018345 - DNA, 19 bp, Homo sapiens
agctgaccagccgtgagca

SEQ ID NO: 3018346 - DNA, 18 bp, Homo sapiens
agctgacgccaataataa

SEQ ID NO: 3018347 - DNA, 16 bp, Homo sapiens
agctgagcaaatcacc

SEQ ID NO: 3018348 - DNA, 10 bp, Homo sapiens
agctgagcca

SEQ ID NO: 3018349 - DNA, 15 bp, Homo sapiens
agctgagccagttgt

SEQ ID NO: 3018350 - DNA, 16 bp, Homo sapiens
agctgagcctgcaggg

SEQ ID NO: 3018351 - DNA, 23 bp, Homo sapiens
agctgagcctgcagggaagcccc

SEQ ID NO: 3018352 - DNA, 15 bp, Homo sapiens
agctgagcgccagga

SEQ ID NO: 3018353 - DNA, 17 bp, Homo sapiens
agctgagcgccaggatg

SEQ ID NO: 3018354 - DNA, 16 bp, Homo sapiens
agctgaggcagcagtg

SEQ ID NO: 3018355 - DNA, 13 bp, Homo sapiens
agctgaggccaca

SEQ ID NO: 3018356 - DNA, 21 bp, Homo sapiens
agctgaggccacactcagcac

SEQ ID NO: 3018357 - DNA, 13 bp, Homo sapiens
agctgaggcctcc

SEQ ID NO: 3018358 - DNA, 14 bp, Homo sapiens
agctgagggaggga

SEQ ID NO: 3018359 - DNA, 19 bp, Homo sapiens
agctgagggagggagccat

SEQ ID NO: 3018360 - DNA, 13 bp, Homo sapiens
agctgagggccct

SEQ ID NO: 3018361 - DNA, 17 bp, Homo sapiens
agctgagggccctgtgg

SEQ ID NO: 3018362 - DNA, 22 bp, Homo sapiens
agctgagggccctgtggagtcc

SEQ ID NO: 3018363 - DNA, 13 bp, Homo sapiens
agctgatcagttt

SEQ ID NO: 3018364 - DNA, 20 bp, Homo sapiens
agctgatgaacttattctgt

SEQ ID NO: 3018365 - DNA, 11 bp, Homo sapiens
agctgcaaagt

SEQ ID NO: 3018366 - DNA, 12 bp, Homo sapiens
agctgcaaagtg

SEQ ID NO: 3018367 - DNA, 13 bp, Homo sapiens
agctgcaaagtgt

SEQ ID NO: 3018368 - DNA, 18 bp, Homo sapiens
agctgcaagtgacatctc

SEQ ID NO: 3018369 - DNA, 17 bp, Homo sapiens
agctgcactgatgctgc

SEQ ID NO: 3018370 - DNA, 11 bp, Homo sapiens
agctgcagaac

SEQ ID NO: 3018371 - DNA, 20 bp, Homo sapiens
agctgcatttcacatgcctt

SEQ ID NO: 3018372 - DNA, 23 bp, Homo sapiens
agctgcatttcacatgccttgca

SEQ ID NO: 3018373 - DNA, 16 bp, Homo sapiens
agctgccactgggcac

SEQ ID NO: 3018374 - DNA, 19 bp, Homo sapiens
agctgccactgggcacctg

SEQ ID NO: 3018375 - DNA, 11 bp, Homo sapiens
agctgccagtg

SEQ ID NO: 3018376 - DNA, 15 bp, Homo sapiens
agctgccccagccag

SEQ ID NO: 3018377 - DNA, 16 bp, Homo sapiens
agctgccccagccaga

SEQ ID NO: 3018378 - DNA, 17 bp, Homo sapiens
agctgccccggcccctc

SEQ ID NO: 3018379 - DNA, 18 bp, Homo sapiens
agctgcccctcctggagc

SEQ ID NO: 3018380 - DNA, 22 bp, Homo sapiens
agctgcccctcctggagcagaa

SEQ ID NO: 3018381 - DNA, 23 bp, Homo sapiens
agctgcccctcctggagcagaaa

SEQ ID NO: 3018382 - DNA, 16 bp, Homo sapiens
agctgcccctctctgg

SEQ ID NO: 3018383 - DNA, 18 bp, Homo sapiens
agctgcccctctctgggc

SEQ ID NO: 3018384 - DNA, 14 bp, Homo sapiens
agctgcccctggca

SEQ ID NO: 3018385 - DNA, 15 bp, Homo sapiens
agctgcccctggcac

SEQ ID NO: 3018386 - DNA, 21 bp, Homo sapiens
agctgcctctgacagcagcct

SEQ ID NO: 3018387 - DNA, 22 bp, Homo sapiens
agctgcctctgacagcagcctg

SEQ ID NO: 3018388 - DNA, 17 bp, Homo sapiens
agctgcctcttctcttg

SEQ ID NO: 3018389 - DNA, 19 bp, Homo sapiens
agctgcctgcagcacatgc

SEQ ID NO: 3018390 - DNA, 14 bp, Homo sapiens
agctgcctggccat

SEQ ID NO: 3018391 - DNA, 17 bp, Homo sapiens
agctgcctggccatgct

SEQ ID NO: 3018392 - DNA, 13 bp, Homo sapiens
agctgccttagct

SEQ ID NO: 3018393 - DNA, 24 bp, Homo sapiens
agctgcgggctgagggcatctctg

SEQ ID NO: 3018394 - DNA, 17 bp, Homo sapiens
agctgcgttctgagggc

SEQ ID NO: 3018395 - DNA, 18 bp, Homo sapiens
agctgctaaaataaacct

SEQ ID NO: 3018396 - DNA, 11 bp, Homo sapiens
agctgctacaa

SEQ ID NO: 3018397 - DNA, 16 bp, Homo sapiens
agctgctacaaagaag

SEQ ID NO: 3018398 - DNA, 20 bp, Homo sapiens
agctgctacaaagaagacat

SEQ ID NO: 3018399 - DNA, 22 bp, Homo sapiens
agctgctacaaagaagacatgt

SEQ ID NO: 3018400 - DNA, 18 bp, Homo sapiens
agctgctaccttctttgg

SEQ ID NO: 3018401 - DNA, 20 bp, Homo sapiens
agctgctactagctctttga

SEQ ID NO: 3018402 - DNA, 21 bp, Homo sapiens
agctgctatagcctggggtgg

SEQ ID NO: 3018403 - DNA, 17 bp, Homo sapiens
agctgctccccacgtca

SEQ ID NO: 3018404 - DNA, 13 bp, Homo sapiens
agctgctccccag

SEQ ID NO: 3018405 - DNA, 17 bp, Homo sapiens
agctgctccccagcagc

SEQ ID NO: 3018406 - DNA, 20 bp, Homo sapiens
agctgctcctagagggaggg

SEQ ID NO: 3018407 - DNA, 14 bp, Homo sapiens
agctgctgcagccc

SEQ ID NO: 3018408 - DNA, 19 bp, Homo sapiens
agctgctgcagccctgcca

SEQ ID NO: 3018409 - DNA, 19 bp, Homo sapiens
agctgctgccactctgctg

SEQ ID NO: 3018410 - DNA, 22 bp, Homo sapiens
agctgctgccactctgctgcct

SEQ ID NO: 3018411 - DNA, 20 bp, Homo sapiens
agctgctggagcccgcactg

SEQ ID NO: 3018412 - DNA, 18 bp, Homo sapiens
agctgctgtgactgtgtc

SEQ ID NO: 3018413 - DNA, 21 bp, Homo sapiens
agctgctgtgactgtgtcccc

SEQ ID NO: 3018414 - DNA, 16 bp, Homo sapiens
agctgctgttgaactt

SEQ ID NO: 3018415 - DNA, 17 bp, Homo sapiens
agctgctgttgaacttt

SEQ ID NO: 3018416 - DNA, 18 bp, Homo sapiens
agctgctgttgaactttt

SEQ ID NO: 3018417 - DNA, 21 bp, Homo sapiens
agctgcttgttgtcaagtata

SEQ ID NO: 3018418 - DNA, 22 bp, Homo sapiens
agctgcttgttgtcaagtataa

SEQ ID NO: 3018419 - DNA, 16 bp, Homo sapiens
agctggagcccgtgcc

SEQ ID NO: 3018420 - DNA, 15 bp, Homo sapiens
agctggccaaggaga

SEQ ID NO: 3018421 - DNA, 21 bp, Homo sapiens
agctggcccactgctggctgc

SEQ ID NO: 3018422 - DNA, 20 bp, Homo sapiens
agctggcccagggggcctgg

SEQ ID NO: 3018423 - DNA, 14 bp, Homo sapiens
agctggccccgccg

SEQ ID NO: 3018424 - DNA, 15 bp, Homo sapiens
agctggcccgtgaca

SEQ ID NO: 3018425 - DNA, 18 bp, Homo sapiens
agctggcccgtgacagac

SEQ ID NO: 3018426 - DNA, 19 bp, Homo sapiens
agctggctggggtggcctg

SEQ ID NO: 3018427 - DNA, 21 bp, Homo sapiens
agctggctttcatccaactct

SEQ ID NO: 3018428 - DNA, 14 bp, Homo sapiens
agctgggaggaaaa

SEQ ID NO: 3018429 - DNA, 23 bp, Homo sapiens
agctgggaggtctcgtcccagcc

SEQ ID NO: 3018430 - DNA, 23 bp, Homo sapiens
agctgggatcccacagccctagt

SEQ ID NO: 3018431 - DNA, 15 bp, Homo sapiens
agctgggattttaaa

SEQ ID NO: 3018432 - DNA, 16 bp, Homo sapiens
agctgggattttaaac

SEQ ID NO: 3018433 - DNA, 18 bp, Homo sapiens
agctgggcagtgccagcc

SEQ ID NO: 3018434 - DNA, 21 bp, Homo sapiens
agctgggcccacagcccccac

SEQ ID NO: 3018435 - DNA, 22 bp, Homo sapiens
agctgggcccgacatggctccg

SEQ ID NO: 3018436 - DNA, 15 bp, Homo sapiens
agctggggatccctc

SEQ ID NO: 3018437 - DNA, 21 bp, Homo sapiens
agctgggggtgggccaggctg

SEQ ID NO: 3018438 - DNA, 17 bp, Homo sapiens
agctgggtcaggcaggg

SEQ ID NO: 3018439 - DNA, 22 bp, Homo sapiens
agctggtgccaaatagccccag

SEQ ID NO: 3018440 - DNA, 16 bp, Homo sapiens
agctggtgcccccaga

SEQ ID NO: 3018441 - DNA, 17 bp, Homo sapiens
agctggtggatggtgac

SEQ ID NO: 3018442 - DNA, 23 bp, Homo sapiens
agctgtaagaaaatgctgtcaca

SEQ ID NO: 3018443 - DNA, 20 bp, Homo sapiens
agctgtaggtgtgcgggacc

SEQ ID NO: 3018444 - DNA, 20 bp, Homo sapiens
agctgtatataaacgtgtcc

SEQ ID NO: 3018445 - DNA, 22 bp, Homo sapiens
agctgtatataaacgtgtcccg

SEQ ID NO: 3018446 - DNA, 14 bp, Homo sapiens
agctgtatcactgc

SEQ ID NO: 3018447 - DNA, 16 bp, Homo sapiens
agctgtatcactgcct

SEQ ID NO: 3018448 - DNA, 17 bp, Homo sapiens
agctgtatgatttgttt

SEQ ID NO: 3018449 - DNA, 16 bp, Homo sapiens
agctgtattgaatcat

SEQ ID NO: 3018450 - DNA, 17 bp, Homo sapiens
agctgtcaccaaggaaa

SEQ ID NO: 3018451 - DNA, 18 bp, Homo sapiens
agctgtcatcaacattct

SEQ ID NO: 3018452 - DNA, 21 bp, Homo sapiens
agctgtcatcaacattcttgt

SEQ ID NO: 3018453 - DNA, 15 bp, Homo sapiens
agctgtccctgccct

SEQ ID NO: 3018454 - DNA, 16 bp, Homo sapiens
agctgtccctgccctt

SEQ ID NO: 3018455 - DNA, 14 bp, Homo sapiens
agctgtccctgtca

SEQ ID NO: 3018456 - DNA, 15 bp, Homo sapiens
agctgtccctgtcac

SEQ ID NO: 3018457 - DNA, 14 bp, Homo sapiens
agctgtcccttgct

SEQ ID NO: 3018458 - DNA, 14 bp, Homo sapiens
agctgtcgggggcc

SEQ ID NO: 3018459 - DNA, 16 bp, Homo sapiens
agctgtcgggggccac

SEQ ID NO: 3018460 - DNA, 12 bp, Homo sapiens
agctgtgcaggt

SEQ ID NO: 3018461 - DNA, 20 bp, Homo sapiens
agctgtgcccctcccccagg

SEQ ID NO: 3018462 - DNA, 22 bp, Homo sapiens
agctgtgcttatggtaccagat

SEQ ID NO: 3018463 - DNA, 17 bp, Homo sapiens
agctgtggtcccaccca

SEQ ID NO: 3018464 - DNA, 22 bp, Homo sapiens
agctgtggtcccacccaggaag

SEQ ID NO: 3018465 - DNA, 24 bp, Homo sapiens
agctgtgtccttgcacctgcatcc

SEQ ID NO: 3018466 - DNA, 11 bp, Homo sapiens
agctgtgtctc

SEQ ID NO: 3018467 - DNA, 13 bp, Homo sapiens
agctgtgtgtttt

SEQ ID NO: 3018468 - DNA, 18 bp, Homo sapiens
agctgtgttacttgaagt

SEQ ID NO: 3018469 - DNA, 16 bp, Homo sapiens
aggccttcctctctcc

SEQ ID NO: 3018470 - DNA, 17 bp, Homo sapiens
aggccttctcaggctgg

SEQ ID NO: 3018471 - DNA, 16 bp, Homo sapiens
aggccttgctgactct

SEQ ID NO: 3018472 - DNA, 19 bp, Homo sapiens
aggccttgctgactctctg

SEQ ID NO: 3018473 - DNA, 21 bp, Homo sapiens
aggccttggggcatgacccag

SEQ ID NO: 3018474 - DNA, 18 bp, Homo sapiens
aggccttggggtgggggc

SEQ ID NO: 3018475 - DNA, 20 bp, Homo sapiens
aggccttggggtgggggcca

SEQ ID NO: 3018476 - DNA, 21 bp, Homo sapiens
aggccttgtgtgtcaggccct

SEQ ID NO: 3018477 - DNA, 18 bp, Homo sapiens
aggcgaagcgttgtcctc

SEQ ID NO: 3018478 - DNA, 18 bp, Homo sapiens
aggcgacgcggttttttc

SEQ ID NO: 3018479 - DNA, 14 bp, Homo sapiens
aggcgagcctgact

SEQ ID NO: 3018480 - DNA, 21 bp, Homo sapiens
aggcgcactgtgacccccagc

SEQ ID NO: 3018481 - DNA, 20 bp, Homo sapiens
aggcgcctataatcccagct

SEQ ID NO: 3018482 - DNA, 16 bp, Homo sapiens
aggcgctgcagggccg

SEQ ID NO: 3018483 - DNA, 22 bp, Homo sapiens
aggcggcagctcttctgggcag

SEQ ID NO: 3018484 - DNA, 13 bp, Homo sapiens
aggcggccagggc

SEQ ID NO: 3018485 - DNA, 16 bp, Homo sapiens
aggcggccagggcggc

SEQ ID NO: 3018486 - DNA, 13 bp, Homo sapiens
aggcggccctcag

SEQ ID NO: 3018487 - DNA, 22 bp, Homo sapiens
aggcggggggggcgcctggaga

SEQ ID NO: 3018488 - DNA, 23 bp, Homo sapiens
aggcggggggggcgcctggagag

SEQ ID NO: 3018489 - DNA, 20 bp, Homo sapiens
aggcggtggacttgaacttt

SEQ ID NO: 3018490 - DNA, 21 bp, Homo sapiens
aggcggtgggcacccaccctg

SEQ ID NO: 3018491 - DNA, 20 bp, Homo sapiens
aggcgtcttcatctccctgc

SEQ ID NO: 3018492 - DNA, 15 bp, Homo sapiens
aggcgtgactcagca

SEQ ID NO: 3018493 - DNA, 19 bp, Homo sapiens
aggcgtgactcagcagcct

SEQ ID NO: 3018494 - DNA, 15 bp, Homo sapiens
aggcgtgtggcagcc

SEQ ID NO: 3018495 - DNA, 22 bp, Homo sapiens
aggcgtgtggcagccacacgca

SEQ ID NO: 3018496 - DNA, 14 bp, Homo sapiens
aggcgttctcctgc

SEQ ID NO: 3018497 - DNA, 19 bp, Homo sapiens
aggcgttcttcgaggtgga

SEQ ID NO: 3018498 - DNA, 16 bp, Homo sapiens
aggctaaactggtgca

SEQ ID NO: 3018499 - DNA, 17 bp, Homo sapiens
aggctaaactggtgcat

SEQ ID NO: 3018500 - DNA, 18 bp, Homo sapiens
aggctaaagcccagagac

SEQ ID NO: 3018501 - DNA, 21 bp, Homo sapiens
aggctaattcagtgtcacatg

SEQ ID NO: 3018502 - DNA, 20 bp, Homo sapiens
aggctaattttttatccttt

SEQ ID NO: 3018503 - DNA, 21 bp, Homo sapiens
aggctagagtgcaatggtgca

SEQ ID NO: 3018504 - DNA, 16 bp, Homo sapiens
aggctagctggagcct

SEQ ID NO: 3018505 - DNA, 17 bp, Homo sapiens
aggctagctggagcctg

SEQ ID NO: 3018506 - DNA, 19 bp, Homo sapiens
aggctaggacgttggcctc

SEQ ID NO: 3018507 - DNA, 16 bp, Homo sapiens
aggctcacccccttct

SEQ ID NO: 3018508 - DNA, 21 bp, Homo sapiens
aggctcacccccttctccatc

SEQ ID NO: 3018509 - DNA, 22 bp, Homo sapiens
aggctcactgcaacttctgcct

SEQ ID NO: 3018510 - DNA, 19 bp, Homo sapiens
aggctcagagggtgtcctg

SEQ ID NO: 3018511 - DNA, 20 bp, Homo sapiens
aggctcagagggtgtcctgc

SEQ ID NO: 3018512 - DNA, 10 bp, Homo sapiens
aggctcaggt

SEQ ID NO: 3018513 - DNA, 19 bp, Homo sapiens
aggctcatttacttgaaat

SEQ ID NO: 3018514 - DNA, 12 bp, Homo sapiens
aggctcatttta

SEQ ID NO: 3018515 - DNA, 16 bp, Homo sapiens
aggctccagagggcac

SEQ ID NO: 3018516 - DNA, 15 bp, Homo sapiens
aggctcccagggaca

SEQ ID NO: 3018517 - DNA, 14 bp, Homo sapiens
aggctcccctgagg

SEQ ID NO: 3018518 - DNA, 23 bp, Homo sapiens
aggctccgggctttcccccaggc

SEQ ID NO: 3018519 - DNA, 13 bp, Homo sapiens
aggctcctccctc

SEQ ID NO: 3018520 - DNA, 16 bp, Homo sapiens
aggctcctccctctgc

SEQ ID NO: 3018521 - DNA, 19 bp, Homo sapiens
aggctcctccctctgcctc

SEQ ID NO: 3018522 - DNA, 21 bp, Homo sapiens
aggctcctgttagctcctcac

SEQ ID NO: 3018523 - DNA, 20 bp, Homo sapiens
aggctctcaacaggggagag

SEQ ID NO: 3018524 - DNA, 23 bp, Homo sapiens
aggctctccttgctcctggcctt

SEQ ID NO: 3018525 - DNA, 20 bp, Homo sapiens
aggctctcgctgccctgtgg

SEQ ID NO: 3018526 - DNA, 13 bp, Homo sapiens
aggctctgagagt

SEQ ID NO: 3018527 - DNA, 20 bp, Homo sapiens
aggctctgagagtctagatt

SEQ ID NO: 3018528 - DNA, 21 bp, Homo sapiens
aggctctgagagtctagattc

SEQ ID NO: 3018529 - DNA, 11 bp, Homo sapiens
aggctctgcct

SEQ ID NO: 3018530 - DNA, 22 bp, Homo sapiens
aggctctgccttcgaggtcaga

SEQ ID NO: 3018531 - DNA, 13 bp, Homo sapiens
aggctctgtgcct

SEQ ID NO: 3018532 - DNA, 21 bp, Homo sapiens
aggctctgtgccttggtctct

SEQ ID NO: 3018533 - DNA, 16 bp, Homo sapiens
aggctctgttcctcaa

SEQ ID NO: 3018534 - DNA, 20 bp, Homo sapiens
aggctcttctccttggagga

SEQ ID NO: 3018535 - DNA, 21 bp, Homo sapiens
aggctcttctccttggaggac

SEQ ID NO: 3018536 - DNA, 17 bp, Homo sapiens
aggctgaccacagcaca

SEQ ID NO: 3018537 - DNA, 21 bp, Homo sapiens
aggctgagaaagctaaagttt

SEQ ID NO: 3018538 - DNA, 14 bp, Homo sapiens
aggctgaggaaagg

SEQ ID NO: 3018539 - DNA, 15 bp, Homo sapiens
aggctgaggaaaggc

SEQ ID NO: 3018540 - DNA, 18 bp, Homo sapiens
aggctgaggaaaggccag

SEQ ID NO: 3018541 - DNA, 20 bp, Homo sapiens
aggctgaggaaaggccagct

SEQ ID NO: 3018542 - DNA, 12 bp, Homo sapiens
aggctgaggcag

SEQ ID NO: 3018543 - DNA, 14 bp, Homo sapiens
aggctgaggcagaa

SEQ ID NO: 3018544 - DNA, 16 bp, Homo sapiens
aggctgaggctggcac

SEQ ID NO: 3018545 - DNA, 17 bp, Homo sapiens
aggctgaggctggcaca

SEQ ID NO: 3018546 - DNA, 13 bp, Homo sapiens
aggctgaggtggt

SEQ ID NO: 3018547 - DNA, 15 bp, Homo sapiens
aggctgatttctagg

SEQ ID NO: 3018548 - DNA, 21 bp, Homo sapiens
aggctgcaaggtttaggctgg

SEQ ID NO: 3018549 - DNA, 19 bp, Homo sapiens
aggctgcaatgagccatga

SEQ ID NO: 3018550 - DNA, 15 bp, Homo sapiens
aggctgcactggagc

SEQ ID NO: 3018551 - DNA, 16 bp, Homo sapiens
aggctgcactggagcc

SEQ ID NO: 3018552 - DNA, 11 bp, Homo sapiens
aggctgcagcc

SEQ ID NO: 3018553 - DNA, 14 bp, Homo sapiens
aggctgcagccagg

SEQ ID NO: 3018554 - DNA, 18 bp, Homo sapiens
aggctgcagccaggccac

SEQ ID NO: 3018555 - DNA, 19 bp, Homo sapiens
aggctgcagccaggcctcg

SEQ ID NO: 3018556 - DNA, 21 bp, Homo sapiens
aggctgcagccaggcctcgcc

SEQ ID NO: 3018557 - DNA, 13 bp, Homo sapiens
aggctgcaggagg

SEQ ID NO: 3018558 - DNA, 18 bp, Homo sapiens
aggctgcaggagggcact

SEQ ID NO: 3018559 - DNA, 13 bp, Homo sapiens
aggctgccccagg

SEQ ID NO: 3018560 - DNA, 14 bp, Homo sapiens
aggctgccccaggc

SEQ ID NO: 3018561 - DNA, 15 bp, Homo sapiens
aggctgccctgaggg

SEQ ID NO: 3018562 - DNA, 19 bp, Homo sapiens
aggctgccctgaggggctg

SEQ ID NO: 3018563 - DNA, 23 bp, Homo sapiens
aggctgccctgaggggctgggga

SEQ ID NO: 3018564 - DNA, 17 bp, Homo sapiens
aggctgcggtgggcagc

SEQ ID NO: 3018565 - DNA, 13 bp, Homo sapiens
aggctgctttcca

SEQ ID NO: 3018566 - DNA, 14 bp, Homo sapiens
aggctgctttccaa

SEQ ID NO: 3018567 - DNA, 17 bp, Homo sapiens
aggctggaatgagggag

SEQ ID NO: 3018568 - DNA, 19 bp, Homo sapiens
aggctggaatgagggaggc

SEQ ID NO: 3018569 - DNA, 20 bp, Homo sapiens
aggctggaatgagggaggcg

SEQ ID NO: 3018570 - DNA, 23 bp, Homo sapiens
aggctggaggcagggccttgccc

SEQ ID NO: 3018571 - DNA, 20 bp, Homo sapiens
aggctggagggcagtggcac

SEQ ID NO: 3018572 - DNA, 18 bp, Homo sapiens
aggctggagtacagtggt

SEQ ID NO: 3018573 - DNA, 18 bp, Homo sapiens
aggctggagtgcaatggt

SEQ ID NO: 3018574 - DNA, 12 bp, Homo sapiens
aggctggccagc

SEQ ID NO: 3018575 - DNA, 18 bp, Homo sapiens
aggctggccagccgctct

SEQ ID NO: 3018576 - DNA, 23 bp, Homo sapiens
aggctgggccgcaagggcctgga

SEQ ID NO: 3018577 - DNA, 24 bp, Homo sapiens
aggctgggccgcaagggcctggac

SEQ ID NO: 3018578 - DNA, 12 bp, Homo sapiens
aggctgggctga

SEQ ID NO: 3018579 - DNA, 15 bp, Homo sapiens
aggctgggtgacaga

SEQ ID NO: 3018580 - DNA, 21 bp, Homo sapiens
aggctggtacaacggaggcct

SEQ ID NO: 3018581 - DNA, 17 bp, Homo sapiens
aggctggtctaaaactc

SEQ ID NO: 3018582 - DNA, 13 bp, Homo sapiens
aggctggtcttga

SEQ ID NO: 3018583 - DNA, 22 bp, Homo sapiens
aggctggtcttgaactgggctc

SEQ ID NO: 3018584 - DNA, 22 bp, Homo sapiens
aggctgtcccaagctcccaaga

SEQ ID NO: 3018585 - DNA, 23 bp, Homo sapiens
aggctgtcccaagctcccaagag

SEQ ID NO: 3018586 - DNA, 21 bp, Homo sapiens
aggctgtccttacccatctgc

SEQ ID NO: 3018587 - DNA, 15 bp, Homo sapiens
aggctgtgctgccct

SEQ ID NO: 3018588 - DNA, 17 bp, Homo sapiens
aggctgtgctgccctga

SEQ ID NO: 3018589 - DNA, 22 bp, Homo sapiens
aggctgtgctgccctgaagaat

SEQ ID NO: 3018590 - DNA, 15 bp, Homo sapiens
aggctgtgtccctgc

SEQ ID NO: 3018591 - DNA, 16 bp, Homo sapiens
aggctgtgtccctgct

SEQ ID NO: 3018592 - DNA, 20 bp, Homo sapiens
aggctgtgtccctgctgggg

SEQ ID NO: 3018593 - DNA, 17 bp, Homo sapiens
aggctgtgtttagattg

SEQ ID NO: 3018594 - DNA, 18 bp, Homo sapiens
aggctgtgtttggctttc

SEQ ID NO: 3018595 - DNA, 12 bp, Homo sapiens
aggctgtttgct

SEQ ID NO: 3018596 - DNA, 18 bp, Homo sapiens
aggcttaatacctgggtg

SEQ ID NO: 3018597 - DNA, 19 bp, Homo sapiens
aggcttcaaaatgttatct

SEQ ID NO: 3018598 - DNA, 20 bp, Homo sapiens
aggcttccctgacttgcttt

SEQ ID NO: 3018599 - DNA, 21 bp, Homo sapiens
aggcttccctgacttgcttta

SEQ ID NO: 3018600 - DNA, 23 bp, Homo sapiens
agtagcacaagttatttaaatct

SEQ ID NO: 3018601 - DNA, 16 bp, Homo sapiens
agtagcaccaaataaa

SEQ ID NO: 3018602 - DNA, 21 bp, Homo sapiens
agtagccatgttaacatgaca

SEQ ID NO: 3018603 - DNA, 19 bp, Homo sapiens
agtagccatttttttgcag

SEQ ID NO: 3018604 - DNA, 22 bp, Homo sapiens
agtagcccctaatcacatgtgc

SEQ ID NO: 3018605 - DNA, 16 bp, Homo sapiens
agtagccgagagcctg

SEQ ID NO: 3018606 - DNA, 19 bp, Homo sapiens
agtagccgagagcctgctc

SEQ ID NO: 3018607 - DNA, 22 bp, Homo sapiens
agtagcctaacacactccaaga

SEQ ID NO: 3018608 - DNA, 18 bp, Homo sapiens
agtagctgctaccttctt

SEQ ID NO: 3018609 - DNA, 17 bp, Homo sapiens
agtagctggattacagg

SEQ ID NO: 3018610 - DNA, 14 bp, Homo sapiens
agtagctgggacta

SEQ ID NO: 3018611 - DNA, 21 bp, Homo sapiens
agtagctgtcagatgtcacat

SEQ ID NO: 3018612 - DNA, 22 bp, Homo sapiens
agtagcttaagggaatatgcat

SEQ ID NO: 3018613 - DNA, 13 bp, Homo sapiens
agtaggagcccag

SEQ ID NO: 3018614 - DNA, 14 bp, Homo sapiens
agtaggccctggtt

SEQ ID NO: 3018615 - DNA, 22 bp, Homo sapiens
agtagggaaaatagggtccttg

SEQ ID NO: 3018616 - DNA, 21 bp, Homo sapiens
agtagggaggaccacaggtgt

SEQ ID NO: 3018617 - DNA, 18 bp, Homo sapiens
agtagggcttagtgtttt

SEQ ID NO: 3018618 - DNA, 23 bp, Homo sapiens
agtaggggaggagcacagtttgt

SEQ ID NO: 3018619 - DNA, 18 bp, Homo sapiens
agtagggtagaaggaaag

SEQ ID NO: 3018620 - DNA, 13 bp, Homo sapiens
agtagtaccttgt

SEQ ID NO: 3018621 - DNA, 14 bp, Homo sapiens
agtagtaccttgtt

SEQ ID NO: 3018622 - DNA, 14 bp, Homo sapiens
agtagttaaaaaaa

SEQ ID NO: 3018623 - DNA, 18 bp, Homo sapiens
agtagttatataattgtt

SEQ ID NO: 3018624 - DNA, 19 bp, Homo sapiens
agtagttctcttggtgtta

SEQ ID NO: 3018625 - DNA, 13 bp, Homo sapiens
agtataacaaact

SEQ ID NO: 3018626 - DNA, 23 bp, Homo sapiens
agtatacggaaacaaaaatgatc

SEQ ID NO: 3018627 - DNA, 23 bp, Homo sapiens
agtatactagggagccatttgag

SEQ ID NO: 3018628 - DNA, 16 bp, Homo sapiens
agtatatacttttaaa

SEQ ID NO: 3018629 - DNA, 19 bp, Homo sapiens
agtatatacttttaaatta

SEQ ID NO: 3018630 - DNA, 15 bp, Homo sapiens
agtatatgaaatatt

SEQ ID NO: 3018631 - DNA, 21 bp, Homo sapiens
agtatatgaaatattttgaat

SEQ ID NO: 3018632 - DNA, 15 bp, Homo sapiens
agtatcaaatattag

SEQ ID NO: 3018633 - DNA, 21 bp, Homo sapiens
agtatcaaatattagatgtga

SEQ ID NO: 3018634 - DNA, 23 bp, Homo sapiens
agtatcaaatattagatgtgatt

SEQ ID NO: 3018635 - DNA, 13 bp, Homo sapiens
agtatcagaattg

SEQ ID NO: 3018636 - DNA, 14 bp, Homo sapiens
agtatcagaattga

SEQ ID NO: 3018637 - DNA, 20 bp, Homo sapiens
agtatcatcagatagcatct

SEQ ID NO: 3018638 - DNA, 19 bp, Homo sapiens
agtatcatgccctgtgcaa

SEQ ID NO: 3018639 - DNA, 14 bp, Homo sapiens
agtatcctgctggt

SEQ ID NO: 3018640 - DNA, 14 bp, Homo sapiens
agtatctaaaagtg

SEQ ID NO: 3018641 - DNA, 22 bp, Homo sapiens
agtatctatatatgtgtatgta

SEQ ID NO: 3018642 - DNA, 23 bp, Homo sapiens
agtatctatatatgtgtatgtac

SEQ ID NO: 3018643 - DNA, 18 bp, Homo sapiens
agtatctcctcgcaagct

SEQ ID NO: 3018644 - DNA, 19 bp, Homo sapiens
agtatctcctcgcaagctg

SEQ ID NO: 3018645 - DNA, 20 bp, Homo sapiens
agtatcttctatttttatca

SEQ ID NO: 3018646 - DNA, 14 bp, Homo sapiens
agtatggaattttc

SEQ ID NO: 3018647 - DNA, 15 bp, Homo sapiens
agtatggatgggtgg

SEQ ID NO: 3018648 - DNA, 21 bp, Homo sapiens
agtatgtgccaggaaactctt

SEQ ID NO: 3018649 - DNA, 18 bp, Homo sapiens
agtatgtgtttgtgtgtg

SEQ ID NO: 3018650 - DNA, 19 bp, Homo sapiens
agtatgtgtttgtgtgtgt

SEQ ID NO: 3018651 - DNA, 14 bp, Homo sapiens
agtatgttttacac

SEQ ID NO: 3018652 - DNA, 17 bp, Homo sapiens
agtatgttttacactgt

SEQ ID NO: 3018653 - DNA, 18 bp, Homo sapiens
agtattattttccaaaag

SEQ ID NO: 3018654 - DNA, 16 bp, Homo sapiens
agtattgattctgctt

SEQ ID NO: 3018655 - DNA, 13 bp, Homo sapiens
agtattgtaaatt

SEQ ID NO: 3018656 - DNA, 15 bp, Homo sapiens
agtattgtaaattat

SEQ ID NO: 3018657 - DNA, 16 bp, Homo sapiens
agtattgtaaattata

SEQ ID NO: 3018658 - DNA, 20 bp, Homo sapiens
agtatttcaaattggagctt

SEQ ID NO: 3018659 - DNA, 11 bp, Homo sapiens
agtatttctga

SEQ ID NO: 3018660 - DNA, 13 bp, Homo sapiens
agtatttgattca

SEQ ID NO: 3018661 - DNA, 18 bp, Homo sapiens
agtatttggaaaaagaaa

SEQ ID NO: 3018662 - DNA, 19 bp, Homo sapiens
agtatttggtccaaaaaaa

SEQ ID NO: 3018663 - DNA, 22 bp, Homo sapiens
agtatttggtccaaaaaaagga

SEQ ID NO: 3018664 - DNA, 13 bp, Homo sapiens
agtattttcctcc

SEQ ID NO: 3018665 - DNA, 16 bp, Homo sapiens
agtattttcctgtaaa

SEQ ID NO: 3018666 - DNA, 17 bp, Homo sapiens
agtcaaaaggtgcctgt

SEQ ID NO: 3018667 - DNA, 18 bp, Homo sapiens
agtcaaaaggtgcctgtg

SEQ ID NO: 3018668 - DNA, 22 bp, Homo sapiens
agtcaaataaatgtttccccca

SEQ ID NO: 3018669 - DNA, 15 bp, Homo sapiens
agtcaacctgcctga

SEQ ID NO: 3018670 - DNA, 19 bp, Homo sapiens
agtcaactggctggccagt

SEQ ID NO: 3018671 - DNA, 20 bp, Homo sapiens
agtcaactggctggccagtc

SEQ ID NO: 3018672 - DNA, 15 bp, Homo sapiens
agtcaagagcatcct

SEQ ID NO: 3018673 - DNA, 18 bp, Homo sapiens
agtcaagctcctcctccc

SEQ ID NO: 3018674 - DNA, 16 bp, Homo sapiens
agtcaaggtgctcaat

SEQ ID NO: 3018675 - DNA, 17 bp, Homo sapiens
agtcaatatttttagat

SEQ ID NO: 3018676 - DNA, 12 bp, Homo sapiens
agtcaatcaagt

SEQ ID NO: 3018677 - DNA, 15 bp, Homo sapiens
agtcaattcagtgat

SEQ ID NO: 3018678 - DNA, 23 bp, Homo sapiens
agtcacaatgttctttatataca

SEQ ID NO: 3018679 - DNA, 16 bp, Homo sapiens
agtcacactgctagca

SEQ ID NO: 3018680 - DNA, 19 bp, Homo sapiens
agtcaccaggaatgttaaa

SEQ ID NO: 3018681 - DNA, 24 bp, Homo sapiens
agtcacccttccaccattgtccta

SEQ ID NO: 3018682 - DNA, 13 bp, Homo sapiens
agtcactggcagc

SEQ ID NO: 3018683 - DNA, 17 bp, Homo sapiens
agtcactggcagcctgc

SEQ ID NO: 3018684 - DNA, 22 bp, Homo sapiens
agtcactggcagcctgcacctg

SEQ ID NO: 3018685 - DNA, 24 bp, Homo sapiens
agtcactgtgagctcccaggtgca

SEQ ID NO: 3018686 - DNA, 14 bp, Homo sapiens
agtcacttctccat

SEQ ID NO: 3018687 - DNA, 15 bp, Homo sapiens
agtcacttctccatc

SEQ ID NO: 3018688 - DNA, 15 bp, Homo sapiens
agtcagaacagcaga

SEQ ID NO: 3018689 - DNA, 22 bp, Homo sapiens
agtcagaatttttaactgtact

SEQ ID NO: 3018690 - DNA, 13 bp, Homo sapiens
agtcagagaaaac

SEQ ID NO: 3018691 - DNA, 18 bp, Homo sapiens
agtcagagaaaacacttt

SEQ ID NO: 3018692 - DNA, 21 bp, Homo sapiens
agtcagatacgcaacctcctt

SEQ ID NO: 3018693 - DNA, 13 bp, Homo sapiens
agtcagcaccttg

SEQ ID NO: 3018694 - DNA, 18 bp, Homo sapiens
agtcagccaggagctgtc

SEQ ID NO: 3018695 - DNA, 18 bp, Homo sapiens
agtcagccatgtctgtgc

SEQ ID NO: 3018696 - DNA, 19 bp, Homo sapiens
agtcagctacaaaagttaa

SEQ ID NO: 3018697 - DNA, 20 bp, Homo sapiens
agtcagctcttcatctgccc

SEQ ID NO: 3018698 - DNA, 13 bp, Homo sapiens
agtcagctgaccc

SEQ ID NO: 3018699 - DNA, 22 bp, Homo sapiens
agtcagctgaccccctcccccc

SEQ ID NO: 3018700 - DNA, 15 bp, Homo sapiens
agtcagctggccaga

SEQ ID NO: 3018701 - DNA, 22 bp, Homo sapiens
agtcagctggccagatttcctc

SEQ ID NO: 3018702 - DNA, 12 bp, Homo sapiens
agtcaggaaagg

SEQ ID NO: 3018703 - DNA, 15 bp, Homo sapiens
agtcaggacctggct

SEQ ID NO: 3018704 - DNA, 17 bp, Homo sapiens
agtcaggccaggtgggc

SEQ ID NO: 3018705 - DNA, 18 bp, Homo sapiens
agtcaggggtcaggtgtc

SEQ ID NO: 3018706 - DNA, 21 bp, Homo sapiens
agtcaggggtcaggtgtcagg

SEQ ID NO: 3018707 - DNA, 22 bp, Homo sapiens
agtcagtgggaacgtgactgcc

SEQ ID NO: 3018708 - DNA, 21 bp, Homo sapiens
agtcataacggttaagaaagc

SEQ ID NO: 3018709 - DNA, 15 bp, Homo sapiens
agtcataagctccag

SEQ ID NO: 3018710 - DNA, 14 bp, Homo sapiens
agtcataccaatga

SEQ ID NO: 3018711 - DNA, 17 bp, Homo sapiens
agtcataccaatgaaaa

SEQ ID NO: 3018712 - DNA, 15 bp, Homo sapiens
agtcatacctgctcc

SEQ ID NO: 3018713 - DNA, 18 bp, Homo sapiens
agtcatataaaagctatg

SEQ ID NO: 3018714 - DNA, 15 bp, Homo sapiens
agtcatcaacaatga

SEQ ID NO: 3018715 - DNA, 19 bp, Homo sapiens
agtcatcaacaatgattaa

SEQ ID NO: 3018716 - DNA, 13 bp, Homo sapiens
agtcatcatctct

SEQ ID NO: 3018717 - DNA, 19 bp, Homo sapiens
agtcatcatctcttgataa

SEQ ID NO: 3018718 - DNA, 20 bp, Homo sapiens
agtcatcttgaccaagcagg

SEQ ID NO: 3018719 - DNA, 15 bp, Homo sapiens
agtcatgatctccct

SEQ ID NO: 3018720 - DNA, 19 bp, Homo sapiens
agtcatgatctccctgccg

SEQ ID NO: 3018721 - DNA, 21 bp, Homo sapiens
agtcatgatctccctgccgcc

SEQ ID NO: 3018722 - DNA, 23 bp, Homo sapiens
agtcatgatctccctgccgcctc

SEQ ID NO: 3018723 - DNA, 16 bp, Homo sapiens
agtcatgggaacgcag

SEQ ID NO: 3018724 - DNA, 16 bp, Homo sapiens
agtcatgtaaatactg

SEQ ID NO: 3018725 - DNA, 14 bp, Homo sapiens
agtcatgtgcctct

SEQ ID NO: 3018726 - DNA, 16 bp, Homo sapiens
agtcattaaaaacata

SEQ ID NO: 3018727 - DNA, 21 bp, Homo sapiens
agtcattaaaaacatagaaaa

SEQ ID NO: 3018728 - DNA, 18 bp, Homo sapiens
agtcattatccttgctat

SEQ ID NO: 3018729 - DNA, 13 bp, Homo sapiens
agtcattgctgta

SEQ ID NO: 3018730 - DNA, 18 bp, Homo sapiens
agtcatttgagtctctta

SEQ ID NO: 3018731 - DNA, 19 bp, Homo sapiens
agtcattttcacttttaaa

SEQ ID NO: 3018732 - DNA, 15 bp, Homo sapiens
agttaacatcatgaa

SEQ ID NO: 3018733 - DNA, 16 bp, Homo sapiens
agttaaggaaagaaag

SEQ ID NO: 3018734 - DNA, 20 bp, Homo sapiens
agttaaggtgtgcagtgttt

SEQ ID NO: 3018735 - DNA, 19 bp, Homo sapiens
agttaataagttgatgttt

SEQ ID NO: 3018736 - DNA, 21 bp, Homo sapiens
agttaataagttgatgttttc

SEQ ID NO: 3018737 - DNA, 21 bp, Homo sapiens
agttaatctcctcagacagta

SEQ ID NO: 3018738 - DNA, 16 bp, Homo sapiens
agttaatgcttaagag

SEQ ID NO: 3018739 - DNA, 19 bp, Homo sapiens
agttaattagcattctggc

SEQ ID NO: 3018740 - DNA, 19 bp, Homo sapiens
agttacaggggattttatt

SEQ ID NO: 3018741 - DNA, 14 bp, Homo sapiens
agttacatgcataa

SEQ ID NO: 3018742 - DNA, 15 bp, Homo sapiens
agttacatgcataaa

SEQ ID NO: 3018743 - DNA, 16 bp, Homo sapiens
agttacatgcataaaa

SEQ ID NO: 3018744 - DNA, 20 bp, Homo sapiens
agttacatgcatacttcaaa

SEQ ID NO: 3018745 - DNA, 22 bp, Homo sapiens
agttacatgcatacttcaaaag

SEQ ID NO: 3018746 - DNA, 19 bp, Homo sapiens
agttacattaatgcccagc

SEQ ID NO: 3018747 - DNA, 13 bp, Homo sapiens
agttactcaagca

SEQ ID NO: 3018748 - DNA, 15 bp, Homo sapiens
agttactcagccctg

SEQ ID NO: 3018749 - DNA, 23 bp, Homo sapiens
agttactcagccctgggccccac

SEQ ID NO: 3018750 - DNA, 20 bp, Homo sapiens
agttactccctacactgatg

SEQ ID NO: 3018751 - DNA, 22 bp, Homo sapiens
agttactccctacactgatgca

SEQ ID NO: 3018752 - DNA, 15 bp, Homo sapiens
agttactctgaaggg

SEQ ID NO: 3018753 - DNA, 18 bp, Homo sapiens
agttactgattcactgca

SEQ ID NO: 3018754 - DNA, 17 bp, Homo sapiens
agttactgcaacttaac

SEQ ID NO: 3018755 - DNA, 14 bp, Homo sapiens
agttactgtgcatt

SEQ ID NO: 3018756 - DNA, 17 bp, Homo sapiens
agttactgttgtgacct

SEQ ID NO: 3018757 - DNA, 19 bp, Homo sapiens
agttacttaagattcagtt

SEQ ID NO: 3018758 - DNA, 22 bp, Homo sapiens
agttagattattgaaatattat

SEQ ID NO: 3018759 - DNA, 20 bp, Homo sapiens
agttagcatttaccaacatg

SEQ ID NO: 3018760 - DNA, 22 bp, Homo sapiens
agttagcatttaccaacatgta

SEQ ID NO: 3018761 - DNA, 16 bp, Homo sapiens
agttaggaatgagaag

SEQ ID NO: 3018762 - DNA, 23 bp, Homo sapiens
agttagtctactcttaagccatc

SEQ ID NO: 3018763 - DNA, 23 bp, Homo sapiens
agttatataggttttgtttgcta

SEQ ID NO: 3018764 - DNA, 14 bp, Homo sapiens
agttatcctgcaag

SEQ ID NO: 3018765 - DNA, 18 bp, Homo sapiens
agttatctgttcttttga

SEQ ID NO: 3018766 - DNA, 23 bp, Homo sapiens
agttatgtgggtggcttctagtt

SEQ ID NO: 3018767 - DNA, 18 bp, Homo sapiens
agttattaagttctttaa

SEQ ID NO: 3018768 - DNA, 19 bp, Homo sapiens
agttattaagttctttaaa

SEQ ID NO: 3018769 - DNA, 16 bp, Homo sapiens
agttattcaaatgaag

SEQ ID NO: 3018770 - DNA, 17 bp, Homo sapiens
agttattcaaatgaagg

SEQ ID NO: 3018771 - DNA, 16 bp, Homo sapiens
agttattgcagtttat

SEQ ID NO: 3018772 - DNA, 16 bp, Homo sapiens
agttatttaagaagaa

SEQ ID NO: 3018773 - DNA, 22 bp, Homo sapiens
agttatttctgcctataaattt

SEQ ID NO: 3018774 - DNA, 11 bp, Homo sapiens
agttattttat

SEQ ID NO: 3018775 - DNA, 20 bp, Homo sapiens
agttcaaaattctaaatgta

SEQ ID NO: 3018776 - DNA, 18 bp, Homo sapiens
agttcaagaccagcctgt

SEQ ID NO: 3018777 - DNA, 19 bp, Homo sapiens
agttcaagactagcctggc

SEQ ID NO: 3018778 - DNA, 11 bp, Homo sapiens
agttcactttt

SEQ ID NO: 3018779 - DNA, 12 bp, Homo sapiens
agttcagagttt

SEQ ID NO: 3018780 - DNA, 17 bp, Homo sapiens
agttcagagttttctgg

SEQ ID NO: 3018781 - DNA, 21 bp, Homo sapiens
agttcagcatccgcaggtgct

SEQ ID NO: 3018782 - DNA, 20 bp, Homo sapiens
agttcaggtagctgcccctg

SEQ ID NO: 3018783 - DNA, 14 bp, Homo sapiens
agttccacagattg

SEQ ID NO: 3018784 - DNA, 13 bp, Homo sapiens
agttccagctttt

SEQ ID NO: 3018785 - DNA, 12 bp, Homo sapiens
agttccaggaca

SEQ ID NO: 3018786 - DNA, 23 bp, Homo sapiens
agttccatatagacaccaaggag

SEQ ID NO: 3018787 - DNA, 24 bp, Homo sapiens
agttccctgaaaacccagagagga

SEQ ID NO: 3018788 - DNA, 21 bp, Homo sapiens
agttccctttgcttgtcttct

SEQ ID NO: 3018789 - DNA, 17 bp, Homo sapiens
agttcctagccaccgcc

SEQ ID NO: 3018790 - DNA, 16 bp, Homo sapiens
agttcctcgccctggg

SEQ ID NO: 3018791 - DNA, 18 bp, Homo sapiens
agttcctctcccttccct

SEQ ID NO: 3018792 - DNA, 12 bp, Homo sapiens
agttcctgctcc

SEQ ID NO: 3018793 - DNA, 14 bp, Homo sapiens
agttcctgctccgt

SEQ ID NO: 3018794 - DNA, 13 bp, Homo sapiens
agttcctgctgcc

SEQ ID NO: 3018795 - DNA, 14 bp, Homo sapiens
agttcctgctgcct

SEQ ID NO: 3018796 - DNA, 15 bp, Homo sapiens
agttcctgctgcctg

SEQ ID NO: 3018797 - DNA, 19 bp, Homo sapiens
agttcctgctgcctgggta

SEQ ID NO: 3018798 - DNA, 13 bp, Homo sapiens
agttcgagaccaa

SEQ ID NO: 3018799 - DNA, 17 bp, Homo sapiens
agttcgagaccagcctg

SEQ ID NO: 3018800 - DNA, 20 bp, Homo sapiens
agttcggtgagctacaaatg

SEQ ID NO: 3018801 - DNA, 21 bp, Homo sapiens
agttctaaaaagatgtaataa

SEQ ID NO: 3018802 - DNA, 13 bp, Homo sapiens
agttctaagattc

SEQ ID NO: 3018803 - DNA, 16 bp, Homo sapiens
agttctaataatttct

SEQ ID NO: 3018804 - DNA, 17 bp, Homo sapiens
agttctaataatttcta

SEQ ID NO: 3018805 - DNA, 18 bp, Homo sapiens
agttctaataatttctaa

SEQ ID NO: 3018806 - DNA, 20 bp, Homo sapiens
agttctaataatttctaatg

SEQ ID NO: 3018807 - DNA, 10 bp, Homo sapiens
agttctagac

SEQ ID NO: 3018808 - DNA, 21 bp, Homo sapiens
agttctagacatggaggttct

SEQ ID NO: 3018809 - DNA, 23 bp, Homo sapiens
agttctaggtgctaaaattcaga

SEQ ID NO: 3018810 - DNA, 15 bp, Homo sapiens
agttctagttgcttg

SEQ ID NO: 3018811 - DNA, 15 bp, Homo sapiens
agttctagtttgcat

SEQ ID NO: 3018812 - DNA, 15 bp, Homo sapiens
agttctcaaatgtgt

SEQ ID NO: 3018813 - DNA, 17 bp, Homo sapiens
agttctcaaatgtgtgt

SEQ ID NO: 3018814 - DNA, 17 bp, Homo sapiens
agttctccttttgaact

SEQ ID NO: 3018815 - DNA, 20 bp, Homo sapiens
agttctccttttgaacttgt

SEQ ID NO: 3018816 - DNA, 23 bp, Homo sapiens
agttctccttttgaacttgtcac

SEQ ID NO: 3018817 - DNA, 20 bp, Homo sapiens
agttctcttggtgttaaaac

SEQ ID NO: 3018818 - DNA, 13 bp, Homo sapiens
agttctgaagaat

SEQ ID NO: 3018819 - DNA, 16 bp, Homo sapiens
agttctgcactccaga

SEQ ID NO: 3018820 - DNA, 13 bp, Homo sapiens
agttctgccagga

SEQ ID NO: 3018821 - DNA, 20 bp, Homo sapiens
agttctgccaggagacaggt

SEQ ID NO: 3018822 - DNA, 23 bp, Homo sapiens
agttctgtactcaaatgtagcca

SEQ ID NO: 3018823 - DNA, 18 bp, Homo sapiens
agttcttaatacaggaga

SEQ ID NO: 3018824 - DNA, 23 bp, Homo sapiens
agttcttactgcttaattcaaat

SEQ ID NO: 3018825 - DNA, 17 bp, Homo sapiens
agttctttaaaatgtaa

SEQ ID NO: 3018826 - DNA, 14 bp, Homo sapiens
agttctttggctct

SEQ ID NO: 3018827 - DNA, 17 bp, Homo sapiens
agttctttgttcctgct

SEQ ID NO: 3018828 - DNA, 18 bp, Homo sapiens
agttctttgttcctgctt

SEQ ID NO: 3018829 - DNA, 23 bp, Homo sapiens
agttctttgttcctgctttctct

SEQ ID NO: 3018830 - DNA, 21 bp, Homo sapiens
agttcttttttgtacagtatt

SEQ ID NO: 3018831 - DNA, 18 bp, Homo sapiens
agttgaaaataaagtgta

SEQ ID NO: 3018832 - DNA, 19 bp, Homo sapiens
agttgaaaataaagtgtat

SEQ ID NO: 3018833 - DNA, 15 bp, Homo sapiens
agttgaaagggcaat

SEQ ID NO: 3018834 - DNA, 13 bp, Homo sapiens
agttgaactgata

SEQ ID NO: 3018835 - DNA, 23 bp, Homo sapiens
agttgaactgatagttactgttg

SEQ ID NO: 3018836 - DNA, 20 bp, Homo sapiens
agttgaaggttaaaggaaaa

SEQ ID NO: 3018837 - DNA, 13 bp, Homo sapiens
agttgacatggaa

SEQ ID NO: 3018838 - DNA, 19 bp, Homo sapiens
agttgagactcggccgcag

SEQ ID NO: 3018839 - DNA, 20 bp, Homo sapiens
agttgagactcggccgcagc

SEQ ID NO: 3018840 - DNA, 21 bp, Homo sapiens
agttgagggaaacccccagcc

SEQ ID NO: 3018841 - DNA, 13 bp, Homo sapiens
agttgatctggaa

SEQ ID NO: 3018842 - DNA, 15 bp, Homo sapiens
agttgatgaaatgga

SEQ ID NO: 3018843 - DNA, 22 bp, Homo sapiens
agttgattgtacgtagccacag

SEQ ID NO: 3018844 - DNA, 16 bp, Homo sapiens
agttgattttctggat

SEQ ID NO: 3018845 - DNA, 18 bp, Homo sapiens
agttgccccgtctctgtt

SEQ ID NO: 3018846 - DNA, 16 bp, Homo sapiens
agttgcgtggactctg

SEQ ID NO: 3018847 - DNA, 13 bp, Homo sapiens
agttgctaaacac

SEQ ID NO: 3018848 - DNA, 15 bp, Homo sapiens
agttgctaaacactg

SEQ ID NO: 3018849 - DNA, 16 bp, Homo sapiens
agttgctaaacactgc

SEQ ID NO: 3018850 - DNA, 15 bp, Homo sapiens
agttgctggcatgtc

SEQ ID NO: 3018851 - DNA, 18 bp, Homo sapiens
agttgcttcttcagctga

SEQ ID NO: 3018852 - DNA, 19 bp, Homo sapiens
agttggagttttttgtacc

SEQ ID NO: 3018853 - DNA, 20 bp, Homo sapiens
agttggcgttgtgggcaggc

SEQ ID NO: 3018854 - DNA, 22 bp, Homo sapiens
agttggctagagcttctgtatt

SEQ ID NO: 3018855 - DNA, 20 bp, Homo sapiens
agttggggcccagtccttgg

SEQ ID NO: 3018856 - DNA, 21 bp, Homo sapiens
agttggtcttactttgtgcaa

SEQ ID NO: 3018857 - DNA, 23 bp, Homo sapiens
agttggtgagaaacctgtatctt

SEQ ID NO: 3018858 - DNA, 20 bp, Homo sapiens
agttgtagaatgtattgtac

SEQ ID NO: 3018859 - DNA, 21 bp, Homo sapiens
agttgtattttgtacattttg

SEQ ID NO: 3018860 - DNA, 16 bp, Homo sapiens
agttgtcctatggaca

SEQ ID NO: 3018861 - DNA, 20 bp, Homo sapiens
agttgtcctatggacaactt

SEQ ID NO: 3018862 - DNA, 17 bp, Homo sapiens
agttgtctttctttgct

SEQ ID NO: 3018863 - DNA, 22 bp, Homo sapiens
atactggttatcctgtgctaca

SEQ ID NO: 3018864 - DNA, 12 bp, Homo sapiens
atactgtaaaga

SEQ ID NO: 3018865 - DNA, 14 bp, Homo sapiens
atactgtaaagaaa

SEQ ID NO: 3018866 - DNA, 19 bp, Homo sapiens
atactgtaaagaaagagag

SEQ ID NO: 3018867 - DNA, 20 bp, Homo sapiens
atactgtaaagaaagagaga

SEQ ID NO: 3018868 - DNA, 22 bp, Homo sapiens
atactgtaaagaaagagagaaa

SEQ ID NO: 3018869 - DNA, 16 bp, Homo sapiens
atactgtcccacttct

SEQ ID NO: 3018870 - DNA, 20 bp, Homo sapiens
atactgtcccacttctcatc

SEQ ID NO: 3018871 - DNA, 17 bp, Homo sapiens
atactgtctctttcatg

SEQ ID NO: 3018872 - DNA, 15 bp, Homo sapiens
atactgttgtgcgca

SEQ ID NO: 3018873 - DNA, 24 bp, Homo sapiens
atactgttttatctccatactttg

SEQ ID NO: 3018874 - DNA, 17 bp, Homo sapiens
atacttaataaaacatt

SEQ ID NO: 3018875 - DNA, 18 bp, Homo sapiens
atacttaatactgaattt

SEQ ID NO: 3018876 - DNA, 24 bp, Homo sapiens
atacttactgaactgtgtgtaatt

SEQ ID NO: 3018877 - DNA, 17 bp, Homo sapiens
atacttcagctttgtgt

SEQ ID NO: 3018878 - DNA, 17 bp, Homo sapiens
atacttcgatgatgatg

SEQ ID NO: 3018879 - DNA, 14 bp, Homo sapiens
atacttgaacttgt

SEQ ID NO: 3018880 - DNA, 22 bp, Homo sapiens
atacttgaagggccagagccag

SEQ ID NO: 3018881 - DNA, 13 bp, Homo sapiens
atactttatttct

SEQ ID NO: 3018882 - DNA, 21 bp, Homo sapiens
atactttcggagaaattctct

SEQ ID NO: 3018883 - DNA, 13 bp, Homo sapiens
atactttgttgtt

SEQ ID NO: 3018884 - DNA, 14 bp, Homo sapiens
atactttgttgttt

SEQ ID NO: 3018885 - DNA, 17 bp, Homo sapiens
atacttttaaattatgg

SEQ ID NO: 3018886 - DNA, 16 bp, Homo sapiens
atacttttaatcaagt

SEQ ID NO: 3018887 - DNA, 21 bp, Homo sapiens
atacttttaatcaagtagaac

SEQ ID NO: 3018888 - DNA, 23 bp, Homo sapiens
atacttttgataatagataactg

SEQ ID NO: 3018889 - DNA, 16 bp, Homo sapiens
atacttttgccctttg

SEQ ID NO: 3018890 - DNA, 13 bp, Homo sapiens
atactttttacaa

SEQ ID NO: 3018891 - DNA, 13 bp, Homo sapiens
atactttttctaa

SEQ ID NO: 3018892 - DNA, 17 bp, Homo sapiens
atactttttctaatgag

SEQ ID NO: 3018893 - DNA, 15 bp, Homo sapiens
atagaaaagttatta

SEQ ID NO: 3018894 - DNA, 16 bp, Homo sapiens
atagaaatgccaagca

SEQ ID NO: 3018895 - DNA, 19 bp, Homo sapiens
atagaaatgccaagcactt

SEQ ID NO: 3018896 - DNA, 20 bp, Homo sapiens
atagaaatggtttcctctgg

SEQ ID NO: 3018897 - DNA, 17 bp, Homo sapiens
atagaaatgtattttga

SEQ ID NO: 3018898 - DNA, 16 bp, Homo sapiens
atagaacactgatgga

SEQ ID NO: 3018899 - DNA, 11 bp, Homo sapiens
atagaataaaa

SEQ ID NO: 3018900 - DNA, 13 bp, Homo sapiens
atagaataaaagc

SEQ ID NO: 3018901 - DNA, 16 bp, Homo sapiens
atagaataaaagctgt

SEQ ID NO: 3018902 - DNA, 13 bp, Homo sapiens
atagaattagctt

SEQ ID NO: 3018903 - DNA, 15 bp, Homo sapiens
atagaattagctttt

SEQ ID NO: 3018904 - DNA, 20 bp, Homo sapiens
atagaattagctttttcatc

SEQ ID NO: 3018905 - DNA, 22 bp, Homo sapiens
atagaattatttcacaaataat

SEQ ID NO: 3018906 - DNA, 15 bp, Homo sapiens
atagaatttcctaat

SEQ ID NO: 3018907 - DNA, 22 bp, Homo sapiens
atagacactccccgaagtcttt

SEQ ID NO: 3018908 - DNA, 20 bp, Homo sapiens
atagacatttcaaaattaat

SEQ ID NO: 3018909 - DNA, 16 bp, Homo sapiens
atagacatttgtaaat

SEQ ID NO: 3018910 - DNA, 19 bp, Homo sapiens
atagaccctctttcttgtt

SEQ ID NO: 3018911 - DNA, 16 bp, Homo sapiens
atagactgaagattta

SEQ ID NO: 3018912 - DNA, 17 bp, Homo sapiens
atagactgaagatttat

SEQ ID NO: 3018913 - DNA, 23 bp, Homo sapiens
atagacttggagaatactgccaa

SEQ ID NO: 3018914 - DNA, 17 bp, Homo sapiens
atagagagttgttgtgt

SEQ ID NO: 3018915 - DNA, 18 bp, Homo sapiens
atagagatatttaaaaga

SEQ ID NO: 3018916 - DNA, 13 bp, Homo sapiens
atagagcctgagg

SEQ ID NO: 3018917 - DNA, 12 bp, Homo sapiens
atagagcctttg

SEQ ID NO: 3018918 - DNA, 16 bp, Homo sapiens
atagagctgccactgg

SEQ ID NO: 3018919 - DNA, 22 bp, Homo sapiens
atagaggctttgagcaactaac

SEQ ID NO: 3018920 - DNA, 12 bp, Homo sapiens
atagagtgtttt

SEQ ID NO: 3018921 - DNA, 16 bp, Homo sapiens
atagatacttttgata

SEQ ID NO: 3018922 - DNA, 16 bp, Homo sapiens
atagatgactttgcag

SEQ ID NO: 3018923 - DNA, 16 bp, Homo sapiens
atagatgctggcccag

SEQ ID NO: 3018924 - DNA, 17 bp, Homo sapiens
atagatgctggcccagg

SEQ ID NO: 3018925 - DNA, 18 bp, Homo sapiens
atagatgctgtgtatatg

SEQ ID NO: 3018926 - DNA, 21 bp, Homo sapiens
atagatggacagtttgtttcc

SEQ ID NO: 3018927 - DNA, 23 bp, Homo sapiens
atagatggacagtttgtttcctg

SEQ ID NO: 3018928 - DNA, 12 bp, Homo sapiens
atagatgggaat

SEQ ID NO: 3018929 - DNA, 22 bp, Homo sapiens
atagatgtagataaactcagaa

SEQ ID NO: 3018930 - DNA, 15 bp, Homo sapiens
atagatgttttaact

SEQ ID NO: 3018931 - DNA, 21 bp, Homo sapiens
atagatgttttaacttattta

SEQ ID NO: 3018932 - DNA, 18 bp, Homo sapiens
atagattctaaagattct

SEQ ID NO: 3018933 - DNA, 15 bp, Homo sapiens
atagattgtatctct

SEQ ID NO: 3018934 - DNA, 13 bp, Homo sapiens
atagatttgaaga

SEQ ID NO: 3018935 - DNA, 15 bp, Homo sapiens
atagatttgacctcc

SEQ ID NO: 3018936 - DNA, 11 bp, Homo sapiens
atagatttttt

SEQ ID NO: 3018937 - DNA, 14 bp, Homo sapiens
atagattttttaaa

SEQ ID NO: 3018938 - DNA, 23 bp, Homo sapiens
atagattttttaaaaaaaatgtg

SEQ ID NO: 3018939 - DNA, 23 bp, Homo sapiens
atagcaaaacttttaaactacag

SEQ ID NO: 3018940 - DNA, 13 bp, Homo sapiens
atagcaagtgaat

SEQ ID NO: 3018941 - DNA, 14 bp, Homo sapiens
atagcatctgtaca

SEQ ID NO: 3018942 - DNA, 13 bp, Homo sapiens
atagcatgtaatg

SEQ ID NO: 3018943 - DNA, 13 bp, Homo sapiens
atagccacatttg

SEQ ID NO: 3018944 - DNA, 22 bp, Homo sapiens
atagccacatttggaatacttt

SEQ ID NO: 3018945 - DNA, 22 bp, Homo sapiens
atagcccaaagccaagaaagaa

SEQ ID NO: 3018946 - DNA, 15 bp, Homo sapiens
atagccccagactgg

SEQ ID NO: 3018947 - DNA, 18 bp, Homo sapiens
atagccccagactgggcc

SEQ ID NO: 3018948 - DNA, 18 bp, Homo sapiens
atagccctggtgctcctg

SEQ ID NO: 3018949 - DNA, 14 bp, Homo sapiens
atagccttgaaaac

SEQ ID NO: 3018950 - DNA, 17 bp, Homo sapiens
atagcgcctgtataagt

SEQ ID NO: 3018951 - DNA, 14 bp, Homo sapiens
atagcgtcctgccc

SEQ ID NO: 3018952 - DNA, 16 bp, Homo sapiens
atagcgtcctgccctg

SEQ ID NO: 3018953 - DNA, 15 bp, Homo sapiens
atagctaactgtaaa

SEQ ID NO: 3018954 - DNA, 17 bp, Homo sapiens
atagctaactgtaaatc

SEQ ID NO: 3018955 - DNA, 15 bp, Homo sapiens
atagctaataagtag

SEQ ID NO: 3018956 - DNA, 19 bp, Homo sapiens
atagctagctatttctatg

SEQ ID NO: 3018957 - DNA, 21 bp, Homo sapiens
atagctagctatttctatgta

SEQ ID NO: 3018958 - DNA, 15 bp, Homo sapiens
atagctcatccttaa

SEQ ID NO: 3018959 - DNA, 14 bp, Homo sapiens
atagctccaagctg

SEQ ID NO: 3018960 - DNA, 14 bp, Homo sapiens
atagctccttttga

SEQ ID NO: 3018961 - DNA, 20 bp, Homo sapiens
atagctctacacaacatgta

SEQ ID NO: 3018962 - DNA, 16 bp, Homo sapiens
atagctcttcacttcc

SEQ ID NO: 3018963 - DNA, 19 bp, Homo sapiens
atagctgcccatttcgtga

SEQ ID NO: 3018964 - DNA, 21 bp, Homo sapiens
atagctgcccatttcgtgagc

SEQ ID NO: 3018965 - DNA, 13 bp, Homo sapiens
atagctgtattga

SEQ ID NO: 3018966 - DNA, 22 bp, Homo sapiens
atagcttgtttctgtcaagcat

SEQ ID NO: 3018967 - DNA, 18 bp, Homo sapiens
ataggaacatatgaaaat

SEQ ID NO: 3018968 - DNA, 17 bp, Homo sapiens
ataggaagttctttttt

SEQ ID NO: 3018969 - DNA, 20 bp, Homo sapiens
ataggaagttcttttttgta

SEQ ID NO: 3018970 - DNA, 21 bp, Homo sapiens
ataggaagttcttttttgtac

SEQ ID NO: 3018971 - DNA, 21 bp, Homo sapiens
ataggaccaggatccagcctc

SEQ ID NO: 3018972 - DNA, 22 bp, Homo sapiens
ataggactgtggcaaacaaaac

SEQ ID NO: 3018973 - DNA, 15 bp, Homo sapiens
ataggatcctggagg

SEQ ID NO: 3018974 - DNA, 19 bp, Homo sapiens
ataggattgcttcaattaa

SEQ ID NO: 3018975 - DNA, 22 bp, Homo sapiens
ataggattgcttcaattaaaat

SEQ ID NO: 3018976 - DNA, 13 bp, Homo sapiens
ataggcaggaagc

SEQ ID NO: 3018977 - DNA, 12 bp, Homo sapiens
ataggccaaggt

SEQ ID NO: 3018978 - DNA, 15 bp, Homo sapiens
ataggcccacacaca

SEQ ID NO: 3018979 - DNA, 16 bp, Homo sapiens
ataggcccacacacag

SEQ ID NO: 3018980 - DNA, 18 bp, Homo sapiens
ataggcccacacacaggt

SEQ ID NO: 3018981 - DNA, 22 bp, Homo sapiens
atagggcctggtccctgggagg

SEQ ID NO: 3018982 - DNA, 20 bp, Homo sapiens
atagggtctaccaatacaaa

SEQ ID NO: 3018983 - DNA, 14 bp, Homo sapiens
atagggtggcacat

SEQ ID NO: 3018984 - DNA, 16 bp, Homo sapiens
ataggttttgtttgct

SEQ ID NO: 3018985 - DNA, 17 bp, Homo sapiens
ataggttttgtttgcta

SEQ ID NO: 3018986 - DNA, 19 bp, Homo sapiens
ataggttttgtttgctatc

SEQ ID NO: 3018987 - DNA, 12 bp, Homo sapiens
atagtaaagtat

SEQ ID NO: 3018988 - DNA, 21 bp, Homo sapiens
atagtaacttcttatggaatt

SEQ ID NO: 3018989 - DNA, 17 bp, Homo sapiens
atagtaatgagtttaaa

SEQ ID NO: 3018990 - DNA, 16 bp, Homo sapiens
atagtattcttcttcc

SEQ ID NO: 3018991 - DNA, 19 bp, Homo sapiens
atagtatttaattgtttca

SEQ ID NO: 3018992 - DNA, 20 bp, Homo sapiens
atagtatttgattcaaaata

SEQ ID NO: 3018993 - DNA, 22 bp, Homo sapiens
atagtatttgattcaaaatatt

SEQ ID NO: 3018994 - DNA, 17 bp, Homo sapiens
atagtcaatttctactt

SEQ ID NO: 3018995 - DNA, 14 bp, Homo sapiens
atagtcagagtgtc

SEQ ID NO: 3018996 - DNA, 19 bp, Homo sapiens
atatttcttcaagtgagtg

SEQ ID NO: 3018997 - DNA, 23 bp, Homo sapiens
atatttcttcaagtgagtggcat

SEQ ID NO: 3018998 - DNA, 19 bp, Homo sapiens
atatttcttcgttcttttt

SEQ ID NO: 3018999 - DNA, 12 bp, Homo sapiens
atatttgaaaaa

SEQ ID NO: 3019000 - DNA, 22 bp, Homo sapiens
atatttgaaaaaattaaaatct

SEQ ID NO: 3019001 - DNA, 12 bp, Homo sapiens
atatttgacatg

SEQ ID NO: 3019002 - DNA, 17 bp, Homo sapiens
atatttgagttgtgatt

SEQ ID NO: 3019003 - DNA, 22 bp, Homo sapiens
atatttgagttgtgattgaaag

SEQ ID NO: 3019004 - DNA, 14 bp, Homo sapiens
atatttgtaaaaat

SEQ ID NO: 3019005 - DNA, 18 bp, Homo sapiens
atatttgtactgtttaat

SEQ ID NO: 3019006 - DNA, 22 bp, Homo sapiens
atatttgtactgtttaatgttc

SEQ ID NO: 3019007 - DNA, 13 bp, Homo sapiens
atatttgtaggag

SEQ ID NO: 3019008 - DNA, 21 bp, Homo sapiens
atatttgtgaatataatttta

SEQ ID NO: 3019009 - DNA, 17 bp, Homo sapiens
atatttgtgctatagta

SEQ ID NO: 3019010 - DNA, 19 bp, Homo sapiens
atatttgtgctttgaaaaa

SEQ ID NO: 3019011 - DNA, 17 bp, Homo sapiens
atatttgtgtatttaac

SEQ ID NO: 3019012 - DNA, 14 bp, Homo sapiens
atatttgtgttcag

SEQ ID NO: 3019013 - DNA, 17 bp, Homo sapiens
atattttatattaaaat

SEQ ID NO: 3019014 - DNA, 17 bp, Homo sapiens
atattttatttgaaaaa

SEQ ID NO: 3019015 - DNA, 16 bp, Homo sapiens
atattttcaacaatta

SEQ ID NO: 3019016 - DNA, 13 bp, Homo sapiens
atattttctattt

SEQ ID NO: 3019017 - DNA, 20 bp, Homo sapiens
atattttctatttctctgtg

SEQ ID NO: 3019018 - DNA, 13 bp, Homo sapiens
atattttctgttt

SEQ ID NO: 3019019 - DNA, 15 bp, Homo sapiens
atattttgaaatgaa

SEQ ID NO: 3019020 - DNA, 19 bp, Homo sapiens
atattttgaaatgaacttt

SEQ ID NO: 3019021 - DNA, 21 bp, Homo sapiens
atattttgcacagttagcaaa

SEQ ID NO: 3019022 - DNA, 13 bp, Homo sapiens
atatttttagata

SEQ ID NO: 3019023 - DNA, 13 bp, Homo sapiens
atatttttattca

SEQ ID NO: 3019024 - DNA, 21 bp, Homo sapiens
atatttttattcaaactacct

SEQ ID NO: 3019025 - DNA, 19 bp, Homo sapiens
atatttttgataccttcaa

SEQ ID NO: 3019026 - DNA, 14 bp, Homo sapiens
atattttttgtctg

SEQ ID NO: 3019027 - DNA, 20 bp, Homo sapiens
atcaaaactctatcaaatgt

SEQ ID NO: 3019028 - DNA, 21 bp, Homo sapiens
atcaaaagacaattctttata

SEQ ID NO: 3019029 - DNA, 19 bp, Homo sapiens
atcaaaataggatttctta

SEQ ID NO: 3019030 - DNA, 13 bp, Homo sapiens
atcaaaatgcttt

SEQ ID NO: 3019031 - DNA, 14 bp, Homo sapiens
atcaaacaaccttc

SEQ ID NO: 3019032 - DNA, 17 bp, Homo sapiens
atcaaacacaacacaag

SEQ ID NO: 3019033 - DNA, 19 bp, Homo sapiens
atcaaacacaacacaagaa

SEQ ID NO: 3019034 - DNA, 15 bp, Homo sapiens
atcaaagattgaaca

SEQ ID NO: 3019035 - DNA, 14 bp, Homo sapiens
atcaaagccacact

SEQ ID NO: 3019036 - DNA, 19 bp, Homo sapiens
atcaaagccggcctgagaa

SEQ ID NO: 3019037 - DNA, 21 bp, Homo sapiens
atcaaaggaaaatagtaatgt

SEQ ID NO: 3019038 - DNA, 13 bp, Homo sapiens
atcaaagtatttg

SEQ ID NO: 3019039 - DNA, 16 bp, Homo sapiens
atcaaagttctgcttt

SEQ ID NO: 3019040 - DNA, 17 bp, Homo sapiens
atcaaatcttacaaaat

SEQ ID NO: 3019041 - DNA, 19 bp, Homo sapiens
atcaaatgcagtatatttc

SEQ ID NO: 3019042 - DNA, 21 bp, Homo sapiens
atcaacaccaccgagctctgt

SEQ ID NO: 3019043 - DNA, 22 bp, Homo sapiens
atcaacaccaccgagctctgtg

SEQ ID NO: 3019044 - DNA, 15 bp, Homo sapiens
atcaacattcttgtg

SEQ ID NO: 3019045 - DNA, 19 bp, Homo sapiens
atcaaccccagacactggt

SEQ ID NO: 3019046 - DNA, 22 bp, Homo sapiens
atcaactggggggaccaaatag

SEQ ID NO: 3019047 - DNA, 15 bp, Homo sapiens
atcaacttaaaagtc

SEQ ID NO: 3019048 - DNA, 16 bp, Homo sapiens
atcaacttaaagtgaa

SEQ ID NO: 3019049 - DNA, 16 bp, Homo sapiens
atcaactttttattgc

SEQ ID NO: 3019050 - DNA, 23 bp, Homo sapiens
atcaagaagtcagagaaaacact

SEQ ID NO: 3019051 - DNA, 15 bp, Homo sapiens
atcaagagtctctcc

SEQ ID NO: 3019052 - DNA, 16 bp, Homo sapiens
atcaagagtctctcca

SEQ ID NO: 3019053 - DNA, 22 bp, Homo sapiens
atcaagagtctctccagcctca

SEQ ID NO: 3019054 - DNA, 14 bp, Homo sapiens
atcaagattttagg

SEQ ID NO: 3019055 - DNA, 11 bp, Homo sapiens
atcaagctgtg

SEQ ID NO: 3019056 - DNA, 12 bp, Homo sapiens
atcaagctgtga

SEQ ID NO: 3019057 - DNA, 22 bp, Homo sapiens
atcaaggccttattggaaagca

SEQ ID NO: 3019058 - DNA, 19 bp, Homo sapiens
atcaagggtgcgtctggga

SEQ ID NO: 3019059 - DNA, 14 bp, Homo sapiens
atcaaggtgaaata

SEQ ID NO: 3019060 - DNA, 20 bp, Homo sapiens
atcaagtagaacaaaaacta

SEQ ID NO: 3019061 - DNA, 21 bp, Homo sapiens
atcaagtttgaccagtgcagt

SEQ ID NO: 3019062 - DNA, 14 bp, Homo sapiens
atcaataaacgatt

SEQ ID NO: 3019063 - DNA, 23 bp, Homo sapiens
atcaatggaaaaaaataaacttt

SEQ ID NO: 3019064 - DNA, 16 bp, Homo sapiens
atcaatttaaacccat

SEQ ID NO: 3019065 - DNA, 16 bp, Homo sapiens
atcaatttaaatgttt

SEQ ID NO: 3019066 - DNA, 19 bp, Homo sapiens
atcaatttgtaattttagt

SEQ ID NO: 3019067 - DNA, 19 bp, Homo sapiens
atcaattttcattaaactt

SEQ ID NO: 3019068 - DNA, 20 bp, Homo sapiens
atcaattttcattaaacttg

SEQ ID NO: 3019069 - DNA, 22 bp, Homo sapiens
atcaattttcattaaacttgaa

SEQ ID NO: 3019070 - DNA, 14 bp, Homo sapiens
atcacaaaagctgt

SEQ ID NO: 3019071 - DNA, 21 bp, Homo sapiens
atcacaaaagctgtgtctctg

SEQ ID NO: 3019072 - DNA, 11 bp, Homo sapiens
atcacacacat

SEQ ID NO: 3019073 - DNA, 12 bp, Homo sapiens
atcacacacatg

SEQ ID NO: 3019074 - DNA, 13 bp, Homo sapiens
atcacacacatgg

SEQ ID NO: 3019075 - DNA, 14 bp, Homo sapiens
atcacacacatgga

SEQ ID NO: 3019076 - DNA, 21 bp, Homo sapiens
atcacaggagcaatcacagga

SEQ ID NO: 3019077 - DNA, 22 bp, Homo sapiens
atcacaggagcaatcacaggaa

SEQ ID NO: 3019078 - DNA, 19 bp, Homo sapiens
atcacatcttttaagacaa

SEQ ID NO: 3019079 - DNA, 16 bp, Homo sapiens
atcacatgatgaaaaa

SEQ ID NO: 3019080 - DNA, 19 bp, Homo sapiens
atcacattctgcatactaa

SEQ ID NO: 3019081 - DNA, 14 bp, Homo sapiens
atcacatttaaatt

SEQ ID NO: 3019082 - DNA, 23 bp, Homo sapiens
atcaccacaaactgtaatacaat

SEQ ID NO: 3019083 - DNA, 22 bp, Homo sapiens
atcacccacaaccctctggaag

SEQ ID NO: 3019084 - DNA, 15 bp, Homo sapiens
atcacctatttccat

SEQ ID NO: 3019085 - DNA, 22 bp, Homo sapiens
atcacctatttccattcaacaa

SEQ ID NO: 3019086 - DNA, 20 bp, Homo sapiens
atcacctgaaccccagaggc

SEQ ID NO: 3019087 - DNA, 17 bp, Homo sapiens
atcacctgaggtcagga

SEQ ID NO: 3019088 - DNA, 14 bp, Homo sapiens
atcacctgcctgtt

SEQ ID NO: 3019089 - DNA, 15 bp, Homo sapiens
atcacctgcctgtta

SEQ ID NO: 3019090 - DNA, 21 bp, Homo sapiens
atcacctggcttgtttatttt

SEQ ID NO: 3019091 - DNA, 19 bp, Homo sapiens
atcaccttcctcctgtagt

SEQ ID NO: 3019092 - DNA, 23 bp, Homo sapiens
atcacgccattgtactccagcct

SEQ ID NO: 3019093 - DNA, 18 bp, Homo sapiens
atcacgggcggtcctgca

SEQ ID NO: 3019094 - DNA, 16 bp, Homo sapiens
atcactcctggaggct

SEQ ID NO: 3019095 - DNA, 16 bp, Homo sapiens
atcactcgcaggacca

SEQ ID NO: 3019096 - DNA, 12 bp, Homo sapiens
atcactgaaaca

SEQ ID NO: 3019097 - DNA, 24 bp, Homo sapiens
atcactgaaacaaaaattgtcttt

SEQ ID NO: 3019098 - DNA, 22 bp, Homo sapiens
atcactgaaacctttaagaaaa

SEQ ID NO: 3019099 - DNA, 12 bp, Homo sapiens
atcactgaagga

SEQ ID NO: 3019100 - DNA, 22 bp, Homo sapiens
atcactgacacatcagcatgtt

SEQ ID NO: 3019101 - DNA, 21 bp, Homo sapiens
atcactgccagagataaacta

SEQ ID NO: 3019102 - DNA, 19 bp, Homo sapiens
atcactgccttcgtttata

SEQ ID NO: 3019103 - DNA, 10 bp, Homo sapiens
atcactgttt

SEQ ID NO: 3019104 - DNA, 14 bp, Homo sapiens
atcactgtttttag

SEQ ID NO: 3019105 - DNA, 15 bp, Homo sapiens
atcacttgattcata

SEQ ID NO: 3019106 - DNA, 20 bp, Homo sapiens
atcactttgagcctgggaaa

SEQ ID NO: 3019107 - DNA, 17 bp, Homo sapiens
atcagaaaaatggagca

SEQ ID NO: 3019108 - DNA, 22 bp, Homo sapiens
atcagaactcaaatggggccag

SEQ ID NO: 3019109 - DNA, 12 bp, Homo sapiens
atcagaagagag

SEQ ID NO: 3019110 - DNA, 12 bp, Homo sapiens
atcagaaggaga

SEQ ID NO: 3019111 - DNA, 21 bp, Homo sapiens
atcagaagtaactcccactcc

SEQ ID NO: 3019112 - DNA, 19 bp, Homo sapiens
atcagaatagccacatttg

SEQ ID NO: 3019113 - DNA, 14 bp, Homo sapiens
atcagaccctaccc

SEQ ID NO: 3019114 - DNA, 15 bp, Homo sapiens
atcagaccctacccc

SEQ ID NO: 3019115 - DNA, 21 bp, Homo sapiens
atcagactagtatcaagtgtt

SEQ ID NO: 3019116 - DNA, 19 bp, Homo sapiens
atcagagaccaggccctgg

SEQ ID NO: 3019117 - DNA, 18 bp, Homo sapiens
atcagagtgcattagaaa

SEQ ID NO: 3019118 - DNA, 21 bp, Homo sapiens
atcagagtgcattagaaagat

SEQ ID NO: 3019119 - DNA, 18 bp, Homo sapiens
atcagatcatttcaaaac

SEQ ID NO: 3019120 - DNA, 15 bp, Homo sapiens
atcagatgttgaatt

SEQ ID NO: 3019121 - DNA, 16 bp, Homo sapiens
atcagatgttgaattc

SEQ ID NO: 3019122 - DNA, 21 bp, Homo sapiens
atcagattgcatgtgactctg

SEQ ID NO: 3019123 - DNA, 12 bp, Homo sapiens
atcagcaaaaaa

SEQ ID NO: 3019124 - DNA, 14 bp, Homo sapiens
atcagcaaaaagac

SEQ ID NO: 3019125 - DNA, 15 bp, Homo sapiens
atcagcaaaaagact

SEQ ID NO: 3019126 - DNA, 20 bp, Homo sapiens
atcagcaaaaagactggatt

SEQ ID NO: 3019127 - DNA, 15 bp, Homo sapiens
atcagcaatgaagaa

SEQ ID NO: 3019128 - DNA, 13 bp, Homo sapiens
atctgcctggaaa

SEQ ID NO: 3019129 - DNA, 14 bp, Homo sapiens
atctgcctggaaag

SEQ ID NO: 3019130 - DNA, 22 bp, Homo sapiens
atctgcgtgacaataaaacatt

SEQ ID NO: 3019131 - DNA, 18 bp, Homo sapiens
atctgctcactttaaacc

SEQ ID NO: 3019132 - DNA, 22 bp, Homo sapiens
atctgctgtgactgtggccctg

SEQ ID NO: 3019133 - DNA, 11 bp, Homo sapiens
atctggaacct

SEQ ID NO: 3019134 - DNA, 20 bp, Homo sapiens
atctggaacctcagcctggc

SEQ ID NO: 3019135 - DNA, 21 bp, Homo sapiens
atctggaacctcagcctggcc

SEQ ID NO: 3019136 - DNA, 22 bp, Homo sapiens
atctggaacctcagcctggcca

SEQ ID NO: 3019137 - DNA, 14 bp, Homo sapiens
atctggcatggctc

SEQ ID NO: 3019138 - DNA, 20 bp, Homo sapiens
atctggcattctacacctgg

SEQ ID NO: 3019139 - DNA, 16 bp, Homo sapiens
atctggcttacagggg

SEQ ID NO: 3019140 - DNA, 22 bp, Homo sapiens
atctggcttctggccaggaagc

SEQ ID NO: 3019141 - DNA, 14 bp, Homo sapiens
atctgggaaagaca

SEQ ID NO: 3019142 - DNA, 16 bp, Homo sapiens
atctgggaagatttct

SEQ ID NO: 3019143 - DNA, 22 bp, Homo sapiens
atctgggaccctttccttcctt

SEQ ID NO: 3019144 - DNA, 15 bp, Homo sapiens
atctggtatctgcat

SEQ ID NO: 3019145 - DNA, 14 bp, Homo sapiens
atctggtcctaccc

SEQ ID NO: 3019146 - DNA, 18 bp, Homo sapiens
atctggtcctacccatcc

SEQ ID NO: 3019147 - DNA, 19 bp, Homo sapiens
atctggtgttcttgctaac

SEQ ID NO: 3019148 - DNA, 14 bp, Homo sapiens
atctgtaaaaaaga

SEQ ID NO: 3019149 - DNA, 16 bp, Homo sapiens
atctgtaaaaaagaaa

SEQ ID NO: 3019150 - DNA, 14 bp, Homo sapiens
atctgtacaaaatg

SEQ ID NO: 3019151 - DNA, 23 bp, Homo sapiens
atctgtacaaaggggaaagaaca

SEQ ID NO: 3019152 - DNA, 13 bp, Homo sapiens
atctgtataaatg

SEQ ID NO: 3019153 - DNA, 22 bp, Homo sapiens
atctgtataaatgtctattatt

SEQ ID NO: 3019154 - DNA, 17 bp, Homo sapiens
atctgtatcttttctct

SEQ ID NO: 3019155 - DNA, 21 bp, Homo sapiens
atctgtcaagagtagttatat

SEQ ID NO: 3019156 - DNA, 17 bp, Homo sapiens
atctgtcataagcatta

SEQ ID NO: 3019157 - DNA, 18 bp, Homo sapiens
atctgtcataagcattac

SEQ ID NO: 3019158 - DNA, 13 bp, Homo sapiens
atctgtccatcct

SEQ ID NO: 3019159 - DNA, 14 bp, Homo sapiens
atctgtccatcctc

SEQ ID NO: 3019160 - DNA, 18 bp, Homo sapiens
atctgtccatcctcctct

SEQ ID NO: 3019161 - DNA, 17 bp, Homo sapiens
atctgtccgtccagagc

SEQ ID NO: 3019162 - DNA, 18 bp, Homo sapiens
atctgtccgtccagagcc

SEQ ID NO: 3019163 - DNA, 19 bp, Homo sapiens
atctgtccgtccagagccg

SEQ ID NO: 3019164 - DNA, 21 bp, Homo sapiens
atctgtcctcagccttgccag

SEQ ID NO: 3019165 - DNA, 13 bp, Homo sapiens
atctgtctacttt

SEQ ID NO: 3019166 - DNA, 21 bp, Homo sapiens
atctgtctactttctcttgtt

SEQ ID NO: 3019167 - DNA, 12 bp, Homo sapiens
atctgtctagaa

SEQ ID NO: 3019168 - DNA, 21 bp, Homo sapiens
atctgtctagaatcctgcttt

SEQ ID NO: 3019169 - DNA, 22 bp, Homo sapiens
atctgtctagaatcctgcttta

SEQ ID NO: 3019170 - DNA, 21 bp, Homo sapiens
atctgtctttgcggggcctgt

SEQ ID NO: 3019171 - DNA, 22 bp, Homo sapiens
atctgtctttgcggggcctgtc

SEQ ID NO: 3019172 - DNA, 15 bp, Homo sapiens
atctgtgattccccc

SEQ ID NO: 3019173 - DNA, 18 bp, Homo sapiens
atctgtgcagggctggtt

SEQ ID NO: 3019174 - DNA, 20 bp, Homo sapiens
atctgtgcagggctggtttg

SEQ ID NO: 3019175 - DNA, 18 bp, Homo sapiens
atctgtgcctgtctgtcc

SEQ ID NO: 3019176 - DNA, 23 bp, Homo sapiens
atctgtgcgcgtggcgtggcccg

SEQ ID NO: 3019177 - DNA, 19 bp, Homo sapiens
atctgtgctcaggactcag

SEQ ID NO: 3019178 - DNA, 14 bp, Homo sapiens
atctgtggagttcc

SEQ ID NO: 3019179 - DNA, 20 bp, Homo sapiens
atctgtggagttcctgctcc

SEQ ID NO: 3019180 - DNA, 22 bp, Homo sapiens
atctgtggattcagcttctgtt

SEQ ID NO: 3019181 - DNA, 19 bp, Homo sapiens
atctgtgggcatggtcaaa

SEQ ID NO: 3019182 - DNA, 23 bp, Homo sapiens
atctgtgggtctgggagtcacac

SEQ ID NO: 3019183 - DNA, 22 bp, Homo sapiens
atctgtgtacaaagaaataaca

SEQ ID NO: 3019184 - DNA, 13 bp, Homo sapiens
atctgtgtcttgt

SEQ ID NO: 3019185 - DNA, 12 bp, Homo sapiens
atctgtgttcta

SEQ ID NO: 3019186 - DNA, 18 bp, Homo sapiens
atctgttaaccaaataaa

SEQ ID NO: 3019187 - DNA, 14 bp, Homo sapiens
atctgttctaacat

SEQ ID NO: 3019188 - DNA, 13 bp, Homo sapiens
atctgttgtttga

SEQ ID NO: 3019189 - DNA, 12 bp, Homo sapiens
atctgtttacag

SEQ ID NO: 3019190 - DNA, 22 bp, Homo sapiens
atctgtttttgtttatttcatt

SEQ ID NO: 3019191 - DNA, 19 bp, Homo sapiens
atcttaaaaagttgttcaa

SEQ ID NO: 3019192 - DNA, 14 bp, Homo sapiens
atcttaaatcagaa

SEQ ID NO: 3019193 - DNA, 18 bp, Homo sapiens
atcttaaatcagaataaa

SEQ ID NO: 3019194 - DNA, 22 bp, Homo sapiens
atcttaaatcagaataaattaa

SEQ ID NO: 3019195 - DNA, 14 bp, Homo sapiens
atcttaacactgaa

SEQ ID NO: 3019196 - DNA, 12 bp, Homo sapiens
atcttaattttg

SEQ ID NO: 3019197 - DNA, 22 bp, Homo sapiens
atcttaattttggttgtattct

SEQ ID NO: 3019198 - DNA, 15 bp, Homo sapiens
atcttagattctctg

SEQ ID NO: 3019199 - DNA, 18 bp, Homo sapiens
atcttagattctctgtgt

SEQ ID NO: 3019200 - DNA, 20 bp, Homo sapiens
atcttagattctctgtgtct

SEQ ID NO: 3019201 - DNA, 14 bp, Homo sapiens
atcttataatttaa

SEQ ID NO: 3019202 - DNA, 15 bp, Homo sapiens
atcttatagttctag

SEQ ID NO: 3019203 - DNA, 16 bp, Homo sapiens
atcttatgcaaaactt

SEQ ID NO: 3019204 - DNA, 21 bp, Homo sapiens
atcttatttttctaaacgtaa

SEQ ID NO: 3019205 - DNA, 17 bp, Homo sapiens
atcttcaaaagtaatgc

SEQ ID NO: 3019206 - DNA, 20 bp, Homo sapiens
atcttcaaagtttttactag

SEQ ID NO: 3019207 - DNA, 19 bp, Homo sapiens
atcttcacccaggcctatg

SEQ ID NO: 3019208 - DNA, 14 bp, Homo sapiens
atcttcagcttctt

SEQ ID NO: 3019209 - DNA, 15 bp, Homo sapiens
atcttcatataaact

SEQ ID NO: 3019210 - DNA, 19 bp, Homo sapiens
atcttccagaagtgtgatt

SEQ ID NO: 3019211 - DNA, 14 bp, Homo sapiens
atcttcgtcttcac

SEQ ID NO: 3019212 - DNA, 15 bp, Homo sapiens
atcttcgtcttcact

SEQ ID NO: 3019213 - DNA, 22 bp, Homo sapiens
atcttcgtcttcactcttaggc

SEQ ID NO: 3019214 - DNA, 15 bp, Homo sapiens
atcttctcaagttct

SEQ ID NO: 3019215 - DNA, 16 bp, Homo sapiens
atcttctcaagttcta

SEQ ID NO: 3019216 - DNA, 19 bp, Homo sapiens
atcttctcaagttctaaga

SEQ ID NO: 3019217 - DNA, 15 bp, Homo sapiens
atcttctccatctgg

SEQ ID NO: 3019218 - DNA, 14 bp, Homo sapiens
atcttctctggcga

SEQ ID NO: 3019219 - DNA, 20 bp, Homo sapiens
atcttcttaaaccaggaaaa

SEQ ID NO: 3019220 - DNA, 12 bp, Homo sapiens
atcttgaaatta

SEQ ID NO: 3019221 - DNA, 22 bp, Homo sapiens
atcttgagagagaaatgctgtt

SEQ ID NO: 3019222 - DNA, 17 bp, Homo sapiens
atcttgatggtgtttct

SEQ ID NO: 3019223 - DNA, 15 bp, Homo sapiens
atcttgcctccaggt

SEQ ID NO: 3019224 - DNA, 13 bp, Homo sapiens
atcttgctctgct

SEQ ID NO: 3019225 - DNA, 15 bp, Homo sapiens
atcttgctctgtaat

SEQ ID NO: 3019226 - DNA, 15 bp, Homo sapiens
atcttgcttccaaga

SEQ ID NO: 3019227 - DNA, 15 bp, Homo sapiens
atcttgctttggagg

SEQ ID NO: 3019228 - DNA, 20 bp, Homo sapiens
atcttggcctaaacctcagt

SEQ ID NO: 3019229 - DNA, 17 bp, Homo sapiens
atcttggggacatctct

SEQ ID NO: 3019230 - DNA, 22 bp, Homo sapiens
atcttggggacatctctttgaa

SEQ ID NO: 3019231 - DNA, 21 bp, Homo sapiens
atcttggtttgccttccagaa

SEQ ID NO: 3019232 - DNA, 21 bp, Homo sapiens
atcttgtaagtatttaagtga

SEQ ID NO: 3019233 - DNA, 15 bp, Homo sapiens
atcttgtaggtcatt

SEQ ID NO: 3019234 - DNA, 18 bp, Homo sapiens
atcttgttattattgtta

SEQ ID NO: 3019235 - DNA, 21 bp, Homo sapiens
atcttgttattattgttaata

SEQ ID NO: 3019236 - DNA, 18 bp, Homo sapiens
atcttgttttaagcaaat

SEQ ID NO: 3019237 - DNA, 23 bp, Homo sapiens
atcttgtttttccactactgcta

SEQ ID NO: 3019238 - DNA, 21 bp, Homo sapiens
atctttacaaaactacatgag

SEQ ID NO: 3019239 - DNA, 15 bp, Homo sapiens
atctttagttgaatt

SEQ ID NO: 3019240 - DNA, 19 bp, Homo sapiens
atctttatatttcaataaa

SEQ ID NO: 3019241 - DNA, 22 bp, Homo sapiens
atctttattcaaacttttatta

SEQ ID NO: 3019242 - DNA, 23 bp, Homo sapiens
atctttcctcaagtatcttctat

SEQ ID NO: 3019243 - DNA, 18 bp, Homo sapiens
atctttgcgaaaagataa

SEQ ID NO: 3019244 - DNA, 16 bp, Homo sapiens
atctttgcttccttgc

SEQ ID NO: 3019245 - DNA, 13 bp, Homo sapiens
atctttgtggcca

SEQ ID NO: 3019246 - DNA, 14 bp, Homo sapiens
atctttgtggccaa

SEQ ID NO: 3019247 - DNA, 19 bp, Homo sapiens
atcttttaatcatgagcct

SEQ ID NO: 3019248 - DNA, 21 bp, Homo sapiens
atcttttaatcatgagcctgt

SEQ ID NO: 3019249 - DNA, 13 bp, Homo sapiens
atcttttctttag

SEQ ID NO: 3019250 - DNA, 14 bp, Homo sapiens
atcttttgtgagat

SEQ ID NO: 3019251 - DNA, 23 bp, Homo sapiens
atcttttgtgagatgtaattgtt

SEQ ID NO: 3019252 - DNA, 12 bp, Homo sapiens
atctttttctcc

SEQ ID NO: 3019253 - DNA, 14 bp, Homo sapiens
atctttttctccac

SEQ ID NO: 3019254 - DNA, 15 bp, Homo sapiens
atcttttttagtgtt

SEQ ID NO: 3019255 - DNA, 18 bp, Homo sapiens
atcttttttagtgttaaa

SEQ ID NO: 3019256 - DNA, 21 bp, Homo sapiens
atcttttttagtgttaaagag

SEQ ID NO: 3019257 - DNA, 22 bp, Homo sapiens
atcttttttctaaacctgtgcc

SEQ ID NO: 3019258 - DNA, 23 bp, Homo sapiens
atcttttttctaaacctgtgcct

SEQ ID NO: 3019259 - DNA, 16 bp, Homo sapiens
atgaaaaaatgtatat

SEQ ID NO: 3019260 - DNA, 21 bp, Homo sapiens
atggggccagatccagcctgg

SEQ ID NO: 3019261 - DNA, 18 bp, Homo sapiens
atgggggaactcagatcc

SEQ ID NO: 3019262 - DNA, 14 bp, Homo sapiens
atgggggcctccgc

SEQ ID NO: 3019263 - DNA, 17 bp, Homo sapiens
atggggtcctggccatc

SEQ ID NO: 3019264 - DNA, 10 bp, Homo sapiens
atggggtggg

SEQ ID NO: 3019265 - DNA, 13 bp, Homo sapiens
atggggtgggggg

SEQ ID NO: 3019266 - DNA, 18 bp, Homo sapiens
atgggtaaggttctaata

SEQ ID NO: 3019267 - DNA, 14 bp, Homo sapiens
atgggtctggcctg

SEQ ID NO: 3019268 - DNA, 12 bp, Homo sapiens
atgggtctggct

SEQ ID NO: 3019269 - DNA, 10 bp, Homo sapiens
atgggtctta

SEQ ID NO: 3019270 - DNA, 16 bp, Homo sapiens
atgggtgaaggctggc

SEQ ID NO: 3019271 - DNA, 18 bp, Homo sapiens
atgggtgaaggctggcat

SEQ ID NO: 3019272 - DNA, 19 bp, Homo sapiens
atgggtgcagtttgagggg

SEQ ID NO: 3019273 - DNA, 18 bp, Homo sapiens
atgggtgggaataaaatt

SEQ ID NO: 3019274 - DNA, 12 bp, Homo sapiens
atggtacatttt

SEQ ID NO: 3019275 - DNA, 19 bp, Homo sapiens
atggtacatttttcaactt

SEQ ID NO: 3019276 - DNA, 15 bp, Homo sapiens
atggtaccagataaa

SEQ ID NO: 3019277 - DNA, 17 bp, Homo sapiens
atggtataagtaacttt

SEQ ID NO: 3019278 - DNA, 22 bp, Homo sapiens
atggtccatcactattcaagga

SEQ ID NO: 3019279 - DNA, 20 bp, Homo sapiens
atggtcccaggaagcaggga

SEQ ID NO: 3019280 - DNA, 22 bp, Homo sapiens
atggtcccaggaagcagggaga

SEQ ID NO: 3019281 - DNA, 15 bp, Homo sapiens
atggtccggtgtcct

SEQ ID NO: 3019282 - DNA, 19 bp, Homo sapiens
atggtcctatttttgtgaa

SEQ ID NO: 3019283 - DNA, 23 bp, Homo sapiens
atggtcctatttttgtgaagagg

SEQ ID NO: 3019284 - DNA, 13 bp, Homo sapiens
atggtctggtcta

SEQ ID NO: 3019285 - DNA, 14 bp, Homo sapiens
atggtctggtctat

SEQ ID NO: 3019286 - DNA, 16 bp, Homo sapiens
atggtctggtctatgt

SEQ ID NO: 3019287 - DNA, 15 bp, Homo sapiens
atggtcttcagcctc

SEQ ID NO: 3019288 - DNA, 18 bp, Homo sapiens
atggtcttgatctcctga

SEQ ID NO: 3019289 - DNA, 20 bp, Homo sapiens
atggtgaaaccccgtctcta

SEQ ID NO: 3019290 - DNA, 21 bp, Homo sapiens
atggtgaaaccccgtctctac

SEQ ID NO: 3019291 - DNA, 15 bp, Homo sapiens
atggtgacttttgaa

SEQ ID NO: 3019292 - DNA, 18 bp, Homo sapiens
atggtgagatgcagctgg

SEQ ID NO: 3019293 - DNA, 15 bp, Homo sapiens
atggtgatttcttgc

SEQ ID NO: 3019294 - DNA, 15 bp, Homo sapiens
atggtgccccaggac

SEQ ID NO: 3019295 - DNA, 16 bp, Homo sapiens
atggtgccccaggacc

SEQ ID NO: 3019296 - DNA, 17 bp, Homo sapiens
atggtgccccaggacca

SEQ ID NO: 3019297 - DNA, 19 bp, Homo sapiens
atggtgccccaggaccagc

SEQ ID NO: 3019298 - DNA, 16 bp, Homo sapiens
atggtgctaatatttt

SEQ ID NO: 3019299 - DNA, 16 bp, Homo sapiens
atggtgctgcccaggc

SEQ ID NO: 3019300 - DNA, 15 bp, Homo sapiens
atggtggcttcagct

SEQ ID NO: 3019301 - DNA, 20 bp, Homo sapiens
atggtggggtaccagccact

SEQ ID NO: 3019302 - DNA, 13 bp, Homo sapiens
atggtgtggccat

SEQ ID NO: 3019303 - DNA, 17 bp, Homo sapiens
atggtgtggtgaatgtg

SEQ ID NO: 3019304 - DNA, 19 bp, Homo sapiens
atggtgtggtgaatgtgtg

SEQ ID NO: 3019305 - DNA, 16 bp, Homo sapiens
atggtgtttctccctc

SEQ ID NO: 3019306 - DNA, 17 bp, Homo sapiens
atggttagaaccagcag

SEQ ID NO: 3019307 - DNA, 16 bp, Homo sapiens
atggttataaaagtga

SEQ ID NO: 3019308 - DNA, 14 bp, Homo sapiens
atggttatgaattt

SEQ ID NO: 3019309 - DNA, 16 bp, Homo sapiens
atggttgagttacatt

SEQ ID NO: 3019310 - DNA, 12 bp, Homo sapiens
atggtttcctct

SEQ ID NO: 3019311 - DNA, 21 bp, Homo sapiens
atggttttgaatagatcttta

SEQ ID NO: 3019312 - DNA, 18 bp, Homo sapiens
atggtttttaaattttgt

SEQ ID NO: 3019313 - DNA, 11 bp, Homo sapiens
atgtaaaaaac

SEQ ID NO: 3019314 - DNA, 15 bp, Homo sapiens
atgtaaaaaacaaaa

SEQ ID NO: 3019315 - DNA, 17 bp, Homo sapiens
atgtaaaaaacaaaaac

SEQ ID NO: 3019316 - DNA, 13 bp, Homo sapiens
atgtaaaagacac

SEQ ID NO: 3019317 - DNA, 23 bp, Homo sapiens
atgtaaaaggccaaacctctgtt

SEQ ID NO: 3019318 - DNA, 13 bp, Homo sapiens
atgtaaaatcttc

SEQ ID NO: 3019319 - DNA, 15 bp, Homo sapiens
atgtaaaatcttcag

SEQ ID NO: 3019320 - DNA, 16 bp, Homo sapiens
atgtaaaatcttcagc

SEQ ID NO: 3019321 - DNA, 19 bp, Homo sapiens
atgtaaaatcttcagctgg

SEQ ID NO: 3019322 - DNA, 20 bp, Homo sapiens
atgtaaaattgaaaatatgt

SEQ ID NO: 3019323 - DNA, 20 bp, Homo sapiens
atgtaaacagtgcctgctga

SEQ ID NO: 3019324 - DNA, 18 bp, Homo sapiens
atgtaaacataccaacat

SEQ ID NO: 3019325 - DNA, 12 bp, Homo sapiens
atgtaaactctt

SEQ ID NO: 3019326 - DNA, 19 bp, Homo sapiens
atgtaaactcttcaccttg

SEQ ID NO: 3019327 - DNA, 13 bp, Homo sapiens
atgtaaatactgt

SEQ ID NO: 3019328 - DNA, 21 bp, Homo sapiens
atgtaaatgattttatgtttt

SEQ ID NO: 3019329 - DNA, 13 bp, Homo sapiens
atgtaacagtctg

SEQ ID NO: 3019330 - DNA, 23 bp, Homo sapiens
atgtaactgcattgagaactgca

SEQ ID NO: 3019331 - DNA, 24 bp, Homo sapiens
atgtaagattatagattctaaaga

SEQ ID NO: 3019332 - DNA, 19 bp, Homo sapiens
atgtaagcatactttgtaa

SEQ ID NO: 3019333 - DNA, 12 bp, Homo sapiens
atgtaaggaatt

SEQ ID NO: 3019334 - DNA, 21 bp, Homo sapiens
atgtaagggtctttggtgttt

SEQ ID NO: 3019335 - DNA, 15 bp, Homo sapiens
atgtaagtgggccca

SEQ ID NO: 3019336 - DNA, 18 bp, Homo sapiens
atgtaagtgggcccaccc

SEQ ID NO: 3019337 - DNA, 21 bp, Homo sapiens
atgtaatgcgattttattact

SEQ ID NO: 3019338 - DNA, 19 bp, Homo sapiens
atgtaatgcttatgtgttg

SEQ ID NO: 3019339 - DNA, 21 bp, Homo sapiens
atgtaatgttttctttgcaaa

SEQ ID NO: 3019340 - DNA, 23 bp, Homo sapiens
atgtaatgttttctttgcaaagt

SEQ ID NO: 3019341 - DNA, 19 bp, Homo sapiens
atgtaatttcagttctaaa

SEQ ID NO: 3019342 - DNA, 14 bp, Homo sapiens
atgtacaaaaatta

SEQ ID NO: 3019343 - DNA, 20 bp, Homo sapiens
atgtacaaaaattatgcaat

SEQ ID NO: 3019344 - DNA, 21 bp, Homo sapiens
atgtacagtctcaattttgta

SEQ ID NO: 3019345 - DNA, 15 bp, Homo sapiens
atgtacagttcataa

SEQ ID NO: 3019346 - DNA, 16 bp, Homo sapiens
atgtacatttggaact

SEQ ID NO: 3019347 - DNA, 16 bp, Homo sapiens
atgtaccccctttccc

SEQ ID NO: 3019348 - DNA, 16 bp, Homo sapiens
atgtactgattgagaa

SEQ ID NO: 3019349 - DNA, 16 bp, Homo sapiens
atgtacttaatccttt

SEQ ID NO: 3019350 - DNA, 12 bp, Homo sapiens
atgtacttccct

SEQ ID NO: 3019351 - DNA, 19 bp, Homo sapiens
atgtacttccctcttgaaa

SEQ ID NO: 3019352 - DNA, 16 bp, Homo sapiens
atgtacttgtcaaaga

SEQ ID NO: 3019353 - DNA, 20 bp, Homo sapiens
atgtacttttattttacaca

SEQ ID NO: 3019354 - DNA, 14 bp, Homo sapiens
atgtagaaaatttg

SEQ ID NO: 3019355 - DNA, 15 bp, Homo sapiens
atgtagaaacattta

SEQ ID NO: 3019356 - DNA, 22 bp, Homo sapiens
atgtagaaggcaggatttagcc

SEQ ID NO: 3019357 - DNA, 16 bp, Homo sapiens
atgtagaataaatgaa

SEQ ID NO: 3019358 - DNA, 18 bp, Homo sapiens
atgtagaataaatgaaga

SEQ ID NO: 3019359 - DNA, 19 bp, Homo sapiens
atgtagaatgtaatatact

SEQ ID NO: 3019360 - DNA, 17 bp, Homo sapiens
atgtagacattgtaaat

SEQ ID NO: 3019361 - DNA, 18 bp, Homo sapiens
atgtagacattgtaaata

SEQ ID NO: 3019362 - DNA, 18 bp, Homo sapiens
atgtagataaactcagaa

SEQ ID NO: 3019363 - DNA, 12 bp, Homo sapiens
atgtagcacctt

SEQ ID NO: 3019364 - DNA, 20 bp, Homo sapiens
atgtagcaccttttctcctc

SEQ ID NO: 3019365 - DNA, 12 bp, Homo sapiens
atgtagcagaca

SEQ ID NO: 3019366 - DNA, 13 bp, Homo sapiens
atgtagcccatcc

SEQ ID NO: 3019367 - DNA, 19 bp, Homo sapiens
atgtagccccagtcagaag

SEQ ID NO: 3019368 - DNA, 23 bp, Homo sapiens
atgtagcccggggtggtccaatg

SEQ ID NO: 3019369 - DNA, 16 bp, Homo sapiens
atgtaggaaaaaaata

SEQ ID NO: 3019370 - DNA, 23 bp, Homo sapiens
atgtaggagctgccttggctcag

SEQ ID NO: 3019371 - DNA, 16 bp, Homo sapiens
atgtagtaattgacat

SEQ ID NO: 3019372 - DNA, 23 bp, Homo sapiens
atgtagtatcaaatattagatgt

SEQ ID NO: 3019373 - DNA, 14 bp, Homo sapiens
atgtagttctttgt

SEQ ID NO: 3019374 - DNA, 22 bp, Homo sapiens
atgtagttctttgttcctgctt

SEQ ID NO: 3019375 - DNA, 18 bp, Homo sapiens
atgtataatgacttttaa

SEQ ID NO: 3019376 - DNA, 21 bp, Homo sapiens
atgtataatgacttttaaaat

SEQ ID NO: 3019377 - DNA, 16 bp, Homo sapiens
atgtatagttttccct

SEQ ID NO: 3019378 - DNA, 16 bp, Homo sapiens
atgtatatacacacat

SEQ ID NO: 3019379 - DNA, 14 bp, Homo sapiens
atgtatatatgtat

SEQ ID NO: 3019380 - DNA, 17 bp, Homo sapiens
atgtatatatgtatttc

SEQ ID NO: 3019381 - DNA, 14 bp, Homo sapiens
atgtatcacattga

SEQ ID NO: 3019382 - DNA, 21 bp, Homo sapiens
atgtatcataattaccaagtg

SEQ ID NO: 3019383 - DNA, 16 bp, Homo sapiens
atgtatctgtctactt

SEQ ID NO: 3019384 - DNA, 22 bp, Homo sapiens
atgtatctgtctactttctctt

SEQ ID NO: 3019385 - DNA, 17 bp, Homo sapiens
atgtatgcagctatctg

SEQ ID NO: 3019386 - DNA, 16 bp, Homo sapiens
atgtatgtaaatagat

SEQ ID NO: 3019387 - DNA, 17 bp, Homo sapiens
atgtatgtgccaatttt

SEQ ID NO: 3019388 - DNA, 19 bp, Homo sapiens
atgtatgtgccaattttgt

SEQ ID NO: 3019389 - DNA, 17 bp, Homo sapiens
atgtatgtggatacagt

SEQ ID NO: 3019390 - DNA, 22 bp, Homo sapiens
atgtattatttcattatgtaaa

SEQ ID NO: 3019391 - DNA, 21 bp, Homo sapiens
atgtattgcagtgcggctcac

SEQ ID NO: 3019392 - DNA, 14 bp, Homo sapiens
atgtatttatattt

SEQ ID NO: 3019393 - DNA, 16 bp, Homo sapiens
attcctagaattaaac

SEQ ID NO: 3019394 - DNA, 21 bp, Homo sapiens
attcctagaattaaaccagat

SEQ ID NO: 3019395 - DNA, 14 bp, Homo sapiens
attcctagttggtg

SEQ ID NO: 3019396 - DNA, 17 bp, Homo sapiens
attcctatctgtggatg

SEQ ID NO: 3019397 - DNA, 19 bp, Homo sapiens
attcctcatcctcagatgc

SEQ ID NO: 3019398 - DNA, 15 bp, Homo sapiens
attcctctttgcttt

SEQ ID NO: 3019399 - DNA, 18 bp, Homo sapiens
attcctctttgctttgct

SEQ ID NO: 3019400 - DNA, 13 bp, Homo sapiens
attcctcttttta

SEQ ID NO: 3019401 - DNA, 15 bp, Homo sapiens
attcctgaagaacca

SEQ ID NO: 3019402 - DNA, 19 bp, Homo sapiens
attcctgatatgatttaaa

SEQ ID NO: 3019403 - DNA, 17 bp, Homo sapiens
attcctgtaacttttaa

SEQ ID NO: 3019404 - DNA, 16 bp, Homo sapiens
attcctgtatgttgtc

SEQ ID NO: 3019405 - DNA, 18 bp, Homo sapiens
attcctgtatgttgtcca

SEQ ID NO: 3019406 - DNA, 19 bp, Homo sapiens
attcgatgcgtattctgtg

SEQ ID NO: 3019407 - DNA, 18 bp, Homo sapiens
attcgcatgtttaatgtg

SEQ ID NO: 3019408 - DNA, 22 bp, Homo sapiens
attcgctgtaccctttaagata

SEQ ID NO: 3019409 - DNA, 19 bp, Homo sapiens
attcgctgtcccctcagcg

SEQ ID NO: 3019410 - DNA, 22 bp, Homo sapiens
attcgtagatattggacaaaga

SEQ ID NO: 3019411 - DNA, 20 bp, Homo sapiens
attcgtgcatttttggatca

SEQ ID NO: 3019412 - DNA, 23 bp, Homo sapiens
attctaaaatgtgatgttctaag

SEQ ID NO: 3019413 - DNA, 17 bp, Homo sapiens
attctaaacagactcat

SEQ ID NO: 3019414 - DNA, 19 bp, Homo sapiens
attctaaagattctatagt

SEQ ID NO: 3019415 - DNA, 13 bp, Homo sapiens
attctaacatatt

SEQ ID NO: 3019416 - DNA, 12 bp, Homo sapiens
attctaagactt

SEQ ID NO: 3019417 - DNA, 20 bp, Homo sapiens
attctaagacttactctaag

SEQ ID NO: 3019418 - DNA, 22 bp, Homo sapiens
attctaagacttactctaagat

SEQ ID NO: 3019419 - DNA, 23 bp, Homo sapiens
attctaagacttactctaagatc

SEQ ID NO: 3019420 - DNA, 18 bp, Homo sapiens
attctaataaatcaatgt

SEQ ID NO: 3019421 - DNA, 22 bp, Homo sapiens
attctacagaaagaaaaatgca

SEQ ID NO: 3019422 - DNA, 16 bp, Homo sapiens
attctacgtatctgct

SEQ ID NO: 3019423 - DNA, 22 bp, Homo sapiens
attctactaagttattttatga

SEQ ID NO: 3019424 - DNA, 14 bp, Homo sapiens
attctacttgctta

SEQ ID NO: 3019425 - DNA, 22 bp, Homo sapiens
attctacttgcttattacattt

SEQ ID NO: 3019426 - DNA, 23 bp, Homo sapiens
attctagatcagatgctccaaga

SEQ ID NO: 3019427 - DNA, 18 bp, Homo sapiens
attctagctgtatgattt

SEQ ID NO: 3019428 - DNA, 14 bp, Homo sapiens
attctagctttttt

SEQ ID NO: 3019429 - DNA, 20 bp, Homo sapiens
attctaggcctcctggccca

SEQ ID NO: 3019430 - DNA, 19 bp, Homo sapiens
attctagggtttcttaaat

SEQ ID NO: 3019431 - DNA, 22 bp, Homo sapiens
attctagggtttcttaaatata

SEQ ID NO: 3019432 - DNA, 15 bp, Homo sapiens
attctagtacataat

SEQ ID NO: 3019433 - DNA, 22 bp, Homo sapiens
attctagtactagaaactgaag

SEQ ID NO: 3019434 - DNA, 18 bp, Homo sapiens
attctataagttttatgt

SEQ ID NO: 3019435 - DNA, 18 bp, Homo sapiens
attctatcgttattataa

SEQ ID NO: 3019436 - DNA, 16 bp, Homo sapiens
attctcaaagttttat

SEQ ID NO: 3019437 - DNA, 17 bp, Homo sapiens
attctcactccaccacc

SEQ ID NO: 3019438 - DNA, 15 bp, Homo sapiens
attctcagtgccaac

SEQ ID NO: 3019439 - DNA, 22 bp, Homo sapiens
attctccctatcttgtgaagtt

SEQ ID NO: 3019440 - DNA, 14 bp, Homo sapiens
attctccctgggcc

SEQ ID NO: 3019441 - DNA, 13 bp, Homo sapiens
attctcctcctcc

SEQ ID NO: 3019442 - DNA, 20 bp, Homo sapiens
attctcctcctcctccctcc

SEQ ID NO: 3019443 - DNA, 15 bp, Homo sapiens
attctcctgcctcag

SEQ ID NO: 3019444 - DNA, 17 bp, Homo sapiens
attctcctgcctcagcc

SEQ ID NO: 3019445 - DNA, 20 bp, Homo sapiens
attctcctgcctcagcctcc

SEQ ID NO: 3019446 - DNA, 13 bp, Homo sapiens
attctcctgcctt

SEQ ID NO: 3019447 - DNA, 19 bp, Homo sapiens
attctcctggatgcttaga

SEQ ID NO: 3019448 - DNA, 14 bp, Homo sapiens
attctctccaaaaa

SEQ ID NO: 3019449 - DNA, 17 bp, Homo sapiens
attctctctaacataac

SEQ ID NO: 3019450 - DNA, 15 bp, Homo sapiens
attctctctatgcaa

SEQ ID NO: 3019451 - DNA, 12 bp, Homo sapiens
attctctctcct

SEQ ID NO: 3019452 - DNA, 15 bp, Homo sapiens
attctctctcctgta

SEQ ID NO: 3019453 - DNA, 16 bp, Homo sapiens
attctctctcctgtcc

SEQ ID NO: 3019454 - DNA, 17 bp, Homo sapiens
attctctctcctgtcca

SEQ ID NO: 3019455 - DNA, 13 bp, Homo sapiens
attctctgtctca

SEQ ID NO: 3019456 - DNA, 17 bp, Homo sapiens
attctctgtctcatcca

SEQ ID NO: 3019457 - DNA, 19 bp, Homo sapiens
attctctgtctcatccatc

SEQ ID NO: 3019458 - DNA, 21 bp, Homo sapiens
attctctgtttgcttttgaac

SEQ ID NO: 3019459 - DNA, 18 bp, Homo sapiens
attctcttgtataagatc

SEQ ID NO: 3019460 - DNA, 19 bp, Homo sapiens
attctgaaaccacagtttc

SEQ ID NO: 3019461 - DNA, 13 bp, Homo sapiens
attctgaagtttt

SEQ ID NO: 3019462 - DNA, 18 bp, Homo sapiens
attctgaatttgcaaagt

SEQ ID NO: 3019463 - DNA, 20 bp, Homo sapiens
attctgaatttgcaaagtac

SEQ ID NO: 3019464 - DNA, 22 bp, Homo sapiens
attctgaatttgcaaagtactg

SEQ ID NO: 3019465 - DNA, 15 bp, Homo sapiens
attctgataatgtat

SEQ ID NO: 3019466 - DNA, 15 bp, Homo sapiens
attctgataggaggg

SEQ ID NO: 3019467 - DNA, 17 bp, Homo sapiens
attctgataggaggggg

SEQ ID NO: 3019468 - DNA, 21 bp, Homo sapiens
attctgattcgaatgacactg

SEQ ID NO: 3019469 - DNA, 15 bp, Homo sapiens
attctgattggtctg

SEQ ID NO: 3019470 - DNA, 18 bp, Homo sapiens
attctgcagtaaatcttt

SEQ ID NO: 3019471 - DNA, 21 bp, Homo sapiens
attctgcagtaaatcttttac

SEQ ID NO: 3019472 - DNA, 19 bp, Homo sapiens
attctgcatactaacctat

SEQ ID NO: 3019473 - DNA, 14 bp, Homo sapiens
attctgccaggccc

SEQ ID NO: 3019474 - DNA, 15 bp, Homo sapiens
attctgcctctctag

SEQ ID NO: 3019475 - DNA, 15 bp, Homo sapiens
attctgcctttgccg

SEQ ID NO: 3019476 - DNA, 17 bp, Homo sapiens
attctgcttgagaatat

SEQ ID NO: 3019477 - DNA, 15 bp, Homo sapiens
attctggacaggatg

SEQ ID NO: 3019478 - DNA, 22 bp, Homo sapiens
attctggacaggatgtgtttgc

SEQ ID NO: 3019479 - DNA, 20 bp, Homo sapiens
attctggacagtcagctctt

SEQ ID NO: 3019480 - DNA, 22 bp, Homo sapiens
attctggagacagaaccagcag

SEQ ID NO: 3019481 - DNA, 23 bp, Homo sapiens
attctggagacagaaccagcaga

SEQ ID NO: 3019482 - DNA, 18 bp, Homo sapiens
attctggtcctgttttct

SEQ ID NO: 3019483 - DNA, 15 bp, Homo sapiens
attctgtagattctg

SEQ ID NO: 3019484 - DNA, 19 bp, Homo sapiens
attctgttctacttgatat

SEQ ID NO: 3019485 - DNA, 20 bp, Homo sapiens
attctgttgtgttcaccaga

SEQ ID NO: 3019486 - DNA, 23 bp, Homo sapiens
attctgttgtgttcaccagagaa

SEQ ID NO: 3019487 - DNA, 19 bp, Homo sapiens
attctgtttttaatgctat

SEQ ID NO: 3019488 - DNA, 21 bp, Homo sapiens
attcttaagacttgcatttaa

SEQ ID NO: 3019489 - DNA, 23 bp, Homo sapiens
attcttagatacactaaaaatct

SEQ ID NO: 3019490 - DNA, 14 bp, Homo sapiens
attcttataaatat

SEQ ID NO: 3019491 - DNA, 15 bp, Homo sapiens
attcttcattctgta

SEQ ID NO: 3019492 - DNA, 13 bp, Homo sapiens
attcttctgtgtt

SEQ ID NO: 3019493 - DNA, 14 bp, Homo sapiens
attcttggcatcta

SEQ ID NO: 3019494 - DNA, 18 bp, Homo sapiens
attcttggcttaatcatt

SEQ ID NO: 3019495 - DNA, 18 bp, Homo sapiens
attctttatacaacagtg

SEQ ID NO: 3019496 - DNA, 19 bp, Homo sapiens
attctttatacaacagtgc

SEQ ID NO: 3019497 - DNA, 23 bp, Homo sapiens
attctttatacaacagtgctaaa

SEQ ID NO: 3019498 - DNA, 20 bp, Homo sapiens
attctttcaattctgtaggt

SEQ ID NO: 3019499 - DNA, 14 bp, Homo sapiens
attctttcttcctc

SEQ ID NO: 3019500 - DNA, 15 bp, Homo sapiens
attctttcttcctcc

SEQ ID NO: 3019501 - DNA, 20 bp, Homo sapiens
attctttcttggtgcattcg

SEQ ID NO: 3019502 - DNA, 14 bp, Homo sapiens
attctttgatgtta

SEQ ID NO: 3019503 - DNA, 20 bp, Homo sapiens
attctttgatgttaacacat

SEQ ID NO: 3019504 - DNA, 19 bp, Homo sapiens
attctttgcaatactgctt

SEQ ID NO: 3019505 - DNA, 14 bp, Homo sapiens
attcttttccagaa

SEQ ID NO: 3019506 - DNA, 15 bp, Homo sapiens
attcttttgaattgt

SEQ ID NO: 3019507 - DNA, 12 bp, Homo sapiens
attcttttgcca

SEQ ID NO: 3019508 - DNA, 14 bp, Homo sapiens
attcttttgccaag

SEQ ID NO: 3019509 - DNA, 13 bp, Homo sapiens
attcttttgtaat

SEQ ID NO: 3019510 - DNA, 15 bp, Homo sapiens
attgaaaaaaataat

SEQ ID NO: 3019511 - DNA, 15 bp, Homo sapiens
attgaaaacagatat

SEQ ID NO: 3019512 - DNA, 18 bp, Homo sapiens
attgaaaacttttctcag

SEQ ID NO: 3019513 - DNA, 17 bp, Homo sapiens
attgaaatttactgtga

SEQ ID NO: 3019514 - DNA, 14 bp, Homo sapiens
attgaacacaaact

SEQ ID NO: 3019515 - DNA, 15 bp, Homo sapiens
attgaacacaaactg

SEQ ID NO: 3019516 - DNA, 16 bp, Homo sapiens
attgaacacaaactgt

SEQ ID NO: 3019517 - DNA, 17 bp, Homo sapiens
attgaacacaaactgta

SEQ ID NO: 3019518 - DNA, 14 bp, Homo sapiens
attgaacccaggag

SEQ ID NO: 3019519 - DNA, 15 bp, Homo sapiens
attgaacccaggagg

SEQ ID NO: 3019520 - DNA, 19 bp, Homo sapiens
attgaagatgtaaggaatt

SEQ ID NO: 3019521 - DNA, 12 bp, Homo sapiens
attgaaggcctg

SEQ ID NO: 3019522 - DNA, 13 bp, Homo sapiens
attgaaggcctgg

SEQ ID NO: 3019523 - DNA, 14 bp, Homo sapiens
attgaagtaatgaa

SEQ ID NO: 3019524 - DNA, 15 bp, Homo sapiens
attgaagtaatgaat

SEQ ID NO: 3019525 - DNA, 18 bp, Homo sapiens
attttatgagaaatgtaa

SEQ ID NO: 3019526 - DNA, 20 bp, Homo sapiens
attttatgagaaatgtaatg

SEQ ID NO: 3019527 - DNA, 17 bp, Homo sapiens
attttatgatcagtgtt

SEQ ID NO: 3019528 - DNA, 21 bp, Homo sapiens
attttatgtattttaaaataa

SEQ ID NO: 3019529 - DNA, 20 bp, Homo sapiens
attttattacatctttcaca

SEQ ID NO: 3019530 - DNA, 13 bp, Homo sapiens
attttattcagta

SEQ ID NO: 3019531 - DNA, 20 bp, Homo sapiens
attttattgtataaaaagtt

SEQ ID NO: 3019532 - DNA, 23 bp, Homo sapiens
attttattgtataaaaagtttca

SEQ ID NO: 3019533 - DNA, 18 bp, Homo sapiens
attttattgtattttgat

SEQ ID NO: 3019534 - DNA, 20 bp, Homo sapiens
attttattgtattttgatga

SEQ ID NO: 3019535 - DNA, 14 bp, Homo sapiens
attttatttgaaaa

SEQ ID NO: 3019536 - DNA, 16 bp, Homo sapiens
attttatttgaaaaaa

SEQ ID NO: 3019537 - DNA, 17 bp, Homo sapiens
attttatttgaaaaaag

SEQ ID NO: 3019538 - DNA, 13 bp, Homo sapiens
attttcaacaatt

SEQ ID NO: 3019539 - DNA, 15 bp, Homo sapiens
attttcaacaattag

SEQ ID NO: 3019540 - DNA, 16 bp, Homo sapiens
attttcaagtaattgt

SEQ ID NO: 3019541 - DNA, 19 bp, Homo sapiens
attttcaagtaattgtgaa

SEQ ID NO: 3019542 - DNA, 20 bp, Homo sapiens
attttcacaggtttgtttct

SEQ ID NO: 3019543 - DNA, 18 bp, Homo sapiens
attttcacttttaaacta

SEQ ID NO: 3019544 - DNA, 12 bp, Homo sapiens
attttcagagtg

SEQ ID NO: 3019545 - DNA, 16 bp, Homo sapiens
attttcagcatcaaac

SEQ ID NO: 3019546 - DNA, 12 bp, Homo sapiens
attttcagcatt

SEQ ID NO: 3019547 - DNA, 20 bp, Homo sapiens
attttcagcattaagctgtt

SEQ ID NO: 3019548 - DNA, 13 bp, Homo sapiens
attttcagtgact

SEQ ID NO: 3019549 - DNA, 22 bp, Homo sapiens
attttccaaaagtggcctcttt

SEQ ID NO: 3019550 - DNA, 17 bp, Homo sapiens
attttccaagtgtgcat

SEQ ID NO: 3019551 - DNA, 21 bp, Homo sapiens
attttccacaagattcccaga

SEQ ID NO: 3019552 - DNA, 21 bp, Homo sapiens
attttccatttttatttcaaa

SEQ ID NO: 3019553 - DNA, 23 bp, Homo sapiens
attttcccatcatcctttgttct

SEQ ID NO: 3019554 - DNA, 21 bp, Homo sapiens
attttcctaaggccactgttt

SEQ ID NO: 3019555 - DNA, 15 bp, Homo sapiens
attttcggaacacat

SEQ ID NO: 3019556 - DNA, 16 bp, Homo sapiens
attttctagtttcctg

SEQ ID NO: 3019557 - DNA, 17 bp, Homo sapiens
attttctataagaaaaa

SEQ ID NO: 3019558 - DNA, 18 bp, Homo sapiens
attttctataagaaaaag

SEQ ID NO: 3019559 - DNA, 15 bp, Homo sapiens
attttctataattta

SEQ ID NO: 3019560 - DNA, 11 bp, Homo sapiens
attttctccac

SEQ ID NO: 3019561 - DNA, 19 bp, Homo sapiens
attttctccacaacactgt

SEQ ID NO: 3019562 - DNA, 17 bp, Homo sapiens
attttctccagtccctg

SEQ ID NO: 3019563 - DNA, 14 bp, Homo sapiens
attttctctgtact

SEQ ID NO: 3019564 - DNA, 15 bp, Homo sapiens
attttctctttaaaa

SEQ ID NO: 3019565 - DNA, 22 bp, Homo sapiens
attttctggattccccatctca

SEQ ID NO: 3019566 - DNA, 17 bp, Homo sapiens
attttctggttctaaca

SEQ ID NO: 3019567 - DNA, 23 bp, Homo sapiens
attttctgtgttttgctgtacca

SEQ ID NO: 3019568 - DNA, 17 bp, Homo sapiens
attttcttaaccagttg

SEQ ID NO: 3019569 - DNA, 12 bp, Homo sapiens
attttctttcta

SEQ ID NO: 3019570 - DNA, 20 bp, Homo sapiens
attttcttttctttcaactt

SEQ ID NO: 3019571 - DNA, 19 bp, Homo sapiens
attttctttttgtttcact

SEQ ID NO: 3019572 - DNA, 13 bp, Homo sapiens
attttgaaaacac

SEQ ID NO: 3019573 - DNA, 18 bp, Homo sapiens
attttgaaaacacttatt

SEQ ID NO: 3019574 - DNA, 17 bp, Homo sapiens
attttgaaatgaacttt

SEQ ID NO: 3019575 - DNA, 13 bp, Homo sapiens
attttgaatcaat

SEQ ID NO: 3019576 - DNA, 15 bp, Homo sapiens
attttgaatcaataa

SEQ ID NO: 3019577 - DNA, 15 bp, Homo sapiens
attttgagaacaaag

SEQ ID NO: 3019578 - DNA, 20 bp, Homo sapiens
attttgagggtgtaaccagt

SEQ ID NO: 3019579 - DNA, 21 bp, Homo sapiens
attttgagtttcagctggaaa

SEQ ID NO: 3019580 - DNA, 22 bp, Homo sapiens
attttgagtttcagctggaaac

SEQ ID NO: 3019581 - DNA, 12 bp, Homo sapiens
attttgatattg

SEQ ID NO: 3019582 - DNA, 21 bp, Homo sapiens
attttgatcactgcattttgt

SEQ ID NO: 3019583 - DNA, 16 bp, Homo sapiens
attttgcatttgaata

SEQ ID NO: 3019584 - DNA, 13 bp, Homo sapiens
attttgctcttgt

SEQ ID NO: 3019585 - DNA, 19 bp, Homo sapiens
attttgctggaattcctaa

SEQ ID NO: 3019586 - DNA, 19 bp, Homo sapiens
attttggaaagtttttgta

SEQ ID NO: 3019587 - DNA, 16 bp, Homo sapiens
attttggaagacatat

SEQ ID NO: 3019588 - DNA, 19 bp, Homo sapiens
attttggaattggtgtata

SEQ ID NO: 3019589 - DNA, 19 bp, Homo sapiens
attttggcatctgcaaagg

SEQ ID NO: 3019590 - DNA, 18 bp, Homo sapiens
attttgggttcaggcctg

SEQ ID NO: 3019591 - DNA, 21 bp, Homo sapiens
attttggtaatgatgttgata

SEQ ID NO: 3019592 - DNA, 14 bp, Homo sapiens
attttggtgtgcat

SEQ ID NO: 3019593 - DNA, 16 bp, Homo sapiens
attttggttcttctca

SEQ ID NO: 3019594 - DNA, 17 bp, Homo sapiens
attttggttcttctcaa

SEQ ID NO: 3019595 - DNA, 15 bp, Homo sapiens
attttggttgtattc

SEQ ID NO: 3019596 - DNA, 20 bp, Homo sapiens
attttggttgtattctttga

SEQ ID NO: 3019597 - DNA, 21 bp, Homo sapiens
attttggttgtattctttgat

SEQ ID NO: 3019598 - DNA, 22 bp, Homo sapiens
attttggtttttcaacactgaa

SEQ ID NO: 3019599 - DNA, 13 bp, Homo sapiens
attttgtaaacta

SEQ ID NO: 3019600 - DNA, 23 bp, Homo sapiens
attttgtaaataataaaatagta

SEQ ID NO: 3019601 - DNA, 16 bp, Homo sapiens
attttgtaatgaattc

SEQ ID NO: 3019602 - DNA, 20 bp, Homo sapiens
attttgtacaaatttgttat

SEQ ID NO: 3019603 - DNA, 20 bp, Homo sapiens
attttgtataattgtatcgt

SEQ ID NO: 3019604 - DNA, 15 bp, Homo sapiens
attttgtattttcca

SEQ ID NO: 3019605 - DNA, 20 bp, Homo sapiens
attttgtattttccaagtgt

SEQ ID NO: 3019606 - DNA, 17 bp, Homo sapiens
attttgtcacagctctt

SEQ ID NO: 3019607 - DNA, 21 bp, Homo sapiens
attttgtcacagctcttgttt

SEQ ID NO: 3019608 - DNA, 20 bp, Homo sapiens
attttgtcaccagaacacaa

SEQ ID NO: 3019609 - DNA, 18 bp, Homo sapiens
attttgtccatgtccccc

SEQ ID NO: 3019610 - DNA, 22 bp, Homo sapiens
attttgtgatgaatctacattt

SEQ ID NO: 3019611 - DNA, 23 bp, Homo sapiens
attttgtgatgaatctacatttg

SEQ ID NO: 3019612 - DNA, 17 bp, Homo sapiens
attttgtttctgtatat

SEQ ID NO: 3019613 - DNA, 20 bp, Homo sapiens
attttgtttttattttcaag

SEQ ID NO: 3019614 - DNA, 18 bp, Homo sapiens
atttttaaaaaatatttt

SEQ ID NO: 3019615 - DNA, 23 bp, Homo sapiens
atttttaaaaaatattttctctg

SEQ ID NO: 3019616 - DNA, 12 bp, Homo sapiens
atttttaaaaac

SEQ ID NO: 3019617 - DNA, 17 bp, Homo sapiens
atttttaaaagaaaaaa

SEQ ID NO: 3019618 - DNA, 21 bp, Homo sapiens
atttttaaaagaaaaaaacca

SEQ ID NO: 3019619 - DNA, 19 bp, Homo sapiens
atttttaaaagactttgat

SEQ ID NO: 3019620 - DNA, 12 bp, Homo sapiens
atttttaactgt

SEQ ID NO: 3019621 - DNA, 15 bp, Homo sapiens
atttttaatatgttg

SEQ ID NO: 3019622 - DNA, 19 bp, Homo sapiens
atttttaatatgttgactt

SEQ ID NO: 3019623 - DNA, 14 bp, Homo sapiens
atttttaatcatga

SEQ ID NO: 3019624 - DNA, 15 bp, Homo sapiens
atttttaatcatgaa

SEQ ID NO: 3019625 - DNA, 17 bp, Homo sapiens
atttttaatcatgaaat

SEQ ID NO: 3019626 - DNA, 12 bp, Homo sapiens
atttttaattaa

SEQ ID NO: 3019627 - DNA, 18 bp, Homo sapiens
atttttaatttaaaaaag

SEQ ID NO: 3019628 - DNA, 19 bp, Homo sapiens
atttttacatggagaaaac

SEQ ID NO: 3019629 - DNA, 20 bp, Homo sapiens
atttttacctttttccttcc

SEQ ID NO: 3019630 - DNA, 21 bp, Homo sapiens
atttttagaattaaaaaagca

SEQ ID NO: 3019631 - DNA, 15 bp, Homo sapiens
atttttagagcatta

SEQ ID NO: 3019632 - DNA, 16 bp, Homo sapiens
atttttagagcattaa

SEQ ID NO: 3019633 - DNA, 17 bp, Homo sapiens
atttttagagcattaaa

SEQ ID NO: 3019634 - DNA, 18 bp, Homo sapiens
atttttagagcattaaaa

SEQ ID NO: 3019635 - DNA, 22 bp, Homo sapiens
atttttagtaacctttaaaaat

SEQ ID NO: 3019636 - DNA, 19 bp, Homo sapiens
atttttagtttaaaatctt

SEQ ID NO: 3019637 - DNA, 23 bp, Homo sapiens
atttttagtttaaaatcttgcat

SEQ ID NO: 3019638 - DNA, 20 bp, Homo sapiens
atttttatcccttcctgtct

SEQ ID NO: 3019639 - DNA, 14 bp, Homo sapiens
atttttatctccaa

SEQ ID NO: 3019640 - DNA, 12 bp, Homo sapiens
atttttatcttt

SEQ ID NO: 3019641 - DNA, 15 bp, Homo sapiens
atttttatctttcgt

SEQ ID NO: 3019642 - DNA, 11 bp, Homo sapiens
atttttatgat

SEQ ID NO: 3019643 - DNA, 21 bp, Homo sapiens
atttttatttctttttaatta

SEQ ID NO: 3019644 - DNA, 21 bp, Homo sapiens
atttttcaaaacatacaagca

SEQ ID NO: 3019645 - DNA, 15 bp, Homo sapiens
atttttcaacttgga

SEQ ID NO: 3019646 - DNA, 17 bp, Homo sapiens
atttttcaactttgaat

SEQ ID NO: 3019647 - DNA, 12 bp, Homo sapiens
atttttccctcc

SEQ ID NO: 3019648 - DNA, 16 bp, Homo sapiens
atttttctttaaagcc

SEQ ID NO: 3019649 - DNA, 21 bp, Homo sapiens
atttttgataaagcctcaagg

SEQ ID NO: 3019650 - DNA, 17 bp, Homo sapiens
atttttgataccttcaa

SEQ ID NO: 3019651 - DNA, 19 bp, Homo sapiens
atttttgcaataccaagta

SEQ ID NO: 3019652 - DNA, 22 bp, Homo sapiens
atttttgccctgagtccaagag

SEQ ID NO: 3019653 - DNA, 14 bp, Homo sapiens
atttttgccttcat

SEQ ID NO: 3019654 - DNA, 21 bp, Homo sapiens
atttttgtatctacatctttt

SEQ ID NO: 3019655 - DNA, 13 bp, Homo sapiens
atttttgtatttt

SEQ ID NO: 3019656 - DNA, 12 bp, Homo sapiens
atttttgtgtat

SEQ ID NO: 3019657 - DNA, 14 bp, Homo sapiens
caaccaatggaatg

SEQ ID NO: 3019658 - DNA, 12 bp, Homo sapiens
caaccagccttt

SEQ ID NO: 3019659 - DNA, 19 bp, Homo sapiens
caaccagtaggatatttct

SEQ ID NO: 3019660 - DNA, 22 bp, Homo sapiens
caacccattaatcttttgtagt

SEQ ID NO: 3019661 - DNA, 15 bp, Homo sapiens
caaccccacccagct

SEQ ID NO: 3019662 - DNA, 16 bp, Homo sapiens
caacccccagccccca

SEQ ID NO: 3019663 - DNA, 13 bp, Homo sapiens
caaccccgcggcc

SEQ ID NO: 3019664 - DNA, 16 bp, Homo sapiens
caaccccgcggcccag

SEQ ID NO: 3019665 - DNA, 17 bp, Homo sapiens
caaccccgcggcccaga

SEQ ID NO: 3019666 - DNA, 19 bp, Homo sapiens
caacccctcccccacgtct

SEQ ID NO: 3019667 - DNA, 20 bp, Homo sapiens
caaccccttaagccctggcc

SEQ ID NO: 3019668 - DNA, 15 bp, Homo sapiens
caaccctctggaagt

SEQ ID NO: 3019669 - DNA, 10 bp, Homo sapiens
caacccttct

SEQ ID NO: 3019670 - DNA, 14 bp, Homo sapiens
caaccgagaaggtt

SEQ ID NO: 3019671 - DNA, 18 bp, Homo sapiens
caacctaacccctttcct

SEQ ID NO: 3019672 - DNA, 14 bp, Homo sapiens
caacctaacctgtg

SEQ ID NO: 3019673 - DNA, 14 bp, Homo sapiens
caacctactgtcta

SEQ ID NO: 3019674 - DNA, 17 bp, Homo sapiens
caacctactgtctaagc

SEQ ID NO: 3019675 - DNA, 21 bp, Homo sapiens
caacctccttatctgctaact

SEQ ID NO: 3019676 - DNA, 20 bp, Homo sapiens
caacctctgcctcccaggtt

SEQ ID NO: 3019677 - DNA, 18 bp, Homo sapiens
caacctcttctggctcaa

SEQ ID NO: 3019678 - DNA, 15 bp, Homo sapiens
caacctcttggcctg

SEQ ID NO: 3019679 - DNA, 21 bp, Homo sapiens
caacctgaaggtcccctggca

SEQ ID NO: 3019680 - DNA, 23 bp, Homo sapiens
caacctgaccaacatggagaaac

SEQ ID NO: 3019681 - DNA, 12 bp, Homo sapiens
caacctgcactc

SEQ ID NO: 3019682 - DNA, 15 bp, Homo sapiens
caacctgcactctac

SEQ ID NO: 3019683 - DNA, 21 bp, Homo sapiens
caacctgtccttactcagagc

SEQ ID NO: 3019684 - DNA, 22 bp, Homo sapiens
caacctgtccttactcagagct

SEQ ID NO: 3019685 - DNA, 22 bp, Homo sapiens
caaccttcagctttatttttct

SEQ ID NO: 3019686 - DNA, 14 bp, Homo sapiens
caaccttgcatcca

SEQ ID NO: 3019687 - DNA, 16 bp, Homo sapiens
caaccttgtcagtttt

SEQ ID NO: 3019688 - DNA, 13 bp, Homo sapiens
caaccttgtttaa

SEQ ID NO: 3019689 - DNA, 14 bp, Homo sapiens
caacctttccagct

SEQ ID NO: 3019690 - DNA, 12 bp, Homo sapiens
caacctttctga

SEQ ID NO: 3019691 - DNA, 19 bp, Homo sapiens
caacctttctgacatcagc

SEQ ID NO: 3019692 - DNA, 21 bp, Homo sapiens
caacgctgaagcggtcagact

SEQ ID NO: 3019693 - DNA, 23 bp, Homo sapiens
caacgtggctttttttttttccc

SEQ ID NO: 3019694 - DNA, 12 bp, Homo sapiens
caacgtgttaat

SEQ ID NO: 3019695 - DNA, 18 bp, Homo sapiens
caacgtttcttcactttt

SEQ ID NO: 3019696 - DNA, 15 bp, Homo sapiens
caactaactaaccac

SEQ ID NO: 3019697 - DNA, 18 bp, Homo sapiens
caactaactaaccacatt

SEQ ID NO: 3019698 - DNA, 20 bp, Homo sapiens
caactaactaaccacatttt

SEQ ID NO: 3019699 - DNA, 16 bp, Homo sapiens
caactagttttgttta

SEQ ID NO: 3019700 - DNA, 19 bp, Homo sapiens
caactatattatcatgcaa

SEQ ID NO: 3019701 - DNA, 17 bp, Homo sapiens
caactatggatcagaat

SEQ ID NO: 3019702 - DNA, 12 bp, Homo sapiens
caactattttat

SEQ ID NO: 3019703 - DNA, 21 bp, Homo sapiens
caactattttattatcctaga

SEQ ID NO: 3019704 - DNA, 21 bp, Homo sapiens
caactcaggttcacagcagct

SEQ ID NO: 3019705 - DNA, 17 bp, Homo sapiens
caactccaacctctcgg

SEQ ID NO: 3019706 - DNA, 20 bp, Homo sapiens
caactccaacctctcggccc

SEQ ID NO: 3019707 - DNA, 14 bp, Homo sapiens
caactcccttctgc

SEQ ID NO: 3019708 - DNA, 15 bp, Homo sapiens
caactcccttctgct

SEQ ID NO: 3019709 - DNA, 21 bp, Homo sapiens
caactcctcgacatcactgtt

SEQ ID NO: 3019710 - DNA, 14 bp, Homo sapiens
caactcctggaagc

SEQ ID NO: 3019711 - DNA, 17 bp, Homo sapiens
caactcctggaagctgt

SEQ ID NO: 3019712 - DNA, 21 bp, Homo sapiens
caactcctggaagctgtgtcc

SEQ ID NO: 3019713 - DNA, 19 bp, Homo sapiens
caactcctttcagccacat

SEQ ID NO: 3019714 - DNA, 20 bp, Homo sapiens
caactcgccctgtttggcat

SEQ ID NO: 3019715 - DNA, 13 bp, Homo sapiens
caactctagctgg

SEQ ID NO: 3019716 - DNA, 14 bp, Homo sapiens
caactctcccaaag

SEQ ID NO: 3019717 - DNA, 21 bp, Homo sapiens
caactctggctccaggcagaa

SEQ ID NO: 3019718 - DNA, 16 bp, Homo sapiens
caactcttgattatcc

SEQ ID NO: 3019719 - DNA, 18 bp, Homo sapiens
caactcttgattatccat

SEQ ID NO: 3019720 - DNA, 14 bp, Homo sapiens
caactgacactccc

SEQ ID NO: 3019721 - DNA, 15 bp, Homo sapiens
caactgacctgccag

SEQ ID NO: 3019722 - DNA, 17 bp, Homo sapiens
caactgacctgccagcc

SEQ ID NO: 3019723 - DNA, 13 bp, Homo sapiens
caactgcctcagc

SEQ ID NO: 3019724 - DNA, 23 bp, Homo sapiens
caactgcctccttgccagcccca

SEQ ID NO: 3019725 - DNA, 21 bp, Homo sapiens
caactgcctcgaaacacagaa

SEQ ID NO: 3019726 - DNA, 23 bp, Homo sapiens
caactgcctcgaaacacagaaac

SEQ ID NO: 3019727 - DNA, 13 bp, Homo sapiens
caactgctcagct

SEQ ID NO: 3019728 - DNA, 18 bp, Homo sapiens
caactgctcagctctggt

SEQ ID NO: 3019729 - DNA, 12 bp, Homo sapiens
caactggcaggc

SEQ ID NO: 3019730 - DNA, 14 bp, Homo sapiens
caactggcaggcag

SEQ ID NO: 3019731 - DNA, 14 bp, Homo sapiens
caactgttgatggt

SEQ ID NO: 3019732 - DNA, 14 bp, Homo sapiens
caactgttggaatt

SEQ ID NO: 3019733 - DNA, 17 bp, Homo sapiens
caactgttttaaaactt

SEQ ID NO: 3019734 - DNA, 18 bp, Homo sapiens
caactgttttaaaacttt

SEQ ID NO: 3019735 - DNA, 20 bp, Homo sapiens
caacttagatctctcctgca

SEQ ID NO: 3019736 - DNA, 21 bp, Homo sapiens
caacttagatctctcctgcaa

SEQ ID NO: 3019737 - DNA, 11 bp, Homo sapiens
caacttattaa

SEQ ID NO: 3019738 - DNA, 20 bp, Homo sapiens
caacttatttaaaaatattt

SEQ ID NO: 3019739 - DNA, 22 bp, Homo sapiens
caacttcaagtgcatgctctct

SEQ ID NO: 3019740 - DNA, 15 bp, Homo sapiens
caacttccctgttct

SEQ ID NO: 3019741 - DNA, 14 bp, Homo sapiens
caacttgcttctaa

SEQ ID NO: 3019742 - DNA, 12 bp, Homo sapiens
caacttggaaaa

SEQ ID NO: 3019743 - DNA, 21 bp, Homo sapiens
caacttttaaccaaacaatta

SEQ ID NO: 3019744 - DNA, 23 bp, Homo sapiens
caacttttcttggaactgtccca

SEQ ID NO: 3019745 - DNA, 14 bp, Homo sapiens
caactttttattgc

SEQ ID NO: 3019746 - DNA, 23 bp, Homo sapiens
caactttttattgccttctcacc

SEQ ID NO: 3019747 - DNA, 15 bp, Homo sapiens
caactttttcatagt

SEQ ID NO: 3019748 - DNA, 15 bp, Homo sapiens
caagaaaaaaaaatg

SEQ ID NO: 3019749 - DNA, 17 bp, Homo sapiens
caagaaaaaaaaatgcc

SEQ ID NO: 3019750 - DNA, 18 bp, Homo sapiens
caagaaaaaaaaatgcca

SEQ ID NO: 3019751 - DNA, 19 bp, Homo sapiens
caagaaaaaaaaatgccat

SEQ ID NO: 3019752 - DNA, 21 bp, Homo sapiens
caagaaaccaagtgggctggt

SEQ ID NO: 3019753 - DNA, 20 bp, Homo sapiens
caagaaataaaaggaagcca

SEQ ID NO: 3019754 - DNA, 19 bp, Homo sapiens
caagaactattgtgttttt

SEQ ID NO: 3019755 - DNA, 11 bp, Homo sapiens
caagaagaaag

SEQ ID NO: 3019756 - DNA, 14 bp, Homo sapiens
caagaagagagaac

SEQ ID NO: 3019757 - DNA, 11 bp, Homo sapiens
caagaagatga

SEQ ID NO: 3019758 - DNA, 18 bp, Homo sapiens
caagaagatgaatggcgt

SEQ ID NO: 3019759 - DNA, 22 bp, Homo sapiens
caagaagcaattatttaaagaa

SEQ ID NO: 3019760 - DNA, 23 bp, Homo sapiens
caagaagtcagagaaaacacttt

SEQ ID NO: 3019761 - DNA, 16 bp, Homo sapiens
caagaatcagaagaaa

SEQ ID NO: 3019762 - DNA, 14 bp, Homo sapiens
caagaatgcattga

SEQ ID NO: 3019763 - DNA, 16 bp, Homo sapiens
caagaatgcattgata

SEQ ID NO: 3019764 - DNA, 17 bp, Homo sapiens
caagaatgcattgatat

SEQ ID NO: 3019765 - DNA, 22 bp, Homo sapiens
caagaatgcattgatattgtga

SEQ ID NO: 3019766 - DNA, 17 bp, Homo sapiens
caagaatggaagcctga

SEQ ID NO: 3019767 - DNA, 20 bp, Homo sapiens
caagaatgtacgtccagcct

SEQ ID NO: 3019768 - DNA, 13 bp, Homo sapiens
caagacacagcag

SEQ ID NO: 3019769 - DNA, 20 bp, Homo sapiens
caagacagctcttcttgaaa

SEQ ID NO: 3019770 - DNA, 22 bp, Homo sapiens
caagaccagactcgccaacatg

SEQ ID NO: 3019771 - DNA, 17 bp, Homo sapiens
caagaccagcctgtcca

SEQ ID NO: 3019772 - DNA, 15 bp, Homo sapiens
caagaccctctcagg

SEQ ID NO: 3019773 - DNA, 16 bp, Homo sapiens
caagaccctctcaggc

SEQ ID NO: 3019774 - DNA, 23 bp, Homo sapiens
caagaccctctcaggctgtccca

SEQ ID NO: 3019775 - DNA, 15 bp, Homo sapiens
caagacctcagggca

SEQ ID NO: 3019776 - DNA, 16 bp, Homo sapiens
caagacctcatctcta

SEQ ID NO: 3019777 - DNA, 22 bp, Homo sapiens
caagagaaggggacttctcttc

SEQ ID NO: 3019778 - DNA, 13 bp, Homo sapiens
caagagactgagt

SEQ ID NO: 3019779 - DNA, 13 bp, Homo sapiens
caagagagacatg

SEQ ID NO: 3019780 - DNA, 13 bp, Homo sapiens
caagagaggaagg

SEQ ID NO: 3019781 - DNA, 19 bp, Homo sapiens
caagagattgctaattgct

SEQ ID NO: 3019782 - DNA, 20 bp, Homo sapiens
caagagattgctaattgctg

SEQ ID NO: 3019783 - DNA, 19 bp, Homo sapiens
caagagcaaaactccgtct

SEQ ID NO: 3019784 - DNA, 18 bp, Homo sapiens
caagagccttggtgtcca

SEQ ID NO: 3019785 - DNA, 23 bp, Homo sapiens
caagagccttggtgtccacctgg

SEQ ID NO: 3019786 - DNA, 23 bp, Homo sapiens
caagaggcagagttctgtgaaga

SEQ ID NO: 3019787 - DNA, 17 bp, Homo sapiens
caagaggcgtgtgcagg

SEQ ID NO: 3019788 - DNA, 21 bp, Homo sapiens
caagaggcgtgtgcaggccga

SEQ ID NO: 3019789 - DNA, 20 bp, Homo sapiens
cacaaaggcaaagggtccag

SEQ ID NO: 3019790 - DNA, 14 bp, Homo sapiens
cacaacacaagaaa

SEQ ID NO: 3019791 - DNA, 15 bp, Homo sapiens
cacaacacaagaaaa

SEQ ID NO: 3019792 - DNA, 21 bp, Homo sapiens
cacaacagccaacagctacaa

SEQ ID NO: 3019793 - DNA, 22 bp, Homo sapiens
cacaacatttgtgtcactgtac

SEQ ID NO: 3019794 - DNA, 20 bp, Homo sapiens
cacaaccaacgcgaaaccaa

SEQ ID NO: 3019795 - DNA, 15 bp, Homo sapiens
cacaaccctctggaa

SEQ ID NO: 3019796 - DNA, 16 bp, Homo sapiens
cacaaccctctggaag

SEQ ID NO: 3019797 - DNA, 16 bp, Homo sapiens
cacaaccttgcagtat

SEQ ID NO: 3019798 - DNA, 21 bp, Homo sapiens
cacaactccttccatccttga

SEQ ID NO: 3019799 - DNA, 20 bp, Homo sapiens
cacaacttgtcacccaaagc

SEQ ID NO: 3019800 - DNA, 12 bp, Homo sapiens
cacaacttgttt

SEQ ID NO: 3019801 - DNA, 14 bp, Homo sapiens
cacaagaaaactca

SEQ ID NO: 3019802 - DNA, 17 bp, Homo sapiens
cacaagaaactttggaa

SEQ ID NO: 3019803 - DNA, 18 bp, Homo sapiens
cacaagagtccccagact

SEQ ID NO: 3019804 - DNA, 19 bp, Homo sapiens
cacaagattcccagagaca

SEQ ID NO: 3019805 - DNA, 22 bp, Homo sapiens
cacaagattcccagagacagga

SEQ ID NO: 3019806 - DNA, 13 bp, Homo sapiens
cacaagctgcctc

SEQ ID NO: 3019807 - DNA, 15 bp, Homo sapiens
cacaaggaataaatg

SEQ ID NO: 3019808 - DNA, 22 bp, Homo sapiens
cacaaggagctttcttgtttct

SEQ ID NO: 3019809 - DNA, 23 bp, Homo sapiens
cacaaggagctttcttgtttctt

SEQ ID NO: 3019810 - DNA, 14 bp, Homo sapiens
cacaaggcctggtc

SEQ ID NO: 3019811 - DNA, 16 bp, Homo sapiens
cacaaggctgttgcat

SEQ ID NO: 3019812 - DNA, 16 bp, Homo sapiens
cacaaggtataataag

SEQ ID NO: 3019813 - DNA, 20 bp, Homo sapiens
cacaaggtcatggccacact

SEQ ID NO: 3019814 - DNA, 23 bp, Homo sapiens
cacaagtaagagactcagcctgc

SEQ ID NO: 3019815 - DNA, 20 bp, Homo sapiens
cacaagtatatacttttaaa

SEQ ID NO: 3019816 - DNA, 13 bp, Homo sapiens
cacaagtggtggt

SEQ ID NO: 3019817 - DNA, 20 bp, Homo sapiens
cacaagtggtggtaaccctg

SEQ ID NO: 3019818 - DNA, 14 bp, Homo sapiens
cacaagttgtgttt

SEQ ID NO: 3019819 - DNA, 15 bp, Homo sapiens
cacaatccctttcta

SEQ ID NO: 3019820 - DNA, 15 bp, Homo sapiens
cacaatctgttctac

SEQ ID NO: 3019821 - DNA, 22 bp, Homo sapiens
cacaatgaaatgctctcctttc

SEQ ID NO: 3019822 - DNA, 17 bp, Homo sapiens
cacaatggtttttaaat

SEQ ID NO: 3019823 - DNA, 20 bp, Homo sapiens
cacaatgttgcactgaaaac

SEQ ID NO: 3019824 - DNA, 21 bp, Homo sapiens
cacaatgttgcactgaaaacc

SEQ ID NO: 3019825 - DNA, 18 bp, Homo sapiens
cacaatttctttaaaaaa

SEQ ID NO: 3019826 - DNA, 20 bp, Homo sapiens
cacacaaaaaggagcgggca

SEQ ID NO: 3019827 - DNA, 21 bp, Homo sapiens
cacacaaaaaggagcgggcag

SEQ ID NO: 3019828 - DNA, 23 bp, Homo sapiens
cacacaaaaaggagcgggcaggg

SEQ ID NO: 3019829 - DNA, 16 bp, Homo sapiens
cacacaagtaagagac

SEQ ID NO: 3019830 - DNA, 15 bp, Homo sapiens
cacacacaaaataaa

SEQ ID NO: 3019831 - DNA, 9 bp, Homo sapiens
cacacacac

SEQ ID NO: 3019832 - DNA, 13 bp, Homo sapiens
cacacacacacaa

SEQ ID NO: 3019833 - DNA, 16 bp, Homo sapiens
cacacacacacacaca

SEQ ID NO: 3019834 - DNA, 15 bp, Homo sapiens
cacacacacacacat

SEQ ID NO: 3019835 - DNA, 14 bp, Homo sapiens
cacacacacacagc

SEQ ID NO: 3019836 - DNA, 14 bp, Homo sapiens
cacacacacacatg

SEQ ID NO: 3019837 - DNA, 11 bp, Homo sapiens
cacacacacag

SEQ ID NO: 3019838 - DNA, 14 bp, Homo sapiens
cacacacacagcca

SEQ ID NO: 3019839 - DNA, 12 bp, Homo sapiens
cacacacacatg

SEQ ID NO: 3019840 - DNA, 13 bp, Homo sapiens
cacacacacatgc

SEQ ID NO: 3019841 - DNA, 14 bp, Homo sapiens
cacacacacatgca

SEQ ID NO: 3019842 - DNA, 16 bp, Homo sapiens
cacacacagaaaatat

SEQ ID NO: 3019843 - DNA, 20 bp, Homo sapiens
cacacacagaaaatatactg

SEQ ID NO: 3019844 - DNA, 12 bp, Homo sapiens
cacacacagcca

SEQ ID NO: 3019845 - DNA, 23 bp, Homo sapiens
cacacacatttggaatgcacaca

SEQ ID NO: 3019846 - DNA, 20 bp, Homo sapiens
cacacacggaggcatcctac

SEQ ID NO: 3019847 - DNA, 14 bp, Homo sapiens
cacacactccttcc

SEQ ID NO: 3019848 - DNA, 16 bp, Homo sapiens
cacacactccttcccc

SEQ ID NO: 3019849 - DNA, 11 bp, Homo sapiens
cacacagaaaa

SEQ ID NO: 3019850 - DNA, 14 bp, Homo sapiens
cacacagaaaatat

SEQ ID NO: 3019851 - DNA, 16 bp, Homo sapiens
cacacagaaaatatac

SEQ ID NO: 3019852 - DNA, 17 bp, Homo sapiens
cacacagaaaatatact

SEQ ID NO: 3019853 - DNA, 21 bp, Homo sapiens
cacacagaaaatatactgtaa

SEQ ID NO: 3019854 - DNA, 23 bp, Homo sapiens
cacacagaaaatatactgtaaag

SEQ ID NO: 3019855 - DNA, 19 bp, Homo sapiens
cacacagcaagtcagggtt

SEQ ID NO: 3019856 - DNA, 11 bp, Homo sapiens
cacacagccac

SEQ ID NO: 3019857 - DNA, 13 bp, Homo sapiens
cacacagccacac

SEQ ID NO: 3019858 - DNA, 21 bp, Homo sapiens
cacacagccacacacacagaa

SEQ ID NO: 3019859 - DNA, 17 bp, Homo sapiens
cacacagcggctgcctc

SEQ ID NO: 3019860 - DNA, 19 bp, Homo sapiens
cacacagcggctgcctcct

SEQ ID NO: 3019861 - DNA, 22 bp, Homo sapiens
cacacaggtggtgtcactgtcc

SEQ ID NO: 3019862 - DNA, 15 bp, Homo sapiens
cacacatcaccaggt

SEQ ID NO: 3019863 - DNA, 12 bp, Homo sapiens
cacacatcccag

SEQ ID NO: 3019864 - DNA, 19 bp, Homo sapiens
cacacatctgggtgccctg

SEQ ID NO: 3019865 - DNA, 16 bp, Homo sapiens
cacacatctgtggaga

SEQ ID NO: 3019866 - DNA, 14 bp, Homo sapiens
cacacatttggaat

SEQ ID NO: 3019867 - DNA, 15 bp, Homo sapiens
cacaccacgcccagc

SEQ ID NO: 3019868 - DNA, 14 bp, Homo sapiens
cacaccagcctcct

SEQ ID NO: 3019869 - DNA, 15 bp, Homo sapiens
cacacccactcagct

SEQ ID NO: 3019870 - DNA, 16 bp, Homo sapiens
cacacccatcatctga

SEQ ID NO: 3019871 - DNA, 20 bp, Homo sapiens
cacacccctggggctgagtc

SEQ ID NO: 3019872 - DNA, 13 bp, Homo sapiens
cacacctgcagtg

SEQ ID NO: 3019873 - DNA, 16 bp, Homo sapiens
cacacctgcagtgcca

SEQ ID NO: 3019874 - DNA, 15 bp, Homo sapiens
cacacctgcctgcgt

SEQ ID NO: 3019875 - DNA, 23 bp, Homo sapiens
cacaccttttattgacacagaaa

SEQ ID NO: 3019876 - DNA, 19 bp, Homo sapiens
cacacgcaggcggccaggg

SEQ ID NO: 3019877 - DNA, 21 bp, Homo sapiens
cacacgccccaattttcaggt

SEQ ID NO: 3019878 - DNA, 17 bp, Homo sapiens
cacacgcctcccactgg

SEQ ID NO: 3019879 - DNA, 20 bp, Homo sapiens
cacacggctggtcactctgc

SEQ ID NO: 3019880 - DNA, 17 bp, Homo sapiens
cacacgtttaatcccag

SEQ ID NO: 3019881 - DNA, 22 bp, Homo sapiens
cacacgtttaatcccagcactt

SEQ ID NO: 3019882 - DNA, 17 bp, Homo sapiens
cacactacaccacacac

SEQ ID NO: 3019883 - DNA, 20 bp, Homo sapiens
cacactacaccacacacaac

SEQ ID NO: 3019884 - DNA, 22 bp, Homo sapiens
cacactacaccacacacaacag

SEQ ID NO: 3019885 - DNA, 23 bp, Homo sapiens
cacactatgtgtgttgtttccat

SEQ ID NO: 3019886 - DNA, 15 bp, Homo sapiens
cacactccttcccct

SEQ ID NO: 3019887 - DNA, 23 bp, Homo sapiens
cacactgaaaaggaaaatgggaa

SEQ ID NO: 3019888 - DNA, 15 bp, Homo sapiens
cacactgaggcaggg

SEQ ID NO: 3019889 - DNA, 18 bp, Homo sapiens
cacactgaggcagggaag

SEQ ID NO: 3019890 - DNA, 18 bp, Homo sapiens
cacactgcaagagccttg

SEQ ID NO: 3019891 - DNA, 19 bp, Homo sapiens
cacactgcaagagccttgg

SEQ ID NO: 3019892 - DNA, 13 bp, Homo sapiens
cacactgctacac

SEQ ID NO: 3019893 - DNA, 15 bp, Homo sapiens
cacactggttctcaa

SEQ ID NO: 3019894 - DNA, 20 bp, Homo sapiens
cacactggttctcaatgaaa

SEQ ID NO: 3019895 - DNA, 18 bp, Homo sapiens
cacactgtcatgcttcat

SEQ ID NO: 3019896 - DNA, 20 bp, Homo sapiens
cacactgtcatgcttcatca

SEQ ID NO: 3019897 - DNA, 21 bp, Homo sapiens
cacactgtcatgcttcatcat

SEQ ID NO: 3019898 - DNA, 17 bp, Homo sapiens
cacactgtgacacacta

SEQ ID NO: 3019899 - DNA, 19 bp, Homo sapiens
cacactgtgacacactaca

SEQ ID NO: 3019900 - DNA, 14 bp, Homo sapiens
cacacttgtgccag

SEQ ID NO: 3019901 - DNA, 19 bp, Homo sapiens
cacacttgtgccagcccgg

SEQ ID NO: 3019902 - DNA, 15 bp, Homo sapiens
cacagaaaaagcatg

SEQ ID NO: 3019903 - DNA, 19 bp, Homo sapiens
cacagaaaaaggatgtttt

SEQ ID NO: 3019904 - DNA, 13 bp, Homo sapiens
cacagaaaatata

SEQ ID NO: 3019905 - DNA, 14 bp, Homo sapiens
cacagaaaatatac

SEQ ID NO: 3019906 - DNA, 16 bp, Homo sapiens
cacagaaaatatactg

SEQ ID NO: 3019907 - DNA, 17 bp, Homo sapiens
cacagaaaatatactgt

SEQ ID NO: 3019908 - DNA, 21 bp, Homo sapiens
cacagaaaatatactgtaaag

SEQ ID NO: 3019909 - DNA, 11 bp, Homo sapiens
cacagaaacac

SEQ ID NO: 3019910 - DNA, 17 bp, Homo sapiens
cacagaaacactgcctt

SEQ ID NO: 3019911 - DNA, 20 bp, Homo sapiens
cacagaaacactgccttttt

SEQ ID NO: 3019912 - DNA, 12 bp, Homo sapiens
cacagaaacctt

SEQ ID NO: 3019913 - DNA, 19 bp, Homo sapiens
cacagaaggtgaactttgt

SEQ ID NO: 3019914 - DNA, 22 bp, Homo sapiens
cacagaaggtgaactttgtgct

SEQ ID NO: 3019915 - DNA, 13 bp, Homo sapiens
cacagacaggttt

SEQ ID NO: 3019916 - DNA, 15 bp, Homo sapiens
cacagactcatcctg

SEQ ID NO: 3019917 - DNA, 16 bp, Homo sapiens
cacagactcatcctga

SEQ ID NO: 3019918 - DNA, 15 bp, Homo sapiens
cacagactcttccac

SEQ ID NO: 3019919 - DNA, 19 bp, Homo sapiens
cacagactcttccaccaga

SEQ ID NO: 3019920 - DNA, 19 bp, Homo sapiens
cacagactgccccagccaa

SEQ ID NO: 3019921 - DNA, 22 bp, Homo sapiens
cacagagaagacaaaattagca

SEQ ID NO: 3019922 - DNA, 15 bp, Homo sapiens
cacctggtacctgga

SEQ ID NO: 3019923 - DNA, 16 bp, Homo sapiens
cacctggtacctggac

SEQ ID NO: 3019924 - DNA, 22 bp, Homo sapiens
cacctggttgacccaaaaatgt

SEQ ID NO: 3019925 - DNA, 17 bp, Homo sapiens
cacctgtaatcccagca

SEQ ID NO: 3019926 - DNA, 22 bp, Homo sapiens
cacctgtagtcccagctacttg

SEQ ID NO: 3019927 - DNA, 20 bp, Homo sapiens
cacctgtgctggagccctgt

SEQ ID NO: 3019928 - DNA, 19 bp, Homo sapiens
cacctgtgcttcgggccct

SEQ ID NO: 3019929 - DNA, 16 bp, Homo sapiens
cacctgtttgaaacca

SEQ ID NO: 3019930 - DNA, 14 bp, Homo sapiens
caccttaggcaggg

SEQ ID NO: 3019931 - DNA, 18 bp, Homo sapiens
caccttaggcagggaagt

SEQ ID NO: 3019932 - DNA, 13 bp, Homo sapiens
caccttagtgcaa

SEQ ID NO: 3019933 - DNA, 21 bp, Homo sapiens
caccttatctatgatgtttct

SEQ ID NO: 3019934 - DNA, 23 bp, Homo sapiens
caccttcagtaacccccactgga

SEQ ID NO: 3019935 - DNA, 22 bp, Homo sapiens
caccttcattttgaggggagga

SEQ ID NO: 3019936 - DNA, 16 bp, Homo sapiens
caccttcccacccctt

SEQ ID NO: 3019937 - DNA, 15 bp, Homo sapiens
caccttcccagctct

SEQ ID NO: 3019938 - DNA, 22 bp, Homo sapiens
caccttcgtttactatgcctgt

SEQ ID NO: 3019939 - DNA, 23 bp, Homo sapiens
caccttcgtttactatgcctgtg

SEQ ID NO: 3019940 - DNA, 23 bp, Homo sapiens
caccttgccacccattcttcccg

SEQ ID NO: 3019941 - DNA, 15 bp, Homo sapiens
caccttgctgcagtg

SEQ ID NO: 3019942 - DNA, 18 bp, Homo sapiens
caccttggagcatttatg

SEQ ID NO: 3019943 - DNA, 12 bp, Homo sapiens
caccttggccca

SEQ ID NO: 3019944 - DNA, 15 bp, Homo sapiens
caccttggcccagga

SEQ ID NO: 3019945 - DNA, 17 bp, Homo sapiens
caccttggcccaggagc

SEQ ID NO: 3019946 - DNA, 18 bp, Homo sapiens
caccttggcccaggagct

SEQ ID NO: 3019947 - DNA, 16 bp, Homo sapiens
caccttggcttgttat

SEQ ID NO: 3019948 - DNA, 13 bp, Homo sapiens
caccttgtgcctg

SEQ ID NO: 3019949 - DNA, 16 bp, Homo sapiens
caccttgtgcctgggg

SEQ ID NO: 3019950 - DNA, 15 bp, Homo sapiens
cacctttaggttctt

SEQ ID NO: 3019951 - DNA, 17 bp, Homo sapiens
cacctttcagcccacgt

SEQ ID NO: 3019952 - DNA, 22 bp, Homo sapiens
cacctttcataatctttgcttt

SEQ ID NO: 3019953 - DNA, 13 bp, Homo sapiens
cacctttcttctt

SEQ ID NO: 3019954 - DNA, 20 bp, Homo sapiens
caccttttcagcgatgtatg

SEQ ID NO: 3019955 - DNA, 16 bp, Homo sapiens
cacgaagtgttgcatg

SEQ ID NO: 3019956 - DNA, 18 bp, Homo sapiens
cacgaagtgttgcatgga

SEQ ID NO: 3019957 - DNA, 18 bp, Homo sapiens
cacgacaaaaacaagact

SEQ ID NO: 3019958 - DNA, 14 bp, Homo sapiens
cacgacccctgcct

SEQ ID NO: 3019959 - DNA, 16 bp, Homo sapiens
cacgacccctgcctcg

SEQ ID NO: 3019960 - DNA, 16 bp, Homo sapiens
cacgactgtctccatg

SEQ ID NO: 3019961 - DNA, 20 bp, Homo sapiens
cacgagctgtttactaggga

SEQ ID NO: 3019962 - DNA, 11 bp, Homo sapiens
cacgagggctg

SEQ ID NO: 3019963 - DNA, 22 bp, Homo sapiens
cacgagggctggctggcctcac

SEQ ID NO: 3019964 - DNA, 14 bp, Homo sapiens
cacgaggggaccca

SEQ ID NO: 3019965 - DNA, 16 bp, Homo sapiens
cacgaggggacccatg

SEQ ID NO: 3019966 - DNA, 17 bp, Homo sapiens
cacgagtgttcctgtgc

SEQ ID NO: 3019967 - DNA, 15 bp, Homo sapiens
cacgatctcagctca

SEQ ID NO: 3019968 - DNA, 19 bp, Homo sapiens
cacgatggaatgtaaaata

SEQ ID NO: 3019969 - DNA, 16 bp, Homo sapiens
cacgatgtggccctgg

SEQ ID NO: 3019970 - DNA, 18 bp, Homo sapiens
cacgatgtggccctggcc

SEQ ID NO: 3019971 - DNA, 21 bp, Homo sapiens
cacgatgtggccctggcctgc

SEQ ID NO: 3019972 - DNA, 22 bp, Homo sapiens
cacgatgtggccctggcctgct

SEQ ID NO: 3019973 - DNA, 15 bp, Homo sapiens
cacgcaacacatttt

SEQ ID NO: 3019974 - DNA, 18 bp, Homo sapiens
cacgcacatatacacaca

SEQ ID NO: 3019975 - DNA, 15 bp, Homo sapiens
cacgcacctcccatc

SEQ ID NO: 3019976 - DNA, 12 bp, Homo sapiens
cacgcacctgcc

SEQ ID NO: 3019977 - DNA, 12 bp, Homo sapiens
cacgcacctgta

SEQ ID NO: 3019978 - DNA, 13 bp, Homo sapiens
cacgcacctgtag

SEQ ID NO: 3019979 - DNA, 19 bp, Homo sapiens
cacgcaggagcacacccag

SEQ ID NO: 3019980 - DNA, 16 bp, Homo sapiens
cacgcaggcggccagg

SEQ ID NO: 3019981 - DNA, 11 bp, Homo sapiens
cacgccacagc

SEQ ID NO: 3019982 - DNA, 15 bp, Homo sapiens
cacgccacccccgcc

SEQ ID NO: 3019983 - DNA, 14 bp, Homo sapiens
cacgccactgcctc

SEQ ID NO: 3019984 - DNA, 14 bp, Homo sapiens
cacgccattctcct

SEQ ID NO: 3019985 - DNA, 18 bp, Homo sapiens
cacgccattgtactccag

SEQ ID NO: 3019986 - DNA, 21 bp, Homo sapiens
cacgccattgtactccagcct

SEQ ID NO: 3019987 - DNA, 20 bp, Homo sapiens
cacgcccagctaatttttgt

SEQ ID NO: 3019988 - DNA, 17 bp, Homo sapiens
cacgccccgctgtgtcc

SEQ ID NO: 3019989 - DNA, 23 bp, Homo sapiens
cacgccgggagaagccaccttcc

SEQ ID NO: 3019990 - DNA, 14 bp, Homo sapiens
cacgccgtctgtcc

SEQ ID NO: 3019991 - DNA, 14 bp, Homo sapiens
cacgcctcccactg

SEQ ID NO: 3019992 - DNA, 21 bp, Homo sapiens
cacgcctgcaaacgctgcctg

SEQ ID NO: 3019993 - DNA, 22 bp, Homo sapiens
cacgcctgcaaacgctgcctgc

SEQ ID NO: 3019994 - DNA, 18 bp, Homo sapiens
cacgcctgccatcttctc

SEQ ID NO: 3019995 - DNA, 19 bp, Homo sapiens
cacgcctgtaatcccagca

SEQ ID NO: 3019996 - DNA, 21 bp, Homo sapiens
cacgcctgtaatcccagcact

SEQ ID NO: 3019997 - DNA, 23 bp, Homo sapiens
cacgcctgtaatcccagcacttt

SEQ ID NO: 3019998 - DNA, 21 bp, Homo sapiens
cacgcctgtaatcccagcagt

SEQ ID NO: 3019999 - DNA, 20 bp, Homo sapiens
cacgcgcccccctcccagag

SEQ ID NO: 3020000 - DNA, 21 bp, Homo sapiens
cacgcgcccccctcccagagg

SEQ ID NO: 3020001 - DNA, 22 bp, Homo sapiens
cacgcgcccccctcccagaggc

SEQ ID NO: 3020002 - DNA, 23 bp, Homo sapiens
cacgcgcccccctcccagaggcg

SEQ ID NO: 3020003 - DNA, 18 bp, Homo sapiens
cacgcggcagcacctctg

SEQ ID NO: 3020004 - DNA, 20 bp, Homo sapiens
cacggagcagttcagagtgg

SEQ ID NO: 3020005 - DNA, 19 bp, Homo sapiens
cacggatcacgatgtaaat

SEQ ID NO: 3020006 - DNA, 21 bp, Homo sapiens
cacggcaggacaacgaggaag

SEQ ID NO: 3020007 - DNA, 19 bp, Homo sapiens
cacggcaggcgtgtggcag

SEQ ID NO: 3020008 - DNA, 16 bp, Homo sapiens
cacggcccagggaggg

SEQ ID NO: 3020009 - DNA, 17 bp, Homo sapiens
cacggcccagggagggt

SEQ ID NO: 3020010 - DNA, 16 bp, Homo sapiens
cacggcccggcccctc

SEQ ID NO: 3020011 - DNA, 18 bp, Homo sapiens
cacggcccggcccctcac

SEQ ID NO: 3020012 - DNA, 20 bp, Homo sapiens
cacggcccggcccctcaccc

SEQ ID NO: 3020013 - DNA, 21 bp, Homo sapiens
cacggcccggcccctcaccct

SEQ ID NO: 3020014 - DNA, 18 bp, Homo sapiens
cacgggacatcacagggt

SEQ ID NO: 3020015 - DNA, 18 bp, Homo sapiens
cacgggcatgcacacggc

SEQ ID NO: 3020016 - DNA, 20 bp, Homo sapiens
cacgggcatgcacacggctg

SEQ ID NO: 3020017 - DNA, 15 bp, Homo sapiens
cacgggcggtcctgc

SEQ ID NO: 3020018 - DNA, 16 bp, Homo sapiens
cacgggcggtcctgca

SEQ ID NO: 3020019 - DNA, 14 bp, Homo sapiens
cacggtccgcggcc

SEQ ID NO: 3020020 - DNA, 16 bp, Homo sapiens
cacggtcttccctctt

SEQ ID NO: 3020021 - DNA, 16 bp, Homo sapiens
cacgtaatgaaacttg

SEQ ID NO: 3020022 - DNA, 14 bp, Homo sapiens
cacgtaccaagcca

SEQ ID NO: 3020023 - DNA, 15 bp, Homo sapiens
cacgtatagtcctag

SEQ ID NO: 3020024 - DNA, 19 bp, Homo sapiens
cacgtatttcacagagcac

SEQ ID NO: 3020025 - DNA, 20 bp, Homo sapiens
cacgtatttcacagagcacg

SEQ ID NO: 3020026 - DNA, 11 bp, Homo sapiens
cacgtctctct

SEQ ID NO: 3020027 - DNA, 16 bp, Homo sapiens
cacgtgcagctcaagg

SEQ ID NO: 3020028 - DNA, 15 bp, Homo sapiens
cacgtgcaggacagc

SEQ ID NO: 3020029 - DNA, 14 bp, Homo sapiens
cacgtgccttagga

SEQ ID NO: 3020030 - DNA, 15 bp, Homo sapiens
cacgtggagacagct

SEQ ID NO: 3020031 - DNA, 13 bp, Homo sapiens
cacgtgtactggc

SEQ ID NO: 3020032 - DNA, 17 bp, Homo sapiens
cacgtgtactggctcct

SEQ ID NO: 3020033 - DNA, 16 bp, Homo sapiens
cacgtgtttgtgctgt

SEQ ID NO: 3020034 - DNA, 22 bp, Homo sapiens
cacgtgttttattcctgtatgt

SEQ ID NO: 3020035 - DNA, 23 bp, Homo sapiens
cacgtgttttattcctgtatgtt

SEQ ID NO: 3020036 - DNA, 16 bp, Homo sapiens
cacgttcagggagggg

SEQ ID NO: 3020037 - DNA, 17 bp, Homo sapiens
cacgttcagggaggggc

SEQ ID NO: 3020038 - DNA, 14 bp, Homo sapiens
cacgtttcttcccc

SEQ ID NO: 3020039 - DNA, 13 bp, Homo sapiens
cactaaacaaaga

SEQ ID NO: 3020040 - DNA, 13 bp, Homo sapiens
cactaagcagagg

SEQ ID NO: 3020041 - DNA, 20 bp, Homo sapiens
cactaagcagaggaggggcc

SEQ ID NO: 3020042 - DNA, 15 bp, Homo sapiens
cactaatgttagaat

SEQ ID NO: 3020043 - DNA, 18 bp, Homo sapiens
cactaatgttagaattga

SEQ ID NO: 3020044 - DNA, 15 bp, Homo sapiens
cactaatttttgtat

SEQ ID NO: 3020045 - DNA, 22 bp, Homo sapiens
cactacaagtttataagcccaa

SEQ ID NO: 3020046 - DNA, 16 bp, Homo sapiens
cactacaccacacaca

SEQ ID NO: 3020047 - DNA, 20 bp, Homo sapiens
cactacaccacacacaacag

SEQ ID NO: 3020048 - DNA, 23 bp, Homo sapiens
cactacaccacacacaacagcca

SEQ ID NO: 3020049 - DNA, 15 bp, Homo sapiens
cactacattcattta

SEQ ID NO: 3020050 - DNA, 15 bp, Homo sapiens
cactacctgaacatt

SEQ ID NO: 3020051 - DNA, 17 bp, Homo sapiens
cactacctgaacattgt

SEQ ID NO: 3020052 - DNA, 15 bp, Homo sapiens
cactactcgagccca

SEQ ID NO: 3020053 - DNA, 21 bp, Homo sapiens
cactactcgagcccacccagc

SEQ ID NO: 3020054 - DNA, 17 bp, Homo sapiens
cactgctctccagcctg

SEQ ID NO: 3020055 - DNA, 23 bp, Homo sapiens
cactgctctccagcctgggaggc

SEQ ID NO: 3020056 - DNA, 17 bp, Homo sapiens
cactgctgcatgttgtt

SEQ ID NO: 3020057 - DNA, 12 bp, Homo sapiens
cactgctgcctc

SEQ ID NO: 3020058 - DNA, 13 bp, Homo sapiens
cactgctgcctca

SEQ ID NO: 3020059 - DNA, 14 bp, Homo sapiens
cactgctgcctcag

SEQ ID NO: 3020060 - DNA, 15 bp, Homo sapiens
cactgctgcctcagc

SEQ ID NO: 3020061 - DNA, 18 bp, Homo sapiens
cactgctgctcctctttc

SEQ ID NO: 3020062 - DNA, 13 bp, Homo sapiens
cactgctggctgc

SEQ ID NO: 3020063 - DNA, 13 bp, Homo sapiens
cactgctgtaact

SEQ ID NO: 3020064 - DNA, 21 bp, Homo sapiens
cactgcttctcggccagcccg

SEQ ID NO: 3020065 - DNA, 14 bp, Homo sapiens
cactgcttgaggaa

SEQ ID NO: 3020066 - DNA, 13 bp, Homo sapiens
cactgcttttggc

SEQ ID NO: 3020067 - DNA, 13 bp, Homo sapiens
cactggaaaggaa

SEQ ID NO: 3020068 - DNA, 18 bp, Homo sapiens
cactggaaaggaaagatg

SEQ ID NO: 3020069 - DNA, 16 bp, Homo sapiens
cactggactccggccc

SEQ ID NO: 3020070 - DNA, 19 bp, Homo sapiens
cactggactccggccctcc

SEQ ID NO: 3020071 - DNA, 14 bp, Homo sapiens
cactggagccacag

SEQ ID NO: 3020072 - DNA, 18 bp, Homo sapiens
cactggaggagagaagaa

SEQ ID NO: 3020073 - DNA, 22 bp, Homo sapiens
cactggagtggctcgccaggcc

SEQ ID NO: 3020074 - DNA, 19 bp, Homo sapiens
cactggcagccccagcacc

SEQ ID NO: 3020075 - DNA, 16 bp, Homo sapiens
cactggcagcctgcac

SEQ ID NO: 3020076 - DNA, 15 bp, Homo sapiens
cactggccaagaaaa

SEQ ID NO: 3020077 - DNA, 18 bp, Homo sapiens
cactggcccctggcctgc

SEQ ID NO: 3020078 - DNA, 18 bp, Homo sapiens
cactggcgccttctcgga

SEQ ID NO: 3020079 - DNA, 22 bp, Homo sapiens
cactggctgtcagtatgacatt

SEQ ID NO: 3020080 - DNA, 18 bp, Homo sapiens
cactggctttgcggaggc

SEQ ID NO: 3020081 - DNA, 14 bp, Homo sapiens
cactgggaagctgg

SEQ ID NO: 3020082 - DNA, 15 bp, Homo sapiens
cactgggaagctgga

SEQ ID NO: 3020083 - DNA, 16 bp, Homo sapiens
cactgggaagctggag

SEQ ID NO: 3020084 - DNA, 12 bp, Homo sapiens
cactgggatcac

SEQ ID NO: 3020085 - DNA, 22 bp, Homo sapiens
cactgggatcacaggtgtcagc

SEQ ID NO: 3020086 - DNA, 16 bp, Homo sapiens
cactgggcacctgcgc

SEQ ID NO: 3020087 - DNA, 23 bp, Homo sapiens
cactgggcacctgcgcacaggtg

SEQ ID NO: 3020088 - DNA, 17 bp, Homo sapiens
cactgggcccctcaggg

SEQ ID NO: 3020089 - DNA, 13 bp, Homo sapiens
cactgggcgtctg

SEQ ID NO: 3020090 - DNA, 20 bp, Homo sapiens
cactgggcgtctgactccct

SEQ ID NO: 3020091 - DNA, 15 bp, Homo sapiens
cactggggattgggc

SEQ ID NO: 3020092 - DNA, 15 bp, Homo sapiens
cactggggcaggggc

SEQ ID NO: 3020093 - DNA, 14 bp, Homo sapiens
cactgggtggtggc

SEQ ID NO: 3020094 - DNA, 22 bp, Homo sapiens
cactggtccccaacaatgtgag

SEQ ID NO: 3020095 - DNA, 16 bp, Homo sapiens
cactggtgtatctcag

SEQ ID NO: 3020096 - DNA, 20 bp, Homo sapiens
cactggttgcacttatgatt

SEQ ID NO: 3020097 - DNA, 14 bp, Homo sapiens
cactgtacagtttt

SEQ ID NO: 3020098 - DNA, 18 bp, Homo sapiens
cactgtagttctaagact

SEQ ID NO: 3020099 - DNA, 22 bp, Homo sapiens
cactgtcccagtagccaaggcc

SEQ ID NO: 3020100 - DNA, 13 bp, Homo sapiens
cactgtccctcct

SEQ ID NO: 3020101 - DNA, 20 bp, Homo sapiens
cactgtccctcctggtgtca

SEQ ID NO: 3020102 - DNA, 14 bp, Homo sapiens
cactgtcctccaag

SEQ ID NO: 3020103 - DNA, 18 bp, Homo sapiens
cactgtcctccaagccag

SEQ ID NO: 3020104 - DNA, 15 bp, Homo sapiens
cactgtcctgggcct

SEQ ID NO: 3020105 - DNA, 17 bp, Homo sapiens
cactgtctagagcaact

SEQ ID NO: 3020106 - DNA, 18 bp, Homo sapiens
cactgtctgagagtttag

SEQ ID NO: 3020107 - DNA, 13 bp, Homo sapiens
cactgtcttttaa

SEQ ID NO: 3020108 - DNA, 17 bp, Homo sapiens
cactgtgacacactaca

SEQ ID NO: 3020109 - DNA, 22 bp, Homo sapiens
cactgtgacacactacaccaca

SEQ ID NO: 3020110 - DNA, 20 bp, Homo sapiens
cactgtgacccccagctccg

SEQ ID NO: 3020111 - DNA, 23 bp, Homo sapiens
cactgtgacccccagctccggcc

SEQ ID NO: 3020112 - DNA, 17 bp, Homo sapiens
cactgtgctccaacctg

SEQ ID NO: 3020113 - DNA, 15 bp, Homo sapiens
cactgtgcttggcca

SEQ ID NO: 3020114 - DNA, 17 bp, Homo sapiens
cactgtggaagtccctc

SEQ ID NO: 3020115 - DNA, 22 bp, Homo sapiens
cactgtggaagtccctcagagg

SEQ ID NO: 3020116 - DNA, 19 bp, Homo sapiens
cactgtgggtgtgtgactc

SEQ ID NO: 3020117 - DNA, 13 bp, Homo sapiens
cactgtgtcacat

SEQ ID NO: 3020118 - DNA, 12 bp, Homo sapiens
cactgtgtctct

SEQ ID NO: 3020119 - DNA, 16 bp, Homo sapiens
cactgtgtctctatgt

SEQ ID NO: 3020120 - DNA, 17 bp, Homo sapiens
cactgttcatgctggcg

SEQ ID NO: 3020121 - DNA, 19 bp, Homo sapiens
cactgttccccctgtgcag

SEQ ID NO: 3020122 - DNA, 21 bp, Homo sapiens
cactgttctcccttcggtgga

SEQ ID NO: 3020123 - DNA, 22 bp, Homo sapiens
cactgttgagaccttgtggtct

SEQ ID NO: 3020124 - DNA, 20 bp, Homo sapiens
cactgttgcttaattgtgaa

SEQ ID NO: 3020125 - DNA, 21 bp, Homo sapiens
cactgttggggagaagaaaca

SEQ ID NO: 3020126 - DNA, 22 bp, Homo sapiens
cactgttggtgttcggagctct

SEQ ID NO: 3020127 - DNA, 23 bp, Homo sapiens
cactgtttgtttttaaaaagcaa

SEQ ID NO: 3020128 - DNA, 20 bp, Homo sapiens
cactgtttttagacaccttc

SEQ ID NO: 3020129 - DNA, 21 bp, Homo sapiens
cactgtttttagacaccttca

SEQ ID NO: 3020130 - DNA, 15 bp, Homo sapiens
cactgtttttccata

SEQ ID NO: 3020131 - DNA, 22 bp, Homo sapiens
cacttaaaagctggctttcatc

SEQ ID NO: 3020132 - DNA, 17 bp, Homo sapiens
cacttaaaatgtgcagt

SEQ ID NO: 3020133 - DNA, 21 bp, Homo sapiens
cacttaagactgtgtattcta

SEQ ID NO: 3020134 - DNA, 21 bp, Homo sapiens
cacttaatattagcttgctta

SEQ ID NO: 3020135 - DNA, 17 bp, Homo sapiens
cacttacaagaaaggcc

SEQ ID NO: 3020136 - DNA, 15 bp, Homo sapiens
cacttaccgccctgc

SEQ ID NO: 3020137 - DNA, 16 bp, Homo sapiens
cacttaccgccctgcg

SEQ ID NO: 3020138 - DNA, 17 bp, Homo sapiens
cacttactgtaagacat

SEQ ID NO: 3020139 - DNA, 16 bp, Homo sapiens
cacttatctgatactt

SEQ ID NO: 3020140 - DNA, 12 bp, Homo sapiens
cacttatgattt

SEQ ID NO: 3020141 - DNA, 17 bp, Homo sapiens
cacttattctcaagaag

SEQ ID NO: 3020142 - DNA, 18 bp, Homo sapiens
cacttcaaggtgacagaa

SEQ ID NO: 3020143 - DNA, 18 bp, Homo sapiens
cacttcaataattgtcca

SEQ ID NO: 3020144 - DNA, 19 bp, Homo sapiens
cacttcaataattgtccat

SEQ ID NO: 3020145 - DNA, 16 bp, Homo sapiens
cacttcatatctagat

SEQ ID NO: 3020146 - DNA, 16 bp, Homo sapiens
cacttccagtctggag

SEQ ID NO: 3020147 - DNA, 18 bp, Homo sapiens
cacttccagtctggagag

SEQ ID NO: 3020148 - DNA, 14 bp, Homo sapiens
cacttcccaccctg

SEQ ID NO: 3020149 - DNA, 13 bp, Homo sapiens
cacttccctgctg

SEQ ID NO: 3020150 - DNA, 14 bp, Homo sapiens
cacttccctgctgc

SEQ ID NO: 3020151 - DNA, 18 bp, Homo sapiens
cacttccctgctgcctgt

SEQ ID NO: 3020152 - DNA, 16 bp, Homo sapiens
cacttcctccagaagc

SEQ ID NO: 3020153 - DNA, 18 bp, Homo sapiens
cacttcctccagaagcct

SEQ ID NO: 3020154 - DNA, 21 bp, Homo sapiens
cacttcctccagaagcctcct

SEQ ID NO: 3020155 - DNA, 13 bp, Homo sapiens
cacttcctctcca

SEQ ID NO: 3020156 - DNA, 16 bp, Homo sapiens
cacttcctctccacag

SEQ ID NO: 3020157 - DNA, 20 bp, Homo sapiens
cacttcctctccacaggagc

SEQ ID NO: 3020158 - DNA, 21 bp, Homo sapiens
cacttcctgttttaagcagct

SEQ ID NO: 3020159 - DNA, 17 bp, Homo sapiens
cacttctaaatgaagtg

SEQ ID NO: 3020160 - DNA, 18 bp, Homo sapiens
cacttctagatctcagcc

SEQ ID NO: 3020161 - DNA, 17 bp, Homo sapiens
cacttctcatcacacac

SEQ ID NO: 3020162 - DNA, 19 bp, Homo sapiens
cacttctcatcacacacat

SEQ ID NO: 3020163 - DNA, 16 bp, Homo sapiens
cacttctcatcttaaa

SEQ ID NO: 3020164 - DNA, 16 bp, Homo sapiens
cacttctgcattcctg

SEQ ID NO: 3020165 - DNA, 18 bp, Homo sapiens
cacttctggtcccctgtg

SEQ ID NO: 3020166 - DNA, 14 bp, Homo sapiens
cacttctgtcctgt

SEQ ID NO: 3020167 - DNA, 18 bp, Homo sapiens
cacttctgtcctgtgagg

SEQ ID NO: 3020168 - DNA, 20 bp, Homo sapiens
cacttctttatactctcttc

SEQ ID NO: 3020169 - DNA, 23 bp, Homo sapiens
cacttctttatactctcttccct

SEQ ID NO: 3020170 - DNA, 17 bp, Homo sapiens
cacttctttgcagagcc

SEQ ID NO: 3020171 - DNA, 23 bp, Homo sapiens
cacttgaaagattttattgtata

SEQ ID NO: 3020172 - DNA, 19 bp, Homo sapiens
cacttgatgtttcctggaa

SEQ ID NO: 3020173 - DNA, 20 bp, Homo sapiens
cacttgatgtttcctggaag

SEQ ID NO: 3020174 - DNA, 14 bp, Homo sapiens
cacttgattcataa

SEQ ID NO: 3020175 - DNA, 17 bp, Homo sapiens
cacttgccctgctccct

SEQ ID NO: 3020176 - DNA, 22 bp, Homo sapiens
cacttgccgcgtcgccctccca

SEQ ID NO: 3020177 - DNA, 14 bp, Homo sapiens
cacttggaaataaa

SEQ ID NO: 3020178 - DNA, 20 bp, Homo sapiens
cacttggagatctttgcttc

SEQ ID NO: 3020179 - DNA, 15 bp, Homo sapiens
cacttggccagtttt

SEQ ID NO: 3020180 - DNA, 21 bp, Homo sapiens
cacttggccagttttctgttc

SEQ ID NO: 3020181 - DNA, 20 bp, Homo sapiens
cacttgggggttcaggcccg

SEQ ID NO: 3020182 - DNA, 15 bp, Homo sapiens
cacttggtaattgta

SEQ ID NO: 3020183 - DNA, 15 bp, Homo sapiens
cacttggtctgccag

SEQ ID NO: 3020184 - DNA, 16 bp, Homo sapiens
cacttgtatatacgca

SEQ ID NO: 3020185 - DNA, 19 bp, Homo sapiens
cacttgtcccactatctgg

SEQ ID NO: 3020186 - DNA, 19 bp, Homo sapiens
cagccctctgcctcctccc

SEQ ID NO: 3020187 - DNA, 16 bp, Homo sapiens
cagccctgaccctgtg

SEQ ID NO: 3020188 - DNA, 17 bp, Homo sapiens
cagccctgattgtgcca

SEQ ID NO: 3020189 - DNA, 11 bp, Homo sapiens
cagccctgggc

SEQ ID NO: 3020190 - DNA, 12 bp, Homo sapiens
cagccctgggcc

SEQ ID NO: 3020191 - DNA, 18 bp, Homo sapiens
cagccctgggccccacca

SEQ ID NO: 3020192 - DNA, 19 bp, Homo sapiens
cagccctgggccccaccac

SEQ ID NO: 3020193 - DNA, 18 bp, Homo sapiens
cagccgcagacaagtaat

SEQ ID NO: 3020194 - DNA, 17 bp, Homo sapiens
cagccgctctcctgcca

SEQ ID NO: 3020195 - DNA, 16 bp, Homo sapiens
cagccggagggaggca

SEQ ID NO: 3020196 - DNA, 18 bp, Homo sapiens
cagccgggcacagtggcg

SEQ ID NO: 3020197 - DNA, 23 bp, Homo sapiens
cagccggttctgctagagcagac

SEQ ID NO: 3020198 - DNA, 16 bp, Homo sapiens
cagccgtcagccatca

SEQ ID NO: 3020199 - DNA, 17 bp, Homo sapiens
cagccgtgagcatgttt

SEQ ID NO: 3020200 - DNA, 22 bp, Homo sapiens
cagccgtgagccgccgcgcctg

SEQ ID NO: 3020201 - DNA, 13 bp, Homo sapiens
cagcctcacagaa

SEQ ID NO: 3020202 - DNA, 17 bp, Homo sapiens
cagcctcacagatgctg

SEQ ID NO: 3020203 - DNA, 22 bp, Homo sapiens
cagcctcacagatgctggcctc

SEQ ID NO: 3020204 - DNA, 23 bp, Homo sapiens
cagcctcacagatgctggcctct

SEQ ID NO: 3020205 - DNA, 14 bp, Homo sapiens
cagcctccagttgt

SEQ ID NO: 3020206 - DNA, 14 bp, Homo sapiens
cagcctcccaaagt

SEQ ID NO: 3020207 - DNA, 22 bp, Homo sapiens
cagcctcccaaagtgctgagat

SEQ ID NO: 3020208 - DNA, 16 bp, Homo sapiens
cagcctcccatccagg

SEQ ID NO: 3020209 - DNA, 20 bp, Homo sapiens
cagcctcccatccagggccc

SEQ ID NO: 3020210 - DNA, 23 bp, Homo sapiens
cagcctcccatccagggccccca

SEQ ID NO: 3020211 - DNA, 16 bp, Homo sapiens
cagcctcccctgccag

SEQ ID NO: 3020212 - DNA, 19 bp, Homo sapiens
cagcctcccctgccagggc

SEQ ID NO: 3020213 - DNA, 12 bp, Homo sapiens
cagcctccctga

SEQ ID NO: 3020214 - DNA, 23 bp, Homo sapiens
cagcctccggggttcagcctcct

SEQ ID NO: 3020215 - DNA, 13 bp, Homo sapiens
cagcctcctgggt

SEQ ID NO: 3020216 - DNA, 14 bp, Homo sapiens
cagcctcctgggta

SEQ ID NO: 3020217 - DNA, 19 bp, Homo sapiens
cagcctcctgtctcgccag

SEQ ID NO: 3020218 - DNA, 18 bp, Homo sapiens
cagcctcgcacaggccct

SEQ ID NO: 3020219 - DNA, 20 bp, Homo sapiens
cagcctcgcacaggccctag

SEQ ID NO: 3020220 - DNA, 19 bp, Homo sapiens
cagcctctcctccttgggc

SEQ ID NO: 3020221 - DNA, 18 bp, Homo sapiens
cagcctctcttcactgct

SEQ ID NO: 3020222 - DNA, 13 bp, Homo sapiens
cagcctcttactt

SEQ ID NO: 3020223 - DNA, 16 bp, Homo sapiens
cagcctctttctgtcc

SEQ ID NO: 3020224 - DNA, 20 bp, Homo sapiens
cagcctgagtgacagagcga

SEQ ID NO: 3020225 - DNA, 21 bp, Homo sapiens
cagcctgatcaggcttcctgg

SEQ ID NO: 3020226 - DNA, 13 bp, Homo sapiens
cagcctgcaccct

SEQ ID NO: 3020227 - DNA, 23 bp, Homo sapiens
cagcctgcacctggtgggtggtg

SEQ ID NO: 3020228 - DNA, 20 bp, Homo sapiens
cagcctgcagttaattagca

SEQ ID NO: 3020229 - DNA, 11 bp, Homo sapiens
cagcctgccac

SEQ ID NO: 3020230 - DNA, 23 bp, Homo sapiens
cagcctgccagcagttactgtga

SEQ ID NO: 3020231 - DNA, 14 bp, Homo sapiens
cagcctgccccgga

SEQ ID NO: 3020232 - DNA, 24 bp, Homo sapiens
cagcctgcgctcggcaggaaggag

SEQ ID NO: 3020233 - DNA, 16 bp, Homo sapiens
cagcctggacatagag

SEQ ID NO: 3020234 - DNA, 19 bp, Homo sapiens
cagcctggcatctgtgcgt

SEQ ID NO: 3020235 - DNA, 20 bp, Homo sapiens
cagcctggccaacatgctga

SEQ ID NO: 3020236 - DNA, 12 bp, Homo sapiens
cagcctgggcaa

SEQ ID NO: 3020237 - DNA, 12 bp, Homo sapiens
cagcctgggccc

SEQ ID NO: 3020238 - DNA, 17 bp, Homo sapiens
cagcctgggtgacagag

SEQ ID NO: 3020239 - DNA, 19 bp, Homo sapiens
cagcctgggtgacagagcg

SEQ ID NO: 3020240 - DNA, 18 bp, Homo sapiens
cagcctggttttcgtcat

SEQ ID NO: 3020241 - DNA, 19 bp, Homo sapiens
cagcctgtcttgtcaggtg

SEQ ID NO: 3020242 - DNA, 19 bp, Homo sapiens
cagcctgtggcggtgcctg

SEQ ID NO: 3020243 - DNA, 21 bp, Homo sapiens
cagcctgtggcggtgcctggg

SEQ ID NO: 3020244 - DNA, 22 bp, Homo sapiens
cagcctgtggcggtgcctgggt

SEQ ID NO: 3020245 - DNA, 22 bp, Homo sapiens
cagccttcaagaatcagaagaa

SEQ ID NO: 3020246 - DNA, 18 bp, Homo sapiens
cagccttcacttttctga

SEQ ID NO: 3020247 - DNA, 10 bp, Homo sapiens
cagccttcag

SEQ ID NO: 3020248 - DNA, 18 bp, Homo sapiens
cagccttcagcagcagct

SEQ ID NO: 3020249 - DNA, 14 bp, Homo sapiens
cagccttgaactct

SEQ ID NO: 3020250 - DNA, 18 bp, Homo sapiens
cagccttgaactctgggc

SEQ ID NO: 3020251 - DNA, 19 bp, Homo sapiens
cagccttgaactctgggct

SEQ ID NO: 3020252 - DNA, 15 bp, Homo sapiens
cagccttgccagaga

SEQ ID NO: 3020253 - DNA, 18 bp, Homo sapiens
cagccttgggcctttcag

SEQ ID NO: 3020254 - DNA, 18 bp, Homo sapiens
cagccttgggggggctgc

SEQ ID NO: 3020255 - DNA, 23 bp, Homo sapiens
cagccttgggggggctgcctttg

SEQ ID NO: 3020256 - DNA, 19 bp, Homo sapiens
cagcctttatcaagagact

SEQ ID NO: 3020257 - DNA, 22 bp, Homo sapiens
cagcctttgatcaggtggggag

SEQ ID NO: 3020258 - DNA, 16 bp, Homo sapiens
cagcctttgggtcctg

SEQ ID NO: 3020259 - DNA, 12 bp, Homo sapiens
cagccttttccc

SEQ ID NO: 3020260 - DNA, 14 bp, Homo sapiens
cagcgagccacagg

SEQ ID NO: 3020261 - DNA, 15 bp, Homo sapiens
cagcgagccacagga

SEQ ID NO: 3020262 - DNA, 17 bp, Homo sapiens
cagcgagccacaggaac

SEQ ID NO: 3020263 - DNA, 16 bp, Homo sapiens
cagcgaggaggctcca

SEQ ID NO: 3020264 - DNA, 18 bp, Homo sapiens
cagcgatgtatgcagcta

SEQ ID NO: 3020265 - DNA, 18 bp, Homo sapiens
cagcgccaggctgaccac

SEQ ID NO: 3020266 - DNA, 15 bp, Homo sapiens
cagcgccagggccca

SEQ ID NO: 3020267 - DNA, 16 bp, Homo sapiens
cagcgccagggcccag

SEQ ID NO: 3020268 - DNA, 13 bp, Homo sapiens
cagcgcccccagg

SEQ ID NO: 3020269 - DNA, 16 bp, Homo sapiens
cagcgcccccaggcct

SEQ ID NO: 3020270 - DNA, 23 bp, Homo sapiens
cagcgcctagtggggtctccctc

SEQ ID NO: 3020271 - DNA, 14 bp, Homo sapiens
cagcgcctgtcccc

SEQ ID NO: 3020272 - DNA, 13 bp, Homo sapiens
cagcgcgcaggcc

SEQ ID NO: 3020273 - DNA, 22 bp, Homo sapiens
cagcgctgtatttacagacaca

SEQ ID NO: 3020274 - DNA, 16 bp, Homo sapiens
cagcgctttgggaggc

SEQ ID NO: 3020275 - DNA, 15 bp, Homo sapiens
cagcggcctcagggt

SEQ ID NO: 3020276 - DNA, 16 bp, Homo sapiens
cagcggcctcagggtc

SEQ ID NO: 3020277 - DNA, 21 bp, Homo sapiens
cagcggccttgaagacagagc

SEQ ID NO: 3020278 - DNA, 13 bp, Homo sapiens
cagcggctctggt

SEQ ID NO: 3020279 - DNA, 13 bp, Homo sapiens
cagcggctgcctc

SEQ ID NO: 3020280 - DNA, 16 bp, Homo sapiens
cagcggctgcctcctg

SEQ ID NO: 3020281 - DNA, 16 bp, Homo sapiens
cagcggctggacttgg

SEQ ID NO: 3020282 - DNA, 22 bp, Homo sapiens
cagcgggaatggcagctgccac

SEQ ID NO: 3020283 - DNA, 16 bp, Homo sapiens
cagcggggaggggagg

SEQ ID NO: 3020284 - DNA, 16 bp, Homo sapiens
cagcgggggccttgaa

SEQ ID NO: 3020285 - DNA, 15 bp, Homo sapiens
cagcggtccatgggt

SEQ ID NO: 3020286 - DNA, 14 bp, Homo sapiens
cagcggtgggaagg

SEQ ID NO: 3020287 - DNA, 20 bp, Homo sapiens
cagcggttgccttttttatc

SEQ ID NO: 3020288 - DNA, 14 bp, Homo sapiens
cagcgtcctgtcca

SEQ ID NO: 3020289 - DNA, 21 bp, Homo sapiens
cagcgtgctggcgacactcag

SEQ ID NO: 3020290 - DNA, 15 bp, Homo sapiens
cagcgtgctttaaaa

SEQ ID NO: 3020291 - DNA, 18 bp, Homo sapiens
cagctaaattttctgaaa

SEQ ID NO: 3020292 - DNA, 19 bp, Homo sapiens
cagctaactccgagagcag

SEQ ID NO: 3020293 - DNA, 22 bp, Homo sapiens
cagctaaggaggggaaaaaaat

SEQ ID NO: 3020294 - DNA, 12 bp, Homo sapiens
cagctacaacag

SEQ ID NO: 3020295 - DNA, 18 bp, Homo sapiens
cagctacacctttctcct

SEQ ID NO: 3020296 - DNA, 16 bp, Homo sapiens
cagctaccaagtcaga

SEQ ID NO: 3020297 - DNA, 13 bp, Homo sapiens
cagctactcagga

SEQ ID NO: 3020298 - DNA, 17 bp, Homo sapiens
cagctactcaggaggct

SEQ ID NO: 3020299 - DNA, 13 bp, Homo sapiens
cagctactctccc

SEQ ID NO: 3020300 - DNA, 15 bp, Homo sapiens
cagctactctcccca

SEQ ID NO: 3020301 - DNA, 15 bp, Homo sapiens
cagctacttagctgg

SEQ ID NO: 3020302 - DNA, 20 bp, Homo sapiens
cagctacttgggagcctgag

SEQ ID NO: 3020303 - DNA, 21 bp, Homo sapiens
cagctacttgggagcctgagg

SEQ ID NO: 3020304 - DNA, 23 bp, Homo sapiens
cagctagaaataagcccaacaga

SEQ ID NO: 3020305 - DNA, 15 bp, Homo sapiens
cagctatacctgtgc

SEQ ID NO: 3020306 - DNA, 16 bp, Homo sapiens
cagctatacctgtgcc

SEQ ID NO: 3020307 - DNA, 21 bp, Homo sapiens
cagctatacctgtgcctcggc

SEQ ID NO: 3020308 - DNA, 23 bp, Homo sapiens
cagctatacctgtgcctcggctt

SEQ ID NO: 3020309 - DNA, 21 bp, Homo sapiens
cagctatgttatattgaaaaa

SEQ ID NO: 3020310 - DNA, 15 bp, Homo sapiens
cagctcaagagatcc

SEQ ID NO: 3020311 - DNA, 21 bp, Homo sapiens
cagctcactgcaagctccaac

SEQ ID NO: 3020312 - DNA, 13 bp, Homo sapiens
cagctcagcttcc

SEQ ID NO: 3020313 - DNA, 23 bp, Homo sapiens
cagctcatatgctgacagctctt

SEQ ID NO: 3020314 - DNA, 15 bp, Homo sapiens
cagctcatcttcaaa

SEQ ID NO: 3020315 - DNA, 14 bp, Homo sapiens
cagctccaacctgc

SEQ ID NO: 3020316 - DNA, 17 bp, Homo sapiens
cagctccaacctgcaaa

SEQ ID NO: 3020317 - DNA, 20 bp, Homo sapiens
cagctccaacctgcaaagat

SEQ ID NO: 3020318 - DNA, 18 bp, Homo sapiens
cagggaagggggagctgg

SEQ ID NO: 3020319 - DNA, 18 bp, Homo sapiens
cagggaagtccccaggcc

SEQ ID NO: 3020320 - DNA, 17 bp, Homo sapiens
cagggacacctgggaga

SEQ ID NO: 3020321 - DNA, 21 bp, Homo sapiens
cagggacagaaaccaaggccc

SEQ ID NO: 3020322 - DNA, 18 bp, Homo sapiens
cagggacagagacacctg

SEQ ID NO: 3020323 - DNA, 19 bp, Homo sapiens
cagggacagaggccccagc

SEQ ID NO: 3020324 - DNA, 21 bp, Homo sapiens
cagggacagaggccccagcct

SEQ ID NO: 3020325 - DNA, 23 bp, Homo sapiens
cagggacagaggccccagcctcc

SEQ ID NO: 3020326 - DNA, 17 bp, Homo sapiens
cagggacatgccctgtg

SEQ ID NO: 3020327 - DNA, 20 bp, Homo sapiens
cagggacatgccctgtgtgg

SEQ ID NO: 3020328 - DNA, 23 bp, Homo sapiens
cagggacatgccctgtgtggctg

SEQ ID NO: 3020329 - DNA, 18 bp, Homo sapiens
cagggacattgcagagtg

SEQ ID NO: 3020330 - DNA, 19 bp, Homo sapiens
cagggacattgcagagtgg

SEQ ID NO: 3020331 - DNA, 21 bp, Homo sapiens
cagggactgaaaacctctcct

SEQ ID NO: 3020332 - DNA, 14 bp, Homo sapiens
cagggagaggctgt

SEQ ID NO: 3020333 - DNA, 20 bp, Homo sapiens
cagggagagttggggaaggc

SEQ ID NO: 3020334 - DNA, 21 bp, Homo sapiens
cagggagcaggcggtgggcac

SEQ ID NO: 3020335 - DNA, 20 bp, Homo sapiens
cagggagcattttcctccat

SEQ ID NO: 3020336 - DNA, 19 bp, Homo sapiens
cagggagcggaaagcagct

SEQ ID NO: 3020337 - DNA, 19 bp, Homo sapiens
cagggagctgggcccgaca

SEQ ID NO: 3020338 - DNA, 18 bp, Homo sapiens
cagggaggcagagcggga

SEQ ID NO: 3020339 - DNA, 11 bp, Homo sapiens
cagggagggcc

SEQ ID NO: 3020340 - DNA, 15 bp, Homo sapiens
cagggagggccaggg

SEQ ID NO: 3020341 - DNA, 19 bp, Homo sapiens
cagggagggccagggaggc

SEQ ID NO: 3020342 - DNA, 16 bp, Homo sapiens
cagggaggggccggcc

SEQ ID NO: 3020343 - DNA, 19 bp, Homo sapiens
cagggaggggccggccctg

SEQ ID NO: 3020344 - DNA, 17 bp, Homo sapiens
cagggagggtgagctgg

SEQ ID NO: 3020345 - DNA, 18 bp, Homo sapiens
cagggagggtgagctggt

SEQ ID NO: 3020346 - DNA, 20 bp, Homo sapiens
cagggagtgtagtaaagccg

SEQ ID NO: 3020347 - DNA, 20 bp, Homo sapiens
cagggatgccctggaggtgg

SEQ ID NO: 3020348 - DNA, 22 bp, Homo sapiens
cagggatgccctggaggtggct

SEQ ID NO: 3020349 - DNA, 11 bp, Homo sapiens
cagggatttgc

SEQ ID NO: 3020350 - DNA, 14 bp, Homo sapiens
cagggcacagatga

SEQ ID NO: 3020351 - DNA, 16 bp, Homo sapiens
cagggcacagatgacc

SEQ ID NO: 3020352 - DNA, 14 bp, Homo sapiens
cagggcagcccctg

SEQ ID NO: 3020353 - DNA, 17 bp, Homo sapiens
cagggcagcccctgcag

SEQ ID NO: 3020354 - DNA, 16 bp, Homo sapiens
cagggcagcgccaggc

SEQ ID NO: 3020355 - DNA, 18 bp, Homo sapiens
cagggcagcgccaggctg

SEQ ID NO: 3020356 - DNA, 13 bp, Homo sapiens
cagggcagctgcc

SEQ ID NO: 3020357 - DNA, 23 bp, Homo sapiens
cagggcagctgcctggccatgct

SEQ ID NO: 3020358 - DNA, 13 bp, Homo sapiens
cagggcagggcca

SEQ ID NO: 3020359 - DNA, 21 bp, Homo sapiens
cagggcagtggcttctttcca

SEQ ID NO: 3020360 - DNA, 13 bp, Homo sapiens
cagggccaaccct

SEQ ID NO: 3020361 - DNA, 16 bp, Homo sapiens
cagggccacgtgccag

SEQ ID NO: 3020362 - DNA, 18 bp, Homo sapiens
cagggccacgtgccaggc

SEQ ID NO: 3020363 - DNA, 20 bp, Homo sapiens
cagggccacgtgccaggccc

SEQ ID NO: 3020364 - DNA, 16 bp, Homo sapiens
cagggccactcaacag

SEQ ID NO: 3020365 - DNA, 23 bp, Homo sapiens
cagggccactcaacagagaggac

SEQ ID NO: 3020366 - DNA, 12 bp, Homo sapiens
cagggccaggaa

SEQ ID NO: 3020367 - DNA, 13 bp, Homo sapiens
cagggccaggaag

SEQ ID NO: 3020368 - DNA, 16 bp, Homo sapiens
cagggccaggctggtc

SEQ ID NO: 3020369 - DNA, 18 bp, Homo sapiens
cagggccatggctcaggg

SEQ ID NO: 3020370 - DNA, 14 bp, Homo sapiens
cagggcccacaccc

SEQ ID NO: 3020371 - DNA, 12 bp, Homo sapiens
cagggcccagag

SEQ ID NO: 3020372 - DNA, 14 bp, Homo sapiens
cagggcccagagcc

SEQ ID NO: 3020373 - DNA, 15 bp, Homo sapiens
cagggcccagagccc

SEQ ID NO: 3020374 - DNA, 18 bp, Homo sapiens
cagggcccagagcccagc

SEQ ID NO: 3020375 - DNA, 19 bp, Homo sapiens
cagggcccagagcccagct

SEQ ID NO: 3020376 - DNA, 18 bp, Homo sapiens
cagggcccaggccatgtg

SEQ ID NO: 3020377 - DNA, 19 bp, Homo sapiens
cagggcccaggcctggagc

SEQ ID NO: 3020378 - DNA, 20 bp, Homo sapiens
cagggccccaggcattgcca

SEQ ID NO: 3020379 - DNA, 17 bp, Homo sapiens
cagggccccccaactgt

SEQ ID NO: 3020380 - DNA, 14 bp, Homo sapiens
cagggccgccaggg

SEQ ID NO: 3020381 - DNA, 20 bp, Homo sapiens
cagggccgtcaaggaaaggg

SEQ ID NO: 3020382 - DNA, 20 bp, Homo sapiens
cagggcctagctgctacaaa

SEQ ID NO: 3020383 - DNA, 17 bp, Homo sapiens
cagggcctgagcctggc

SEQ ID NO: 3020384 - DNA, 20 bp, Homo sapiens
cagggcctgagcctggccag

SEQ ID NO: 3020385 - DNA, 22 bp, Homo sapiens
cagggcctgagcctggccagcc

SEQ ID NO: 3020386 - DNA, 19 bp, Homo sapiens
cagggccttgcccagagat

SEQ ID NO: 3020387 - DNA, 19 bp, Homo sapiens
cagggcgggcagagggctg

SEQ ID NO: 3020388 - DNA, 20 bp, Homo sapiens
cagggcgggcagagggctgg

SEQ ID NO: 3020389 - DNA, 19 bp, Homo sapiens
cagggcgggggggggggcg

SEQ ID NO: 3020390 - DNA, 12 bp, Homo sapiens
cagggctcctgg

SEQ ID NO: 3020391 - DNA, 15 bp, Homo sapiens
cagggctcctgtggc

SEQ ID NO: 3020392 - DNA, 12 bp, Homo sapiens
cagggctgagga

SEQ ID NO: 3020393 - DNA, 17 bp, Homo sapiens
cagggctgaggatgggc

SEQ ID NO: 3020394 - DNA, 20 bp, Homo sapiens
cagggctgcattgggagcat

SEQ ID NO: 3020395 - DNA, 12 bp, Homo sapiens
cagggctgccag

SEQ ID NO: 3020396 - DNA, 11 bp, Homo sapiens
cagggctgggt

SEQ ID NO: 3020397 - DNA, 13 bp, Homo sapiens
cagggctgggtca

SEQ ID NO: 3020398 - DNA, 23 bp, Homo sapiens
cagggctggtttgttctgacttt

SEQ ID NO: 3020399 - DNA, 14 bp, Homo sapiens
caggggaagctgct

SEQ ID NO: 3020400 - DNA, 15 bp, Homo sapiens
caggggaagctgcta

SEQ ID NO: 3020401 - DNA, 11 bp, Homo sapiens
caggggaaggg

SEQ ID NO: 3020402 - DNA, 15 bp, Homo sapiens
caggggacactggcc

SEQ ID NO: 3020403 - DNA, 15 bp, Homo sapiens
caggggaccagaggg

SEQ ID NO: 3020404 - DNA, 18 bp, Homo sapiens
caggggaccagagggatg

SEQ ID NO: 3020405 - DNA, 18 bp, Homo sapiens
caggggacgtgggccctg

SEQ ID NO: 3020406 - DNA, 13 bp, Homo sapiens
caggggactgggc

SEQ ID NO: 3020407 - DNA, 17 bp, Homo sapiens
caggggactgggccatg

SEQ ID NO: 3020408 - DNA, 19 bp, Homo sapiens
caggggagaatgcagccca

SEQ ID NO: 3020409 - DNA, 22 bp, Homo sapiens
caggggagaatgcagcccacca

SEQ ID NO: 3020410 - DNA, 21 bp, Homo sapiens
caggggagagggtctggagaa

SEQ ID NO: 3020411 - DNA, 12 bp, Homo sapiens
caggggagccag

SEQ ID NO: 3020412 - DNA, 13 bp, Homo sapiens
caggggagccagg

SEQ ID NO: 3020413 - DNA, 19 bp, Homo sapiens
caggggaggcggcactcca

SEQ ID NO: 3020414 - DNA, 16 bp, Homo sapiens
caggggatggggtggg

SEQ ID NO: 3020415 - DNA, 13 bp, Homo sapiens
caggggcaaggtc

SEQ ID NO: 3020416 - DNA, 15 bp, Homo sapiens
caggggcagccacac

SEQ ID NO: 3020417 - DNA, 14 bp, Homo sapiens
caggggcaggagga

SEQ ID NO: 3020418 - DNA, 13 bp, Homo sapiens
caggggctgcagt

SEQ ID NO: 3020419 - DNA, 13 bp, Homo sapiens
caggggctgctgg

SEQ ID NO: 3020420 - DNA, 14 bp, Homo sapiens
caggggctgctggg

SEQ ID NO: 3020421 - DNA, 14 bp, Homo sapiens
cagggggcctggag

SEQ ID NO: 3020422 - DNA, 15 bp, Homo sapiens
cagggggcctggagc

SEQ ID NO: 3020423 - DNA, 16 bp, Homo sapiens
cagggggctgaaactt

SEQ ID NO: 3020424 - DNA, 18 bp, Homo sapiens
caggggggtgaggagctg

SEQ ID NO: 3020425 - DNA, 19 bp, Homo sapiens
caggggtaccaggcacatg

SEQ ID NO: 3020426 - DNA, 17 bp, Homo sapiens
caggggtcactgaggcc

SEQ ID NO: 3020427 - DNA, 13 bp, Homo sapiens
caggggtgacaca

SEQ ID NO: 3020428 - DNA, 18 bp, Homo sapiens
caggggtgcacagtccac

SEQ ID NO: 3020429 - DNA, 16 bp, Homo sapiens
caggggttgagagctt

SEQ ID NO: 3020430 - DNA, 17 bp, Homo sapiens
cagggtagagcaaagga

SEQ ID NO: 3020431 - DNA, 16 bp, Homo sapiens
cagggtagcaggtacc

SEQ ID NO: 3020432 - DNA, 17 bp, Homo sapiens
cagggtaggtttgtgtc

SEQ ID NO: 3020433 - DNA, 19 bp, Homo sapiens
cagggtcagaaacaggacc

SEQ ID NO: 3020434 - DNA, 14 bp, Homo sapiens
cagggtcaggcgga

SEQ ID NO: 3020435 - DNA, 15 bp, Homo sapiens
cagggtcaggcggag

SEQ ID NO: 3020436 - DNA, 16 bp, Homo sapiens
cagggtcccctgccac

SEQ ID NO: 3020437 - DNA, 12 bp, Homo sapiens
cagggtccctgg

SEQ ID NO: 3020438 - DNA, 20 bp, Homo sapiens
cagggtctagccgctgccct

SEQ ID NO: 3020439 - DNA, 11 bp, Homo sapiens
cagggtctcac

SEQ ID NO: 3020440 - DNA, 14 bp, Homo sapiens
cagggtctctgctc

SEQ ID NO: 3020441 - DNA, 14 bp, Homo sapiens
cagggtgcagtgtg

SEQ ID NO: 3020442 - DNA, 21 bp, Homo sapiens
cagggtgctaaagccaaccag

SEQ ID NO: 3020443 - DNA, 21 bp, Homo sapiens
cagggtggcgtccactcggct

SEQ ID NO: 3020444 - DNA, 15 bp, Homo sapiens
cagggtgggagccgg

SEQ ID NO: 3020445 - DNA, 22 bp, Homo sapiens
cagggtgggagccgggaccctc

SEQ ID NO: 3020446 - DNA, 20 bp, Homo sapiens
cagggtgggatggaggagaa

SEQ ID NO: 3020447 - DNA, 15 bp, Homo sapiens
cagggtggtggcaca

SEQ ID NO: 3020448 - DNA, 15 bp, Homo sapiens
cagggtgtcctgagg

SEQ ID NO: 3020449 - DNA, 16 bp, Homo sapiens
cagggtgtcctgaggt

SEQ ID NO: 3020450 - DNA, 13 bp, Homo sapiens
cagggtgtgtgct

SEQ ID NO: 3020451 - DNA, 23 bp, Homo sapiens
catacttgaagggccagagccag

SEQ ID NO: 3020452 - DNA, 14 bp, Homo sapiens
catactttgtctga

SEQ ID NO: 3020453 - DNA, 21 bp, Homo sapiens
catagaaaaatgatgtcttta

SEQ ID NO: 3020454 - DNA, 18 bp, Homo sapiens
catagaattctagctttt

SEQ ID NO: 3020455 - DNA, 13 bp, Homo sapiens
catagagaggcct

SEQ ID NO: 3020456 - DNA, 14 bp, Homo sapiens
catagagaggcctg

SEQ ID NO: 3020457 - DNA, 18 bp, Homo sapiens
catagagagggagaagaa

SEQ ID NO: 3020458 - DNA, 17 bp, Homo sapiens
catagagatatttaaaa

SEQ ID NO: 3020459 - DNA, 19 bp, Homo sapiens
catagcatccaagtggcat

SEQ ID NO: 3020460 - DNA, 18 bp, Homo sapiens
catagcatgacatttctt

SEQ ID NO: 3020461 - DNA, 14 bp, Homo sapiens
catagcctcatgtt

SEQ ID NO: 3020462 - DNA, 20 bp, Homo sapiens
catagcgtcctgccctgccc

SEQ ID NO: 3020463 - DNA, 19 bp, Homo sapiens
catagctcttcacttcctc

SEQ ID NO: 3020464 - DNA, 14 bp, Homo sapiens
catagctgggaaac

SEQ ID NO: 3020465 - DNA, 15 bp, Homo sapiens
catagctgtctagag

SEQ ID NO: 3020466 - DNA, 16 bp, Homo sapiens
cataggccaaggtgca

SEQ ID NO: 3020467 - DNA, 14 bp, Homo sapiens
cataggcccacaca

SEQ ID NO: 3020468 - DNA, 16 bp, Homo sapiens
cataggcccacacaca

SEQ ID NO: 3020469 - DNA, 16 bp, Homo sapiens
cataggtatgcttact

SEQ ID NO: 3020470 - DNA, 23 bp, Homo sapiens
cataggtctaaataggatcctgg

SEQ ID NO: 3020471 - DNA, 20 bp, Homo sapiens
catagtaactgacatgatta

SEQ ID NO: 3020472 - DNA, 21 bp, Homo sapiens
catagtaacttcttatggaat

SEQ ID NO: 3020473 - DNA, 22 bp, Homo sapiens
catagtaacttcttatggaatt

SEQ ID NO: 3020474 - DNA, 21 bp, Homo sapiens
catagtactctttgtagcaaa

SEQ ID NO: 3020475 - DNA, 18 bp, Homo sapiens
catagtattcatgactat

SEQ ID NO: 3020476 - DNA, 20 bp, Homo sapiens
catagtcccaccttggagca

SEQ ID NO: 3020477 - DNA, 19 bp, Homo sapiens
catagttatttacttgaaa

SEQ ID NO: 3020478 - DNA, 23 bp, Homo sapiens
catagttatttacttgaaagatg

SEQ ID NO: 3020479 - DNA, 21 bp, Homo sapiens
catagttctgagctgccagtg

SEQ ID NO: 3020480 - DNA, 17 bp, Homo sapiens
catagtttcaaatctgt

SEQ ID NO: 3020481 - DNA, 22 bp, Homo sapiens
catagtttcaaatctgtaatca

SEQ ID NO: 3020482 - DNA, 13 bp, Homo sapiens
catagtttttcct

SEQ ID NO: 3020483 - DNA, 15 bp, Homo sapiens
catagtttttcctgg

SEQ ID NO: 3020484 - DNA, 19 bp, Homo sapiens
catataaaatgctgatatt

SEQ ID NO: 3020485 - DNA, 19 bp, Homo sapiens
catataaactttttaaaga

SEQ ID NO: 3020486 - DNA, 22 bp, Homo sapiens
catataaattccccatatttgt

SEQ ID NO: 3020487 - DNA, 14 bp, Homo sapiens
catatacacacaca

SEQ ID NO: 3020488 - DNA, 12 bp, Homo sapiens
catatacacttg

SEQ ID NO: 3020489 - DNA, 13 bp, Homo sapiens
catatacacttgg

SEQ ID NO: 3020490 - DNA, 14 bp, Homo sapiens
catatagaaaacaa

SEQ ID NO: 3020491 - DNA, 19 bp, Homo sapiens
catatagcaaaacttttaa

SEQ ID NO: 3020492 - DNA, 22 bp, Homo sapiens
catatagcaaaacttttaaact

SEQ ID NO: 3020493 - DNA, 21 bp, Homo sapiens
catataggaaaacaataattt

SEQ ID NO: 3020494 - DNA, 14 bp, Homo sapiens
catatagtgccctt

SEQ ID NO: 3020495 - DNA, 17 bp, Homo sapiens
catatatatactattaa

SEQ ID NO: 3020496 - DNA, 11 bp, Homo sapiens
catatatatat

SEQ ID NO: 3020497 - DNA, 13 bp, Homo sapiens
catatatattaca

SEQ ID NO: 3020498 - DNA, 20 bp, Homo sapiens
catatatccttttcttctat

SEQ ID NO: 3020499 - DNA, 13 bp, Homo sapiens
catatattatata

SEQ ID NO: 3020500 - DNA, 14 bp, Homo sapiens
catatattatatat

SEQ ID NO: 3020501 - DNA, 15 bp, Homo sapiens
catatattatatata

SEQ ID NO: 3020502 - DNA, 20 bp, Homo sapiens
catatattatatatagaaaa

SEQ ID NO: 3020503 - DNA, 15 bp, Homo sapiens
catatcactgaagga

SEQ ID NO: 3020504 - DNA, 20 bp, Homo sapiens
catatcactgaaggatattt

SEQ ID NO: 3020505 - DNA, 21 bp, Homo sapiens
catatcctccgccctttttgt

SEQ ID NO: 3020506 - DNA, 14 bp, Homo sapiens
catatctaaagtca

SEQ ID NO: 3020507 - DNA, 14 bp, Homo sapiens
catatctacagata

SEQ ID NO: 3020508 - DNA, 15 bp, Homo sapiens
catatctagatttct

SEQ ID NO: 3020509 - DNA, 12 bp, Homo sapiens
catatctctccc

SEQ ID NO: 3020510 - DNA, 19 bp, Homo sapiens
catatcttctgtttcataa

SEQ ID NO: 3020511 - DNA, 12 bp, Homo sapiens
catatgaatgaa

SEQ ID NO: 3020512 - DNA, 18 bp, Homo sapiens
catatgaatgcagcactg

SEQ ID NO: 3020513 - DNA, 22 bp, Homo sapiens
catatgaatgcagcactgctgc

SEQ ID NO: 3020514 - DNA, 17 bp, Homo sapiens
catatgaattgctgtct

SEQ ID NO: 3020515 - DNA, 14 bp, Homo sapiens
catatgattctctt

SEQ ID NO: 3020516 - DNA, 17 bp, Homo sapiens
catatgcaccttgtgtc

SEQ ID NO: 3020517 - DNA, 21 bp, Homo sapiens
catatgcaccttgtgtctgta

SEQ ID NO: 3020518 - DNA, 23 bp, Homo sapiens
catatgcaccttgtgtctgtaca

SEQ ID NO: 3020519 - DNA, 15 bp, Homo sapiens
catatgcccacattt

SEQ ID NO: 3020520 - DNA, 20 bp, Homo sapiens
catatgcccacatttagtct

SEQ ID NO: 3020521 - DNA, 20 bp, Homo sapiens
catatggactctgcacatga

SEQ ID NO: 3020522 - DNA, 17 bp, Homo sapiens
catatgggttagatgtt

SEQ ID NO: 3020523 - DNA, 23 bp, Homo sapiens
catatgtcagtgtaaatccttgt

SEQ ID NO: 3020524 - DNA, 18 bp, Homo sapiens
catatgtccccactggca

SEQ ID NO: 3020525 - DNA, 19 bp, Homo sapiens
catatgttaataaactgca

SEQ ID NO: 3020526 - DNA, 16 bp, Homo sapiens
catatgttgaatactt

SEQ ID NO: 3020527 - DNA, 17 bp, Homo sapiens
catatgttgaatacttt

SEQ ID NO: 3020528 - DNA, 22 bp, Homo sapiens
catatgtttcgctgatatatgt

SEQ ID NO: 3020529 - DNA, 19 bp, Homo sapiens
catattaatataagtttct

SEQ ID NO: 3020530 - DNA, 20 bp, Homo sapiens
catattaatataagtttctt

SEQ ID NO: 3020531 - DNA, 16 bp, Homo sapiens
catattacgttgtttc

SEQ ID NO: 3020532 - DNA, 17 bp, Homo sapiens
catattacgttgtttct

SEQ ID NO: 3020533 - DNA, 14 bp, Homo sapiens
catattcaacacac

SEQ ID NO: 3020534 - DNA, 15 bp, Homo sapiens
catattcaacacact

SEQ ID NO: 3020535 - DNA, 15 bp, Homo sapiens
catattctgttggaa

SEQ ID NO: 3020536 - DNA, 16 bp, Homo sapiens
catattctgttggaag

SEQ ID NO: 3020537 - DNA, 19 bp, Homo sapiens
catattgcaggagacattt

SEQ ID NO: 3020538 - DNA, 20 bp, Homo sapiens
catattgcaggagacatttt

SEQ ID NO: 3020539 - DNA, 16 bp, Homo sapiens
catattgccatgtgtg

SEQ ID NO: 3020540 - DNA, 13 bp, Homo sapiens
catattgcttttt

SEQ ID NO: 3020541 - DNA, 14 bp, Homo sapiens
catattgtaatcta

SEQ ID NO: 3020542 - DNA, 21 bp, Homo sapiens
catattgtaatctatgtttat

SEQ ID NO: 3020543 - DNA, 12 bp, Homo sapiens
catattgtacac

SEQ ID NO: 3020544 - DNA, 11 bp, Homo sapiens
catatttaagg

SEQ ID NO: 3020545 - DNA, 10 bp, Homo sapiens
catatttaat

SEQ ID NO: 3020546 - DNA, 13 bp, Homo sapiens
catatttaatgtt

SEQ ID NO: 3020547 - DNA, 15 bp, Homo sapiens
catatttaatgtttt

SEQ ID NO: 3020548 - DNA, 16 bp, Homo sapiens
catatttaatgtttta

SEQ ID NO: 3020549 - DNA, 21 bp, Homo sapiens
catatttaatgttttaaatgt

SEQ ID NO: 3020550 - DNA, 22 bp, Homo sapiens
catatttaatgttttaaatgta

SEQ ID NO: 3020551 - DNA, 12 bp, Homo sapiens
catatttatcca

SEQ ID NO: 3020552 - DNA, 21 bp, Homo sapiens
catatttatccaaaatgtgta

SEQ ID NO: 3020553 - DNA, 18 bp, Homo sapiens
catatttcagtgattttt

SEQ ID NO: 3020554 - DNA, 12 bp, Homo sapiens
catatttgaaaa

SEQ ID NO: 3020555 - DNA, 19 bp, Homo sapiens
catatttgaattggcctga

SEQ ID NO: 3020556 - DNA, 16 bp, Homo sapiens
catattttattgtatt

SEQ ID NO: 3020557 - DNA, 14 bp, Homo sapiens
catcaaacatgaaa

SEQ ID NO: 3020558 - DNA, 15 bp, Homo sapiens
catcaaacatgaaaa

SEQ ID NO: 3020559 - DNA, 17 bp, Homo sapiens
catcaaacatgaaaaca

SEQ ID NO: 3020560 - DNA, 11 bp, Homo sapiens
catcaaagagg

SEQ ID NO: 3020561 - DNA, 21 bp, Homo sapiens
catcaaataaaccttgtttct

SEQ ID NO: 3020562 - DNA, 13 bp, Homo sapiens
catcaacaaaaat

SEQ ID NO: 3020563 - DNA, 19 bp, Homo sapiens
catcaacaatgattaatca

SEQ ID NO: 3020564 - DNA, 22 bp, Homo sapiens
catcaacaatgattaatcagct

SEQ ID NO: 3020565 - DNA, 14 bp, Homo sapiens
catcaacttaaaag

SEQ ID NO: 3020566 - DNA, 21 bp, Homo sapiens
catcaagaactattgtgtttt

SEQ ID NO: 3020567 - DNA, 16 bp, Homo sapiens
catcaaggggtcactt

SEQ ID NO: 3020568 - DNA, 17 bp, Homo sapiens
catcaaggggtcactta

SEQ ID NO: 3020569 - DNA, 21 bp, Homo sapiens
catcaatatgtatatatgtat

SEQ ID NO: 3020570 - DNA, 20 bp, Homo sapiens
catcaatgggattttctagt

SEQ ID NO: 3020571 - DNA, 17 bp, Homo sapiens
catcaatgtgacattta

SEQ ID NO: 3020572 - DNA, 22 bp, Homo sapiens
catcaatttgtaattttagtat

SEQ ID NO: 3020573 - DNA, 13 bp, Homo sapiens
catcacacacatg

SEQ ID NO: 3020574 - DNA, 15 bp, Homo sapiens
catcacatgatgaaa

SEQ ID NO: 3020575 - DNA, 19 bp, Homo sapiens
catcaccaggtgcatctgc

SEQ ID NO: 3020576 - DNA, 22 bp, Homo sapiens
catcaccaggtgcatctgcagg

SEQ ID NO: 3020577 - DNA, 14 bp, Homo sapiens
catcacctctttgc

SEQ ID NO: 3020578 - DNA, 20 bp, Homo sapiens
catcacctctttgcccccga

SEQ ID NO: 3020579 - DNA, 18 bp, Homo sapiens
catcaccttaggcaggga

SEQ ID NO: 3020580 - DNA, 20 bp, Homo sapiens
catcacgaaggaaaactgcc

SEQ ID NO: 3020581 - DNA, 18 bp, Homo sapiens
catcactagagtgctctg

SEQ ID NO: 3020582 - DNA, 14 bp, Homo sapiens
catcactagtgaca

SEQ ID NO: 3020583 - DNA, 23 bp, Homo sapiens
catcactgagttttccatggcag

SEQ ID NO: 3020584 - DNA, 23 bp, Homo sapiens
catgggtcgggagaggggacgca

SEQ ID NO: 3020585 - DNA, 13 bp, Homo sapiens
catgggtctggct

SEQ ID NO: 3020586 - DNA, 22 bp, Homo sapiens
catgggtctggctagagggccc

SEQ ID NO: 3020587 - DNA, 23 bp, Homo sapiens
catggtagaaaatgcaccaaata

SEQ ID NO: 3020588 - DNA, 14 bp, Homo sapiens
catggtcacacact

SEQ ID NO: 3020589 - DNA, 17 bp, Homo sapiens
catggtccggtgtcctt

SEQ ID NO: 3020590 - DNA, 20 bp, Homo sapiens
catggtccggtgtccttttc

SEQ ID NO: 3020591 - DNA, 19 bp, Homo sapiens
catggtgaaaccccgtctc

SEQ ID NO: 3020592 - DNA, 19 bp, Homo sapiens
catggtgccccaggaccag

SEQ ID NO: 3020593 - DNA, 22 bp, Homo sapiens
catggtgccccaggaccagctc

SEQ ID NO: 3020594 - DNA, 13 bp, Homo sapiens
catggtggccaga

SEQ ID NO: 3020595 - DNA, 12 bp, Homo sapiens
catggtggcgca

SEQ ID NO: 3020596 - DNA, 17 bp, Homo sapiens
catggtgtctcacacgt

SEQ ID NO: 3020597 - DNA, 22 bp, Homo sapiens
catggtgtggccatcactcagc

SEQ ID NO: 3020598 - DNA, 15 bp, Homo sapiens
catggtgtgtgtctc

SEQ ID NO: 3020599 - DNA, 23 bp, Homo sapiens
catggttccaattttttttaagt

SEQ ID NO: 3020600 - DNA, 14 bp, Homo sapiens
catggttctcaatt

SEQ ID NO: 3020601 - DNA, 16 bp, Homo sapiens
catgtaaaatcttcag

SEQ ID NO: 3020602 - DNA, 21 bp, Homo sapiens
catgtaaaatcttcagctggt

SEQ ID NO: 3020603 - DNA, 15 bp, Homo sapiens
catgtaaactgtgca

SEQ ID NO: 3020604 - DNA, 15 bp, Homo sapiens
catgtaacagaaagg

SEQ ID NO: 3020605 - DNA, 17 bp, Homo sapiens
catgtaacagaaagggc

SEQ ID NO: 3020606 - DNA, 18 bp, Homo sapiens
catgtaactatttcttca

SEQ ID NO: 3020607 - DNA, 13 bp, Homo sapiens
catgtaatgatct

SEQ ID NO: 3020608 - DNA, 21 bp, Homo sapiens
catgtaatggtatcttaaagt

SEQ ID NO: 3020609 - DNA, 21 bp, Homo sapiens
catgtacaaaaattatgcaat

SEQ ID NO: 3020610 - DNA, 14 bp, Homo sapiens
catgtacagacaga

SEQ ID NO: 3020611 - DNA, 17 bp, Homo sapiens
catgtacatagtaaagt

SEQ ID NO: 3020612 - DNA, 13 bp, Homo sapiens
catgtacatttgg

SEQ ID NO: 3020613 - DNA, 14 bp, Homo sapiens
catgtacatttgga

SEQ ID NO: 3020614 - DNA, 21 bp, Homo sapiens
catgtaccccctttcccttct

SEQ ID NO: 3020615 - DNA, 21 bp, Homo sapiens
catgtactgttactgtgtcag

SEQ ID NO: 3020616 - DNA, 22 bp, Homo sapiens
catgtactttttagtaatttct

SEQ ID NO: 3020617 - DNA, 13 bp, Homo sapiens
catgtagcagaca

SEQ ID NO: 3020618 - DNA, 20 bp, Homo sapiens
catgtagtatcaaatattag

SEQ ID NO: 3020619 - DNA, 12 bp, Homo sapiens
catgtatactta

SEQ ID NO: 3020620 - DNA, 15 bp, Homo sapiens
catgtatagctagct

SEQ ID NO: 3020621 - DNA, 19 bp, Homo sapiens
catgtatagttttccctat

SEQ ID NO: 3020622 - DNA, 13 bp, Homo sapiens
catgtatctgtct

SEQ ID NO: 3020623 - DNA, 18 bp, Homo sapiens
catgtatctgtctacttt

SEQ ID NO: 3020624 - DNA, 22 bp, Homo sapiens
catgtatggaatcccactgtat

SEQ ID NO: 3020625 - DNA, 22 bp, Homo sapiens
catgtatgtcttggacactgta

SEQ ID NO: 3020626 - DNA, 19 bp, Homo sapiens
catgtattagccagtcatt

SEQ ID NO: 3020627 - DNA, 15 bp, Homo sapiens
catgtcaaacaaata

SEQ ID NO: 3020628 - DNA, 13 bp, Homo sapiens
catgtcaaacatg

SEQ ID NO: 3020629 - DNA, 21 bp, Homo sapiens
catgtcaaacatgagatgtgt

SEQ ID NO: 3020630 - DNA, 13 bp, Homo sapiens
catgtcaaagtga

SEQ ID NO: 3020631 - DNA, 21 bp, Homo sapiens
catgtcaaagtgaaagacatt

SEQ ID NO: 3020632 - DNA, 23 bp, Homo sapiens
catgtcaaagtgaaagacatttc

SEQ ID NO: 3020633 - DNA, 21 bp, Homo sapiens
catgtcagttggccctttaat

SEQ ID NO: 3020634 - DNA, 21 bp, Homo sapiens
catgtccagcaccttgtgcct

SEQ ID NO: 3020635 - DNA, 23 bp, Homo sapiens
catgtccagcaccttgtgcctgg

SEQ ID NO: 3020636 - DNA, 15 bp, Homo sapiens
catgtcccctcccag

SEQ ID NO: 3020637 - DNA, 19 bp, Homo sapiens
catgtcctaattcttctgt

SEQ ID NO: 3020638 - DNA, 16 bp, Homo sapiens
catgtcgctccggtca

SEQ ID NO: 3020639 - DNA, 21 bp, Homo sapiens
catgtctaacctgatttacct

SEQ ID NO: 3020640 - DNA, 23 bp, Homo sapiens
catgtctaacctgatttacctct

SEQ ID NO: 3020641 - DNA, 16 bp, Homo sapiens
catgtctaattcattt

SEQ ID NO: 3020642 - DNA, 22 bp, Homo sapiens
catgtctcctttaagagctctg

SEQ ID NO: 3020643 - DNA, 14 bp, Homo sapiens
catgtctctgcttc

SEQ ID NO: 3020644 - DNA, 15 bp, Homo sapiens
catgtctgcatttcg

SEQ ID NO: 3020645 - DNA, 23 bp, Homo sapiens
catgtctgcctggagtgctgtgc

SEQ ID NO: 3020646 - DNA, 13 bp, Homo sapiens
catgtcttgtaca

SEQ ID NO: 3020647 - DNA, 14 bp, Homo sapiens
catgtcttgtacat

SEQ ID NO: 3020648 - DNA, 17 bp, Homo sapiens
catgtcttgtacatgtg

SEQ ID NO: 3020649 - DNA, 21 bp, Homo sapiens
catgtctttccacttctctgg

SEQ ID NO: 3020650 - DNA, 15 bp, Homo sapiens
catgtgacacatatg

SEQ ID NO: 3020651 - DNA, 23 bp, Homo sapiens
catgtgactaaaaatgcatctgg

SEQ ID NO: 3020652 - DNA, 16 bp, Homo sapiens
catgtgactctgaagc

SEQ ID NO: 3020653 - DNA, 17 bp, Homo sapiens
catgtgactctgaagct

SEQ ID NO: 3020654 - DNA, 17 bp, Homo sapiens
catgtgactctggcttg

SEQ ID NO: 3020655 - DNA, 16 bp, Homo sapiens
catgtgcaactcttgt

SEQ ID NO: 3020656 - DNA, 19 bp, Homo sapiens
catgtgcaactcttgtatt

SEQ ID NO: 3020657 - DNA, 23 bp, Homo sapiens
catgtgcagattgcagttctgat

SEQ ID NO: 3020658 - DNA, 20 bp, Homo sapiens
catgtgccacaacgcctggc

SEQ ID NO: 3020659 - DNA, 22 bp, Homo sapiens
catgtgccagggcaatgatgaa

SEQ ID NO: 3020660 - DNA, 18 bp, Homo sapiens
catgtgcctctgtcctta

SEQ ID NO: 3020661 - DNA, 19 bp, Homo sapiens
catgtgcggagcagccttt

SEQ ID NO: 3020662 - DNA, 22 bp, Homo sapiens
catgtgcgtggaagtgttcctg

SEQ ID NO: 3020663 - DNA, 22 bp, Homo sapiens
catgtggaagaaaacaagacat

SEQ ID NO: 3020664 - DNA, 12 bp, Homo sapiens
catgtggcagca

SEQ ID NO: 3020665 - DNA, 15 bp, Homo sapiens
catgtggcagcaggc

SEQ ID NO: 3020666 - DNA, 21 bp, Homo sapiens
catgtggccatggcctctgca

SEQ ID NO: 3020667 - DNA, 20 bp, Homo sapiens
catgtggcttctctgtctct

SEQ ID NO: 3020668 - DNA, 13 bp, Homo sapiens
catgtgggcttca

SEQ ID NO: 3020669 - DNA, 21 bp, Homo sapiens
catgtgggttgtgatattgac

SEQ ID NO: 3020670 - DNA, 14 bp, Homo sapiens
catgtggtgatgat

SEQ ID NO: 3020671 - DNA, 17 bp, Homo sapiens
catgtgtaatcaataaa

SEQ ID NO: 3020672 - DNA, 13 bp, Homo sapiens
catgtgtatatat

SEQ ID NO: 3020673 - DNA, 22 bp, Homo sapiens
catgtgtgagataacttccttc

SEQ ID NO: 3020674 - DNA, 20 bp, Homo sapiens
catgtgtgcgtgtctccatg

SEQ ID NO: 3020675 - DNA, 21 bp, Homo sapiens
catgtgtgtattttttcatag

SEQ ID NO: 3020676 - DNA, 12 bp, Homo sapiens
catgtgtgtcca

SEQ ID NO: 3020677 - DNA, 21 bp, Homo sapiens
catgtgtgtccacgactgtct

SEQ ID NO: 3020678 - DNA, 14 bp, Homo sapiens
catgtgttgttgtt

SEQ ID NO: 3020679 - DNA, 18 bp, Homo sapiens
catgtgttttataaaatc

SEQ ID NO: 3020680 - DNA, 22 bp, Homo sapiens
catgtgttttcatcatttcagc

SEQ ID NO: 3020681 - DNA, 16 bp, Homo sapiens
catgttcccaaaacaa

SEQ ID NO: 3020682 - DNA, 17 bp, Homo sapiens
catgttcccaaaacaat

SEQ ID NO: 3020683 - DNA, 22 bp, Homo sapiens
catgttcgggagcgaactcccc

SEQ ID NO: 3020684 - DNA, 17 bp, Homo sapiens
catgttgatcatgtact

SEQ ID NO: 3020685 - DNA, 18 bp, Homo sapiens
catgttgcacacccactc

SEQ ID NO: 3020686 - DNA, 22 bp, Homo sapiens
catgttgcacacccactcagct

SEQ ID NO: 3020687 - DNA, 22 bp, Homo sapiens
catgttgcccccgtgagccaat

SEQ ID NO: 3020688 - DNA, 18 bp, Homo sapiens
catgttgctgtttccagt

SEQ ID NO: 3020689 - DNA, 21 bp, Homo sapiens
catgttggccaggctggtcta

SEQ ID NO: 3020690 - DNA, 17 bp, Homo sapiens
catgttggtcaggctgg

SEQ ID NO: 3020691 - DNA, 14 bp, Homo sapiens
catgtttaatgtga

SEQ ID NO: 3020692 - DNA, 22 bp, Homo sapiens
catgtttaatgtgaactctccc

SEQ ID NO: 3020693 - DNA, 12 bp, Homo sapiens
catgtttataaa

SEQ ID NO: 3020694 - DNA, 23 bp, Homo sapiens
catgtttataaatcttatgctct

SEQ ID NO: 3020695 - DNA, 15 bp, Homo sapiens
catgtttattctaat

SEQ ID NO: 3020696 - DNA, 13 bp, Homo sapiens
catgtttcactta

SEQ ID NO: 3020697 - DNA, 19 bp, Homo sapiens
catgtttgagctcagaccc

SEQ ID NO: 3020698 - DNA, 23 bp, Homo sapiens
catgtttgagctcagacccccac

SEQ ID NO: 3020699 - DNA, 21 bp, Homo sapiens
catgtttgcacctttctagtt

SEQ ID NO: 3020700 - DNA, 22 bp, Homo sapiens
catgtttgcacctttctagttg

SEQ ID NO: 3020701 - DNA, 21 bp, Homo sapiens
catgttttaaaagtttgtcct

SEQ ID NO: 3020702 - DNA, 22 bp, Homo sapiens
catgttttaaaattatatagca

SEQ ID NO: 3020703 - DNA, 15 bp, Homo sapiens
catgttttaaatgta

SEQ ID NO: 3020704 - DNA, 13 bp, Homo sapiens
catgttttaacaa

SEQ ID NO: 3020705 - DNA, 23 bp, Homo sapiens
catgttttagacaaatactcatg

SEQ ID NO: 3020706 - DNA, 15 bp, Homo sapiens
catgttttcaactgc

SEQ ID NO: 3020707 - DNA, 16 bp, Homo sapiens
catgttttcaactgcc

SEQ ID NO: 3020708 - DNA, 15 bp, Homo sapiens
catgttttccattgt

SEQ ID NO: 3020709 - DNA, 21 bp, Homo sapiens
catgttttctgaaaatataac

SEQ ID NO: 3020710 - DNA, 13 bp, Homo sapiens
catgttttctgct

SEQ ID NO: 3020711 - DNA, 16 bp, Homo sapiens
catgttttctgcttta

SEQ ID NO: 3020712 - DNA, 18 bp, Homo sapiens
catgtttttaaagggcta

SEQ ID NO: 3020713 - DNA, 16 bp, Homo sapiens
catgtttttgttttaa

SEQ ID NO: 3020714 - DNA, 20 bp, Homo sapiens
catgtttttgttttaaaacg

SEQ ID NO: 3020715 - DNA, 18 bp, Homo sapiens
ccaactcccttctgcttg

SEQ ID NO: 3020716 - DNA, 22 bp, Homo sapiens
ccaactcctggaagctgtgtcc

SEQ ID NO: 3020717 - DNA, 21 bp, Homo sapiens
ccaactctagctgggggtggg

SEQ ID NO: 3020718 - DNA, 16 bp, Homo sapiens
ccaactgacctgccag

SEQ ID NO: 3020719 - DNA, 13 bp, Homo sapiens
ccaactgcctcct

SEQ ID NO: 3020720 - DNA, 14 bp, Homo sapiens
ccaactgtggctgg

SEQ ID NO: 3020721 - DNA, 19 bp, Homo sapiens
ccaactgtggtagctccag

SEQ ID NO: 3020722 - DNA, 20 bp, Homo sapiens
ccaactgtggtagctccagc

SEQ ID NO: 3020723 - DNA, 15 bp, Homo sapiens
ccaactgtgtagcat

SEQ ID NO: 3020724 - DNA, 14 bp, Homo sapiens
ccaactgttggaat

SEQ ID NO: 3020725 - DNA, 18 bp, Homo sapiens
ccaagaaaatgaagggat

SEQ ID NO: 3020726 - DNA, 22 bp, Homo sapiens
ccaagaatagcatctgtacaaa

SEQ ID NO: 3020727 - DNA, 18 bp, Homo sapiens
ccaagaatccacatttct

SEQ ID NO: 3020728 - DNA, 21 bp, Homo sapiens
ccaagaatccacatttctaaa

SEQ ID NO: 3020729 - DNA, 19 bp, Homo sapiens
ccaagacgggatgattgct

SEQ ID NO: 3020730 - DNA, 22 bp, Homo sapiens
ccaagactctagagtccaaggt

SEQ ID NO: 3020731 - DNA, 14 bp, Homo sapiens
ccaagactgggctg

SEQ ID NO: 3020732 - DNA, 17 bp, Homo sapiens
ccaagagattgctaatt

SEQ ID NO: 3020733 - DNA, 23 bp, Homo sapiens
ccaagagcccgtgccacccccag

SEQ ID NO: 3020734 - DNA, 12 bp, Homo sapiens
ccaagagcctga

SEQ ID NO: 3020735 - DNA, 19 bp, Homo sapiens
ccaagagggtcctttagta

SEQ ID NO: 3020736 - DNA, 17 bp, Homo sapiens
ccaagatgttctcctga

SEQ ID NO: 3020737 - DNA, 20 bp, Homo sapiens
ccaagattccggatcctaag

SEQ ID NO: 3020738 - DNA, 18 bp, Homo sapiens
ccaagattttgaaggaaa

SEQ ID NO: 3020739 - DNA, 13 bp, Homo sapiens
ccaagcacagcag

SEQ ID NO: 3020740 - DNA, 14 bp, Homo sapiens
ccaagcacagcagc

SEQ ID NO: 3020741 - DNA, 15 bp, Homo sapiens
ccaagcacagcagcc

SEQ ID NO: 3020742 - DNA, 18 bp, Homo sapiens
ccaagcacagcagcctgg

SEQ ID NO: 3020743 - DNA, 18 bp, Homo sapiens
ccaagcacttctttttct

SEQ ID NO: 3020744 - DNA, 17 bp, Homo sapiens
ccaagcagtgcctgcct

SEQ ID NO: 3020745 - DNA, 20 bp, Homo sapiens
ccaagcagtgcctgcctatg

SEQ ID NO: 3020746 - DNA, 18 bp, Homo sapiens
ccaagccaccgcagctgc

SEQ ID NO: 3020747 - DNA, 19 bp, Homo sapiens
ccaagccaccgcagctgct

SEQ ID NO: 3020748 - DNA, 22 bp, Homo sapiens
ccaagccaccgcagctgctgcc

SEQ ID NO: 3020749 - DNA, 14 bp, Homo sapiens
ccaagccccatcct

SEQ ID NO: 3020750 - DNA, 17 bp, Homo sapiens
ccaagccccctggcagc

SEQ ID NO: 3020751 - DNA, 20 bp, Homo sapiens
ccaagccccctggcagctgc

SEQ ID NO: 3020752 - DNA, 11 bp, Homo sapiens
ccaagcctctg

SEQ ID NO: 3020753 - DNA, 20 bp, Homo sapiens
ccaagcgaggtcaacagaga

SEQ ID NO: 3020754 - DNA, 21 bp, Homo sapiens
ccaagcgaggtcaacagagaa

SEQ ID NO: 3020755 - DNA, 22 bp, Homo sapiens
ccaagcggccttttccaaatgc

SEQ ID NO: 3020756 - DNA, 13 bp, Homo sapiens
ccaagctcacagt

SEQ ID NO: 3020757 - DNA, 17 bp, Homo sapiens
ccaagctccttgggagg

SEQ ID NO: 3020758 - DNA, 22 bp, Homo sapiens
ccaagctccttgggaggcccca

SEQ ID NO: 3020759 - DNA, 13 bp, Homo sapiens
ccaagctggctgg

SEQ ID NO: 3020760 - DNA, 21 bp, Homo sapiens
ccaagctgtgttaactgttca

SEQ ID NO: 3020761 - DNA, 14 bp, Homo sapiens
ccaagctgttaaag

SEQ ID NO: 3020762 - DNA, 20 bp, Homo sapiens
ccaagctgttaaagatattt

SEQ ID NO: 3020763 - DNA, 21 bp, Homo sapiens
ccaagctgttaaagatatttt

SEQ ID NO: 3020764 - DNA, 22 bp, Homo sapiens
ccaagctgttaaagatattttt

SEQ ID NO: 3020765 - DNA, 18 bp, Homo sapiens
ccaaggaaaggcatgtac

SEQ ID NO: 3020766 - DNA, 16 bp, Homo sapiens
ccaaggaaggagcccc

SEQ ID NO: 3020767 - DNA, 17 bp, Homo sapiens
ccaaggaaggagcccct

SEQ ID NO: 3020768 - DNA, 19 bp, Homo sapiens
ccaaggacttccacatttt

SEQ ID NO: 3020769 - DNA, 20 bp, Homo sapiens
ccaaggacttccacattttt

SEQ ID NO: 3020770 - DNA, 13 bp, Homo sapiens
ccaaggagcagag

SEQ ID NO: 3020771 - DNA, 16 bp, Homo sapiens
ccaaggagcagagagg

SEQ ID NO: 3020772 - DNA, 17 bp, Homo sapiens
ccaaggagcagagaggt

SEQ ID NO: 3020773 - DNA, 13 bp, Homo sapiens
ccaaggagcatcc

SEQ ID NO: 3020774 - DNA, 12 bp, Homo sapiens
ccaaggagctgc

SEQ ID NO: 3020775 - DNA, 13 bp, Homo sapiens
ccaaggagctgct

SEQ ID NO: 3020776 - DNA, 14 bp, Homo sapiens
ccaaggagctgcta

SEQ ID NO: 3020777 - DNA, 13 bp, Homo sapiens
ccaaggaggaaaa

SEQ ID NO: 3020778 - DNA, 12 bp, Homo sapiens
ccaaggaggatt

SEQ ID NO: 3020779 - DNA, 21 bp, Homo sapiens
ccaaggatgccttagcatgtg

SEQ ID NO: 3020780 - DNA, 22 bp, Homo sapiens
ccaaggctcttctccttggagg

SEQ ID NO: 3020781 - DNA, 23 bp, Homo sapiens
ccaagggggcagagggctttcag

SEQ ID NO: 3020782 - DNA, 24 bp, Homo sapiens
ccaagggggcggggactgctggct

SEQ ID NO: 3020783 - DNA, 21 bp, Homo sapiens
ccaaggtctcacactcctcct

SEQ ID NO: 3020784 - DNA, 22 bp, Homo sapiens
ccaaggtctcacactcctcctg

SEQ ID NO: 3020785 - DNA, 16 bp, Homo sapiens
ccaaggtctgagcact

SEQ ID NO: 3020786 - DNA, 16 bp, Homo sapiens
ccaaggtgcatataga

SEQ ID NO: 3020787 - DNA, 20 bp, Homo sapiens
ccaaggtgcatatagaaaac

SEQ ID NO: 3020788 - DNA, 20 bp, Homo sapiens
ccaaggttactcagcagcag

SEQ ID NO: 3020789 - DNA, 21 bp, Homo sapiens
ccaaggttactcagcagcaga

SEQ ID NO: 3020790 - DNA, 17 bp, Homo sapiens
ccaagtaagaggctgga

SEQ ID NO: 3020791 - DNA, 22 bp, Homo sapiens
ccaagtagaatctcagttgatt

SEQ ID NO: 3020792 - DNA, 18 bp, Homo sapiens
ccaagtcaggccaggtgg

SEQ ID NO: 3020793 - DNA, 18 bp, Homo sapiens
ccaagtcatttccgtccc

SEQ ID NO: 3020794 - DNA, 18 bp, Homo sapiens
ccaagtcctagctcctcc

SEQ ID NO: 3020795 - DNA, 14 bp, Homo sapiens
ccaagtcctgcctt

SEQ ID NO: 3020796 - DNA, 15 bp, Homo sapiens
ccaagtcctgccttt

SEQ ID NO: 3020797 - DNA, 18 bp, Homo sapiens
ccaagtcctgcctttggg

SEQ ID NO: 3020798 - DNA, 14 bp, Homo sapiens
ccaagtcctttaac

SEQ ID NO: 3020799 - DNA, 23 bp, Homo sapiens
ccaagtgctggcccacccagtcc

SEQ ID NO: 3020800 - DNA, 16 bp, Homo sapiens
ccaagtgggggcagag

SEQ ID NO: 3020801 - DNA, 14 bp, Homo sapiens
ccaagtgtatttta

SEQ ID NO: 3020802 - DNA, 14 bp, Homo sapiens
ccaagtgtgaacaa

SEQ ID NO: 3020803 - DNA, 21 bp, Homo sapiens
ccaagtgtgcatattgtacac

SEQ ID NO: 3020804 - DNA, 22 bp, Homo sapiens
ccaagtgtgcatattgtacact

SEQ ID NO: 3020805 - DNA, 19 bp, Homo sapiens
ccaagtttctaagggaggc

SEQ ID NO: 3020806 - DNA, 21 bp, Homo sapiens
ccaataataaaaaacaagaaa

SEQ ID NO: 3020807 - DNA, 22 bp, Homo sapiens
ccaataatcgtcataggcttct

SEQ ID NO: 3020808 - DNA, 13 bp, Homo sapiens
ccaatacatttgt

SEQ ID NO: 3020809 - DNA, 19 bp, Homo sapiens
ccaatacatttgtattttg

SEQ ID NO: 3020810 - DNA, 22 bp, Homo sapiens
ccaataccccgactcaccttgt

SEQ ID NO: 3020811 - DNA, 15 bp, Homo sapiens
ccaatacctcttgga

SEQ ID NO: 3020812 - DNA, 14 bp, Homo sapiens
ccaatagctgccca

SEQ ID NO: 3020813 - DNA, 13 bp, Homo sapiens
ccaataggagtct

SEQ ID NO: 3020814 - DNA, 23 bp, Homo sapiens
ccaatagttttagattattttat

SEQ ID NO: 3020815 - DNA, 23 bp, Homo sapiens
ccaatatagttttctaactcctg

SEQ ID NO: 3020816 - DNA, 14 bp, Homo sapiens
ccaatatatgtatt

SEQ ID NO: 3020817 - DNA, 20 bp, Homo sapiens
ccaatatcctcgctcccggg

SEQ ID NO: 3020818 - DNA, 15 bp, Homo sapiens
ccaatcagagaccag

SEQ ID NO: 3020819 - DNA, 21 bp, Homo sapiens
ccaatcagagaccaggccctg

SEQ ID NO: 3020820 - DNA, 13 bp, Homo sapiens
ccaatccaggtac

SEQ ID NO: 3020821 - DNA, 21 bp, Homo sapiens
ccaatccaggtacgcacagac

SEQ ID NO: 3020822 - DNA, 23 bp, Homo sapiens
ccaatccatttggcagaactgct

SEQ ID NO: 3020823 - DNA, 14 bp, Homo sapiens
ccaatcctatgttt

SEQ ID NO: 3020824 - DNA, 19 bp, Homo sapiens
ccaatctcaatacagcctg

SEQ ID NO: 3020825 - DNA, 19 bp, Homo sapiens
ccaatctgcaatttctact

SEQ ID NO: 3020826 - DNA, 20 bp, Homo sapiens
ccaatctggacacttcttta

SEQ ID NO: 3020827 - DNA, 21 bp, Homo sapiens
ccaatcttgttttaagcaaat

SEQ ID NO: 3020828 - DNA, 15 bp, Homo sapiens
ccaatgaaaaaatgt

SEQ ID NO: 3020829 - DNA, 23 bp, Homo sapiens
ccaatgaaaaaatgtatatgcac

SEQ ID NO: 3020830 - DNA, 16 bp, Homo sapiens
ccaatgagacttgcct

SEQ ID NO: 3020831 - DNA, 18 bp, Homo sapiens
ccaatgcctataaaatgc

SEQ ID NO: 3020832 - DNA, 15 bp, Homo sapiens
ccaatgtaggagctg

SEQ ID NO: 3020833 - DNA, 21 bp, Homo sapiens
ccaatgtgaaagattatttaa

SEQ ID NO: 3020834 - DNA, 19 bp, Homo sapiens
ccaatgtgaacagcggctg

SEQ ID NO: 3020835 - DNA, 20 bp, Homo sapiens
ccaatgttgtgtgttgcact

SEQ ID NO: 3020836 - DNA, 13 bp, Homo sapiens
ccaattaaattta

SEQ ID NO: 3020837 - DNA, 16 bp, Homo sapiens
ccaattaaatttattt

SEQ ID NO: 3020838 - DNA, 20 bp, Homo sapiens
ccaattccttgcacatagta

SEQ ID NO: 3020839 - DNA, 18 bp, Homo sapiens
ccaattctcgagcttggg

SEQ ID NO: 3020840 - DNA, 18 bp, Homo sapiens
ccaattgcctcttgcagg

SEQ ID NO: 3020841 - DNA, 22 bp, Homo sapiens
ccaattgttgacagttctgaag

SEQ ID NO: 3020842 - DNA, 16 bp, Homo sapiens
ccaatttcagactccc

SEQ ID NO: 3020843 - DNA, 15 bp, Homo sapiens
ccaatttgtctccta

SEQ ID NO: 3020844 - DNA, 17 bp, Homo sapiens
ccaatttgtctcctact

SEQ ID NO: 3020845 - DNA, 22 bp, Homo sapiens
ccaatttgtctcctactctgtg

SEQ ID NO: 3020846 - DNA, 15 bp, Homo sapiens
ccagcagcctcgcac

SEQ ID NO: 3020847 - DNA, 18 bp, Homo sapiens
ccagcagcctcgcacagg

SEQ ID NO: 3020848 - DNA, 19 bp, Homo sapiens
ccagcagcctcgcacaggc

SEQ ID NO: 3020849 - DNA, 15 bp, Homo sapiens
ccagcagcctgccag

SEQ ID NO: 3020850 - DNA, 18 bp, Homo sapiens
ccagcagcgcgcaggcct

SEQ ID NO: 3020851 - DNA, 19 bp, Homo sapiens
ccagcagcgcgcaggcctg

SEQ ID NO: 3020852 - DNA, 20 bp, Homo sapiens
ccagcagcgcgcaggcctgc

SEQ ID NO: 3020853 - DNA, 24 bp, Homo sapiens
ccagcagcggaaccgcccaggatc

SEQ ID NO: 3020854 - DNA, 14 bp, Homo sapiens
ccagcaggcagcgc

SEQ ID NO: 3020855 - DNA, 20 bp, Homo sapiens
ccagcaggcctccctgaaac

SEQ ID NO: 3020856 - DNA, 14 bp, Homo sapiens
ccagcaggtgcggc

SEQ ID NO: 3020857 - DNA, 17 bp, Homo sapiens
ccagcatcacctgcctg

SEQ ID NO: 3020858 - DNA, 18 bp, Homo sapiens
ccagcatccacactgccg

SEQ ID NO: 3020859 - DNA, 21 bp, Homo sapiens
ccagcatggaatctgatgaaa

SEQ ID NO: 3020860 - DNA, 15 bp, Homo sapiens
ccagcattctcagcc

SEQ ID NO: 3020861 - DNA, 14 bp, Homo sapiens
ccagcattctcagg

SEQ ID NO: 3020862 - DNA, 22 bp, Homo sapiens
ccagcattgttgagctgtcatc

SEQ ID NO: 3020863 - DNA, 10 bp, Homo sapiens
ccagccacag

SEQ ID NO: 3020864 - DNA, 12 bp, Homo sapiens
ccagccacaggc

SEQ ID NO: 3020865 - DNA, 15 bp, Homo sapiens
ccagccacaggccaa

SEQ ID NO: 3020866 - DNA, 19 bp, Homo sapiens
ccagccacccctgccactc

SEQ ID NO: 3020867 - DNA, 15 bp, Homo sapiens
ccagccactccaagc

SEQ ID NO: 3020868 - DNA, 20 bp, Homo sapiens
ccagccactccaagccccct

SEQ ID NO: 3020869 - DNA, 12 bp, Homo sapiens
ccagccagccac

SEQ ID NO: 3020870 - DNA, 16 bp, Homo sapiens
ccagccagccactcta

SEQ ID NO: 3020871 - DNA, 22 bp, Homo sapiens
ccagccagtgacctgaggaagc

SEQ ID NO: 3020872 - DNA, 18 bp, Homo sapiens
ccagccatcaagagactg

SEQ ID NO: 3020873 - DNA, 17 bp, Homo sapiens
ccagccatgtctgcatt

SEQ ID NO: 3020874 - DNA, 17 bp, Homo sapiens
ccagcccaaaccttggg

SEQ ID NO: 3020875 - DNA, 18 bp, Homo sapiens
ccagcccacagagcctga

SEQ ID NO: 3020876 - DNA, 12 bp, Homo sapiens
ccagcccagaga

SEQ ID NO: 3020877 - DNA, 22 bp, Homo sapiens
ccagcccagagacatacttgaa

SEQ ID NO: 3020878 - DNA, 23 bp, Homo sapiens
ccagcccagagacatacttgaag

SEQ ID NO: 3020879 - DNA, 15 bp, Homo sapiens
ccagcccagagcccg

SEQ ID NO: 3020880 - DNA, 23 bp, Homo sapiens
ccagcccaggagtttgaggctgc

SEQ ID NO: 3020881 - DNA, 19 bp, Homo sapiens
ccagcccattctctctcct

SEQ ID NO: 3020882 - DNA, 22 bp, Homo sapiens
ccagcccattctctctcctgtc

SEQ ID NO: 3020883 - DNA, 14 bp, Homo sapiens
ccagccccgctccc

SEQ ID NO: 3020884 - DNA, 15 bp, Homo sapiens
ccagcccctgctggc

SEQ ID NO: 3020885 - DNA, 23 bp, Homo sapiens
ccagcccctggccccaggacctg

SEQ ID NO: 3020886 - DNA, 22 bp, Homo sapiens
ccagcccggccgctccaccagc

SEQ ID NO: 3020887 - DNA, 20 bp, Homo sapiens
ccagcccggctcggcccagc

SEQ ID NO: 3020888 - DNA, 14 bp, Homo sapiens
ccagccctccctgt

SEQ ID NO: 3020889 - DNA, 16 bp, Homo sapiens
ccagccctccctgtcc

SEQ ID NO: 3020890 - DNA, 17 bp, Homo sapiens
ccagccctccctgtcct

SEQ ID NO: 3020891 - DNA, 19 bp, Homo sapiens
ccagccctccctgtcctcc

SEQ ID NO: 3020892 - DNA, 13 bp, Homo sapiens
ccagccctgccca

SEQ ID NO: 3020893 - DNA, 18 bp, Homo sapiens
ccagccctgcccaccctc

SEQ ID NO: 3020894 - DNA, 15 bp, Homo sapiens
ccagccctggcccct

SEQ ID NO: 3020895 - DNA, 17 bp, Homo sapiens
ccagccgctctcctgcc

SEQ ID NO: 3020896 - DNA, 19 bp, Homo sapiens
ccagccgctctcctgccac

SEQ ID NO: 3020897 - DNA, 10 bp, Homo sapiens
ccagcctcag

SEQ ID NO: 3020898 - DNA, 13 bp, Homo sapiens
ccagcctcagcct

SEQ ID NO: 3020899 - DNA, 19 bp, Homo sapiens
ccagcctcatctctttgtt

SEQ ID NO: 3020900 - DNA, 17 bp, Homo sapiens
ccagcctccctgaagcc

SEQ ID NO: 3020901 - DNA, 21 bp, Homo sapiens
ccagcctccctgaagcctttg

SEQ ID NO: 3020902 - DNA, 19 bp, Homo sapiens
ccagcctgcctggcaggct

SEQ ID NO: 3020903 - DNA, 16 bp, Homo sapiens
ccagcctgggcaacaa

SEQ ID NO: 3020904 - DNA, 16 bp, Homo sapiens
ccagcctgggtgacag

SEQ ID NO: 3020905 - DNA, 16 bp, Homo sapiens
ccagccttgagatgct

SEQ ID NO: 3020906 - DNA, 22 bp, Homo sapiens
ccagccttgagatgcttcactt

SEQ ID NO: 3020907 - DNA, 10 bp, Homo sapiens
ccagcctttc

SEQ ID NO: 3020908 - DNA, 14 bp, Homo sapiens
ccagcctttcttcc

SEQ ID NO: 3020909 - DNA, 20 bp, Homo sapiens
ccagcctttgggtcctgggc

SEQ ID NO: 3020910 - DNA, 23 bp, Homo sapiens
ccagcctttgggtcctgggcagg

SEQ ID NO: 3020911 - DNA, 16 bp, Homo sapiens
ccagcgagccacagga

SEQ ID NO: 3020912 - DNA, 13 bp, Homo sapiens
ccagcgatggtgc

SEQ ID NO: 3020913 - DNA, 19 bp, Homo sapiens
ccagcgatggtgctgccca

SEQ ID NO: 3020914 - DNA, 19 bp, Homo sapiens
ccagcgccagggcccaggc

SEQ ID NO: 3020915 - DNA, 18 bp, Homo sapiens
ccagcgctctcctggacg

SEQ ID NO: 3020916 - DNA, 15 bp, Homo sapiens
ccagcggcccaagag

SEQ ID NO: 3020917 - DNA, 19 bp, Homo sapiens
ccagcggcccaagagcccg

SEQ ID NO: 3020918 - DNA, 16 bp, Homo sapiens
ccagcggcctcagggt

SEQ ID NO: 3020919 - DNA, 14 bp, Homo sapiens
ccagcggctccaac

SEQ ID NO: 3020920 - DNA, 18 bp, Homo sapiens
ccagcggctccaactcct

SEQ ID NO: 3020921 - DNA, 13 bp, Homo sapiens
ccagcgtcctcct

SEQ ID NO: 3020922 - DNA, 17 bp, Homo sapiens
ccagcgtcctcctctgt

SEQ ID NO: 3020923 - DNA, 19 bp, Homo sapiens
ccagcgtcctcctctgtga

SEQ ID NO: 3020924 - DNA, 15 bp, Homo sapiens
ccagctaagaacctg

SEQ ID NO: 3020925 - DNA, 17 bp, Homo sapiens
ccagctaagaacctgga

SEQ ID NO: 3020926 - DNA, 18 bp, Homo sapiens
ccagctacacctttctcc

SEQ ID NO: 3020927 - DNA, 20 bp, Homo sapiens
ccagctacacctttctcctt

SEQ ID NO: 3020928 - DNA, 23 bp, Homo sapiens
ccagctaccaagtcagacaccaa

SEQ ID NO: 3020929 - DNA, 19 bp, Homo sapiens
ccagctactcaggaggctg

SEQ ID NO: 3020930 - DNA, 20 bp, Homo sapiens
ccagctactggggaggctga

SEQ ID NO: 3020931 - DNA, 17 bp, Homo sapiens
ccagctacttagctggc

SEQ ID NO: 3020932 - DNA, 19 bp, Homo sapiens
ccagctacttgggagcctg

SEQ ID NO: 3020933 - DNA, 21 bp, Homo sapiens
ccagctacttgggagcctgag

SEQ ID NO: 3020934 - DNA, 14 bp, Homo sapiens
ccagctatacctgt

SEQ ID NO: 3020935 - DNA, 15 bp, Homo sapiens
ccagctatacctgtg

SEQ ID NO: 3020936 - DNA, 22 bp, Homo sapiens
ccagctatgttatattgaaaaa

SEQ ID NO: 3020937 - DNA, 12 bp, Homo sapiens
ccagctcagcag

SEQ ID NO: 3020938 - DNA, 19 bp, Homo sapiens
ccagctcaggacagatgcc

SEQ ID NO: 3020939 - DNA, 20 bp, Homo sapiens
ccagctcaggacagatgcca

SEQ ID NO: 3020940 - DNA, 23 bp, Homo sapiens
ccagctcaggacagatgccacac

SEQ ID NO: 3020941 - DNA, 15 bp, Homo sapiens
ccagctccaggccca

SEQ ID NO: 3020942 - DNA, 23 bp, Homo sapiens
ccagctccctcgtcttcagctgc

SEQ ID NO: 3020943 - DNA, 14 bp, Homo sapiens
ccagctccctctat

SEQ ID NO: 3020944 - DNA, 14 bp, Homo sapiens
ccagctccgacctc

SEQ ID NO: 3020945 - DNA, 17 bp, Homo sapiens
ccagctccgacctctct

SEQ ID NO: 3020946 - DNA, 19 bp, Homo sapiens
ccagctccggcctgtcctc

SEQ ID NO: 3020947 - DNA, 18 bp, Homo sapiens
ccagctcctcactcacct

SEQ ID NO: 3020948 - DNA, 15 bp, Homo sapiens
ccagctccttttctg

SEQ ID NO: 3020949 - DNA, 17 bp, Homo sapiens
ccagctccttttctgtg

SEQ ID NO: 3020950 - DNA, 19 bp, Homo sapiens
ccagctctaagcagccagg

SEQ ID NO: 3020951 - DNA, 16 bp, Homo sapiens
ccagctctactaccta

SEQ ID NO: 3020952 - DNA, 16 bp, Homo sapiens
ccagctctccctctgg

SEQ ID NO: 3020953 - DNA, 17 bp, Homo sapiens
ccagctctccctctggc

SEQ ID NO: 3020954 - DNA, 21 bp, Homo sapiens
ccagctctccctctggccctg

SEQ ID NO: 3020955 - DNA, 15 bp, Homo sapiens
ccagctctgaaacca

SEQ ID NO: 3020956 - DNA, 21 bp, Homo sapiens
ccagctctgaaaccagtgtta

SEQ ID NO: 3020957 - DNA, 21 bp, Homo sapiens
ccagctctgccgtctctggag

SEQ ID NO: 3020958 - DNA, 13 bp, Homo sapiens
ccagctctgtcac

SEQ ID NO: 3020959 - DNA, 16 bp, Homo sapiens
ccagctcttgctctct

SEQ ID NO: 3020960 - DNA, 19 bp, Homo sapiens
ccagctcttgctctcttgt

SEQ ID NO: 3020961 - DNA, 13 bp, Homo sapiens
ccagctgcactga

SEQ ID NO: 3020962 - DNA, 14 bp, Homo sapiens
ccagctgcactgat

SEQ ID NO: 3020963 - DNA, 19 bp, Homo sapiens
ccagctgcactgatgctgc

SEQ ID NO: 3020964 - DNA, 18 bp, Homo sapiens
ccagctgccccggcccct

SEQ ID NO: 3020965 - DNA, 12 bp, Homo sapiens
ccagctgctccc

SEQ ID NO: 3020966 - DNA, 16 bp, Homo sapiens
ccagctgggtcaggca

SEQ ID NO: 3020967 - DNA, 18 bp, Homo sapiens
ccagctgggtcaggcagg

SEQ ID NO: 3020968 - DNA, 18 bp, Homo sapiens
ccagctggtgcccccaga

SEQ ID NO: 3020969 - DNA, 20 bp, Homo sapiens
ccagctgtgcccctccccca

SEQ ID NO: 3020970 - DNA, 21 bp, Homo sapiens
ccagcttattgtgtgcgctgc

SEQ ID NO: 3020971 - DNA, 16 bp, Homo sapiens
ccagctttaaaaagaa

SEQ ID NO: 3020972 - DNA, 18 bp, Homo sapiens
ccagctttctgcagactg

SEQ ID NO: 3020973 - DNA, 17 bp, Homo sapiens
ccagcttttcctcaggg

SEQ ID NO: 3020974 - DNA, 20 bp, Homo sapiens
ccaggaaacatgaagcataa

SEQ ID NO: 3020975 - DNA, 21 bp, Homo sapiens
ccaggaactcgcacctgtgct

SEQ ID NO: 3020976 - DNA, 19 bp, Homo sapiens
ccaggaagcccactgcctc

SEQ ID NO: 3020977 - DNA, 20 bp, Homo sapiens
ccaggaagcccactgcctcc

SEQ ID NO: 3020978 - DNA, 18 bp, Homo sapiens
ccagggagacctggacac

SEQ ID NO: 3020979 - DNA, 23 bp, Homo sapiens
ccagggagacctggacacaggcc

SEQ ID NO: 3020980 - DNA, 17 bp, Homo sapiens
ccagggagaggctgtgt

SEQ ID NO: 3020981 - DNA, 21 bp, Homo sapiens
ccagggagcattttcctccat

SEQ ID NO: 3020982 - DNA, 12 bp, Homo sapiens
ccagggagcctt

SEQ ID NO: 3020983 - DNA, 23 bp, Homo sapiens
ccagggagcggaaagcagctcaa

SEQ ID NO: 3020984 - DNA, 13 bp, Homo sapiens
ccagggaggcaga

SEQ ID NO: 3020985 - DNA, 14 bp, Homo sapiens
ccagggaggcagag

SEQ ID NO: 3020986 - DNA, 18 bp, Homo sapiens
ccagggagggtgagctgg

SEQ ID NO: 3020987 - DNA, 15 bp, Homo sapiens
ccagggatgggcagc

SEQ ID NO: 3020988 - DNA, 16 bp, Homo sapiens
ccagggccacgctcca

SEQ ID NO: 3020989 - DNA, 18 bp, Homo sapiens
ccagggccacgctccagc

SEQ ID NO: 3020990 - DNA, 18 bp, Homo sapiens
ccagggccagcaggcagc

SEQ ID NO: 3020991 - DNA, 15 bp, Homo sapiens
ccagggcccagagcc

SEQ ID NO: 3020992 - DNA, 16 bp, Homo sapiens
ccagggcccagagccc

SEQ ID NO: 3020993 - DNA, 18 bp, Homo sapiens
ccagggcccagagcccag

SEQ ID NO: 3020994 - DNA, 21 bp, Homo sapiens
ccagggcccagagcccagctc

SEQ ID NO: 3020995 - DNA, 22 bp, Homo sapiens
ccagggcccagagcccagctcc

SEQ ID NO: 3020996 - DNA, 14 bp, Homo sapiens
ccagggcccaggcc

SEQ ID NO: 3020997 - DNA, 17 bp, Homo sapiens
ccagggcccaggccatg

SEQ ID NO: 3020998 - DNA, 19 bp, Homo sapiens
ccagggctccagcactacc

SEQ ID NO: 3020999 - DNA, 20 bp, Homo sapiens
ccagggctctgggggcagat

SEQ ID NO: 3021000 - DNA, 13 bp, Homo sapiens
ccagggctgccag

SEQ ID NO: 3021001 - DNA, 15 bp, Homo sapiens
ccagggctgggtcac

SEQ ID NO: 3021002 - DNA, 18 bp, Homo sapiens
ccagggctgggtcacagg

SEQ ID NO: 3021003 - DNA, 20 bp, Homo sapiens
ccagggctgggtcacaggaa

SEQ ID NO: 3021004 - DNA, 22 bp, Homo sapiens
ccagggctgggtcacaggaagg

SEQ ID NO: 3021005 - DNA, 20 bp, Homo sapiens
ccagggcttcctcttccggg

SEQ ID NO: 3021006 - DNA, 16 bp, Homo sapiens
ccaggggacgtgggcc

SEQ ID NO: 3021007 - DNA, 19 bp, Homo sapiens
ccaggggagaatgcagccc

SEQ ID NO: 3021008 - DNA, 22 bp, Homo sapiens
ccaggggagaatgcagcccacc

SEQ ID NO: 3021009 - DNA, 20 bp, Homo sapiens
ccaggggagagggtctggag

SEQ ID NO: 3021010 - DNA, 16 bp, Homo sapiens
ccaggggatgggaggt

SEQ ID NO: 3021011 - DNA, 21 bp, Homo sapiens
ccaggggcagccacaccactg

SEQ ID NO: 3021012 - DNA, 15 bp, Homo sapiens
ccagggggcctggag

SEQ ID NO: 3021013 - DNA, 20 bp, Homo sapiens
ccaggggggtgaggagctgg

SEQ ID NO: 3021014 - DNA, 17 bp, Homo sapiens
ccaggggtaccaggcac

SEQ ID NO: 3021015 - DNA, 15 bp, Homo sapiens
ccagggtcccctgcc

SEQ ID NO: 3021016 - DNA, 12 bp, Homo sapiens
ccagggtctagc

SEQ ID NO: 3021017 - DNA, 16 bp, Homo sapiens
ccagggttgaccccag

SEQ ID NO: 3021018 - DNA, 21 bp, Homo sapiens
ccagggttgaccccagaggat

SEQ ID NO: 3021019 - DNA, 14 bp, Homo sapiens
ccaggtacgcacag

SEQ ID NO: 3021020 - DNA, 17 bp, Homo sapiens
ccaggtacgcacagaca

SEQ ID NO: 3021021 - DNA, 13 bp, Homo sapiens
ccaggtagaaact

SEQ ID NO: 3021022 - DNA, 17 bp, Homo sapiens
ccaggtagcagcaaata

SEQ ID NO: 3021023 - DNA, 16 bp, Homo sapiens
ccaggtagctgggatt

SEQ ID NO: 3021024 - DNA, 15 bp, Homo sapiens
ccaggtccattttgc

SEQ ID NO: 3021025 - DNA, 15 bp, Homo sapiens
ccaggtcccccgact

SEQ ID NO: 3021026 - DNA, 12 bp, Homo sapiens
ccaggtcccctc

SEQ ID NO: 3021027 - DNA, 21 bp, Homo sapiens
ccaggtgagtcctagagctac

SEQ ID NO: 3021028 - DNA, 14 bp, Homo sapiens
ccaggtgagtgtga

SEQ ID NO: 3021029 - DNA, 23 bp, Homo sapiens
ccaggtgcagaggtaccctgggt

SEQ ID NO: 3021030 - DNA, 14 bp, Homo sapiens
ccaggtgcagccag

SEQ ID NO: 3021031 - DNA, 15 bp, Homo sapiens
ccaggtgcagccaga

SEQ ID NO: 3021032 - DNA, 16 bp, Homo sapiens
ccaggtgcagccagag

SEQ ID NO: 3021033 - DNA, 20 bp, Homo sapiens
ccaggtgcctttcaaattta

SEQ ID NO: 3021034 - DNA, 11 bp, Homo sapiens
ccaggtggcta

SEQ ID NO: 3021035 - DNA, 16 bp, Homo sapiens
ccaggtggctattttg

SEQ ID NO: 3021036 - DNA, 17 bp, Homo sapiens
ccaggtggctgacccag

SEQ ID NO: 3021037 - DNA, 23 bp, Homo sapiens
ccaggtggctgacccagtccctg

SEQ ID NO: 3021038 - DNA, 18 bp, Homo sapiens
ccaggtgggaacggctga

SEQ ID NO: 3021039 - DNA, 19 bp, Homo sapiens
ccaggtgttaacattccaa

SEQ ID NO: 3021040 - DNA, 20 bp, Homo sapiens
ccaggtgttaacattccaag

SEQ ID NO: 3021041 - DNA, 23 bp, Homo sapiens
ccaggttaggaaggcagcattcc

SEQ ID NO: 3021042 - DNA, 20 bp, Homo sapiens
ccaggttcaagcgattctcc

SEQ ID NO: 3021043 - DNA, 23 bp, Homo sapiens
ccaggttcaagcgattctcctgc

SEQ ID NO: 3021044 - DNA, 14 bp, Homo sapiens
ccaggttccgaaga

SEQ ID NO: 3021045 - DNA, 23 bp, Homo sapiens
ccaggttggaaaagaaatcaatt

SEQ ID NO: 3021046 - DNA, 21 bp, Homo sapiens
ccaggtttttgcccatcctcc

SEQ ID NO: 3021047 - DNA, 14 bp, Homo sapiens
ccagtaccttgctt

SEQ ID NO: 3021048 - DNA, 17 bp, Homo sapiens
ccagtagtaccttgttt

SEQ ID NO: 3021049 - DNA, 16 bp, Homo sapiens
ccagtagtgtttggaa

SEQ ID NO: 3021050 - DNA, 16 bp, Homo sapiens
ccagtattactgctgc

SEQ ID NO: 3021051 - DNA, 18 bp, Homo sapiens
ccagtattactgctgctg

SEQ ID NO: 3021052 - DNA, 22 bp, Homo sapiens
ccagtattactgctgctgtgct

SEQ ID NO: 3021053 - DNA, 23 bp, Homo sapiens
ccagtattactgctgctgtgctt

SEQ ID NO: 3021054 - DNA, 16 bp, Homo sapiens
ccagtcaaatctgggc

SEQ ID NO: 3021055 - DNA, 17 bp, Homo sapiens
ccagtcagaagttctgg

SEQ ID NO: 3021056 - DNA, 16 bp, Homo sapiens
ccagtcatcatctctt

SEQ ID NO: 3021057 - DNA, 16 bp, Homo sapiens
ccagtccatgctccag

SEQ ID NO: 3021058 - DNA, 17 bp, Homo sapiens
ccagtccatgctccagg

SEQ ID NO: 3021059 - DNA, 18 bp, Homo sapiens
ccagtccatgctccaggg

SEQ ID NO: 3021060 - DNA, 12 bp, Homo sapiens
ccagtccctggg

SEQ ID NO: 3021061 - DNA, 22 bp, Homo sapiens
ccagtccctgggggaagccctg

SEQ ID NO: 3021062 - DNA, 13 bp, Homo sapiens
ccagtccctgtcc

SEQ ID NO: 3021063 - DNA, 12 bp, Homo sapiens
ccagtcctgctg

SEQ ID NO: 3021064 - DNA, 14 bp, Homo sapiens
ccagtcctgctggc

SEQ ID NO: 3021065 - DNA, 20 bp, Homo sapiens
ccagtcctgctggcctgctc

SEQ ID NO: 3021066 - DNA, 21 bp, Homo sapiens
ccagtcctgctggcctgctct

SEQ ID NO: 3021067 - DNA, 22 bp, Homo sapiens
ccagtcctgctggcctgctctt

SEQ ID NO: 3021068 - DNA, 18 bp, Homo sapiens
ccagtccttggctgtatc

SEQ ID NO: 3021069 - DNA, 14 bp, Homo sapiens
ccagtctgttctca

SEQ ID NO: 3021070 - DNA, 15 bp, Homo sapiens
ccagtcttcctctta

SEQ ID NO: 3021071 - DNA, 15 bp, Homo sapiens
ccagtgaagatattt

SEQ ID NO: 3021072 - DNA, 22 bp, Homo sapiens
ccagtgaatttttgcaataatg

SEQ ID NO: 3021073 - DNA, 14 bp, Homo sapiens
ccagtgacagctag

SEQ ID NO: 3021074 - DNA, 18 bp, Homo sapiens
ccagtgacctgaggaagc

SEQ ID NO: 3021075 - DNA, 18 bp, Homo sapiens
ccagtgagggacgtcaga

SEQ ID NO: 3021076 - DNA, 15 bp, Homo sapiens
ccagtgagtggcccc

SEQ ID NO: 3021077 - DNA, 19 bp, Homo sapiens
ccagtgcaggctggccagc

SEQ ID NO: 3021078 - DNA, 11 bp, Homo sapiens
ccagtgcagtc

SEQ ID NO: 3021079 - DNA, 18 bp, Homo sapiens
ccagtgcagtttctaagc

SEQ ID NO: 3021080 - DNA, 18 bp, Homo sapiens
ccagtgcatggtggccag

SEQ ID NO: 3021081 - DNA, 16 bp, Homo sapiens
ccagtgcccccactga

SEQ ID NO: 3021082 - DNA, 18 bp, Homo sapiens
ccagtgcccccactgacc

SEQ ID NO: 3021083 - DNA, 20 bp, Homo sapiens
ccagtgccttacctcctgcc

SEQ ID NO: 3021084 - DNA, 14 bp, Homo sapiens
ccagtgccttctgg

SEQ ID NO: 3021085 - DNA, 13 bp, Homo sapiens
ccagtgctgccca

SEQ ID NO: 3021086 - DNA, 19 bp, Homo sapiens
ccagtgctgcccatgagca

SEQ ID NO: 3021087 - DNA, 22 bp, Homo sapiens
ccagtgcttctccaacactgaa

SEQ ID NO: 3021088 - DNA, 24 bp, Homo sapiens
ccagtggaaggacactcttggctc

SEQ ID NO: 3021089 - DNA, 19 bp, Homo sapiens
ccagtggatggattcatca

SEQ ID NO: 3021090 - DNA, 19 bp, Homo sapiens
ccagtggccttacccctgc

SEQ ID NO: 3021091 - DNA, 22 bp, Homo sapiens
ccagtggccttacccctgcctt

SEQ ID NO: 3021092 - DNA, 20 bp, Homo sapiens
ccagtggctggaagaaccac

SEQ ID NO: 3021093 - DNA, 16 bp, Homo sapiens
ccagtgggagatgtta

SEQ ID NO: 3021094 - DNA, 14 bp, Homo sapiens
ccagtgggctgcac

SEQ ID NO: 3021095 - DNA, 15 bp, Homo sapiens
ccagtgggctgcacg

SEQ ID NO: 3021096 - DNA, 15 bp, Homo sapiens
ccagtgggctgtgtt

SEQ ID NO: 3021097 - DNA, 22 bp, Homo sapiens
ccagtgggctgtgttgactgct

SEQ ID NO: 3021098 - DNA, 16 bp, Homo sapiens
ccagtgtaaattcagt

SEQ ID NO: 3021099 - DNA, 19 bp, Homo sapiens
ccagtgtattttgtccaag

SEQ ID NO: 3021100 - DNA, 20 bp, Homo sapiens
ccagtgtgacaggaaagatt

SEQ ID NO: 3021101 - DNA, 15 bp, Homo sapiens
ccagtgtgctgatgg

SEQ ID NO: 3021102 - DNA, 17 bp, Homo sapiens
ccagtgttagggaaggg

SEQ ID NO: 3021103 - DNA, 17 bp, Homo sapiens
ccagtgtttctgaatgt

SEQ ID NO: 3021104 - DNA, 13 bp, Homo sapiens
ccagttaattttt

SEQ ID NO: 3021105 - DNA, 20 bp, Homo sapiens
ccagttcagaaatttggcat

SEQ ID NO: 3021106 - DNA, 18 bp, Homo sapiens
ccagttcgcctggagccc

SEQ ID NO: 3021107 - DNA, 15 bp, Homo sapiens
ccagttgccatctgc

SEQ ID NO: 3021108 - DNA, 10 bp, Homo sapiens
ccagttgtgg

SEQ ID NO: 3021109 - DNA, 23 bp, Homo sapiens
ccagtttaagacaccaaatataa

SEQ ID NO: 3021110 - DNA, 13 bp, Homo sapiens
cccagccagccac

SEQ ID NO: 3021111 - DNA, 15 bp, Homo sapiens
cccagccagccaccc

SEQ ID NO: 3021112 - DNA, 21 bp, Homo sapiens
cccagccagccacccctgcca

SEQ ID NO: 3021113 - DNA, 21 bp, Homo sapiens
cccagccaggccccaggcagg

SEQ ID NO: 3021114 - DNA, 15 bp, Homo sapiens
cccagcccacagagc

SEQ ID NO: 3021115 - DNA, 17 bp, Homo sapiens
cccagcccacagagcct

SEQ ID NO: 3021116 - DNA, 19 bp, Homo sapiens
cccagcccacagagcctga

SEQ ID NO: 3021117 - DNA, 11 bp, Homo sapiens
cccagcccaga

SEQ ID NO: 3021118 - DNA, 13 bp, Homo sapiens
cccagcccagaga

SEQ ID NO: 3021119 - DNA, 14 bp, Homo sapiens
cccagcccagagac

SEQ ID NO: 3021120 - DNA, 14 bp, Homo sapiens
cccagcccagagcc

SEQ ID NO: 3021121 - DNA, 18 bp, Homo sapiens
cccagcccagctggtggg

SEQ ID NO: 3021122 - DNA, 13 bp, Homo sapiens
cccagcccccacc

SEQ ID NO: 3021123 - DNA, 18 bp, Homo sapiens
cccagcccgcggcctgga

SEQ ID NO: 3021124 - DNA, 14 bp, Homo sapiens
cccagccctcatcc

SEQ ID NO: 3021125 - DNA, 16 bp, Homo sapiens
cccagccctcatcccg

SEQ ID NO: 3021126 - DNA, 19 bp, Homo sapiens
cccagccctcatcccgagc

SEQ ID NO: 3021127 - DNA, 15 bp, Homo sapiens
cccagccctggcccc

SEQ ID NO: 3021128 - DNA, 18 bp, Homo sapiens
cccagccgcaggaaggca

SEQ ID NO: 3021129 - DNA, 19 bp, Homo sapiens
cccagcctcaatgtcactt

SEQ ID NO: 3021130 - DNA, 20 bp, Homo sapiens
cccagcctcaatgtcacttg

SEQ ID NO: 3021131 - DNA, 16 bp, Homo sapiens
cccagcctccctgaag

SEQ ID NO: 3021132 - DNA, 15 bp, Homo sapiens
cccagcctctcctcc

SEQ ID NO: 3021133 - DNA, 16 bp, Homo sapiens
cccagcctctcctcct

SEQ ID NO: 3021134 - DNA, 16 bp, Homo sapiens
cccagcgagccacagg

SEQ ID NO: 3021135 - DNA, 21 bp, Homo sapiens
cccagcgagccacaggaacgg

SEQ ID NO: 3021136 - DNA, 15 bp, Homo sapiens
cccagcgctctcctg

SEQ ID NO: 3021137 - DNA, 14 bp, Homo sapiens
cccagcggcctcag

SEQ ID NO: 3021138 - DNA, 15 bp, Homo sapiens
cccagcggcctcagg

SEQ ID NO: 3021139 - DNA, 17 bp, Homo sapiens
cccagctaagaacctgg

SEQ ID NO: 3021140 - DNA, 19 bp, Homo sapiens
cccagctaagaacctggaa

SEQ ID NO: 3021141 - DNA, 20 bp, Homo sapiens
cccagctaagaacctggaac

SEQ ID NO: 3021142 - DNA, 14 bp, Homo sapiens
cccagctacctcaa

SEQ ID NO: 3021143 - DNA, 20 bp, Homo sapiens
cccagctactggggaggctg

SEQ ID NO: 3021144 - DNA, 21 bp, Homo sapiens
cccagctactggggaggctga

SEQ ID NO: 3021145 - DNA, 22 bp, Homo sapiens
cccagctactggggaggctgag

SEQ ID NO: 3021146 - DNA, 19 bp, Homo sapiens
cccagctacttgggagcct

SEQ ID NO: 3021147 - DNA, 17 bp, Homo sapiens
cccagctatacctgtgc

SEQ ID NO: 3021148 - DNA, 19 bp, Homo sapiens
cccagctccaggcccaccg

SEQ ID NO: 3021149 - DNA, 13 bp, Homo sapiens
cccagctctccct

SEQ ID NO: 3021150 - DNA, 14 bp, Homo sapiens
cccagctctccctc

SEQ ID NO: 3021151 - DNA, 18 bp, Homo sapiens
cccagctctccctctggc

SEQ ID NO: 3021152 - DNA, 22 bp, Homo sapiens
cccagctctgaaaccagtgtta

SEQ ID NO: 3021153 - DNA, 18 bp, Homo sapiens
cccagctcttgctctctt

SEQ ID NO: 3021154 - DNA, 19 bp, Homo sapiens
cccagctcttgctctcttg

SEQ ID NO: 3021155 - DNA, 21 bp, Homo sapiens
cccagctgtgcccctccccca

SEQ ID NO: 3021156 - DNA, 22 bp, Homo sapiens
cccagctgtgcttatggtacca

SEQ ID NO: 3021157 - DNA, 18 bp, Homo sapiens
cccagctttaaaaagaaa

SEQ ID NO: 3021158 - DNA, 22 bp, Homo sapiens
cccaggaactcgcacctgtgct

SEQ ID NO: 3021159 - DNA, 13 bp, Homo sapiens
cccaggaagcagg

SEQ ID NO: 3021160 - DNA, 14 bp, Homo sapiens
cccaggaagcaggg

SEQ ID NO: 3021161 - DNA, 21 bp, Homo sapiens
cccaggaagcccactgcctcc

SEQ ID NO: 3021162 - DNA, 22 bp, Homo sapiens
cccaggaagcccactgcctcct

SEQ ID NO: 3021163 - DNA, 16 bp, Homo sapiens
cccaggaagggaggga

SEQ ID NO: 3021164 - DNA, 19 bp, Homo sapiens
cccaggaagggagggagct

SEQ ID NO: 3021165 - DNA, 23 bp, Homo sapiens
cccaggaatttgggaccctgctt

SEQ ID NO: 3021166 - DNA, 14 bp, Homo sapiens
cccaggaccagctc

SEQ ID NO: 3021167 - DNA, 16 bp, Homo sapiens
cccaggaccagctcag

SEQ ID NO: 3021168 - DNA, 17 bp, Homo sapiens
cccaggaccagctcagg

SEQ ID NO: 3021169 - DNA, 20 bp, Homo sapiens
cccaggaccagctcaggaca

SEQ ID NO: 3021170 - DNA, 16 bp, Homo sapiens
cccaggacccctgagt

SEQ ID NO: 3021171 - DNA, 11 bp, Homo sapiens
cccaggaccct

SEQ ID NO: 3021172 - DNA, 13 bp, Homo sapiens
cccaggaccctga

SEQ ID NO: 3021173 - DNA, 23 bp, Homo sapiens
cccaggaccctgaaggggccatg

SEQ ID NO: 3021174 - DNA, 17 bp, Homo sapiens
cccaggactcaccctcc

SEQ ID NO: 3021175 - DNA, 19 bp, Homo sapiens
cccaggactctgaccccag

SEQ ID NO: 3021176 - DNA, 15 bp, Homo sapiens
cccaggagagccagc

SEQ ID NO: 3021177 - DNA, 21 bp, Homo sapiens
cccaggagagccagccctccc

SEQ ID NO: 3021178 - DNA, 22 bp, Homo sapiens
cccaggagagccagccctccct

SEQ ID NO: 3021179 - DNA, 23 bp, Homo sapiens
cccaggagagccagccctccctg

SEQ ID NO: 3021180 - DNA, 21 bp, Homo sapiens
cccaggagctctgcgccaggc

SEQ ID NO: 3021181 - DNA, 18 bp, Homo sapiens
cccaggagtttgtgtgtc

SEQ ID NO: 3021182 - DNA, 23 bp, Homo sapiens
cccaggattgtgcaatagtcaga

SEQ ID NO: 3021183 - DNA, 20 bp, Homo sapiens
cccaggcaggtctgcaaggg

SEQ ID NO: 3021184 - DNA, 18 bp, Homo sapiens
cccaggccagcttcgagc

SEQ ID NO: 3021185 - DNA, 12 bp, Homo sapiens
cccaggccaggg

SEQ ID NO: 3021186 - DNA, 16 bp, Homo sapiens
cccaggccagggctgg

SEQ ID NO: 3021187 - DNA, 19 bp, Homo sapiens
cccaggccatgtggcctgc

SEQ ID NO: 3021188 - DNA, 22 bp, Homo sapiens
cccaggccatgtggcctgccca

SEQ ID NO: 3021189 - DNA, 13 bp, Homo sapiens
cccaggcccactc

SEQ ID NO: 3021190 - DNA, 16 bp, Homo sapiens
cccaggcccactcagg

SEQ ID NO: 3021191 - DNA, 15 bp, Homo sapiens
cccaggccctcccac

SEQ ID NO: 3021192 - DNA, 16 bp, Homo sapiens
cccaggccctcccacc

SEQ ID NO: 3021193 - DNA, 13 bp, Homo sapiens
cccaggccggagc

SEQ ID NO: 3021194 - DNA, 14 bp, Homo sapiens
cccaggccggagcc

SEQ ID NO: 3021195 - DNA, 15 bp, Homo sapiens
cccaggccggagccc

SEQ ID NO: 3021196 - DNA, 17 bp, Homo sapiens
cccaggccggagcccag

SEQ ID NO: 3021197 - DNA, 19 bp, Homo sapiens
cccaggccggagcccagat

SEQ ID NO: 3021198 - DNA, 14 bp, Homo sapiens
cccaggcctatgtt

SEQ ID NO: 3021199 - DNA, 21 bp, Homo sapiens
cccaggcctatgttgatccat

SEQ ID NO: 3021200 - DNA, 21 bp, Homo sapiens
cccaggcctctcggtgctcca

SEQ ID NO: 3021201 - DNA, 19 bp, Homo sapiens
cccaggcctgccctgctat

SEQ ID NO: 3021202 - DNA, 13 bp, Homo sapiens
cccaggcctggag

SEQ ID NO: 3021203 - DNA, 12 bp, Homo sapiens
cccaggcctggc

SEQ ID NO: 3021204 - DNA, 14 bp, Homo sapiens
cccaggcctggctc

SEQ ID NO: 3021205 - DNA, 15 bp, Homo sapiens
cccaggcctggctcc

SEQ ID NO: 3021206 - DNA, 20 bp, Homo sapiens
cccaggccttgctgactctc

SEQ ID NO: 3021207 - DNA, 15 bp, Homo sapiens
cccaggcgcctgcgc

SEQ ID NO: 3021208 - DNA, 18 bp, Homo sapiens
cccaggctagagtgcaat

SEQ ID NO: 3021209 - DNA, 21 bp, Homo sapiens
cccaggctgggaactcatctg

SEQ ID NO: 3021210 - DNA, 20 bp, Homo sapiens
cccagggacattgcagagtg

SEQ ID NO: 3021211 - DNA, 23 bp, Homo sapiens
cccagggagggtgagctggtgcc

SEQ ID NO: 3021212 - DNA, 13 bp, Homo sapiens
cccagggcccaga

SEQ ID NO: 3021213 - DNA, 16 bp, Homo sapiens
cccagggcccagagcc

SEQ ID NO: 3021214 - DNA, 20 bp, Homo sapiens
cccagggcccagagcccagc

SEQ ID NO: 3021215 - DNA, 13 bp, Homo sapiens
cccagggcctgag

SEQ ID NO: 3021216 - DNA, 15 bp, Homo sapiens
cccagggcctgagcc

SEQ ID NO: 3021217 - DNA, 14 bp, Homo sapiens
cccagggcctgcag

SEQ ID NO: 3021218 - DNA, 18 bp, Homo sapiens
cccagggctagtgaagtg

SEQ ID NO: 3021219 - DNA, 15 bp, Homo sapiens
cccaggggacgtggg

SEQ ID NO: 3021220 - DNA, 20 bp, Homo sapiens
cccaggggacgtgggccctg

SEQ ID NO: 3021221 - DNA, 16 bp, Homo sapiens
cccaggggaggcggca

SEQ ID NO: 3021222 - DNA, 23 bp, Homo sapiens
cccaggggaggcggcactccaac

SEQ ID NO: 3021223 - DNA, 16 bp, Homo sapiens
cccagggggcctggag

SEQ ID NO: 3021224 - DNA, 21 bp, Homo sapiens
cccagggtctagccgctgccc

SEQ ID NO: 3021225 - DNA, 12 bp, Homo sapiens
cccagggtgcag

SEQ ID NO: 3021226 - DNA, 20 bp, Homo sapiens
cccagggtggagtgcagtgg

SEQ ID NO: 3021227 - DNA, 20 bp, Homo sapiens
cccaggtagctgggattaca

SEQ ID NO: 3021228 - DNA, 20 bp, Homo sapiens
cccaggtgcagccagaggca

SEQ ID NO: 3021229 - DNA, 23 bp, Homo sapiens
cccaggtggctgacccagtccct

SEQ ID NO: 3021230 - DNA, 16 bp, Homo sapiens
cccagtattactgctg

SEQ ID NO: 3021231 - DNA, 20 bp, Homo sapiens
cccagtattactgctgctgt

SEQ ID NO: 3021232 - DNA, 22 bp, Homo sapiens
cccagtattactgctgctgtgc

SEQ ID NO: 3021233 - DNA, 21 bp, Homo sapiens
cccagtccccaacctgcactc

SEQ ID NO: 3021234 - DNA, 18 bp, Homo sapiens
cccagtcctctgcctcca

SEQ ID NO: 3021235 - DNA, 14 bp, Homo sapiens
cccagtccttccac

SEQ ID NO: 3021236 - DNA, 17 bp, Homo sapiens
cccagtccttccacctc

SEQ ID NO: 3021237 - DNA, 14 bp, Homo sapiens
cccagtgaaataaa

SEQ ID NO: 3021238 - DNA, 11 bp, Homo sapiens
cccagtgcaga

SEQ ID NO: 3021239 - DNA, 17 bp, Homo sapiens
cccagtgcagaatgtaa

SEQ ID NO: 3021240 - DNA, 14 bp, Homo sapiens
cccagtgcccccac

SEQ ID NO: 3021241 - DNA, 11 bp, Homo sapiens
cccagtgcctt

SEQ ID NO: 3021242 - DNA, 12 bp, Homo sapiens
cctctctgtctt

SEQ ID NO: 3021243 - DNA, 23 bp, Homo sapiens
cctctctgtctttttccttcctg

SEQ ID NO: 3021244 - DNA, 19 bp, Homo sapiens
cctctcttccgggagctgg

SEQ ID NO: 3021245 - DNA, 16 bp, Homo sapiens
cctctcttttcctctc

SEQ ID NO: 3021246 - DNA, 18 bp, Homo sapiens
cctctcttttcctctctg

SEQ ID NO: 3021247 - DNA, 19 bp, Homo sapiens
cctctcttttcctctctgt

SEQ ID NO: 3021248 - DNA, 12 bp, Homo sapiens
cctctgaaacag

SEQ ID NO: 3021249 - DNA, 13 bp, Homo sapiens
cctctgaaacagc

SEQ ID NO: 3021250 - DNA, 19 bp, Homo sapiens
cctctgaaacagctgcctt

SEQ ID NO: 3021251 - DNA, 21 bp, Homo sapiens
cctctgaaacagctgccttag

SEQ ID NO: 3021252 - DNA, 19 bp, Homo sapiens
cctctgaaagttgtacatg

SEQ ID NO: 3021253 - DNA, 18 bp, Homo sapiens
cctctgacagcagcctgt

SEQ ID NO: 3021254 - DNA, 19 bp, Homo sapiens
cctctgacagcagcctgtg

SEQ ID NO: 3021255 - DNA, 20 bp, Homo sapiens
cctctgacagcagcctgtga

SEQ ID NO: 3021256 - DNA, 22 bp, Homo sapiens
cctctgacttaagctgcctcaa

SEQ ID NO: 3021257 - DNA, 11 bp, Homo sapiens
cctctgccacc

SEQ ID NO: 3021258 - DNA, 15 bp, Homo sapiens
cctctgccacctccc

SEQ ID NO: 3021259 - DNA, 19 bp, Homo sapiens
cctctgccccatcctccag

SEQ ID NO: 3021260 - DNA, 22 bp, Homo sapiens
cctctgccccatcctccagcag

SEQ ID NO: 3021261 - DNA, 22 bp, Homo sapiens
cctctgccgctgcttccaggct

SEQ ID NO: 3021262 - DNA, 13 bp, Homo sapiens
cctctgcctcaat

SEQ ID NO: 3021263 - DNA, 16 bp, Homo sapiens
cctctgcctcatcctc

SEQ ID NO: 3021264 - DNA, 10 bp, Homo sapiens
cctctgcctg

SEQ ID NO: 3021265 - DNA, 12 bp, Homo sapiens
cctctgcctggg

SEQ ID NO: 3021266 - DNA, 12 bp, Homo sapiens
cctctgctgctg

SEQ ID NO: 3021267 - DNA, 11 bp, Homo sapiens
cctctgctggt

SEQ ID NO: 3021268 - DNA, 13 bp, Homo sapiens
cctctgcttccca

SEQ ID NO: 3021269 - DNA, 12 bp, Homo sapiens
cctctgcttctc

SEQ ID NO: 3021270 - DNA, 14 bp, Homo sapiens
cctctggaagtggc

SEQ ID NO: 3021271 - DNA, 14 bp, Homo sapiens
cctctggagtggcc

SEQ ID NO: 3021272 - DNA, 21 bp, Homo sapiens
cctctggagtggccactaagc

SEQ ID NO: 3021273 - DNA, 13 bp, Homo sapiens
cctctggccctgc

SEQ ID NO: 3021274 - DNA, 22 bp, Homo sapiens
cctctggctggctaactggaag

SEQ ID NO: 3021275 - DNA, 22 bp, Homo sapiens
cctctggcttgggcagggtctg

SEQ ID NO: 3021276 - DNA, 17 bp, Homo sapiens
cctctgggtcagtggtc

SEQ ID NO: 3021277 - DNA, 13 bp, Homo sapiens
cctctgtcaccca

SEQ ID NO: 3021278 - DNA, 18 bp, Homo sapiens
cctctgtcagtcacagcc

SEQ ID NO: 3021279 - DNA, 17 bp, Homo sapiens
cctctgtccccaggcct

SEQ ID NO: 3021280 - DNA, 18 bp, Homo sapiens
cctctgtccccaggcctg

SEQ ID NO: 3021281 - DNA, 23 bp, Homo sapiens
cctctgtccgcctttacaaggga

SEQ ID NO: 3021282 - DNA, 15 bp, Homo sapiens
cctctgtctagcatg

SEQ ID NO: 3021283 - DNA, 16 bp, Homo sapiens
cctctgtctagcatgc

SEQ ID NO: 3021284 - DNA, 15 bp, Homo sapiens
cctctgtcttctgga

SEQ ID NO: 3021285 - DNA, 21 bp, Homo sapiens
cctctgtgaccaatgtcttga

SEQ ID NO: 3021286 - DNA, 11 bp, Homo sapiens
cctctgttctt

SEQ ID NO: 3021287 - DNA, 15 bp, Homo sapiens
cctcttcctgcctag

SEQ ID NO: 3021288 - DNA, 15 bp, Homo sapiens
cctcttctggctcaa

SEQ ID NO: 3021289 - DNA, 23 bp, Homo sapiens
cctcttctgtattttttttttcc

SEQ ID NO: 3021290 - DNA, 15 bp, Homo sapiens
cctcttgcaggctga

SEQ ID NO: 3021291 - DNA, 23 bp, Homo sapiens
cctcttggggagtttagggtggg

SEQ ID NO: 3021292 - DNA, 12 bp, Homo sapiens
cctcttgtaaat

SEQ ID NO: 3021293 - DNA, 20 bp, Homo sapiens
cctcttgtaaataaagccct

SEQ ID NO: 3021294 - DNA, 16 bp, Homo sapiens
cctcttgtgctcagtc

SEQ ID NO: 3021295 - DNA, 22 bp, Homo sapiens
cctctttcccctcctttgtctt

SEQ ID NO: 3021296 - DNA, 16 bp, Homo sapiens
cctctttctagcctgg

SEQ ID NO: 3021297 - DNA, 23 bp, Homo sapiens
cctctttctagcctggggcttga

SEQ ID NO: 3021298 - DNA, 14 bp, Homo sapiens
cctctttcttgttt

SEQ ID NO: 3021299 - DNA, 13 bp, Homo sapiens
cctctttgctttg

SEQ ID NO: 3021300 - DNA, 14 bp, Homo sapiens
cctctttgctttgc

SEQ ID NO: 3021301 - DNA, 17 bp, Homo sapiens
cctctttgctttgcttt

SEQ ID NO: 3021302 - DNA, 21 bp, Homo sapiens
cctctttgctttgctttctgc

SEQ ID NO: 3021303 - DNA, 18 bp, Homo sapiens
cctctttgggcagtgcca

SEQ ID NO: 3021304 - DNA, 16 bp, Homo sapiens
cctgaaacactgcttc

SEQ ID NO: 3021305 - DNA, 13 bp, Homo sapiens
cctgaaagcctca

SEQ ID NO: 3021306 - DNA, 22 bp, Homo sapiens
cctgaaagggcccttcccctcc

SEQ ID NO: 3021307 - DNA, 21 bp, Homo sapiens
cctgaaagttggggcccagtc

SEQ ID NO: 3021308 - DNA, 13 bp, Homo sapiens
cctgaaattccaa

SEQ ID NO: 3021309 - DNA, 16 bp, Homo sapiens
cctgaaattccaaagt

SEQ ID NO: 3021310 - DNA, 18 bp, Homo sapiens
cctgaaattccaaagtct

SEQ ID NO: 3021311 - DNA, 12 bp, Homo sapiens
cctgaacagatg

SEQ ID NO: 3021312 - DNA, 13 bp, Homo sapiens
cctgaacagatgt

SEQ ID NO: 3021313 - DNA, 19 bp, Homo sapiens
cctgaaccccagaggcaga

SEQ ID NO: 3021314 - DNA, 13 bp, Homo sapiens
cctgaacctagga

SEQ ID NO: 3021315 - DNA, 18 bp, Homo sapiens
cctgaaccttgagcaaat

SEQ ID NO: 3021316 - DNA, 14 bp, Homo sapiens
cctgaactctgcaa

SEQ ID NO: 3021317 - DNA, 16 bp, Homo sapiens
cctgaactctgcaact

SEQ ID NO: 3021318 - DNA, 16 bp, Homo sapiens
cctgaactgaggcctt

SEQ ID NO: 3021319 - DNA, 17 bp, Homo sapiens
cctgaagatgggagcct

SEQ ID NO: 3021320 - DNA, 21 bp, Homo sapiens
cctgaagccaggccatggcta

SEQ ID NO: 3021321 - DNA, 16 bp, Homo sapiens
cctgaagggaaggcaa

SEQ ID NO: 3021322 - DNA, 22 bp, Homo sapiens
cctgaagggaaggcaaaggcag

SEQ ID NO: 3021323 - DNA, 20 bp, Homo sapiens
cctgaaggggccatgatggc

SEQ ID NO: 3021324 - DNA, 14 bp, Homo sapiens
cctgaaggggcgtc

SEQ ID NO: 3021325 - DNA, 16 bp, Homo sapiens
cctgaaggggcgtctg

SEQ ID NO: 3021326 - DNA, 22 bp, Homo sapiens
cctgaaggggcgtctgttcccc

SEQ ID NO: 3021327 - DNA, 20 bp, Homo sapiens
cctgaaggtcccctggcagt

SEQ ID NO: 3021328 - DNA, 13 bp, Homo sapiens
cctgaataaacca

SEQ ID NO: 3021329 - DNA, 16 bp, Homo sapiens
cctgaataaaccaaga

SEQ ID NO: 3021330 - DNA, 15 bp, Homo sapiens
cctgaatccagcatt

SEQ ID NO: 3021331 - DNA, 20 bp, Homo sapiens
cctgaatggctttgtcttga

SEQ ID NO: 3021332 - DNA, 14 bp, Homo sapiens
cctgaatttcttct

SEQ ID NO: 3021333 - DNA, 16 bp, Homo sapiens
cctgaatttgtaagca

SEQ ID NO: 3021334 - DNA, 14 bp, Homo sapiens
cctgaatttgtata

SEQ ID NO: 3021335 - DNA, 22 bp, Homo sapiens
cctgacaactcattttcatatt

SEQ ID NO: 3021336 - DNA, 13 bp, Homo sapiens
cctgacactccct

SEQ ID NO: 3021337 - DNA, 16 bp, Homo sapiens
cctgacagacgaggag

SEQ ID NO: 3021338 - DNA, 12 bp, Homo sapiens
cctgacagcact

SEQ ID NO: 3021339 - DNA, 13 bp, Homo sapiens
cctgacattgtct

SEQ ID NO: 3021340 - DNA, 19 bp, Homo sapiens
cctgaccaacatggagaaa

SEQ ID NO: 3021341 - DNA, 18 bp, Homo sapiens
cctgaccctcatctttct

SEQ ID NO: 3021342 - DNA, 19 bp, Homo sapiens
cctgaccctcccggcctgg

SEQ ID NO: 3021343 - DNA, 19 bp, Homo sapiens
cctgaccctgtatatagcc

SEQ ID NO: 3021344 - DNA, 13 bp, Homo sapiens
cctgaccgctgcc

SEQ ID NO: 3021345 - DNA, 21 bp, Homo sapiens
cctgacctcatgatccaccca

SEQ ID NO: 3021346 - DNA, 12 bp, Homo sapiens
cctgacctccag

SEQ ID NO: 3021347 - DNA, 17 bp, Homo sapiens
cctgacctccagtcctg

SEQ ID NO: 3021348 - DNA, 18 bp, Homo sapiens
cctgacctccagtcctgc

SEQ ID NO: 3021349 - DNA, 21 bp, Homo sapiens
cctgacctccagtcctgctgg

SEQ ID NO: 3021350 - DNA, 14 bp, Homo sapiens
cctgacctgtccag

SEQ ID NO: 3021351 - DNA, 20 bp, Homo sapiens
cctgacctgtgagcccagct

SEQ ID NO: 3021352 - DNA, 19 bp, Homo sapiens
cctgactaggttctgtaga

SEQ ID NO: 3021353 - DNA, 15 bp, Homo sapiens
cctgactgggctggg

SEQ ID NO: 3021354 - DNA, 12 bp, Homo sapiens
cctgactggtgc

SEQ ID NO: 3021355 - DNA, 14 bp, Homo sapiens
cctgacttgcttta

SEQ ID NO: 3021356 - DNA, 23 bp, Homo sapiens
cctgagaaacgtccatctctctc

SEQ ID NO: 3021357 - DNA, 15 bp, Homo sapiens
cctgagaaagccctg

SEQ ID NO: 3021358 - DNA, 23 bp, Homo sapiens
cctgagaatttaatttttaaaag

SEQ ID NO: 3021359 - DNA, 19 bp, Homo sapiens
cctgagacctctagagaaa

SEQ ID NO: 3021360 - DNA, 23 bp, Homo sapiens
cctgagagagaatagagctgcca

SEQ ID NO: 3021361 - DNA, 16 bp, Homo sapiens
cctgagcagtccctgc

SEQ ID NO: 3021362 - DNA, 18 bp, Homo sapiens
cctgagcagtccctgctt

SEQ ID NO: 3021363 - DNA, 17 bp, Homo sapiens
cctgagcattcaggcag

SEQ ID NO: 3021364 - DNA, 23 bp, Homo sapiens
cctgagcattcaggcagcactga

SEQ ID NO: 3021365 - DNA, 17 bp, Homo sapiens
cctgagcccctcagaca

SEQ ID NO: 3021366 - DNA, 16 bp, Homo sapiens
cctgagcccgcagccc

SEQ ID NO: 3021367 - DNA, 20 bp, Homo sapiens
cctgagcccgcagcccagac

SEQ ID NO: 3021368 - DNA, 14 bp, Homo sapiens
cctgagcctggcca

SEQ ID NO: 3021369 - DNA, 18 bp, Homo sapiens
cctgagctaggaagagtc

SEQ ID NO: 3021370 - DNA, 17 bp, Homo sapiens
cctgagctgaccagccg

SEQ ID NO: 3021371 - DNA, 15 bp, Homo sapiens
cctgagctgaggcag

SEQ ID NO: 3021372 - DNA, 16 bp, Homo sapiens
cctgagctgaggcagc

SEQ ID NO: 3021373 - DNA, 20 bp, Homo sapiens
cctgaggacagctgtcctct

SEQ ID NO: 3021374 - DNA, 21 bp, Homo sapiens
cctgaggcaggagaatcgctt

SEQ ID NO: 3021375 - DNA, 20 bp, Homo sapiens
cctgtagatgcagaaaaaga

SEQ ID NO: 3021376 - DNA, 20 bp, Homo sapiens
cctgtagccccagtgacagc

SEQ ID NO: 3021377 - DNA, 22 bp, Homo sapiens
cctgtagccccagtgacagcta

SEQ ID NO: 3021378 - DNA, 18 bp, Homo sapiens
cctgtaggatttttttct

SEQ ID NO: 3021379 - DNA, 15 bp, Homo sapiens
cctgtagtctcagct

SEQ ID NO: 3021380 - DNA, 21 bp, Homo sapiens
cctgtagttgcgtggactctg

SEQ ID NO: 3021381 - DNA, 13 bp, Homo sapiens
cctgtatatagcc

SEQ ID NO: 3021382 - DNA, 23 bp, Homo sapiens
cctgtatatagcccagccaggcc

SEQ ID NO: 3021383 - DNA, 21 bp, Homo sapiens
cctgtatctttctatgctgct

SEQ ID NO: 3021384 - DNA, 14 bp, Homo sapiens
cctgtatgtctgtc

SEQ ID NO: 3021385 - DNA, 18 bp, Homo sapiens
cctgtatgtctgtcattg

SEQ ID NO: 3021386 - DNA, 18 bp, Homo sapiens
cctgtatttaaaaataga

SEQ ID NO: 3021387 - DNA, 23 bp, Homo sapiens
cctgtcaaacaaagccagaagct

SEQ ID NO: 3021388 - DNA, 16 bp, Homo sapiens
cctgtccacacccagc

SEQ ID NO: 3021389 - DNA, 12 bp, Homo sapiens
cctgtccagccc

SEQ ID NO: 3021390 - DNA, 13 bp, Homo sapiens
cctgtccagctcc

SEQ ID NO: 3021391 - DNA, 19 bp, Homo sapiens
cctgtccagctccaacctg

SEQ ID NO: 3021392 - DNA, 22 bp, Homo sapiens
cctgtcccaggactcaccctcc

SEQ ID NO: 3021393 - DNA, 16 bp, Homo sapiens
cctgtccccatctgtc

SEQ ID NO: 3021394 - DNA, 22 bp, Homo sapiens
cctgtccccgccttccctcact

SEQ ID NO: 3021395 - DNA, 13 bp, Homo sapiens
cctgtcccctcac

SEQ ID NO: 3021396 - DNA, 15 bp, Homo sapiens
cctgtcccctcacag

SEQ ID NO: 3021397 - DNA, 16 bp, Homo sapiens
cctgtcccctcacaga

SEQ ID NO: 3021398 - DNA, 13 bp, Homo sapiens
cctgtcccctgga

SEQ ID NO: 3021399 - DNA, 12 bp, Homo sapiens
cctgtcctcacc

SEQ ID NO: 3021400 - DNA, 15 bp, Homo sapiens
cctgtcctcaccgtc

SEQ ID NO: 3021401 - DNA, 13 bp, Homo sapiens
cctgtcctccaac

SEQ ID NO: 3021402 - DNA, 22 bp, Homo sapiens
cctgtcctcccagctcctcact

SEQ ID NO: 3021403 - DNA, 18 bp, Homo sapiens
cctgtcctgccatgcaag

SEQ ID NO: 3021404 - DNA, 13 bp, Homo sapiens
cctgtcctgtgct

SEQ ID NO: 3021405 - DNA, 18 bp, Homo sapiens
cctgtccttactcagagc

SEQ ID NO: 3021406 - DNA, 20 bp, Homo sapiens
cctgtccttactcagagctg

SEQ ID NO: 3021407 - DNA, 21 bp, Homo sapiens
cctgtccttactcagagctgc

SEQ ID NO: 3021408 - DNA, 19 bp, Homo sapiens
cctgtcggtggctgccttt

SEQ ID NO: 3021409 - DNA, 11 bp, Homo sapiens
cctgtctaaag

SEQ ID NO: 3021410 - DNA, 23 bp, Homo sapiens
cctgtctaaagccttaactaaga

SEQ ID NO: 3021411 - DNA, 14 bp, Homo sapiens
cctgtctagagagg

SEQ ID NO: 3021412 - DNA, 16 bp, Homo sapiens
cctgtctagagaggga

SEQ ID NO: 3021413 - DNA, 21 bp, Homo sapiens
cctgtctccctcctctgcccg

SEQ ID NO: 3021414 - DNA, 14 bp, Homo sapiens
cctgtctcggggct

SEQ ID NO: 3021415 - DNA, 13 bp, Homo sapiens
cctgtctgtccaa

SEQ ID NO: 3021416 - DNA, 15 bp, Homo sapiens
cctgtctgtccaacc

SEQ ID NO: 3021417 - DNA, 21 bp, Homo sapiens
cctgtctgtccaacccctccc

SEQ ID NO: 3021418 - DNA, 11 bp, Homo sapiens
cctgtctgtga

SEQ ID NO: 3021419 - DNA, 13 bp, Homo sapiens
cctgtctgtgacc

SEQ ID NO: 3021420 - DNA, 22 bp, Homo sapiens
cctgtcttcggccgagctggtt

SEQ ID NO: 3021421 - DNA, 21 bp, Homo sapiens
cctgtcttgctcctggggaga

SEQ ID NO: 3021422 - DNA, 20 bp, Homo sapiens
cctgtgaccctctcactttg

SEQ ID NO: 3021423 - DNA, 17 bp, Homo sapiens
cctgtgaccttgggacc

SEQ ID NO: 3021424 - DNA, 17 bp, Homo sapiens
cctgtgaggggcccctg

SEQ ID NO: 3021425 - DNA, 18 bp, Homo sapiens
cctgtgaggggcccctgg

SEQ ID NO: 3021426 - DNA, 19 bp, Homo sapiens
cctgtgaggggcccctggc

SEQ ID NO: 3021427 - DNA, 19 bp, Homo sapiens
cctgtgatcttatttttct

SEQ ID NO: 3021428 - DNA, 21 bp, Homo sapiens
cctgtgatcttatttttctaa

SEQ ID NO: 3021429 - DNA, 17 bp, Homo sapiens
cctgtgcaaaaaaatta

SEQ ID NO: 3021430 - DNA, 21 bp, Homo sapiens
cctgtgcagccgctgagcgag

SEQ ID NO: 3021431 - DNA, 17 bp, Homo sapiens
cctgtgcatgtatgtct

SEQ ID NO: 3021432 - DNA, 17 bp, Homo sapiens
cctgtgcccatcatctc

SEQ ID NO: 3021433 - DNA, 15 bp, Homo sapiens
cctgtgccgcactct

SEQ ID NO: 3021434 - DNA, 17 bp, Homo sapiens
cctgtgccgcactctgg

SEQ ID NO: 3021435 - DNA, 19 bp, Homo sapiens
cctgtgccgcactctggcg

SEQ ID NO: 3021436 - DNA, 13 bp, Homo sapiens
cctgtgcctccct

SEQ ID NO: 3021437 - DNA, 15 bp, Homo sapiens
cctgtgcctccctct

SEQ ID NO: 3021438 - DNA, 16 bp, Homo sapiens
cctgtgcctctgtcct

SEQ ID NO: 3021439 - DNA, 19 bp, Homo sapiens
cctgtgcgttcccttcagt

SEQ ID NO: 3021440 - DNA, 14 bp, Homo sapiens
cctgtgctacagag

SEQ ID NO: 3021441 - DNA, 17 bp, Homo sapiens
cctgtggagtccagctc

SEQ ID NO: 3021442 - DNA, 20 bp, Homo sapiens
cctgtggatgagccctcaga

SEQ ID NO: 3021443 - DNA, 14 bp, Homo sapiens
cctgtggcagctgc

SEQ ID NO: 3021444 - DNA, 15 bp, Homo sapiens
cctgtggcagctgcc

SEQ ID NO: 3021445 - DNA, 18 bp, Homo sapiens
cctgtggcagctgcccct

SEQ ID NO: 3021446 - DNA, 22 bp, Homo sapiens
cctgtggccctgtcctgccatg

SEQ ID NO: 3021447 - DNA, 20 bp, Homo sapiens
cctgtggcggtgcctgggtg

SEQ ID NO: 3021448 - DNA, 18 bp, Homo sapiens
cctgtggctccctctctc

SEQ ID NO: 3021449 - DNA, 20 bp, Homo sapiens
cctgtggctccctctctcct

SEQ ID NO: 3021450 - DNA, 22 bp, Homo sapiens
cctgtggctccctctctcctgg

SEQ ID NO: 3021451 - DNA, 21 bp, Homo sapiens
cctgtggggtcaacccttctg

SEQ ID NO: 3021452 - DNA, 16 bp, Homo sapiens
cctgtggtgatgtgcc

SEQ ID NO: 3021453 - DNA, 21 bp, Homo sapiens
cctgtggtggcctggtgcaca

SEQ ID NO: 3021454 - DNA, 14 bp, Homo sapiens
cctgtggtggctcc

SEQ ID NO: 3021455 - DNA, 16 bp, Homo sapiens
cctgtggtggctcccc

SEQ ID NO: 3021456 - DNA, 22 bp, Homo sapiens
cctgtggtggctccccctctgc

SEQ ID NO: 3021457 - DNA, 23 bp, Homo sapiens
cctgtgtagtagtgcatagaatt

SEQ ID NO: 3021458 - DNA, 21 bp, Homo sapiens
cctgtgtcaatccagatggtg

SEQ ID NO: 3021459 - DNA, 22 bp, Homo sapiens
cctgtgtccccgatgctgacct

SEQ ID NO: 3021460 - DNA, 23 bp, Homo sapiens
cctgtgtcttctccaccacgctg

SEQ ID NO: 3021461 - DNA, 18 bp, Homo sapiens
cctgtgtgattgacagct

SEQ ID NO: 3021462 - DNA, 19 bp, Homo sapiens
cctgtgtgattgacagctt

SEQ ID NO: 3021463 - DNA, 12 bp, Homo sapiens
cctgtgtgcagg

SEQ ID NO: 3021464 - DNA, 20 bp, Homo sapiens
cctgtgtgtccaaaactgcc

SEQ ID NO: 3021465 - DNA, 15 bp, Homo sapiens
cctgtgttccagccc

SEQ ID NO: 3021466 - DNA, 22 bp, Homo sapiens
cctgttagctaaaagaggcctg

SEQ ID NO: 3021467 - DNA, 23 bp, Homo sapiens
cctgttagctaaaagaggcctgt

SEQ ID NO: 3021468 - DNA, 23 bp, Homo sapiens
cctgttagctcctcactgtggta

SEQ ID NO: 3021469 - DNA, 21 bp, Homo sapiens
cctgttaggccaactgcctcc

SEQ ID NO: 3021470 - DNA, 21 bp, Homo sapiens
cctgttcacagaaaaagcatg

SEQ ID NO: 3021471 - DNA, 17 bp, Homo sapiens
cctgttcagttacagaa

SEQ ID NO: 3021472 - DNA, 19 bp, Homo sapiens
cctgttcagttacagaaag

SEQ ID NO: 3021473 - DNA, 16 bp, Homo sapiens
cctgttccccagagaa

SEQ ID NO: 3021474 - DNA, 18 bp, Homo sapiens
cctgttcggttccagaca

SEQ ID NO: 3021475 - DNA, 20 bp, Homo sapiens
cctgttcggttccagacact

SEQ ID NO: 3021476 - DNA, 18 bp, Homo sapiens
cctgttctcgttgcccta

SEQ ID NO: 3021477 - DNA, 20 bp, Homo sapiens
cctgttctcgttgccctaat

SEQ ID NO: 3021478 - DNA, 21 bp, Homo sapiens
cctgttctgtagctttctgga

SEQ ID NO: 3021479 - DNA, 17 bp, Homo sapiens
cctgttcttgaggtctc

SEQ ID NO: 3021480 - DNA, 23 bp, Homo sapiens
cctgttcttgaggtctcttttct

SEQ ID NO: 3021481 - DNA, 17 bp, Homo sapiens
cctgttgacacaggtct

SEQ ID NO: 3021482 - DNA, 22 bp, Homo sapiens
cctgttgacacaggtctttcct

SEQ ID NO: 3021483 - DNA, 17 bp, Homo sapiens
cctgttgagcatcacag

SEQ ID NO: 3021484 - DNA, 18 bp, Homo sapiens
cctgttggctgctgccac

SEQ ID NO: 3021485 - DNA, 13 bp, Homo sapiens
cctgttgtgccac

SEQ ID NO: 3021486 - DNA, 20 bp, Homo sapiens
cctgtttagttgcttgctaa

SEQ ID NO: 3021487 - DNA, 18 bp, Homo sapiens
cctgtttcctgctgcttt

SEQ ID NO: 3021488 - DNA, 15 bp, Homo sapiens
cctgtttctgaaaag

SEQ ID NO: 3021489 - DNA, 16 bp, Homo sapiens
cctgtttctgaaaaga

SEQ ID NO: 3021490 - DNA, 13 bp, Homo sapiens
cctgtttggattt

SEQ ID NO: 3021491 - DNA, 19 bp, Homo sapiens
cctgtttggggagcaagtg

SEQ ID NO: 3021492 - DNA, 13 bp, Homo sapiens
cctgttttctaaa

SEQ ID NO: 3021493 - DNA, 12 bp, Homo sapiens
ccttaaaaatgc

SEQ ID NO: 3021494 - DNA, 14 bp, Homo sapiens
ccttaaaaatgcac

SEQ ID NO: 3021495 - DNA, 15 bp, Homo sapiens
ccttaactaagactc

SEQ ID NO: 3021496 - DNA, 22 bp, Homo sapiens
ccttaactaagactcccgcccc

SEQ ID NO: 3021497 - DNA, 16 bp, Homo sapiens
ccttaagatttttctt

SEQ ID NO: 3021498 - DNA, 18 bp, Homo sapiens
ccttaagatttttctttt

SEQ ID NO: 3021499 - DNA, 16 bp, Homo sapiens
ccttaaggctcttttg

SEQ ID NO: 3021500 - DNA, 18 bp, Homo sapiens
ccttaaggctcttttgta

SEQ ID NO: 3021501 - DNA, 22 bp, Homo sapiens
ccttaatgtatggctcatttgc

SEQ ID NO: 3021502 - DNA, 19 bp, Homo sapiens
ccttaatgtcaccatgctt

SEQ ID NO: 3021503 - DNA, 20 bp, Homo sapiens
ccttaatttaactttccagt

SEQ ID NO: 3021504 - DNA, 13 bp, Homo sapiens
ccttacagttatc

SEQ ID NO: 3021505 - DNA, 16 bp, Homo sapiens
ccttacattaaaaagc

SEQ ID NO: 3021506 - DNA, 11 bp, Homo sapiens
cgattagactg

SEQ ID NO: 3021507 - DNA, 18 bp, Homo sapiens
cgattagactggacagct

SEQ ID NO: 3021508 - DNA, 15 bp, Homo sapiens
cgattctcctgcctc

SEQ ID NO: 3021509 - DNA, 18 bp, Homo sapiens
cgattctcctgcctcagc

SEQ ID NO: 3021510 - DNA, 19 bp, Homo sapiens
cgattgacctgtcctcttt

SEQ ID NO: 3021511 - DNA, 14 bp, Homo sapiens
cgatttaattctct

SEQ ID NO: 3021512 - DNA, 15 bp, Homo sapiens
cgattttatctgtta

SEQ ID NO: 3021513 - DNA, 13 bp, Homo sapiens
cgcaagccacagc

SEQ ID NO: 3021514 - DNA, 19 bp, Homo sapiens
cgcaaggaaggacttaccc

SEQ ID NO: 3021515 - DNA, 15 bp, Homo sapiens
cgcaagggcctggac

SEQ ID NO: 3021516 - DNA, 17 bp, Homo sapiens
cgcacaccgccagcagc

SEQ ID NO: 3021517 - DNA, 20 bp, Homo sapiens
cgcaccactgcactccagcc

SEQ ID NO: 3021518 - DNA, 16 bp, Homo sapiens
cgcacctcccatccta

SEQ ID NO: 3021519 - DNA, 21 bp, Homo sapiens
cgcacctgaccgctgcccagg

SEQ ID NO: 3021520 - DNA, 14 bp, Homo sapiens
cgcacctgcctcag

SEQ ID NO: 3021521 - DNA, 19 bp, Homo sapiens
cgcacctgtagtcccagct

SEQ ID NO: 3021522 - DNA, 13 bp, Homo sapiens
cgcaccttcctcc

SEQ ID NO: 3021523 - DNA, 14 bp, Homo sapiens
cgcaccttcctcct

SEQ ID NO: 3021524 - DNA, 16 bp, Homo sapiens
cgcaccttcctcctcc

SEQ ID NO: 3021525 - DNA, 15 bp, Homo sapiens
cgcaccttgctgcag

SEQ ID NO: 3021526 - DNA, 13 bp, Homo sapiens
cgcacgcctctcc

SEQ ID NO: 3021527 - DNA, 13 bp, Homo sapiens
cgcactgtcccag

SEQ ID NO: 3021528 - DNA, 17 bp, Homo sapiens
cgcactgtgacccccag

SEQ ID NO: 3021529 - DNA, 22 bp, Homo sapiens
cgcacttgcagaggagcccagt

SEQ ID NO: 3021530 - DNA, 18 bp, Homo sapiens
cgcagactgcttggccag

SEQ ID NO: 3021531 - DNA, 20 bp, Homo sapiens
cgcagactgcttggccagat

SEQ ID NO: 3021532 - DNA, 11 bp, Homo sapiens
cgcagagactg

SEQ ID NO: 3021533 - DNA, 13 bp, Homo sapiens
cgcagaggcagaa

SEQ ID NO: 3021534 - DNA, 17 bp, Homo sapiens
cgcagatgtgcagcaga

SEQ ID NO: 3021535 - DNA, 18 bp, Homo sapiens
cgcagatgtgcagcagat

SEQ ID NO: 3021536 - DNA, 20 bp, Homo sapiens
cgcagatgtgcagcagattg

SEQ ID NO: 3021537 - DNA, 23 bp, Homo sapiens
cgcagccctggcagggggcatgc

SEQ ID NO: 3021538 - DNA, 18 bp, Homo sapiens
cgcagcggcgtcagactt

SEQ ID NO: 3021539 - DNA, 22 bp, Homo sapiens
cgcagcggcgtcagacttttct

SEQ ID NO: 3021540 - DNA, 20 bp, Homo sapiens
cgcagcggtgggaaggaaag

SEQ ID NO: 3021541 - DNA, 11 bp, Homo sapiens
cgcagctgctg

SEQ ID NO: 3021542 - DNA, 13 bp, Homo sapiens
cgcagctgctgcc

SEQ ID NO: 3021543 - DNA, 15 bp, Homo sapiens
cgcagctgctgccac

SEQ ID NO: 3021544 - DNA, 21 bp, Homo sapiens
cgcagctgctgccactctgct

SEQ ID NO: 3021545 - DNA, 13 bp, Homo sapiens
cgcaggaaggcag

SEQ ID NO: 3021546 - DNA, 18 bp, Homo sapiens
cgcaggagcacacccagc

SEQ ID NO: 3021547 - DNA, 23 bp, Homo sapiens
cgcaggagcacacccagccccca

SEQ ID NO: 3021548 - DNA, 21 bp, Homo sapiens
cgcaggccctgtccagccccc

SEQ ID NO: 3021549 - DNA, 18 bp, Homo sapiens
cgcaggcctgccttctca

SEQ ID NO: 3021550 - DNA, 17 bp, Homo sapiens
cgcaggcggccagggcg

SEQ ID NO: 3021551 - DNA, 22 bp, Homo sapiens
cgcagggtggtggtattctgtc

SEQ ID NO: 3021552 - DNA, 21 bp, Homo sapiens
cgcagtggggtcaagctgagc

SEQ ID NO: 3021553 - DNA, 17 bp, Homo sapiens
cgcagtgtgcactaagg

SEQ ID NO: 3021554 - DNA, 18 bp, Homo sapiens
cgcatcaaaagacaattc

SEQ ID NO: 3021555 - DNA, 15 bp, Homo sapiens
cgcatccagacagtc

SEQ ID NO: 3021556 - DNA, 17 bp, Homo sapiens
cgcatcccggctgaccc

SEQ ID NO: 3021557 - DNA, 15 bp, Homo sapiens
cgcatcttctccatc

SEQ ID NO: 3021558 - DNA, 17 bp, Homo sapiens
cgcatcttgcctccagg

SEQ ID NO: 3021559 - DNA, 21 bp, Homo sapiens
cgcatgcctgtaatcccagaa

SEQ ID NO: 3021560 - DNA, 12 bp, Homo sapiens
cgcatggcagct

SEQ ID NO: 3021561 - DNA, 14 bp, Homo sapiens
cgcatgtttaatgt

SEQ ID NO: 3021562 - DNA, 14 bp, Homo sapiens
cgcatgttttcttc

SEQ ID NO: 3021563 - DNA, 22 bp, Homo sapiens
cgcattcagtgcacctgcctca

SEQ ID NO: 3021564 - DNA, 20 bp, Homo sapiens
cgccacatggtgtggccatc

SEQ ID NO: 3021565 - DNA, 13 bp, Homo sapiens
cgccactgcctcc

SEQ ID NO: 3021566 - DNA, 19 bp, Homo sapiens
cgccagaagactcctaggc

SEQ ID NO: 3021567 - DNA, 23 bp, Homo sapiens
cgccaggatggaacacggccaca

SEQ ID NO: 3021568 - DNA, 23 bp, Homo sapiens
cgccaggcagagctgagggccct

SEQ ID NO: 3021569 - DNA, 19 bp, Homo sapiens
cgccaggcgctgcagggcc

SEQ ID NO: 3021570 - DNA, 16 bp, Homo sapiens
cgccaggctgaccaca

SEQ ID NO: 3021571 - DNA, 16 bp, Homo sapiens
cgccagggcccaggcc

SEQ ID NO: 3021572 - DNA, 16 bp, Homo sapiens
cgccataggccaaggt

SEQ ID NO: 3021573 - DNA, 17 bp, Homo sapiens
cgccatctgcgcagggt

SEQ ID NO: 3021574 - DNA, 17 bp, Homo sapiens
cgccattgtactccagc

SEQ ID NO: 3021575 - DNA, 18 bp, Homo sapiens
cgccattgtactccagcc

SEQ ID NO: 3021576 - DNA, 17 bp, Homo sapiens
cgccatttcctcacgtg

SEQ ID NO: 3021577 - DNA, 15 bp, Homo sapiens
cgcccagcagcctgc

SEQ ID NO: 3021578 - DNA, 16 bp, Homo sapiens
cgcccagcagcctgcc

SEQ ID NO: 3021579 - DNA, 13 bp, Homo sapiens
cgcccaggaaggc

SEQ ID NO: 3021580 - DNA, 23 bp, Homo sapiens
cgcccaggatcagattgcatgtg

SEQ ID NO: 3021581 - DNA, 14 bp, Homo sapiens
cgcccagtccttcc

SEQ ID NO: 3021582 - DNA, 16 bp, Homo sapiens
cgcccagtccttccac

SEQ ID NO: 3021583 - DNA, 13 bp, Homo sapiens
cgcccatcagtgc

SEQ ID NO: 3021584 - DNA, 19 bp, Homo sapiens
cgcccccaccctgagcgcc

SEQ ID NO: 3021585 - DNA, 16 bp, Homo sapiens
cgcccccaccgggctg

SEQ ID NO: 3021586 - DNA, 13 bp, Homo sapiens
cgcccccaggcct

SEQ ID NO: 3021587 - DNA, 19 bp, Homo sapiens
cgccccctgccctcccctc

SEQ ID NO: 3021588 - DNA, 18 bp, Homo sapiens
cgccccgctgtgtcctcc

SEQ ID NO: 3021589 - DNA, 16 bp, Homo sapiens
cgccccgggctggccc

SEQ ID NO: 3021590 - DNA, 17 bp, Homo sapiens
cgccccgggctggccct

SEQ ID NO: 3021591 - DNA, 18 bp, Homo sapiens
cgccccgggctggccctg

SEQ ID NO: 3021592 - DNA, 12 bp, Homo sapiens
cgcccctgaggc

SEQ ID NO: 3021593 - DNA, 17 bp, Homo sapiens
cgcccgaggtggctgcc

SEQ ID NO: 3021594 - DNA, 11 bp, Homo sapiens
cgccctcaggc

SEQ ID NO: 3021595 - DNA, 12 bp, Homo sapiens
cgccctcccagg

SEQ ID NO: 3021596 - DNA, 16 bp, Homo sapiens
cgccctccctccgcct

SEQ ID NO: 3021597 - DNA, 20 bp, Homo sapiens
cgccctccctccgcctccca

SEQ ID NO: 3021598 - DNA, 14 bp, Homo sapiens
cgccctccgacctc

SEQ ID NO: 3021599 - DNA, 23 bp, Homo sapiens
cgccctctctcatatcactgaag

SEQ ID NO: 3021600 - DNA, 14 bp, Homo sapiens
cgccctgcgggcca

SEQ ID NO: 3021601 - DNA, 14 bp, Homo sapiens
cgcccttccttccc

SEQ ID NO: 3021602 - DNA, 14 bp, Homo sapiens
cgcccttttcccct

SEQ ID NO: 3021603 - DNA, 21 bp, Homo sapiens
cgccgcaaaccacactggact

SEQ ID NO: 3021604 - DNA, 23 bp, Homo sapiens
cgccgcaaaccacactggactcc

SEQ ID NO: 3021605 - DNA, 14 bp, Homo sapiens
cgccgcctggtact

SEQ ID NO: 3021606 - DNA, 13 bp, Homo sapiens
cgccgctgaccct

SEQ ID NO: 3021607 - DNA, 19 bp, Homo sapiens
cgccggctttcagggcagc

SEQ ID NO: 3021608 - DNA, 16 bp, Homo sapiens
cgccggggtcctggga

SEQ ID NO: 3021609 - DNA, 18 bp, Homo sapiens
cgccggggtcctgggagg

SEQ ID NO: 3021610 - DNA, 19 bp, Homo sapiens
cgccgtctggcgagccctt

SEQ ID NO: 3021611 - DNA, 15 bp, Homo sapiens
cgcctactgtccctc

SEQ ID NO: 3021612 - DNA, 23 bp, Homo sapiens
cgcctagagcgcggctggctctg

SEQ ID NO: 3021613 - DNA, 20 bp, Homo sapiens
cgcctagtggggtctccctc

SEQ ID NO: 3021614 - DNA, 16 bp, Homo sapiens
cgcctataatcccagc

SEQ ID NO: 3021615 - DNA, 21 bp, Homo sapiens
cgcctcactgcaaccttcacc

SEQ ID NO: 3021616 - DNA, 13 bp, Homo sapiens
cgcctcccatccc

SEQ ID NO: 3021617 - DNA, 17 bp, Homo sapiens
cgcctccccacctccag

SEQ ID NO: 3021618 - DNA, 19 bp, Homo sapiens
cgcctcgtgccagcagcct

SEQ ID NO: 3021619 - DNA, 20 bp, Homo sapiens
cgcctgcaaacgctgcctgc

SEQ ID NO: 3021620 - DNA, 11 bp, Homo sapiens
cgcctgccatc

SEQ ID NO: 3021621 - DNA, 14 bp, Homo sapiens
cgcctgccatcttc

SEQ ID NO: 3021622 - DNA, 13 bp, Homo sapiens
cgcctgcccacct

SEQ ID NO: 3021623 - DNA, 21 bp, Homo sapiens
cgcctgcccacctgcctggcc

SEQ ID NO: 3021624 - DNA, 21 bp, Homo sapiens
cgcctgccctcccgcaccttc

SEQ ID NO: 3021625 - DNA, 15 bp, Homo sapiens
cgcctgccctcctct

SEQ ID NO: 3021626 - DNA, 14 bp, Homo sapiens
cgcctgccctgccc

SEQ ID NO: 3021627 - DNA, 18 bp, Homo sapiens
cgcctgccctgcccaagt

SEQ ID NO: 3021628 - DNA, 10 bp, Homo sapiens
cgcctgcctt

SEQ ID NO: 3021629 - DNA, 18 bp, Homo sapiens
cgcctgcgcctccatcca

SEQ ID NO: 3021630 - DNA, 11 bp, Homo sapiens
cgcctggagag

SEQ ID NO: 3021631 - DNA, 12 bp, Homo sapiens
cgcctggagagc

SEQ ID NO: 3021632 - DNA, 17 bp, Homo sapiens
cgcctggagagcgagga

SEQ ID NO: 3021633 - DNA, 18 bp, Homo sapiens
cgcctggagagcgaggag

SEQ ID NO: 3021634 - DNA, 13 bp, Homo sapiens
cgcctggagccct

SEQ ID NO: 3021635 - DNA, 14 bp, Homo sapiens
cgcctggcctccag

SEQ ID NO: 3021636 - DNA, 15 bp, Homo sapiens
cgcctggcctccagg

SEQ ID NO: 3021637 - DNA, 16 bp, Homo sapiens
cgcctggcctccaggc

SEQ ID NO: 3021638 - DNA, 23 bp, Homo sapiens
cgcctggctgctgcttcttgctt

SEQ ID NO: 3021639 - DNA, 18 bp, Homo sapiens
cgcctgtaatcccagcag

SEQ ID NO: 3021640 - DNA, 19 bp, Homo sapiens
ctaaatgagtcactgagca

SEQ ID NO: 3021641 - DNA, 15 bp, Homo sapiens
ctaaatgtgtaataa

SEQ ID NO: 3021642 - DNA, 17 bp, Homo sapiens
ctaaatttattaaataa

SEQ ID NO: 3021643 - DNA, 14 bp, Homo sapiens
ctaaatttcttcct

SEQ ID NO: 3021644 - DNA, 22 bp, Homo sapiens
ctaacaatcagctccttcctgg

SEQ ID NO: 3021645 - DNA, 12 bp, Homo sapiens
ctaacacacaga

SEQ ID NO: 3021646 - DNA, 18 bp, Homo sapiens
ctaacacgtgatgtgata

SEQ ID NO: 3021647 - DNA, 14 bp, Homo sapiens
ctaacacttacccc

SEQ ID NO: 3021648 - DNA, 19 bp, Homo sapiens
ctaacataccgtttataat

SEQ ID NO: 3021649 - DNA, 18 bp, Homo sapiens
ctaacatatgatactgat

SEQ ID NO: 3021650 - DNA, 17 bp, Homo sapiens
ctaacatttaggagaag

SEQ ID NO: 3021651 - DNA, 21 bp, Homo sapiens
ctaaccaaaagacaccagcca

SEQ ID NO: 3021652 - DNA, 17 bp, Homo sapiens
ctaaccaaagagtctct

SEQ ID NO: 3021653 - DNA, 20 bp, Homo sapiens
ctaaccaaagagtctctggc

SEQ ID NO: 3021654 - DNA, 22 bp, Homo sapiens
ctaaccaaagagtctctggctc

SEQ ID NO: 3021655 - DNA, 10 bp, Homo sapiens
ctaaccacta

SEQ ID NO: 3021656 - DNA, 19 bp, Homo sapiens
ctaacccccagcccacaga

SEQ ID NO: 3021657 - DNA, 13 bp, Homo sapiens
ctaaccctctgtc

SEQ ID NO: 3021658 - DNA, 14 bp, Homo sapiens
ctaaccctctgtca

SEQ ID NO: 3021659 - DNA, 18 bp, Homo sapiens
ctaacccttaaaaatgca

SEQ ID NO: 3021660 - DNA, 12 bp, Homo sapiens
ctaacctcatct

SEQ ID NO: 3021661 - DNA, 15 bp, Homo sapiens
ctaacctcatcttct

SEQ ID NO: 3021662 - DNA, 12 bp, Homo sapiens
ctaacctgtgac

SEQ ID NO: 3021663 - DNA, 12 bp, Homo sapiens
ctaacctgtgtc

SEQ ID NO: 3021664 - DNA, 22 bp, Homo sapiens
ctaacggtctgttctgtttcaa

SEQ ID NO: 3021665 - DNA, 14 bp, Homo sapiens
ctaacgttttttct

SEQ ID NO: 3021666 - DNA, 19 bp, Homo sapiens
ctaactaaccacattttag

SEQ ID NO: 3021667 - DNA, 21 bp, Homo sapiens
ctaactaaccacattttagga

SEQ ID NO: 3021668 - DNA, 22 bp, Homo sapiens
ctaactagacaccaaagttcta

SEQ ID NO: 3021669 - DNA, 16 bp, Homo sapiens
ctaactccctcctcac

SEQ ID NO: 3021670 - DNA, 16 bp, Homo sapiens
ctaactgaactttgaa

SEQ ID NO: 3021671 - DNA, 13 bp, Homo sapiens
ctaactgtaaatc

SEQ ID NO: 3021672 - DNA, 14 bp, Homo sapiens
ctaactgtaaatca

SEQ ID NO: 3021673 - DNA, 10 bp, Homo sapiens
ctaactgtat

SEQ ID NO: 3021674 - DNA, 12 bp, Homo sapiens
ctaactgtatct

SEQ ID NO: 3021675 - DNA, 23 bp, Homo sapiens
ctaacttattgcctgggcagtgc

SEQ ID NO: 3021676 - DNA, 12 bp, Homo sapiens
ctaacttattta

SEQ ID NO: 3021677 - DNA, 16 bp, Homo sapiens
ctaagaatacagcttt

SEQ ID NO: 3021678 - DNA, 13 bp, Homo sapiens
ctaagacatgtaa

SEQ ID NO: 3021679 - DNA, 17 bp, Homo sapiens
ctaagactcaaatgttc

SEQ ID NO: 3021680 - DNA, 19 bp, Homo sapiens
ctaagactcaaatgttcta

SEQ ID NO: 3021681 - DNA, 18 bp, Homo sapiens
ctaagactgctgctgaat

SEQ ID NO: 3021682 - DNA, 18 bp, Homo sapiens
ctaagacttactctaaga

SEQ ID NO: 3021683 - DNA, 16 bp, Homo sapiens
ctaagagattctgatt

SEQ ID NO: 3021684 - DNA, 19 bp, Homo sapiens
ctaagagctagcgctgccg

SEQ ID NO: 3021685 - DNA, 12 bp, Homo sapiens
ctaagagtgtcc

SEQ ID NO: 3021686 - DNA, 18 bp, Homo sapiens
ctaagagtgtcctaggag

SEQ ID NO: 3021687 - DNA, 19 bp, Homo sapiens
ctaagatactgctgatgct

SEQ ID NO: 3021688 - DNA, 11 bp, Homo sapiens
ctaagatgctc

SEQ ID NO: 3021689 - DNA, 21 bp, Homo sapiens
ctaagatgtgatattctaaga

SEQ ID NO: 3021690 - DNA, 14 bp, Homo sapiens
ctaagattctaaag

SEQ ID NO: 3021691 - DNA, 15 bp, Homo sapiens
ctaagattctaaagg

SEQ ID NO: 3021692 - DNA, 16 bp, Homo sapiens
ctaagattctaaaggt

SEQ ID NO: 3021693 - DNA, 21 bp, Homo sapiens
ctaagattctaatgatgatca

SEQ ID NO: 3021694 - DNA, 12 bp, Homo sapiens
ctaagattctag

SEQ ID NO: 3021695 - DNA, 14 bp, Homo sapiens
ctaagattctagat

SEQ ID NO: 3021696 - DNA, 16 bp, Homo sapiens
ctaagattctagatca

SEQ ID NO: 3021697 - DNA, 18 bp, Homo sapiens
ctaagattctgattttag

SEQ ID NO: 3021698 - DNA, 15 bp, Homo sapiens
ctaagcagaggaggg

SEQ ID NO: 3021699 - DNA, 16 bp, Homo sapiens
ctaagcagaggagggg

SEQ ID NO: 3021700 - DNA, 23 bp, Homo sapiens
ctaagcagaggaggggccgctgc

SEQ ID NO: 3021701 - DNA, 17 bp, Homo sapiens
ctaagcagccaggaggg

SEQ ID NO: 3021702 - DNA, 15 bp, Homo sapiens
ctaagcatctaagtt

SEQ ID NO: 3021703 - DNA, 12 bp, Homo sapiens
ctaagccaagct

SEQ ID NO: 3021704 - DNA, 14 bp, Homo sapiens
ctaagccaagctgt

SEQ ID NO: 3021705 - DNA, 21 bp, Homo sapiens
ctaagccaagctgtgttcatc

SEQ ID NO: 3021706 - DNA, 14 bp, Homo sapiens
ctaagcctgtggct

SEQ ID NO: 3021707 - DNA, 17 bp, Homo sapiens
ctaaggacatttcccag

SEQ ID NO: 3021708 - DNA, 20 bp, Homo sapiens
ctaaggataatgaaataatc

SEQ ID NO: 3021709 - DNA, 22 bp, Homo sapiens
ctaaggataatgaaataatcag

SEQ ID NO: 3021710 - DNA, 21 bp, Homo sapiens
ctaaggccactgttttaaaag

SEQ ID NO: 3021711 - DNA, 21 bp, Homo sapiens
ctaaggcctaggattctaaaa

SEQ ID NO: 3021712 - DNA, 22 bp, Homo sapiens
ctaaggcctaggattctaaaat

SEQ ID NO: 3021713 - DNA, 23 bp, Homo sapiens
ctaaggctctatgagtctagatg

SEQ ID NO: 3021714 - DNA, 13 bp, Homo sapiens
ctaaggctctgag

SEQ ID NO: 3021715 - DNA, 22 bp, Homo sapiens
ctaaggctctgagagtctagat

SEQ ID NO: 3021716 - DNA, 19 bp, Homo sapiens
ctaagggaggcacttcctc

SEQ ID NO: 3021717 - DNA, 23 bp, Homo sapiens
ctaagggaggcacttcctcccct

SEQ ID NO: 3021718 - DNA, 13 bp, Homo sapiens
ctaagggcagccc

SEQ ID NO: 3021719 - DNA, 15 bp, Homo sapiens
ctaagggcagccctc

SEQ ID NO: 3021720 - DNA, 19 bp, Homo sapiens
ctaaggggacctacagaca

SEQ ID NO: 3021721 - DNA, 20 bp, Homo sapiens
ctaaggggacctacagacag

SEQ ID NO: 3021722 - DNA, 14 bp, Homo sapiens
ctaagggggaccat

SEQ ID NO: 3021723 - DNA, 19 bp, Homo sapiens
ctaaggtccggtgttctaa

SEQ ID NO: 3021724 - DNA, 22 bp, Homo sapiens
ctaaggtccggtgttctaagat

SEQ ID NO: 3021725 - DNA, 17 bp, Homo sapiens
ctaaggtgactttctga

SEQ ID NO: 3021726 - DNA, 15 bp, Homo sapiens
ctaaggtgctaaatc

SEQ ID NO: 3021727 - DNA, 17 bp, Homo sapiens
ctaaggttctaaggcct

SEQ ID NO: 3021728 - DNA, 22 bp, Homo sapiens
ctaagtcgttgagggaatgaca

SEQ ID NO: 3021729 - DNA, 16 bp, Homo sapiens
ctaagtctttccattg

SEQ ID NO: 3021730 - DNA, 17 bp, Homo sapiens
ctaagtggcgtgtgcat

SEQ ID NO: 3021731 - DNA, 22 bp, Homo sapiens
ctaagtgggacattcaaaaaac

SEQ ID NO: 3021732 - DNA, 21 bp, Homo sapiens
ctaagttaatttaaagttgtt

SEQ ID NO: 3021733 - DNA, 17 bp, Homo sapiens
ctaagttataagactct

SEQ ID NO: 3021734 - DNA, 20 bp, Homo sapiens
ctaagttattgttaattatg

SEQ ID NO: 3021735 - DNA, 22 bp, Homo sapiens
ctaagttattttatgacatgaa

SEQ ID NO: 3021736 - DNA, 13 bp, Homo sapiens
ctaagtttcagtt

SEQ ID NO: 3021737 - DNA, 15 bp, Homo sapiens
ctaagtttctaagat

SEQ ID NO: 3021738 - DNA, 19 bp, Homo sapiens
ctaagtttctaagattcta

SEQ ID NO: 3021739 - DNA, 16 bp, Homo sapiens
ctaagttttgtgtgta

SEQ ID NO: 3021740 - DNA, 17 bp, Homo sapiens
ctaataaatcaatgtga

SEQ ID NO: 3021741 - DNA, 21 bp, Homo sapiens
ctaataattggccttcgattt

SEQ ID NO: 3021742 - DNA, 15 bp, Homo sapiens
ctaataatttctaat

SEQ ID NO: 3021743 - DNA, 17 bp, Homo sapiens
ctaataatttctaatgt

SEQ ID NO: 3021744 - DNA, 17 bp, Homo sapiens
ctaatatacagggtagc

SEQ ID NO: 3021745 - DNA, 23 bp, Homo sapiens
ctaatatccaacacaactatcaa

SEQ ID NO: 3021746 - DNA, 20 bp, Homo sapiens
ctaatatggccacagtagtc

SEQ ID NO: 3021747 - DNA, 10 bp, Homo sapiens
ctaatatttt

SEQ ID NO: 3021748 - DNA, 17 bp, Homo sapiens
ctaatattttatttgaa

SEQ ID NO: 3021749 - DNA, 19 bp, Homo sapiens
ctaatattttatttgaaaa

SEQ ID NO: 3021750 - DNA, 21 bp, Homo sapiens
ctaatcaagagtctctccagc

SEQ ID NO: 3021751 - DNA, 22 bp, Homo sapiens
ctaatcaagagtctctccagcc

SEQ ID NO: 3021752 - DNA, 13 bp, Homo sapiens
ctaatcacatgtg

SEQ ID NO: 3021753 - DNA, 23 bp, Homo sapiens
ctaatcacatgtgctgcaaatag

SEQ ID NO: 3021754 - DNA, 13 bp, Homo sapiens
ctaatccaaccca

SEQ ID NO: 3021755 - DNA, 18 bp, Homo sapiens
ctaatccaggcagatcca

SEQ ID NO: 3021756 - DNA, 19 bp, Homo sapiens
ctaatccctgggcattgct

SEQ ID NO: 3021757 - DNA, 23 bp, Homo sapiens
ctaatccctgggcattgctttcc

SEQ ID NO: 3021758 - DNA, 17 bp, Homo sapiens
ctaatcttaaatcagaa

SEQ ID NO: 3021759 - DNA, 17 bp, Homo sapiens
ctaatgaattgaaattt

SEQ ID NO: 3021760 - DNA, 18 bp, Homo sapiens
ctaatgagatatatcttt

SEQ ID NO: 3021761 - DNA, 19 bp, Homo sapiens
ctaatgagatatatcttta

SEQ ID NO: 3021762 - DNA, 19 bp, Homo sapiens
ctaatgaggagagaaaata

SEQ ID NO: 3021763 - DNA, 23 bp, Homo sapiens
ctaatgaggagagaaaatatatg

SEQ ID NO: 3021764 - DNA, 21 bp, Homo sapiens
ctaatgatgacttgagccctg

SEQ ID NO: 3021765 - DNA, 23 bp, Homo sapiens
ctaatgatgacttgagccctgcc

SEQ ID NO: 3021766 - DNA, 13 bp, Homo sapiens
ctaatgctcacct

SEQ ID NO: 3021767 - DNA, 15 bp, Homo sapiens
ctaatgctctgaaag

SEQ ID NO: 3021768 - DNA, 14 bp, Homo sapiens
ctaatggcatgaga

SEQ ID NO: 3021769 - DNA, 20 bp, Homo sapiens
ctaatgtgagtgtgaagctt

SEQ ID NO: 3021770 - DNA, 17 bp, Homo sapiens
ctaattaaccttactaa

SEQ ID NO: 3021771 - DNA, 12 bp, Homo sapiens
ctaattcatctt

SEQ ID NO: 3021772 - DNA, 21 bp, Homo sapiens
ctcacacttactgtaagacat

SEQ ID NO: 3021773 - DNA, 13 bp, Homo sapiens
ctcacagaagaat

SEQ ID NO: 3021774 - DNA, 20 bp, Homo sapiens
ctcacagactcttccaccag

SEQ ID NO: 3021775 - DNA, 21 bp, Homo sapiens
ctcacagactcttccaccaga

SEQ ID NO: 3021776 - DNA, 19 bp, Homo sapiens
ctcacagatgctggcctct

SEQ ID NO: 3021777 - DNA, 20 bp, Homo sapiens
ctcacagatgctggcctctt

SEQ ID NO: 3021778 - DNA, 18 bp, Homo sapiens
ctcacagttcctcgccct

SEQ ID NO: 3021779 - DNA, 21 bp, Homo sapiens
ctcacagttcctcgccctggg

SEQ ID NO: 3021780 - DNA, 23 bp, Homo sapiens
ctcacagttcctcgccctgggtc

SEQ ID NO: 3021781 - DNA, 13 bp, Homo sapiens
ctcacatttatat

SEQ ID NO: 3021782 - DNA, 13 bp, Homo sapiens
ctcaccaccccca

SEQ ID NO: 3021783 - DNA, 14 bp, Homo sapiens
ctcaccagctgcaa

SEQ ID NO: 3021784 - DNA, 15 bp, Homo sapiens
ctcaccagctgcaaa

SEQ ID NO: 3021785 - DNA, 16 bp, Homo sapiens
ctcaccagctgcaaag

SEQ ID NO: 3021786 - DNA, 18 bp, Homo sapiens
ctcaccagctgcaaagtg

SEQ ID NO: 3021787 - DNA, 19 bp, Homo sapiens
ctcaccatatttgaattgg

SEQ ID NO: 3021788 - DNA, 17 bp, Homo sapiens
ctcacccacccctgcac

SEQ ID NO: 3021789 - DNA, 21 bp, Homo sapiens
ctcacccatgcaagcagagga

SEQ ID NO: 3021790 - DNA, 22 bp, Homo sapiens
ctcaccccaaacccagaacatg

SEQ ID NO: 3021791 - DNA, 23 bp, Homo sapiens
ctcaccccagactcctgactgtc

SEQ ID NO: 3021792 - DNA, 20 bp, Homo sapiens
ctcaccccagctccgacctc

SEQ ID NO: 3021793 - DNA, 16 bp, Homo sapiens
ctcacccccttctcca

SEQ ID NO: 3021794 - DNA, 20 bp, Homo sapiens
ctcacccccttctccatcca

SEQ ID NO: 3021795 - DNA, 15 bp, Homo sapiens
ctcaccccgaggccc

SEQ ID NO: 3021796 - DNA, 12 bp, Homo sapiens
ctcaccctctgt

SEQ ID NO: 3021797 - DNA, 16 bp, Homo sapiens
ctcacccttcctggcc

SEQ ID NO: 3021798 - DNA, 19 bp, Homo sapiens
ctcacccttcctggcccag

SEQ ID NO: 3021799 - DNA, 23 bp, Homo sapiens
ctcacccttcctggcccaggcct

SEQ ID NO: 3021800 - DNA, 21 bp, Homo sapiens
ctcaccgtggctaagagtgtc

SEQ ID NO: 3021801 - DNA, 15 bp, Homo sapiens
ctcacctctgcctca

SEQ ID NO: 3021802 - DNA, 19 bp, Homo sapiens
ctcacctctgcctcaatgt

SEQ ID NO: 3021803 - DNA, 20 bp, Homo sapiens
ctcacctctttgttcttcct

SEQ ID NO: 3021804 - DNA, 11 bp, Homo sapiens
ctcacctgggg

SEQ ID NO: 3021805 - DNA, 21 bp, Homo sapiens
ctcacctgttgcttacaattt

SEQ ID NO: 3021806 - DNA, 16 bp, Homo sapiens
ctcaccttggcaccag

SEQ ID NO: 3021807 - DNA, 17 bp, Homo sapiens
ctcaccttggcaccaga

SEQ ID NO: 3021808 - DNA, 20 bp, Homo sapiens
ctcacctttctccactgggt

SEQ ID NO: 3021809 - DNA, 15 bp, Homo sapiens
ctcacgcacctccca

SEQ ID NO: 3021810 - DNA, 19 bp, Homo sapiens
ctcacgcacctcccatcct

SEQ ID NO: 3021811 - DNA, 14 bp, Homo sapiens
ctcacgccaccccc

SEQ ID NO: 3021812 - DNA, 16 bp, Homo sapiens
ctcacgccccgctgtg

SEQ ID NO: 3021813 - DNA, 22 bp, Homo sapiens
ctcacgcctgtaatcccagcag

SEQ ID NO: 3021814 - DNA, 19 bp, Homo sapiens
ctcacgggcagtagctgtg

SEQ ID NO: 3021815 - DNA, 22 bp, Homo sapiens
ctcacgtctgtaatcccagcgc

SEQ ID NO: 3021816 - DNA, 15 bp, Homo sapiens
ctcacgtgcaggaca

SEQ ID NO: 3021817 - DNA, 16 bp, Homo sapiens
ctcacgtttcttcccc

SEQ ID NO: 3021818 - DNA, 13 bp, Homo sapiens
ctcactaattttt

SEQ ID NO: 3021819 - DNA, 15 bp, Homo sapiens
ctcactaatttttgt

SEQ ID NO: 3021820 - DNA, 17 bp, Homo sapiens
ctcactataccagtata

SEQ ID NO: 3021821 - DNA, 15 bp, Homo sapiens
ctcactatgtttctc

SEQ ID NO: 3021822 - DNA, 20 bp, Homo sapiens
ctcactatgtttctcagact

SEQ ID NO: 3021823 - DNA, 18 bp, Homo sapiens
ctcactcagctctgaaag

SEQ ID NO: 3021824 - DNA, 12 bp, Homo sapiens
ctcactccacca

SEQ ID NO: 3021825 - DNA, 22 bp, Homo sapiens
ctcactccctaggcccaagtct

SEQ ID NO: 3021826 - DNA, 21 bp, Homo sapiens
ctcactcccttcccataagct

SEQ ID NO: 3021827 - DNA, 19 bp, Homo sapiens
ctcactgaaaacatctgga

SEQ ID NO: 3021828 - DNA, 19 bp, Homo sapiens
ctcactgaactccttcccc

SEQ ID NO: 3021829 - DNA, 20 bp, Homo sapiens
ctcactgaagcccagacctc

SEQ ID NO: 3021830 - DNA, 22 bp, Homo sapiens
ctcactgctaagaatatttgaa

SEQ ID NO: 3021831 - DNA, 23 bp, Homo sapiens
ctcactgctaagaatatttgaat

SEQ ID NO: 3021832 - DNA, 13 bp, Homo sapiens
ctcactggcagcc

SEQ ID NO: 3021833 - DNA, 18 bp, Homo sapiens
ctcactggcagccccagc

SEQ ID NO: 3021834 - DNA, 15 bp, Homo sapiens
ctcactggctcatgc

SEQ ID NO: 3021835 - DNA, 23 bp, Homo sapiens
ctcactggttttacttacaaaaa

SEQ ID NO: 3021836 - DNA, 13 bp, Homo sapiens
ctcactgtctgag

SEQ ID NO: 3021837 - DNA, 23 bp, Homo sapiens
ctcactgtgggaaggccagctgc

SEQ ID NO: 3021838 - DNA, 22 bp, Homo sapiens
ctcactgtggtaaatgccacac

SEQ ID NO: 3021839 - DNA, 19 bp, Homo sapiens
ctcactgtgtcacccaggc

SEQ ID NO: 3021840 - DNA, 17 bp, Homo sapiens
ctcactgttgcagtggc

SEQ ID NO: 3021841 - DNA, 23 bp, Homo sapiens
ctcactgttgcagtggcctggcc

SEQ ID NO: 3021842 - DNA, 19 bp, Homo sapiens
ctcactgtttgtttttatt

SEQ ID NO: 3021843 - DNA, 15 bp, Homo sapiens
ctcacttatctgata

SEQ ID NO: 3021844 - DNA, 18 bp, Homo sapiens
ctcacttctagatctcag

SEQ ID NO: 3021845 - DNA, 17 bp, Homo sapiens
ctcacttcttccatcca

SEQ ID NO: 3021846 - DNA, 19 bp, Homo sapiens
ctcacttggtctgccaggc

SEQ ID NO: 3021847 - DNA, 16 bp, Homo sapiens
ctcactttaaacctgt

SEQ ID NO: 3021848 - DNA, 23 bp, Homo sapiens
ctcacttttcacttgtcttgctc

SEQ ID NO: 3021849 - DNA, 16 bp, Homo sapiens
ctcacttttcatctgg

SEQ ID NO: 3021850 - DNA, 19 bp, Homo sapiens
ctcagaaatggacaaagaa

SEQ ID NO: 3021851 - DNA, 23 bp, Homo sapiens
ctcagaaatggacaaagaaaacg

SEQ ID NO: 3021852 - DNA, 12 bp, Homo sapiens
ctcagaagaaaa

SEQ ID NO: 3021853 - DNA, 12 bp, Homo sapiens
ctcagaagagca

SEQ ID NO: 3021854 - DNA, 21 bp, Homo sapiens
ctcagaagggagctagccaga

SEQ ID NO: 3021855 - DNA, 15 bp, Homo sapiens
ctcagaatgggggct

SEQ ID NO: 3021856 - DNA, 20 bp, Homo sapiens
ctcagaatgggggctttcgg

SEQ ID NO: 3021857 - DNA, 19 bp, Homo sapiens
ctcagacatgttttccgtg

SEQ ID NO: 3021858 - DNA, 20 bp, Homo sapiens
ctcagacatgttttccgtga

SEQ ID NO: 3021859 - DNA, 15 bp, Homo sapiens
ctcagaccagagaag

SEQ ID NO: 3021860 - DNA, 15 bp, Homo sapiens
ctcagaccagctctt

SEQ ID NO: 3021861 - DNA, 16 bp, Homo sapiens
ctcagaccagctcttc

SEQ ID NO: 3021862 - DNA, 13 bp, Homo sapiens
ctcagacccccac

SEQ ID NO: 3021863 - DNA, 19 bp, Homo sapiens
ctcagactgcacccaggag

SEQ ID NO: 3021864 - DNA, 13 bp, Homo sapiens
ctcagagcccatg

SEQ ID NO: 3021865 - DNA, 15 bp, Homo sapiens
ctcagagcccatggt

SEQ ID NO: 3021866 - DNA, 15 bp, Homo sapiens
ctcagagctgcgggc

SEQ ID NO: 3021867 - DNA, 17 bp, Homo sapiens
ctcagagctgcgggctg

SEQ ID NO: 3021868 - DNA, 20 bp, Homo sapiens
ctcagagctgcgggctgagg

SEQ ID NO: 3021869 - DNA, 16 bp, Homo sapiens
ctcagagtatctttac

SEQ ID NO: 3021870 - DNA, 18 bp, Homo sapiens
ctcagagtcggaacggag

SEQ ID NO: 3021871 - DNA, 21 bp, Homo sapiens
ctcagataaggtaaaatgcca

SEQ ID NO: 3021872 - DNA, 18 bp, Homo sapiens
ctcagatccagggacaga

SEQ ID NO: 3021873 - DNA, 14 bp, Homo sapiens
ctcagatgctcaaa

SEQ ID NO: 3021874 - DNA, 20 bp, Homo sapiens
ctcagatggaaccgcaggaa

SEQ ID NO: 3021875 - DNA, 21 bp, Homo sapiens
ctcagatggaaccgcaggaag

SEQ ID NO: 3021876 - DNA, 14 bp, Homo sapiens
ctcagcacaaggcc

SEQ ID NO: 3021877 - DNA, 16 bp, Homo sapiens
ctcagcagaggcagtg

SEQ ID NO: 3021878 - DNA, 13 bp, Homo sapiens
ctcagcagccctc

SEQ ID NO: 3021879 - DNA, 15 bp, Homo sapiens
ctcagcagccctcct

SEQ ID NO: 3021880 - DNA, 19 bp, Homo sapiens
ctcagcagccctcctcacc

SEQ ID NO: 3021881 - DNA, 23 bp, Homo sapiens
ctcagcagcctgcgctcggcagg

SEQ ID NO: 3021882 - DNA, 22 bp, Homo sapiens
ctcagcatttgattaacatttg

SEQ ID NO: 3021883 - DNA, 13 bp, Homo sapiens
ctcagccaagcac

SEQ ID NO: 3021884 - DNA, 23 bp, Homo sapiens
ctcagccaagcacagtggtggca

SEQ ID NO: 3021885 - DNA, 23 bp, Homo sapiens
ctcagccagcccgtgtgtataat

SEQ ID NO: 3021886 - DNA, 21 bp, Homo sapiens
ctcagccatttctaagcagat

SEQ ID NO: 3021887 - DNA, 18 bp, Homo sapiens
ctcagccccatcgcccca

SEQ ID NO: 3021888 - DNA, 22 bp, Homo sapiens
ctcagcccctacccctgccctg

SEQ ID NO: 3021889 - DNA, 14 bp, Homo sapiens
ctcagccctgaccc

SEQ ID NO: 3021890 - DNA, 21 bp, Homo sapiens
ctcagccctgggccccaccac

SEQ ID NO: 3021891 - DNA, 12 bp, Homo sapiens
ctcagcctcccg

SEQ ID NO: 3021892 - DNA, 22 bp, Homo sapiens
ctcagcctgatcaggcttcctg

SEQ ID NO: 3021893 - DNA, 10 bp, Homo sapiens
ctcagcctgc

SEQ ID NO: 3021894 - DNA, 11 bp, Homo sapiens
ctcagcctgca

SEQ ID NO: 3021895 - DNA, 14 bp, Homo sapiens
ctcagcctgcaccc

SEQ ID NO: 3021896 - DNA, 13 bp, Homo sapiens
ctcagcctggcca

SEQ ID NO: 3021897 - DNA, 15 bp, Homo sapiens
ctcagcctggccaga

SEQ ID NO: 3021898 - DNA, 16 bp, Homo sapiens
ctcagcctggccagac

SEQ ID NO: 3021899 - DNA, 17 bp, Homo sapiens
ctcagcctggccagaca

SEQ ID NO: 3021900 - DNA, 19 bp, Homo sapiens
ctcagcctggccagacaca

SEQ ID NO: 3021901 - DNA, 20 bp, Homo sapiens
ctcagcctggccagacacag

SEQ ID NO: 3021902 - DNA, 16 bp, Homo sapiens
ctcagccttgccagag

SEQ ID NO: 3021903 - DNA, 18 bp, Homo sapiens
ctcagccttgccagagat

SEQ ID NO: 3021904 - DNA, 18 bp, Homo sapiens
ctccaacaccaagcacag

SEQ ID NO: 3021905 - DNA, 22 bp, Homo sapiens
ctccaacaccaagcacagcagc

SEQ ID NO: 3021906 - DNA, 23 bp, Homo sapiens
ctccaacaccaagcacagcagcc

SEQ ID NO: 3021907 - DNA, 22 bp, Homo sapiens
ctccaactcctttcagccacat

SEQ ID NO: 3021908 - DNA, 22 bp, Homo sapiens
ctccaagaatggaagcctgaac

SEQ ID NO: 3021909 - DNA, 16 bp, Homo sapiens
ctccaagattctagat

SEQ ID NO: 3021910 - DNA, 13 bp, Homo sapiens
ctccaagccagcg

SEQ ID NO: 3021911 - DNA, 15 bp, Homo sapiens
ctccaagccccctgg

SEQ ID NO: 3021912 - DNA, 23 bp, Homo sapiens
ctccaagccccctggcagctgcc

SEQ ID NO: 3021913 - DNA, 12 bp, Homo sapiens
ctccaagctgtt

SEQ ID NO: 3021914 - DNA, 20 bp, Homo sapiens
ctccaagctgttaaagatat

SEQ ID NO: 3021915 - DNA, 19 bp, Homo sapiens
ctccaagtggcagttttta

SEQ ID NO: 3021916 - DNA, 17 bp, Homo sapiens
ctccaagttgagactcg

SEQ ID NO: 3021917 - DNA, 16 bp, Homo sapiens
ctccacaaagcaaagg

SEQ ID NO: 3021918 - DNA, 16 bp, Homo sapiens
ctccacaacactgtgt

SEQ ID NO: 3021919 - DNA, 20 bp, Homo sapiens
ctccacaccattcaggtctt

SEQ ID NO: 3021920 - DNA, 14 bp, Homo sapiens
ctccacactgacca

SEQ ID NO: 3021921 - DNA, 20 bp, Homo sapiens
ctccacactgaccaagtgct

SEQ ID NO: 3021922 - DNA, 13 bp, Homo sapiens
ctccacaggagcc

SEQ ID NO: 3021923 - DNA, 15 bp, Homo sapiens
ctccacatcctccac

SEQ ID NO: 3021924 - DNA, 17 bp, Homo sapiens
ctccacatcctccacgt

SEQ ID NO: 3021925 - DNA, 12 bp, Homo sapiens
ctccaccaaccc

SEQ ID NO: 3021926 - DNA, 20 bp, Homo sapiens
ctccaccaacccatcagaag

SEQ ID NO: 3021927 - DNA, 17 bp, Homo sapiens
ctccaccaaccccgcgg

SEQ ID NO: 3021928 - DNA, 21 bp, Homo sapiens
ctccaccaaccccgcggccca

SEQ ID NO: 3021929 - DNA, 14 bp, Homo sapiens
ctccaccacccaaa

SEQ ID NO: 3021930 - DNA, 22 bp, Homo sapiens
ctccaccagcatcacctgcctg

SEQ ID NO: 3021931 - DNA, 23 bp, Homo sapiens
ctccaccagcatcacctgcctgt

SEQ ID NO: 3021932 - DNA, 23 bp, Homo sapiens
ctccacccaaaccccttcccacg

SEQ ID NO: 3021933 - DNA, 16 bp, Homo sapiens
ctccaccccagccccc

SEQ ID NO: 3021934 - DNA, 17 bp, Homo sapiens
ctccaccccagccccca

SEQ ID NO: 3021935 - DNA, 19 bp, Homo sapiens
ctccaccgctgcctaagtg

SEQ ID NO: 3021936 - DNA, 12 bp, Homo sapiens
ctccacctcagc

SEQ ID NO: 3021937 - DNA, 14 bp, Homo sapiens
ctccacctcagcct

SEQ ID NO: 3021938 - DNA, 14 bp, Homo sapiens
ctccacgccactgc

SEQ ID NO: 3021939 - DNA, 20 bp, Homo sapiens
ctccacggtccgcggcctgc

SEQ ID NO: 3021940 - DNA, 22 bp, Homo sapiens
ctccacggtccgcggcctgcac

SEQ ID NO: 3021941 - DNA, 20 bp, Homo sapiens
ctccactcactgaagcccag

SEQ ID NO: 3021942 - DNA, 14 bp, Homo sapiens
ctccactcaggtgc

SEQ ID NO: 3021943 - DNA, 18 bp, Homo sapiens
ctccactcaggtgcacac

SEQ ID NO: 3021944 - DNA, 16 bp, Homo sapiens
ctccactcatgtgact

SEQ ID NO: 3021945 - DNA, 17 bp, Homo sapiens
ctccacttctggtcccc

SEQ ID NO: 3021946 - DNA, 15 bp, Homo sapiens
ctccagaagatagct

SEQ ID NO: 3021947 - DNA, 15 bp, Homo sapiens
ctccagaagcctcct

SEQ ID NO: 3021948 - DNA, 22 bp, Homo sapiens
ctccagaattacccttcctcat

SEQ ID NO: 3021949 - DNA, 19 bp, Homo sapiens
ctccagacctgatcctgga

SEQ ID NO: 3021950 - DNA, 23 bp, Homo sapiens
ctccagacctgatcctggaggcc

SEQ ID NO: 3021951 - DNA, 20 bp, Homo sapiens
ctccagagggcactctgctt

SEQ ID NO: 3021952 - DNA, 21 bp, Homo sapiens
ctccagagggcactctgcttg

SEQ ID NO: 3021953 - DNA, 17 bp, Homo sapiens
ctccagatgcagggcag

SEQ ID NO: 3021954 - DNA, 16 bp, Homo sapiens
ctccagcaacacagcc

SEQ ID NO: 3021955 - DNA, 18 bp, Homo sapiens
ctccagcaacacagcctg

SEQ ID NO: 3021956 - DNA, 21 bp, Homo sapiens
ctccagcaacacagcctgggc

SEQ ID NO: 3021957 - DNA, 18 bp, Homo sapiens
ctccagcaccatccgcca

SEQ ID NO: 3021958 - DNA, 18 bp, Homo sapiens
ctccagcccctttccaaa

SEQ ID NO: 3021959 - DNA, 19 bp, Homo sapiens
ctccagcctcacagatgct

SEQ ID NO: 3021960 - DNA, 19 bp, Homo sapiens
ctccagcctgagtgacaga

SEQ ID NO: 3021961 - DNA, 19 bp, Homo sapiens
ctccagcctgcctggcagg

SEQ ID NO: 3021962 - DNA, 12 bp, Homo sapiens
ctccagcctggg

SEQ ID NO: 3021963 - DNA, 14 bp, Homo sapiens
ctccagcctgggca

SEQ ID NO: 3021964 - DNA, 23 bp, Homo sapiens
ctccagcctgggcaacaagagca

SEQ ID NO: 3021965 - DNA, 21 bp, Homo sapiens
ctccagcctgggtgacagagc

SEQ ID NO: 3021966 - DNA, 11 bp, Homo sapiens
ctccagctcct

SEQ ID NO: 3021967 - DNA, 20 bp, Homo sapiens
ctccagctctggcttcctgc

SEQ ID NO: 3021968 - DNA, 19 bp, Homo sapiens
ctccagcttttcctcaggg

SEQ ID NO: 3021969 - DNA, 20 bp, Homo sapiens
ctccagcttttcctcagggt

SEQ ID NO: 3021970 - DNA, 12 bp, Homo sapiens
ctccaggaacca

SEQ ID NO: 3021971 - DNA, 14 bp, Homo sapiens
ctccaggccagctc

SEQ ID NO: 3021972 - DNA, 16 bp, Homo sapiens
ctccaggccagctcct

SEQ ID NO: 3021973 - DNA, 12 bp, Homo sapiens
ctccaggccagg

SEQ ID NO: 3021974 - DNA, 15 bp, Homo sapiens
ctccaggccaggtgg

SEQ ID NO: 3021975 - DNA, 23 bp, Homo sapiens
ctccaggccaggtgggaacggct

SEQ ID NO: 3021976 - DNA, 11 bp, Homo sapiens
ctccaggccca

SEQ ID NO: 3021977 - DNA, 19 bp, Homo sapiens
ctccaggcccaaggctccc

SEQ ID NO: 3021978 - DNA, 17 bp, Homo sapiens
ctccaggcccgtctgtc

SEQ ID NO: 3021979 - DNA, 14 bp, Homo sapiens
ctccaggctgggct

SEQ ID NO: 3021980 - DNA, 16 bp, Homo sapiens
ctccaggctgggctga

SEQ ID NO: 3021981 - DNA, 16 bp, Homo sapiens
ctccagggccacgtgc

SEQ ID NO: 3021982 - DNA, 20 bp, Homo sapiens
ctccagggtcagaaacagga

SEQ ID NO: 3021983 - DNA, 16 bp, Homo sapiens
ctccagggtcccctgc

SEQ ID NO: 3021984 - DNA, 19 bp, Homo sapiens
ctccagggtcccctgccac

SEQ ID NO: 3021985 - DNA, 15 bp, Homo sapiens
ctccagggtgatttt

SEQ ID NO: 3021986 - DNA, 12 bp, Homo sapiens
ctccaggtacct

SEQ ID NO: 3021987 - DNA, 15 bp, Homo sapiens
ctccaggtgcagagg

SEQ ID NO: 3021988 - DNA, 15 bp, Homo sapiens
ctccagtccctggga

SEQ ID NO: 3021989 - DNA, 18 bp, Homo sapiens
ctccagtccctgggagca

SEQ ID NO: 3021990 - DNA, 14 bp, Homo sapiens
ctccagtcctgctg

SEQ ID NO: 3021991 - DNA, 16 bp, Homo sapiens
ctccagtcctgctggc

SEQ ID NO: 3021992 - DNA, 14 bp, Homo sapiens
ctccagtctgttct

SEQ ID NO: 3021993 - DNA, 16 bp, Homo sapiens
ctccagtctgttctca

SEQ ID NO: 3021994 - DNA, 19 bp, Homo sapiens
ctccagtctgttctcacat

SEQ ID NO: 3021995 - DNA, 14 bp, Homo sapiens
ctccagtgccaaca

SEQ ID NO: 3021996 - DNA, 23 bp, Homo sapiens
ctccagttttcgtattgcaaata

SEQ ID NO: 3021997 - DNA, 13 bp, Homo sapiens
ctccataagttta

SEQ ID NO: 3021998 - DNA, 18 bp, Homo sapiens
ctccataagtttaacttt

SEQ ID NO: 3021999 - DNA, 18 bp, Homo sapiens
ctccatactgggctaagg

SEQ ID NO: 3022000 - DNA, 13 bp, Homo sapiens
ctccatactttgg

SEQ ID NO: 3022001 - DNA, 20 bp, Homo sapiens
ctccatagtttggcatttgc

SEQ ID NO: 3022002 - DNA, 18 bp, Homo sapiens
ctccatccatctgtccgt

SEQ ID NO: 3022003 - DNA, 22 bp, Homo sapiens
ctccatcccattcacttctgca

SEQ ID NO: 3022004 - DNA, 18 bp, Homo sapiens
ctccatcctaccccctgt

SEQ ID NO: 3022005 - DNA, 20 bp, Homo sapiens
ctccatctctcatcctccag

SEQ ID NO: 3022006 - DNA, 17 bp, Homo sapiens
ctccatcttcagcttct

SEQ ID NO: 3022007 - DNA, 20 bp, Homo sapiens
ctccatgaggtactggtccc

SEQ ID NO: 3022008 - DNA, 15 bp, Homo sapiens
ctccatgcaagtgct

SEQ ID NO: 3022009 - DNA, 16 bp, Homo sapiens
ctccatgctttcacct

SEQ ID NO: 3022010 - DNA, 15 bp, Homo sapiens
ctccatggtcctgtc

SEQ ID NO: 3022011 - DNA, 21 bp, Homo sapiens
ctccatggtcctgtctgtcct

SEQ ID NO: 3022012 - DNA, 15 bp, Homo sapiens
ctccatggttctcaa

SEQ ID NO: 3022013 - DNA, 17 bp, Homo sapiens
ctccattcaatttcagg

SEQ ID NO: 3022014 - DNA, 18 bp, Homo sapiens
ctccatttctttcttcca

SEQ ID NO: 3022015 - DNA, 13 bp, Homo sapiens
ctccatttttgtt

SEQ ID NO: 3022016 - DNA, 15 bp, Homo sapiens
ctcccaaatgagcca

SEQ ID NO: 3022017 - DNA, 15 bp, Homo sapiens
ctcccaacgctgaag

SEQ ID NO: 3022018 - DNA, 17 bp, Homo sapiens
ctcccaacgctgaagcg

SEQ ID NO: 3022019 - DNA, 20 bp, Homo sapiens
ctcccaacgctgaagcggtc

SEQ ID NO: 3022020 - DNA, 13 bp, Homo sapiens
ctcccaactccct

SEQ ID NO: 3022021 - DNA, 17 bp, Homo sapiens
ctcccaagctggctggg

SEQ ID NO: 3022022 - DNA, 18 bp, Homo sapiens
ctcccaagctggctgggg

SEQ ID NO: 3022023 - DNA, 19 bp, Homo sapiens
ctcccaatttcagactccc

SEQ ID NO: 3022024 - DNA, 21 bp, Homo sapiens
ctcccacacccaaagctgagc

SEQ ID NO: 3022025 - DNA, 17 bp, Homo sapiens
ctcccacacttgtgcca

SEQ ID NO: 3022026 - DNA, 20 bp, Homo sapiens
ctcccacacttgtgccagcc

SEQ ID NO: 3022027 - DNA, 21 bp, Homo sapiens
ctcccacacttgtgccagccc

SEQ ID NO: 3022028 - DNA, 15 bp, Homo sapiens
ctcccacatcccact

SEQ ID NO: 3022029 - DNA, 21 bp, Homo sapiens
ctcccacatcccactggatct

SEQ ID NO: 3022030 - DNA, 13 bp, Homo sapiens
ctcccaccacccc

SEQ ID NO: 3022031 - DNA, 18 bp, Homo sapiens
ctcccacccagtctctgc

SEQ ID NO: 3022032 - DNA, 21 bp, Homo sapiens
ctcccacccagtctctgctcc

SEQ ID NO: 3022033 - DNA, 22 bp, Homo sapiens
ctcccacccagtctctgctcca

SEQ ID NO: 3022034 - DNA, 20 bp, Homo sapiens
ctcccaccctaagggcagcc

SEQ ID NO: 3022035 - DNA, 13 bp, Homo sapiens
ctcccacgggacc

SEQ ID NO: 3022036 - DNA, 18 bp, Homo sapiens
ctctactttgattctgat

SEQ ID NO: 3022037 - DNA, 15 bp, Homo sapiens
ctctagatgagctgg

SEQ ID NO: 3022038 - DNA, 21 bp, Homo sapiens
ctctaggaagacatttttccg

SEQ ID NO: 3022039 - DNA, 17 bp, Homo sapiens
ctctaggctctgccttc

SEQ ID NO: 3022040 - DNA, 12 bp, Homo sapiens
ctctagggcagg

SEQ ID NO: 3022041 - DNA, 16 bp, Homo sapiens
ctctagggcagggtgg

SEQ ID NO: 3022042 - DNA, 13 bp, Homo sapiens
ctctataaagtat

SEQ ID NO: 3022043 - DNA, 13 bp, Homo sapiens
ctctatcctctct

SEQ ID NO: 3022044 - DNA, 21 bp, Homo sapiens
ctctatcggggtcacttgcaa

SEQ ID NO: 3022045 - DNA, 16 bp, Homo sapiens
ctctatgagtctagat

SEQ ID NO: 3022046 - DNA, 19 bp, Homo sapiens
ctctatggggcatcctctt

SEQ ID NO: 3022047 - DNA, 15 bp, Homo sapiens
ctctatgtatattct

SEQ ID NO: 3022048 - DNA, 13 bp, Homo sapiens
ctctatgtgaata

SEQ ID NO: 3022049 - DNA, 18 bp, Homo sapiens
ctctattggatttgtcca

SEQ ID NO: 3022050 - DNA, 11 bp, Homo sapiens
ctctatttctt

SEQ ID NO: 3022051 - DNA, 15 bp, Homo sapiens
ctctatttttaatca

SEQ ID NO: 3022052 - DNA, 13 bp, Homo sapiens
ctctcaaatgtga

SEQ ID NO: 3022053 - DNA, 22 bp, Homo sapiens
ctctcaaatgtgaccatgtgaa

SEQ ID NO: 3022054 - DNA, 13 bp, Homo sapiens
ctctcacctcagc

SEQ ID NO: 3022055 - DNA, 15 bp, Homo sapiens
ctctcacctcagcct

SEQ ID NO: 3022056 - DNA, 16 bp, Homo sapiens
ctctcacgccaccccc

SEQ ID NO: 3022057 - DNA, 12 bp, Homo sapiens
ctctcactgtct

SEQ ID NO: 3022058 - DNA, 19 bp, Homo sapiens
ctctcagccccatcgcccc

SEQ ID NO: 3022059 - DNA, 16 bp, Homo sapiens
ctctcagctcccaggc

SEQ ID NO: 3022060 - DNA, 17 bp, Homo sapiens
ctctcagctcccaggcc

SEQ ID NO: 3022061 - DNA, 18 bp, Homo sapiens
ctctcagctcccaggcca

SEQ ID NO: 3022062 - DNA, 17 bp, Homo sapiens
ctctcagcttctaattt

SEQ ID NO: 3022063 - DNA, 21 bp, Homo sapiens
ctctcaggagccatcatcggc

SEQ ID NO: 3022064 - DNA, 16 bp, Homo sapiens
ctctcaggctgtccca

SEQ ID NO: 3022065 - DNA, 18 bp, Homo sapiens
ctctcaggctgtcccaag

SEQ ID NO: 3022066 - DNA, 13 bp, Homo sapiens
ctctcagtctctg

SEQ ID NO: 3022067 - DNA, 17 bp, Homo sapiens
ctctcagtctctgagca

SEQ ID NO: 3022068 - DNA, 16 bp, Homo sapiens
ctctcatatcactgaa

SEQ ID NO: 3022069 - DNA, 13 bp, Homo sapiens
ctctcatctcagg

SEQ ID NO: 3022070 - DNA, 14 bp, Homo sapiens
ctctcatctgaggc

SEQ ID NO: 3022071 - DNA, 15 bp, Homo sapiens
ctctcatctgaggca

SEQ ID NO: 3022072 - DNA, 16 bp, Homo sapiens
ctctcattccccaggt

SEQ ID NO: 3022073 - DNA, 20 bp, Homo sapiens
ctctcattccccaggtggct

SEQ ID NO: 3022074 - DNA, 15 bp, Homo sapiens
ctctccaaaaatgca

SEQ ID NO: 3022075 - DNA, 14 bp, Homo sapiens
ctctccaacctgga

SEQ ID NO: 3022076 - DNA, 21 bp, Homo sapiens
ctctccaactgcctaaggccc

SEQ ID NO: 3022077 - DNA, 15 bp, Homo sapiens
ctctccaaggaaatc

SEQ ID NO: 3022078 - DNA, 12 bp, Homo sapiens
ctctccacagga

SEQ ID NO: 3022079 - DNA, 14 bp, Homo sapiens
ctctccacaggagc

SEQ ID NO: 3022080 - DNA, 13 bp, Homo sapiens
ctctccacctcag

SEQ ID NO: 3022081 - DNA, 14 bp, Homo sapiens
ctctccacctcagc

SEQ ID NO: 3022082 - DNA, 20 bp, Homo sapiens
ctctccacctcagccttgga

SEQ ID NO: 3022083 - DNA, 12 bp, Homo sapiens
ctctccagcctc

SEQ ID NO: 3022084 - DNA, 12 bp, Homo sapiens
ctctccaggcca

SEQ ID NO: 3022085 - DNA, 16 bp, Homo sapiens
ctctccaggccaggtg

SEQ ID NO: 3022086 - DNA, 19 bp, Homo sapiens
ctctccatgcaagtgctgt

SEQ ID NO: 3022087 - DNA, 17 bp, Homo sapiens
ctctcccaacgctgaag

SEQ ID NO: 3022088 - DNA, 21 bp, Homo sapiens
ctctcccaacgctgaagcggt

SEQ ID NO: 3022089 - DNA, 18 bp, Homo sapiens
ctctcccaccctaagggc

SEQ ID NO: 3022090 - DNA, 19 bp, Homo sapiens
ctctcccaccctaagggca

SEQ ID NO: 3022091 - DNA, 11 bp, Homo sapiens
ctctcccaggg

SEQ ID NO: 3022092 - DNA, 19 bp, Homo sapiens
ctctcccattgtccctctg

SEQ ID NO: 3022093 - DNA, 17 bp, Homo sapiens
ctctcccatttcaggaa

SEQ ID NO: 3022094 - DNA, 20 bp, Homo sapiens
ctctccccaatatcctcgct

SEQ ID NO: 3022095 - DNA, 17 bp, Homo sapiens
ctctccccagcccagag

SEQ ID NO: 3022096 - DNA, 20 bp, Homo sapiens
ctctccccagcccagagaca

SEQ ID NO: 3022097 - DNA, 11 bp, Homo sapiens
ctctcccctcc

SEQ ID NO: 3022098 - DNA, 17 bp, Homo sapiens
ctctcccctccccatct

SEQ ID NO: 3022099 - DNA, 20 bp, Homo sapiens
ctctcccctccccatctgtg

SEQ ID NO: 3022100 - DNA, 13 bp, Homo sapiens
ctctccctacctt

SEQ ID NO: 3022101 - DNA, 17 bp, Homo sapiens
ctctccctaccttgcct

SEQ ID NO: 3022102 - DNA, 19 bp, Homo sapiens
ctctccctctggccctgcc

SEQ ID NO: 3022103 - DNA, 22 bp, Homo sapiens
ctctccctctggccctgccttc

SEQ ID NO: 3022104 - DNA, 17 bp, Homo sapiens
ctctccctctttctagc

SEQ ID NO: 3022105 - DNA, 20 bp, Homo sapiens
ctctccctgaccctgtatat

SEQ ID NO: 3022106 - DNA, 13 bp, Homo sapiens
ctctccctgcctc

SEQ ID NO: 3022107 - DNA, 14 bp, Homo sapiens
ctctccctgcctca

SEQ ID NO: 3022108 - DNA, 15 bp, Homo sapiens
ctctcccttcccttc

SEQ ID NO: 3022109 - DNA, 23 bp, Homo sapiens
ctctcccttcccttccctcaccc

SEQ ID NO: 3022110 - DNA, 14 bp, Homo sapiens
ctctcccttcttta

SEQ ID NO: 3022111 - DNA, 16 bp, Homo sapiens
ctctccgcgccctccg

SEQ ID NO: 3022112 - DNA, 17 bp, Homo sapiens
ctctcctccgtggcaca

SEQ ID NO: 3022113 - DNA, 19 bp, Homo sapiens
ctctcctccttgggcaggg

SEQ ID NO: 3022114 - DNA, 22 bp, Homo sapiens
ctctcctccttgggcagggtct

SEQ ID NO: 3022115 - DNA, 13 bp, Homo sapiens
ctctcctctccgc

SEQ ID NO: 3022116 - DNA, 13 bp, Homo sapiens
ctctcctgccaca

SEQ ID NO: 3022117 - DNA, 12 bp, Homo sapiens
ctctcctggacg

SEQ ID NO: 3022118 - DNA, 13 bp, Homo sapiens
ctctcctggacgc

SEQ ID NO: 3022119 - DNA, 16 bp, Homo sapiens
ctctcctggagggcgc

SEQ ID NO: 3022120 - DNA, 13 bp, Homo sapiens
ctctcctgtctga

SEQ ID NO: 3022121 - DNA, 16 bp, Homo sapiens
ctctccttcctcttgg

SEQ ID NO: 3022122 - DNA, 14 bp, Homo sapiens
ctctccttcctgtg

SEQ ID NO: 3022123 - DNA, 18 bp, Homo sapiens
ctctccttgttgccccca

SEQ ID NO: 3022124 - DNA, 18 bp, Homo sapiens
ctctcgcacctttccaaa

SEQ ID NO: 3022125 - DNA, 15 bp, Homo sapiens
ctctcgcatcttccc

SEQ ID NO: 3022126 - DNA, 21 bp, Homo sapiens
ctctcgctgccctgtggacag

SEQ ID NO: 3022127 - DNA, 15 bp, Homo sapiens
ctctcggccccatcg

SEQ ID NO: 3022128 - DNA, 14 bp, Homo sapiens
ctctcggtgctcca

SEQ ID NO: 3022129 - DNA, 20 bp, Homo sapiens
ctctcggtgctccatctccg

SEQ ID NO: 3022130 - DNA, 13 bp, Homo sapiens
ctctctaacataa

SEQ ID NO: 3022131 - DNA, 23 bp, Homo sapiens
ctctctatcggggtcacttgcaa

SEQ ID NO: 3022132 - DNA, 13 bp, Homo sapiens
ctctctattgtca

SEQ ID NO: 3022133 - DNA, 20 bp, Homo sapiens
ctctctcccaccctaagggc

SEQ ID NO: 3022134 - DNA, 23 bp, Homo sapiens
ctctctcccaccctaagggcagc

SEQ ID NO: 3022135 - DNA, 14 bp, Homo sapiens
ctctctcccatttc

SEQ ID NO: 3022136 - DNA, 13 bp, Homo sapiens
ctctctccctgcc

SEQ ID NO: 3022137 - DNA, 14 bp, Homo sapiens
ctctctcctcctgc

SEQ ID NO: 3022138 - DNA, 20 bp, Homo sapiens
ctctctcctcctgcccacct

SEQ ID NO: 3022139 - DNA, 20 bp, Homo sapiens
ctctctcctgtactttttcc

SEQ ID NO: 3022140 - DNA, 15 bp, Homo sapiens
ctctctcctgtccaa

SEQ ID NO: 3022141 - DNA, 13 bp, Homo sapiens
ctctctctccctc

SEQ ID NO: 3022142 - DNA, 13 bp, Homo sapiens
ctctctctctcta

SEQ ID NO: 3022143 - DNA, 18 bp, Homo sapiens
ctctctgcaccgtactgt

SEQ ID NO: 3022144 - DNA, 14 bp, Homo sapiens
ctctctgcctgctg

SEQ ID NO: 3022145 - DNA, 15 bp, Homo sapiens
ctctctgcctgctgg

SEQ ID NO: 3022146 - DNA, 22 bp, Homo sapiens
ctctctgctctgcgtgtcacct

SEQ ID NO: 3022147 - DNA, 12 bp, Homo sapiens
ctctctggagcc

SEQ ID NO: 3022148 - DNA, 19 bp, Homo sapiens
ctctctgtcccttgctgta

SEQ ID NO: 3022149 - DNA, 18 bp, Homo sapiens
ctctctgtctgtctctcc

SEQ ID NO: 3022150 - DNA, 17 bp, Homo sapiens
ctctctgtctttttcct

SEQ ID NO: 3022151 - DNA, 16 bp, Homo sapiens
ctctctgtggggctga

SEQ ID NO: 3022152 - DNA, 17 bp, Homo sapiens
ctctctgtggggctgaa

SEQ ID NO: 3022153 - DNA, 24 bp, Homo sapiens
ctctcttcactgctacatgtgctg

SEQ ID NO: 3022154 - DNA, 11 bp, Homo sapiens
ctctcttccct

SEQ ID NO: 3022155 - DNA, 13 bp, Homo sapiens
ctctcttcccttt

SEQ ID NO: 3022156 - DNA, 19 bp, Homo sapiens
ctctcttgttgtccaggct

SEQ ID NO: 3022157 - DNA, 13 bp, Homo sapiens
ctctgaaacagct

SEQ ID NO: 3022158 - DNA, 19 bp, Homo sapiens
ctctgaaacagctgcctta

SEQ ID NO: 3022159 - DNA, 23 bp, Homo sapiens
ctctgaaacagctgccttagctt

SEQ ID NO: 3022160 - DNA, 17 bp, Homo sapiens
ctctgaaagttgtacat

SEQ ID NO: 3022161 - DNA, 22 bp, Homo sapiens
ctctgaaagttgtacatgaaat

SEQ ID NO: 3022162 - DNA, 23 bp, Homo sapiens
ctctgaaatagccgaactccagg

SEQ ID NO: 3022163 - DNA, 21 bp, Homo sapiens
ctctgaagagtgggtttcaca

SEQ ID NO: 3022164 - DNA, 15 bp, Homo sapiens
ctctgaagcaaggcg

SEQ ID NO: 3022165 - DNA, 19 bp, Homo sapiens
ctctgaatttgagatacaa

SEQ ID NO: 3022166 - DNA, 15 bp, Homo sapiens
ctctgacagcagcct

SEQ ID NO: 3022167 - DNA, 16 bp, Homo sapiens
ctctgacagcagcctg

SEQ ID NO: 3022168 - DNA, 17 bp, Homo sapiens
ctctgaccgaaacagcg

SEQ ID NO: 3022169 - DNA, 14 bp, Homo sapiens
ctctgactcagggc

SEQ ID NO: 3022170 - DNA, 18 bp, Homo sapiens
ctgacccggattggccct

SEQ ID NO: 3022171 - DNA, 22 bp, Homo sapiens
ctgacccggattggccctgccc

SEQ ID NO: 3022172 - DNA, 19 bp, Homo sapiens
ctgaccctgggcctggagg

SEQ ID NO: 3022173 - DNA, 13 bp, Homo sapiens
ctgaccctgggct

SEQ ID NO: 3022174 - DNA, 13 bp, Homo sapiens
ctgaccctgtgcc

SEQ ID NO: 3022175 - DNA, 16 bp, Homo sapiens
ctgaccctgtgcccca

SEQ ID NO: 3022176 - DNA, 13 bp, Homo sapiens
ctgaccctgtgga

SEQ ID NO: 3022177 - DNA, 20 bp, Homo sapiens
ctgacccttacagcctctga

SEQ ID NO: 3022178 - DNA, 20 bp, Homo sapiens
ctgaccgaaacagcgctggg

SEQ ID NO: 3022179 - DNA, 16 bp, Homo sapiens
ctgaccgctgcccagg

SEQ ID NO: 3022180 - DNA, 18 bp, Homo sapiens
ctgaccgctgcccaggtg

SEQ ID NO: 3022181 - DNA, 12 bp, Homo sapiens
ctgacctcacct

SEQ ID NO: 3022182 - DNA, 14 bp, Homo sapiens
ctgacctccacagc

SEQ ID NO: 3022183 - DNA, 19 bp, Homo sapiens
ctgacctccagtcctgctg

SEQ ID NO: 3022184 - DNA, 22 bp, Homo sapiens
ctgacctccagtcctgctggcc

SEQ ID NO: 3022185 - DNA, 23 bp, Homo sapiens
ctgacctccagtcctgctggcct

SEQ ID NO: 3022186 - DNA, 17 bp, Homo sapiens
ctgacctgccagccggt

SEQ ID NO: 3022187 - DNA, 16 bp, Homo sapiens
ctgacctggtccacag

SEQ ID NO: 3022188 - DNA, 20 bp, Homo sapiens
ctgacctggtccacagggca

SEQ ID NO: 3022189 - DNA, 15 bp, Homo sapiens
ctgacctgtccaggt

SEQ ID NO: 3022190 - DNA, 22 bp, Homo sapiens
ctgaccttcagctcacgcttca

SEQ ID NO: 3022191 - DNA, 19 bp, Homo sapiens
ctgaccttgtaaaagacag

SEQ ID NO: 3022192 - DNA, 20 bp, Homo sapiens
ctgacggccagggagaagct

SEQ ID NO: 3022193 - DNA, 16 bp, Homo sapiens
ctgactacattttttc

SEQ ID NO: 3022194 - DNA, 14 bp, Homo sapiens
ctgactcagggctc

SEQ ID NO: 3022195 - DNA, 16 bp, Homo sapiens
ctgactccctccccac

SEQ ID NO: 3022196 - DNA, 18 bp, Homo sapiens
ctgactccctccccaccc

SEQ ID NO: 3022197 - DNA, 19 bp, Homo sapiens
ctgactccctccccaccca

SEQ ID NO: 3022198 - DNA, 20 bp, Homo sapiens
ctgactccctccccacccaa

SEQ ID NO: 3022199 - DNA, 23 bp, Homo sapiens
ctgactccctccccacccaagag

SEQ ID NO: 3022200 - DNA, 21 bp, Homo sapiens
ctgactctaggtgcccttgga

SEQ ID NO: 3022201 - DNA, 15 bp, Homo sapiens
ctgactctctgagct

SEQ ID NO: 3022202 - DNA, 16 bp, Homo sapiens
ctgactgaactagagc

SEQ ID NO: 3022203 - DNA, 12 bp, Homo sapiens
ctgactgggagt

SEQ ID NO: 3022204 - DNA, 18 bp, Homo sapiens
ctgactgggctgggtttg

SEQ ID NO: 3022205 - DNA, 18 bp, Homo sapiens
ctgactgtcagggagggc

SEQ ID NO: 3022206 - DNA, 21 bp, Homo sapiens
ctgacttccccgcattccagg

SEQ ID NO: 3022207 - DNA, 23 bp, Homo sapiens
ctgacttccccgcattccaggct

SEQ ID NO: 3022208 - DNA, 22 bp, Homo sapiens
ctgacttgtgttcatgtggagt

SEQ ID NO: 3022209 - DNA, 14 bp, Homo sapiens
ctgactttgctctt

SEQ ID NO: 3022210 - DNA, 21 bp, Homo sapiens
ctgacttttaatgtcatttgt

SEQ ID NO: 3022211 - DNA, 19 bp, Homo sapiens
ctgactttttgtttctttg

SEQ ID NO: 3022212 - DNA, 21 bp, Homo sapiens
ctgagaaacactatttgtgac

SEQ ID NO: 3022213 - DNA, 19 bp, Homo sapiens
ctgagaaacgtccatctct

SEQ ID NO: 3022214 - DNA, 12 bp, Homo sapiens
ctgagaaactct

SEQ ID NO: 3022215 - DNA, 18 bp, Homo sapiens
ctgagaaagcccacctgg

SEQ ID NO: 3022216 - DNA, 19 bp, Homo sapiens
ctgagaaagcccacctggg

SEQ ID NO: 3022217 - DNA, 16 bp, Homo sapiens
ctgagaaagccctgtc

SEQ ID NO: 3022218 - DNA, 16 bp, Homo sapiens
ctgagaagaggaggag

SEQ ID NO: 3022219 - DNA, 21 bp, Homo sapiens
ctgagacaggagaatcacctg

SEQ ID NO: 3022220 - DNA, 21 bp, Homo sapiens
ctgagacccaggactcctccc

SEQ ID NO: 3022221 - DNA, 19 bp, Homo sapiens
ctgagagacccaaggagga

SEQ ID NO: 3022222 - DNA, 23 bp, Homo sapiens
ctgagagagaatagagctgccac

SEQ ID NO: 3022223 - DNA, 13 bp, Homo sapiens
ctgagagaggcca

SEQ ID NO: 3022224 - DNA, 19 bp, Homo sapiens
ctgagatcgtgccactgca

SEQ ID NO: 3022225 - DNA, 20 bp, Homo sapiens
ctgagatttcttaaatcttt

SEQ ID NO: 3022226 - DNA, 14 bp, Homo sapiens
ctgagcaaagcatc

SEQ ID NO: 3022227 - DNA, 24 bp, Homo sapiens
ctgagcaaggagtttaaatgagac

SEQ ID NO: 3022228 - DNA, 11 bp, Homo sapiens
ctgagcacaga

SEQ ID NO: 3022229 - DNA, 13 bp, Homo sapiens
ctgagcacagatg

SEQ ID NO: 3022230 - DNA, 18 bp, Homo sapiens
ctgagcagggttgccttt

SEQ ID NO: 3022231 - DNA, 18 bp, Homo sapiens
ctgagcagtccctgctta

SEQ ID NO: 3022232 - DNA, 15 bp, Homo sapiens
ctgagcagtctactt

SEQ ID NO: 3022233 - DNA, 23 bp, Homo sapiens
ctgagcagtctacttctgtgtct

SEQ ID NO: 3022234 - DNA, 15 bp, Homo sapiens
ctgagcattcaggca

SEQ ID NO: 3022235 - DNA, 18 bp, Homo sapiens
ctgagcattcaggcagca

SEQ ID NO: 3022236 - DNA, 17 bp, Homo sapiens
ctgagccaaagccagag

SEQ ID NO: 3022237 - DNA, 20 bp, Homo sapiens
ctgagccaaagccagagtgg

SEQ ID NO: 3022238 - DNA, 21 bp, Homo sapiens
ctgagccaaagccagagtggc

SEQ ID NO: 3022239 - DNA, 16 bp, Homo sapiens
ctgagccagcaccgcc

SEQ ID NO: 3022240 - DNA, 23 bp, Homo sapiens
ctgagccaggctagctggagcct

SEQ ID NO: 3022241 - DNA, 16 bp, Homo sapiens
ctgagcccctgtctag

SEQ ID NO: 3022242 - DNA, 18 bp, Homo sapiens
ctgagcctctgctcccca

SEQ ID NO: 3022243 - DNA, 14 bp, Homo sapiens
ctgagcctgcaggg

SEQ ID NO: 3022244 - DNA, 14 bp, Homo sapiens
ctgagcgaggaaaa

SEQ ID NO: 3022245 - DNA, 19 bp, Homo sapiens
ctgagcgaggaaaaacaac

SEQ ID NO: 3022246 - DNA, 20 bp, Homo sapiens
ctgagcgaggagatgctcct

SEQ ID NO: 3022247 - DNA, 13 bp, Homo sapiens
ctgagcgcaagcc

SEQ ID NO: 3022248 - DNA, 21 bp, Homo sapiens
ctgagcgcaagccacagcctg

SEQ ID NO: 3022249 - DNA, 20 bp, Homo sapiens
ctgagcggccgcagagactg

SEQ ID NO: 3022250 - DNA, 21 bp, Homo sapiens
ctgagcggccgcagagactgg

SEQ ID NO: 3022251 - DNA, 22 bp, Homo sapiens
ctgagctcgcagcccccgcgcc

SEQ ID NO: 3022252 - DNA, 13 bp, Homo sapiens
ctgagctctccag

SEQ ID NO: 3022253 - DNA, 14 bp, Homo sapiens
ctgagctctccagg

SEQ ID NO: 3022254 - DNA, 15 bp, Homo sapiens
ctgagctctccaggc

SEQ ID NO: 3022255 - DNA, 16 bp, Homo sapiens
ctgagctctccaggcc

SEQ ID NO: 3022256 - DNA, 18 bp, Homo sapiens
ctgagctctccaggccag

SEQ ID NO: 3022257 - DNA, 17 bp, Homo sapiens
ctgagctctgcctcaac

SEQ ID NO: 3022258 - DNA, 18 bp, Homo sapiens
ctgagctctgcctcaact

SEQ ID NO: 3022259 - DNA, 15 bp, Homo sapiens
ctgagctgaccagcc

SEQ ID NO: 3022260 - DNA, 14 bp, Homo sapiens
ctgagctgagccag

SEQ ID NO: 3022261 - DNA, 16 bp, Homo sapiens
ctgagctgagccaggc

SEQ ID NO: 3022262 - DNA, 17 bp, Homo sapiens
ctgagctgagccaggct

SEQ ID NO: 3022263 - DNA, 12 bp, Homo sapiens
ctgagctgaggc

SEQ ID NO: 3022264 - DNA, 13 bp, Homo sapiens
ctgagctgaggca

SEQ ID NO: 3022265 - DNA, 15 bp, Homo sapiens
ctgagctgaggcagc

SEQ ID NO: 3022266 - DNA, 18 bp, Homo sapiens
ctgagctgaggcagcagt

SEQ ID NO: 3022267 - DNA, 14 bp, Homo sapiens
ctgagctgctaaaa

SEQ ID NO: 3022268 - DNA, 18 bp, Homo sapiens
ctgagctgctaaaataaa

SEQ ID NO: 3022269 - DNA, 14 bp, Homo sapiens
ctgagctggggagg

SEQ ID NO: 3022270 - DNA, 22 bp, Homo sapiens
ctgagctggggaggtgggaggc

SEQ ID NO: 3022271 - DNA, 14 bp, Homo sapiens
ctgagctgtcccaa

SEQ ID NO: 3022272 - DNA, 22 bp, Homo sapiens
ctgagctgtgacattgctggtc

SEQ ID NO: 3022273 - DNA, 13 bp, Homo sapiens
ctgagctgtgcag

SEQ ID NO: 3022274 - DNA, 20 bp, Homo sapiens
ctgagcttggaagcttctgg

SEQ ID NO: 3022275 - DNA, 21 bp, Homo sapiens
ctgagcttggaagcttctggt

SEQ ID NO: 3022276 - DNA, 16 bp, Homo sapiens
ctgagctttagacagc

SEQ ID NO: 3022277 - DNA, 21 bp, Homo sapiens
ctgagctttagacagcagagc

SEQ ID NO: 3022278 - DNA, 12 bp, Homo sapiens
ctgagctttgtt

SEQ ID NO: 3022279 - DNA, 13 bp, Homo sapiens
ctgaggacagctg

SEQ ID NO: 3022280 - DNA, 14 bp, Homo sapiens
ctgaggacagctgt

SEQ ID NO: 3022281 - DNA, 16 bp, Homo sapiens
ctgaggagccctctcg

SEQ ID NO: 3022282 - DNA, 17 bp, Homo sapiens
ctgaggatcccctgtcc

SEQ ID NO: 3022283 - DNA, 19 bp, Homo sapiens
ctgaggatcccctgtcccc

SEQ ID NO: 3022284 - DNA, 22 bp, Homo sapiens
ctgaggatcccctgtcccctgg

SEQ ID NO: 3022285 - DNA, 15 bp, Homo sapiens
ctgaggatgagacag

SEQ ID NO: 3022286 - DNA, 17 bp, Homo sapiens
ctgaggcagcagtgtga

SEQ ID NO: 3022287 - DNA, 22 bp, Homo sapiens
ctgaggcagcagtgtgaggcca

SEQ ID NO: 3022288 - DNA, 14 bp, Homo sapiens
ctgaggcagggaag

SEQ ID NO: 3022289 - DNA, 16 bp, Homo sapiens
ctgaggcagggaagtc

SEQ ID NO: 3022290 - DNA, 20 bp, Homo sapiens
ctgaggcagggaagtcccca

SEQ ID NO: 3022291 - DNA, 22 bp, Homo sapiens
ctgaggcagggaagtccccagg

SEQ ID NO: 3022292 - DNA, 15 bp, Homo sapiens
ctgaggcatccagca

SEQ ID NO: 3022293 - DNA, 20 bp, Homo sapiens
ctgaggcatccagcagtctc

SEQ ID NO: 3022294 - DNA, 14 bp, Homo sapiens
ctgaggccacactc

SEQ ID NO: 3022295 - DNA, 11 bp, Homo sapiens
ctgaggcctcc

SEQ ID NO: 3022296 - DNA, 14 bp, Homo sapiens
ctgaggcctgagac

SEQ ID NO: 3022297 - DNA, 15 bp, Homo sapiens
ctgaggcctgagacc

SEQ ID NO: 3022298 - DNA, 18 bp, Homo sapiens
ctgaggcctgagacccag

SEQ ID NO: 3022299 - DNA, 22 bp, Homo sapiens
ctgaggccttgtgtgtcaggcc

SEQ ID NO: 3022300 - DNA, 23 bp, Homo sapiens
ctgaggccttgtgtgtcaggccc

SEQ ID NO: 3022301 - DNA, 13 bp, Homo sapiens
ctgagggaccctt

SEQ ID NO: 3022302 - DNA, 18 bp, Homo sapiens
ctgcctgagtattactag

SEQ ID NO: 3022303 - DNA, 19 bp, Homo sapiens
ctgcctgagtattactagt

SEQ ID NO: 3022304 - DNA, 15 bp, Homo sapiens
ctgcctgcagcacat

SEQ ID NO: 3022305 - DNA, 21 bp, Homo sapiens
ctgcctgccagctgcactgat

SEQ ID NO: 3022306 - DNA, 12 bp, Homo sapiens
ctgcctgcccac

SEQ ID NO: 3022307 - DNA, 18 bp, Homo sapiens
ctgcctgccctctgtctg

SEQ ID NO: 3022308 - DNA, 17 bp, Homo sapiens
ctgcctgctgtgctggg

SEQ ID NO: 3022309 - DNA, 16 bp, Homo sapiens
ctgcctggagcagggg

SEQ ID NO: 3022310 - DNA, 13 bp, Homo sapiens
ctgcctggagccc

SEQ ID NO: 3022311 - DNA, 18 bp, Homo sapiens
ctgcctggagtgctgtgc

SEQ ID NO: 3022312 - DNA, 20 bp, Homo sapiens
ctgcctggagtgctgtgctg

SEQ ID NO: 3022313 - DNA, 18 bp, Homo sapiens
ctgcctggccggccagcc

SEQ ID NO: 3022314 - DNA, 23 bp, Homo sapiens
ctgcctgggctgaccccggtggc

SEQ ID NO: 3022315 - DNA, 15 bp, Homo sapiens
ctgcctgtagcccac

SEQ ID NO: 3022316 - DNA, 23 bp, Homo sapiens
ctgcctgttgcgtgacactctcc

SEQ ID NO: 3022317 - DNA, 12 bp, Homo sapiens
ctgccttagcct

SEQ ID NO: 3022318 - DNA, 17 bp, Homo sapiens
ctgccttagcttcagga

SEQ ID NO: 3022319 - DNA, 15 bp, Homo sapiens
ctgccttcctcctgg

SEQ ID NO: 3022320 - DNA, 18 bp, Homo sapiens
ctgccttcctcctgggcc

SEQ ID NO: 3022321 - DNA, 21 bp, Homo sapiens
ctgccttcctcctgggccctc

SEQ ID NO: 3022322 - DNA, 13 bp, Homo sapiens
ctgccttcgttta

SEQ ID NO: 3022323 - DNA, 24 bp, Homo sapiens
ctgccttcttcggggaactcctgg

SEQ ID NO: 3022324 - DNA, 14 bp, Homo sapiens
ctgccttggcctcc

SEQ ID NO: 3022325 - DNA, 17 bp, Homo sapiens
ctgccttggcctcccaa

SEQ ID NO: 3022326 - DNA, 18 bp, Homo sapiens
ctgccttggctcagacat

SEQ ID NO: 3022327 - DNA, 22 bp, Homo sapiens
ctgccttggctcagacatgttt

SEQ ID NO: 3022328 - DNA, 20 bp, Homo sapiens
ctgcctttgcaccacgggac

SEQ ID NO: 3022329 - DNA, 16 bp, Homo sapiens
ctgcctttgcctccag

SEQ ID NO: 3022330 - DNA, 21 bp, Homo sapiens
ctgcctttgcctccagaagca

SEQ ID NO: 3022331 - DNA, 13 bp, Homo sapiens
ctgcgaccctggg

SEQ ID NO: 3022332 - DNA, 15 bp, Homo sapiens
ctgcgaccctggggg

SEQ ID NO: 3022333 - DNA, 21 bp, Homo sapiens
ctgcgaccctgggggcacagg

SEQ ID NO: 3022334 - DNA, 20 bp, Homo sapiens
ctgcgatccggcagcctctc

SEQ ID NO: 3022335 - DNA, 15 bp, Homo sapiens
ctgcgcacaggtggg

SEQ ID NO: 3022336 - DNA, 18 bp, Homo sapiens
ctgcgccaggcagagctg

SEQ ID NO: 3022337 - DNA, 18 bp, Homo sapiens
ctgcgcccagtccttcca

SEQ ID NO: 3022338 - DNA, 23 bp, Homo sapiens
ctgcgcccagtccttccacctcg

SEQ ID NO: 3022339 - DNA, 15 bp, Homo sapiens
ctgcgctcggcagga

SEQ ID NO: 3022340 - DNA, 17 bp, Homo sapiens
ctgcgctttattttctt

SEQ ID NO: 3022341 - DNA, 19 bp, Homo sapiens
ctgcgctttgaacgtgcca

SEQ ID NO: 3022342 - DNA, 17 bp, Homo sapiens
ctgcggacaccgtggcc

SEQ ID NO: 3022343 - DNA, 21 bp, Homo sapiens
ctgcggacaccgtggcctggg

SEQ ID NO: 3022344 - DNA, 20 bp, Homo sapiens
ctgcggatagcatttggtag

SEQ ID NO: 3022345 - DNA, 14 bp, Homo sapiens
ctgcggcccgggcc

SEQ ID NO: 3022346 - DNA, 17 bp, Homo sapiens
ctgcggcgcgggcccct

SEQ ID NO: 3022347 - DNA, 13 bp, Homo sapiens
ctgcgggccacag

SEQ ID NO: 3022348 - DNA, 15 bp, Homo sapiens
ctgcgggccacaggg

SEQ ID NO: 3022349 - DNA, 16 bp, Homo sapiens
ctgcgggccacagggc

SEQ ID NO: 3022350 - DNA, 13 bp, Homo sapiens
ctgcgggctgagg

SEQ ID NO: 3022351 - DNA, 19 bp, Homo sapiens
ctgcgggtcctcagctgct

SEQ ID NO: 3022352 - DNA, 23 bp, Homo sapiens
ctgcggtacaggagtcagccatg

SEQ ID NO: 3022353 - DNA, 13 bp, Homo sapiens
ctgcggtgggcag

SEQ ID NO: 3022354 - DNA, 15 bp, Homo sapiens
ctgcggtgggcagcc

SEQ ID NO: 3022355 - DNA, 23 bp, Homo sapiens
ctgcgtaactccatctgacaaat

SEQ ID NO: 3022356 - DNA, 14 bp, Homo sapiens
ctgcgtccaccagg

SEQ ID NO: 3022357 - DNA, 17 bp, Homo sapiens
ctgctacaaagaagaca

SEQ ID NO: 3022358 - DNA, 22 bp, Homo sapiens
ctgctacaaagaagacatgttt

SEQ ID NO: 3022359 - DNA, 12 bp, Homo sapiens
ctgctacacttc

SEQ ID NO: 3022360 - DNA, 18 bp, Homo sapiens
ctgctacctttcaaagct

SEQ ID NO: 3022361 - DNA, 15 bp, Homo sapiens
ctgctactgcccctc

SEQ ID NO: 3022362 - DNA, 18 bp, Homo sapiens
ctgctactgcccctctcc

SEQ ID NO: 3022363 - DNA, 19 bp, Homo sapiens
ctgctactgcccctctccg

SEQ ID NO: 3022364 - DNA, 17 bp, Homo sapiens
ctgctactggcaaaagg

SEQ ID NO: 3022365 - DNA, 21 bp, Homo sapiens
ctgctagagcagacaggcctg

SEQ ID NO: 3022366 - DNA, 22 bp, Homo sapiens
ctgctagagcagacaggcctgg

SEQ ID NO: 3022367 - DNA, 13 bp, Homo sapiens
ctgctagcaggcc

SEQ ID NO: 3022368 - DNA, 16 bp, Homo sapiens
ctgctagcaggccccc

SEQ ID NO: 3022369 - DNA, 14 bp, Homo sapiens
ctgctatagcctgg

SEQ ID NO: 3022370 - DNA, 15 bp, Homo sapiens
ctgctatagcctggg

SEQ ID NO: 3022371 - DNA, 15 bp, Homo sapiens
ctgctatcattattc

SEQ ID NO: 3022372 - DNA, 22 bp, Homo sapiens
ctgctatctactaagtttcctt

SEQ ID NO: 3022373 - DNA, 21 bp, Homo sapiens
ctgctatgaaaggaataaaac

SEQ ID NO: 3022374 - DNA, 22 bp, Homo sapiens
ctgctcaatgccattgtgcaga

SEQ ID NO: 3022375 - DNA, 19 bp, Homo sapiens
ctgctcacggaccccatgt

SEQ ID NO: 3022376 - DNA, 15 bp, Homo sapiens
ctgctcagagccaag

SEQ ID NO: 3022377 - DNA, 23 bp, Homo sapiens
ctgctcagagccaagggggcaga

SEQ ID NO: 3022378 - DNA, 20 bp, Homo sapiens
ctgctcagctgcgtcatggg

SEQ ID NO: 3022379 - DNA, 15 bp, Homo sapiens
ctgctcagcttctcc

SEQ ID NO: 3022380 - DNA, 23 bp, Homo sapiens
ctgctcaggaattgaagatgtaa

SEQ ID NO: 3022381 - DNA, 22 bp, Homo sapiens
ctgctcagggaaaagcagctct

SEQ ID NO: 3022382 - DNA, 23 bp, Homo sapiens
ctgctcagggaaaagcagctctc

SEQ ID NO: 3022383 - DNA, 14 bp, Homo sapiens
ctgctcatactggt

SEQ ID NO: 3022384 - DNA, 17 bp, Homo sapiens
ctgctcatcattctctg

SEQ ID NO: 3022385 - DNA, 18 bp, Homo sapiens
ctgctcatcattctctgt

SEQ ID NO: 3022386 - DNA, 22 bp, Homo sapiens
ctgctcatcattctctgtctca

SEQ ID NO: 3022387 - DNA, 18 bp, Homo sapiens
ctgctcattccacactgt

SEQ ID NO: 3022388 - DNA, 14 bp, Homo sapiens
ctgctccagacctg

SEQ ID NO: 3022389 - DNA, 22 bp, Homo sapiens
ctgctccagacctgatcctgga

SEQ ID NO: 3022390 - DNA, 17 bp, Homo sapiens
ctgctcccacacttgtg

SEQ ID NO: 3022391 - DNA, 20 bp, Homo sapiens
ctgctcccacacttgtgcca

SEQ ID NO: 3022392 - DNA, 15 bp, Homo sapiens
ctgctccccacccct

SEQ ID NO: 3022393 - DNA, 21 bp, Homo sapiens
ctgctcccccaccccctcccc

SEQ ID NO: 3022394 - DNA, 12 bp, Homo sapiens
ctgctccctctc

SEQ ID NO: 3022395 - DNA, 14 bp, Homo sapiens
ctgctccgctgcct

SEQ ID NO: 3022396 - DNA, 15 bp, Homo sapiens
ctgctccgctgcctg

SEQ ID NO: 3022397 - DNA, 16 bp, Homo sapiens
ctgctccgctgcctgg

SEQ ID NO: 3022398 - DNA, 17 bp, Homo sapiens
ctgctccgctgcctgga

SEQ ID NO: 3022399 - DNA, 14 bp, Homo sapiens
ctgctcctagaggg

SEQ ID NO: 3022400 - DNA, 13 bp, Homo sapiens
ctgctcctccagg

SEQ ID NO: 3022401 - DNA, 14 bp, Homo sapiens
ctgctcctccaggg

SEQ ID NO: 3022402 - DNA, 24 bp, Homo sapiens
ctgctcctccagggccacgtgcca

SEQ ID NO: 3022403 - DNA, 23 bp, Homo sapiens
ctgctcgaaatggcccctgtctt

SEQ ID NO: 3022404 - DNA, 16 bp, Homo sapiens
ctgctcgccttagcac

SEQ ID NO: 3022405 - DNA, 22 bp, Homo sapiens
ctgctctagatgagctgggccg

SEQ ID NO: 3022406 - DNA, 20 bp, Homo sapiens
ctgctctctttttctccagg

SEQ ID NO: 3022407 - DNA, 14 bp, Homo sapiens
ctgctctgcacggt

SEQ ID NO: 3022408 - DNA, 21 bp, Homo sapiens
ctgctctgcacggtctgcggc

SEQ ID NO: 3022409 - DNA, 16 bp, Homo sapiens
ctgctcttacttcccc

SEQ ID NO: 3022410 - DNA, 18 bp, Homo sapiens
ctgctcttacttccccca

SEQ ID NO: 3022411 - DNA, 18 bp, Homo sapiens
ctgctcttttactaagac

SEQ ID NO: 3022412 - DNA, 17 bp, Homo sapiens
ctgctgaagctgctgca

SEQ ID NO: 3022413 - DNA, 22 bp, Homo sapiens
ctgctgaatgatttccaaagag

SEQ ID NO: 3022414 - DNA, 19 bp, Homo sapiens
ctgctgacctccacagctt

SEQ ID NO: 3022415 - DNA, 15 bp, Homo sapiens
ctgctgagactgagc

SEQ ID NO: 3022416 - DNA, 15 bp, Homo sapiens
ctgctgagagaccca

SEQ ID NO: 3022417 - DNA, 22 bp, Homo sapiens
ctgctgagagacccaaggagga

SEQ ID NO: 3022418 - DNA, 18 bp, Homo sapiens
ctgctgagagtactgtcc

SEQ ID NO: 3022419 - DNA, 13 bp, Homo sapiens
ctgctgatataat

SEQ ID NO: 3022420 - DNA, 12 bp, Homo sapiens
ctgctgatgcag

SEQ ID NO: 3022421 - DNA, 16 bp, Homo sapiens
ctgctgatgcgctggg

SEQ ID NO: 3022422 - DNA, 15 bp, Homo sapiens
ctgctgcacatagca

SEQ ID NO: 3022423 - DNA, 20 bp, Homo sapiens
ctgctgcacatagcagacta

SEQ ID NO: 3022424 - DNA, 21 bp, Homo sapiens
ctgctgcacatagcagactag

SEQ ID NO: 3022425 - DNA, 13 bp, Homo sapiens
ctgctgcagccct

SEQ ID NO: 3022426 - DNA, 18 bp, Homo sapiens
ctgctgcagccctgccag

SEQ ID NO: 3022427 - DNA, 13 bp, Homo sapiens
ctgctgcccctcc

SEQ ID NO: 3022428 - DNA, 19 bp, Homo sapiens
ctgctgcccctccctgcct

SEQ ID NO: 3022429 - DNA, 11 bp, Homo sapiens
ctgctgcctca

SEQ ID NO: 3022430 - DNA, 12 bp, Homo sapiens
ctgctgcctcag

SEQ ID NO: 3022431 - DNA, 14 bp, Homo sapiens
ctgctgctcctctt

SEQ ID NO: 3022432 - DNA, 19 bp, Homo sapiens
ctgctgctgccagggcttc

SEQ ID NO: 3022433 - DNA, 14 bp, Homo sapiens
ctgctgctgtgctt

SEQ ID NO: 3022434 - DNA, 17 bp, Homo sapiens
ctgggctctccacctca

SEQ ID NO: 3022435 - DNA, 14 bp, Homo sapiens
ctgggctctggctc

SEQ ID NO: 3022436 - DNA, 12 bp, Homo sapiens
ctgggctgagcc

SEQ ID NO: 3022437 - DNA, 18 bp, Homo sapiens
ctgggctgagccaaagcc

SEQ ID NO: 3022438 - DNA, 12 bp, Homo sapiens
ctgggctgaggg

SEQ ID NO: 3022439 - DNA, 16 bp, Homo sapiens
ctgggctgagggagcc

SEQ ID NO: 3022440 - DNA, 18 bp, Homo sapiens
ctgggctgagggagcctg

SEQ ID NO: 3022441 - DNA, 23 bp, Homo sapiens
ctgggctgagggagcctggcccc

SEQ ID NO: 3022442 - DNA, 18 bp, Homo sapiens
ctggggaaagacactgcc

SEQ ID NO: 3022443 - DNA, 19 bp, Homo sapiens
ctggggaaataacagctgt

SEQ ID NO: 3022444 - DNA, 19 bp, Homo sapiens
ctggggaagtacgtcccag

SEQ ID NO: 3022445 - DNA, 22 bp, Homo sapiens
ctggggaagtacgtcccagcgg

SEQ ID NO: 3022446 - DNA, 12 bp, Homo sapiens
ctggggacccac

SEQ ID NO: 3022447 - DNA, 21 bp, Homo sapiens
ctggggacgctccgctgccgt

SEQ ID NO: 3022448 - DNA, 21 bp, Homo sapiens
ctggggagaaagaggggcctg

SEQ ID NO: 3022449 - DNA, 18 bp, Homo sapiens
ctggggaggctgaggcag

SEQ ID NO: 3022450 - DNA, 20 bp, Homo sapiens
ctggggaggctgaggcagga

SEQ ID NO: 3022451 - DNA, 16 bp, Homo sapiens
ctggggaggtgggagg

SEQ ID NO: 3022452 - DNA, 18 bp, Homo sapiens
ctggggaggtgggaggcc

SEQ ID NO: 3022453 - DNA, 22 bp, Homo sapiens
ctggggaggtgggaggccaggc

SEQ ID NO: 3022454 - DNA, 18 bp, Homo sapiens
ctggggatgtgctttgtg

SEQ ID NO: 3022455 - DNA, 18 bp, Homo sapiens
ctggggcactcccccagg

SEQ ID NO: 3022456 - DNA, 12 bp, Homo sapiens
ctggggccaggc

SEQ ID NO: 3022457 - DNA, 21 bp, Homo sapiens
ctggggcgggcagccaggctg

SEQ ID NO: 3022458 - DNA, 19 bp, Homo sapiens
ctggggctaggctggagcc

SEQ ID NO: 3022459 - DNA, 18 bp, Homo sapiens
ctggggctagggggagcc

SEQ ID NO: 3022460 - DNA, 13 bp, Homo sapiens
ctggggctgagtc

SEQ ID NO: 3022461 - DNA, 14 bp, Homo sapiens
ctggggctggcctc

SEQ ID NO: 3022462 - DNA, 18 bp, Homo sapiens
ctggggctggcctcccaa

SEQ ID NO: 3022463 - DNA, 15 bp, Homo sapiens
ctggggcttgaattt

SEQ ID NO: 3022464 - DNA, 17 bp, Homo sapiens
ctgggggaagccctgga

SEQ ID NO: 3022465 - DNA, 20 bp, Homo sapiens
ctgggggacccaatgtagga

SEQ ID NO: 3022466 - DNA, 17 bp, Homo sapiens
ctgggggacccctggct

SEQ ID NO: 3022467 - DNA, 21 bp, Homo sapiens
ctgggggacccctggctctgg

SEQ ID NO: 3022468 - DNA, 19 bp, Homo sapiens
ctgggggagagaggcagca

SEQ ID NO: 3022469 - DNA, 17 bp, Homo sapiens
ctgggggcaactggcca

SEQ ID NO: 3022470 - DNA, 15 bp, Homo sapiens
ctgggggcaggccag

SEQ ID NO: 3022471 - DNA, 18 bp, Homo sapiens
ctgggggctccccttgcc

SEQ ID NO: 3022472 - DNA, 16 bp, Homo sapiens
ctggggggacccagtg

SEQ ID NO: 3022473 - DNA, 17 bp, Homo sapiens
ctggggggacccagtgc

SEQ ID NO: 3022474 - DNA, 18 bp, Homo sapiens
ctggggggacccagtgca

SEQ ID NO: 3022475 - DNA, 15 bp, Homo sapiens
ctgggggtgccagga

SEQ ID NO: 3022476 - DNA, 16 bp, Homo sapiens
ctgggggtgggccagg

SEQ ID NO: 3022477 - DNA, 20 bp, Homo sapiens
ctggggtaagcggaataaac

SEQ ID NO: 3022478 - DNA, 16 bp, Homo sapiens
ctggggtacacagtga

SEQ ID NO: 3022479 - DNA, 14 bp, Homo sapiens
ctggggtccccagg

SEQ ID NO: 3022480 - DNA, 16 bp, Homo sapiens
ctggggtccccagggc

SEQ ID NO: 3022481 - DNA, 20 bp, Homo sapiens
ctggggtggggatagggagc

SEQ ID NO: 3022482 - DNA, 16 bp, Homo sapiens
ctggggtgtgggaggc

SEQ ID NO: 3022483 - DNA, 19 bp, Homo sapiens
ctggggtgtgggaggcccg

SEQ ID NO: 3022484 - DNA, 20 bp, Homo sapiens
ctggggtgttagtggcaccg

SEQ ID NO: 3022485 - DNA, 15 bp, Homo sapiens
ctggggttcagcccc

SEQ ID NO: 3022486 - DNA, 17 bp, Homo sapiens
ctggggttcagcccctc

SEQ ID NO: 3022487 - DNA, 20 bp, Homo sapiens
ctggggttcagcccctcctc

SEQ ID NO: 3022488 - DNA, 23 bp, Homo sapiens
ctgggtaataagcataagaccaa

SEQ ID NO: 3022489 - DNA, 21 bp, Homo sapiens
ctgggtacctgcaagcagaac

SEQ ID NO: 3022490 - DNA, 17 bp, Homo sapiens
ctgggtacttcttgaag

SEQ ID NO: 3022491 - DNA, 20 bp, Homo sapiens
ctgggtacttcttgaaggtg

SEQ ID NO: 3022492 - DNA, 14 bp, Homo sapiens
ctgggtagaagcca

SEQ ID NO: 3022493 - DNA, 22 bp, Homo sapiens
ctgggtaggccccacaaggcct

SEQ ID NO: 3022494 - DNA, 23 bp, Homo sapiens
ctgggtaggccccacaaggcctg

SEQ ID NO: 3022495 - DNA, 13 bp, Homo sapiens
ctgggtatgtgta

SEQ ID NO: 3022496 - DNA, 14 bp, Homo sapiens
ctgggtcacacacg

SEQ ID NO: 3022497 - DNA, 15 bp, Homo sapiens
ctgggtcacaggaag

SEQ ID NO: 3022498 - DNA, 19 bp, Homo sapiens
ctgggtcacaggaaggaaa

SEQ ID NO: 3022499 - DNA, 21 bp, Homo sapiens
ctgggtccaggggatgggagg

SEQ ID NO: 3022500 - DNA, 22 bp, Homo sapiens
ctgggtccaggggatgggaggt

SEQ ID NO: 3022501 - DNA, 22 bp, Homo sapiens
ctgggtcccggggtgcatttgt

SEQ ID NO: 3022502 - DNA, 13 bp, Homo sapiens
ctgggtcctgcct

SEQ ID NO: 3022503 - DNA, 14 bp, Homo sapiens
ctgggtcctgcctg

SEQ ID NO: 3022504 - DNA, 17 bp, Homo sapiens
ctgggtccttgggcctg

SEQ ID NO: 3022505 - DNA, 16 bp, Homo sapiens
ctgggtctacaaggac

SEQ ID NO: 3022506 - DNA, 15 bp, Homo sapiens
ctgggtctgacctgg

SEQ ID NO: 3022507 - DNA, 14 bp, Homo sapiens
ctgggtctgggttt

SEQ ID NO: 3022508 - DNA, 14 bp, Homo sapiens
ctgggtcttgccat

SEQ ID NO: 3022509 - DNA, 17 bp, Homo sapiens
ctgggtgacagagcgag

SEQ ID NO: 3022510 - DNA, 16 bp, Homo sapiens
ctgggtgagctcttcc

SEQ ID NO: 3022511 - DNA, 18 bp, Homo sapiens
ctgggtgagctcttccag

SEQ ID NO: 3022512 - DNA, 20 bp, Homo sapiens
ctgggtgcatgatcttgagc

SEQ ID NO: 3022513 - DNA, 17 bp, Homo sapiens
ctgggtgccctgaaagg

SEQ ID NO: 3022514 - DNA, 22 bp, Homo sapiens
ctgggtgccctgaaagggccct

SEQ ID NO: 3022515 - DNA, 14 bp, Homo sapiens
ctgggtgctcccta

SEQ ID NO: 3022516 - DNA, 15 bp, Homo sapiens
ctgggtgctccctac

SEQ ID NO: 3022517 - DNA, 17 bp, Homo sapiens
ctgggtggatgtgagca

SEQ ID NO: 3022518 - DNA, 18 bp, Homo sapiens
ctgggtggatgtgagcag

SEQ ID NO: 3022519 - DNA, 22 bp, Homo sapiens
ctgggtggatgtgagcagaaga

SEQ ID NO: 3022520 - DNA, 13 bp, Homo sapiens
ctgggtggggctg

SEQ ID NO: 3022521 - DNA, 21 bp, Homo sapiens
ctgggtggtagatttcctcct

SEQ ID NO: 3022522 - DNA, 20 bp, Homo sapiens
ctgggtgtccccgctgctgt

SEQ ID NO: 3022523 - DNA, 20 bp, Homo sapiens
ctgggttccccactggtctg

SEQ ID NO: 3022524 - DNA, 15 bp, Homo sapiens
ctgggttgcagacag

SEQ ID NO: 3022525 - DNA, 14 bp, Homo sapiens
ctgggtttggcccc

SEQ ID NO: 3022526 - DNA, 17 bp, Homo sapiens
ctggtaattgtacaata

SEQ ID NO: 3022527 - DNA, 22 bp, Homo sapiens
ctggtaggaggaggcatggaaa

SEQ ID NO: 3022528 - DNA, 20 bp, Homo sapiens
ctggtaggtttggtgtgtgt

SEQ ID NO: 3022529 - DNA, 23 bp, Homo sapiens
ctggtataaagctctcaaatgtg

SEQ ID NO: 3022530 - DNA, 13 bp, Homo sapiens
ctggtattctctc

SEQ ID NO: 3022531 - DNA, 14 bp, Homo sapiens
ctggtattctctct

SEQ ID NO: 3022532 - DNA, 16 bp, Homo sapiens
ctggtcaacctcctgg

SEQ ID NO: 3022533 - DNA, 19 bp, Homo sapiens
ctggtcaacctcctggaca

SEQ ID NO: 3022534 - DNA, 19 bp, Homo sapiens
ctggtcacacacaggtgtt

SEQ ID NO: 3022535 - DNA, 16 bp, Homo sapiens
ctggtcactctgccct

SEQ ID NO: 3022536 - DNA, 17 bp, Homo sapiens
ctggtcactctgccctc

SEQ ID NO: 3022537 - DNA, 24 bp, Homo sapiens
ctggtcatccttggtgctcttgct

SEQ ID NO: 3022538 - DNA, 19 bp, Homo sapiens
ctggtcccctccctctgtc

SEQ ID NO: 3022539 - DNA, 15 bp, Homo sapiens
ctggtccctgggagg

SEQ ID NO: 3022540 - DNA, 17 bp, Homo sapiens
ctggtccctggtccttc

SEQ ID NO: 3022541 - DNA, 18 bp, Homo sapiens
ctggtccctggtccttca

SEQ ID NO: 3022542 - DNA, 19 bp, Homo sapiens
ctggtccgagctgaggact

SEQ ID NO: 3022543 - DNA, 16 bp, Homo sapiens
ctggtcctacccatcc

SEQ ID NO: 3022544 - DNA, 22 bp, Homo sapiens
ctggtcctacccatccccgcag

SEQ ID NO: 3022545 - DNA, 23 bp, Homo sapiens
ctggtcctccgcctactgtccct

SEQ ID NO: 3022546 - DNA, 12 bp, Homo sapiens
ctggtcctcgga

SEQ ID NO: 3022547 - DNA, 16 bp, Homo sapiens
ctggtcctcggagctg

SEQ ID NO: 3022548 - DNA, 15 bp, Homo sapiens
ctggtcctggctgca

SEQ ID NO: 3022549 - DNA, 17 bp, Homo sapiens
ctggtcctggctgcact

SEQ ID NO: 3022550 - DNA, 21 bp, Homo sapiens
ctggtctcaaactcctgactt

SEQ ID NO: 3022551 - DNA, 22 bp, Homo sapiens
ctggtctcgaactcctgacctc

SEQ ID NO: 3022552 - DNA, 21 bp, Homo sapiens
ctggtctcgaactcctggcct

SEQ ID NO: 3022553 - DNA, 12 bp, Homo sapiens
ctggtctgggag

SEQ ID NO: 3022554 - DNA, 22 bp, Homo sapiens
ctggtgaccttccaagagcctg

SEQ ID NO: 3022555 - DNA, 18 bp, Homo sapiens
ctggtgagaactgaggag

SEQ ID NO: 3022556 - DNA, 13 bp, Homo sapiens
ctggtgagacagt

SEQ ID NO: 3022557 - DNA, 22 bp, Homo sapiens
ctggtgagagaagaaaacattt

SEQ ID NO: 3022558 - DNA, 12 bp, Homo sapiens
ctggtgaggccg

SEQ ID NO: 3022559 - DNA, 20 bp, Homo sapiens
ctggtgaggccggccctgcc

SEQ ID NO: 3022560 - DNA, 16 bp, Homo sapiens
ctggtgataaggacat

SEQ ID NO: 3022561 - DNA, 19 bp, Homo sapiens
ctggtgcacagccactccc

SEQ ID NO: 3022562 - DNA, 23 bp, Homo sapiens
ctggtgccaaatagccccagact

SEQ ID NO: 3022563 - DNA, 21 bp, Homo sapiens
ctggtgcctgaagaccccaga

SEQ ID NO: 3022564 - DNA, 15 bp, Homo sapiens
ctggtgcctgagccc

SEQ ID NO: 3022565 - DNA, 21 bp, Homo sapiens
ctggtgcctgagcccctcaga

SEQ ID NO: 3022566 - DNA, 20 bp, Homo sapiens
ctgttgtgttcaccagagaa

SEQ ID NO: 3022567 - DNA, 17 bp, Homo sapiens
ctgtttagatttattag

SEQ ID NO: 3022568 - DNA, 18 bp, Homo sapiens
ctgtttagtaaatacatc

SEQ ID NO: 3022569 - DNA, 20 bp, Homo sapiens
ctgtttatgggtttcttcca

SEQ ID NO: 3022570 - DNA, 16 bp, Homo sapiens
ctgtttattgccatta

SEQ ID NO: 3022571 - DNA, 21 bp, Homo sapiens
ctgtttcaaggcactctagat

SEQ ID NO: 3022572 - DNA, 22 bp, Homo sapiens
ctgtttcaaggcactctagatt

SEQ ID NO: 3022573 - DNA, 20 bp, Homo sapiens
ctgtttcactgaaatgtttg

SEQ ID NO: 3022574 - DNA, 16 bp, Homo sapiens
ctgtttcacttgctct

SEQ ID NO: 3022575 - DNA, 17 bp, Homo sapiens
ctgtttcaggcaagctt

SEQ ID NO: 3022576 - DNA, 14 bp, Homo sapiens
ctgtttcctgctgc

SEQ ID NO: 3022577 - DNA, 15 bp, Homo sapiens
ctgtttctgaaaaga

SEQ ID NO: 3022578 - DNA, 18 bp, Homo sapiens
ctgtttctgaaaagaaat

SEQ ID NO: 3022579 - DNA, 21 bp, Homo sapiens
ctgtttctgaaaagaaataat

SEQ ID NO: 3022580 - DNA, 16 bp, Homo sapiens
ctgtttgctgatggtc

SEQ ID NO: 3022581 - DNA, 16 bp, Homo sapiens
ctgtttggacccatgg

SEQ ID NO: 3022582 - DNA, 13 bp, Homo sapiens
ctgtttgggcagg

SEQ ID NO: 3022583 - DNA, 20 bp, Homo sapiens
ctgtttgtttgacaaagaaa

SEQ ID NO: 3022584 - DNA, 23 bp, Homo sapiens
ctgttttaaaactttaagaaagg

SEQ ID NO: 3022585 - DNA, 21 bp, Homo sapiens
ctgttttaaattgcatttcta

SEQ ID NO: 3022586 - DNA, 12 bp, Homo sapiens
ctgttttcctcc

SEQ ID NO: 3022587 - DNA, 14 bp, Homo sapiens
ctgttttcctccct

SEQ ID NO: 3022588 - DNA, 19 bp, Homo sapiens
ctgttttcctcccttctgc

SEQ ID NO: 3022589 - DNA, 19 bp, Homo sapiens
ctgttttcgtaccttccca

SEQ ID NO: 3022590 - DNA, 21 bp, Homo sapiens
ctgttttctttatgtcttttg

SEQ ID NO: 3022591 - DNA, 22 bp, Homo sapiens
ctgtttttcggacagtttattt

SEQ ID NO: 3022592 - DNA, 17 bp, Homo sapiens
ctgtttttctaactggg

SEQ ID NO: 3022593 - DNA, 13 bp, Homo sapiens
ctgttttttagtt

SEQ ID NO: 3022594 - DNA, 23 bp, Homo sapiens
cttaaaaagtggcgttgttcata

SEQ ID NO: 3022595 - DNA, 17 bp, Homo sapiens
cttaaaaatatatttcc

SEQ ID NO: 3022596 - DNA, 22 bp, Homo sapiens
cttaaaaatcacactgtaaata

SEQ ID NO: 3022597 - DNA, 15 bp, Homo sapiens
cttaaaacttttcaa

SEQ ID NO: 3022598 - DNA, 19 bp, Homo sapiens
cttaaaagctggctttcat

SEQ ID NO: 3022599 - DNA, 20 bp, Homo sapiens
cttaaaaggtactggtacta

SEQ ID NO: 3022600 - DNA, 22 bp, Homo sapiens
cttaaaatcactcagcactcca

SEQ ID NO: 3022601 - DNA, 19 bp, Homo sapiens
cttaaactgaaagctttaa

SEQ ID NO: 3022602 - DNA, 16 bp, Homo sapiens
cttaaagcaaagtcac

SEQ ID NO: 3022603 - DNA, 18 bp, Homo sapiens
cttaaagcaaagtcactt

SEQ ID NO: 3022604 - DNA, 23 bp, Homo sapiens
cttaaagcaaagtcacttctcca

SEQ ID NO: 3022605 - DNA, 13 bp, Homo sapiens
cttaaatcagaat

SEQ ID NO: 3022606 - DNA, 16 bp, Homo sapiens
cttaaatcagaataaa

SEQ ID NO: 3022607 - DNA, 13 bp, Homo sapiens
cttaaatcagttt

SEQ ID NO: 3022608 - DNA, 17 bp, Homo sapiens
cttaacaaaccaacatc

SEQ ID NO: 3022609 - DNA, 18 bp, Homo sapiens
cttaacaaactcttcagt

SEQ ID NO: 3022610 - DNA, 14 bp, Homo sapiens
cttaaccagttgtg

SEQ ID NO: 3022611 - DNA, 23 bp, Homo sapiens
cttaaccagttgtggtgtgagta

SEQ ID NO: 3022612 - DNA, 15 bp, Homo sapiens
cttaacctttgctat

SEQ ID NO: 3022613 - DNA, 18 bp, Homo sapiens
cttaacctttgctatgta

SEQ ID NO: 3022614 - DNA, 16 bp, Homo sapiens
cttaactttttaacca

SEQ ID NO: 3022615 - DNA, 20 bp, Homo sapiens
cttaagacctactgttctaa

SEQ ID NO: 3022616 - DNA, 21 bp, Homo sapiens
cttaagatgtccagggcccca

SEQ ID NO: 3022617 - DNA, 18 bp, Homo sapiens
cttaagcagagataaata

SEQ ID NO: 3022618 - DNA, 19 bp, Homo sapiens
cttaagcagagataaataa

SEQ ID NO: 3022619 - DNA, 18 bp, Homo sapiens
cttaaggacaaagtgcca

SEQ ID NO: 3022620 - DNA, 18 bp, Homo sapiens
cttaaggcatacttttaa

SEQ ID NO: 3022621 - DNA, 15 bp, Homo sapiens
cttaaggctcttttg

SEQ ID NO: 3022622 - DNA, 16 bp, Homo sapiens
cttaagggagtttaat

SEQ ID NO: 3022623 - DNA, 17 bp, Homo sapiens
cttaaggtgaggcctgt

SEQ ID NO: 3022624 - DNA, 22 bp, Homo sapiens
cttaaggtgaggcctgtctgtg

SEQ ID NO: 3022625 - DNA, 23 bp, Homo sapiens
cttaaggtgaggcctgtctgtga

SEQ ID NO: 3022626 - DNA, 14 bp, Homo sapiens
cttaaggtgtagcc

SEQ ID NO: 3022627 - DNA, 17 bp, Homo sapiens
cttaaggtgtagccaca

SEQ ID NO: 3022628 - DNA, 20 bp, Homo sapiens
cttaagtcaccctagccctc

SEQ ID NO: 3022629 - DNA, 17 bp, Homo sapiens
cttaagtcagaacagca

SEQ ID NO: 3022630 - DNA, 22 bp, Homo sapiens
cttaagtcctaaaagttctcaa

SEQ ID NO: 3022631 - DNA, 17 bp, Homo sapiens
cttaataaaaatgacag

SEQ ID NO: 3022632 - DNA, 16 bp, Homo sapiens
cttaatactaccttga

SEQ ID NO: 3022633 - DNA, 16 bp, Homo sapiens
cttaatactgaatttc

SEQ ID NO: 3022634 - DNA, 11 bp, Homo sapiens
cttaatatact

SEQ ID NO: 3022635 - DNA, 23 bp, Homo sapiens
cttaatccgtagttattttgcac

SEQ ID NO: 3022636 - DNA, 21 bp, Homo sapiens
cttaatgaatgagtctgttgt

SEQ ID NO: 3022637 - DNA, 23 bp, Homo sapiens
cttaatgatgttatcttaacact

SEQ ID NO: 3022638 - DNA, 21 bp, Homo sapiens
cttaatgtatggctcatttgc

SEQ ID NO: 3022639 - DNA, 21 bp, Homo sapiens
cttaattaagatcattgaaga

SEQ ID NO: 3022640 - DNA, 23 bp, Homo sapiens
cttaattcagtatgatttatcct

SEQ ID NO: 3022641 - DNA, 18 bp, Homo sapiens
cttaatttaactttccag

SEQ ID NO: 3022642 - DNA, 17 bp, Homo sapiens
cttaatttggatctatt

SEQ ID NO: 3022643 - DNA, 18 bp, Homo sapiens
cttaatttggatctattt

SEQ ID NO: 3022644 - DNA, 19 bp, Homo sapiens
cttaatttggatctattta

SEQ ID NO: 3022645 - DNA, 11 bp, Homo sapiens
cttaattttgg

SEQ ID NO: 3022646 - DNA, 13 bp, Homo sapiens
cttacaaaaatgg

SEQ ID NO: 3022647 - DNA, 16 bp, Homo sapiens
cttacaagaaaggcct

SEQ ID NO: 3022648 - DNA, 23 bp, Homo sapiens
cttacaaggcaggcctttcctac

SEQ ID NO: 3022649 - DNA, 14 bp, Homo sapiens
cttacaatctttat

SEQ ID NO: 3022650 - DNA, 23 bp, Homo sapiens
cttacaggggggtcggaagcctg

SEQ ID NO: 3022651 - DNA, 14 bp, Homo sapiens
cttacagttatcct

SEQ ID NO: 3022652 - DNA, 18 bp, Homo sapiens
cttacagttatcctgcaa

SEQ ID NO: 3022653 - DNA, 16 bp, Homo sapiens
cttacatatgttaata

SEQ ID NO: 3022654 - DNA, 15 bp, Homo sapiens
cttacattaaaaagc

SEQ ID NO: 3022655 - DNA, 18 bp, Homo sapiens
cttacattaaaaagcctt

SEQ ID NO: 3022656 - DNA, 22 bp, Homo sapiens
cttacattaaaaagccttacag

SEQ ID NO: 3022657 - DNA, 16 bp, Homo sapiens
cttacattctctaata

SEQ ID NO: 3022658 - DNA, 22 bp, Homo sapiens
cttacattctctaataagaaaa

SEQ ID NO: 3022659 - DNA, 14 bp, Homo sapiens
cttacattgaaaac

SEQ ID NO: 3022660 - DNA, 16 bp, Homo sapiens
cttacattgcctgact

SEQ ID NO: 3022661 - DNA, 21 bp, Homo sapiens
cttacattgcctgactaaaat

SEQ ID NO: 3022662 - DNA, 20 bp, Homo sapiens
cttacattttactttttcct

SEQ ID NO: 3022663 - DNA, 23 bp, Homo sapiens
cttaccattcctatagtacttta

SEQ ID NO: 3022664 - DNA, 23 bp, Homo sapiens
cttacccatctgcacccccctgg

SEQ ID NO: 3022665 - DNA, 18 bp, Homo sapiens
cttaccccaaagagaaag

SEQ ID NO: 3022666 - DNA, 18 bp, Homo sapiens
cttaccctagttctctta

SEQ ID NO: 3022667 - DNA, 13 bp, Homo sapiens
cttacccttagaa

SEQ ID NO: 3022668 - DNA, 13 bp, Homo sapiens
cttacctcctgcc

SEQ ID NO: 3022669 - DNA, 20 bp, Homo sapiens
cttacctcctgcccaggaga

SEQ ID NO: 3022670 - DNA, 19 bp, Homo sapiens
cttaccttgttttgccagt

SEQ ID NO: 3022671 - DNA, 21 bp, Homo sapiens
cttacgatcaggcacaggtca

SEQ ID NO: 3022672 - DNA, 12 bp, Homo sapiens
cttactaggaag

SEQ ID NO: 3022673 - DNA, 13 bp, Homo sapiens
cttactattccca

SEQ ID NO: 3022674 - DNA, 15 bp, Homo sapiens
cttactattcccact

SEQ ID NO: 3022675 - DNA, 12 bp, Homo sapiens
cttactgaaggt

SEQ ID NO: 3022676 - DNA, 23 bp, Homo sapiens
cttactgagcgcaagccacagcc

SEQ ID NO: 3022677 - DNA, 16 bp, Homo sapiens
cttactgtaagacatt

SEQ ID NO: 3022678 - DNA, 18 bp, Homo sapiens
cttactgtacctgttcct

SEQ ID NO: 3022679 - DNA, 12 bp, Homo sapiens
cttactgtctct

SEQ ID NO: 3022680 - DNA, 23 bp, Homo sapiens
cttactgtctctcttgtcacatg

SEQ ID NO: 3022681 - DNA, 15 bp, Homo sapiens
cttacttcccccacc

SEQ ID NO: 3022682 - DNA, 21 bp, Homo sapiens
cttacttcccccaccctgggt

SEQ ID NO: 3022683 - DNA, 16 bp, Homo sapiens
cttacttcttgccctg

SEQ ID NO: 3022684 - DNA, 12 bp, Homo sapiens
cttactttgtgc

SEQ ID NO: 3022685 - DNA, 13 bp, Homo sapiens
cttactttgtgca

SEQ ID NO: 3022686 - DNA, 14 bp, Homo sapiens
cttactttgtgcaa

SEQ ID NO: 3022687 - DNA, 15 bp, Homo sapiens
cttactttgtgcaaa

SEQ ID NO: 3022688 - DNA, 18 bp, Homo sapiens
cttagaaacacataaatt

SEQ ID NO: 3022689 - DNA, 19 bp, Homo sapiens
cttagaacccttctgcttt

SEQ ID NO: 3022690 - DNA, 17 bp, Homo sapiens
cttagaagtggaccagg

SEQ ID NO: 3022691 - DNA, 20 bp, Homo sapiens
cttagaagtggaccaggaca

SEQ ID NO: 3022692 - DNA, 21 bp, Homo sapiens
cttagaagtggaccaggacag

SEQ ID NO: 3022693 - DNA, 19 bp, Homo sapiens
cttagaagtgttgtaaaag

SEQ ID NO: 3022694 - DNA, 20 bp, Homo sapiens
cttagacacttttatatttg

SEQ ID NO: 3022695 - DNA, 18 bp, Homo sapiens
cttagaccttccataatg

SEQ ID NO: 3022696 - DNA, 22 bp, Homo sapiens
cttagacggtcttcactgtgtg

SEQ ID NO: 3022697 - DNA, 17 bp, Homo sapiens
cttgaaaaaaaaaatat

SEQ ID NO: 3022698 - DNA, 21 bp, Homo sapiens
cttgaaaaatacttttcctta

SEQ ID NO: 3022699 - DNA, 12 bp, Homo sapiens
cttgaaaagatt

SEQ ID NO: 3022700 - DNA, 14 bp, Homo sapiens
cttgaaaagattct

SEQ ID NO: 3022701 - DNA, 14 bp, Homo sapiens
cttgaaacatgttc

SEQ ID NO: 3022702 - DNA, 13 bp, Homo sapiens
cttgaaagatttt

SEQ ID NO: 3022703 - DNA, 20 bp, Homo sapiens
cttgaaagcagttaaactga

SEQ ID NO: 3022704 - DNA, 16 bp, Homo sapiens
cttgaaaggggaaacg

SEQ ID NO: 3022705 - DNA, 23 bp, Homo sapiens
cttgaaaggggaaacgtctccca

SEQ ID NO: 3022706 - DNA, 20 bp, Homo sapiens
cttgaaattaagaaggcaaa

SEQ ID NO: 3022707 - DNA, 15 bp, Homo sapiens
cttgaacctcattaa

SEQ ID NO: 3022708 - DNA, 16 bp, Homo sapiens
cttgaacctgggaagt

SEQ ID NO: 3022709 - DNA, 18 bp, Homo sapiens
cttgaacctgggaagtgg

SEQ ID NO: 3022710 - DNA, 19 bp, Homo sapiens
cttgaacctgggaggtgga

SEQ ID NO: 3022711 - DNA, 18 bp, Homo sapiens
cttgaactcctggactca

SEQ ID NO: 3022712 - DNA, 14 bp, Homo sapiens
cttgaactctgggc

SEQ ID NO: 3022713 - DNA, 18 bp, Homo sapiens
cttgaactctgggctcaa

SEQ ID NO: 3022714 - DNA, 14 bp, Homo sapiens
cttgaactgattca

SEQ ID NO: 3022715 - DNA, 15 bp, Homo sapiens
cttgaactgggctca

SEQ ID NO: 3022716 - DNA, 19 bp, Homo sapiens
cttgaactttcctggatgt

SEQ ID NO: 3022717 - DNA, 12 bp, Homo sapiens
cttgaagcagta

SEQ ID NO: 3022718 - DNA, 24 bp, Homo sapiens
cttgaagcatttcaaagccctgcc

SEQ ID NO: 3022719 - DNA, 14 bp, Homo sapiens
cttgaaggtgctga

SEQ ID NO: 3022720 - DNA, 21 bp, Homo sapiens
cttgaagtaactataacaaaa

SEQ ID NO: 3022721 - DNA, 13 bp, Homo sapiens
cttgaagtcctgg

SEQ ID NO: 3022722 - DNA, 15 bp, Homo sapiens
cttgaagtcctggct

SEQ ID NO: 3022723 - DNA, 14 bp, Homo sapiens
cttgaataataagc

SEQ ID NO: 3022724 - DNA, 16 bp, Homo sapiens
cttgaatatgggtggc

SEQ ID NO: 3022725 - DNA, 17 bp, Homo sapiens
cttgaatccattgaaag

SEQ ID NO: 3022726 - DNA, 13 bp, Homo sapiens
cttgaatgtcttt

SEQ ID NO: 3022727 - DNA, 21 bp, Homo sapiens
cttgaattgtaactgttcttg

SEQ ID NO: 3022728 - DNA, 21 bp, Homo sapiens
cttgaatttgcatgtctaatt

SEQ ID NO: 3022729 - DNA, 16 bp, Homo sapiens
cttgacaaagtcaagc

SEQ ID NO: 3022730 - DNA, 19 bp, Homo sapiens
cttgacaaagtcaagccac

SEQ ID NO: 3022731 - DNA, 16 bp, Homo sapiens
cttgacaactggcagg

SEQ ID NO: 3022732 - DNA, 22 bp, Homo sapiens
cttgacaattcccgggcccttc

SEQ ID NO: 3022733 - DNA, 15 bp, Homo sapiens
cttgacagagcagct

SEQ ID NO: 3022734 - DNA, 15 bp, Homo sapiens
cttgaccaagcagga

SEQ ID NO: 3022735 - DNA, 19 bp, Homo sapiens
cttgaccaagcaggaagct

SEQ ID NO: 3022736 - DNA, 18 bp, Homo sapiens
cttgacctgtttctctgc

SEQ ID NO: 3022737 - DNA, 13 bp, Homo sapiens
cttgacctttgta

SEQ ID NO: 3022738 - DNA, 16 bp, Homo sapiens
cttgacctttgtacag

SEQ ID NO: 3022739 - DNA, 17 bp, Homo sapiens
cttgacctttgtacagc

SEQ ID NO: 3022740 - DNA, 21 bp, Homo sapiens
cttgacctttgtacagcccag

SEQ ID NO: 3022741 - DNA, 21 bp, Homo sapiens
cttgactacctactggtgtaa

SEQ ID NO: 3022742 - DNA, 22 bp, Homo sapiens
cttgactcctttggtatttcac

SEQ ID NO: 3022743 - DNA, 11 bp, Homo sapiens
cttgactgaag

SEQ ID NO: 3022744 - DNA, 22 bp, Homo sapiens
cttgactttggctgatttaaaa

SEQ ID NO: 3022745 - DNA, 23 bp, Homo sapiens
cttgagaagacctcacctagaaa

SEQ ID NO: 3022746 - DNA, 16 bp, Homo sapiens
cttgagacctcagcca

SEQ ID NO: 3022747 - DNA, 12 bp, Homo sapiens
cttgagagagaa

SEQ ID NO: 3022748 - DNA, 20 bp, Homo sapiens
cttgagagtagatggtttga

SEQ ID NO: 3022749 - DNA, 22 bp, Homo sapiens
cttgagagtgttcctgagacag

SEQ ID NO: 3022750 - DNA, 13 bp, Homo sapiens
cttgagattctga

SEQ ID NO: 3022751 - DNA, 19 bp, Homo sapiens
cttgagcaagttccttctg

SEQ ID NO: 3022752 - DNA, 20 bp, Homo sapiens
cttgagcaagttccttctgg

SEQ ID NO: 3022753 - DNA, 12 bp, Homo sapiens
cttgagctcagg

SEQ ID NO: 3022754 - DNA, 13 bp, Homo sapiens
cttgagcttggga

SEQ ID NO: 3022755 - DNA, 21 bp, Homo sapiens
cttgaggtctcttttctctac

SEQ ID NO: 3022756 - DNA, 15 bp, Homo sapiens
cttgaggtggcctcc

SEQ ID NO: 3022757 - DNA, 21 bp, Homo sapiens
cttgaggtggtagtaaaacac

SEQ ID NO: 3022758 - DNA, 17 bp, Homo sapiens
cttgagtaggccctgct

SEQ ID NO: 3022759 - DNA, 17 bp, Homo sapiens
cttgagtcatggatttc

SEQ ID NO: 3022760 - DNA, 20 bp, Homo sapiens
cttgagtgttatgtgaattt

SEQ ID NO: 3022761 - DNA, 22 bp, Homo sapiens
cttgagtgttatgtgaatttga

SEQ ID NO: 3022762 - DNA, 22 bp, Homo sapiens
cttgatagaaatgccaagcact

SEQ ID NO: 3022763 - DNA, 13 bp, Homo sapiens
cttgatattttct

SEQ ID NO: 3022764 - DNA, 13 bp, Homo sapiens
cttgatctcctga

SEQ ID NO: 3022765 - DNA, 16 bp, Homo sapiens
cttgatctcctgacct

SEQ ID NO: 3022766 - DNA, 15 bp, Homo sapiens
cttgatcttaaagat

SEQ ID NO: 3022767 - DNA, 18 bp, Homo sapiens
cttgatgaccaaagtcct

SEQ ID NO: 3022768 - DNA, 21 bp, Homo sapiens
cttgatgaccaaagtcctttt

SEQ ID NO: 3022769 - DNA, 17 bp, Homo sapiens
cttgatgtttcctggaa

SEQ ID NO: 3022770 - DNA, 17 bp, Homo sapiens
cttgattataaatgttt

SEQ ID NO: 3022771 - DNA, 22 bp, Homo sapiens
cttgattataaatgtttggaaa

SEQ ID NO: 3022772 - DNA, 16 bp, Homo sapiens
cttgattatccatatt

SEQ ID NO: 3022773 - DNA, 18 bp, Homo sapiens
cttgattcacaatgaaat

SEQ ID NO: 3022774 - DNA, 20 bp, Homo sapiens
cttgattctgcagtaaatct

SEQ ID NO: 3022775 - DNA, 21 bp, Homo sapiens
cttgattctgcagtaaatctt

SEQ ID NO: 3022776 - DNA, 23 bp, Homo sapiens
cttgattggggaattaaaagtca

SEQ ID NO: 3022777 - DNA, 16 bp, Homo sapiens
cttgcagaggagccca

SEQ ID NO: 3022778 - DNA, 17 bp, Homo sapiens
cttgcagatcatctggg

SEQ ID NO: 3022779 - DNA, 22 bp, Homo sapiens
cttgcagatcatctggggacct

SEQ ID NO: 3022780 - DNA, 16 bp, Homo sapiens
cttgcagcctggtcac

SEQ ID NO: 3022781 - DNA, 17 bp, Homo sapiens
cttgcagtagattttct

SEQ ID NO: 3022782 - DNA, 22 bp, Homo sapiens
cttgcagtagattttctttaaa

SEQ ID NO: 3022783 - DNA, 20 bp, Homo sapiens
cttgcagtgaagtgttctgc

SEQ ID NO: 3022784 - DNA, 15 bp, Homo sapiens
cttgcagtttaagat

SEQ ID NO: 3022785 - DNA, 13 bp, Homo sapiens
cttgcatcaaggg

SEQ ID NO: 3022786 - DNA, 14 bp, Homo sapiens
cttgcatcaagggg

SEQ ID NO: 3022787 - DNA, 20 bp, Homo sapiens
cttgcatggcattaattgtt

SEQ ID NO: 3022788 - DNA, 10 bp, Homo sapiens
cttgcattga

SEQ ID NO: 3022789 - DNA, 15 bp, Homo sapiens
cttgccaaagcagat

SEQ ID NO: 3022790 - DNA, 17 bp, Homo sapiens
cttgccaaatataaata

SEQ ID NO: 3022791 - DNA, 17 bp, Homo sapiens
cttgccaagaaaatgaa

SEQ ID NO: 3022792 - DNA, 20 bp, Homo sapiens
cttgccacccattcttcccg

SEQ ID NO: 3022793 - DNA, 19 bp, Homo sapiens
cttgccactaagccatgaa

SEQ ID NO: 3022794 - DNA, 20 bp, Homo sapiens
cttgccagagccgggcacat

SEQ ID NO: 3022795 - DNA, 20 bp, Homo sapiens
cttgccagggctctgggggc

SEQ ID NO: 3022796 - DNA, 15 bp, Homo sapiens
cttgccatgtgactc

SEQ ID NO: 3022797 - DNA, 13 bp, Homo sapiens
cttgcccagagat

SEQ ID NO: 3022798 - DNA, 19 bp, Homo sapiens
cttgcccagagatgcctcc

SEQ ID NO: 3022799 - DNA, 21 bp, Homo sapiens
cttgccccactctgcctgcct

SEQ ID NO: 3022800 - DNA, 18 bp, Homo sapiens
cttgcccgtcgtgtgctg

SEQ ID NO: 3022801 - DNA, 11 bp, Homo sapiens
cttgccctgct

SEQ ID NO: 3022802 - DNA, 13 bp, Homo sapiens
cttgccctgctcc

SEQ ID NO: 3022803 - DNA, 15 bp, Homo sapiens
cttgccctgctccct

SEQ ID NO: 3022804 - DNA, 16 bp, Homo sapiens
cttgccctgctccctc

SEQ ID NO: 3022805 - DNA, 15 bp, Homo sapiens
cttgcccttcctact

SEQ ID NO: 3022806 - DNA, 19 bp, Homo sapiens
cttgccgcacatgaaacat

SEQ ID NO: 3022807 - DNA, 14 bp, Homo sapiens
cttgcctccaggtg

SEQ ID NO: 3022808 - DNA, 19 bp, Homo sapiens
cttgcctccaggtgcagag

SEQ ID NO: 3022809 - DNA, 21 bp, Homo sapiens
cttgcctccaggtgcagaggt

SEQ ID NO: 3022810 - DNA, 19 bp, Homo sapiens
cttgcctccttttttctta

SEQ ID NO: 3022811 - DNA, 12 bp, Homo sapiens
cttgccttcccc

SEQ ID NO: 3022812 - DNA, 23 bp, Homo sapiens
cttgccttcctaagcctgtggct

SEQ ID NO: 3022813 - DNA, 23 bp, Homo sapiens
cttgcctttagcccctcccaagc

SEQ ID NO: 3022814 - DNA, 12 bp, Homo sapiens
cttgctaagctc

SEQ ID NO: 3022815 - DNA, 20 bp, Homo sapiens
cttgctagctagccagccaa

SEQ ID NO: 3022816 - DNA, 19 bp, Homo sapiens
cttgctatattgcccaggc

SEQ ID NO: 3022817 - DNA, 21 bp, Homo sapiens
cttgctatcggggaagccaga

SEQ ID NO: 3022818 - DNA, 20 bp, Homo sapiens
cttgctcttagattgggcca

SEQ ID NO: 3022819 - DNA, 10 bp, Homo sapiens
cttgctgcca

SEQ ID NO: 3022820 - DNA, 16 bp, Homo sapiens
cttgctgttaaatcag

SEQ ID NO: 3022821 - DNA, 21 bp, Homo sapiens
cttgcttaaggcatactttta

SEQ ID NO: 3022822 - DNA, 18 bp, Homo sapiens
cttgcttattacatttaa

SEQ ID NO: 3022823 - DNA, 19 bp, Homo sapiens
cttgcttgcctgcagggcc

SEQ ID NO: 3022824 - DNA, 17 bp, Homo sapiens
cttgctttcttctttcc

SEQ ID NO: 3022825 - DNA, 18 bp, Homo sapiens
cttgctttcttctttcct

SEQ ID NO: 3022826 - DNA, 22 bp, Homo sapiens
cttgcttttttgaaagatgctt

SEQ ID NO: 3022827 - DNA, 14 bp, Homo sapiens
cttggaaaaacagc

SEQ ID NO: 3022828 - DNA, 16 bp, Homo sapiens
cttggaaaaagaaaga

SEQ ID NO: 3022829 - DNA, 18 bp, Homo sapiens
ctttggcatgtttaattg

SEQ ID NO: 3022830 - DNA, 15 bp, Homo sapiens
ctttggcccaatgcc

SEQ ID NO: 3022831 - DNA, 13 bp, Homo sapiens
ctttggcctgagt

SEQ ID NO: 3022832 - DNA, 20 bp, Homo sapiens
ctttggctctattggatttg

SEQ ID NO: 3022833 - DNA, 13 bp, Homo sapiens
ctttgggacattc

SEQ ID NO: 3022834 - DNA, 13 bp, Homo sapiens
ctttgggagacca

SEQ ID NO: 3022835 - DNA, 13 bp, Homo sapiens
ctttgggaggcag

SEQ ID NO: 3022836 - DNA, 14 bp, Homo sapiens
ctttgggaggcagg

SEQ ID NO: 3022837 - DNA, 18 bp, Homo sapiens
ctttgggatgctatttca

SEQ ID NO: 3022838 - DNA, 20 bp, Homo sapiens
ctttgggatgctatttcagc

SEQ ID NO: 3022839 - DNA, 17 bp, Homo sapiens
ctttgggccctgcatgt

SEQ ID NO: 3022840 - DNA, 22 bp, Homo sapiens
ctttggggtcctagcccagtgc

SEQ ID NO: 3022841 - DNA, 23 bp, Homo sapiens
ctttggggtcctagcccagtgct

SEQ ID NO: 3022842 - DNA, 13 bp, Homo sapiens
ctttgggtcattt

SEQ ID NO: 3022843 - DNA, 22 bp, Homo sapiens
ctttggtaagagttaaagagta

SEQ ID NO: 3022844 - DNA, 17 bp, Homo sapiens
ctttggtggagataaag

SEQ ID NO: 3022845 - DNA, 22 bp, Homo sapiens
ctttggtggtttaaaaatggta

SEQ ID NO: 3022846 - DNA, 17 bp, Homo sapiens
ctttggttggaacttta

SEQ ID NO: 3022847 - DNA, 19 bp, Homo sapiens
ctttggttggcagcattcc

SEQ ID NO: 3022848 - DNA, 13 bp, Homo sapiens
ctttggttttact

SEQ ID NO: 3022849 - DNA, 12 bp, Homo sapiens
ctttgtaaatag

SEQ ID NO: 3022850 - DNA, 15 bp, Homo sapiens
ctttgtaagaactaa

SEQ ID NO: 3022851 - DNA, 12 bp, Homo sapiens
ctttgtaataaa

SEQ ID NO: 3022852 - DNA, 17 bp, Homo sapiens
ctttgtaatgtcaccac

SEQ ID NO: 3022853 - DNA, 22 bp, Homo sapiens
ctttgtactcctgctgtctacc

SEQ ID NO: 3022854 - DNA, 21 bp, Homo sapiens
ctttgtagcactcaggctctc

SEQ ID NO: 3022855 - DNA, 19 bp, Homo sapiens
ctttgtagttactcaagca

SEQ ID NO: 3022856 - DNA, 15 bp, Homo sapiens
ctttgtatattattt

SEQ ID NO: 3022857 - DNA, 13 bp, Homo sapiens
ctttgtcagtgtt

SEQ ID NO: 3022858 - DNA, 14 bp, Homo sapiens
ctttgtcccctgct

SEQ ID NO: 3022859 - DNA, 18 bp, Homo sapiens
ctttgtcctgaatggctt

SEQ ID NO: 3022860 - DNA, 19 bp, Homo sapiens
ctttgtctaaaacaataaa

SEQ ID NO: 3022861 - DNA, 14 bp, Homo sapiens
ctttgtcttgaaaa

SEQ ID NO: 3022862 - DNA, 12 bp, Homo sapiens
ctttgtgcaaaa

SEQ ID NO: 3022863 - DNA, 14 bp, Homo sapiens
ctttgtggcactgg

SEQ ID NO: 3022864 - DNA, 16 bp, Homo sapiens
ctttgtggccaaggag

SEQ ID NO: 3022865 - DNA, 15 bp, Homo sapiens
ctttgtggtgggcgc

SEQ ID NO: 3022866 - DNA, 20 bp, Homo sapiens
ctttgtggtgggcgctgggg

SEQ ID NO: 3022867 - DNA, 21 bp, Homo sapiens
ctttgtggtgggcgctgggga

SEQ ID NO: 3022868 - DNA, 14 bp, Homo sapiens
ctttgtgtttctat

SEQ ID NO: 3022869 - DNA, 16 bp, Homo sapiens
ctttgttaaggtcctg

SEQ ID NO: 3022870 - DNA, 15 bp, Homo sapiens
ctttgttacaataaa

SEQ ID NO: 3022871 - DNA, 14 bp, Homo sapiens
ctttgttataccat

SEQ ID NO: 3022872 - DNA, 21 bp, Homo sapiens
ctttgttcccaaggacttcca

SEQ ID NO: 3022873 - DNA, 17 bp, Homo sapiens
ctttgttcctgctttct

SEQ ID NO: 3022874 - DNA, 19 bp, Homo sapiens
ctttgttcctgctttctct

SEQ ID NO: 3022875 - DNA, 20 bp, Homo sapiens
ctttgttcctgctttctctt

SEQ ID NO: 3022876 - DNA, 22 bp, Homo sapiens
ctttgttcctgctttctctttc

SEQ ID NO: 3022877 - DNA, 14 bp, Homo sapiens
ctttgttctgagca

SEQ ID NO: 3022878 - DNA, 15 bp, Homo sapiens
ctttgttctgagcat

SEQ ID NO: 3022879 - DNA, 21 bp, Homo sapiens
ctttgttgcaagtactgctgt

SEQ ID NO: 3022880 - DNA, 17 bp, Homo sapiens
ctttgttggcccttcca

SEQ ID NO: 3022881 - DNA, 17 bp, Homo sapiens
ctttgttgttctgcctg

SEQ ID NO: 3022882 - DNA, 23 bp, Homo sapiens
ctttgttgttctgcctgtcctag

SEQ ID NO: 3022883 - DNA, 19 bp, Homo sapiens
ctttgttttgcacactttg

SEQ ID NO: 3022884 - DNA, 14 bp, Homo sapiens
ctttgtttttattt

SEQ ID NO: 3022885 - DNA, 16 bp, Homo sapiens
ctttgtttttccatgt

SEQ ID NO: 3022886 - DNA, 17 bp, Homo sapiens
ctttgtttttccatgtg

SEQ ID NO: 3022887 - DNA, 18 bp, Homo sapiens
ctttgtttttccatgtgt

SEQ ID NO: 3022888 - DNA, 14 bp, Homo sapiens
cttttaaaataaat

SEQ ID NO: 3022889 - DNA, 19 bp, Homo sapiens
cttttaaaatgcaatgtaa

SEQ ID NO: 3022890 - DNA, 17 bp, Homo sapiens
cttttaaacaaaagtgt

SEQ ID NO: 3022891 - DNA, 23 bp, Homo sapiens
cttttaaacaaaagtgtacctgt

SEQ ID NO: 3022892 - DNA, 21 bp, Homo sapiens
cttttaacacctgatgtgtac

SEQ ID NO: 3022893 - DNA, 16 bp, Homo sapiens
cttttaaccaaacaat

SEQ ID NO: 3022894 - DNA, 14 bp, Homo sapiens
cttttaactgtgca

SEQ ID NO: 3022895 - DNA, 22 bp, Homo sapiens
cttttaatccctatgtttgtct

SEQ ID NO: 3022896 - DNA, 16 bp, Homo sapiens
cttttaatgaacaaat

SEQ ID NO: 3022897 - DNA, 18 bp, Homo sapiens
cttttaatgaacaaatgg

SEQ ID NO: 3022898 - DNA, 15 bp, Homo sapiens
cttttacctggatat

SEQ ID NO: 3022899 - DNA, 18 bp, Homo sapiens
cttttactacagctatga

SEQ ID NO: 3022900 - DNA, 23 bp, Homo sapiens
cttttactacagctatgaagaaa

SEQ ID NO: 3022901 - DNA, 20 bp, Homo sapiens
cttttagttccaacaaagaa

SEQ ID NO: 3022902 - DNA, 21 bp, Homo sapiens
cttttagttccaacaaagaaa

SEQ ID NO: 3022903 - DNA, 15 bp, Homo sapiens
cttttatatctgtat

SEQ ID NO: 3022904 - DNA, 23 bp, Homo sapiens
cttttatatctgtatgtattagt

SEQ ID NO: 3022905 - DNA, 15 bp, Homo sapiens
cttttatatttgaaa

SEQ ID NO: 3022906 - DNA, 19 bp, Homo sapiens
cttttatcaataaagcact

SEQ ID NO: 3022907 - DNA, 21 bp, Homo sapiens
cttttatccactggcattttt

SEQ ID NO: 3022908 - DNA, 17 bp, Homo sapiens
cttttatccacttacct

SEQ ID NO: 3022909 - DNA, 23 bp, Homo sapiens
cttttatctattctgagaaaaca

SEQ ID NO: 3022910 - DNA, 19 bp, Homo sapiens
cttttatctgtagcagaaa

SEQ ID NO: 3022911 - DNA, 15 bp, Homo sapiens
cttttatgtttgtac

SEQ ID NO: 3022912 - DNA, 23 bp, Homo sapiens
cttttatgtttgtacacaacacc

SEQ ID NO: 3022913 - DNA, 22 bp, Homo sapiens
cttttattagccagtgaaacac

SEQ ID NO: 3022914 - DNA, 15 bp, Homo sapiens
cttttatttcattca

SEQ ID NO: 3022915 - DNA, 13 bp, Homo sapiens
cttttattttttc

SEQ ID NO: 3022916 - DNA, 23 bp, Homo sapiens
cttttattttttcttttgtaatt

SEQ ID NO: 3022917 - DNA, 21 bp, Homo sapiens
cttttcacctttactttagaa

SEQ ID NO: 3022918 - DNA, 20 bp, Homo sapiens
cttttcacttcctctccaca

SEQ ID NO: 3022919 - DNA, 14 bp, Homo sapiens
cttttcacttgtct

SEQ ID NO: 3022920 - DNA, 20 bp, Homo sapiens
cttttcacttgtcttgctct

SEQ ID NO: 3022921 - DNA, 23 bp, Homo sapiens
cttttcactttctacttttttca

SEQ ID NO: 3022922 - DNA, 20 bp, Homo sapiens
cttttcagccaatttgtctc

SEQ ID NO: 3022923 - DNA, 12 bp, Homo sapiens
cttttcattgca

SEQ ID NO: 3022924 - DNA, 17 bp, Homo sapiens
cttttccaaatgcccaa

SEQ ID NO: 3022925 - DNA, 11 bp, Homo sapiens
cttttccagaa

SEQ ID NO: 3022926 - DNA, 16 bp, Homo sapiens
cttttccattatgctg

SEQ ID NO: 3022927 - DNA, 19 bp, Homo sapiens
cttttcccctcattgcatt

SEQ ID NO: 3022928 - DNA, 16 bp, Homo sapiens
cttttcctctctctcc

SEQ ID NO: 3022929 - DNA, 13 bp, Homo sapiens
cttttcctctctg

SEQ ID NO: 3022930 - DNA, 16 bp, Homo sapiens
cttttcctctctgtct

SEQ ID NO: 3022931 - DNA, 13 bp, Homo sapiens
cttttccttgggg

SEQ ID NO: 3022932 - DNA, 20 bp, Homo sapiens
cttttccttggggcaggcag

SEQ ID NO: 3022933 - DNA, 21 bp, Homo sapiens
cttttccttggggcaggcagt

SEQ ID NO: 3022934 - DNA, 16 bp, Homo sapiens
cttttcgaactgtgct

SEQ ID NO: 3022935 - DNA, 19 bp, Homo sapiens
cttttctaaactgcatctg

SEQ ID NO: 3022936 - DNA, 22 bp, Homo sapiens
cttttctaaatgttattacttg

SEQ ID NO: 3022937 - DNA, 19 bp, Homo sapiens
cttttctataatgtgcctg

SEQ ID NO: 3022938 - DNA, 17 bp, Homo sapiens
cttttctcctgcatgtg

SEQ ID NO: 3022939 - DNA, 21 bp, Homo sapiens
cttttctggggaaagacactg

SEQ ID NO: 3022940 - DNA, 22 bp, Homo sapiens
cttttctgtgaagccctttgcc

SEQ ID NO: 3022941 - DNA, 12 bp, Homo sapiens
cttttctgtttc

SEQ ID NO: 3022942 - DNA, 19 bp, Homo sapiens
cttttctgtttcctgtacc

SEQ ID NO: 3022943 - DNA, 14 bp, Homo sapiens
cttttcttcctggc

SEQ ID NO: 3022944 - DNA, 20 bp, Homo sapiens
cttttcttggaactgtccca

SEQ ID NO: 3022945 - DNA, 23 bp, Homo sapiens
cttttctttaagttttatttaac

SEQ ID NO: 3022946 - DNA, 21 bp, Homo sapiens
cttttctttagagaactgaaa

SEQ ID NO: 3022947 - DNA, 21 bp, Homo sapiens
cttttgaacgtatgtgctctt

SEQ ID NO: 3022948 - DNA, 16 bp, Homo sapiens
cttttgaacttgtcac

SEQ ID NO: 3022949 - DNA, 22 bp, Homo sapiens
cttttgaagaacaaaaggcttt

SEQ ID NO: 3022950 - DNA, 14 bp, Homo sapiens
cttttgaagtgttt

SEQ ID NO: 3022951 - DNA, 13 bp, Homo sapiens
cttttgaatattc

SEQ ID NO: 3022952 - DNA, 16 bp, Homo sapiens
cttttgacattttatt

SEQ ID NO: 3022953 - DNA, 15 bp, Homo sapiens
cttttgatctctgct

SEQ ID NO: 3022954 - DNA, 23 bp, Homo sapiens
cttttgcagaagagggtgtgttt

SEQ ID NO: 3022955 - DNA, 23 bp, Homo sapiens
cttttgcctgcctgtgctatttt

SEQ ID NO: 3022956 - DNA, 14 bp, Homo sapiens
cttttggcttccat

SEQ ID NO: 3022957 - DNA, 19 bp, Homo sapiens
cttttgggtagttgttttt

SEQ ID NO: 3022958 - DNA, 24 bp, Homo sapiens
cttttggtatttgtttgtagcttt

SEQ ID NO: 3022959 - DNA, 18 bp, Homo sapiens
cttttggtgctctcacct

SEQ ID NO: 3022960 - DNA, 19 bp, Homo sapiens
cttttggtgtcattattcc

SEQ ID NO: 3022961 - DNA, 16 bp, Homo sapiens
gaagggaggggctgtg

SEQ ID NO: 3022962 - DNA, 16 bp, Homo sapiens
gaagggccagagccag

SEQ ID NO: 3022963 - DNA, 17 bp, Homo sapiens
gaagggccagagccagg

SEQ ID NO: 3022964 - DNA, 16 bp, Homo sapiens
gaaggggacccccgcc

SEQ ID NO: 3022965 - DNA, 16 bp, Homo sapiens
gaaggggatggtgttg

SEQ ID NO: 3022966 - DNA, 16 bp, Homo sapiens
gaaggggcctccctcc

SEQ ID NO: 3022967 - DNA, 23 bp, Homo sapiens
gaaggggggccgccgctgaccct

SEQ ID NO: 3022968 - DNA, 18 bp, Homo sapiens
gaaggggtgcaggtgggg

SEQ ID NO: 3022969 - DNA, 13 bp, Homo sapiens
gaaggtaaaattg

SEQ ID NO: 3022970 - DNA, 18 bp, Homo sapiens
gaaggtaactaagaagtg

SEQ ID NO: 3022971 - DNA, 15 bp, Homo sapiens
gaaggtcccctggca

SEQ ID NO: 3022972 - DNA, 16 bp, Homo sapiens
gaaggtctgatttgca

SEQ ID NO: 3022973 - DNA, 19 bp, Homo sapiens
gaaggtctgatttgcagga

SEQ ID NO: 3022974 - DNA, 13 bp, Homo sapiens
gaaggtgaacttt

SEQ ID NO: 3022975 - DNA, 19 bp, Homo sapiens
gaaggtgaccgcccagctc

SEQ ID NO: 3022976 - DNA, 24 bp, Homo sapiens
gaaggtgaccgcccagctctccca

SEQ ID NO: 3022977 - DNA, 17 bp, Homo sapiens
gaaggtgccagaaggaa

SEQ ID NO: 3022978 - DNA, 18 bp, Homo sapiens
gaaggtgccagaaggaag

SEQ ID NO: 3022979 - DNA, 19 bp, Homo sapiens
gaaggtgccagaaggaagg

SEQ ID NO: 3022980 - DNA, 18 bp, Homo sapiens
gaaggtgctgacggccag

SEQ ID NO: 3022981 - DNA, 19 bp, Homo sapiens
gaaggtgctgacggccagg

SEQ ID NO: 3022982 - DNA, 12 bp, Homo sapiens
gaaggtgtgcta

SEQ ID NO: 3022983 - DNA, 18 bp, Homo sapiens
gaaggttaaaggaaaagc

SEQ ID NO: 3022984 - DNA, 14 bp, Homo sapiens
gaagtaaactgcag

SEQ ID NO: 3022985 - DNA, 19 bp, Homo sapiens
gaagtaaaggcattccaca

SEQ ID NO: 3022986 - DNA, 12 bp, Homo sapiens
gaagtaacttat

SEQ ID NO: 3022987 - DNA, 19 bp, Homo sapiens
gaagtaagaagaggagcct

SEQ ID NO: 3022988 - DNA, 22 bp, Homo sapiens
gaagtaagcagagttctttgca

SEQ ID NO: 3022989 - DNA, 22 bp, Homo sapiens
gaagtaattatcagttggtttg

SEQ ID NO: 3022990 - DNA, 19 bp, Homo sapiens
gaagtacttgccagaagtt

SEQ ID NO: 3022991 - DNA, 15 bp, Homo sapiens
gaagtcaaagcaagg

SEQ ID NO: 3022992 - DNA, 23 bp, Homo sapiens
gaagtcaaataaatgtttccccc

SEQ ID NO: 3022993 - DNA, 21 bp, Homo sapiens
gaagtcaatttgggggacatg

SEQ ID NO: 3022994 - DNA, 14 bp, Homo sapiens
gaagtcagaatttt

SEQ ID NO: 3022995 - DNA, 17 bp, Homo sapiens
gaagtcagaatttttaa

SEQ ID NO: 3022996 - DNA, 18 bp, Homo sapiens
gaagtcagagaaaacact

SEQ ID NO: 3022997 - DNA, 14 bp, Homo sapiens
gaagtccaatgtgg

SEQ ID NO: 3022998 - DNA, 22 bp, Homo sapiens
gaagtcctatggaaacccgagg

SEQ ID NO: 3022999 - DNA, 21 bp, Homo sapiens
gaagtcctgggaggatcctga

SEQ ID NO: 3023000 - DNA, 18 bp, Homo sapiens
gaagtcctgtatgtctgt

SEQ ID NO: 3023001 - DNA, 16 bp, Homo sapiens
gaagtctaggagctgg

SEQ ID NO: 3023002 - DNA, 21 bp, Homo sapiens
gaagtctcaaagatctttcgt

SEQ ID NO: 3023003 - DNA, 16 bp, Homo sapiens
gaagtctggccatttt

SEQ ID NO: 3023004 - DNA, 17 bp, Homo sapiens
gaagtcttaaggacaaa

SEQ ID NO: 3023005 - DNA, 19 bp, Homo sapiens
gaagtcttactacagaaat

SEQ ID NO: 3023006 - DNA, 17 bp, Homo sapiens
gaagtgctacagaaagc

SEQ ID NO: 3023007 - DNA, 19 bp, Homo sapiens
gaagtgctcccctctgaaa

SEQ ID NO: 3023008 - DNA, 22 bp, Homo sapiens
gaagtggaccaggacaggacca

SEQ ID NO: 3023009 - DNA, 22 bp, Homo sapiens
gaagtggggaccccacccctca

SEQ ID NO: 3023010 - DNA, 23 bp, Homo sapiens
gaagtggggaccccacccctcat

SEQ ID NO: 3023011 - DNA, 20 bp, Homo sapiens
gaagtggtttcctgataaca

SEQ ID NO: 3023012 - DNA, 23 bp, Homo sapiens
gaagtgtgattgggaataaatat

SEQ ID NO: 3023013 - DNA, 13 bp, Homo sapiens
gaagtgttcctgt

SEQ ID NO: 3023014 - DNA, 13 bp, Homo sapiens
gaagtgttgcatg

SEQ ID NO: 3023015 - DNA, 15 bp, Homo sapiens
gaagtgttgcatgga

SEQ ID NO: 3023016 - DNA, 18 bp, Homo sapiens
gaagtgttgcatggatgt

SEQ ID NO: 3023017 - DNA, 21 bp, Homo sapiens
gaagtgttgcatggatgtttt

SEQ ID NO: 3023018 - DNA, 21 bp, Homo sapiens
gaagttaaaaaacagctgcat

SEQ ID NO: 3023019 - DNA, 15 bp, Homo sapiens
gaagttactttctta

SEQ ID NO: 3023020 - DNA, 22 bp, Homo sapiens
gaagttaggttcttaaaagtgc

SEQ ID NO: 3023021 - DNA, 15 bp, Homo sapiens
gaagttcaccattaa

SEQ ID NO: 3023022 - DNA, 20 bp, Homo sapiens
gaagttcaccattaaaaggg

SEQ ID NO: 3023023 - DNA, 12 bp, Homo sapiens
gaagttcatttt

SEQ ID NO: 3023024 - DNA, 13 bp, Homo sapiens
gaagttcattttt

SEQ ID NO: 3023025 - DNA, 13 bp, Homo sapiens
gaagttctgggtg

SEQ ID NO: 3023026 - DNA, 20 bp, Homo sapiens
gaagttggggcactgggcgt

SEQ ID NO: 3023027 - DNA, 17 bp, Homo sapiens
gaagtttggagatagat

SEQ ID NO: 3023028 - DNA, 23 bp, Homo sapiens
gaataaaagttcctctcccttcc

SEQ ID NO: 3023029 - DNA, 15 bp, Homo sapiens
gaataaaccaagaca

SEQ ID NO: 3023030 - DNA, 18 bp, Homo sapiens
gaataaactagagaaggg

SEQ ID NO: 3023031 - DNA, 17 bp, Homo sapiens
gaataaagaatacttga

SEQ ID NO: 3023032 - DNA, 19 bp, Homo sapiens
gaataaagaatacttgaac

SEQ ID NO: 3023033 - DNA, 17 bp, Homo sapiens
gaataaagaatgaatgg

SEQ ID NO: 3023034 - DNA, 11 bp, Homo sapiens
gaataaatatg

SEQ ID NO: 3023035 - DNA, 19 bp, Homo sapiens
gaataaatatgcctctcct

SEQ ID NO: 3023036 - DNA, 14 bp, Homo sapiens
gaataaatgtcttt

SEQ ID NO: 3023037 - DNA, 18 bp, Homo sapiens
gaataaattaatattgta

SEQ ID NO: 3023038 - DNA, 21 bp, Homo sapiens
gaataaattaatattgtattg

SEQ ID NO: 3023039 - DNA, 20 bp, Homo sapiens
gaataagagacctgttttaa

SEQ ID NO: 3023040 - DNA, 22 bp, Homo sapiens
gaataagagacctgttttaaaa

SEQ ID NO: 3023041 - DNA, 16 bp, Homo sapiens
gaataagttattgcag

SEQ ID NO: 3023042 - DNA, 21 bp, Homo sapiens
gaataataaatacacaatgaa

SEQ ID NO: 3023043 - DNA, 14 bp, Homo sapiens
gaataataagcagg

SEQ ID NO: 3023044 - DNA, 20 bp, Homo sapiens
gaataatggtaccagataaa

SEQ ID NO: 3023045 - DNA, 16 bp, Homo sapiens
gaatacaatgggaaaa

SEQ ID NO: 3023046 - DNA, 12 bp, Homo sapiens
gaatacagcagc

SEQ ID NO: 3023047 - DNA, 20 bp, Homo sapiens
gaatacagcagcaagaaaaa

SEQ ID NO: 3023048 - DNA, 21 bp, Homo sapiens
gaatactgccaaaacatttat

SEQ ID NO: 3023049 - DNA, 22 bp, Homo sapiens
gaatactgccaaaacatttatg

SEQ ID NO: 3023050 - DNA, 13 bp, Homo sapiens
gaatactgtttta

SEQ ID NO: 3023051 - DNA, 16 bp, Homo sapiens
gaatacttgaacttgt

SEQ ID NO: 3023052 - DNA, 14 bp, Homo sapiens
gaatagagctgcca

SEQ ID NO: 3023053 - DNA, 15 bp, Homo sapiens
gaatagagctgccac

SEQ ID NO: 3023054 - DNA, 17 bp, Homo sapiens
gaatagagctgccactg

SEQ ID NO: 3023055 - DNA, 13 bp, Homo sapiens
gaatagcatctgt

SEQ ID NO: 3023056 - DNA, 16 bp, Homo sapiens
gaatagcatctgtaca

SEQ ID NO: 3023057 - DNA, 19 bp, Homo sapiens
gaatagcttgtttctgtca

SEQ ID NO: 3023058 - DNA, 16 bp, Homo sapiens
gaatagtcctaaaaag

SEQ ID NO: 3023059 - DNA, 16 bp, Homo sapiens
gaatagtctctgggtt

SEQ ID NO: 3023060 - DNA, 19 bp, Homo sapiens
gaatataatatatttgtgt

SEQ ID NO: 3023061 - DNA, 20 bp, Homo sapiens
gaatataatatatttgtgta

SEQ ID NO: 3023062 - DNA, 22 bp, Homo sapiens
gaatataatatttgaagcagct

SEQ ID NO: 3023063 - DNA, 12 bp, Homo sapiens
gaatataatgga

SEQ ID NO: 3023064 - DNA, 22 bp, Homo sapiens
gaatatccagtggatggattca

SEQ ID NO: 3023065 - DNA, 16 bp, Homo sapiens
gaatatgcctgtaatt

SEQ ID NO: 3023066 - DNA, 20 bp, Homo sapiens
gaatatgcctgtaattcagt

SEQ ID NO: 3023067 - DNA, 22 bp, Homo sapiens
gaatatggacagttagcattta

SEQ ID NO: 3023068 - DNA, 12 bp, Homo sapiens
gaatatgtctgc

SEQ ID NO: 3023069 - DNA, 13 bp, Homo sapiens
gaatattgtccat

SEQ ID NO: 3023070 - DNA, 15 bp, Homo sapiens
gaatattgtttcttt

SEQ ID NO: 3023071 - DNA, 22 bp, Homo sapiens
gaatatttagcataaatttaat

SEQ ID NO: 3023072 - DNA, 15 bp, Homo sapiens
gaatatttatactat

SEQ ID NO: 3023073 - DNA, 12 bp, Homo sapiens
gaatattttata

SEQ ID NO: 3023074 - DNA, 17 bp, Homo sapiens
gaatcaacatttctcaa

SEQ ID NO: 3023075 - DNA, 11 bp, Homo sapiens
gaatcaataat

SEQ ID NO: 3023076 - DNA, 21 bp, Homo sapiens
gaatcaataatatattttctg

SEQ ID NO: 3023077 - DNA, 23 bp, Homo sapiens
gaatcacagctcaagcattctgt

SEQ ID NO: 3023078 - DNA, 19 bp, Homo sapiens
gaatcacctgaaccccaga

SEQ ID NO: 3023079 - DNA, 20 bp, Homo sapiens
gaatcacctgaaccccagag

SEQ ID NO: 3023080 - DNA, 23 bp, Homo sapiens
gaatcactgtttttagacacctt

SEQ ID NO: 3023081 - DNA, 23 bp, Homo sapiens
gaatcagaacagatgctgagcca

SEQ ID NO: 3023082 - DNA, 13 bp, Homo sapiens
gaatcagaactca

SEQ ID NO: 3023083 - DNA, 15 bp, Homo sapiens
gaatcagaagaaagg

SEQ ID NO: 3023084 - DNA, 19 bp, Homo sapiens
gaatcagacttcacactgc

SEQ ID NO: 3023085 - DNA, 12 bp, Homo sapiens
gaatcagcttct

SEQ ID NO: 3023086 - DNA, 13 bp, Homo sapiens
gaatcaggaaact

SEQ ID NO: 3023087 - DNA, 14 bp, Homo sapiens
gaatcatgtagtat

SEQ ID NO: 3023088 - DNA, 22 bp, Homo sapiens
gaatcatttctatttctcctcc

SEQ ID NO: 3023089 - DNA, 19 bp, Homo sapiens
gaatccaaatctgtcctct

SEQ ID NO: 3023090 - DNA, 20 bp, Homo sapiens
gaatccaaatctgtcctctg

SEQ ID NO: 3023091 - DNA, 22 bp, Homo sapiens
gaatccaaatctgtcctctgta

SEQ ID NO: 3023092 - DNA, 16 bp, Homo sapiens
gaatccaagcgaggtc

SEQ ID NO: 3023093 - DNA, 18 bp, Homo sapiens
gacccacttctcatcaca

SEQ ID NO: 3023094 - DNA, 20 bp, Homo sapiens
gacccagcatgggttagtgc

SEQ ID NO: 3023095 - DNA, 17 bp, Homo sapiens
gacccagcccgcggcct

SEQ ID NO: 3023096 - DNA, 12 bp, Homo sapiens
gacccagctact

SEQ ID NO: 3023097 - DNA, 13 bp, Homo sapiens
gacccaggagccg

SEQ ID NO: 3023098 - DNA, 17 bp, Homo sapiens
gacccagggaacagcca

SEQ ID NO: 3023099 - DNA, 22 bp, Homo sapiens
gacccagggaacagccactccc

SEQ ID NO: 3023100 - DNA, 14 bp, Homo sapiens
gacccagtccctgg

SEQ ID NO: 3023101 - DNA, 16 bp, Homo sapiens
gacccagtccctgggg

SEQ ID NO: 3023102 - DNA, 10 bp, Homo sapiens
gacccagtgc

SEQ ID NO: 3023103 - DNA, 23 bp, Homo sapiens
gacccatgagttggggtctggca

SEQ ID NO: 3023104 - DNA, 15 bp, Homo sapiens
gacccatgggggctg

SEQ ID NO: 3023105 - DNA, 20 bp, Homo sapiens
gaccccaatatatgtatttt

SEQ ID NO: 3023106 - DNA, 11 bp, Homo sapiens
gaccccagcat

SEQ ID NO: 3023107 - DNA, 17 bp, Homo sapiens
gaccccaggcccactca

SEQ ID NO: 3023108 - DNA, 18 bp, Homo sapiens
gaccccaggcccactcag

SEQ ID NO: 3023109 - DNA, 19 bp, Homo sapiens
gaccccaggcccactcagg

SEQ ID NO: 3023110 - DNA, 17 bp, Homo sapiens
gaccccatcactcgcag

SEQ ID NO: 3023111 - DNA, 16 bp, Homo sapiens
gacccccgcagaggca

SEQ ID NO: 3023112 - DNA, 12 bp, Homo sapiens
gaccccctggag

SEQ ID NO: 3023113 - DNA, 19 bp, Homo sapiens
gaccccggcttcctttccc

SEQ ID NO: 3023114 - DNA, 20 bp, Homo sapiens
gaccccgggccggacctgag

SEQ ID NO: 3023115 - DNA, 12 bp, Homo sapiens
gacccctcacca

SEQ ID NO: 3023116 - DNA, 15 bp, Homo sapiens
gacccctcaccaccc

SEQ ID NO: 3023117 - DNA, 18 bp, Homo sapiens
gacccctcaccaccccca

SEQ ID NO: 3023118 - DNA, 12 bp, Homo sapiens
gacccctcctgg

SEQ ID NO: 3023119 - DNA, 16 bp, Homo sapiens
gacccggattggccct

SEQ ID NO: 3023120 - DNA, 17 bp, Homo sapiens
gacccggattggccctg

SEQ ID NO: 3023121 - DNA, 18 bp, Homo sapiens
gacccggattggccctgc

SEQ ID NO: 3023122 - DNA, 16 bp, Homo sapiens
gacccggggtctcctg

SEQ ID NO: 3023123 - DNA, 19 bp, Homo sapiens
gacccggggtctcctggac

SEQ ID NO: 3023124 - DNA, 20 bp, Homo sapiens
gacccggggtctcctggacc

SEQ ID NO: 3023125 - DNA, 16 bp, Homo sapiens
gaccctaccccaccac

SEQ ID NO: 3023126 - DNA, 15 bp, Homo sapiens
gaccctctcaggctg

SEQ ID NO: 3023127 - DNA, 20 bp, Homo sapiens
gaccctctcaggctgtccca

SEQ ID NO: 3023128 - DNA, 13 bp, Homo sapiens
gaccctctgtccc

SEQ ID NO: 3023129 - DNA, 17 bp, Homo sapiens
gaccctctgtccccagg

SEQ ID NO: 3023130 - DNA, 18 bp, Homo sapiens
gaccctctgtccccaggc

SEQ ID NO: 3023131 - DNA, 21 bp, Homo sapiens
gaccctctgtccccaggcctg

SEQ ID NO: 3023132 - DNA, 23 bp, Homo sapiens
gaccctctgtccccaggcctggc

SEQ ID NO: 3023133 - DNA, 16 bp, Homo sapiens
gaccctgctttagagc

SEQ ID NO: 3023134 - DNA, 14 bp, Homo sapiens
gaccctggggctgg

SEQ ID NO: 3023135 - DNA, 21 bp, Homo sapiens
gaccctgggggcacaggaggc

SEQ ID NO: 3023136 - DNA, 14 bp, Homo sapiens
gaccctgtggaagc

SEQ ID NO: 3023137 - DNA, 15 bp, Homo sapiens
gacccttaggccttt

SEQ ID NO: 3023138 - DNA, 17 bp, Homo sapiens
gacccttctccaaaggc

SEQ ID NO: 3023139 - DNA, 21 bp, Homo sapiens
gacccttctccaaaggctctg

SEQ ID NO: 3023140 - DNA, 14 bp, Homo sapiens
gaccctttccttcc

SEQ ID NO: 3023141 - DNA, 16 bp, Homo sapiens
gaccgccatggtgctg

SEQ ID NO: 3023142 - DNA, 13 bp, Homo sapiens
gaccgctgcccag

SEQ ID NO: 3023143 - DNA, 15 bp, Homo sapiens
gaccgctgcccaggt

SEQ ID NO: 3023144 - DNA, 20 bp, Homo sapiens
gaccgggacccggcggccct

SEQ ID NO: 3023145 - DNA, 14 bp, Homo sapiens
gaccgggcactccc

SEQ ID NO: 3023146 - DNA, 16 bp, Homo sapiens
gaccggttcccacaag

SEQ ID NO: 3023147 - DNA, 20 bp, Homo sapiens
gacctacagacagacataca

SEQ ID NO: 3023148 - DNA, 13 bp, Homo sapiens
gacctactctcat

SEQ ID NO: 3023149 - DNA, 15 bp, Homo sapiens
gacctactgttctaa

SEQ ID NO: 3023150 - DNA, 23 bp, Homo sapiens
gacctattgccaggaatgtttca

SEQ ID NO: 3023151 - DNA, 20 bp, Homo sapiens
gacctcaagtgatctgtcca

SEQ ID NO: 3023152 - DNA, 17 bp, Homo sapiens
gacctcacctggtcctc

SEQ ID NO: 3023153 - DNA, 13 bp, Homo sapiens
gacctcagatgtg

SEQ ID NO: 3023154 - DNA, 13 bp, Homo sapiens
gacctcagcctgc

SEQ ID NO: 3023155 - DNA, 16 bp, Homo sapiens
gacctcagcctgcacc

SEQ ID NO: 3023156 - DNA, 14 bp, Homo sapiens
gacctcatccaaac

SEQ ID NO: 3023157 - DNA, 19 bp, Homo sapiens
gacctcatgatccacccac

SEQ ID NO: 3023158 - DNA, 16 bp, Homo sapiens
gacctccaagccactg

SEQ ID NO: 3023159 - DNA, 21 bp, Homo sapiens
gacctccagtcctgctggcct

SEQ ID NO: 3023160 - DNA, 24 bp, Homo sapiens
gacctccagtcctgctggcctgct

SEQ ID NO: 3023161 - DNA, 17 bp, Homo sapiens
gacctccatactgggct

SEQ ID NO: 3023162 - DNA, 19 bp, Homo sapiens
gacctcctccctgttattt

SEQ ID NO: 3023163 - DNA, 13 bp, Homo sapiens
gacctcctgacaa

SEQ ID NO: 3023164 - DNA, 22 bp, Homo sapiens
gacctcggatgaccatactcag

SEQ ID NO: 3023165 - DNA, 14 bp, Homo sapiens
gacctctctcagcc

SEQ ID NO: 3023166 - DNA, 13 bp, Homo sapiens
gacctctcttgtg

SEQ ID NO: 3023167 - DNA, 17 bp, Homo sapiens
gacctgaaattccaaag

SEQ ID NO: 3023168 - DNA, 14 bp, Homo sapiens
gacctgaactctgc

SEQ ID NO: 3023169 - DNA, 22 bp, Homo sapiens
gacctgaactctgcaactgaat

SEQ ID NO: 3023170 - DNA, 13 bp, Homo sapiens
gacctgaggaagc

SEQ ID NO: 3023171 - DNA, 15 bp, Homo sapiens
gacctgatcctggag

SEQ ID NO: 3023172 - DNA, 18 bp, Homo sapiens
gacctgatcctggaggcc

SEQ ID NO: 3023173 - DNA, 14 bp, Homo sapiens
gacctgatggagag

SEQ ID NO: 3023174 - DNA, 23 bp, Homo sapiens
gacctgatttctgagcatttaat

SEQ ID NO: 3023175 - DNA, 15 bp, Homo sapiens
gacctgcgggtcctc

SEQ ID NO: 3023176 - DNA, 16 bp, Homo sapiens
gacctgcgggtcctca

SEQ ID NO: 3023177 - DNA, 18 bp, Homo sapiens
gacctgcgggtcctcagc

SEQ ID NO: 3023178 - DNA, 18 bp, Homo sapiens
gacctggacacaggcctg

SEQ ID NO: 3023179 - DNA, 17 bp, Homo sapiens
gacctggactagggcct

SEQ ID NO: 3023180 - DNA, 18 bp, Homo sapiens
gacctggactagggcctc

SEQ ID NO: 3023181 - DNA, 13 bp, Homo sapiens
gacctggttttta

SEQ ID NO: 3023182 - DNA, 17 bp, Homo sapiens
gacctgtaacttttgta

SEQ ID NO: 3023183 - DNA, 23 bp, Homo sapiens
gacctgtatatttgtaaagctat

SEQ ID NO: 3023184 - DNA, 10 bp, Homo sapiens
gacctgtcca

SEQ ID NO: 3023185 - DNA, 18 bp, Homo sapiens
gacctgtcctctttgtga

SEQ ID NO: 3023186 - DNA, 16 bp, Homo sapiens
gacctgtcgtctctcc

SEQ ID NO: 3023187 - DNA, 22 bp, Homo sapiens
gacctgtcgtctctcccacccc

SEQ ID NO: 3023188 - DNA, 23 bp, Homo sapiens
gacctgtgagcccagctgggtca

SEQ ID NO: 3023189 - DNA, 17 bp, Homo sapiens
gacctgttagcagacag

SEQ ID NO: 3023190 - DNA, 19 bp, Homo sapiens
gacctgttagcagacaggc

SEQ ID NO: 3023191 - DNA, 15 bp, Homo sapiens
gaccttaggccttcc

SEQ ID NO: 3023192 - DNA, 21 bp, Homo sapiens
gaccttaggccttcctctctc

SEQ ID NO: 3023193 - DNA, 16 bp, Homo sapiens
gaccttagtgtttctg

SEQ ID NO: 3023194 - DNA, 18 bp, Homo sapiens
gaccttcgggctgtgccc

SEQ ID NO: 3023195 - DNA, 18 bp, Homo sapiens
gaccttggggtacaattg

SEQ ID NO: 3023196 - DNA, 12 bp, Homo sapiens
gacctttaaaaa

SEQ ID NO: 3023197 - DNA, 16 bp, Homo sapiens
gacctttaaaaagcag

SEQ ID NO: 3023198 - DNA, 23 bp, Homo sapiens
gacctttattgggtatcaagaca

SEQ ID NO: 3023199 - DNA, 14 bp, Homo sapiens
gacctttgcccaca

SEQ ID NO: 3023200 - DNA, 15 bp, Homo sapiens
gacctttgcccacac

SEQ ID NO: 3023201 - DNA, 21 bp, Homo sapiens
gacgaacatccaaccttccca

SEQ ID NO: 3023202 - DNA, 13 bp, Homo sapiens
gacgcaggcccct

SEQ ID NO: 3023203 - DNA, 14 bp, Homo sapiens
gacgcaggccctgt

SEQ ID NO: 3023204 - DNA, 11 bp, Homo sapiens
gacgcccaccc

SEQ ID NO: 3023205 - DNA, 22 bp, Homo sapiens
gacgccccggggcgcctagagc

SEQ ID NO: 3023206 - DNA, 13 bp, Homo sapiens
gacgcctgaggaa

SEQ ID NO: 3023207 - DNA, 14 bp, Homo sapiens
gacgcctgaggaac

SEQ ID NO: 3023208 - DNA, 19 bp, Homo sapiens
gacgcctgggggtgccagg

SEQ ID NO: 3023209 - DNA, 22 bp, Homo sapiens
gacgcgaggggaaaggcctgtg

SEQ ID NO: 3023210 - DNA, 16 bp, Homo sapiens
gacgctgaataaatgt

SEQ ID NO: 3023211 - DNA, 14 bp, Homo sapiens
gacggagccgggaa

SEQ ID NO: 3023212 - DNA, 16 bp, Homo sapiens
gacggccaagaatgta

SEQ ID NO: 3023213 - DNA, 13 bp, Homo sapiens
gacggcgctgcct

SEQ ID NO: 3023214 - DNA, 22 bp, Homo sapiens
gacggcggggtgtggtggcctg

SEQ ID NO: 3023215 - DNA, 17 bp, Homo sapiens
gacggcgtttcaccatg

SEQ ID NO: 3023216 - DNA, 12 bp, Homo sapiens
gacggctccact

SEQ ID NO: 3023217 - DNA, 20 bp, Homo sapiens
gacggctgccattggtccac

SEQ ID NO: 3023218 - DNA, 12 bp, Homo sapiens
gacggctgggca

SEQ ID NO: 3023219 - DNA, 22 bp, Homo sapiens
gacggctgggcacacgcctccc

SEQ ID NO: 3023220 - DNA, 19 bp, Homo sapiens
gacggctgtgacgcagccg

SEQ ID NO: 3023221 - DNA, 17 bp, Homo sapiens
gacggggtttcatcatg

SEQ ID NO: 3023222 - DNA, 22 bp, Homo sapiens
gacgggtgcccgtaatcccagc

SEQ ID NO: 3023223 - DNA, 23 bp, Homo sapiens
gacgggtgcccgtaatcccagct

SEQ ID NO: 3023224 - DNA, 15 bp, Homo sapiens
gacggtttccaggga

SEQ ID NO: 3023225 - DNA, 12 bp, Homo sapiens
gacgtaaaattt

SEQ ID NO: 3023226 - DNA, 18 bp, Homo sapiens
gagccaattagacttgaa

SEQ ID NO: 3023227 - DNA, 19 bp, Homo sapiens
gagccaattagacttgaaa

SEQ ID NO: 3023228 - DNA, 21 bp, Homo sapiens
gagccacaggaacggccctgc

SEQ ID NO: 3023229 - DNA, 20 bp, Homo sapiens
gagccacaggcaggggtgag

SEQ ID NO: 3023230 - DNA, 12 bp, Homo sapiens
gagccacctcac

SEQ ID NO: 3023231 - DNA, 12 bp, Homo sapiens
gagccagagaag

SEQ ID NO: 3023232 - DNA, 17 bp, Homo sapiens
gagccagagaagtgaca

SEQ ID NO: 3023233 - DNA, 19 bp, Homo sapiens
gagccagccctccctgtcc

SEQ ID NO: 3023234 - DNA, 18 bp, Homo sapiens
gagccagctccctctatt

SEQ ID NO: 3023235 - DNA, 13 bp, Homo sapiens
gagccaggagacc

SEQ ID NO: 3023236 - DNA, 23 bp, Homo sapiens
gagccaggagacctgctctccgg

SEQ ID NO: 3023237 - DNA, 21 bp, Homo sapiens
gagccaggctagctggagcct

SEQ ID NO: 3023238 - DNA, 22 bp, Homo sapiens
gagccaggctagctggagcctg

SEQ ID NO: 3023239 - DNA, 14 bp, Homo sapiens
gagccaggcttgga

SEQ ID NO: 3023240 - DNA, 18 bp, Homo sapiens
gagccaggcttggatgga

SEQ ID NO: 3023241 - DNA, 15 bp, Homo sapiens
gagccagggtagagc

SEQ ID NO: 3023242 - DNA, 18 bp, Homo sapiens
gagccagttgtcctatgg

SEQ ID NO: 3023243 - DNA, 17 bp, Homo sapiens
gagccatcttggcaggg

SEQ ID NO: 3023244 - DNA, 19 bp, Homo sapiens
gagccatggaaggtgccag

SEQ ID NO: 3023245 - DNA, 22 bp, Homo sapiens
gagccatggaccacgcaggaag

SEQ ID NO: 3023246 - DNA, 14 bp, Homo sapiens
gagcccaagggaat

SEQ ID NO: 3023247 - DNA, 12 bp, Homo sapiens
gagcccacccag

SEQ ID NO: 3023248 - DNA, 14 bp, Homo sapiens
gagcccacccagca

SEQ ID NO: 3023249 - DNA, 24 bp, Homo sapiens
gagcccactgtcctgggcctgcag

SEQ ID NO: 3023250 - DNA, 13 bp, Homo sapiens
gagcccagcccag

SEQ ID NO: 3023251 - DNA, 17 bp, Homo sapiens
gagcccagcggcccaag

SEQ ID NO: 3023252 - DNA, 18 bp, Homo sapiens
gagcccagcggcccaaga

SEQ ID NO: 3023253 - DNA, 11 bp, Homo sapiens
gagcccagctc

SEQ ID NO: 3023254 - DNA, 13 bp, Homo sapiens
gagcccagctcca

SEQ ID NO: 3023255 - DNA, 22 bp, Homo sapiens
gagcccagctcttgctctcttg

SEQ ID NO: 3023256 - DNA, 15 bp, Homo sapiens
gagcccagtgggctg

SEQ ID NO: 3023257 - DNA, 20 bp, Homo sapiens
gagcccagtgggctgcacgc

SEQ ID NO: 3023258 - DNA, 23 bp, Homo sapiens
gagcccatggtaacgaaccccta

SEQ ID NO: 3023259 - DNA, 14 bp, Homo sapiens
gagccccactgccc

SEQ ID NO: 3023260 - DNA, 15 bp, Homo sapiens
gagccccactgccct

SEQ ID NO: 3023261 - DNA, 19 bp, Homo sapiens
gagccccactgcccttctc

SEQ ID NO: 3023262 - DNA, 19 bp, Homo sapiens
gagcccccagctgccaaag

SEQ ID NO: 3023263 - DNA, 12 bp, Homo sapiens
gagcccctcctc

SEQ ID NO: 3023264 - DNA, 16 bp, Homo sapiens
gagcccctcctccccc

SEQ ID NO: 3023265 - DNA, 13 bp, Homo sapiens
gagcccctcggct

SEQ ID NO: 3023266 - DNA, 15 bp, Homo sapiens
gagcccctcggctct

SEQ ID NO: 3023267 - DNA, 19 bp, Homo sapiens
gagcccctcggctctggag

SEQ ID NO: 3023268 - DNA, 13 bp, Homo sapiens
gagcccctgaaag

SEQ ID NO: 3023269 - DNA, 23 bp, Homo sapiens
gagcccctgagtccgcctgcgcc

SEQ ID NO: 3023270 - DNA, 20 bp, Homo sapiens
gagcccctgtctagagaggg

SEQ ID NO: 3023271 - DNA, 22 bp, Homo sapiens
gagccccttctgctcagctctg

SEQ ID NO: 3023272 - DNA, 13 bp, Homo sapiens
gagccctcagaac

SEQ ID NO: 3023273 - DNA, 14 bp, Homo sapiens
gagccctccccagg

SEQ ID NO: 3023274 - DNA, 18 bp, Homo sapiens
gagccctccgccttcaca

SEQ ID NO: 3023275 - DNA, 20 bp, Homo sapiens
gagccctctagggcagggtg

SEQ ID NO: 3023276 - DNA, 23 bp, Homo sapiens
gagccctgctatgaaaggaataa

SEQ ID NO: 3023277 - DNA, 13 bp, Homo sapiens
gagccctgggtga

SEQ ID NO: 3023278 - DNA, 14 bp, Homo sapiens
gagccgccaccggg

SEQ ID NO: 3023279 - DNA, 22 bp, Homo sapiens
gagccgccaccgggcatgtctg

SEQ ID NO: 3023280 - DNA, 21 bp, Homo sapiens
gagccggagggcaccagggac

SEQ ID NO: 3023281 - DNA, 22 bp, Homo sapiens
gagccggcatccttgcctgtct

SEQ ID NO: 3023282 - DNA, 17 bp, Homo sapiens
gagccgggtctgcctct

SEQ ID NO: 3023283 - DNA, 20 bp, Homo sapiens
gagccgggtggatcgcctga

SEQ ID NO: 3023284 - DNA, 11 bp, Homo sapiens
gagcctcagaa

SEQ ID NO: 3023285 - DNA, 17 bp, Homo sapiens
gagcctctgctccccag

SEQ ID NO: 3023286 - DNA, 10 bp, Homo sapiens
gagcctgagg

SEQ ID NO: 3023287 - DNA, 15 bp, Homo sapiens
gagcctgaggcagga

SEQ ID NO: 3023288 - DNA, 17 bp, Homo sapiens
gagcctgaggcaggaga

SEQ ID NO: 3023289 - DNA, 16 bp, Homo sapiens
gagcctgcagggaagc

SEQ ID NO: 3023290 - DNA, 12 bp, Homo sapiens
gagcctggaagc

SEQ ID NO: 3023291 - DNA, 15 bp, Homo sapiens
gagcctggaagcact

SEQ ID NO: 3023292 - DNA, 22 bp, Homo sapiens
gagcctgtccccgccttccctc

SEQ ID NO: 3023293 - DNA, 16 bp, Homo sapiens
gagcctgtgaccttgg

SEQ ID NO: 3023294 - DNA, 18 bp, Homo sapiens
gagcctgtgaccttggga

SEQ ID NO: 3023295 - DNA, 22 bp, Homo sapiens
gagccttctgaggacattccaa

SEQ ID NO: 3023296 - DNA, 13 bp, Homo sapiens
gagccttgctgcc

SEQ ID NO: 3023297 - DNA, 14 bp, Homo sapiens
gagccttgctgcca

SEQ ID NO: 3023298 - DNA, 20 bp, Homo sapiens
gagccttggtgtccacctgg

SEQ ID NO: 3023299 - DNA, 23 bp, Homo sapiens
gagcctttggttctggccagaat

SEQ ID NO: 3023300 - DNA, 18 bp, Homo sapiens
gagcgaggaaaaacaaca

SEQ ID NO: 3023301 - DNA, 18 bp, Homo sapiens
gagcgaggagatgctcct

SEQ ID NO: 3023302 - DNA, 12 bp, Homo sapiens
gagcgaggaggc

SEQ ID NO: 3023303 - DNA, 21 bp, Homo sapiens
gagcgaggaggcgcggcctcc

SEQ ID NO: 3023304 - DNA, 21 bp, Homo sapiens
gagcgagtggatgctgtgcta

SEQ ID NO: 3023305 - DNA, 18 bp, Homo sapiens
gagcgcaagccacagcct

SEQ ID NO: 3023306 - DNA, 22 bp, Homo sapiens
gagcgcaagccacagcctgtct

SEQ ID NO: 3023307 - DNA, 16 bp, Homo sapiens
gagcgcctgcccctcc

SEQ ID NO: 3023308 - DNA, 17 bp, Homo sapiens
gagcgcggctggctctg

SEQ ID NO: 3023309 - DNA, 15 bp, Homo sapiens
gagcggaaagcagct

SEQ ID NO: 3023310 - DNA, 17 bp, Homo sapiens
gagcggccgcagagact

SEQ ID NO: 3023311 - DNA, 18 bp, Homo sapiens
gagcggccgcagagactg

SEQ ID NO: 3023312 - DNA, 12 bp, Homo sapiens
gagcggctgctc

SEQ ID NO: 3023313 - DNA, 20 bp, Homo sapiens
gagcggctgctcgcccagga

SEQ ID NO: 3023314 - DNA, 14 bp, Homo sapiens
gagcgggagggagt

SEQ ID NO: 3023315 - DNA, 20 bp, Homo sapiens
gagcgggagggagtctcagg

SEQ ID NO: 3023316 - DNA, 22 bp, Homo sapiens
gagcgggagggagtctcaggag

SEQ ID NO: 3023317 - DNA, 12 bp, Homo sapiens
gagcgggcaggg

SEQ ID NO: 3023318 - DNA, 19 bp, Homo sapiens
gagcggtgctgtcctcagg

SEQ ID NO: 3023319 - DNA, 17 bp, Homo sapiens
gagcgtaaatgggtcat

SEQ ID NO: 3023320 - DNA, 13 bp, Homo sapiens
gagcgtgaaggac

SEQ ID NO: 3023321 - DNA, 16 bp, Homo sapiens
gagcgtttaaagtact

SEQ ID NO: 3023322 - DNA, 19 bp, Homo sapiens
gagcgtttaaagtactgag

SEQ ID NO: 3023323 - DNA, 14 bp, Homo sapiens
gagctaataaatct

SEQ ID NO: 3023324 - DNA, 18 bp, Homo sapiens
gagctacccgcagagttc

SEQ ID NO: 3023325 - DNA, 15 bp, Homo sapiens
gagctacttcttatt

SEQ ID NO: 3023326 - DNA, 13 bp, Homo sapiens
gagctagccagag

SEQ ID NO: 3023327 - DNA, 14 bp, Homo sapiens
gagctagcgctgcc

SEQ ID NO: 3023328 - DNA, 18 bp, Homo sapiens
gagctagcgctgccgcac

SEQ ID NO: 3023329 - DNA, 19 bp, Homo sapiens
gagctagcgctgccgcacc

SEQ ID NO: 3023330 - DNA, 18 bp, Homo sapiens
gagctcagacccccactc

SEQ ID NO: 3023331 - DNA, 20 bp, Homo sapiens
gagctcaggaaccgaggcag

SEQ ID NO: 3023332 - DNA, 22 bp, Homo sapiens
gagctcaggaaccgaggcaggg

SEQ ID NO: 3023333 - DNA, 23 bp, Homo sapiens
gagctcaggaaccgaggcaggga

SEQ ID NO: 3023334 - DNA, 18 bp, Homo sapiens
gagctccaactcagaagg

SEQ ID NO: 3023335 - DNA, 16 bp, Homo sapiens
gagctcccaggtgcag

SEQ ID NO: 3023336 - DNA, 20 bp, Homo sapiens
gagctcccaggtgcagccag

SEQ ID NO: 3023337 - DNA, 17 bp, Homo sapiens
gagctcgcagcccccgc

SEQ ID NO: 3023338 - DNA, 20 bp, Homo sapiens
gagctcgcagcccccgcgcc

SEQ ID NO: 3023339 - DNA, 17 bp, Homo sapiens
gagctctccaggccagg

SEQ ID NO: 3023340 - DNA, 19 bp, Homo sapiens
gagctctccaggccaggtg

SEQ ID NO: 3023341 - DNA, 19 bp, Homo sapiens
gagctctgacccacagcct

SEQ ID NO: 3023342 - DNA, 20 bp, Homo sapiens
gagctctgcctcaactccac

SEQ ID NO: 3023343 - DNA, 15 bp, Homo sapiens
gagctctgcgccagg

SEQ ID NO: 3023344 - DNA, 16 bp, Homo sapiens
gagctctgcgccaggc

SEQ ID NO: 3023345 - DNA, 18 bp, Homo sapiens
gagctctgcgccaggcag

SEQ ID NO: 3023346 - DNA, 20 bp, Homo sapiens
gagctctgtgggtctctgga

SEQ ID NO: 3023347 - DNA, 17 bp, Homo sapiens
gagctcttgggtcagag

SEQ ID NO: 3023348 - DNA, 13 bp, Homo sapiens
gagctgagatcgt

SEQ ID NO: 3023349 - DNA, 13 bp, Homo sapiens
gagctgagccagg

SEQ ID NO: 3023350 - DNA, 14 bp, Homo sapiens
gagctgagccaggc

SEQ ID NO: 3023351 - DNA, 13 bp, Homo sapiens
gagctgaggactc

SEQ ID NO: 3023352 - DNA, 16 bp, Homo sapiens
gagctgaggcagcagt

SEQ ID NO: 3023353 - DNA, 12 bp, Homo sapiens
gagctgaggcct

SEQ ID NO: 3023354 - DNA, 17 bp, Homo sapiens
gagctgagggagggagc

SEQ ID NO: 3023355 - DNA, 20 bp, Homo sapiens
gagctgatgtgagtgtgtgt

SEQ ID NO: 3023356 - DNA, 23 bp, Homo sapiens
gagctgcacagggtttggcccaa

SEQ ID NO: 3023357 - DNA, 16 bp, Homo sapiens
gagctgccactgggca

SEQ ID NO: 3023358 - DNA, 20 bp, Homo sapiens
gagctgccactgggcacctg

SEQ ID NO: 3023359 - DNA, 15 bp, Homo sapiens
gataaagtagtaaaa

SEQ ID NO: 3023360 - DNA, 17 bp, Homo sapiens
gataaagtagtaaaaat

SEQ ID NO: 3023361 - DNA, 18 bp, Homo sapiens
gataaagttgagagacag

SEQ ID NO: 3023362 - DNA, 14 bp, Homo sapiens
gataaagtttctca

SEQ ID NO: 3023363 - DNA, 16 bp, Homo sapiens
gataaagtttctcaga

SEQ ID NO: 3023364 - DNA, 20 bp, Homo sapiens
gataaataaaagatagcaat

SEQ ID NO: 3023365 - DNA, 22 bp, Homo sapiens
gataacaaagatatcttttctt

SEQ ID NO: 3023366 - DNA, 12 bp, Homo sapiens
gataacattttc

SEQ ID NO: 3023367 - DNA, 17 bp, Homo sapiens
gataactgctgtattca

SEQ ID NO: 3023368 - DNA, 13 bp, Homo sapiens
gataagattgaaa

SEQ ID NO: 3023369 - DNA, 14 bp, Homo sapiens
gataagtaagagta

SEQ ID NO: 3023370 - DNA, 14 bp, Homo sapiens
gataagtgttcttc

SEQ ID NO: 3023371 - DNA, 15 bp, Homo sapiens
gataataataataat

SEQ ID NO: 3023372 - DNA, 18 bp, Homo sapiens
gataataatgcttaataa

SEQ ID NO: 3023373 - DNA, 12 bp, Homo sapiens
gataatagattc

SEQ ID NO: 3023374 - DNA, 14 bp, Homo sapiens
gataatagattctc

SEQ ID NO: 3023375 - DNA, 22 bp, Homo sapiens
gataatggactcagctctgtct

SEQ ID NO: 3023376 - DNA, 13 bp, Homo sapiens
gataatgtattgc

SEQ ID NO: 3023377 - DNA, 22 bp, Homo sapiens
gataatttagtggattaaccag

SEQ ID NO: 3023378 - DNA, 13 bp, Homo sapiens
gataatttcaggg

SEQ ID NO: 3023379 - DNA, 22 bp, Homo sapiens
gataatttcagggaaattaatc

SEQ ID NO: 3023380 - DNA, 11 bp, Homo sapiens
gataatttttt

SEQ ID NO: 3023381 - DNA, 18 bp, Homo sapiens
gataattttttaattatt

SEQ ID NO: 3023382 - DNA, 22 bp, Homo sapiens
gatacaatgtatttatttaaaa

SEQ ID NO: 3023383 - DNA, 16 bp, Homo sapiens
gatacagcagtagaca

SEQ ID NO: 3023384 - DNA, 19 bp, Homo sapiens
gatacaggcccctgggttt

SEQ ID NO: 3023385 - DNA, 19 bp, Homo sapiens
gatacagtcaacaagcctg

SEQ ID NO: 3023386 - DNA, 22 bp, Homo sapiens
gatacagtcattatttaaagca

SEQ ID NO: 3023387 - DNA, 16 bp, Homo sapiens
gatacagtgtttttta

SEQ ID NO: 3023388 - DNA, 20 bp, Homo sapiens
gatacagtgttttttaggaa

SEQ ID NO: 3023389 - DNA, 11 bp, Homo sapiens
gatacataaaa

SEQ ID NO: 3023390 - DNA, 20 bp, Homo sapiens
gatacatccaaagcagacag

SEQ ID NO: 3023391 - DNA, 16 bp, Homo sapiens
gataccacttttcatt

SEQ ID NO: 3023392 - DNA, 18 bp, Homo sapiens
gataccatatgaatgaaa

SEQ ID NO: 3023393 - DNA, 20 bp, Homo sapiens
gataccttcatttaatatat

SEQ ID NO: 3023394 - DNA, 13 bp, Homo sapiens
gataccttgaaaa

SEQ ID NO: 3023395 - DNA, 15 bp, Homo sapiens
gatactgctgtgtaa

SEQ ID NO: 3023396 - DNA, 13 bp, Homo sapiens
gatactgtgagct

SEQ ID NO: 3023397 - DNA, 16 bp, Homo sapiens
gatagaaagcattaca

SEQ ID NO: 3023398 - DNA, 13 bp, Homo sapiens
gatagaaatgcca

SEQ ID NO: 3023399 - DNA, 14 bp, Homo sapiens
gatagaaatgccaa

SEQ ID NO: 3023400 - DNA, 14 bp, Homo sapiens
gatagaatgacagt

SEQ ID NO: 3023401 - DNA, 23 bp, Homo sapiens
gatagagactggaacactagaca

SEQ ID NO: 3023402 - DNA, 16 bp, Homo sapiens
gatagatgctggccca

SEQ ID NO: 3023403 - DNA, 17 bp, Homo sapiens
gatagatgctggcccag

SEQ ID NO: 3023404 - DNA, 18 bp, Homo sapiens
gatagatgctggcccagg

SEQ ID NO: 3023405 - DNA, 15 bp, Homo sapiens
gatagcattgtgaac

SEQ ID NO: 3023406 - DNA, 17 bp, Homo sapiens
gatagcattgtgaactg

SEQ ID NO: 3023407 - DNA, 14 bp, Homo sapiens
gatagcctgtggcc

SEQ ID NO: 3023408 - DNA, 16 bp, Homo sapiens
gatagcctgtggccct

SEQ ID NO: 3023409 - DNA, 15 bp, Homo sapiens
gatagccttgaaaac

SEQ ID NO: 3023410 - DNA, 16 bp, Homo sapiens
gatagccttgaaaaca

SEQ ID NO: 3023411 - DNA, 19 bp, Homo sapiens
gatagccttgaaaacaaac

SEQ ID NO: 3023412 - DNA, 22 bp, Homo sapiens
gatagctcaatactctctgagt

SEQ ID NO: 3023413 - DNA, 19 bp, Homo sapiens
gatagggtggcacatctgt

SEQ ID NO: 3023414 - DNA, 17 bp, Homo sapiens
gataggtcagtgcaaat

SEQ ID NO: 3023415 - DNA, 18 bp, Homo sapiens
gatagtctctgttcttca

SEQ ID NO: 3023416 - DNA, 20 bp, Homo sapiens
gatagttactgttgtgacct

SEQ ID NO: 3023417 - DNA, 21 bp, Homo sapiens
gatagttatctgttcttttga

SEQ ID NO: 3023418 - DNA, 18 bp, Homo sapiens
gatataaatactgacaat

SEQ ID NO: 3023419 - DNA, 20 bp, Homo sapiens
gatataaattaattgtgcct

SEQ ID NO: 3023420 - DNA, 18 bp, Homo sapiens
gatatacacggatgactt

SEQ ID NO: 3023421 - DNA, 14 bp, Homo sapiens
gatatatacatagc

SEQ ID NO: 3023422 - DNA, 17 bp, Homo sapiens
gatatatctttatactt

SEQ ID NO: 3023423 - DNA, 13 bp, Homo sapiens
gatatattaaatg

SEQ ID NO: 3023424 - DNA, 13 bp, Homo sapiens
gatatcccagctt

SEQ ID NO: 3023425 - DNA, 14 bp, Homo sapiens
gatatctgaatgtt

SEQ ID NO: 3023426 - DNA, 22 bp, Homo sapiens
gatatcttttctttagagaact

SEQ ID NO: 3023427 - DNA, 13 bp, Homo sapiens
gatattaaaattt

SEQ ID NO: 3023428 - DNA, 16 bp, Homo sapiens
gatattaaaatttggt

SEQ ID NO: 3023429 - DNA, 18 bp, Homo sapiens
gatattacagcttatttt

SEQ ID NO: 3023430 - DNA, 13 bp, Homo sapiens
gatattctaagac

SEQ ID NO: 3023431 - DNA, 16 bp, Homo sapiens
gatattgaccatgtga

SEQ ID NO: 3023432 - DNA, 21 bp, Homo sapiens
gatattgtgaacatttgtgat

SEQ ID NO: 3023433 - DNA, 19 bp, Homo sapiens
gatatttatggggggagaa

SEQ ID NO: 3023434 - DNA, 13 bp, Homo sapiens
gatatttatgtat

SEQ ID NO: 3023435 - DNA, 16 bp, Homo sapiens
gatatttatgtatctt

SEQ ID NO: 3023436 - DNA, 18 bp, Homo sapiens
gatatttatgtatcttga

SEQ ID NO: 3023437 - DNA, 20 bp, Homo sapiens
gatatttatgtatcttgatg

SEQ ID NO: 3023438 - DNA, 23 bp, Homo sapiens
gatatttctacaaggtgttcatt

SEQ ID NO: 3023439 - DNA, 14 bp, Homo sapiens
gatatttcttgctt

SEQ ID NO: 3023440 - DNA, 20 bp, Homo sapiens
gatattttgaaatgaacttt

SEQ ID NO: 3023441 - DNA, 20 bp, Homo sapiens
gatatttttattcaaactac

SEQ ID NO: 3023442 - DNA, 14 bp, Homo sapiens
gatatttttctcca

SEQ ID NO: 3023443 - DNA, 17 bp, Homo sapiens
gatcaaaggcacacagc

SEQ ID NO: 3023444 - DNA, 23 bp, Homo sapiens
gatcaaggccttattggaaagca

SEQ ID NO: 3023445 - DNA, 18 bp, Homo sapiens
gatcaatgacagagcctt

SEQ ID NO: 3023446 - DNA, 15 bp, Homo sapiens
gatcacaaggtcagg

SEQ ID NO: 3023447 - DNA, 13 bp, Homo sapiens
gatcacagatttt

SEQ ID NO: 3023448 - DNA, 14 bp, Homo sapiens
gatcacctgaggtc

SEQ ID NO: 3023449 - DNA, 21 bp, Homo sapiens
gatcacgccattgtactccag

SEQ ID NO: 3023450 - DNA, 23 bp, Homo sapiens
gatcacgccattgtactccagcc

SEQ ID NO: 3023451 - DNA, 20 bp, Homo sapiens
gatcactgtgaaccaacccc

SEQ ID NO: 3023452 - DNA, 11 bp, Homo sapiens
gatcagacagc

SEQ ID NO: 3023453 - DNA, 22 bp, Homo sapiens
gatcagatgctccaagattcta

SEQ ID NO: 3023454 - DNA, 22 bp, Homo sapiens
gatcagatttggtgatggaaaa

SEQ ID NO: 3023455 - DNA, 23 bp, Homo sapiens
gatcagatttggtgatggaaaaa

SEQ ID NO: 3023456 - DNA, 18 bp, Homo sapiens
gatcagcaaaaagactgg

SEQ ID NO: 3023457 - DNA, 20 bp, Homo sapiens
gatcagctttcaaagcattt

SEQ ID NO: 3023458 - DNA, 15 bp, Homo sapiens
gatcaggcacaggtc

SEQ ID NO: 3023459 - DNA, 13 bp, Homo sapiens
gatcaggcttcct

SEQ ID NO: 3023460 - DNA, 15 bp, Homo sapiens
gatcaggcttcctgg

SEQ ID NO: 3023461 - DNA, 20 bp, Homo sapiens
gatcagtataattttttaaa

SEQ ID NO: 3023462 - DNA, 18 bp, Homo sapiens
gatcagtgaaaaacatta

SEQ ID NO: 3023463 - DNA, 13 bp, Homo sapiens
gatcagtggacag

SEQ ID NO: 3023464 - DNA, 22 bp, Homo sapiens
gatcataaaagtgattcttttt

SEQ ID NO: 3023465 - DNA, 16 bp, Homo sapiens
gatcataaactggaaa

SEQ ID NO: 3023466 - DNA, 15 bp, Homo sapiens
gatcatagttgcaaa

SEQ ID NO: 3023467 - DNA, 20 bp, Homo sapiens
gatcatatgaattgctgtct

SEQ ID NO: 3023468 - DNA, 15 bp, Homo sapiens
gatcatcatttaaaa

SEQ ID NO: 3023469 - DNA, 19 bp, Homo sapiens
gatcatcgccagaggtgct

SEQ ID NO: 3023470 - DNA, 23 bp, Homo sapiens
gatcatcgtcatttgctgtgaac

SEQ ID NO: 3023471 - DNA, 13 bp, Homo sapiens
gatcatctttgct

SEQ ID NO: 3023472 - DNA, 13 bp, Homo sapiens
gatcatgtacttt

SEQ ID NO: 3023473 - DNA, 16 bp, Homo sapiens
gatccaaaagaagccc

SEQ ID NO: 3023474 - DNA, 15 bp, Homo sapiens
gatccaaatgctgtg

SEQ ID NO: 3023475 - DNA, 23 bp, Homo sapiens
gatccaaggccgcggcccagacc

SEQ ID NO: 3023476 - DNA, 17 bp, Homo sapiens
gatccacccacctcagc

SEQ ID NO: 3023477 - DNA, 19 bp, Homo sapiens
gatccacccacctcagcct

SEQ ID NO: 3023478 - DNA, 13 bp, Homo sapiens
gatccagcctggg

SEQ ID NO: 3023479 - DNA, 14 bp, Homo sapiens
gatccaggcttctc

SEQ ID NO: 3023480 - DNA, 15 bp, Homo sapiens
gatccaggcttctcc

SEQ ID NO: 3023481 - DNA, 22 bp, Homo sapiens
gatccagggacagaggccccag

SEQ ID NO: 3023482 - DNA, 13 bp, Homo sapiens
gatccatccagct

SEQ ID NO: 3023483 - DNA, 16 bp, Homo sapiens
gatcccaaagcaagga

SEQ ID NO: 3023484 - DNA, 16 bp, Homo sapiens
gatcccaacactgcca

SEQ ID NO: 3023485 - DNA, 16 bp, Homo sapiens
gatcccacagccctag

SEQ ID NO: 3023486 - DNA, 14 bp, Homo sapiens
gatcccagtttctg

SEQ ID NO: 3023487 - DNA, 17 bp, Homo sapiens
gatcccatgagctcctt

SEQ ID NO: 3023488 - DNA, 18 bp, Homo sapiens
gatccccaagtgtgaaca

SEQ ID NO: 3023489 - DNA, 17 bp, Homo sapiens
gatcccctgtcccctgg

SEQ ID NO: 3023490 - DNA, 21 bp, Homo sapiens
gatcccctgtcccctggggct

SEQ ID NO: 3023491 - DNA, 22 bp, Homo sapiens
gatcccctgtcccctggggctg

SEQ ID NO: 3023492 - DNA, 16 bp, Homo sapiens
gcacaaagggcccaga

SEQ ID NO: 3023493 - DNA, 19 bp, Homo sapiens
gcacaactttaagaggaca

SEQ ID NO: 3023494 - DNA, 19 bp, Homo sapiens
gcacaagaatcacttgaac

SEQ ID NO: 3023495 - DNA, 19 bp, Homo sapiens
gcacaataaaaccaagcct

SEQ ID NO: 3023496 - DNA, 20 bp, Homo sapiens
gcacaatattgaactttttt

SEQ ID NO: 3023497 - DNA, 13 bp, Homo sapiens
gcacaatctgttc

SEQ ID NO: 3023498 - DNA, 19 bp, Homo sapiens
gcacaatctgttctactct

SEQ ID NO: 3023499 - DNA, 14 bp, Homo sapiens
gcacaattctgttt

SEQ ID NO: 3023500 - DNA, 17 bp, Homo sapiens
gcacacagcggctgcct

SEQ ID NO: 3023501 - DNA, 18 bp, Homo sapiens
gcacacagcggctgcctc

SEQ ID NO: 3023502 - DNA, 21 bp, Homo sapiens
gcacacagcggctgcctcctg

SEQ ID NO: 3023503 - DNA, 13 bp, Homo sapiens
gcacacagggcag

SEQ ID NO: 3023504 - DNA, 17 bp, Homo sapiens
gcacaccacgcccagct

SEQ ID NO: 3023505 - DNA, 15 bp, Homo sapiens
gcacactgtgaaaat

SEQ ID NO: 3023506 - DNA, 17 bp, Homo sapiens
gcacagaagtcctgtat

SEQ ID NO: 3023507 - DNA, 18 bp, Homo sapiens
gcacagaagtcctgtatg

SEQ ID NO: 3023508 - DNA, 11 bp, Homo sapiens
gcacagacagg

SEQ ID NO: 3023509 - DNA, 16 bp, Homo sapiens
gcacagagaagacaaa

SEQ ID NO: 3023510 - DNA, 18 bp, Homo sapiens
gcacagagggcgctcctg

SEQ ID NO: 3023511 - DNA, 19 bp, Homo sapiens
gcacagagggcgctcctgt

SEQ ID NO: 3023512 - DNA, 22 bp, Homo sapiens
gcacagccaacacgcacctgcc

SEQ ID NO: 3023513 - DNA, 14 bp, Homo sapiens
gcacagctcccggc

SEQ ID NO: 3023514 - DNA, 14 bp, Homo sapiens
gcacagctcctccc

SEQ ID NO: 3023515 - DNA, 16 bp, Homo sapiens
gcacagctcctcccct

SEQ ID NO: 3023516 - DNA, 22 bp, Homo sapiens
gcacagctcctcccctgccgcc

SEQ ID NO: 3023517 - DNA, 24 bp, Homo sapiens
gcacagctcctcccctgccgcctc

SEQ ID NO: 3023518 - DNA, 15 bp, Homo sapiens
gcacaggaggcaggc

SEQ ID NO: 3023519 - DNA, 21 bp, Homo sapiens
gcacaggaggcaggcatggcc

SEQ ID NO: 3023520 - DNA, 14 bp, Homo sapiens
gcacaggccctagc

SEQ ID NO: 3023521 - DNA, 15 bp, Homo sapiens
gcacaggccctagct

SEQ ID NO: 3023522 - DNA, 21 bp, Homo sapiens
gcacaggtcaggggtgacaca

SEQ ID NO: 3023523 - DNA, 22 bp, Homo sapiens
gcacaggtcaggggtgacacag

SEQ ID NO: 3023524 - DNA, 23 bp, Homo sapiens
gcacaggtggctgtttcttgtct

SEQ ID NO: 3023525 - DNA, 17 bp, Homo sapiens
gcacagtccacagctga

SEQ ID NO: 3023526 - DNA, 23 bp, Homo sapiens
gcacagtccacagctgaagagca

SEQ ID NO: 3023527 - DNA, 16 bp, Homo sapiens
gcacagtgaagtgctg

SEQ ID NO: 3023528 - DNA, 13 bp, Homo sapiens
gcacagtggctca

SEQ ID NO: 3023529 - DNA, 16 bp, Homo sapiens
gcacagtgtcccccag

SEQ ID NO: 3023530 - DNA, 21 bp, Homo sapiens
gcacagttgaagggaggggct

SEQ ID NO: 3023531 - DNA, 15 bp, Homo sapiens
gcacagtttgaacaa

SEQ ID NO: 3023532 - DNA, 23 bp, Homo sapiens
gcacatccgcgtgtgcctgtgtg

SEQ ID NO: 3023533 - DNA, 17 bp, Homo sapiens
gcacatcctatgcaata

SEQ ID NO: 3023534 - DNA, 21 bp, Homo sapiens
gcacatctggatgccttcccc

SEQ ID NO: 3023535 - DNA, 13 bp, Homo sapiens
gcacatgaagaaa

SEQ ID NO: 3023536 - DNA, 16 bp, Homo sapiens
gcacatgaagaaatac

SEQ ID NO: 3023537 - DNA, 14 bp, Homo sapiens
gcacatgcgggctc

SEQ ID NO: 3023538 - DNA, 13 bp, Homo sapiens
gcacatggctggg

SEQ ID NO: 3023539 - DNA, 14 bp, Homo sapiens
gcacattaactgtt

SEQ ID NO: 3023540 - DNA, 21 bp, Homo sapiens
gcacattaactgttgcacttt

SEQ ID NO: 3023541 - DNA, 14 bp, Homo sapiens
gcacattgagctgt

SEQ ID NO: 3023542 - DNA, 19 bp, Homo sapiens
gcaccacacgcaaaccaac

SEQ ID NO: 3023543 - DNA, 17 bp, Homo sapiens
gcaccacactcagccct

SEQ ID NO: 3023544 - DNA, 16 bp, Homo sapiens
gcaccaccaggtctcc

SEQ ID NO: 3023545 - DNA, 20 bp, Homo sapiens
gcaccaccaggtctcccggg

SEQ ID NO: 3023546 - DNA, 22 bp, Homo sapiens
gcaccactgcactccagcctgg

SEQ ID NO: 3023547 - DNA, 16 bp, Homo sapiens
gcaccagacacccagg

SEQ ID NO: 3023548 - DNA, 17 bp, Homo sapiens
gcaccagacacccagga

SEQ ID NO: 3023549 - DNA, 18 bp, Homo sapiens
gcaccagacacccaggac

SEQ ID NO: 3023550 - DNA, 20 bp, Homo sapiens
gcaccagacacccaggactt

SEQ ID NO: 3023551 - DNA, 22 bp, Homo sapiens
gcaccagacgaacagtgaggaa

SEQ ID NO: 3023552 - DNA, 18 bp, Homo sapiens
gcaccagcgaagggagtg

SEQ ID NO: 3023553 - DNA, 19 bp, Homo sapiens
gcaccatccgccagggccc

SEQ ID NO: 3023554 - DNA, 14 bp, Homo sapiens
gcacccaccctggg

SEQ ID NO: 3023555 - DNA, 21 bp, Homo sapiens
gcacccccctgggctgagaga

SEQ ID NO: 3023556 - DNA, 18 bp, Homo sapiens
gcaccccctctcctggag

SEQ ID NO: 3023557 - DNA, 16 bp, Homo sapiens
gcaccctcttctcctc

SEQ ID NO: 3023558 - DNA, 17 bp, Homo sapiens
gcaccctggcctggtcc

SEQ ID NO: 3023559 - DNA, 19 bp, Homo sapiens
gcaccctggcctggtccct

SEQ ID NO: 3023560 - DNA, 22 bp, Homo sapiens
gcaccctggcctggtccctggt

SEQ ID NO: 3023561 - DNA, 15 bp, Homo sapiens
gcaccgaccccgggc

SEQ ID NO: 3023562 - DNA, 18 bp, Homo sapiens
gcaccgacccgaggccca

SEQ ID NO: 3023563 - DNA, 14 bp, Homo sapiens
gcaccgcagcctgt

SEQ ID NO: 3023564 - DNA, 15 bp, Homo sapiens
gcaccgcagcctgtc

SEQ ID NO: 3023565 - DNA, 19 bp, Homo sapiens
gcaccgcagcctgtcagcc

SEQ ID NO: 3023566 - DNA, 23 bp, Homo sapiens
gcaccgcctgccctcccgcacct

SEQ ID NO: 3023567 - DNA, 13 bp, Homo sapiens
gcaccgggctggc

SEQ ID NO: 3023568 - DNA, 14 bp, Homo sapiens
gcaccgtactgtgg

SEQ ID NO: 3023569 - DNA, 16 bp, Homo sapiens
gcacctaatccaggca

SEQ ID NO: 3023570 - DNA, 17 bp, Homo sapiens
gcacctaatccaggcag

SEQ ID NO: 3023571 - DNA, 16 bp, Homo sapiens
gcacctatctcagcca

SEQ ID NO: 3023572 - DNA, 15 bp, Homo sapiens
gcacctcagcctgca

SEQ ID NO: 3023573 - DNA, 16 bp, Homo sapiens
gcacctcagcctgcac

SEQ ID NO: 3023574 - DNA, 13 bp, Homo sapiens
gcacctccacgcc

SEQ ID NO: 3023575 - DNA, 22 bp, Homo sapiens
gcacctccacgccactgcctcc

SEQ ID NO: 3023576 - DNA, 11 bp, Homo sapiens
gcacctcccat

SEQ ID NO: 3023577 - DNA, 17 bp, Homo sapiens
gcacctcccatcctaat

SEQ ID NO: 3023578 - DNA, 17 bp, Homo sapiens
gcacctccccccactgc

SEQ ID NO: 3023579 - DNA, 18 bp, Homo sapiens
gcacctccccccactgca

SEQ ID NO: 3023580 - DNA, 20 bp, Homo sapiens
gcacctgaccgctgcccagg

SEQ ID NO: 3023581 - DNA, 23 bp, Homo sapiens
gcacctgcatccgtagttccctg

SEQ ID NO: 3023582 - DNA, 15 bp, Homo sapiens
gcacctgcctagctc

SEQ ID NO: 3023583 - DNA, 16 bp, Homo sapiens
gcacctgcctagctct

SEQ ID NO: 3023584 - DNA, 21 bp, Homo sapiens
gcacctgcctagctcttgggc

SEQ ID NO: 3023585 - DNA, 13 bp, Homo sapiens
gcacctgcctcag

SEQ ID NO: 3023586 - DNA, 14 bp, Homo sapiens
gcacctggaccccc

SEQ ID NO: 3023587 - DNA, 16 bp, Homo sapiens
gcacctggaccccctg

SEQ ID NO: 3023588 - DNA, 17 bp, Homo sapiens
gcacctggaccccctgc

SEQ ID NO: 3023589 - DNA, 19 bp, Homo sapiens
gcacctgtagtcccagcta

SEQ ID NO: 3023590 - DNA, 12 bp, Homo sapiens
gcaccttcctcc

SEQ ID NO: 3023591 - DNA, 14 bp, Homo sapiens
gcaccttcctcctc

SEQ ID NO: 3023592 - DNA, 15 bp, Homo sapiens
gcaccttcctcctcc

SEQ ID NO: 3023593 - DNA, 18 bp, Homo sapiens
gcaccttcctcctccccg

SEQ ID NO: 3023594 - DNA, 21 bp, Homo sapiens
gcaccttcctcctccccgctc

SEQ ID NO: 3023595 - DNA, 19 bp, Homo sapiens
gcaccttgtgcctggggtg

SEQ ID NO: 3023596 - DNA, 13 bp, Homo sapiens
gcacctttctagt

SEQ ID NO: 3023597 - DNA, 16 bp, Homo sapiens
gcacgaacccacctgc

SEQ ID NO: 3023598 - DNA, 21 bp, Homo sapiens
gcacgatctcagctcactgca

SEQ ID NO: 3023599 - DNA, 13 bp, Homo sapiens
gcacgcacctgta

SEQ ID NO: 3023600 - DNA, 22 bp, Homo sapiens
gcacgcacctgtagtcccagct

SEQ ID NO: 3023601 - DNA, 15 bp, Homo sapiens
gcacgcctgccatct

SEQ ID NO: 3023602 - DNA, 16 bp, Homo sapiens
gcacgctcccctccat

SEQ ID NO: 3023603 - DNA, 18 bp, Homo sapiens
gcacgctcccctccatcc

SEQ ID NO: 3023604 - DNA, 19 bp, Homo sapiens
gcacggacatggtctgtcc

SEQ ID NO: 3023605 - DNA, 17 bp, Homo sapiens
gcacggagcgccccggc

SEQ ID NO: 3023606 - DNA, 20 bp, Homo sapiens
gcacggcaggcgtgtggcag

SEQ ID NO: 3023607 - DNA, 22 bp, Homo sapiens
gcacggcccggcccctcaccct

SEQ ID NO: 3023608 - DNA, 14 bp, Homo sapiens
gcacggtttctgtt

SEQ ID NO: 3023609 - DNA, 21 bp, Homo sapiens
gcactaattctgcatctgggc

SEQ ID NO: 3023610 - DNA, 16 bp, Homo sapiens
gcactacattcattta

SEQ ID NO: 3023611 - DNA, 20 bp, Homo sapiens
gcactacctgaacattgtaa

SEQ ID NO: 3023612 - DNA, 22 bp, Homo sapiens
gcactacctgaacattgtaata

SEQ ID NO: 3023613 - DNA, 12 bp, Homo sapiens
gcactcaagttg

SEQ ID NO: 3023614 - DNA, 20 bp, Homo sapiens
gcactcaagttgtttaactg

SEQ ID NO: 3023615 - DNA, 18 bp, Homo sapiens
gcactccaacctaacctg

SEQ ID NO: 3023616 - DNA, 23 bp, Homo sapiens
gcactccaacctaacctgtgtct

SEQ ID NO: 3023617 - DNA, 14 bp, Homo sapiens
gcactccagcctgg

SEQ ID NO: 3023618 - DNA, 17 bp, Homo sapiens
gcactccagcctgggtc

SEQ ID NO: 3023619 - DNA, 18 bp, Homo sapiens
gcactcccgggatgggtg

SEQ ID NO: 3023620 - DNA, 15 bp, Homo sapiens
gcactccctcctgga

SEQ ID NO: 3023621 - DNA, 18 bp, Homo sapiens
gcactccctggccttgcc

SEQ ID NO: 3023622 - DNA, 11 bp, Homo sapiens
gcactctagat

SEQ ID NO: 3023623 - DNA, 14 bp, Homo sapiens
gcactctcacccca

SEQ ID NO: 3023624 - DNA, 22 bp, Homo sapiens
gccaaggataccggacacacct

SEQ ID NO: 3023625 - DNA, 18 bp, Homo sapiens
gccaagggggcagagggc

SEQ ID NO: 3023626 - DNA, 20 bp, Homo sapiens
gccaagtcctagctcctcct

SEQ ID NO: 3023627 - DNA, 13 bp, Homo sapiens
gccaagtgcctgc

SEQ ID NO: 3023628 - DNA, 14 bp, Homo sapiens
gccaagtgcctgct

SEQ ID NO: 3023629 - DNA, 17 bp, Homo sapiens
gccaagtgcctgcttag

SEQ ID NO: 3023630 - DNA, 22 bp, Homo sapiens
gccaataataaaaaacaagaaa

SEQ ID NO: 3023631 - DNA, 17 bp, Homo sapiens
gccaatctgtacaaaat

SEQ ID NO: 3023632 - DNA, 23 bp, Homo sapiens
gccaatcttgttttaagcaaatg

SEQ ID NO: 3023633 - DNA, 21 bp, Homo sapiens
gccaatctttcctactttcta

SEQ ID NO: 3023634 - DNA, 19 bp, Homo sapiens
gccaatgttgtgtgttgca

SEQ ID NO: 3023635 - DNA, 23 bp, Homo sapiens
gccaattacggtgtacagtttaa

SEQ ID NO: 3023636 - DNA, 18 bp, Homo sapiens
gccaattcagacaggcaa

SEQ ID NO: 3023637 - DNA, 13 bp, Homo sapiens
gccaattcctata

SEQ ID NO: 3023638 - DNA, 13 bp, Homo sapiens
gccaatttgtctc

SEQ ID NO: 3023639 - DNA, 18 bp, Homo sapiens
gccacaaaaatgttcact

SEQ ID NO: 3023640 - DNA, 10 bp, Homo sapiens
gccacacaca

SEQ ID NO: 3023641 - DNA, 12 bp, Homo sapiens
gccacacacaca

SEQ ID NO: 3023642 - DNA, 16 bp, Homo sapiens
gccacacacacagaaa

SEQ ID NO: 3023643 - DNA, 17 bp, Homo sapiens
gccacacacacagaaaa

SEQ ID NO: 3023644 - DNA, 15 bp, Homo sapiens
gccacaccactgcca

SEQ ID NO: 3023645 - DNA, 20 bp, Homo sapiens
gccacacgcaggcggccagg

SEQ ID NO: 3023646 - DNA, 16 bp, Homo sapiens
gccacactcagcacaa

SEQ ID NO: 3023647 - DNA, 16 bp, Homo sapiens
gccacactgtgacaca

SEQ ID NO: 3023648 - DNA, 17 bp, Homo sapiens
gccacactgtgacacac

SEQ ID NO: 3023649 - DNA, 18 bp, Homo sapiens
gccacactgtgacacact

SEQ ID NO: 3023650 - DNA, 19 bp, Homo sapiens
gccacagaaggtgaacttt

SEQ ID NO: 3023651 - DNA, 21 bp, Homo sapiens
gccacagcccatccatagtaa

SEQ ID NO: 3023652 - DNA, 11 bp, Homo sapiens
gccacagcctg

SEQ ID NO: 3023653 - DNA, 17 bp, Homo sapiens
gccacagcgtgctggcg

SEQ ID NO: 3023654 - DNA, 19 bp, Homo sapiens
gccacaggaacggccctgc

SEQ ID NO: 3023655 - DNA, 17 bp, Homo sapiens
gccacaggagccctgct

SEQ ID NO: 3023656 - DNA, 18 bp, Homo sapiens
gccacaggccaaatcctt

SEQ ID NO: 3023657 - DNA, 20 bp, Homo sapiens
gccacaggccaaatccttgg

SEQ ID NO: 3023658 - DNA, 16 bp, Homo sapiens
gccacatcttaaactt

SEQ ID NO: 3023659 - DNA, 18 bp, Homo sapiens
gccacatgccccaggctc

SEQ ID NO: 3023660 - DNA, 14 bp, Homo sapiens
gccacatttggaat

SEQ ID NO: 3023661 - DNA, 16 bp, Homo sapiens
gccacattttcagcca

SEQ ID NO: 3023662 - DNA, 15 bp, Homo sapiens
gccaccacccaacct

SEQ ID NO: 3023663 - DNA, 17 bp, Homo sapiens
gccaccagctctgccgt

SEQ ID NO: 3023664 - DNA, 19 bp, Homo sapiens
gccaccagctctgccgtct

SEQ ID NO: 3023665 - DNA, 22 bp, Homo sapiens
gccaccaggatcagccaggagg

SEQ ID NO: 3023666 - DNA, 17 bp, Homo sapiens
gccacccacctccctgc

SEQ ID NO: 3023667 - DNA, 16 bp, Homo sapiens
gccacccattcttccc

SEQ ID NO: 3023668 - DNA, 17 bp, Homo sapiens
gccacccccagccctgg

SEQ ID NO: 3023669 - DNA, 22 bp, Homo sapiens
gccacccccagccctggcccct

SEQ ID NO: 3023670 - DNA, 13 bp, Homo sapiens
gccacccccgccc

SEQ ID NO: 3023671 - DNA, 19 bp, Homo sapiens
gccacccccgcccccaccg

SEQ ID NO: 3023672 - DNA, 14 bp, Homo sapiens
gccacccctcagat

SEQ ID NO: 3023673 - DNA, 15 bp, Homo sapiens
gccaccctcccagct

SEQ ID NO: 3023674 - DNA, 16 bp, Homo sapiens
gccaccctcccagctc

SEQ ID NO: 3023675 - DNA, 14 bp, Homo sapiens
gccacccttccctg

SEQ ID NO: 3023676 - DNA, 18 bp, Homo sapiens
gccacccttccctgcctc

SEQ ID NO: 3023677 - DNA, 16 bp, Homo sapiens
gccaccgactgcccag

SEQ ID NO: 3023678 - DNA, 17 bp, Homo sapiens
gccaccgactgcccagc

SEQ ID NO: 3023679 - DNA, 18 bp, Homo sapiens
gccaccgactgcccagcc

SEQ ID NO: 3023680 - DNA, 13 bp, Homo sapiens
gccaccgcagctg

SEQ ID NO: 3023681 - DNA, 18 bp, Homo sapiens
gccaccgcagctgctgcc

SEQ ID NO: 3023682 - DNA, 17 bp, Homo sapiens
gccaccgcgcccagcct

SEQ ID NO: 3023683 - DNA, 21 bp, Homo sapiens
gccaccgggcatgtctgcctg

SEQ ID NO: 3023684 - DNA, 14 bp, Homo sapiens
gccaccgggggtgg

SEQ ID NO: 3023685 - DNA, 13 bp, Homo sapiens
gccacctccccta

SEQ ID NO: 3023686 - DNA, 14 bp, Homo sapiens
gccaccttcccacc

SEQ ID NO: 3023687 - DNA, 17 bp, Homo sapiens
gccacgaacagcccgcc

SEQ ID NO: 3023688 - DNA, 13 bp, Homo sapiens
gccacgctccagc

SEQ ID NO: 3023689 - DNA, 14 bp, Homo sapiens
gccacgctccagct

SEQ ID NO: 3023690 - DNA, 17 bp, Homo sapiens
gccacgctccagctgcc

SEQ ID NO: 3023691 - DNA, 14 bp, Homo sapiens
gccacggcccaggg

SEQ ID NO: 3023692 - DNA, 15 bp, Homo sapiens
gccacgtatagtcct

SEQ ID NO: 3023693 - DNA, 20 bp, Homo sapiens
gccacgtatagtcctagctg

SEQ ID NO: 3023694 - DNA, 16 bp, Homo sapiens
gccacgttccttactg

SEQ ID NO: 3023695 - DNA, 13 bp, Homo sapiens
gccactaagcaga

SEQ ID NO: 3023696 - DNA, 14 bp, Homo sapiens
gccactaagcagag

SEQ ID NO: 3023697 - DNA, 16 bp, Homo sapiens
gccactaagcagagga

SEQ ID NO: 3023698 - DNA, 16 bp, Homo sapiens
gccactcaacagagag

SEQ ID NO: 3023699 - DNA, 14 bp, Homo sapiens
gccactcaggccca

SEQ ID NO: 3023700 - DNA, 22 bp, Homo sapiens
gccactcaggcccaaagcctcg

SEQ ID NO: 3023701 - DNA, 13 bp, Homo sapiens
gccactccaagcc

SEQ ID NO: 3023702 - DNA, 15 bp, Homo sapiens
gccactccaagcccc

SEQ ID NO: 3023703 - DNA, 12 bp, Homo sapiens
gccactcctccc

SEQ ID NO: 3023704 - DNA, 21 bp, Homo sapiens
gccactcctctgactcagggc

SEQ ID NO: 3023705 - DNA, 23 bp, Homo sapiens
gccactcctctgactcagggctc

SEQ ID NO: 3023706 - DNA, 20 bp, Homo sapiens
gccactctaccagtgcaggc

SEQ ID NO: 3023707 - DNA, 13 bp, Homo sapiens
gccactctgctgc

SEQ ID NO: 3023708 - DNA, 14 bp, Homo sapiens
gccactctgctgcc

SEQ ID NO: 3023709 - DNA, 16 bp, Homo sapiens
gccactctgctgcctg

SEQ ID NO: 3023710 - DNA, 22 bp, Homo sapiens
gccactctgctgcctgtacaga

SEQ ID NO: 3023711 - DNA, 20 bp, Homo sapiens
gccactgaaaagctttcctg

SEQ ID NO: 3023712 - DNA, 13 bp, Homo sapiens
gccactgcctccc

SEQ ID NO: 3023713 - DNA, 19 bp, Homo sapiens
gccactgggcacctgcgca

SEQ ID NO: 3023714 - DNA, 22 bp, Homo sapiens
gccactgggcacctgcgcacag

SEQ ID NO: 3023715 - DNA, 12 bp, Homo sapiens
gccactgtgctt

SEQ ID NO: 3023716 - DNA, 18 bp, Homo sapiens
gccacttaaaatgttcac

SEQ ID NO: 3023717 - DNA, 18 bp, Homo sapiens
gccagaacgtggctctgc

SEQ ID NO: 3023718 - DNA, 22 bp, Homo sapiens
gccagaacgtggctctgctggc

SEQ ID NO: 3023719 - DNA, 19 bp, Homo sapiens
gccagaagactcctaggcc

SEQ ID NO: 3023720 - DNA, 14 bp, Homo sapiens
gccagaaggaaggt

SEQ ID NO: 3023721 - DNA, 17 bp, Homo sapiens
gccagaagtaacttatt

SEQ ID NO: 3023722 - DNA, 21 bp, Homo sapiens
gccagaagtttgtcaagtcaa

SEQ ID NO: 3023723 - DNA, 17 bp, Homo sapiens
gccagaatataatgtgc

SEQ ID NO: 3023724 - DNA, 22 bp, Homo sapiens
gccagagaaagttggtgctgct

SEQ ID NO: 3023725 - DNA, 22 bp, Homo sapiens
gccagagatccaaaagaagccc

SEQ ID NO: 3023726 - DNA, 19 bp, Homo sapiens
gccagaggaatgatgggct

SEQ ID NO: 3023727 - DNA, 23 bp, Homo sapiens
gccagaggatgctctttcccagg

SEQ ID NO: 3023728 - DNA, 17 bp, Homo sapiens
gccagagtcctttccaa

SEQ ID NO: 3023729 - DNA, 15 bp, Homo sapiens
gccagagtggccacg

SEQ ID NO: 3023730 - DNA, 14 bp, Homo sapiens
gccagatccagcct

SEQ ID NO: 3023731 - DNA, 16 bp, Homo sapiens
gccagatccagcctgg

SEQ ID NO: 3023732 - DNA, 20 bp, Homo sapiens
gccagatccagcctggggtc

SEQ ID NO: 3023733 - DNA, 17 bp, Homo sapiens
gccagatcctcttctca

SEQ ID NO: 3023734 - DNA, 21 bp, Homo sapiens
gccagatgcacatccctggaa

SEQ ID NO: 3023735 - DNA, 12 bp, Homo sapiens
gccagatgctga

SEQ ID NO: 3023736 - DNA, 15 bp, Homo sapiens
gccagatgctgatgt

SEQ ID NO: 3023737 - DNA, 24 bp, Homo sapiens
gccagatgctgatgttcagtgtaa

SEQ ID NO: 3023738 - DNA, 12 bp, Homo sapiens
gccagatgctgc

SEQ ID NO: 3023739 - DNA, 15 bp, Homo sapiens
gccagatttgtcttt

SEQ ID NO: 3023740 - DNA, 13 bp, Homo sapiens
gccagatttttta

SEQ ID NO: 3023741 - DNA, 23 bp, Homo sapiens
gccagattttttaaaatttatat

SEQ ID NO: 3023742 - DNA, 21 bp, Homo sapiens
gccagcacccagtcctctgcc

SEQ ID NO: 3023743 - DNA, 23 bp, Homo sapiens
gccagcacccagtcctctgcctc

SEQ ID NO: 3023744 - DNA, 17 bp, Homo sapiens
gccagcaccgccggctt

SEQ ID NO: 3023745 - DNA, 15 bp, Homo sapiens
gccagcacttgtata

SEQ ID NO: 3023746 - DNA, 14 bp, Homo sapiens
gccagcacttgtcc

SEQ ID NO: 3023747 - DNA, 14 bp, Homo sapiens
gccagcagcataga

SEQ ID NO: 3023748 - DNA, 17 bp, Homo sapiens
gccagcagcccttgttt

SEQ ID NO: 3023749 - DNA, 12 bp, Homo sapiens
gccagcagcctc

SEQ ID NO: 3023750 - DNA, 22 bp, Homo sapiens
gccagcagcctcgcacaggccc

SEQ ID NO: 3023751 - DNA, 23 bp, Homo sapiens
gccagcagcctcgcacaggccct

SEQ ID NO: 3023752 - DNA, 18 bp, Homo sapiens
gccagcagcgcgcaggcc

SEQ ID NO: 3023753 - DNA, 20 bp, Homo sapiens
gccagcagcgcgcaggcctg

SEQ ID NO: 3023754 - DNA, 13 bp, Homo sapiens
gccagcaggcagc

SEQ ID NO: 3023755 - DNA, 17 bp, Homo sapiens
gccagcaggcagcgcct

SEQ ID NO: 3023756 - DNA, 18 bp, Homo sapiens
gccagcaggcagcgcctg

SEQ ID NO: 3023757 - DNA, 20 bp, Homo sapiens
gccctgtgcagaccttactc

SEQ ID NO: 3023758 - DNA, 22 bp, Homo sapiens
gccctgtgccccttgacaactg

SEQ ID NO: 3023759 - DNA, 11 bp, Homo sapiens
gccctgtgccg

SEQ ID NO: 3023760 - DNA, 12 bp, Homo sapiens
gccctgtgccgc

SEQ ID NO: 3023761 - DNA, 22 bp, Homo sapiens
gccctgtggatgagccctcaga

SEQ ID NO: 3023762 - DNA, 20 bp, Homo sapiens
gccctgtgggaccccaggcc

SEQ ID NO: 3023763 - DNA, 15 bp, Homo sapiens
gccctgttctcgttg

SEQ ID NO: 3023764 - DNA, 16 bp, Homo sapiens
gccctgttgacacagg

SEQ ID NO: 3023765 - DNA, 20 bp, Homo sapiens
gccctgttgtgccacagagt

SEQ ID NO: 3023766 - DNA, 14 bp, Homo sapiens
gccctgtttctgtt

SEQ ID NO: 3023767 - DNA, 14 bp, Homo sapiens
gccctgtttggcat

SEQ ID NO: 3023768 - DNA, 19 bp, Homo sapiens
gcccttacttcttgccctg

SEQ ID NO: 3023769 - DNA, 16 bp, Homo sapiens
gcccttatctgtgctc

SEQ ID NO: 3023770 - DNA, 18 bp, Homo sapiens
gcccttatctgtgctcag

SEQ ID NO: 3023771 - DNA, 18 bp, Homo sapiens
gcccttcccctcccccac

SEQ ID NO: 3023772 - DNA, 15 bp, Homo sapiens
gcccttcctctttgg

SEQ ID NO: 3023773 - DNA, 20 bp, Homo sapiens
gcccttctaggcaaaagaaa

SEQ ID NO: 3023774 - DNA, 14 bp, Homo sapiens
gcccttgagggaga

SEQ ID NO: 3023775 - DNA, 17 bp, Homo sapiens
gcccttgatttttatct

SEQ ID NO: 3023776 - DNA, 20 bp, Homo sapiens
gcccttgcaatcttctactt

SEQ ID NO: 3023777 - DNA, 16 bp, Homo sapiens
gcccttggaggccagc

SEQ ID NO: 3023778 - DNA, 19 bp, Homo sapiens
gcccttggtttctgggggc

SEQ ID NO: 3023779 - DNA, 21 bp, Homo sapiens
gcccttgtcccactcaagcca

SEQ ID NO: 3023780 - DNA, 15 bp, Homo sapiens
gccctttaatatttc

SEQ ID NO: 3023781 - DNA, 16 bp, Homo sapiens
gccctttcctcctcag

SEQ ID NO: 3023782 - DNA, 15 bp, Homo sapiens
gccctttgcctgtag

SEQ ID NO: 3023783 - DNA, 13 bp, Homo sapiens
gcccttttcccct

SEQ ID NO: 3023784 - DNA, 19 bp, Homo sapiens
gcccttttcccctaccaat

SEQ ID NO: 3023785 - DNA, 14 bp, Homo sapiens
gccctttttaagga

SEQ ID NO: 3023786 - DNA, 14 bp, Homo sapiens
gccgaactccaggc

SEQ ID NO: 3023787 - DNA, 15 bp, Homo sapiens
gccgaactccaggct

SEQ ID NO: 3023788 - DNA, 16 bp, Homo sapiens
gccgaactccaggctg

SEQ ID NO: 3023789 - DNA, 16 bp, Homo sapiens
gccgaagctgctgtga

SEQ ID NO: 3023790 - DNA, 18 bp, Homo sapiens
gccgacaccactcctgcc

SEQ ID NO: 3023791 - DNA, 21 bp, Homo sapiens
gccgacaccactcctgccagc

SEQ ID NO: 3023792 - DNA, 12 bp, Homo sapiens
gccgacactgtt

SEQ ID NO: 3023793 - DNA, 14 bp, Homo sapiens
gccgacatccctcc

SEQ ID NO: 3023794 - DNA, 18 bp, Homo sapiens
gccgacatccctccccca

SEQ ID NO: 3023795 - DNA, 19 bp, Homo sapiens
gccgacatccctcccccag

SEQ ID NO: 3023796 - DNA, 21 bp, Homo sapiens
gccgacatccctcccccagca

SEQ ID NO: 3023797 - DNA, 13 bp, Homo sapiens
gccgaccttagat

SEQ ID NO: 3023798 - DNA, 13 bp, Homo sapiens
gccgagaagcaag

SEQ ID NO: 3023799 - DNA, 14 bp, Homo sapiens
gccgagaagcaaga

SEQ ID NO: 3023800 - DNA, 23 bp, Homo sapiens
gccgagaccccatcttccagcca

SEQ ID NO: 3023801 - DNA, 17 bp, Homo sapiens
gccgagcggtggccccg

SEQ ID NO: 3023802 - DNA, 19 bp, Homo sapiens
gccgagctggtttcctgcc

SEQ ID NO: 3023803 - DNA, 22 bp, Homo sapiens
gccgaggacatgcatgacactt

SEQ ID NO: 3023804 - DNA, 14 bp, Homo sapiens
gccgagggcgtcag

SEQ ID NO: 3023805 - DNA, 17 bp, Homo sapiens
gccgagggcgtcagaga

SEQ ID NO: 3023806 - DNA, 14 bp, Homo sapiens
gccgagtccaagct

SEQ ID NO: 3023807 - DNA, 21 bp, Homo sapiens
gccgatgggagtctccctccg

SEQ ID NO: 3023808 - DNA, 16 bp, Homo sapiens
gccgcaaaccacactg

SEQ ID NO: 3023809 - DNA, 19 bp, Homo sapiens
gccgcaaaccacactggac

SEQ ID NO: 3023810 - DNA, 21 bp, Homo sapiens
gccgcaaaccacactggactc

SEQ ID NO: 3023811 - DNA, 22 bp, Homo sapiens
gccgcaaattgtaccttttttg

SEQ ID NO: 3023812 - DNA, 17 bp, Homo sapiens
gccgcaagggcctggac

SEQ ID NO: 3023813 - DNA, 15 bp, Homo sapiens
gccgcaccccagagt

SEQ ID NO: 3023814 - DNA, 19 bp, Homo sapiens
gccgcacgcctctccctgc

SEQ ID NO: 3023815 - DNA, 13 bp, Homo sapiens
gccgcagagactg

SEQ ID NO: 3023816 - DNA, 15 bp, Homo sapiens
gccgcaggaaggcag

SEQ ID NO: 3023817 - DNA, 21 bp, Homo sapiens
gccgcagtggggtcaagctga

SEQ ID NO: 3023818 - DNA, 18 bp, Homo sapiens
gccgcatcttctccatct

SEQ ID NO: 3023819 - DNA, 18 bp, Homo sapiens
gccgcattccctgagtca

SEQ ID NO: 3023820 - DNA, 18 bp, Homo sapiens
gccgccatctgcgcaggg

SEQ ID NO: 3023821 - DNA, 15 bp, Homo sapiens
gccgcccgctgggga

SEQ ID NO: 3023822 - DNA, 17 bp, Homo sapiens
gccgccggaagtggctc

SEQ ID NO: 3023823 - DNA, 13 bp, Homo sapiens
gccgcctcccggg

SEQ ID NO: 3023824 - DNA, 18 bp, Homo sapiens
gccgcctgcactcctcag

SEQ ID NO: 3023825 - DNA, 19 bp, Homo sapiens
gccgcctgcactcctcagg

SEQ ID NO: 3023826 - DNA, 13 bp, Homo sapiens
gccgcctgcctta

SEQ ID NO: 3023827 - DNA, 15 bp, Homo sapiens
gccgcctggtactca

SEQ ID NO: 3023828 - DNA, 18 bp, Homo sapiens
gccgcctggtactcaagc

SEQ ID NO: 3023829 - DNA, 17 bp, Homo sapiens
gccgccttggccttgca

SEQ ID NO: 3023830 - DNA, 13 bp, Homo sapiens
gccgcggcccaga

SEQ ID NO: 3023831 - DNA, 14 bp, Homo sapiens
gccgcggcccagac

SEQ ID NO: 3023832 - DNA, 17 bp, Homo sapiens
gccgcggcctccccgag

SEQ ID NO: 3023833 - DNA, 17 bp, Homo sapiens
gccgcgtcgccctccca

SEQ ID NO: 3023834 - DNA, 16 bp, Homo sapiens
gccgcgtgccgggccc

SEQ ID NO: 3023835 - DNA, 15 bp, Homo sapiens
gccgctccaccagca

SEQ ID NO: 3023836 - DNA, 15 bp, Homo sapiens
gccgctctcctgcca

SEQ ID NO: 3023837 - DNA, 16 bp, Homo sapiens
gccgctgaccctgggc

SEQ ID NO: 3023838 - DNA, 17 bp, Homo sapiens
gccgctgagcgaggaga

SEQ ID NO: 3023839 - DNA, 12 bp, Homo sapiens
gccgctgccacc

SEQ ID NO: 3023840 - DNA, 18 bp, Homo sapiens
gccgctgcccgctcagcc

SEQ ID NO: 3023841 - DNA, 12 bp, Homo sapiens
gccgctgccctg

SEQ ID NO: 3023842 - DNA, 17 bp, Homo sapiens
gccggaaggccgaggtc

SEQ ID NO: 3023843 - DNA, 16 bp, Homo sapiens
gccggacacttctcag

SEQ ID NO: 3023844 - DNA, 14 bp, Homo sapiens
gccggacgcaggtg

SEQ ID NO: 3023845 - DNA, 22 bp, Homo sapiens
gccggacgcaggtgctgcggcg

SEQ ID NO: 3023846 - DNA, 13 bp, Homo sapiens
gccggagcccaga

SEQ ID NO: 3023847 - DNA, 19 bp, Homo sapiens
gccggaggccttggggtgg

SEQ ID NO: 3023848 - DNA, 13 bp, Homo sapiens
gccggccagccag

SEQ ID NO: 3023849 - DNA, 13 bp, Homo sapiens
gccggccctgccc

SEQ ID NO: 3023850 - DNA, 12 bp, Homo sapiens
gccggccctggg

SEQ ID NO: 3023851 - DNA, 20 bp, Homo sapiens
gccggccctggggctaggct

SEQ ID NO: 3023852 - DNA, 15 bp, Homo sapiens
gccggcctgagaaac

SEQ ID NO: 3023853 - DNA, 15 bp, Homo sapiens
gccggcgagccctgt

SEQ ID NO: 3023854 - DNA, 17 bp, Homo sapiens
gccggctgtgctcagag

SEQ ID NO: 3023855 - DNA, 18 bp, Homo sapiens
gccgggaccccgagcctg

SEQ ID NO: 3023856 - DNA, 23 bp, Homo sapiens
gccgggaccccgagcctggctcc

SEQ ID NO: 3023857 - DNA, 14 bp, Homo sapiens
gccgggagcctgac

SEQ ID NO: 3023858 - DNA, 19 bp, Homo sapiens
gccgggagcctgaccctca

SEQ ID NO: 3023859 - DNA, 19 bp, Homo sapiens
gccgggcatggtggcaggc

SEQ ID NO: 3023860 - DNA, 17 bp, Homo sapiens
gccgggcccccaccgcc

SEQ ID NO: 3023861 - DNA, 15 bp, Homo sapiens
gccggggtcctggga

SEQ ID NO: 3023862 - DNA, 16 bp, Homo sapiens
gccggggtcctgggag

SEQ ID NO: 3023863 - DNA, 20 bp, Homo sapiens
gccggggtcctgggaggctg

SEQ ID NO: 3023864 - DNA, 22 bp, Homo sapiens
gccggggtcctgggaggctgca

SEQ ID NO: 3023865 - DNA, 21 bp, Homo sapiens
gccggtgtgcctgactgccca

SEQ ID NO: 3023866 - DNA, 20 bp, Homo sapiens
gccgtcagccatcagccatg

SEQ ID NO: 3023867 - DNA, 22 bp, Homo sapiens
gccgtctcccttggcccagaga

SEQ ID NO: 3023868 - DNA, 19 bp, Homo sapiens
gccgtctggcgagccctta

SEQ ID NO: 3023869 - DNA, 17 bp, Homo sapiens
gccgtgctcgccccagc

SEQ ID NO: 3023870 - DNA, 22 bp, Homo sapiens
gccgtggctccagaatgtgctg

SEQ ID NO: 3023871 - DNA, 21 bp, Homo sapiens
gccgtggcttgggctggtcag

SEQ ID NO: 3023872 - DNA, 19 bp, Homo sapiens
gccgtgtgtttagaagcct

SEQ ID NO: 3023873 - DNA, 20 bp, Homo sapiens
gccgtgtgtttagaagccta

SEQ ID NO: 3023874 - DNA, 13 bp, Homo sapiens
gccgttcagcctg

SEQ ID NO: 3023875 - DNA, 15 bp, Homo sapiens
gccgttcagcctgtc

SEQ ID NO: 3023876 - DNA, 23 bp, Homo sapiens
gcctaaaagtgggcttgattctg

SEQ ID NO: 3023877 - DNA, 21 bp, Homo sapiens
gcctaattgtcacatcaagca

SEQ ID NO: 3023878 - DNA, 18 bp, Homo sapiens
gcctacaaagagatgctt

SEQ ID NO: 3023879 - DNA, 17 bp, Homo sapiens
gcctacccacccccagg

SEQ ID NO: 3023880 - DNA, 15 bp, Homo sapiens
gcctactgtccctct

SEQ ID NO: 3023881 - DNA, 21 bp, Homo sapiens
gcctactgtccctctcagtgc

SEQ ID NO: 3023882 - DNA, 23 bp, Homo sapiens
gcctactgtccctctcagtgcct

SEQ ID NO: 3023883 - DNA, 13 bp, Homo sapiens
gcctagaagctgg

SEQ ID NO: 3023884 - DNA, 19 bp, Homo sapiens
gcctagacttgtgtgttct

SEQ ID NO: 3023885 - DNA, 20 bp, Homo sapiens
gcctagagcgcggctggctc

SEQ ID NO: 3023886 - DNA, 22 bp, Homo sapiens
gcctagagcgcggctggctctg

SEQ ID NO: 3023887 - DNA, 15 bp, Homo sapiens
gcctagccctgggac

SEQ ID NO: 3023888 - DNA, 15 bp, Homo sapiens
gcctagcctataaat

SEQ ID NO: 3023889 - DNA, 15 bp, Homo sapiens
gcctagctcttgggc

SEQ ID NO: 3023890 - DNA, 15 bp, Homo sapiens
gcgcaagccacagcc

SEQ ID NO: 3023891 - DNA, 18 bp, Homo sapiens
gcgcaagccacagcctgt

SEQ ID NO: 3023892 - DNA, 13 bp, Homo sapiens
gcgcaagcctgta

SEQ ID NO: 3023893 - DNA, 21 bp, Homo sapiens
gcgcaagcctgtaatcccagc

SEQ ID NO: 3023894 - DNA, 22 bp, Homo sapiens
gcgcactgtgacccccagctcc

SEQ ID NO: 3023895 - DNA, 23 bp, Homo sapiens
gcgcacttaccgccctgcgggcc

SEQ ID NO: 3023896 - DNA, 15 bp, Homo sapiens
gcgcagccccatctg

SEQ ID NO: 3023897 - DNA, 18 bp, Homo sapiens
gcgcatcttgcctccagg

SEQ ID NO: 3023898 - DNA, 22 bp, Homo sapiens
gcgcatcttgcctccaggtgca

SEQ ID NO: 3023899 - DNA, 15 bp, Homo sapiens
gcgccaccagctctg

SEQ ID NO: 3023900 - DNA, 21 bp, Homo sapiens
gcgccaggatggaacacggcc

SEQ ID NO: 3023901 - DNA, 22 bp, Homo sapiens
gcgccaggatggaacacggcca

SEQ ID NO: 3023902 - DNA, 19 bp, Homo sapiens
gcgccaggcagagctgagg

SEQ ID NO: 3023903 - DNA, 23 bp, Homo sapiens
gcgccaggcagagctgagggccc

SEQ ID NO: 3023904 - DNA, 13 bp, Homo sapiens
gcgccagggccca

SEQ ID NO: 3023905 - DNA, 17 bp, Homo sapiens
gcgcccagcagcctgcc

SEQ ID NO: 3023906 - DNA, 22 bp, Homo sapiens
gcgcccagcagcctgccagcag

SEQ ID NO: 3023907 - DNA, 13 bp, Homo sapiens
gcgcccccaggcc

SEQ ID NO: 3023908 - DNA, 14 bp, Homo sapiens
gcgcccccaggcct

SEQ ID NO: 3023909 - DNA, 21 bp, Homo sapiens
gcgcccccaggcctgccctgc

SEQ ID NO: 3023910 - DNA, 18 bp, Homo sapiens
gcgccctccgacctctct

SEQ ID NO: 3023911 - DNA, 13 bp, Homo sapiens
gcgccctggactt

SEQ ID NO: 3023912 - DNA, 18 bp, Homo sapiens
gcgccctttccccgacgc

SEQ ID NO: 3023913 - DNA, 19 bp, Homo sapiens
gcgccgcaaaccacactgg

SEQ ID NO: 3023914 - DNA, 21 bp, Homo sapiens
gcgccgcaaaccacactggac

SEQ ID NO: 3023915 - DNA, 21 bp, Homo sapiens
gcgcctagagcgcggctggct

SEQ ID NO: 3023916 - DNA, 21 bp, Homo sapiens
gcgcctccatccatctgtccg

SEQ ID NO: 3023917 - DNA, 18 bp, Homo sapiens
gcgcctgcccctcccaga

SEQ ID NO: 3023918 - DNA, 11 bp, Homo sapiens
gcgcctgccct

SEQ ID NO: 3023919 - DNA, 12 bp, Homo sapiens
gcgcctgccctg

SEQ ID NO: 3023920 - DNA, 20 bp, Homo sapiens
gcgcctgccctgcccaagtg

SEQ ID NO: 3023921 - DNA, 12 bp, Homo sapiens
gcgcctgccttt

SEQ ID NO: 3023922 - DNA, 18 bp, Homo sapiens
gcgcctggagagcgagga

SEQ ID NO: 3023923 - DNA, 17 bp, Homo sapiens
gcgcctggcctccaggc

SEQ ID NO: 3023924 - DNA, 15 bp, Homo sapiens
gcgcctggctgctgc

SEQ ID NO: 3023925 - DNA, 14 bp, Homo sapiens
gcgcctgtcccctc

SEQ ID NO: 3023926 - DNA, 18 bp, Homo sapiens
gcgcctgtcccctcacag

SEQ ID NO: 3023927 - DNA, 14 bp, Homo sapiens
gcgcctttcccaac

SEQ ID NO: 3023928 - DNA, 12 bp, Homo sapiens
gcgcgcctgcct

SEQ ID NO: 3023929 - DNA, 18 bp, Homo sapiens
gcgcggcctcccgaggag

SEQ ID NO: 3023930 - DNA, 20 bp, Homo sapiens
gcgcggcctcccgaggaggg

SEQ ID NO: 3023931 - DNA, 12 bp, Homo sapiens
gcgcggctggga

SEQ ID NO: 3023932 - DNA, 17 bp, Homo sapiens
gcgctcaataggaccag

SEQ ID NO: 3023933 - DNA, 22 bp, Homo sapiens
gcgctctggacagatggacgca

SEQ ID NO: 3023934 - DNA, 19 bp, Homo sapiens
gcgctgccgcaccccagag

SEQ ID NO: 3023935 - DNA, 19 bp, Homo sapiens
gcgctgggcacttccctgc

SEQ ID NO: 3023936 - DNA, 18 bp, Homo sapiens
gcgctgtatttacagaca

SEQ ID NO: 3023937 - DNA, 19 bp, Homo sapiens
gcgcttcctgagcagtccc

SEQ ID NO: 3023938 - DNA, 18 bp, Homo sapiens
gcggacaaaagggccagg

SEQ ID NO: 3023939 - DNA, 14 bp, Homo sapiens
gcggacgtgctggc

SEQ ID NO: 3023940 - DNA, 18 bp, Homo sapiens
gcggagacctcctgacaa

SEQ ID NO: 3023941 - DNA, 13 bp, Homo sapiens
gcggagccagcag

SEQ ID NO: 3023942 - DNA, 21 bp, Homo sapiens
gcggagctgctgagtgacagc

SEQ ID NO: 3023943 - DNA, 21 bp, Homo sapiens
gcggaggaggaagtcatggga

SEQ ID NO: 3023944 - DNA, 23 bp, Homo sapiens
gcggaggcgctcctccctgcctc

SEQ ID NO: 3023945 - DNA, 20 bp, Homo sapiens
gcggaggctgctcagatggc

SEQ ID NO: 3023946 - DNA, 19 bp, Homo sapiens
gcggatcccgcgtagtgtc

SEQ ID NO: 3023947 - DNA, 13 bp, Homo sapiens
gcggatggccgga

SEQ ID NO: 3023948 - DNA, 21 bp, Homo sapiens
gcggccagggcggccagggac

SEQ ID NO: 3023949 - DNA, 15 bp, Homo sapiens
gcggcccagacccag

SEQ ID NO: 3023950 - DNA, 13 bp, Homo sapiens
gcggcccgggccg

SEQ ID NO: 3023951 - DNA, 13 bp, Homo sapiens
gcggccctgctga

SEQ ID NO: 3023952 - DNA, 22 bp, Homo sapiens
gcggccgatgggagtctccctc

SEQ ID NO: 3023953 - DNA, 16 bp, Homo sapiens
gcggccgcattccctg

SEQ ID NO: 3023954 - DNA, 17 bp, Homo sapiens
gcggccgcattccctga

SEQ ID NO: 3023955 - DNA, 19 bp, Homo sapiens
gcggccgcattccctgagt

SEQ ID NO: 3023956 - DNA, 13 bp, Homo sapiens
gcggccggccagc

SEQ ID NO: 3023957 - DNA, 15 bp, Homo sapiens
gcggcctcagggtct

SEQ ID NO: 3023958 - DNA, 21 bp, Homo sapiens
gcggcctcagggtctaaggag

SEQ ID NO: 3023959 - DNA, 18 bp, Homo sapiens
gcggcctggacccctgga

SEQ ID NO: 3023960 - DNA, 19 bp, Homo sapiens
gcggcctggacccctggac

SEQ ID NO: 3023961 - DNA, 19 bp, Homo sapiens
gcggccttttccaaatgcc

SEQ ID NO: 3023962 - DNA, 13 bp, Homo sapiens
gcggcgccctgga

SEQ ID NO: 3023963 - DNA, 17 bp, Homo sapiens
gcggcgccctggacttg

SEQ ID NO: 3023964 - DNA, 14 bp, Homo sapiens
gcggcgcgcacgga

SEQ ID NO: 3023965 - DNA, 18 bp, Homo sapiens
gcggcggagctggccccg

SEQ ID NO: 3023966 - DNA, 15 bp, Homo sapiens
gcggcgtggagactg

SEQ ID NO: 3023967 - DNA, 21 bp, Homo sapiens
gcggctactcagcagccctcc

SEQ ID NO: 3023968 - DNA, 22 bp, Homo sapiens
gcggctactcagcagccctcct

SEQ ID NO: 3023969 - DNA, 19 bp, Homo sapiens
gcggctctaaacctcaggc

SEQ ID NO: 3023970 - DNA, 20 bp, Homo sapiens
gcggctctaaacctcaggcc

SEQ ID NO: 3023971 - DNA, 16 bp, Homo sapiens
gcggctctgcccacct

SEQ ID NO: 3023972 - DNA, 14 bp, Homo sapiens
gcggctgccgactc

SEQ ID NO: 3023973 - DNA, 15 bp, Homo sapiens
gcggctggacttgga

SEQ ID NO: 3023974 - DNA, 20 bp, Homo sapiens
gcggctggctctgtggaggg

SEQ ID NO: 3023975 - DNA, 19 bp, Homo sapiens
gcgggaatattgtttcttt

SEQ ID NO: 3023976 - DNA, 19 bp, Homo sapiens
gcgggaccggtacagaaag

SEQ ID NO: 3023977 - DNA, 20 bp, Homo sapiens
gcgggagggagtctcaggag

SEQ ID NO: 3023978 - DNA, 12 bp, Homo sapiens
gcgggcacagcc

SEQ ID NO: 3023979 - DNA, 14 bp, Homo sapiens
gcgggcacagccag

SEQ ID NO: 3023980 - DNA, 16 bp, Homo sapiens
gcgggcagagggctgg

SEQ ID NO: 3023981 - DNA, 17 bp, Homo sapiens
gcgggcagagggctgga

SEQ ID NO: 3023982 - DNA, 18 bp, Homo sapiens
gcgggcagagggctggag

SEQ ID NO: 3023983 - DNA, 17 bp, Homo sapiens
gcgggcagccaggctgg

SEQ ID NO: 3023984 - DNA, 17 bp, Homo sapiens
gcggggaccttggtctg

SEQ ID NO: 3023985 - DNA, 22 bp, Homo sapiens
gcggggcccagcgctctcctgg

SEQ ID NO: 3023986 - DNA, 23 bp, Homo sapiens
gcggggcccagcgctctcctgga

SEQ ID NO: 3023987 - DNA, 22 bp, Homo sapiens
gcgggggccttgaagactccct

SEQ ID NO: 3023988 - DNA, 18 bp, Homo sapiens
gcggggggggcgcctgga

SEQ ID NO: 3023989 - DNA, 21 bp, Homo sapiens
gcgggggggggggcggtgtca

SEQ ID NO: 3023990 - DNA, 16 bp, Homo sapiens
gcggggtgtggtggcc

SEQ ID NO: 3023991 - DNA, 22 bp, Homo sapiens
gcgggtgaacaaagcagccacg

SEQ ID NO: 3023992 - DNA, 12 bp, Homo sapiens
gcgggtggctgc

SEQ ID NO: 3023993 - DNA, 13 bp, Homo sapiens
gcgggtggctgca

SEQ ID NO: 3023994 - DNA, 23 bp, Homo sapiens
gcggtagccagcacacagggcag

SEQ ID NO: 3023995 - DNA, 12 bp, Homo sapiens
gcggtcagactg

SEQ ID NO: 3023996 - DNA, 19 bp, Homo sapiens
gcggtcccctccgccaggc

SEQ ID NO: 3023997 - DNA, 22 bp, Homo sapiens
gcggtcccctccgccaggcgag

SEQ ID NO: 3023998 - DNA, 22 bp, Homo sapiens
gcggtcctgcacagattcccag

SEQ ID NO: 3023999 - DNA, 18 bp, Homo sapiens
gcggtggctcacgcctgt

SEQ ID NO: 3024000 - DNA, 14 bp, Homo sapiens
gcggtgggaaggaa

SEQ ID NO: 3024001 - DNA, 18 bp, Homo sapiens
gcggtgggcacccaccct

SEQ ID NO: 3024002 - DNA, 14 bp, Homo sapiens
gcggtgggcagcca

SEQ ID NO: 3024003 - DNA, 24 bp, Homo sapiens
gcggtgtcaggtcccagcgagcca

SEQ ID NO: 3024004 - DNA, 17 bp, Homo sapiens
gcgtagcacccacaagt

SEQ ID NO: 3024005 - DNA, 20 bp, Homo sapiens
gcgtcaggggtgcacagtcc

SEQ ID NO: 3024006 - DNA, 21 bp, Homo sapiens
gcgtcatgggccccccatgca

SEQ ID NO: 3024007 - DNA, 15 bp, Homo sapiens
gcgtccaccaggcct

SEQ ID NO: 3024008 - DNA, 21 bp, Homo sapiens
gcgtccaccaggcctcactgg

SEQ ID NO: 3024009 - DNA, 15 bp, Homo sapiens
gcgtcccgcacctgt

SEQ ID NO: 3024010 - DNA, 14 bp, Homo sapiens
gcgtccgagaaggc

SEQ ID NO: 3024011 - DNA, 15 bp, Homo sapiens
gcgtcctcctctgtg

SEQ ID NO: 3024012 - DNA, 14 bp, Homo sapiens
gcgtcctgccctgc

SEQ ID NO: 3024013 - DNA, 13 bp, Homo sapiens
gcgtcctgtccac

SEQ ID NO: 3024014 - DNA, 20 bp, Homo sapiens
gcgtctgctcaggtaaatct

SEQ ID NO: 3024015 - DNA, 13 bp, Homo sapiens
gcgtctgtgtgcg

SEQ ID NO: 3024016 - DNA, 20 bp, Homo sapiens
gcgtcttcatctccctgcca

SEQ ID NO: 3024017 - DNA, 23 bp, Homo sapiens
gcgtcttcatctccctgccatcc

SEQ ID NO: 3024018 - DNA, 21 bp, Homo sapiens
gcgtctttaagagactcactg

SEQ ID NO: 3024019 - DNA, 14 bp, Homo sapiens
gcgtgaaggactta

SEQ ID NO: 3024020 - DNA, 16 bp, Homo sapiens
gcgtgaaggccgagaa

SEQ ID NO: 3024021 - DNA, 21 bp, Homo sapiens
gcgtgacactctccttgcagt

SEQ ID NO: 3024022 - DNA, 21 bp, Homo sapiens
gctgagggaccgagcccagca

SEQ ID NO: 3024023 - DNA, 18 bp, Homo sapiens
gctgagggagggagccat

SEQ ID NO: 3024024 - DNA, 14 bp, Homo sapiens
gctgagggccctgt

SEQ ID NO: 3024025 - DNA, 21 bp, Homo sapiens
gctgagggccctgtggagtcc

SEQ ID NO: 3024026 - DNA, 11 bp, Homo sapiens
gctgaggggac

SEQ ID NO: 3024027 - DNA, 17 bp, Homo sapiens
gctgaggggacgggcaa

SEQ ID NO: 3024028 - DNA, 21 bp, Homo sapiens
gctgagggtgcccttttccag

SEQ ID NO: 3024029 - DNA, 23 bp, Homo sapiens
gctgaggtggtaggatcacctga

SEQ ID NO: 3024030 - DNA, 18 bp, Homo sapiens
gctgaggtgtctggcctg

SEQ ID NO: 3024031 - DNA, 20 bp, Homo sapiens
gctgaggtgtctggcctgag

SEQ ID NO: 3024032 - DNA, 23 bp, Homo sapiens
gctgagtcatgatctccctgccg

SEQ ID NO: 3024033 - DNA, 13 bp, Homo sapiens
gctgataccatat

SEQ ID NO: 3024034 - DNA, 22 bp, Homo sapiens
gctgatcatcgccagaggtgct

SEQ ID NO: 3024035 - DNA, 21 bp, Homo sapiens
gctgatgaacttattctgtag

SEQ ID NO: 3024036 - DNA, 18 bp, Homo sapiens
gctgatgaatcactgttt

SEQ ID NO: 3024037 - DNA, 16 bp, Homo sapiens
gctgatgagttaattg

SEQ ID NO: 3024038 - DNA, 15 bp, Homo sapiens
gctgatgcaggattt

SEQ ID NO: 3024039 - DNA, 19 bp, Homo sapiens
gctgatgctgaaataaact

SEQ ID NO: 3024040 - DNA, 20 bp, Homo sapiens
gctgatggattccaaaccag

SEQ ID NO: 3024041 - DNA, 16 bp, Homo sapiens
gctgatgtggactgtc

SEQ ID NO: 3024042 - DNA, 17 bp, Homo sapiens
gctgatgtggactgtct

SEQ ID NO: 3024043 - DNA, 16 bp, Homo sapiens
gctgatgttcagtgta

SEQ ID NO: 3024044 - DNA, 17 bp, Homo sapiens
gctgatgttcagtgtaa

SEQ ID NO: 3024045 - DNA, 18 bp, Homo sapiens
gctgatgttcagtgtaat

SEQ ID NO: 3024046 - DNA, 17 bp, Homo sapiens
gctgatttaaaaagtga

SEQ ID NO: 3024047 - DNA, 23 bp, Homo sapiens
gctgatttctaggtaggaaatgt

SEQ ID NO: 3024048 - DNA, 21 bp, Homo sapiens
gctgcaaagtgttttgtacca

SEQ ID NO: 3024049 - DNA, 22 bp, Homo sapiens
gctgcaaggtggctccagcacc

SEQ ID NO: 3024050 - DNA, 23 bp, Homo sapiens
gctgcaaggtggctccagcacca

SEQ ID NO: 3024051 - DNA, 21 bp, Homo sapiens
gctgcaaggtttaggctggtg

SEQ ID NO: 3024052 - DNA, 20 bp, Homo sapiens
gctgcaagtgacatctcttt

SEQ ID NO: 3024053 - DNA, 16 bp, Homo sapiens
gctgcaatgagccatg

SEQ ID NO: 3024054 - DNA, 15 bp, Homo sapiens
gctgcacatagcaga

SEQ ID NO: 3024055 - DNA, 19 bp, Homo sapiens
gctgcaccaatgcactgag

SEQ ID NO: 3024056 - DNA, 22 bp, Homo sapiens
gctgcacgctcccctccatccc

SEQ ID NO: 3024057 - DNA, 20 bp, Homo sapiens
gctgcactgatgctgcccct

SEQ ID NO: 3024058 - DNA, 14 bp, Homo sapiens
gctgcactggagcc

SEQ ID NO: 3024059 - DNA, 15 bp, Homo sapiens
gctgcactggagcca

SEQ ID NO: 3024060 - DNA, 21 bp, Homo sapiens
gctgcactggagccacaggca

SEQ ID NO: 3024061 - DNA, 20 bp, Homo sapiens
gctgcagcaccgaggggcct

SEQ ID NO: 3024062 - DNA, 23 bp, Homo sapiens
gctgcagcaccgaggggcctttg

SEQ ID NO: 3024063 - DNA, 11 bp, Homo sapiens
gctgcagccag

SEQ ID NO: 3024064 - DNA, 16 bp, Homo sapiens
gctgcagccaggcctc

SEQ ID NO: 3024065 - DNA, 23 bp, Homo sapiens
gctgcagcggcaggaccgccatg

SEQ ID NO: 3024066 - DNA, 22 bp, Homo sapiens
gctgcaggaatctttaaaagat

SEQ ID NO: 3024067 - DNA, 21 bp, Homo sapiens
gctgcagggagcaccacggcc

SEQ ID NO: 3024068 - DNA, 16 bp, Homo sapiens
gctgcaggtgctgctg

SEQ ID NO: 3024069 - DNA, 13 bp, Homo sapiens
gctgcagtcagcc

SEQ ID NO: 3024070 - DNA, 18 bp, Homo sapiens
gctgcatttcacatgcct

SEQ ID NO: 3024071 - DNA, 15 bp, Homo sapiens
gctgccaagccccat

SEQ ID NO: 3024072 - DNA, 19 bp, Homo sapiens
gctgccaccaaatctgtct

SEQ ID NO: 3024073 - DNA, 19 bp, Homo sapiens
gctgccacccacctccctg

SEQ ID NO: 3024074 - DNA, 22 bp, Homo sapiens
gctgccacccacctccctgcct

SEQ ID NO: 3024075 - DNA, 23 bp, Homo sapiens
gctgccacccacctccctgcctc

SEQ ID NO: 3024076 - DNA, 13 bp, Homo sapiens
gctgccactctgc

SEQ ID NO: 3024077 - DNA, 22 bp, Homo sapiens
gctgccactctgctgcctgtac

SEQ ID NO: 3024078 - DNA, 13 bp, Homo sapiens
gctgccactgggc

SEQ ID NO: 3024079 - DNA, 21 bp, Homo sapiens
gctgccactgggcacctgcgc

SEQ ID NO: 3024080 - DNA, 22 bp, Homo sapiens
gctgccactgggcacctgcgca

SEQ ID NO: 3024081 - DNA, 17 bp, Homo sapiens
gctgccagctctgtatc

SEQ ID NO: 3024082 - DNA, 22 bp, Homo sapiens
gctgccaggaaacaagggaagg

SEQ ID NO: 3024083 - DNA, 12 bp, Homo sapiens
gctgccagggct

SEQ ID NO: 3024084 - DNA, 15 bp, Homo sapiens
gctgccatcttgctt

SEQ ID NO: 3024085 - DNA, 21 bp, Homo sapiens
gctgccattggtccacccttt

SEQ ID NO: 3024086 - DNA, 21 bp, Homo sapiens
gctgcccatttcgtgagcccc

SEQ ID NO: 3024087 - DNA, 14 bp, Homo sapiens
gctgccccagccag

SEQ ID NO: 3024088 - DNA, 16 bp, Homo sapiens
gctgccccagccagat

SEQ ID NO: 3024089 - DNA, 22 bp, Homo sapiens
gctgccccaggccggagcccag

SEQ ID NO: 3024090 - DNA, 19 bp, Homo sapiens
gctgccccatgaagccaca

SEQ ID NO: 3024091 - DNA, 20 bp, Homo sapiens
gctgccccatgaagccacag

SEQ ID NO: 3024092 - DNA, 13 bp, Homo sapiens
gctgccccggccc

SEQ ID NO: 3024093 - DNA, 15 bp, Homo sapiens
gctgcccctccctgc

SEQ ID NO: 3024094 - DNA, 12 bp, Homo sapiens
gctgcccctctc

SEQ ID NO: 3024095 - DNA, 19 bp, Homo sapiens
gctgcccctctctgggcct

SEQ ID NO: 3024096 - DNA, 13 bp, Homo sapiens
gctgcccctggca

SEQ ID NO: 3024097 - DNA, 14 bp, Homo sapiens
gctgcccctggcac

SEQ ID NO: 3024098 - DNA, 15 bp, Homo sapiens
gctgcccggggtggg

SEQ ID NO: 3024099 - DNA, 13 bp, Homo sapiens
gctgccctgaggg

SEQ ID NO: 3024100 - DNA, 20 bp, Homo sapiens
gctgccctgggtcctgcctg

SEQ ID NO: 3024101 - DNA, 14 bp, Homo sapiens
gctgccgactcccc

SEQ ID NO: 3024102 - DNA, 21 bp, Homo sapiens
gctgccgagacagaccctctg

SEQ ID NO: 3024103 - DNA, 15 bp, Homo sapiens
gctgcctaagacatg

SEQ ID NO: 3024104 - DNA, 18 bp, Homo sapiens
gctgcctaagtggctgct

SEQ ID NO: 3024105 - DNA, 12 bp, Homo sapiens
gctgcctcaggc

SEQ ID NO: 3024106 - DNA, 22 bp, Homo sapiens
gctgcctcaggcactctcctgt

SEQ ID NO: 3024107 - DNA, 12 bp, Homo sapiens
gctgcctcccca

SEQ ID NO: 3024108 - DNA, 17 bp, Homo sapiens
gctgcctccgcacctga

SEQ ID NO: 3024109 - DNA, 20 bp, Homo sapiens
gctgcctccgcacctgaccg

SEQ ID NO: 3024110 - DNA, 20 bp, Homo sapiens
gctgcctcttctcttgacag

SEQ ID NO: 3024111 - DNA, 17 bp, Homo sapiens
gctgcctgagtattact

SEQ ID NO: 3024112 - DNA, 13 bp, Homo sapiens
gctgcctgcagca

SEQ ID NO: 3024113 - DNA, 14 bp, Homo sapiens
gctgcctgcccaca

SEQ ID NO: 3024114 - DNA, 22 bp, Homo sapiens
gctgcctgcccgtaaacacgcc

SEQ ID NO: 3024115 - DNA, 21 bp, Homo sapiens
gctgcctggaacaccagcagc

SEQ ID NO: 3024116 - DNA, 12 bp, Homo sapiens
gctgcctggcca

SEQ ID NO: 3024117 - DNA, 13 bp, Homo sapiens
gctgcctggccag

SEQ ID NO: 3024118 - DNA, 14 bp, Homo sapiens
gctgcctggccagg

SEQ ID NO: 3024119 - DNA, 16 bp, Homo sapiens
gctgcctggccaggcc

SEQ ID NO: 3024120 - DNA, 18 bp, Homo sapiens
gctgcctgggtaggcccc

SEQ ID NO: 3024121 - DNA, 20 bp, Homo sapiens
gctgcctgggtaggccccac

SEQ ID NO: 3024122 - DNA, 14 bp, Homo sapiens
gctgccttagcttc

SEQ ID NO: 3024123 - DNA, 16 bp, Homo sapiens
gctgccttggctcaga

SEQ ID NO: 3024124 - DNA, 18 bp, Homo sapiens
gctgcctttgatcacagg

SEQ ID NO: 3024125 - DNA, 18 bp, Homo sapiens
gctgcctttgtggtgggc

SEQ ID NO: 3024126 - DNA, 23 bp, Homo sapiens
gctgcggacaccgtggcctgggc

SEQ ID NO: 3024127 - DNA, 21 bp, Homo sapiens
gctgcgggctgagggcatctc

SEQ ID NO: 3024128 - DNA, 16 bp, Homo sapiens
gctgcgtgcccctgct

SEQ ID NO: 3024129 - DNA, 16 bp, Homo sapiens
gctgctacaaagaaga

SEQ ID NO: 3024130 - DNA, 19 bp, Homo sapiens
gctgctaggggaaggactg

SEQ ID NO: 3024131 - DNA, 16 bp, Homo sapiens
gctgctatagcctggg

SEQ ID NO: 3024132 - DNA, 17 bp, Homo sapiens
gctgctatagcctgggg

SEQ ID NO: 3024133 - DNA, 19 bp, Homo sapiens
gctgctcccacacttgtgc

SEQ ID NO: 3024134 - DNA, 23 bp, Homo sapiens
gctgctcccacacttgtgccagc

SEQ ID NO: 3024135 - DNA, 13 bp, Homo sapiens
gctgctccccacc

SEQ ID NO: 3024136 - DNA, 22 bp, Homo sapiens
gctgctccccacgtcagctggg

SEQ ID NO: 3024137 - DNA, 20 bp, Homo sapiens
gctgctccttagctgccaag

SEQ ID NO: 3024138 - DNA, 17 bp, Homo sapiens
gctgctcgcccaggaag

SEQ ID NO: 3024139 - DNA, 15 bp, Homo sapiens
gctgctgcagccctg

SEQ ID NO: 3024140 - DNA, 19 bp, Homo sapiens
gctgctgcagccctgccag

SEQ ID NO: 3024141 - DNA, 23 bp, Homo sapiens
gctgctgccaccaaatctgtcta

SEQ ID NO: 3024142 - DNA, 12 bp, Homo sapiens
gctgctgccact

SEQ ID NO: 3024143 - DNA, 13 bp, Homo sapiens
gctgctgccactc

SEQ ID NO: 3024144 - DNA, 12 bp, Homo sapiens
gctgctgctgct

SEQ ID NO: 3024145 - DNA, 13 bp, Homo sapiens
gctgctgctgctc

SEQ ID NO: 3024146 - DNA, 13 bp, Homo sapiens
gctgctggcctcc

SEQ ID NO: 3024147 - DNA, 17 bp, Homo sapiens
gctgctggcctccctcc

SEQ ID NO: 3024148 - DNA, 23 bp, Homo sapiens
gctgctgggatggtgggcttcag

SEQ ID NO: 3024149 - DNA, 21 bp, Homo sapiens
gctgctgggggcaactggcca

SEQ ID NO: 3024150 - DNA, 22 bp, Homo sapiens
gctgctgggggcaactggccat

SEQ ID NO: 3024151 - DNA, 17 bp, Homo sapiens
gctgctggtgcacagcc

SEQ ID NO: 3024152 - DNA, 21 bp, Homo sapiens
gctgctgtcacctctcccacg

SEQ ID NO: 3024153 - DNA, 14 bp, Homo sapiens
gcttttcccaggag

SEQ ID NO: 3024154 - DNA, 14 bp, Homo sapiens
gcttttcctcaggg

SEQ ID NO: 3024155 - DNA, 18 bp, Homo sapiens
gcttttcgaactgtgctc

SEQ ID NO: 3024156 - DNA, 14 bp, Homo sapiens
gcttttctcagctg

SEQ ID NO: 3024157 - DNA, 18 bp, Homo sapiens
gcttttctgtttcctgta

SEQ ID NO: 3024158 - DNA, 15 bp, Homo sapiens
gcttttcttagtgtg

SEQ ID NO: 3024159 - DNA, 17 bp, Homo sapiens
gcttttctttctaccaa

SEQ ID NO: 3024160 - DNA, 12 bp, Homo sapiens
gcttttggcctg

SEQ ID NO: 3024161 - DNA, 23 bp, Homo sapiens
gcttttggtatttgtttgtagct

SEQ ID NO: 3024162 - DNA, 20 bp, Homo sapiens
gcttttgtagatggcacttt

SEQ ID NO: 3024163 - DNA, 13 bp, Homo sapiens
gcttttgttctga

SEQ ID NO: 3024164 - DNA, 14 bp, Homo sapiens
gcttttgttctgag

SEQ ID NO: 3024165 - DNA, 21 bp, Homo sapiens
gctttttatttctgcatatgt

SEQ ID NO: 3024166 - DNA, 18 bp, Homo sapiens
gcttttttcctcctttct

SEQ ID NO: 3024167 - DNA, 19 bp, Homo sapiens
gcttttttcctcctttctc

SEQ ID NO: 3024168 - DNA, 20 bp, Homo sapiens
gcttttttcctcctttctct

SEQ ID NO: 3024169 - DNA, 18 bp, Homo sapiens
ggaaaaaaattacaaaga

SEQ ID NO: 3024170 - DNA, 16 bp, Homo sapiens
ggaaaaacaacaaata

SEQ ID NO: 3024171 - DNA, 23 bp, Homo sapiens
ggaaaaataatcaagattttagg

SEQ ID NO: 3024172 - DNA, 12 bp, Homo sapiens
ggaaaaccagac

SEQ ID NO: 3024173 - DNA, 23 bp, Homo sapiens
ggaaaacttattttatattttcc

SEQ ID NO: 3024174 - DNA, 13 bp, Homo sapiens
ggaaaagagctgg

SEQ ID NO: 3024175 - DNA, 14 bp, Homo sapiens
ggaaaagagctggg

SEQ ID NO: 3024176 - DNA, 19 bp, Homo sapiens
ggaaaagcggacatcagct

SEQ ID NO: 3024177 - DNA, 22 bp, Homo sapiens
ggaaaagcgtctttaagagact

SEQ ID NO: 3024178 - DNA, 16 bp, Homo sapiens
ggaaaaggctggtaca

SEQ ID NO: 3024179 - DNA, 16 bp, Homo sapiens
ggaaaataatactgct

SEQ ID NO: 3024180 - DNA, 15 bp, Homo sapiens
ggaaaatatttcctg

SEQ ID NO: 3024181 - DNA, 19 bp, Homo sapiens
ggaaaatctctttttgact

SEQ ID NO: 3024182 - DNA, 22 bp, Homo sapiens
ggaaaatgagtatttggtccaa

SEQ ID NO: 3024183 - DNA, 14 bp, Homo sapiens
ggaaacaaagctta

SEQ ID NO: 3024184 - DNA, 21 bp, Homo sapiens
ggaaacaaataatttgaactt

SEQ ID NO: 3024185 - DNA, 17 bp, Homo sapiens
ggaaacactccttgcat

SEQ ID NO: 3024186 - DNA, 13 bp, Homo sapiens
ggaaacagactcg

SEQ ID NO: 3024187 - DNA, 20 bp, Homo sapiens
ggaaaccaagtcaggccagg

SEQ ID NO: 3024188 - DNA, 24 bp, Homo sapiens
ggaaacccataggcccacacacag

SEQ ID NO: 3024189 - DNA, 22 bp, Homo sapiens
ggaaacctttgcttaccttgtt

SEQ ID NO: 3024190 - DNA, 16 bp, Homo sapiens
ggaaacgtctcccaga

SEQ ID NO: 3024191 - DNA, 19 bp, Homo sapiens
ggaaacttgtcacttgcat

SEQ ID NO: 3024192 - DNA, 10 bp, Homo sapiens
ggaaagaaac

SEQ ID NO: 3024193 - DNA, 14 bp, Homo sapiens
ggaaagatggataa

SEQ ID NO: 3024194 - DNA, 14 bp, Homo sapiens
ggaaagcagctcaa

SEQ ID NO: 3024195 - DNA, 15 bp, Homo sapiens
ggaaagcagctcaaa

SEQ ID NO: 3024196 - DNA, 22 bp, Homo sapiens
ggaaaggccagctggcagcaga

SEQ ID NO: 3024197 - DNA, 22 bp, Homo sapiens
ggaaaggccctgcacaggtggc

SEQ ID NO: 3024198 - DNA, 18 bp, Homo sapiens
ggaaagtgctttccagaa

SEQ ID NO: 3024199 - DNA, 14 bp, Homo sapiens
ggaaagtgtaaagc

SEQ ID NO: 3024200 - DNA, 15 bp, Homo sapiens
ggaaagtgtaaagca

SEQ ID NO: 3024201 - DNA, 16 bp, Homo sapiens
ggaaagtgtaaagcat

SEQ ID NO: 3024202 - DNA, 19 bp, Homo sapiens
ggaaataccttgagcagaa

SEQ ID NO: 3024203 - DNA, 14 bp, Homo sapiens
ggaaatctggattt

SEQ ID NO: 3024204 - DNA, 15 bp, Homo sapiens
ggaaatgaaagaaag

SEQ ID NO: 3024205 - DNA, 20 bp, Homo sapiens
ggaaatgcaagctctggaaa

SEQ ID NO: 3024206 - DNA, 22 bp, Homo sapiens
ggaaattcaaccccagaaattg

SEQ ID NO: 3024207 - DNA, 18 bp, Homo sapiens
ggaacaagacagccttca

SEQ ID NO: 3024208 - DNA, 16 bp, Homo sapiens
ggaacaatcacaaaag

SEQ ID NO: 3024209 - DNA, 18 bp, Homo sapiens
ggaacaatcacaaaagct

SEQ ID NO: 3024210 - DNA, 14 bp, Homo sapiens
ggaacacggccaca

SEQ ID NO: 3024211 - DNA, 20 bp, Homo sapiens
ggaacactagacaagccaga

SEQ ID NO: 3024212 - DNA, 13 bp, Homo sapiens
ggaacactgccct

SEQ ID NO: 3024213 - DNA, 13 bp, Homo sapiens
ggaacagtcctgt

SEQ ID NO: 3024214 - DNA, 17 bp, Homo sapiens
ggaacatgcttttactt

SEQ ID NO: 3024215 - DNA, 17 bp, Homo sapiens
ggaacatttattttatg

SEQ ID NO: 3024216 - DNA, 14 bp, Homo sapiens
ggaaccacctggac

SEQ ID NO: 3024217 - DNA, 14 bp, Homo sapiens
ggaaccaggcttgg

SEQ ID NO: 3024218 - DNA, 21 bp, Homo sapiens
ggaaccccggggtgcccacag

SEQ ID NO: 3024219 - DNA, 16 bp, Homo sapiens
ggaaccgaggcaggga

SEQ ID NO: 3024220 - DNA, 13 bp, Homo sapiens
ggaacctcagcct

SEQ ID NO: 3024221 - DNA, 18 bp, Homo sapiens
ggaacctcgagtactgtg

SEQ ID NO: 3024222 - DNA, 22 bp, Homo sapiens
ggaacctcgagtactgtgggca

SEQ ID NO: 3024223 - DNA, 19 bp, Homo sapiens
ggaacggccctgcaggagc

SEQ ID NO: 3024224 - DNA, 20 bp, Homo sapiens
ggaacggccctgcaggagca

SEQ ID NO: 3024225 - DNA, 21 bp, Homo sapiens
ggaacggccctgcaggagcag

SEQ ID NO: 3024226 - DNA, 22 bp, Homo sapiens
ggaacggccctgcaggagcagg

SEQ ID NO: 3024227 - DNA, 20 bp, Homo sapiens
ggaacggctgatgtggactg

SEQ ID NO: 3024228 - DNA, 16 bp, Homo sapiens
ggaactcagatccagg

SEQ ID NO: 3024229 - DNA, 15 bp, Homo sapiens
ggaactcgcctcagc

SEQ ID NO: 3024230 - DNA, 17 bp, Homo sapiens
ggaactcgtgtctggca

SEQ ID NO: 3024231 - DNA, 15 bp, Homo sapiens
ggaactgcttgccca

SEQ ID NO: 3024232 - DNA, 12 bp, Homo sapiens
ggaactggaaca

SEQ ID NO: 3024233 - DNA, 12 bp, Homo sapiens
ggaactgtccca

SEQ ID NO: 3024234 - DNA, 21 bp, Homo sapiens
ggaacttaaaaccttgaaggt

SEQ ID NO: 3024235 - DNA, 18 bp, Homo sapiens
ggaacttgaactgattca

SEQ ID NO: 3024236 - DNA, 23 bp, Homo sapiens
ggaacttggggagttaagacctg

SEQ ID NO: 3024237 - DNA, 18 bp, Homo sapiens
ggaactttagggggtggg

SEQ ID NO: 3024238 - DNA, 19 bp, Homo sapiens
ggaagaaacactttctctt

SEQ ID NO: 3024239 - DNA, 14 bp, Homo sapiens
ggaagaaccactgt

SEQ ID NO: 3024240 - DNA, 14 bp, Homo sapiens
ggaagaattttaaa

SEQ ID NO: 3024241 - DNA, 19 bp, Homo sapiens
ggaagaattttaaaaatga

SEQ ID NO: 3024242 - DNA, 21 bp, Homo sapiens
ggaagaccaaggcctcggcag

SEQ ID NO: 3024243 - DNA, 20 bp, Homo sapiens
ggaagactgttgtgctccat

SEQ ID NO: 3024244 - DNA, 15 bp, Homo sapiens
ggaagatcagatgca

SEQ ID NO: 3024245 - DNA, 19 bp, Homo sapiens
ggaagatcctgtgaggagc

SEQ ID NO: 3024246 - DNA, 18 bp, Homo sapiens
ggaagatctacctgcaac

SEQ ID NO: 3024247 - DNA, 14 bp, Homo sapiens
ggaagatttctaaa

SEQ ID NO: 3024248 - DNA, 18 bp, Homo sapiens
ggaagattttggtaatga

SEQ ID NO: 3024249 - DNA, 13 bp, Homo sapiens
ggaagcagagcaa

SEQ ID NO: 3024250 - DNA, 15 bp, Homo sapiens
ggaagcatcctcccc

SEQ ID NO: 3024251 - DNA, 18 bp, Homo sapiens
ggaagcatcctccccacc

SEQ ID NO: 3024252 - DNA, 19 bp, Homo sapiens
ggaagcatcctccccacca

SEQ ID NO: 3024253 - DNA, 19 bp, Homo sapiens
ggaagcatttgtttctact

SEQ ID NO: 3024254 - DNA, 23 bp, Homo sapiens
ggaagcccactgcctcctccctg

SEQ ID NO: 3024255 - DNA, 13 bp, Homo sapiens
ggaagcccccacc

SEQ ID NO: 3024256 - DNA, 11 bp, Homo sapiens
ggaagcctgtc

SEQ ID NO: 3024257 - DNA, 12 bp, Homo sapiens
ggaagcctgtcc

SEQ ID NO: 3024258 - DNA, 12 bp, Homo sapiens
ggaagcctgtgg

SEQ ID NO: 3024259 - DNA, 23 bp, Homo sapiens
ggaagctaaaagcatggccctgc

SEQ ID NO: 3024260 - DNA, 22 bp, Homo sapiens
ggaagctacaggttacaacaga

SEQ ID NO: 3024261 - DNA, 16 bp, Homo sapiens
ggaagctggagtgctg

SEQ ID NO: 3024262 - DNA, 21 bp, Homo sapiens
ggaagctgtgtccttgcacct

SEQ ID NO: 3024263 - DNA, 23 bp, Homo sapiens
ggaagctgtgtccttgcacctgc

SEQ ID NO: 3024264 - DNA, 21 bp, Homo sapiens
ggaagctgtgttgaaacagaa

SEQ ID NO: 3024265 - DNA, 23 bp, Homo sapiens
ggaagctgtgttgaaacagaaaa

SEQ ID NO: 3024266 - DNA, 20 bp, Homo sapiens
ggaagctttggtgagaacct

SEQ ID NO: 3024267 - DNA, 19 bp, Homo sapiens
ggaagctttgtcccctgct

SEQ ID NO: 3024268 - DNA, 15 bp, Homo sapiens
ggaaggaaggctctc

SEQ ID NO: 3024269 - DNA, 16 bp, Homo sapiens
ggaaggagacacagat

SEQ ID NO: 3024270 - DNA, 17 bp, Homo sapiens
ggaaggagacacagatg

SEQ ID NO: 3024271 - DNA, 19 bp, Homo sapiens
ggaaggagacacagatgtt

SEQ ID NO: 3024272 - DNA, 22 bp, Homo sapiens
ggaaggagactcacctctgcct

SEQ ID NO: 3024273 - DNA, 16 bp, Homo sapiens
ggaaggagagatgacc

SEQ ID NO: 3024274 - DNA, 19 bp, Homo sapiens
ggaaggcaaaggcagagga

SEQ ID NO: 3024275 - DNA, 16 bp, Homo sapiens
ggaaggcaggaagaga

SEQ ID NO: 3024276 - DNA, 21 bp, Homo sapiens
ggaaggcttgttgtgctttta

SEQ ID NO: 3024277 - DNA, 13 bp, Homo sapiens
ggaagggagggag

SEQ ID NO: 3024278 - DNA, 14 bp, Homo sapiens
ggaagggaggggaa

SEQ ID NO: 3024279 - DNA, 17 bp, Homo sapiens
ggaagggcatgcacggg

SEQ ID NO: 3024280 - DNA, 21 bp, Homo sapiens
ggaagggcatgcacgggcatg

SEQ ID NO: 3024281 - DNA, 22 bp, Homo sapiens
ggaaggggacccccgccccctg

SEQ ID NO: 3024282 - DNA, 16 bp, Homo sapiens
ggaaggggcctccctc

SEQ ID NO: 3024283 - DNA, 19 bp, Homo sapiens
ggaaggtgccagaaggaag

SEQ ID NO: 3024284 - DNA, 20 bp, Homo sapiens
ggaaggtgccagaaggaagg

SEQ ID NO: 3024285 - DNA, 14 bp, Homo sapiens
ggagttccagtgct

SEQ ID NO: 3024286 - DNA, 19 bp, Homo sapiens
ggagttcttcttctcctag

SEQ ID NO: 3024287 - DNA, 22 bp, Homo sapiens
ggagttgatctggaacccagac

SEQ ID NO: 3024288 - DNA, 12 bp, Homo sapiens
ggagtttctaag

SEQ ID NO: 3024289 - DNA, 15 bp, Homo sapiens
ggagtttgaggctgc

SEQ ID NO: 3024290 - DNA, 11 bp, Homo sapiens
ggagtttgtgt

SEQ ID NO: 3024291 - DNA, 14 bp, Homo sapiens
ggataaaaaagaaa

SEQ ID NO: 3024292 - DNA, 21 bp, Homo sapiens
ggataaaaaggaaggagagat

SEQ ID NO: 3024293 - DNA, 13 bp, Homo sapiens
ggataaagcagct

SEQ ID NO: 3024294 - DNA, 20 bp, Homo sapiens
ggatacagcagtagacattt

SEQ ID NO: 3024295 - DNA, 21 bp, Homo sapiens
ggataccacttttcattgcaa

SEQ ID NO: 3024296 - DNA, 13 bp, Homo sapiens
ggatagatgctgg

SEQ ID NO: 3024297 - DNA, 20 bp, Homo sapiens
ggatagatgctggcccaggg

SEQ ID NO: 3024298 - DNA, 21 bp, Homo sapiens
ggatagatgctggcccagggc

SEQ ID NO: 3024299 - DNA, 21 bp, Homo sapiens
ggatagccttgaaaacaaaca

SEQ ID NO: 3024300 - DNA, 19 bp, Homo sapiens
ggatagctaactgtaaatc

SEQ ID NO: 3024301 - DNA, 19 bp, Homo sapiens
ggatattttcaacaattag

SEQ ID NO: 3024302 - DNA, 21 bp, Homo sapiens
ggatattttcaacaattagag

SEQ ID NO: 3024303 - DNA, 18 bp, Homo sapiens
ggatcacaaggtcaggag

SEQ ID NO: 3024304 - DNA, 18 bp, Homo sapiens
ggatcacaggtgtcagcc

SEQ ID NO: 3024305 - DNA, 13 bp, Homo sapiens
ggatcagaagtat

SEQ ID NO: 3024306 - DNA, 13 bp, Homo sapiens
ggatcagccagga

SEQ ID NO: 3024307 - DNA, 17 bp, Homo sapiens
ggatcatagcttgtttt

SEQ ID NO: 3024308 - DNA, 22 bp, Homo sapiens
ggatcatatgaattgctgtcta

SEQ ID NO: 3024309 - DNA, 23 bp, Homo sapiens
ggatcccaccccattttctgtgg

SEQ ID NO: 3024310 - DNA, 20 bp, Homo sapiens
ggatcccatgagctccttaa

SEQ ID NO: 3024311 - DNA, 15 bp, Homo sapiens
ggatcccctgtcccc

SEQ ID NO: 3024312 - DNA, 17 bp, Homo sapiens
ggatcccctgtcccctg

SEQ ID NO: 3024313 - DNA, 21 bp, Homo sapiens
ggatcccctgtcccctggggc

SEQ ID NO: 3024314 - DNA, 23 bp, Homo sapiens
ggatcccctgtcccctggggctg

SEQ ID NO: 3024315 - DNA, 13 bp, Homo sapiens
ggatccctcatct

SEQ ID NO: 3024316 - DNA, 22 bp, Homo sapiens
ggatccctcatctgtccctccg

SEQ ID NO: 3024317 - DNA, 11 bp, Homo sapiens
ggatccgggca

SEQ ID NO: 3024318 - DNA, 23 bp, Homo sapiens
ggatccgtgctgtctcctttgga

SEQ ID NO: 3024319 - DNA, 12 bp, Homo sapiens
ggatcctgcccc

SEQ ID NO: 3024320 - DNA, 14 bp, Homo sapiens
ggatcgaggcatgg

SEQ ID NO: 3024321 - DNA, 24 bp, Homo sapiens
ggatctcattggacccttccatgg

SEQ ID NO: 3024322 - DNA, 18 bp, Homo sapiens
ggatctcgcctggaaaca

SEQ ID NO: 3024323 - DNA, 21 bp, Homo sapiens
ggatctcgcctggaaacagag

SEQ ID NO: 3024324 - DNA, 22 bp, Homo sapiens
ggatctcgcctggaaacagagg

SEQ ID NO: 3024325 - DNA, 19 bp, Homo sapiens
ggatctgggaccctttcct

SEQ ID NO: 3024326 - DNA, 23 bp, Homo sapiens
ggatctgggaccctttccttcct

SEQ ID NO: 3024327 - DNA, 17 bp, Homo sapiens
ggatctggtcctaccca

SEQ ID NO: 3024328 - DNA, 20 bp, Homo sapiens
ggatcttgagctctgctctc

SEQ ID NO: 3024329 - DNA, 21 bp, Homo sapiens
ggatctttggacagaagcagc

SEQ ID NO: 3024330 - DNA, 13 bp, Homo sapiens
ggatcttttctaa

SEQ ID NO: 3024331 - DNA, 22 bp, Homo sapiens
ggatcttttctaaatgttatta

SEQ ID NO: 3024332 - DNA, 21 bp, Homo sapiens
ggatgacatgcactcagctct

SEQ ID NO: 3024333 - DNA, 21 bp, Homo sapiens
ggatgagaatttgagtgctct

SEQ ID NO: 3024334 - DNA, 21 bp, Homo sapiens
ggatgattgcttgagctcagg

SEQ ID NO: 3024335 - DNA, 23 bp, Homo sapiens
ggatgattgcttgagctcaggag

SEQ ID NO: 3024336 - DNA, 20 bp, Homo sapiens
ggatgcacggtttctgttct

SEQ ID NO: 3024337 - DNA, 21 bp, Homo sapiens
ggatgcattctgataggaggg

SEQ ID NO: 3024338 - DNA, 22 bp, Homo sapiens
ggatgcattctgataggagggg

SEQ ID NO: 3024339 - DNA, 19 bp, Homo sapiens
ggatgccactcctccctcc

SEQ ID NO: 3024340 - DNA, 20 bp, Homo sapiens
ggatgccactcctccctccg

SEQ ID NO: 3024341 - DNA, 16 bp, Homo sapiens
ggatgcggatggccgg

SEQ ID NO: 3024342 - DNA, 18 bp, Homo sapiens
ggatgctatttcagccaa

SEQ ID NO: 3024343 - DNA, 20 bp, Homo sapiens
ggatgctccgaggactggac

SEQ ID NO: 3024344 - DNA, 17 bp, Homo sapiens
ggatgctctttcccagg

SEQ ID NO: 3024345 - DNA, 18 bp, Homo sapiens
ggatgctctttcccagga

SEQ ID NO: 3024346 - DNA, 23 bp, Homo sapiens
ggatgctctttcccaggacggat

SEQ ID NO: 3024347 - DNA, 23 bp, Homo sapiens
ggatgctgtgctacgtgtgaaat

SEQ ID NO: 3024348 - DNA, 15 bp, Homo sapiens
ggatggcccttcctc

SEQ ID NO: 3024349 - DNA, 22 bp, Homo sapiens
ggatggggaggaagagagagac

SEQ ID NO: 3024350 - DNA, 21 bp, Homo sapiens
ggatgggggaactcagatcca

SEQ ID NO: 3024351 - DNA, 15 bp, Homo sapiens
ggatggggggatttt

SEQ ID NO: 3024352 - DNA, 20 bp, Homo sapiens
ggatggtgacttttgaagaa

SEQ ID NO: 3024353 - DNA, 21 bp, Homo sapiens
ggatggtgacttttgaagaac

SEQ ID NO: 3024354 - DNA, 15 bp, Homo sapiens
ggatggtgggcttca

SEQ ID NO: 3024355 - DNA, 17 bp, Homo sapiens
ggatggtgggcttcagg

SEQ ID NO: 3024356 - DNA, 21 bp, Homo sapiens
ggatggtgttactgcagttga

SEQ ID NO: 3024357 - DNA, 21 bp, Homo sapiens
ggatgtaaacagtgcctgctg

SEQ ID NO: 3024358 - DNA, 23 bp, Homo sapiens
ggatgtcttttttaaggctctgt

SEQ ID NO: 3024359 - DNA, 18 bp, Homo sapiens
ggatgtgattgtggaatg

SEQ ID NO: 3024360 - DNA, 16 bp, Homo sapiens
ggatgtttacctggtg

SEQ ID NO: 3024361 - DNA, 16 bp, Homo sapiens
ggattacagaaactga

SEQ ID NO: 3024362 - DNA, 19 bp, Homo sapiens
ggattacaggcatgtgcca

SEQ ID NO: 3024363 - DNA, 14 bp, Homo sapiens
ggattaggggatgg

SEQ ID NO: 3024364 - DNA, 18 bp, Homo sapiens
ggattccaaccttccttt

SEQ ID NO: 3024365 - DNA, 19 bp, Homo sapiens
ggattccaaccttcctttt

SEQ ID NO: 3024366 - DNA, 18 bp, Homo sapiens
ggattccccctgccctgt

SEQ ID NO: 3024367 - DNA, 22 bp, Homo sapiens
ggattcctaaatattttcaaga

SEQ ID NO: 3024368 - DNA, 22 bp, Homo sapiens
ggattctgaagttttattttaa

SEQ ID NO: 3024369 - DNA, 16 bp, Homo sapiens
ggattctgagagctgt

SEQ ID NO: 3024370 - DNA, 13 bp, Homo sapiens
ggattgagtctgt

SEQ ID NO: 3024371 - DNA, 16 bp, Homo sapiens
ggattggccctgcccc

SEQ ID NO: 3024372 - DNA, 19 bp, Homo sapiens
ggattggccctgcccctcc

SEQ ID NO: 3024373 - DNA, 22 bp, Homo sapiens
ggattggccctgcccctccccc

SEQ ID NO: 3024374 - DNA, 17 bp, Homo sapiens
ggattgggcccctgcca

SEQ ID NO: 3024375 - DNA, 17 bp, Homo sapiens
ggatttacgactgaaga

SEQ ID NO: 3024376 - DNA, 23 bp, Homo sapiens
ggatttagaagtgtcatgtttat

SEQ ID NO: 3024377 - DNA, 13 bp, Homo sapiens
ggatttcagccat

SEQ ID NO: 3024378 - DNA, 23 bp, Homo sapiens
ggatttcctgctttgggaagccg

SEQ ID NO: 3024379 - DNA, 13 bp, Homo sapiens
ggatttcttaggg

SEQ ID NO: 3024380 - DNA, 12 bp, Homo sapiens
ggatttcttgta

SEQ ID NO: 3024381 - DNA, 15 bp, Homo sapiens
ggatttggttgttta

SEQ ID NO: 3024382 - DNA, 18 bp, Homo sapiens
ggatttgtaactgttttt

SEQ ID NO: 3024383 - DNA, 20 bp, Homo sapiens
ggatttgtccaaacaggtgc

SEQ ID NO: 3024384 - DNA, 14 bp, Homo sapiens
ggatttgttctctg

SEQ ID NO: 3024385 - DNA, 22 bp, Homo sapiens
ggatttttagagcattaaaata

SEQ ID NO: 3024386 - DNA, 23 bp, Homo sapiens
ggatttttttataaacagtttta

SEQ ID NO: 3024387 - DNA, 15 bp, Homo sapiens
ggcaaaagaaaagct

SEQ ID NO: 3024388 - DNA, 23 bp, Homo sapiens
ggcaaaagtctgaggcacctgca

SEQ ID NO: 3024389 - DNA, 13 bp, Homo sapiens
ggcaaacccatca

SEQ ID NO: 3024390 - DNA, 22 bp, Homo sapiens
ggcaaagaggcgaattgtagaa

SEQ ID NO: 3024391 - DNA, 15 bp, Homo sapiens
ggcaaaggcagagga

SEQ ID NO: 3024392 - DNA, 19 bp, Homo sapiens
ggcaaagggtccagaagga

SEQ ID NO: 3024393 - DNA, 20 bp, Homo sapiens
ggcaacaaagtgagactcca

SEQ ID NO: 3024394 - DNA, 14 bp, Homo sapiens
ggcaacacagaggc

SEQ ID NO: 3024395 - DNA, 23 bp, Homo sapiens
ggcaactgacattgctccaagat

SEQ ID NO: 3024396 - DNA, 12 bp, Homo sapiens
ggcaactggcca

SEQ ID NO: 3024397 - DNA, 15 bp, Homo sapiens
ggcaacttgaagaaa

SEQ ID NO: 3024398 - DNA, 23 bp, Homo sapiens
ggcaagagaatcgcttgaaccca

SEQ ID NO: 3024399 - DNA, 16 bp, Homo sapiens
ggcaagagggaaggtg

SEQ ID NO: 3024400 - DNA, 22 bp, Homo sapiens
ggcaaggaaaggggagaaggga

SEQ ID NO: 3024401 - DNA, 23 bp, Homo sapiens
ggcaagtgagaggggagggaggg

SEQ ID NO: 3024402 - DNA, 20 bp, Homo sapiens
ggcaagtggatgggaatttg

SEQ ID NO: 3024403 - DNA, 16 bp, Homo sapiens
ggcaagtgtaaaaaga

SEQ ID NO: 3024404 - DNA, 21 bp, Homo sapiens
ggcaatatagcaagatcccat

SEQ ID NO: 3024405 - DNA, 12 bp, Homo sapiens
ggcaatgaagaa

SEQ ID NO: 3024406 - DNA, 20 bp, Homo sapiens
ggcaatgggagctgaggcca

SEQ ID NO: 3024407 - DNA, 16 bp, Homo sapiens
ggcaatttagaaaaag

SEQ ID NO: 3024408 - DNA, 14 bp, Homo sapiens
ggcacacccctggg

SEQ ID NO: 3024409 - DNA, 22 bp, Homo sapiens
ggcacagcatctgtagtcagcc

SEQ ID NO: 3024410 - DNA, 12 bp, Homo sapiens
ggcacagccagc

SEQ ID NO: 3024411 - DNA, 13 bp, Homo sapiens
ggcacagccagcc

SEQ ID NO: 3024412 - DNA, 14 bp, Homo sapiens
ggcacagccagccc

SEQ ID NO: 3024413 - DNA, 22 bp, Homo sapiens
ggcacaggaaacagcaaacagt

SEQ ID NO: 3024414 - DNA, 18 bp, Homo sapiens
ggcacatcctatgcaata

SEQ ID NO: 3024415 - DNA, 21 bp, Homo sapiens
ggcatttgctggcctggcagg

SEQ ID NO: 3024416 - DNA, 16 bp, Homo sapiens
ggccaaacctctgttc

SEQ ID NO: 3024417 - DNA, 19 bp, Homo sapiens
ggccaaatcacccttagaa

SEQ ID NO: 3024418 - DNA, 21 bp, Homo sapiens
ggccaaatccttggagtccca

SEQ ID NO: 3024419 - DNA, 16 bp, Homo sapiens
ggccaacccttctcct

SEQ ID NO: 3024420 - DNA, 18 bp, Homo sapiens
ggccaactgcctccttgc

SEQ ID NO: 3024421 - DNA, 13 bp, Homo sapiens
ggccaagacggga

SEQ ID NO: 3024422 - DNA, 12 bp, Homo sapiens
ggccaagagaag

SEQ ID NO: 3024423 - DNA, 16 bp, Homo sapiens
ggccaagcagtgcctg

SEQ ID NO: 3024424 - DNA, 19 bp, Homo sapiens
ggccaagcagtgcctgcct

SEQ ID NO: 3024425 - DNA, 16 bp, Homo sapiens
ggccaaggagctgcta

SEQ ID NO: 3024426 - DNA, 14 bp, Homo sapiens
ggccaaggtgcata

SEQ ID NO: 3024427 - DNA, 16 bp, Homo sapiens
ggccacatggcggaga

SEQ ID NO: 3024428 - DNA, 19 bp, Homo sapiens
ggccacatgggaggctcac

SEQ ID NO: 3024429 - DNA, 22 bp, Homo sapiens
ggccaccacccaacctgtcctt

SEQ ID NO: 3024430 - DNA, 17 bp, Homo sapiens
ggccaccggggcaagag

SEQ ID NO: 3024431 - DNA, 21 bp, Homo sapiens
ggccaccgggggtggctctgt

SEQ ID NO: 3024432 - DNA, 16 bp, Homo sapiens
ggccacctcaccctct

SEQ ID NO: 3024433 - DNA, 18 bp, Homo sapiens
ggccacgctccagctgcc

SEQ ID NO: 3024434 - DNA, 15 bp, Homo sapiens
ggccacggcccaggg

SEQ ID NO: 3024435 - DNA, 16 bp, Homo sapiens
ggccacggcccaggga

SEQ ID NO: 3024436 - DNA, 12 bp, Homo sapiens
ggccacgtgcca

SEQ ID NO: 3024437 - DNA, 16 bp, Homo sapiens
ggccacgtgccaggcc

SEQ ID NO: 3024438 - DNA, 19 bp, Homo sapiens
ggccacgttcagggagggg

SEQ ID NO: 3024439 - DNA, 11 bp, Homo sapiens
ggccactaagc

SEQ ID NO: 3024440 - DNA, 12 bp, Homo sapiens
ggccactcctcc

SEQ ID NO: 3024441 - DNA, 21 bp, Homo sapiens
ggccagacatggtgtctcaca

SEQ ID NO: 3024442 - DNA, 18 bp, Homo sapiens
ggccagcaggcagcgcct

SEQ ID NO: 3024443 - DNA, 17 bp, Homo sapiens
ggccagccagccactct

SEQ ID NO: 3024444 - DNA, 14 bp, Homo sapiens
ggccagccatgtct

SEQ ID NO: 3024445 - DNA, 14 bp, Homo sapiens
ggccagcccctcca

SEQ ID NO: 3024446 - DNA, 19 bp, Homo sapiens
ggccagccgctctcctgcc

SEQ ID NO: 3024447 - DNA, 18 bp, Homo sapiens
ggccagcgccagggccca

SEQ ID NO: 3024448 - DNA, 19 bp, Homo sapiens
ggccagcgccagggcccag

SEQ ID NO: 3024449 - DNA, 23 bp, Homo sapiens
ggccagcgccagggcccaggcca

SEQ ID NO: 3024450 - DNA, 19 bp, Homo sapiens
ggccagctccttttctgtg

SEQ ID NO: 3024451 - DNA, 14 bp, Homo sapiens
ggccagctggcagc

SEQ ID NO: 3024452 - DNA, 16 bp, Homo sapiens
ggccaggacaggcccg

SEQ ID NO: 3024453 - DNA, 20 bp, Homo sapiens
ggccaggatttggttgttta

SEQ ID NO: 3024454 - DNA, 15 bp, Homo sapiens
ggccaggccagctgc

SEQ ID NO: 3024455 - DNA, 16 bp, Homo sapiens
ggccaggccctggagg

SEQ ID NO: 3024456 - DNA, 21 bp, Homo sapiens
ggccaggctgatgggacagaa

SEQ ID NO: 3024457 - DNA, 19 bp, Homo sapiens
ggccagggacccaaagcag

SEQ ID NO: 3024458 - DNA, 16 bp, Homo sapiens
ggccagggagaagctc

SEQ ID NO: 3024459 - DNA, 15 bp, Homo sapiens
ggccagggaggcaga

SEQ ID NO: 3024460 - DNA, 16 bp, Homo sapiens
ggccagggaggcagag

SEQ ID NO: 3024461 - DNA, 13 bp, Homo sapiens
ggccagggcagag

SEQ ID NO: 3024462 - DNA, 21 bp, Homo sapiens
ggccagggccacgctccagct

SEQ ID NO: 3024463 - DNA, 15 bp, Homo sapiens
ggccagggcggccag

SEQ ID NO: 3024464 - DNA, 18 bp, Homo sapiens
ggccagggcggccaggga

SEQ ID NO: 3024465 - DNA, 19 bp, Homo sapiens
ggccagggctgggtcacag

SEQ ID NO: 3024466 - DNA, 15 bp, Homo sapiens
ggccaggtgcggcct

SEQ ID NO: 3024467 - DNA, 15 bp, Homo sapiens
ggccaggtgggaacg

SEQ ID NO: 3024468 - DNA, 15 bp, Homo sapiens
ggccaggtgggcgga

SEQ ID NO: 3024469 - DNA, 19 bp, Homo sapiens
ggccaggtgggcggacaaa

SEQ ID NO: 3024470 - DNA, 16 bp, Homo sapiens
ggccagtacctttcca

SEQ ID NO: 3024471 - DNA, 20 bp, Homo sapiens
ggccagtgctgcccatgagc

SEQ ID NO: 3024472 - DNA, 19 bp, Homo sapiens
ggccatcactcagccccta

SEQ ID NO: 3024473 - DNA, 21 bp, Homo sapiens
ggccatcactcagcccctacc

SEQ ID NO: 3024474 - DNA, 22 bp, Homo sapiens
ggccatgagactgatccctggc

SEQ ID NO: 3024475 - DNA, 20 bp, Homo sapiens
ggccatgctgtccctgcact

SEQ ID NO: 3024476 - DNA, 22 bp, Homo sapiens
ggccatgctgtgtgagaccagg

SEQ ID NO: 3024477 - DNA, 16 bp, Homo sapiens
ggccatggcctctgca

SEQ ID NO: 3024478 - DNA, 15 bp, Homo sapiens
ggccatgggtcctcg

SEQ ID NO: 3024479 - DNA, 20 bp, Homo sapiens
ggccatgggtcctcggccca

SEQ ID NO: 3024480 - DNA, 13 bp, Homo sapiens
ggccatgtggcct

SEQ ID NO: 3024481 - DNA, 16 bp, Homo sapiens
ggccatgtggcctgcc

SEQ ID NO: 3024482 - DNA, 22 bp, Homo sapiens
ggccatgtggcctgcccagcct

SEQ ID NO: 3024483 - DNA, 21 bp, Homo sapiens
ggccatgttccacttggaaat

SEQ ID NO: 3024484 - DNA, 17 bp, Homo sapiens
ggccattaggaaactgt

SEQ ID NO: 3024485 - DNA, 20 bp, Homo sapiens
ggccattctccacagcaacc

SEQ ID NO: 3024486 - DNA, 14 bp, Homo sapiens
ggccatttggcccc

SEQ ID NO: 3024487 - DNA, 19 bp, Homo sapiens
ggcccaaagcttgtaaata

SEQ ID NO: 3024488 - DNA, 14 bp, Homo sapiens
ggcccaagtctcct

SEQ ID NO: 3024489 - DNA, 23 bp, Homo sapiens
ggcccaatctcgtcaggctgcca

SEQ ID NO: 3024490 - DNA, 16 bp, Homo sapiens
ggcccaatgcctataa

SEQ ID NO: 3024491 - DNA, 13 bp, Homo sapiens
ggcccacacacag

SEQ ID NO: 3024492 - DNA, 20 bp, Homo sapiens
ggcccacacccgacaccagc

SEQ ID NO: 3024493 - DNA, 13 bp, Homo sapiens
ggcccacagcccc

SEQ ID NO: 3024494 - DNA, 19 bp, Homo sapiens
ggcccacagcccccacccc

SEQ ID NO: 3024495 - DNA, 17 bp, Homo sapiens
ggcccacagctcccacc

SEQ ID NO: 3024496 - DNA, 20 bp, Homo sapiens
ggcccacccagtccatgctc

SEQ ID NO: 3024497 - DNA, 20 bp, Homo sapiens
ggcccaccggatgctgtgcc

SEQ ID NO: 3024498 - DNA, 17 bp, Homo sapiens
ggcccactgctggctgc

SEQ ID NO: 3024499 - DNA, 16 bp, Homo sapiens
ggcccagacccactct

SEQ ID NO: 3024500 - DNA, 14 bp, Homo sapiens
ggcccagagcccag

SEQ ID NO: 3024501 - DNA, 16 bp, Homo sapiens
ggcccagagcccagct

SEQ ID NO: 3024502 - DNA, 17 bp, Homo sapiens
ggcccagagcccagctc

SEQ ID NO: 3024503 - DNA, 18 bp, Homo sapiens
ggcccagagcccagctcc

SEQ ID NO: 3024504 - DNA, 15 bp, Homo sapiens
ggcccagcaccccct

SEQ ID NO: 3024505 - DNA, 20 bp, Homo sapiens
ggcccagcaccccctctcct

SEQ ID NO: 3024506 - DNA, 15 bp, Homo sapiens
ggcccagcaggggcc

SEQ ID NO: 3024507 - DNA, 22 bp, Homo sapiens
ggcccaggaccatcatcctact

SEQ ID NO: 3024508 - DNA, 16 bp, Homo sapiens
ggcccaggagctctgc

SEQ ID NO: 3024509 - DNA, 23 bp, Homo sapiens
ggcccaggagctctgcgccaggc

SEQ ID NO: 3024510 - DNA, 11 bp, Homo sapiens
ggcccaggagg

SEQ ID NO: 3024511 - DNA, 13 bp, Homo sapiens
ggcccaggcaggt

SEQ ID NO: 3024512 - DNA, 20 bp, Homo sapiens
ggcccaggcaggtctgcaag

SEQ ID NO: 3024513 - DNA, 10 bp, Homo sapiens
ggcccaggga

SEQ ID NO: 3024514 - DNA, 13 bp, Homo sapiens
ggcccagggggcc

SEQ ID NO: 3024515 - DNA, 16 bp, Homo sapiens
ggcccagtccttggct

SEQ ID NO: 3024516 - DNA, 21 bp, Homo sapiens
ggcccagtgcatggtggccag

SEQ ID NO: 3024517 - DNA, 16 bp, Homo sapiens
ggcccatggaggagac

SEQ ID NO: 3024518 - DNA, 14 bp, Homo sapiens
ggccccacaggagt

SEQ ID NO: 3024519 - DNA, 13 bp, Homo sapiens
ggccccaggaagc

SEQ ID NO: 3024520 - DNA, 21 bp, Homo sapiens
ggccccaggggacgtgggccc

SEQ ID NO: 3024521 - DNA, 21 bp, Homo sapiens
ggccccatcgccccaccgcag

SEQ ID NO: 3024522 - DNA, 21 bp, Homo sapiens
ggcccccaccacacatcccag

SEQ ID NO: 3024523 - DNA, 13 bp, Homo sapiens
ggcccccaccgcc

SEQ ID NO: 3024524 - DNA, 13 bp, Homo sapiens
ggcccccagagac

SEQ ID NO: 3024525 - DNA, 19 bp, Homo sapiens
ggcccccagagacctttgc

SEQ ID NO: 3024526 - DNA, 14 bp, Homo sapiens
ggcccccctgccct

SEQ ID NO: 3024527 - DNA, 19 bp, Homo sapiens
ggcccccgccccctcccta

SEQ ID NO: 3024528 - DNA, 13 bp, Homo sapiens
ggccccctaggat

SEQ ID NO: 3024529 - DNA, 17 bp, Homo sapiens
ggccccctcaccccagc

SEQ ID NO: 3024530 - DNA, 22 bp, Homo sapiens
ggcccctatgtagtccgtgctg

SEQ ID NO: 3024531 - DNA, 13 bp, Homo sapiens
ggcccctcaccct

SEQ ID NO: 3024532 - DNA, 14 bp, Homo sapiens
ggcccctcaccctc

SEQ ID NO: 3024533 - DNA, 15 bp, Homo sapiens
ggcccctcaccctct

SEQ ID NO: 3024534 - DNA, 19 bp, Homo sapiens
ggcccctcaccctctgtcc

SEQ ID NO: 3024535 - DNA, 17 bp, Homo sapiens
ggcccctcacctggtac

SEQ ID NO: 3024536 - DNA, 23 bp, Homo sapiens
ggcccctcacctggtacctggac

SEQ ID NO: 3024537 - DNA, 15 bp, Homo sapiens
ggcccctccaatcct

SEQ ID NO: 3024538 - DNA, 19 bp, Homo sapiens
ggcccctcccctcagagcc

SEQ ID NO: 3024539 - DNA, 14 bp, Homo sapiens
ggcccctctcctcc

SEQ ID NO: 3024540 - DNA, 17 bp, Homo sapiens
ggcccctgagatctctg

SEQ ID NO: 3024541 - DNA, 21 bp, Homo sapiens
ggcccctgagatctctgcagg

SEQ ID NO: 3024542 - DNA, 18 bp, Homo sapiens
ggcccctgctgtctctct

SEQ ID NO: 3024543 - DNA, 19 bp, Homo sapiens
ggcccctgctgtctctctg

SEQ ID NO: 3024544 - DNA, 21 bp, Homo sapiens
ggcccctgctgtctctctggg

SEQ ID NO: 3024545 - DNA, 13 bp, Homo sapiens
ggcccctggcact

SEQ ID NO: 3024546 - DNA, 12 bp, Homo sapiens
ggcccctggccc

SEQ ID NO: 3024547 - DNA, 16 bp, Homo sapiens
ggcccctggcccagga

SEQ ID NO: 3024548 - DNA, 19 bp, Homo sapiens
ggcttggatcctgggctgg

SEQ ID NO: 3024549 - DNA, 14 bp, Homo sapiens
ggcttggcatctgt

SEQ ID NO: 3024550 - DNA, 17 bp, Homo sapiens
ggcttggcatctgtgtg

SEQ ID NO: 3024551 - DNA, 20 bp, Homo sapiens
ggcttggcccgcggcctgca

SEQ ID NO: 3024552 - DNA, 15 bp, Homo sapiens
ggcttgtaactccac

SEQ ID NO: 3024553 - DNA, 17 bp, Homo sapiens
ggcttgtaactccacca

SEQ ID NO: 3024554 - DNA, 20 bp, Homo sapiens
ggcttgtacatttttaaatt

SEQ ID NO: 3024555 - DNA, 23 bp, Homo sapiens
ggcttgtacatttttaaattctt

SEQ ID NO: 3024556 - DNA, 15 bp, Homo sapiens
ggcttgttgtaaagc

SEQ ID NO: 3024557 - DNA, 15 bp, Homo sapiens
ggcttgtttattttg

SEQ ID NO: 3024558 - DNA, 16 bp, Homo sapiens
ggctttaagctccagc

SEQ ID NO: 3024559 - DNA, 17 bp, Homo sapiens
ggctttaagctccagct

SEQ ID NO: 3024560 - DNA, 22 bp, Homo sapiens
ggctttcagggcagcccctgca

SEQ ID NO: 3024561 - DNA, 19 bp, Homo sapiens
ggctttcctggttctgtct

SEQ ID NO: 3024562 - DNA, 16 bp, Homo sapiens
ggctttcggggagggc

SEQ ID NO: 3024563 - DNA, 19 bp, Homo sapiens
ggctttcgtccacagcttc

SEQ ID NO: 3024564 - DNA, 15 bp, Homo sapiens
ggctttctgttgcca

SEQ ID NO: 3024565 - DNA, 12 bp, Homo sapiens
ggctttggattt

SEQ ID NO: 3024566 - DNA, 12 bp, Homo sapiens
ggctttggccca

SEQ ID NO: 3024567 - DNA, 19 bp, Homo sapiens
ggctttgggatgggaggcc

SEQ ID NO: 3024568 - DNA, 14 bp, Homo sapiens
ggctttgtcttgaa

SEQ ID NO: 3024569 - DNA, 18 bp, Homo sapiens
ggcttttactgaagcctt

SEQ ID NO: 3024570 - DNA, 20 bp, Homo sapiens
ggcttttactgaagcctttc

SEQ ID NO: 3024571 - DNA, 19 bp, Homo sapiens
ggcttttattaatgcactt

SEQ ID NO: 3024572 - DNA, 15 bp, Homo sapiens
gggaaaaaaatgttg

SEQ ID NO: 3024573 - DNA, 10 bp, Homo sapiens
gggaaaaagc

SEQ ID NO: 3024574 - DNA, 13 bp, Homo sapiens
gggaaaagcagct

SEQ ID NO: 3024575 - DNA, 17 bp, Homo sapiens
gggaaaatatttcctga

SEQ ID NO: 3024576 - DNA, 18 bp, Homo sapiens
gggaaaattatttgcata

SEQ ID NO: 3024577 - DNA, 14 bp, Homo sapiens
gggaaactggctga

SEQ ID NO: 3024578 - DNA, 13 bp, Homo sapiens
gggaaagacactg

SEQ ID NO: 3024579 - DNA, 22 bp, Homo sapiens
gggaaagacactgcctgggctg

SEQ ID NO: 3024580 - DNA, 13 bp, Homo sapiens
gggaaagagaaag

SEQ ID NO: 3024581 - DNA, 22 bp, Homo sapiens
gggaaaggcctgtggggagccg

SEQ ID NO: 3024582 - DNA, 18 bp, Homo sapiens
gggaacagacaggagaaa

SEQ ID NO: 3024583 - DNA, 16 bp, Homo sapiens
gggaacatatttaagg

SEQ ID NO: 3024584 - DNA, 16 bp, Homo sapiens
gggaaccccagggggc

SEQ ID NO: 3024585 - DNA, 19 bp, Homo sapiens
gggaacgcagcctccagtt

SEQ ID NO: 3024586 - DNA, 16 bp, Homo sapiens
gggaactcagatccag

SEQ ID NO: 3024587 - DNA, 20 bp, Homo sapiens
gggaactgaatcaggaaact

SEQ ID NO: 3024588 - DNA, 21 bp, Homo sapiens
gggaagaaacactttctcttc

SEQ ID NO: 3024589 - DNA, 13 bp, Homo sapiens
gggaagcatcctc

SEQ ID NO: 3024590 - DNA, 15 bp, Homo sapiens
gggaagcatcctccc

SEQ ID NO: 3024591 - DNA, 21 bp, Homo sapiens
gggaaggacaatcccaggaag

SEQ ID NO: 3024592 - DNA, 19 bp, Homo sapiens
gggaaggacagaaaggaga

SEQ ID NO: 3024593 - DNA, 17 bp, Homo sapiens
gggaaggaggctggctt

SEQ ID NO: 3024594 - DNA, 16 bp, Homo sapiens
gggaagggagagcggg

SEQ ID NO: 3024595 - DNA, 15 bp, Homo sapiens
gggaagggcatgcac

SEQ ID NO: 3024596 - DNA, 13 bp, Homo sapiens
gggaaggggccgg

SEQ ID NO: 3024597 - DNA, 19 bp, Homo sapiens
gggaaggggtgcaggtggg

SEQ ID NO: 3024598 - DNA, 17 bp, Homo sapiens
gggaagtacgtcccagc

SEQ ID NO: 3024599 - DNA, 14 bp, Homo sapiens
gggaatcagaactc

SEQ ID NO: 3024600 - DNA, 15 bp, Homo sapiens
gggaatggcagctgc

SEQ ID NO: 3024601 - DNA, 15 bp, Homo sapiens
gggaatgggcaggtg

SEQ ID NO: 3024602 - DNA, 16 bp, Homo sapiens
gggacaccgtggggaa

SEQ ID NO: 3024603 - DNA, 14 bp, Homo sapiens
gggacacctaggct

SEQ ID NO: 3024604 - DNA, 17 bp, Homo sapiens
gggacagagacacctgc

SEQ ID NO: 3024605 - DNA, 20 bp, Homo sapiens
gggacagagacacctgcacc

SEQ ID NO: 3024606 - DNA, 19 bp, Homo sapiens
gggacagaggccccagcct

SEQ ID NO: 3024607 - DNA, 20 bp, Homo sapiens
gggacagaggccccagcctc

SEQ ID NO: 3024608 - DNA, 21 bp, Homo sapiens
gggacagaggccccagcctcc

SEQ ID NO: 3024609 - DNA, 12 bp, Homo sapiens
gggacagagggt

SEQ ID NO: 3024610 - DNA, 21 bp, Homo sapiens
gggacaggaaggtctgatttg

SEQ ID NO: 3024611 - DNA, 22 bp, Homo sapiens
gggacaggctggaatgagggag

SEQ ID NO: 3024612 - DNA, 18 bp, Homo sapiens
gggacaggggcaggagga

SEQ ID NO: 3024613 - DNA, 17 bp, Homo sapiens
gggacatcacagggtgg

SEQ ID NO: 3024614 - DNA, 17 bp, Homo sapiens
gggacatgccctgtgtg

SEQ ID NO: 3024615 - DNA, 16 bp, Homo sapiens
gggaccaaagggggag

SEQ ID NO: 3024616 - DNA, 19 bp, Homo sapiens
gggaccaaattgcttctag

SEQ ID NO: 3024617 - DNA, 17 bp, Homo sapiens
gggaccactgggcccct

SEQ ID NO: 3024618 - DNA, 20 bp, Homo sapiens
gggaccagagggatgggaga

SEQ ID NO: 3024619 - DNA, 12 bp, Homo sapiens
gggacccagtgc

SEQ ID NO: 3024620 - DNA, 15 bp, Homo sapiens
gggaccccacccctc

SEQ ID NO: 3024621 - DNA, 15 bp, Homo sapiens
gggaccccaggccca

SEQ ID NO: 3024622 - DNA, 21 bp, Homo sapiens
gggaccccaggcccactcagg

SEQ ID NO: 3024623 - DNA, 13 bp, Homo sapiens
gggacccccgccc

SEQ ID NO: 3024624 - DNA, 14 bp, Homo sapiens
gggacccccgcccc

SEQ ID NO: 3024625 - DNA, 17 bp, Homo sapiens
gggacccccgccccctg

SEQ ID NO: 3024626 - DNA, 18 bp, Homo sapiens
gggacccccgccccctgc

SEQ ID NO: 3024627 - DNA, 21 bp, Homo sapiens
gggacccccgccccctgccct

SEQ ID NO: 3024628 - DNA, 18 bp, Homo sapiens
gggaccggtacagaaagg

SEQ ID NO: 3024629 - DNA, 14 bp, Homo sapiens
gggacctcagcctg

SEQ ID NO: 3024630 - DNA, 15 bp, Homo sapiens
gggacctcagcctgc

SEQ ID NO: 3024631 - DNA, 17 bp, Homo sapiens
gggacctcagcctgcac

SEQ ID NO: 3024632 - DNA, 20 bp, Homo sapiens
gggacctcagcctgcaccct

SEQ ID NO: 3024633 - DNA, 23 bp, Homo sapiens
gggacctctcccagggtccctgg

SEQ ID NO: 3024634 - DNA, 17 bp, Homo sapiens
gggacctgatggagagt

SEQ ID NO: 3024635 - DNA, 23 bp, Homo sapiens
gggaccttggtctgatcgacgtg

SEQ ID NO: 3024636 - DNA, 19 bp, Homo sapiens
gggacgaagaagagccaca

SEQ ID NO: 3024637 - DNA, 20 bp, Homo sapiens
gggacgaagaagagccacag

SEQ ID NO: 3024638 - DNA, 18 bp, Homo sapiens
gggacgcaggcccctctc

SEQ ID NO: 3024639 - DNA, 20 bp, Homo sapiens
gggacggtcagtttggtgtc

SEQ ID NO: 3024640 - DNA, 14 bp, Homo sapiens
gggacgtttctcat

SEQ ID NO: 3024641 - DNA, 18 bp, Homo sapiens
gggactcactggcagccc

SEQ ID NO: 3024642 - DNA, 21 bp, Homo sapiens
gggactcactggcagccccag

SEQ ID NO: 3024643 - DNA, 14 bp, Homo sapiens
gggacttcttttca

SEQ ID NO: 3024644 - DNA, 22 bp, Homo sapiens
gggagaaaagacggatggcagg

SEQ ID NO: 3024645 - DNA, 14 bp, Homo sapiens
gggagaaagcaata

SEQ ID NO: 3024646 - DNA, 16 bp, Homo sapiens
gggagaaattgacaga

SEQ ID NO: 3024647 - DNA, 15 bp, Homo sapiens
gggagaaggcctccc

SEQ ID NO: 3024648 - DNA, 21 bp, Homo sapiens
gggagacggtttccagggagg

SEQ ID NO: 3024649 - DNA, 20 bp, Homo sapiens
gggagactgggctgagggag

SEQ ID NO: 3024650 - DNA, 20 bp, Homo sapiens
gggagagacttggatgagga

SEQ ID NO: 3024651 - DNA, 22 bp, Homo sapiens
gggagagccaggcttggatgga

SEQ ID NO: 3024652 - DNA, 14 bp, Homo sapiens
gggagaggaagaga

SEQ ID NO: 3024653 - DNA, 11 bp, Homo sapiens
gggagaggctg

SEQ ID NO: 3024654 - DNA, 19 bp, Homo sapiens
gggagaggggacgcaggcc

SEQ ID NO: 3024655 - DNA, 19 bp, Homo sapiens
gggagatggatcaatcaaa

SEQ ID NO: 3024656 - DNA, 17 bp, Homo sapiens
gggagattcaagggacc

SEQ ID NO: 3024657 - DNA, 17 bp, Homo sapiens
gggagcaaaaggcggtg

SEQ ID NO: 3024658 - DNA, 21 bp, Homo sapiens
gggagcaccacggccagaagt

SEQ ID NO: 3024659 - DNA, 20 bp, Homo sapiens
gggagcagcggctctggtcc

SEQ ID NO: 3024660 - DNA, 15 bp, Homo sapiens
gggagcaggcggtgg

SEQ ID NO: 3024661 - DNA, 24 bp, Homo sapiens
gggagcaggcggtgggcacccacc

SEQ ID NO: 3024662 - DNA, 22 bp, Homo sapiens
gggagccaaaatctcaagaaat

SEQ ID NO: 3024663 - DNA, 19 bp, Homo sapiens
gggagcccactgtcctggg

SEQ ID NO: 3024664 - DNA, 21 bp, Homo sapiens
gggagcccactgtcctgggcc

SEQ ID NO: 3024665 - DNA, 19 bp, Homo sapiens
gggagccccttctgctcag

SEQ ID NO: 3024666 - DNA, 22 bp, Homo sapiens
gggagccgagggcgtcagagag

SEQ ID NO: 3024667 - DNA, 18 bp, Homo sapiens
gggagccttagccgccca

SEQ ID NO: 3024668 - DNA, 21 bp, Homo sapiens
gggagcctttggttctggcca

SEQ ID NO: 3024669 - DNA, 15 bp, Homo sapiens
gggagctagccagag

SEQ ID NO: 3024670 - DNA, 18 bp, Homo sapiens
gggagctagccagaggac

SEQ ID NO: 3024671 - DNA, 12 bp, Homo sapiens
gggagctcagga

SEQ ID NO: 3024672 - DNA, 23 bp, Homo sapiens
gggagcttcccacacctgcctgc

SEQ ID NO: 3024673 - DNA, 20 bp, Homo sapiens
gggaggaccacaggtgtgag

SEQ ID NO: 3024674 - DNA, 12 bp, Homo sapiens
gggaggagggca

SEQ ID NO: 3024675 - DNA, 19 bp, Homo sapiens
gggaggcagagcgggaggg

SEQ ID NO: 3024676 - DNA, 12 bp, Homo sapiens
gggaggccaggc

SEQ ID NO: 3024677 - DNA, 11 bp, Homo sapiens
gggaggcccca

SEQ ID NO: 3024678 - DNA, 13 bp, Homo sapiens
gggaggctcaggt

SEQ ID NO: 3024679 - DNA, 15 bp, Homo sapiens
gggaggctgaggcag

SEQ ID NO: 3024680 - DNA, 16 bp, Homo sapiens
gggtggccgggcacag

SEQ ID NO: 3024681 - DNA, 15 bp, Homo sapiens
gggtgggaggggcca

SEQ ID NO: 3024682 - DNA, 13 bp, Homo sapiens
gggtgggcctcgg

SEQ ID NO: 3024683 - DNA, 16 bp, Homo sapiens
gggtggggaggggcct

SEQ ID NO: 3024684 - DNA, 23 bp, Homo sapiens
gggtgggggagaaaaaatcactg

SEQ ID NO: 3024685 - DNA, 14 bp, Homo sapiens
gggtgggggagcca

SEQ ID NO: 3024686 - DNA, 14 bp, Homo sapiens
gggtgggggccagg

SEQ ID NO: 3024687 - DNA, 15 bp, Homo sapiens
gggtgggggccaggc

SEQ ID NO: 3024688 - DNA, 17 bp, Homo sapiens
gggtggggggcttcata

SEQ ID NO: 3024689 - DNA, 17 bp, Homo sapiens
gggtggggtcatgccct

SEQ ID NO: 3024690 - DNA, 16 bp, Homo sapiens
gggtggtctgcaggca

SEQ ID NO: 3024691 - DNA, 16 bp, Homo sapiens
gggtggtggggggcag

SEQ ID NO: 3024692 - DNA, 13 bp, Homo sapiens
gggtggtttttat

SEQ ID NO: 3024693 - DNA, 19 bp, Homo sapiens
gggtgtccccgctgctgtg

SEQ ID NO: 3024694 - DNA, 15 bp, Homo sapiens
gggtgtccgagaggc

SEQ ID NO: 3024695 - DNA, 17 bp, Homo sapiens
gggtgtcctgcaccggg

SEQ ID NO: 3024696 - DNA, 21 bp, Homo sapiens
gggtgtggcacgcacctgtag

SEQ ID NO: 3024697 - DNA, 13 bp, Homo sapiens
gggtgtgggaggc

SEQ ID NO: 3024698 - DNA, 21 bp, Homo sapiens
gggttaatcatatttgaaaac

SEQ ID NO: 3024699 - DNA, 16 bp, Homo sapiens
gggttaattcatttgg

SEQ ID NO: 3024700 - DNA, 18 bp, Homo sapiens
gggttagatgttgccatg

SEQ ID NO: 3024701 - DNA, 19 bp, Homo sapiens
gggttatgtatcagaagag

SEQ ID NO: 3024702 - DNA, 22 bp, Homo sapiens
gggttcaagtgactctcctgcc

SEQ ID NO: 3024703 - DNA, 17 bp, Homo sapiens
gggttcacacagcccag

SEQ ID NO: 3024704 - DNA, 13 bp, Homo sapiens
gggttcagcccct

SEQ ID NO: 3024705 - DNA, 13 bp, Homo sapiens
gggttcaggcctg

SEQ ID NO: 3024706 - DNA, 14 bp, Homo sapiens
gggttcaggcctgg

SEQ ID NO: 3024707 - DNA, 15 bp, Homo sapiens
gggttctcagtgccg

SEQ ID NO: 3024708 - DNA, 13 bp, Homo sapiens
gggttgtgagccc

SEQ ID NO: 3024709 - DNA, 20 bp, Homo sapiens
gggtttcaccatgttggcca

SEQ ID NO: 3024710 - DNA, 16 bp, Homo sapiens
gggtttggcccctgga

SEQ ID NO: 3024711 - DNA, 17 bp, Homo sapiens
gggttttccgcccacag

SEQ ID NO: 3024712 - DNA, 16 bp, Homo sapiens
ggtaaaattagatgca

SEQ ID NO: 3024713 - DNA, 16 bp, Homo sapiens
ggtaaacacgcctgca

SEQ ID NO: 3024714 - DNA, 15 bp, Homo sapiens
ggtaaagactggctt

SEQ ID NO: 3024715 - DNA, 22 bp, Homo sapiens
ggtaaatttccccaacagtgtg

SEQ ID NO: 3024716 - DNA, 13 bp, Homo sapiens
ggtaaatttctgt

SEQ ID NO: 3024717 - DNA, 12 bp, Homo sapiens
ggtaactaagaa

SEQ ID NO: 3024718 - DNA, 22 bp, Homo sapiens
ggtaactttgcaggcggccctc

SEQ ID NO: 3024719 - DNA, 15 bp, Homo sapiens
ggtaagcggaataaa

SEQ ID NO: 3024720 - DNA, 20 bp, Homo sapiens
ggtaatcttgctctgcttga

SEQ ID NO: 3024721 - DNA, 14 bp, Homo sapiens
ggtaattgtacaat

SEQ ID NO: 3024722 - DNA, 14 bp, Homo sapiens
ggtacacagtgaga

SEQ ID NO: 3024723 - DNA, 14 bp, Homo sapiens
ggtacaggagtcag

SEQ ID NO: 3024724 - DNA, 16 bp, Homo sapiens
ggtacatttttcaact

SEQ ID NO: 3024725 - DNA, 14 bp, Homo sapiens
ggtaccactgattt

SEQ ID NO: 3024726 - DNA, 14 bp, Homo sapiens
ggtaccagatgcag

SEQ ID NO: 3024727 - DNA, 21 bp, Homo sapiens
ggtaccagcagaaaggttagt

SEQ ID NO: 3024728 - DNA, 13 bp, Homo sapiens
ggtacgtgaccct

SEQ ID NO: 3024729 - DNA, 22 bp, Homo sapiens
ggtacttcagtattaaattaga

SEQ ID NO: 3024730 - DNA, 16 bp, Homo sapiens
ggtacttcttgaaggt

SEQ ID NO: 3024731 - DNA, 20 bp, Homo sapiens
ggtagaaaatgcaccaaata

SEQ ID NO: 3024732 - DNA, 22 bp, Homo sapiens
ggtagaaaatgcaccaaatagg

SEQ ID NO: 3024733 - DNA, 20 bp, Homo sapiens
ggtagaagccacccttccct

SEQ ID NO: 3024734 - DNA, 17 bp, Homo sapiens
ggtagagcaaaggagac

SEQ ID NO: 3024735 - DNA, 14 bp, Homo sapiens
ggtagattcgctgt

SEQ ID NO: 3024736 - DNA, 15 bp, Homo sapiens
ggtagattcgctgtc

SEQ ID NO: 3024737 - DNA, 22 bp, Homo sapiens
ggtagattcgctgtcccctcag

SEQ ID NO: 3024738 - DNA, 16 bp, Homo sapiens
ggtagatttcctcctc

SEQ ID NO: 3024739 - DNA, 13 bp, Homo sapiens
ggtagccagcaca

SEQ ID NO: 3024740 - DNA, 18 bp, Homo sapiens
ggtagccatcaagcactt

SEQ ID NO: 3024741 - DNA, 12 bp, Homo sapiens
ggtagctccagc

SEQ ID NO: 3024742 - DNA, 12 bp, Homo sapiens
ggtaggaaatgt

SEQ ID NO: 3024743 - DNA, 19 bp, Homo sapiens
ggtaggaggaggcatggaa

SEQ ID NO: 3024744 - DNA, 13 bp, Homo sapiens
ggtaggtaaatct

SEQ ID NO: 3024745 - DNA, 11 bp, Homo sapiens
ggtatgtacag

SEQ ID NO: 3024746 - DNA, 24 bp, Homo sapiens
ggtatgtgcgtgtgcgtgttcctt

SEQ ID NO: 3024747 - DNA, 15 bp, Homo sapiens
ggtattctctctatg

SEQ ID NO: 3024748 - DNA, 20 bp, Homo sapiens
ggtattctctctatgcaaaa

SEQ ID NO: 3024749 - DNA, 17 bp, Homo sapiens
ggtcaacagaatgaaaa

SEQ ID NO: 3024750 - DNA, 14 bp, Homo sapiens
ggtcaacagagaag

SEQ ID NO: 3024751 - DNA, 16 bp, Homo sapiens
ggtcaacagttttcct

SEQ ID NO: 3024752 - DNA, 15 bp, Homo sapiens
ggtcaagctgagctg

SEQ ID NO: 3024753 - DNA, 18 bp, Homo sapiens
ggtcaagctgagctggct

SEQ ID NO: 3024754 - DNA, 21 bp, Homo sapiens
ggtcaataaacttagaggaaa

SEQ ID NO: 3024755 - DNA, 14 bp, Homo sapiens
ggtcacaggaagga

SEQ ID NO: 3024756 - DNA, 16 bp, Homo sapiens
ggtcacaggaaggaaa

SEQ ID NO: 3024757 - DNA, 18 bp, Homo sapiens
ggtcacaggaaggaaaca

SEQ ID NO: 3024758 - DNA, 12 bp, Homo sapiens
ggtcaccctgtg

SEQ ID NO: 3024759 - DNA, 12 bp, Homo sapiens
ggtcaccttgtt

SEQ ID NO: 3024760 - DNA, 14 bp, Homo sapiens
ggtcactctgccct

SEQ ID NO: 3024761 - DNA, 15 bp, Homo sapiens
ggtcactctgccctc

SEQ ID NO: 3024762 - DNA, 24 bp, Homo sapiens
ggtcactctgccctctgctgctgc

SEQ ID NO: 3024763 - DNA, 19 bp, Homo sapiens
ggtcactgaggcctgagac

SEQ ID NO: 3024764 - DNA, 23 bp, Homo sapiens
ggtcactgaggcctgagacccag

SEQ ID NO: 3024765 - DNA, 17 bp, Homo sapiens
ggtcactgtcactgccg

SEQ ID NO: 3024766 - DNA, 23 bp, Homo sapiens
ggtcagaggagagatagcctgtg

SEQ ID NO: 3024767 - DNA, 18 bp, Homo sapiens
ggtcagattagttggctt

SEQ ID NO: 3024768 - DNA, 20 bp, Homo sapiens
ggtcagatttatttgtttga

SEQ ID NO: 3024769 - DNA, 15 bp, Homo sapiens
ggtcaggaccaggac

SEQ ID NO: 3024770 - DNA, 18 bp, Homo sapiens
ggtcaggctggtctcaaa

SEQ ID NO: 3024771 - DNA, 18 bp, Homo sapiens
ggtcaggggtgacacaga

SEQ ID NO: 3024772 - DNA, 14 bp, Homo sapiens
ggtcagtgcaaata

SEQ ID NO: 3024773 - DNA, 17 bp, Homo sapiens
ggtcagtttatgaaaca

SEQ ID NO: 3024774 - DNA, 13 bp, Homo sapiens
ggtcatccttgcc

SEQ ID NO: 3024775 - DNA, 22 bp, Homo sapiens
ggtcatgaattcatactctgtt

SEQ ID NO: 3024776 - DNA, 21 bp, Homo sapiens
ggtcatgacaagatgggacag

SEQ ID NO: 3024777 - DNA, 16 bp, Homo sapiens
ggtcatgccctcctct

SEQ ID NO: 3024778 - DNA, 13 bp, Homo sapiens
ggtcatggccaca

SEQ ID NO: 3024779 - DNA, 15 bp, Homo sapiens
ggtcatggccacact

SEQ ID NO: 3024780 - DNA, 12 bp, Homo sapiens
ggtcatgtgtgt

SEQ ID NO: 3024781 - DNA, 13 bp, Homo sapiens
ggtccaaatgttt

SEQ ID NO: 3024782 - DNA, 16 bp, Homo sapiens
ggtccaactgcaactc

SEQ ID NO: 3024783 - DNA, 18 bp, Homo sapiens
ggtccaagattctggagc

SEQ ID NO: 3024784 - DNA, 17 bp, Homo sapiens
ggtccacatcccgggac

SEQ ID NO: 3024785 - DNA, 23 bp, Homo sapiens
ggtccaccctttcatagagaggc

SEQ ID NO: 3024786 - DNA, 19 bp, Homo sapiens
ggtccacttgccagggctc

SEQ ID NO: 3024787 - DNA, 17 bp, Homo sapiens
ggtccagcttgctcttc

SEQ ID NO: 3024788 - DNA, 18 bp, Homo sapiens
ggtccagcttgctcttca

SEQ ID NO: 3024789 - DNA, 11 bp, Homo sapiens
ggtccaggaga

SEQ ID NO: 3024790 - DNA, 13 bp, Homo sapiens
ggtccatgggcag

SEQ ID NO: 3024791 - DNA, 13 bp, Homo sapiens
ggtcccaggaagc

SEQ ID NO: 3024792 - DNA, 17 bp, Homo sapiens
ggtcccaggaagcaggg

SEQ ID NO: 3024793 - DNA, 23 bp, Homo sapiens
ggtccccacagactgccccagcc

SEQ ID NO: 3024794 - DNA, 18 bp, Homo sapiens
ggtccccgccctctctca

SEQ ID NO: 3024795 - DNA, 13 bp, Homo sapiens
ggtcccctccctc

SEQ ID NO: 3024796 - DNA, 18 bp, Homo sapiens
ggtccccttcccaggggc

SEQ ID NO: 3024797 - DNA, 17 bp, Homo sapiens
ggtccctccccttctct

SEQ ID NO: 3024798 - DNA, 16 bp, Homo sapiens
ggtccctggtccttca

SEQ ID NO: 3024799 - DNA, 21 bp, Homo sapiens
ggtcccttgagacctcagcca

SEQ ID NO: 3024800 - DNA, 13 bp, Homo sapiens
ggtccgcggcctg

SEQ ID NO: 3024801 - DNA, 16 bp, Homo sapiens
ggtccgcggcctgcac

SEQ ID NO: 3024802 - DNA, 17 bp, Homo sapiens
ggtccggtgttctaaga

SEQ ID NO: 3024803 - DNA, 19 bp, Homo sapiens
ggtcctagcccagtgcttc

SEQ ID NO: 3024804 - DNA, 16 bp, Homo sapiens
ggtcctatttttgtga

SEQ ID NO: 3024805 - DNA, 13 bp, Homo sapiens
ggtcctcagctgc

SEQ ID NO: 3024806 - DNA, 16 bp, Homo sapiens
ggtcctcattcaaagg

SEQ ID NO: 3024807 - DNA, 15 bp, Homo sapiens
ggtcctcggcccatc

SEQ ID NO: 3024808 - DNA, 21 bp, Homo sapiens
ggtcctcggcccatctgtcca

SEQ ID NO: 3024809 - DNA, 12 bp, Homo sapiens
ggtcctctctct

SEQ ID NO: 3024810 - DNA, 18 bp, Homo sapiens
ggtcctgctccgctgcct

SEQ ID NO: 3024811 - DNA, 19 bp, Homo sapiens
ggtcctgctccgctgcctg

SEQ ID NO: 3024812 - DNA, 16 bp, Homo sapiens
ggtcctggccatccca

SEQ ID NO: 3024813 - DNA, 11 bp, Homo sapiens
ggtcctgggag

SEQ ID NO: 3024814 - DNA, 20 bp, Homo sapiens
gtacaagttgctttgttaca

SEQ ID NO: 3024815 - DNA, 22 bp, Homo sapiens
gtacaagttgctttgttacaat

SEQ ID NO: 3024816 - DNA, 14 bp, Homo sapiens
gtacacgtgtcctg

SEQ ID NO: 3024817 - DNA, 16 bp, Homo sapiens
gtacactgtgtctcta

SEQ ID NO: 3024818 - DNA, 12 bp, Homo sapiens
gtacactttttt

SEQ ID NO: 3024819 - DNA, 16 bp, Homo sapiens
gtacagacatatttaa

SEQ ID NO: 3024820 - DNA, 20 bp, Homo sapiens
gtacagagacctccctgttc

SEQ ID NO: 3024821 - DNA, 21 bp, Homo sapiens
gtacagagtgtggactctggt

SEQ ID NO: 3024822 - DNA, 14 bp, Homo sapiens
gtacagcccagagg

SEQ ID NO: 3024823 - DNA, 16 bp, Homo sapiens
gtacagtctcaatttt

SEQ ID NO: 3024824 - DNA, 19 bp, Homo sapiens
gtacagtctgtcttctgta

SEQ ID NO: 3024825 - DNA, 14 bp, Homo sapiens
gtacagttatctaa

SEQ ID NO: 3024826 - DNA, 20 bp, Homo sapiens
gtacagttatctaagttaat

SEQ ID NO: 3024827 - DNA, 17 bp, Homo sapiens
gtacagttcataaattt

SEQ ID NO: 3024828 - DNA, 17 bp, Homo sapiens
gtacagttgcaggagcg

SEQ ID NO: 3024829 - DNA, 15 bp, Homo sapiens
gtacagtttaacaga

SEQ ID NO: 3024830 - DNA, 21 bp, Homo sapiens
gtacagttttgtggactgagc

SEQ ID NO: 3024831 - DNA, 16 bp, Homo sapiens
gtacataattgattaa

SEQ ID NO: 3024832 - DNA, 17 bp, Homo sapiens
gtacatcccatgtaaca

SEQ ID NO: 3024833 - DNA, 11 bp, Homo sapiens
gtacatgaaat

SEQ ID NO: 3024834 - DNA, 19 bp, Homo sapiens
gtacatgaaatttttgtaa

SEQ ID NO: 3024835 - DNA, 23 bp, Homo sapiens
gtacatttttaaattcttactct

SEQ ID NO: 3024836 - DNA, 23 bp, Homo sapiens
gtaccaagccaccgcagctgctg

SEQ ID NO: 3024837 - DNA, 19 bp, Homo sapiens
gtaccacaccctgcctgct

SEQ ID NO: 3024838 - DNA, 16 bp, Homo sapiens
gtaccagataaaatta

SEQ ID NO: 3024839 - DNA, 12 bp, Homo sapiens
gtaccagccact

SEQ ID NO: 3024840 - DNA, 16 bp, Homo sapiens
gtaccagcccagatgt

SEQ ID NO: 3024841 - DNA, 15 bp, Homo sapiens
gtaccaggcacatgg

SEQ ID NO: 3024842 - DNA, 16 bp, Homo sapiens
gtaccaggcacatggc

SEQ ID NO: 3024843 - DNA, 17 bp, Homo sapiens
gtaccaggcacatggct

SEQ ID NO: 3024844 - DNA, 18 bp, Homo sapiens
gtaccaggcacatggctg

SEQ ID NO: 3024845 - DNA, 19 bp, Homo sapiens
gtaccagtgaatttttgca

SEQ ID NO: 3024846 - DNA, 21 bp, Homo sapiens
gtaccagtgaatttttgcaat

SEQ ID NO: 3024847 - DNA, 22 bp, Homo sapiens
gtaccagtgaatttttgcaata

SEQ ID NO: 3024848 - DNA, 22 bp, Homo sapiens
gtaccatctactcttttgaagt

SEQ ID NO: 3024849 - DNA, 22 bp, Homo sapiens
gtacccaatagctgcccatttc

SEQ ID NO: 3024850 - DNA, 17 bp, Homo sapiens
gtaccccctttcccttc

SEQ ID NO: 3024851 - DNA, 22 bp, Homo sapiens
gtacccctaaaatcccaccaga

SEQ ID NO: 3024852 - DNA, 22 bp, Homo sapiens
gtaccctttaagatatccatct

SEQ ID NO: 3024853 - DNA, 14 bp, Homo sapiens
gtacctaaagcaat

SEQ ID NO: 3024854 - DNA, 23 bp, Homo sapiens
gtacctaagactaatgctttctg

SEQ ID NO: 3024855 - DNA, 13 bp, Homo sapiens
gtacctcatgagg

SEQ ID NO: 3024856 - DNA, 14 bp, Homo sapiens
gtacctgaaaagta

SEQ ID NO: 3024857 - DNA, 23 bp, Homo sapiens
gtacctgaaaagtaacttggctt

SEQ ID NO: 3024858 - DNA, 17 bp, Homo sapiens
gtacctgcaagcagaac

SEQ ID NO: 3024859 - DNA, 12 bp, Homo sapiens
gtacctgtgcct

SEQ ID NO: 3024860 - DNA, 19 bp, Homo sapiens
gtacctgttccttagacct

SEQ ID NO: 3024861 - DNA, 12 bp, Homo sapiens
gtaccttcccac

SEQ ID NO: 3024862 - DNA, 13 bp, Homo sapiens
gtaccttgcttct

SEQ ID NO: 3024863 - DNA, 13 bp, Homo sapiens
gtaccttttaaca

SEQ ID NO: 3024864 - DNA, 22 bp, Homo sapiens
gtaccttttttgttttttcaaa

SEQ ID NO: 3024865 - DNA, 14 bp, Homo sapiens
gtacgcacagacag

SEQ ID NO: 3024866 - DNA, 23 bp, Homo sapiens
gtacgctagagcatgctgcctga

SEQ ID NO: 3024867 - DNA, 20 bp, Homo sapiens
gtacgtcccagcggcctcag

SEQ ID NO: 3024868 - DNA, 15 bp, Homo sapiens
gtactacttgtttca

SEQ ID NO: 3024869 - DNA, 17 bp, Homo sapiens
gtactagttacacatct

SEQ ID NO: 3024870 - DNA, 15 bp, Homo sapiens
gtactcaaatgtagc

SEQ ID NO: 3024871 - DNA, 16 bp, Homo sapiens
gtactcacttttcact

SEQ ID NO: 3024872 - DNA, 17 bp, Homo sapiens
gtactcacttttcactt

SEQ ID NO: 3024873 - DNA, 11 bp, Homo sapiens
gtactccagcc

SEQ ID NO: 3024874 - DNA, 13 bp, Homo sapiens
gtactccagcctg

SEQ ID NO: 3024875 - DNA, 14 bp, Homo sapiens
gtactccagcctgg

SEQ ID NO: 3024876 - DNA, 16 bp, Homo sapiens
gtactccctctcagga

SEQ ID NO: 3024877 - DNA, 15 bp, Homo sapiens
gtactctaacttaag

SEQ ID NO: 3024878 - DNA, 17 bp, Homo sapiens
gtactgattgagaagtt

SEQ ID NO: 3024879 - DNA, 15 bp, Homo sapiens
gtactggtaattgta

SEQ ID NO: 3024880 - DNA, 19 bp, Homo sapiens
gtactggtaattgtacaat

SEQ ID NO: 3024881 - DNA, 16 bp, Homo sapiens
gtactggtcccttcct

SEQ ID NO: 3024882 - DNA, 16 bp, Homo sapiens
gtactgtaagaataat

SEQ ID NO: 3024883 - DNA, 16 bp, Homo sapiens
gtactgtgggcaattt

SEQ ID NO: 3024884 - DNA, 20 bp, Homo sapiens
gtactgtgggcaatttagaa

SEQ ID NO: 3024885 - DNA, 15 bp, Homo sapiens
gtactgtttaatgtt

SEQ ID NO: 3024886 - DNA, 14 bp, Homo sapiens
gtacttgtcaaaga

SEQ ID NO: 3024887 - DNA, 19 bp, Homo sapiens
gtactttatttttctgata

SEQ ID NO: 3024888 - DNA, 14 bp, Homo sapiens
gtactttggaggcc

SEQ ID NO: 3024889 - DNA, 20 bp, Homo sapiens
gtactttgtcccgtggcatt

SEQ ID NO: 3024890 - DNA, 12 bp, Homo sapiens
gtactttgtttt

SEQ ID NO: 3024891 - DNA, 23 bp, Homo sapiens
gtactttgtttttccatgtgttt

SEQ ID NO: 3024892 - DNA, 16 bp, Homo sapiens
gtacttttcattctct

SEQ ID NO: 3024893 - DNA, 18 bp, Homo sapiens
gtacttttcattctcttt

SEQ ID NO: 3024894 - DNA, 20 bp, Homo sapiens
gtacttttcattctctttta

SEQ ID NO: 3024895 - DNA, 22 bp, Homo sapiens
gtacttttcattctcttttaat

SEQ ID NO: 3024896 - DNA, 21 bp, Homo sapiens
gtacttttttaaatattttct

SEQ ID NO: 3024897 - DNA, 20 bp, Homo sapiens
gtagaaaaaaaaacagctct

SEQ ID NO: 3024898 - DNA, 14 bp, Homo sapiens
gtagaaaactccag

SEQ ID NO: 3024899 - DNA, 19 bp, Homo sapiens
gtagaaaatgcaccaaata

SEQ ID NO: 3024900 - DNA, 15 bp, Homo sapiens
gtagaaactgcaggg

SEQ ID NO: 3024901 - DNA, 19 bp, Homo sapiens
gtagaaactgcagggaaaa

SEQ ID NO: 3024902 - DNA, 14 bp, Homo sapiens
gtagaaatgatgat

SEQ ID NO: 3024903 - DNA, 15 bp, Homo sapiens
gtagaaattcttaat

SEQ ID NO: 3024904 - DNA, 11 bp, Homo sapiens
gtagaagccac

SEQ ID NO: 3024905 - DNA, 15 bp, Homo sapiens
gtagaagccaccctt

SEQ ID NO: 3024906 - DNA, 17 bp, Homo sapiens
gtagaagccacccttcc

SEQ ID NO: 3024907 - DNA, 23 bp, Homo sapiens
gtagaagccacccttccctgcct

SEQ ID NO: 3024908 - DNA, 19 bp, Homo sapiens
gtagaatagcctgtggcct

SEQ ID NO: 3024909 - DNA, 19 bp, Homo sapiens
gtagaatgtaaagcttgtc

SEQ ID NO: 3024910 - DNA, 21 bp, Homo sapiens
gtagaatgtaaagcttgtctg

SEQ ID NO: 3024911 - DNA, 17 bp, Homo sapiens
gtagaatgtattgtacc

SEQ ID NO: 3024912 - DNA, 18 bp, Homo sapiens
gtagaatgtattgtacct

SEQ ID NO: 3024913 - DNA, 19 bp, Homo sapiens
gtagaatgtattgtacctt

SEQ ID NO: 3024914 - DNA, 18 bp, Homo sapiens
gtagacacgctcttctat

SEQ ID NO: 3024915 - DNA, 14 bp, Homo sapiens
gtagacattgtaaa

SEQ ID NO: 3024916 - DNA, 22 bp, Homo sapiens
gtagagacttccgtcacccttg

SEQ ID NO: 3024917 - DNA, 17 bp, Homo sapiens
gtagagcaaaggagaca

SEQ ID NO: 3024918 - DNA, 13 bp, Homo sapiens
gtagagcacagcc

SEQ ID NO: 3024919 - DNA, 14 bp, Homo sapiens
gtagagccaattag

SEQ ID NO: 3024920 - DNA, 22 bp, Homo sapiens
gtagatctgctttctgttcatc

SEQ ID NO: 3024921 - DNA, 14 bp, Homo sapiens
gtagatgcagaaaa

SEQ ID NO: 3024922 - DNA, 14 bp, Homo sapiens
gtagattaaaaatt

SEQ ID NO: 3024923 - DNA, 18 bp, Homo sapiens
gtagattcgctgtcccct

SEQ ID NO: 3024924 - DNA, 23 bp, Homo sapiens
gtagattcgctgtcccctcagcg

SEQ ID NO: 3024925 - DNA, 13 bp, Homo sapiens
gtagattctgtgg

SEQ ID NO: 3024926 - DNA, 19 bp, Homo sapiens
gtagattcttacaaggccc

SEQ ID NO: 3024927 - DNA, 23 bp, Homo sapiens
gtagcacaagttatttaaatctg

SEQ ID NO: 3024928 - DNA, 19 bp, Homo sapiens
gtagcaccaaataaattac

SEQ ID NO: 3024929 - DNA, 18 bp, Homo sapiens
gtagcagcaaatagcaaa

SEQ ID NO: 3024930 - DNA, 13 bp, Homo sapiens
gtagccacaccag

SEQ ID NO: 3024931 - DNA, 20 bp, Homo sapiens
gtagccacaggagccctgct

SEQ ID NO: 3024932 - DNA, 22 bp, Homo sapiens
gtagccaggtccccctgcagct

SEQ ID NO: 3024933 - DNA, 15 bp, Homo sapiens
gtagcccaggctgga

SEQ ID NO: 3024934 - DNA, 17 bp, Homo sapiens
gtagcccatccttccct

SEQ ID NO: 3024935 - DNA, 15 bp, Homo sapiens
gtagccccagtgaca

SEQ ID NO: 3024936 - DNA, 16 bp, Homo sapiens
gtagccccctggcctc

SEQ ID NO: 3024937 - DNA, 17 bp, Homo sapiens
gtagccccctggcctct

SEQ ID NO: 3024938 - DNA, 15 bp, Homo sapiens
gtagccctcccactt

SEQ ID NO: 3024939 - DNA, 21 bp, Homo sapiens
gtagcctcgccgtctgtgaat

SEQ ID NO: 3024940 - DNA, 22 bp, Homo sapiens
gtagcctggatattattcttgt

SEQ ID NO: 3024941 - DNA, 20 bp, Homo sapiens
gtagctccagcgatggtgct

SEQ ID NO: 3024942 - DNA, 17 bp, Homo sapiens
gtagctgggatgacagg

SEQ ID NO: 3024943 - DNA, 18 bp, Homo sapiens
gtagctgggatgacaggc

SEQ ID NO: 3024944 - DNA, 20 bp, Homo sapiens
gtagctgtcagatgtcacat

SEQ ID NO: 3024945 - DNA, 23 bp, Homo sapiens
gtagctgtccaaaataataacat

SEQ ID NO: 3024946 - DNA, 21 bp, Homo sapiens
gtccccccccaggccctccca

SEQ ID NO: 3024947 - DNA, 22 bp, Homo sapiens
gtcccccgactgcctgtctcca

SEQ ID NO: 3024948 - DNA, 13 bp, Homo sapiens
gtccccctctgtc

SEQ ID NO: 3024949 - DNA, 19 bp, Homo sapiens
gtccccctctgtccaggca

SEQ ID NO: 3024950 - DNA, 21 bp, Homo sapiens
gtccccctctgtccaggcact

SEQ ID NO: 3024951 - DNA, 14 bp, Homo sapiens
gtccccctgcagct

SEQ ID NO: 3024952 - DNA, 13 bp, Homo sapiens
gtccccgcagccc

SEQ ID NO: 3024953 - DNA, 14 bp, Homo sapiens
gtccccgccctctc

SEQ ID NO: 3024954 - DNA, 18 bp, Homo sapiens
gtccccgccctctctcat

SEQ ID NO: 3024955 - DNA, 14 bp, Homo sapiens
gtccccgccttccc

SEQ ID NO: 3024956 - DNA, 17 bp, Homo sapiens
gtccccgccttccctca

SEQ ID NO: 3024957 - DNA, 15 bp, Homo sapiens
gtccccgctgctgtg

SEQ ID NO: 3024958 - DNA, 16 bp, Homo sapiens
gtccccggggcccagg

SEQ ID NO: 3024959 - DNA, 12 bp, Homo sapiens
gtcccctccccc

SEQ ID NO: 3024960 - DNA, 24 bp, Homo sapiens
gtcccctgccaccgactgcccagc

SEQ ID NO: 3024961 - DNA, 21 bp, Homo sapiens
gtcccctggagtgtgtcagag

SEQ ID NO: 3024962 - DNA, 15 bp, Homo sapiens
gtcccctggggctgg

SEQ ID NO: 3024963 - DNA, 22 bp, Homo sapiens
gtccccttactgagcgcaagcc

SEQ ID NO: 3024964 - DNA, 23 bp, Homo sapiens
gtcccgagcttagattctgtatg

SEQ ID NO: 3024965 - DNA, 22 bp, Homo sapiens
gtcccgggacacctaggctagg

SEQ ID NO: 3024966 - DNA, 14 bp, Homo sapiens
gtccctacaggagg

SEQ ID NO: 3024967 - DNA, 18 bp, Homo sapiens
gtccctagcagcccaccc

SEQ ID NO: 3024968 - DNA, 21 bp, Homo sapiens
gtccctagcagcccaccctgc

SEQ ID NO: 3024969 - DNA, 22 bp, Homo sapiens
gtccctatgtatttgcagttca

SEQ ID NO: 3024970 - DNA, 22 bp, Homo sapiens
gtccctcctggtgtcaccccag

SEQ ID NO: 3024971 - DNA, 23 bp, Homo sapiens
gtccctcctggtgtcaccccaga

SEQ ID NO: 3024972 - DNA, 16 bp, Homo sapiens
gtccctctcagtgcct

SEQ ID NO: 3024973 - DNA, 20 bp, Homo sapiens
gtccctctcagtgccttctc

SEQ ID NO: 3024974 - DNA, 23 bp, Homo sapiens
gtccctctcagtgccttctctca

SEQ ID NO: 3024975 - DNA, 20 bp, Homo sapiens
gtccctctgccccatcctcc

SEQ ID NO: 3024976 - DNA, 13 bp, Homo sapiens
gtccctctgtcca

SEQ ID NO: 3024977 - DNA, 23 bp, Homo sapiens
gtccctgcctggaccagcctctc

SEQ ID NO: 3024978 - DNA, 12 bp, Homo sapiens
gtccctgccttc

SEQ ID NO: 3024979 - DNA, 13 bp, Homo sapiens
gtccctgccttca

SEQ ID NO: 3024980 - DNA, 20 bp, Homo sapiens
gtccctgccttcactgtgct

SEQ ID NO: 3024981 - DNA, 22 bp, Homo sapiens
gtccctgggagcaagttgcagt

SEQ ID NO: 3024982 - DNA, 12 bp, Homo sapiens
gtccctggggca

SEQ ID NO: 3024983 - DNA, 16 bp, Homo sapiens
gtccctggggcactcc

SEQ ID NO: 3024984 - DNA, 19 bp, Homo sapiens
gtccctggggcactccccc

SEQ ID NO: 3024985 - DNA, 20 bp, Homo sapiens
gtccctggggcactccccca

SEQ ID NO: 3024986 - DNA, 22 bp, Homo sapiens
gtccctggggcactcccccagg

SEQ ID NO: 3024987 - DNA, 22 bp, Homo sapiens
gtccctggggctagggggagcc

SEQ ID NO: 3024988 - DNA, 12 bp, Homo sapiens
gtccctggtcct

SEQ ID NO: 3024989 - DNA, 14 bp, Homo sapiens
gtccctggtccttc

SEQ ID NO: 3024990 - DNA, 20 bp, Homo sapiens
gtccctggtccttcactggc

SEQ ID NO: 3024991 - DNA, 14 bp, Homo sapiens
gtccctgtgttctg

SEQ ID NO: 3024992 - DNA, 14 bp, Homo sapiens
gtcccttgagacct

SEQ ID NO: 3024993 - DNA, 17 bp, Homo sapiens
gtcccttgagacctcag

SEQ ID NO: 3024994 - DNA, 19 bp, Homo sapiens
gtccctttttgcaggggac

SEQ ID NO: 3024995 - DNA, 16 bp, Homo sapiens
gtccgcataagaaaaa

SEQ ID NO: 3024996 - DNA, 18 bp, Homo sapiens
gtccgcctgcgcctccat

SEQ ID NO: 3024997 - DNA, 17 bp, Homo sapiens
gtccggtgtccttttca

SEQ ID NO: 3024998 - DNA, 14 bp, Homo sapiens
gtccggtgttctaa

SEQ ID NO: 3024999 - DNA, 16 bp, Homo sapiens
gtccggtgttctaaga

SEQ ID NO: 3025000 - DNA, 14 bp, Homo sapiens
gtccgtccagagcc

SEQ ID NO: 3025001 - DNA, 15 bp, Homo sapiens
gtccgtccagagccg

SEQ ID NO: 3025002 - DNA, 15 bp, Homo sapiens
gtccgtgctgacagc

SEQ ID NO: 3025003 - DNA, 22 bp, Homo sapiens
gtccgtgggttgctaactgaac

SEQ ID NO: 3025004 - DNA, 19 bp, Homo sapiens
gtcctaaaagttctcaatg

SEQ ID NO: 3025005 - DNA, 18 bp, Homo sapiens
gtcctaacttcctgtgcc

SEQ ID NO: 3025006 - DNA, 20 bp, Homo sapiens
gtcctaagtgtcaagtcctg

SEQ ID NO: 3025007 - DNA, 19 bp, Homo sapiens
gtcctaattcttctgtcct

SEQ ID NO: 3025008 - DNA, 14 bp, Homo sapiens
gtcctacccatccc

SEQ ID NO: 3025009 - DNA, 18 bp, Homo sapiens
gtcctacccatccccgca

SEQ ID NO: 3025010 - DNA, 20 bp, Homo sapiens
gtcctagcccagtgcttctc

SEQ ID NO: 3025011 - DNA, 22 bp, Homo sapiens
gtcctagtcgggcagggcccct

SEQ ID NO: 3025012 - DNA, 19 bp, Homo sapiens
gtcctatccaaaggaatca

SEQ ID NO: 3025013 - DNA, 19 bp, Homo sapiens
gtcctatgaatgctttgca

SEQ ID NO: 3025014 - DNA, 22 bp, Homo sapiens
gtcctattgtgactcttctaaa

SEQ ID NO: 3025015 - DNA, 22 bp, Homo sapiens
gtcctcacttctagatctcagc

SEQ ID NO: 3025016 - DNA, 12 bp, Homo sapiens
gtcctcagcctt

SEQ ID NO: 3025017 - DNA, 21 bp, Homo sapiens
gtcctcagccttgccagagat

SEQ ID NO: 3025018 - DNA, 17 bp, Homo sapiens
gtcctccccctgccagt

SEQ ID NO: 3025019 - DNA, 21 bp, Homo sapiens
gtcctcctcggatcaccgaga

SEQ ID NO: 3025020 - DNA, 21 bp, Homo sapiens
gtcctcctctacctctctcct

SEQ ID NO: 3025021 - DNA, 21 bp, Homo sapiens
gtcctcgaattttatctgtgg

SEQ ID NO: 3025022 - DNA, 13 bp, Homo sapiens
gtcctcgatggga

SEQ ID NO: 3025023 - DNA, 17 bp, Homo sapiens
gtcctcggcccatctgt

SEQ ID NO: 3025024 - DNA, 13 bp, Homo sapiens
gtcctctctctgt

SEQ ID NO: 3025025 - DNA, 13 bp, Homo sapiens
gtcctctgcctcc

SEQ ID NO: 3025026 - DNA, 14 bp, Homo sapiens
gtcctctgtagtat

SEQ ID NO: 3025027 - DNA, 18 bp, Homo sapiens
gtcctctgtcagtcacag

SEQ ID NO: 3025028 - DNA, 20 bp, Homo sapiens
gtcctctgtcagtcacagcc

SEQ ID NO: 3025029 - DNA, 20 bp, Homo sapiens
gtcctcttccctctctgcag

SEQ ID NO: 3025030 - DNA, 12 bp, Homo sapiens
gtcctgaagctg

SEQ ID NO: 3025031 - DNA, 17 bp, Homo sapiens
gtcctgaatggctttgt

SEQ ID NO: 3025032 - DNA, 18 bp, Homo sapiens
gtcctgaatggctttgtc

SEQ ID NO: 3025033 - DNA, 15 bp, Homo sapiens
gtcctgactgggctg

SEQ ID NO: 3025034 - DNA, 15 bp, Homo sapiens
gtcctgatcagagcc

SEQ ID NO: 3025035 - DNA, 21 bp, Homo sapiens
gtcctgcacagattcccaggc

SEQ ID NO: 3025036 - DNA, 22 bp, Homo sapiens
gtcctgcacagattcccaggcc

SEQ ID NO: 3025037 - DNA, 12 bp, Homo sapiens
gtcctgccctgc

SEQ ID NO: 3025038 - DNA, 18 bp, Homo sapiens
gtcctgccggagaggaag

SEQ ID NO: 3025039 - DNA, 16 bp, Homo sapiens
gtcctgctccgctgcc

SEQ ID NO: 3025040 - DNA, 17 bp, Homo sapiens
gtcctgctccgctgcct

SEQ ID NO: 3025041 - DNA, 13 bp, Homo sapiens
gtcctgctggcct

SEQ ID NO: 3025042 - DNA, 22 bp, Homo sapiens
gtcctggactcctgccaccagc

SEQ ID NO: 3025043 - DNA, 16 bp, Homo sapiens
gtcctggccatcccac

SEQ ID NO: 3025044 - DNA, 17 bp, Homo sapiens
gtcctggccatcccaca

SEQ ID NO: 3025045 - DNA, 15 bp, Homo sapiens
gtcctggctgcactc

SEQ ID NO: 3025046 - DNA, 12 bp, Homo sapiens
gtcctgggagga

SEQ ID NO: 3025047 - DNA, 23 bp, Homo sapiens
gtcctgggaggatcctgagctgc

SEQ ID NO: 3025048 - DNA, 14 bp, Homo sapiens
gtcctgggaggctg

SEQ ID NO: 3025049 - DNA, 20 bp, Homo sapiens
gtcctgggaggctgcagcca

SEQ ID NO: 3025050 - DNA, 22 bp, Homo sapiens
gtcctgggaggctgcagccagg

SEQ ID NO: 3025051 - DNA, 23 bp, Homo sapiens
gtcctgggaggctgcagccaggc

SEQ ID NO: 3025052 - DNA, 13 bp, Homo sapiens
gtcctgggcaggt

SEQ ID NO: 3025053 - DNA, 22 bp, Homo sapiens
gtcctgggcaggtgggagctga

SEQ ID NO: 3025054 - DNA, 13 bp, Homo sapiens
gtcctgggcctgc

SEQ ID NO: 3025055 - DNA, 14 bp, Homo sapiens
gtcctgggcctgca

SEQ ID NO: 3025056 - DNA, 16 bp, Homo sapiens
gtcctggtcctggctg

SEQ ID NO: 3025057 - DNA, 19 bp, Homo sapiens
gtcctggtctgctcaggaa

SEQ ID NO: 3025058 - DNA, 16 bp, Homo sapiens
gtcctggtggctgggc

SEQ ID NO: 3025059 - DNA, 18 bp, Homo sapiens
gtcctgtccacacccagc

SEQ ID NO: 3025060 - DNA, 15 bp, Homo sapiens
gtcctgttaggccaa

SEQ ID NO: 3025061 - DNA, 22 bp, Homo sapiens
gtcctgttcagaaaggggctct

SEQ ID NO: 3025062 - DNA, 15 bp, Homo sapiens
gtcctgttttctaaa

SEQ ID NO: 3025063 - DNA, 14 bp, Homo sapiens
gtccttactcagag

SEQ ID NO: 3025064 - DNA, 22 bp, Homo sapiens
gtccttactcagagctgcgggc

SEQ ID NO: 3025065 - DNA, 21 bp, Homo sapiens
gtccttcacctcactgaaaac

SEQ ID NO: 3025066 - DNA, 17 bp, Homo sapiens
gtccttgcacctgcatc

SEQ ID NO: 3025067 - DNA, 17 bp, Homo sapiens
gtccttggcaactttct

SEQ ID NO: 3025068 - DNA, 20 bp, Homo sapiens
gtccttggcaggctgatttc

SEQ ID NO: 3025069 - DNA, 13 bp, Homo sapiens
gtccttggctgta

SEQ ID NO: 3025070 - DNA, 21 bp, Homo sapiens
gtccttggctgtatccatgta

SEQ ID NO: 3025071 - DNA, 13 bp, Homo sapiens
gtccttgggcctg

SEQ ID NO: 3025072 - DNA, 18 bp, Homo sapiens
gtccttgggcctggccag

SEQ ID NO: 3025073 - DNA, 24 bp, Homo sapiens
gtccttgggcctggccagtcttcc

SEQ ID NO: 3025074 - DNA, 14 bp, Homo sapiens
gtcctttagtacct

SEQ ID NO: 3025075 - DNA, 15 bp, Homo sapiens
gtcctttccatctgt

SEQ ID NO: 3025076 - DNA, 16 bp, Homo sapiens
gtcgaaagctctagaa

SEQ ID NO: 3025077 - DNA, 23 bp, Homo sapiens
gtcgaaaggtgcagctgcgttct

SEQ ID NO: 3025078 - DNA, 22 bp, Homo sapiens
gtgatgttctaaggctctgaga

SEQ ID NO: 3025079 - DNA, 15 bp, Homo sapiens
gtgattaactgtgaa

SEQ ID NO: 3025080 - DNA, 16 bp, Homo sapiens
gtgattactgcaatca

SEQ ID NO: 3025081 - DNA, 22 bp, Homo sapiens
gtgattatggacatcgatatga

SEQ ID NO: 3025082 - DNA, 17 bp, Homo sapiens
gtgattgacagctttgc

SEQ ID NO: 3025083 - DNA, 14 bp, Homo sapiens
gtgattgtggaatg

SEQ ID NO: 3025084 - DNA, 19 bp, Homo sapiens
gtgattgtggaatggagat

SEQ ID NO: 3025085 - DNA, 20 bp, Homo sapiens
gtgatttaatagtgttaatc

SEQ ID NO: 3025086 - DNA, 14 bp, Homo sapiens
gtgattttaactct

SEQ ID NO: 3025087 - DNA, 19 bp, Homo sapiens
gtgattttatttttgcaaa

SEQ ID NO: 3025088 - DNA, 23 bp, Homo sapiens
gtgattttatttttgcaaaataa

SEQ ID NO: 3025089 - DNA, 23 bp, Homo sapiens
gtgcaacctcttggcctgatcag

SEQ ID NO: 3025090 - DNA, 18 bp, Homo sapiens
gtgcaactcttgtattgc

SEQ ID NO: 3025091 - DNA, 13 bp, Homo sapiens
gtgcaactgacac

SEQ ID NO: 3025092 - DNA, 19 bp, Homo sapiens
gtgcaataaatctgaccca

SEQ ID NO: 3025093 - DNA, 23 bp, Homo sapiens
gtgcaataaatctgacccagtgc

SEQ ID NO: 3025094 - DNA, 17 bp, Homo sapiens
gtgcaatcacagctcac

SEQ ID NO: 3025095 - DNA, 17 bp, Homo sapiens
gtgcaattaactctgga

SEQ ID NO: 3025096 - DNA, 21 bp, Homo sapiens
gtgcacatccgcgtgtgcctg

SEQ ID NO: 3025097 - DNA, 18 bp, Homo sapiens
gtgcactcatacatatgt

SEQ ID NO: 3025098 - DNA, 13 bp, Homo sapiens
gtgcactcgccat

SEQ ID NO: 3025099 - DNA, 17 bp, Homo sapiens
gtgcactgcattagaaa

SEQ ID NO: 3025100 - DNA, 15 bp, Homo sapiens
gtgcagaacacctgg

SEQ ID NO: 3025101 - DNA, 20 bp, Homo sapiens
gtgcagaccttactcagggg

SEQ ID NO: 3025102 - DNA, 17 bp, Homo sapiens
gtgcagactcaagactt

SEQ ID NO: 3025103 - DNA, 15 bp, Homo sapiens
gtgcagctaacatga

SEQ ID NO: 3025104 - DNA, 15 bp, Homo sapiens
gtgcagctcctcagc

SEQ ID NO: 3025105 - DNA, 17 bp, Homo sapiens
gtgcaggctggccagcc

SEQ ID NO: 3025106 - DNA, 18 bp, Homo sapiens
gtgcaggctggccagccg

SEQ ID NO: 3025107 - DNA, 18 bp, Homo sapiens
gtgcaggctgtctcattt

SEQ ID NO: 3025108 - DNA, 12 bp, Homo sapiens
gtgcagggctgg

SEQ ID NO: 3025109 - DNA, 21 bp, Homo sapiens
gtgcagggctggtttgttctg

SEQ ID NO: 3025110 - DNA, 20 bp, Homo sapiens
gtgcaggggatggggtgggg

SEQ ID NO: 3025111 - DNA, 22 bp, Homo sapiens
gtgcaggtggggtgatggccag

SEQ ID NO: 3025112 - DNA, 22 bp, Homo sapiens
gtgcagtatcatgccctgtgca

SEQ ID NO: 3025113 - DNA, 16 bp, Homo sapiens
gtgcagtcctgatcag

SEQ ID NO: 3025114 - DNA, 15 bp, Homo sapiens
gtgcatagcgtcctg

SEQ ID NO: 3025115 - DNA, 19 bp, Homo sapiens
gtgcatagcgtcctgccct

SEQ ID NO: 3025116 - DNA, 13 bp, Homo sapiens
gtgcatattgtac

SEQ ID NO: 3025117 - DNA, 18 bp, Homo sapiens
gtgcatattgtacacttt

SEQ ID NO: 3025118 - DNA, 19 bp, Homo sapiens
gtgcatgcgcctactcgct

SEQ ID NO: 3025119 - DNA, 16 bp, Homo sapiens
gtgcatgctctctgca

SEQ ID NO: 3025120 - DNA, 18 bp, Homo sapiens
gtgcatgctctctgcagc

SEQ ID NO: 3025121 - DNA, 18 bp, Homo sapiens
gtgcatggaagttggggc

SEQ ID NO: 3025122 - DNA, 15 bp, Homo sapiens
gtgcatggtggccag

SEQ ID NO: 3025123 - DNA, 16 bp, Homo sapiens
gtgcatgtatgtcttg

SEQ ID NO: 3025124 - DNA, 22 bp, Homo sapiens
gtgcatgtgcgtggaagtgttc

SEQ ID NO: 3025125 - DNA, 12 bp, Homo sapiens
gtgcattctcct

SEQ ID NO: 3025126 - DNA, 20 bp, Homo sapiens
gtgcattttgtttctgtata

SEQ ID NO: 3025127 - DNA, 11 bp, Homo sapiens
gtgccaaagaa

SEQ ID NO: 3025128 - DNA, 18 bp, Homo sapiens
gtgccaaatagccccaga

SEQ ID NO: 3025129 - DNA, 20 bp, Homo sapiens
gtgccaaatagccccagact

SEQ ID NO: 3025130 - DNA, 21 bp, Homo sapiens
gtgccaaatagccccagactg

SEQ ID NO: 3025131 - DNA, 20 bp, Homo sapiens
gtgccaacaatcctagtgct

SEQ ID NO: 3025132 - DNA, 15 bp, Homo sapiens
gtgccaactgtggct

SEQ ID NO: 3025133 - DNA, 18 bp, Homo sapiens
gtgccaatgttgtgtgtt

SEQ ID NO: 3025134 - DNA, 19 bp, Homo sapiens
gtgccacagagtgtagcca

SEQ ID NO: 3025135 - DNA, 13 bp, Homo sapiens
gtgccacccccag

SEQ ID NO: 3025136 - DNA, 15 bp, Homo sapiens
gtgccacccccagcc

SEQ ID NO: 3025137 - DNA, 16 bp, Homo sapiens
gtgccactttccacca

SEQ ID NO: 3025138 - DNA, 15 bp, Homo sapiens
gtgccagaaggaagg

SEQ ID NO: 3025139 - DNA, 16 bp, Homo sapiens
gtgccagaaggaaggt

SEQ ID NO: 3025140 - DNA, 23 bp, Homo sapiens
gtgccagcacccagtcctctgcc

SEQ ID NO: 3025141 - DNA, 11 bp, Homo sapiens
gtgccagcagc

SEQ ID NO: 3025142 - DNA, 15 bp, Homo sapiens
gtgccagcagcctcg

SEQ ID NO: 3025143 - DNA, 13 bp, Homo sapiens
gtgccagcccctg

SEQ ID NO: 3025144 - DNA, 18 bp, Homo sapiens
gtgccagcccctgctggc

SEQ ID NO: 3025145 - DNA, 18 bp, Homo sapiens
gtgccaggaaactcttgc

SEQ ID NO: 3025146 - DNA, 17 bp, Homo sapiens
gtgccaggaggcggcag

SEQ ID NO: 3025147 - DNA, 12 bp, Homo sapiens
gtgccaggcccg

SEQ ID NO: 3025148 - DNA, 17 bp, Homo sapiens
gtgccaggcccggggct

SEQ ID NO: 3025149 - DNA, 19 bp, Homo sapiens
gtgccaggcccggggctgg

SEQ ID NO: 3025150 - DNA, 14 bp, Homo sapiens
gtgccaggcttgcc

SEQ ID NO: 3025151 - DNA, 18 bp, Homo sapiens
gtgccaggcttgcctggg

SEQ ID NO: 3025152 - DNA, 17 bp, Homo sapiens
gtgccatagtcacatgg

SEQ ID NO: 3025153 - DNA, 16 bp, Homo sapiens
gtgccatgtctttact

SEQ ID NO: 3025154 - DNA, 20 bp, Homo sapiens
gtgccattgtactccagcct

SEQ ID NO: 3025155 - DNA, 15 bp, Homo sapiens
gtgcccaccatgcac

SEQ ID NO: 3025156 - DNA, 16 bp, Homo sapiens
gtgcccagaataagtt

SEQ ID NO: 3025157 - DNA, 21 bp, Homo sapiens
gtgcccagctatacctgtgcc

SEQ ID NO: 3025158 - DNA, 22 bp, Homo sapiens
gtgcccagctatacctgtgcct

SEQ ID NO: 3025159 - DNA, 20 bp, Homo sapiens
gtgcccatcatctctgcctt

SEQ ID NO: 3025160 - DNA, 23 bp, Homo sapiens
gtgcccatcatctctgcctttga

SEQ ID NO: 3025161 - DNA, 13 bp, Homo sapiens
gtgccccagactg

SEQ ID NO: 3025162 - DNA, 14 bp, Homo sapiens
gtgccccaggacca

SEQ ID NO: 3025163 - DNA, 15 bp, Homo sapiens
gtgccccaggaccag

SEQ ID NO: 3025164 - DNA, 15 bp, Homo sapiens
gtgcccccactgacc

SEQ ID NO: 3025165 - DNA, 19 bp, Homo sapiens
gtgcccccactgaccagaa

SEQ ID NO: 3025166 - DNA, 17 bp, Homo sapiens
gtgccccgcgggctttg

SEQ ID NO: 3025167 - DNA, 15 bp, Homo sapiens
gtgcccgtaatccca

SEQ ID NO: 3025168 - DNA, 18 bp, Homo sapiens
gtgccctgaaagggccct

SEQ ID NO: 3025169 - DNA, 23 bp, Homo sapiens
gtgccgcagtggggtcaagctga

SEQ ID NO: 3025170 - DNA, 21 bp, Homo sapiens
gtgccgcctgcactcctcagg

SEQ ID NO: 3025171 - DNA, 14 bp, Homo sapiens
gtgccgggccccca

SEQ ID NO: 3025172 - DNA, 17 bp, Homo sapiens
gtgcctccctctcctcg

SEQ ID NO: 3025173 - DNA, 14 bp, Homo sapiens
gtgcctcccttccc

SEQ ID NO: 3025174 - DNA, 15 bp, Homo sapiens
gtgcctcccttccca

SEQ ID NO: 3025175 - DNA, 20 bp, Homo sapiens
gtgcctctgtcctagactcc

SEQ ID NO: 3025176 - DNA, 17 bp, Homo sapiens
gtgcctgagaatttaat

SEQ ID NO: 3025177 - DNA, 15 bp, Homo sapiens
gtgcctggcctggca

SEQ ID NO: 3025178 - DNA, 19 bp, Homo sapiens
gtgcctggcctggcacaca

SEQ ID NO: 3025179 - DNA, 15 bp, Homo sapiens
gtgcctgggcccctc

SEQ ID NO: 3025180 - DNA, 21 bp, Homo sapiens
gtgcctgggtggggctgctcc

SEQ ID NO: 3025181 - DNA, 23 bp, Homo sapiens
gtgcctgggtggggctgctcctc

SEQ ID NO: 3025182 - DNA, 23 bp, Homo sapiens
gtgcctgtaatctttttctccac

SEQ ID NO: 3025183 - DNA, 14 bp, Homo sapiens
gtgcctgtctgtcc

SEQ ID NO: 3025184 - DNA, 16 bp, Homo sapiens
gtgcctgtctgtccaa

SEQ ID NO: 3025185 - DNA, 20 bp, Homo sapiens
gtgcctgtctgttacactgg

SEQ ID NO: 3025186 - DNA, 15 bp, Homo sapiens
gtgcctgtgaggcag

SEQ ID NO: 3025187 - DNA, 14 bp, Homo sapiens
gtgccttacctcct

SEQ ID NO: 3025188 - DNA, 14 bp, Homo sapiens
gtgccttgcccaca

SEQ ID NO: 3025189 - DNA, 19 bp, Homo sapiens
gtgccttgcccacaggtgc

SEQ ID NO: 3025190 - DNA, 18 bp, Homo sapiens
gtgccttttgcagaagag

SEQ ID NO: 3025191 - DNA, 14 bp, Homo sapiens
gtgcgaagactgag

SEQ ID NO: 3025192 - DNA, 18 bp, Homo sapiens
gtgcgcatcttgcctcca

SEQ ID NO: 3025193 - DNA, 13 bp, Homo sapiens
gtgcgctgcctgg

SEQ ID NO: 3025194 - DNA, 15 bp, Homo sapiens
gtgcgctgcctggcc

SEQ ID NO: 3025195 - DNA, 21 bp, Homo sapiens
gtgcgctgggcacttccctgc

SEQ ID NO: 3025196 - DNA, 23 bp, Homo sapiens
gtgcgctgggcacttccctgctg

SEQ ID NO: 3025197 - DNA, 14 bp, Homo sapiens
gtgcggccaccacc

SEQ ID NO: 3025198 - DNA, 15 bp, Homo sapiens
gtgcggcgtggagac

SEQ ID NO: 3025199 - DNA, 15 bp, Homo sapiens
gtgcgtggaagtgtt

SEQ ID NO: 3025200 - DNA, 14 bp, Homo sapiens
gtgcgtgtgcgtgt

SEQ ID NO: 3025201 - DNA, 17 bp, Homo sapiens
gtgcgttcccttcagta

SEQ ID NO: 3025202 - DNA, 13 bp, Homo sapiens
gtgctaaaaatgg

SEQ ID NO: 3025203 - DNA, 18 bp, Homo sapiens
gtgctaaaaatgggactt

SEQ ID NO: 3025204 - DNA, 21 bp, Homo sapiens
gtgctaaaaatgggacttctt

SEQ ID NO: 3025205 - DNA, 22 bp, Homo sapiens
gtgctaaaaatgggacttcttt

SEQ ID NO: 3025206 - DNA, 17 bp, Homo sapiens
gtgctaaagccaaccag

SEQ ID NO: 3025207 - DNA, 20 bp, Homo sapiens
gtgctaaagccaaccagcct

SEQ ID NO: 3025208 - DNA, 17 bp, Homo sapiens
gtgctaaggttctaagg

SEQ ID NO: 3025209 - DNA, 16 bp, Homo sapiens
gtgctaatattttatt

SEQ ID NO: 3025210 - DNA, 20 bp, Homo sapiens
gtgttgttgtttttgataat

SEQ ID NO: 3025211 - DNA, 14 bp, Homo sapiens
gtgtttccatctca

SEQ ID NO: 3025212 - DNA, 19 bp, Homo sapiens
gtgtttctatgagtggaaa

SEQ ID NO: 3025213 - DNA, 17 bp, Homo sapiens
gtgtttctattgacttc

SEQ ID NO: 3025214 - DNA, 21 bp, Homo sapiens
gtgtttctccctctcactgtc

SEQ ID NO: 3025215 - DNA, 22 bp, Homo sapiens
gtgtttctccctctcactgtct

SEQ ID NO: 3025216 - DNA, 11 bp, Homo sapiens
gtgtttgtgtt

SEQ ID NO: 3025217 - DNA, 18 bp, Homo sapiens
gtgtttgttgctggcttg

SEQ ID NO: 3025218 - DNA, 11 bp, Homo sapiens
gtgttttgctt

SEQ ID NO: 3025219 - DNA, 14 bp, Homo sapiens
gtgttttgctttta

SEQ ID NO: 3025220 - DNA, 21 bp, Homo sapiens
gtgttttgtgaggtgaatgtc

SEQ ID NO: 3025221 - DNA, 21 bp, Homo sapiens
gtgtttttcttgtaaatgtgt

SEQ ID NO: 3025222 - DNA, 11 bp, Homo sapiens
gtgtttttgta

SEQ ID NO: 3025223 - DNA, 18 bp, Homo sapiens
gttaaaccatgtgactaa

SEQ ID NO: 3025224 - DNA, 21 bp, Homo sapiens
gttaaagatatttttattcaa

SEQ ID NO: 3025225 - DNA, 12 bp, Homo sapiens
gttaaaggcagt

SEQ ID NO: 3025226 - DNA, 17 bp, Homo sapiens
gttaaaggcagtccaga

SEQ ID NO: 3025227 - DNA, 20 bp, Homo sapiens
gttaaaggcagtccagagct

SEQ ID NO: 3025228 - DNA, 13 bp, Homo sapiens
gttaaatgtatca

SEQ ID NO: 3025229 - DNA, 18 bp, Homo sapiens
gttaacacaatgtgaatt

SEQ ID NO: 3025230 - DNA, 20 bp, Homo sapiens
gttaacacaatgtgaatttc

SEQ ID NO: 3025231 - DNA, 15 bp, Homo sapiens
gttaacacattttgt

SEQ ID NO: 3025232 - DNA, 16 bp, Homo sapiens
gttaacacattttgta

SEQ ID NO: 3025233 - DNA, 23 bp, Homo sapiens
gttaacagcgtgtcaactttcat

SEQ ID NO: 3025234 - DNA, 19 bp, Homo sapiens
gttaagacatgatttcctt

SEQ ID NO: 3025235 - DNA, 15 bp, Homo sapiens
gttaagacttgacag

SEQ ID NO: 3025236 - DNA, 16 bp, Homo sapiens
gttaagacttgacagt

SEQ ID NO: 3025237 - DNA, 23 bp, Homo sapiens
gttaataaaataattatgatcta

SEQ ID NO: 3025238 - DNA, 21 bp, Homo sapiens
gttaataagttgatgttttct

SEQ ID NO: 3025239 - DNA, 16 bp, Homo sapiens
gttaataataattatt

SEQ ID NO: 3025240 - DNA, 17 bp, Homo sapiens
gttaataataattatta

SEQ ID NO: 3025241 - DNA, 13 bp, Homo sapiens
gttaatcaaagat

SEQ ID NO: 3025242 - DNA, 12 bp, Homo sapiens
gttaatcaattt

SEQ ID NO: 3025243 - DNA, 13 bp, Homo sapiens
gttaatcaattta

SEQ ID NO: 3025244 - DNA, 14 bp, Homo sapiens
gttaatcaatttaa

SEQ ID NO: 3025245 - DNA, 21 bp, Homo sapiens
gttaatcaatttaaacccatt

SEQ ID NO: 3025246 - DNA, 21 bp, Homo sapiens
gttaatgaaggtgtgctacag

SEQ ID NO: 3025247 - DNA, 14 bp, Homo sapiens
gttaattcatttgg

SEQ ID NO: 3025248 - DNA, 23 bp, Homo sapiens
gttaatttaaagttgtttgtgcc

SEQ ID NO: 3025249 - DNA, 19 bp, Homo sapiens
gttaatttttccttcctct

SEQ ID NO: 3025250 - DNA, 21 bp, Homo sapiens
gttaatttttccttcctctgt

SEQ ID NO: 3025251 - DNA, 21 bp, Homo sapiens
gttaattttttggtacaaaaa

SEQ ID NO: 3025252 - DNA, 14 bp, Homo sapiens
gttacaacagattt

SEQ ID NO: 3025253 - DNA, 22 bp, Homo sapiens
gttacaataaaactaaatgtgt

SEQ ID NO: 3025254 - DNA, 19 bp, Homo sapiens
gttacagaaagtggtgctc

SEQ ID NO: 3025255 - DNA, 22 bp, Homo sapiens
gttacagagacctatgtaagaa

SEQ ID NO: 3025256 - DNA, 17 bp, Homo sapiens
gttacagtatgcttgct

SEQ ID NO: 3025257 - DNA, 17 bp, Homo sapiens
gttacatgcataaaagg

SEQ ID NO: 3025258 - DNA, 21 bp, Homo sapiens
gttacatgcatacttcaaaag

SEQ ID NO: 3025259 - DNA, 14 bp, Homo sapiens
gttacatgtttgca

SEQ ID NO: 3025260 - DNA, 18 bp, Homo sapiens
gttacattaaaataaacc

SEQ ID NO: 3025261 - DNA, 23 bp, Homo sapiens
gttacattaaaataaaccaaata

SEQ ID NO: 3025262 - DNA, 20 bp, Homo sapiens
gttacccaggctggagtgca

SEQ ID NO: 3025263 - DNA, 21 bp, Homo sapiens
gttacctgtcttgctcctggg

SEQ ID NO: 3025264 - DNA, 12 bp, Homo sapiens
gttactcagccc

SEQ ID NO: 3025265 - DNA, 14 bp, Homo sapiens
gttactcagccctg

SEQ ID NO: 3025266 - DNA, 15 bp, Homo sapiens
gttactcagccctgg

SEQ ID NO: 3025267 - DNA, 19 bp, Homo sapiens
gttactcatcgggcccagg

SEQ ID NO: 3025268 - DNA, 22 bp, Homo sapiens
gttactccagtgccaacaatcc

SEQ ID NO: 3025269 - DNA, 20 bp, Homo sapiens
gttactccctacactgatgc

SEQ ID NO: 3025270 - DNA, 18 bp, Homo sapiens
gttactctccaacctgga

SEQ ID NO: 3025271 - DNA, 22 bp, Homo sapiens
gttactctccaacctggacaac

SEQ ID NO: 3025272 - DNA, 14 bp, Homo sapiens
gttactctgaaggg

SEQ ID NO: 3025273 - DNA, 17 bp, Homo sapiens
gttactgaaatgagcct

SEQ ID NO: 3025274 - DNA, 23 bp, Homo sapiens
gttactgttgtgacctgaagttc

SEQ ID NO: 3025275 - DNA, 20 bp, Homo sapiens
gttacttaaacatcattgga

SEQ ID NO: 3025276 - DNA, 19 bp, Homo sapiens
gttacttaagattcagttt

SEQ ID NO: 3025277 - DNA, 16 bp, Homo sapiens
gttacttgaagtaact

SEQ ID NO: 3025278 - DNA, 14 bp, Homo sapiens
gttagaaccagcag

SEQ ID NO: 3025279 - DNA, 15 bp, Homo sapiens
gttagaaccagcaga

SEQ ID NO: 3025280 - DNA, 12 bp, Homo sapiens
gttagaattcct

SEQ ID NO: 3025281 - DNA, 13 bp, Homo sapiens
gttagaattcctt

SEQ ID NO: 3025282 - DNA, 18 bp, Homo sapiens
gttagaattgatttccaa

SEQ ID NO: 3025283 - DNA, 10 bp, Homo sapiens
gttagagcac

SEQ ID NO: 3025284 - DNA, 15 bp, Homo sapiens
gttagattttgcatt

SEQ ID NO: 3025285 - DNA, 22 bp, Homo sapiens
gttagcctggatagccttgaaa

SEQ ID NO: 3025286 - DNA, 17 bp, Homo sapiens
gttaggatgctcagttg

SEQ ID NO: 3025287 - DNA, 15 bp, Homo sapiens
gttaggatggcagga

SEQ ID NO: 3025288 - DNA, 16 bp, Homo sapiens
gttagtctactcttaa

SEQ ID NO: 3025289 - DNA, 23 bp, Homo sapiens
gttagtctactcttaagccatct

SEQ ID NO: 3025290 - DNA, 16 bp, Homo sapiens
gttagtgacatttaat

SEQ ID NO: 3025291 - DNA, 17 bp, Homo sapiens
gttagtgacatttaatg

SEQ ID NO: 3025292 - DNA, 13 bp, Homo sapiens
gttagtggcaccg

SEQ ID NO: 3025293 - DNA, 13 bp, Homo sapiens
gttagtttcttgg

SEQ ID NO: 3025294 - DNA, 16 bp, Homo sapiens
gttataaaagtgattg

SEQ ID NO: 3025295 - DNA, 15 bp, Homo sapiens
gttataaagatacag

SEQ ID NO: 3025296 - DNA, 16 bp, Homo sapiens
gttataagaaacagag

SEQ ID NO: 3025297 - DNA, 14 bp, Homo sapiens
gttataagactctc

SEQ ID NO: 3025298 - DNA, 14 bp, Homo sapiens
gttatatgaatata

SEQ ID NO: 3025299 - DNA, 17 bp, Homo sapiens
gttatattatttacatt

SEQ ID NO: 3025300 - DNA, 10 bp, Homo sapiens
gttatatttc

SEQ ID NO: 3025301 - DNA, 23 bp, Homo sapiens
gttatatttcagatgtaatgttt

SEQ ID NO: 3025302 - DNA, 20 bp, Homo sapiens
gttatcaccgtgggctccct

SEQ ID NO: 3025303 - DNA, 13 bp, Homo sapiens
gttatcagctggg

SEQ ID NO: 3025304 - DNA, 23 bp, Homo sapiens
gttatccatattacgttgtttct

SEQ ID NO: 3025305 - DNA, 12 bp, Homo sapiens
gttatcctgcaa

SEQ ID NO: 3025306 - DNA, 16 bp, Homo sapiens
gttatcctgcaaggga

SEQ ID NO: 3025307 - DNA, 18 bp, Homo sapiens
gttatctaagttaattta

SEQ ID NO: 3025308 - DNA, 21 bp, Homo sapiens
gttatctaagttaatttaaag

SEQ ID NO: 3025309 - DNA, 19 bp, Homo sapiens
gttatcttatactgtacaa

SEQ ID NO: 3025310 - DNA, 20 bp, Homo sapiens
gttatcttatactgtacaat

SEQ ID NO: 3025311 - DNA, 22 bp, Homo sapiens
gttatcttatactgtacaataa

SEQ ID NO: 3025312 - DNA, 19 bp, Homo sapiens
gttatgaatttaaaaataa

SEQ ID NO: 3025313 - DNA, 13 bp, Homo sapiens
gttatgtatttcc

SEQ ID NO: 3025314 - DNA, 23 bp, Homo sapiens
gttatgtatttcctggatgtttg

SEQ ID NO: 3025315 - DNA, 21 bp, Homo sapiens
gttattaaacgtatgcatgtg

SEQ ID NO: 3025316 - DNA, 21 bp, Homo sapiens
gttattaacctcttaaacatg

SEQ ID NO: 3025317 - DNA, 22 bp, Homo sapiens
gttattagagattacctcctga

SEQ ID NO: 3025318 - DNA, 15 bp, Homo sapiens
gttattataaatgtt

SEQ ID NO: 3025319 - DNA, 20 bp, Homo sapiens
gttattatatatttaacatg

SEQ ID NO: 3025320 - DNA, 19 bp, Homo sapiens
gttattatatttacaaatg

SEQ ID NO: 3025321 - DNA, 20 bp, Homo sapiens
gttattctagtactagaaac

SEQ ID NO: 3025322 - DNA, 14 bp, Homo sapiens
gttattgcagttta

SEQ ID NO: 3025323 - DNA, 20 bp, Homo sapiens
gttattggccttttctattc

SEQ ID NO: 3025324 - DNA, 13 bp, Homo sapiens
gttattgttttca

SEQ ID NO: 3025325 - DNA, 15 bp, Homo sapiens
gttatttaattgaaa

SEQ ID NO: 3025326 - DNA, 13 bp, Homo sapiens
gttatttctgtag

SEQ ID NO: 3025327 - DNA, 17 bp, Homo sapiens
gttattttatatttgag

SEQ ID NO: 3025328 - DNA, 13 bp, Homo sapiens
gttattttgcaac

SEQ ID NO: 3025329 - DNA, 14 bp, Homo sapiens
gttcaaaagtggag

SEQ ID NO: 3025330 - DNA, 14 bp, Homo sapiens
gttcaacttattaa

SEQ ID NO: 3025331 - DNA, 16 bp, Homo sapiens
gttcaagaccagcctg

SEQ ID NO: 3025332 - DNA, 19 bp, Homo sapiens
gttcacacagcccagttcc

SEQ ID NO: 3025333 - DNA, 14 bp, Homo sapiens
gttcacagaaaaag

SEQ ID NO: 3025334 - DNA, 17 bp, Homo sapiens
gttcacagtagagtagg

SEQ ID NO: 3025335 - DNA, 18 bp, Homo sapiens
gttcacagtagagtaggg

SEQ ID NO: 3025336 - DNA, 14 bp, Homo sapiens
gttcacctttgtag

SEQ ID NO: 3025337 - DNA, 17 bp, Homo sapiens
gttcacctttgtagcac

SEQ ID NO: 3025338 - DNA, 19 bp, Homo sapiens
gttcacgtgcagctcaagg

SEQ ID NO: 3025339 - DNA, 13 bp, Homo sapiens
gttcactgcattc

SEQ ID NO: 3025340 - DNA, 15 bp, Homo sapiens
gttcagaaaaccact

SEQ ID NO: 3025341 - DNA, 18 bp, Homo sapiens
gttcagaaatttggcatt

SEQ ID NO: 3025342 - DNA, 14 bp, Homo sapiens
gttcagacacctgt

SEQ ID NO: 3025343 - DNA, 16 bp, Homo sapiens
gttttgtaaatgtact

SEQ ID NO: 3025344 - DNA, 19 bp, Homo sapiens
gttttgtacatgtaacatt

SEQ ID NO: 3025345 - DNA, 14 bp, Homo sapiens
gttttgtaccagtg

SEQ ID NO: 3025346 - DNA, 14 bp, Homo sapiens
gttttgtactggat

SEQ ID NO: 3025347 - DNA, 15 bp, Homo sapiens
gttttgtattctctg

SEQ ID NO: 3025348 - DNA, 15 bp, Homo sapiens
gttttgtgtgtatat

SEQ ID NO: 3025349 - DNA, 16 bp, Homo sapiens
gttttgtttattaaat

SEQ ID NO: 3025350 - DNA, 15 bp, Homo sapiens
gttttgtttgctatc

SEQ ID NO: 3025351 - DNA, 12 bp, Homo sapiens
gtttttaactca

SEQ ID NO: 3025352 - DNA, 15 bp, Homo sapiens
gtttttactagaaat

SEQ ID NO: 3025353 - DNA, 22 bp, Homo sapiens
gtttttactcaaccaaattaaa

SEQ ID NO: 3025354 - DNA, 16 bp, Homo sapiens
gtttttccatgtgttt

SEQ ID NO: 3025355 - DNA, 15 bp, Homo sapiens
gtttttgaaatacct

SEQ ID NO: 3025356 - DNA, 14 bp, Homo sapiens
gtttttgacattta

SEQ ID NO: 3025357 - DNA, 18 bp, Homo sapiens
gtttttgacatttatatt

SEQ ID NO: 3025358 - DNA, 21 bp, Homo sapiens
gtttttgacatttatattaaa

SEQ ID NO: 3025359 - DNA, 12 bp, Homo sapiens
gtttttgccaaa

SEQ ID NO: 3025360 - DNA, 17 bp, Homo sapiens
gtttttgctttctgaaa

SEQ ID NO: 3025361 - DNA, 22 bp, Homo sapiens
gtttttgttgagtctctgaaca

SEQ ID NO: 3025362 - DNA, 21 bp, Homo sapiens
gttttttaaaatatttatctg

SEQ ID NO: 3025363 - DNA, 18 bp, Homo sapiens
gttttttcaaaatagaaa

SEQ ID NO: 3025364 - DNA, 15 bp, Homo sapiens
gttttttcctcagtg

SEQ ID NO: 3025365 - DNA, 20 bp, Homo sapiens
gttttttcctcagtgcattt

SEQ ID NO: 3025366 - DNA, 13 bp, Homo sapiens
gttttttctgcaa

SEQ ID NO: 3025367 - DNA, 16 bp, Homo sapiens
gtttttttcctgtttc

SEQ ID NO: 3025368 - DNA, 14 bp, Homo sapiens
gtttttttttcatt

SEQ ID NO: 3025369 - DNA, 16 bp, Homo sapiens
gtttttttttgttttg

SEQ ID NO: 3025370 - DNA, 18 bp, Homo sapiens
gttttttttttgaaagtc

SEQ ID NO: 3025371 - DNA, 17 bp, Homo sapiens
gttttttttttttttgg

SEQ ID NO: 3025372 - DNA, 18 bp, Homo sapiens
taaaaaaaaaaaaaggaa

SEQ ID NO: 3025373 - DNA, 19 bp, Homo sapiens
taaaaaaaaaaaaaggaaa

SEQ ID NO: 3025374 - DNA, 20 bp, Homo sapiens
taaaaaaaaaaaaaggaaaa

SEQ ID NO: 3025375 - DNA, 17 bp, Homo sapiens
taaaaaaaaaaaagtta

SEQ ID NO: 3025376 - DNA, 16 bp, Homo sapiens
taaaaaaaaaaagtac

SEQ ID NO: 3025377 - DNA, 19 bp, Homo sapiens
taaaaaaaaagatctgttt

SEQ ID NO: 3025378 - DNA, 11 bp, Homo sapiens
taaaaaaaaga

SEQ ID NO: 3025379 - DNA, 16 bp, Homo sapiens
taaaaaaaatgtgaaa

SEQ ID NO: 3025380 - DNA, 13 bp, Homo sapiens
taaaaaacaaaaa

SEQ ID NO: 3025381 - DNA, 11 bp, Homo sapiens
taaaaaacaac

SEQ ID NO: 3025382 - DNA, 16 bp, Homo sapiens
taaaaaagaaaacatt

SEQ ID NO: 3025383 - DNA, 17 bp, Homo sapiens
taaaaaagaaaacattc

SEQ ID NO: 3025384 - DNA, 20 bp, Homo sapiens
taaaaaagaagcactttgat

SEQ ID NO: 3025385 - DNA, 16 bp, Homo sapiens
taaaaaatattttctc

SEQ ID NO: 3025386 - DNA, 18 bp, Homo sapiens
taaaaaatattttctctg

SEQ ID NO: 3025387 - DNA, 18 bp, Homo sapiens
taaaaaattgaaaagatt

SEQ ID NO: 3025388 - DNA, 20 bp, Homo sapiens
taaaaacagcattgctttct

SEQ ID NO: 3025389 - DNA, 16 bp, Homo sapiens
taaaaacatagaaaaa

SEQ ID NO: 3025390 - DNA, 21 bp, Homo sapiens
taaaaacattgcctttgaatg

SEQ ID NO: 3025391 - DNA, 13 bp, Homo sapiens
taaaaaccaaatt

SEQ ID NO: 3025392 - DNA, 14 bp, Homo sapiens
taaaaactagtagt

SEQ ID NO: 3025393 - DNA, 16 bp, Homo sapiens
taaaaactgagtgact

SEQ ID NO: 3025394 - DNA, 16 bp, Homo sapiens
taaaaagaaacaagat

SEQ ID NO: 3025395 - DNA, 21 bp, Homo sapiens
taaaaagaggatgatttcaga

SEQ ID NO: 3025396 - DNA, 22 bp, Homo sapiens
taaaaagatgatcgctgtattt

SEQ ID NO: 3025397 - DNA, 13 bp, Homo sapiens
taaaaagcaaatc

SEQ ID NO: 3025398 - DNA, 16 bp, Homo sapiens
taaaaagcaaatcttt

SEQ ID NO: 3025399 - DNA, 20 bp, Homo sapiens
taaaaagggcagccctcctt

SEQ ID NO: 3025400 - DNA, 12 bp, Homo sapiens
taaaaagttaaa

SEQ ID NO: 3025401 - DNA, 15 bp, Homo sapiens
taaaaagttaaaaag

SEQ ID NO: 3025402 - DNA, 14 bp, Homo sapiens
taaaaataaatcta

SEQ ID NO: 3025403 - DNA, 13 bp, Homo sapiens
taaaaatagaaac

SEQ ID NO: 3025404 - DNA, 21 bp, Homo sapiens
taaaaatattgtcatgtttat

SEQ ID NO: 3025405 - DNA, 15 bp, Homo sapiens
taaaaatatttcaga

SEQ ID NO: 3025406 - DNA, 15 bp, Homo sapiens
taaaaatcacactgt

SEQ ID NO: 3025407 - DNA, 15 bp, Homo sapiens
taaaaatcatagtac

SEQ ID NO: 3025408 - DNA, 15 bp, Homo sapiens
taaaaatctcttttc

SEQ ID NO: 3025409 - DNA, 11 bp, Homo sapiens
taaaaatgaag

SEQ ID NO: 3025410 - DNA, 14 bp, Homo sapiens
taaaaatgaatcct

SEQ ID NO: 3025411 - DNA, 16 bp, Homo sapiens
taaaaatgatttcagt

SEQ ID NO: 3025412 - DNA, 20 bp, Homo sapiens
taaaaatgcaaatcctatgt

SEQ ID NO: 3025413 - DNA, 20 bp, Homo sapiens
taaaaatgggacttcttttc

SEQ ID NO: 3025414 - DNA, 13 bp, Homo sapiens
taaaaatggtggc

SEQ ID NO: 3025415 - DNA, 23 bp, Homo sapiens
taaaaatgttttttcatgtgttt

SEQ ID NO: 3025416 - DNA, 23 bp, Homo sapiens
taaaaattgtcttcatgtacatt

SEQ ID NO: 3025417 - DNA, 20 bp, Homo sapiens
taaaacaaaagcattttgct

SEQ ID NO: 3025418 - DNA, 21 bp, Homo sapiens
taaaacaaaatttgactaatt

SEQ ID NO: 3025419 - DNA, 14 bp, Homo sapiens
taaaacaaagggca

SEQ ID NO: 3025420 - DNA, 14 bp, Homo sapiens
taaaacaatattgt

SEQ ID NO: 3025421 - DNA, 15 bp, Homo sapiens
taaaacaatccttac

SEQ ID NO: 3025422 - DNA, 13 bp, Homo sapiens
taaaacacagagg

SEQ ID NO: 3025423 - DNA, 19 bp, Homo sapiens
taaaacacatacaaaagaa

SEQ ID NO: 3025424 - DNA, 22 bp, Homo sapiens
taaaacagagaaggtcaatcta

SEQ ID NO: 3025425 - DNA, 21 bp, Homo sapiens
taaaacataatagaatttcct

SEQ ID NO: 3025426 - DNA, 15 bp, Homo sapiens
taaaacatgctgttt

SEQ ID NO: 3025427 - DNA, 12 bp, Homo sapiens
taaaacatgtaa

SEQ ID NO: 3025428 - DNA, 22 bp, Homo sapiens
taaaaccttgaaggtctgtcat

SEQ ID NO: 3025429 - DNA, 16 bp, Homo sapiens
taaaacgtgtaaatga

SEQ ID NO: 3025430 - DNA, 21 bp, Homo sapiens
taaaactccaaaatctggctt

SEQ ID NO: 3025431 - DNA, 15 bp, Homo sapiens
taaaactttaagaaa

SEQ ID NO: 3025432 - DNA, 19 bp, Homo sapiens
taaaagaaaaaaaccaaag

SEQ ID NO: 3025433 - DNA, 15 bp, Homo sapiens
taaaagaaaccactt

SEQ ID NO: 3025434 - DNA, 20 bp, Homo sapiens
taaaagacagtgaaagaaaa

SEQ ID NO: 3025435 - DNA, 18 bp, Homo sapiens
taaaagacagtgtatgta

SEQ ID NO: 3025436 - DNA, 20 bp, Homo sapiens
taaaagatcatagttgcaaa

SEQ ID NO: 3025437 - DNA, 15 bp, Homo sapiens
taaaagatcttcaaa

SEQ ID NO: 3025438 - DNA, 14 bp, Homo sapiens
taaaagatgcagag

SEQ ID NO: 3025439 - DNA, 23 bp, Homo sapiens
taaaagatgcagagtaagtatta

SEQ ID NO: 3025440 - DNA, 11 bp, Homo sapiens
taaaagcacac

SEQ ID NO: 3025441 - DNA, 22 bp, Homo sapiens
taaaagcagaaaataaaggaag

SEQ ID NO: 3025442 - DNA, 19 bp, Homo sapiens
taaaaggcaaatgtgtaca

SEQ ID NO: 3025443 - DNA, 20 bp, Homo sapiens
taaaaggccaaacctctgtt

SEQ ID NO: 3025444 - DNA, 21 bp, Homo sapiens
taaaagggattacccaagcaa

SEQ ID NO: 3025445 - DNA, 19 bp, Homo sapiens
taaaagtagaagcatgttt

SEQ ID NO: 3025446 - DNA, 20 bp, Homo sapiens
taaaagtagtgttgtccagg

SEQ ID NO: 3025447 - DNA, 15 bp, Homo sapiens
taaaagtgatctaca

SEQ ID NO: 3025448 - DNA, 14 bp, Homo sapiens
taaaagtgtacaag

SEQ ID NO: 3025449 - DNA, 22 bp, Homo sapiens
taaaagtgtcaccttttcttgc

SEQ ID NO: 3025450 - DNA, 14 bp, Homo sapiens
taaaagttcctctc

SEQ ID NO: 3025451 - DNA, 17 bp, Homo sapiens
taaaagttctcaatgta

SEQ ID NO: 3025452 - DNA, 12 bp, Homo sapiens
taaaagttcttt

SEQ ID NO: 3025453 - DNA, 13 bp, Homo sapiens
taaaagtttgcat

SEQ ID NO: 3025454 - DNA, 14 bp, Homo sapiens
taaaagtttgcatg

SEQ ID NO: 3025455 - DNA, 17 bp, Homo sapiens
taaaagtttgtccttta

SEQ ID NO: 3025456 - DNA, 11 bp, Homo sapiens
taaaataaacc

SEQ ID NO: 3025457 - DNA, 18 bp, Homo sapiens
taaaataaaccaaatatg

SEQ ID NO: 3025458 - DNA, 14 bp, Homo sapiens
taaaataaattggt

SEQ ID NO: 3025459 - DNA, 14 bp, Homo sapiens
taaaataactatca

SEQ ID NO: 3025460 - DNA, 19 bp, Homo sapiens
taaaataactatcaggcag

SEQ ID NO: 3025461 - DNA, 22 bp, Homo sapiens
taaaataactatcaggcagaag

SEQ ID NO: 3025462 - DNA, 23 bp, Homo sapiens
taaaataactatcaggcagaaga

SEQ ID NO: 3025463 - DNA, 22 bp, Homo sapiens
taaaatagaggctttgagcaac

SEQ ID NO: 3025464 - DNA, 16 bp, Homo sapiens
taaaatagagtgtagt

SEQ ID NO: 3025465 - DNA, 21 bp, Homo sapiens
taaaatagagtgtagtttaca

SEQ ID NO: 3025466 - DNA, 20 bp, Homo sapiens
taaaatatgaagacataaac

SEQ ID NO: 3025467 - DNA, 14 bp, Homo sapiens
taaaatattttgaa

SEQ ID NO: 3025468 - DNA, 16 bp, Homo sapiens
taaaatattttgaatc

SEQ ID NO: 3025469 - DNA, 20 bp, Homo sapiens
taaaatcaaaaacttttgca

SEQ ID NO: 3025470 - DNA, 15 bp, Homo sapiens
taaaatcctcaatcc

SEQ ID NO: 3025471 - DNA, 15 bp, Homo sapiens
taaaatctcttgatt

SEQ ID NO: 3025472 - DNA, 14 bp, Homo sapiens
taaaatctgtcacg

SEQ ID NO: 3025473 - DNA, 13 bp, Homo sapiens
taaaatcttatag

SEQ ID NO: 3025474 - DNA, 17 bp, Homo sapiens
taaaatcttatagttct

SEQ ID NO: 3025475 - DNA, 18 bp, Homo sapiens
taaaatcttatagttcta

SEQ ID NO: 3025476 - DNA, 17 bp, Homo sapiens
taagacttactctaaga

SEQ ID NO: 3025477 - DNA, 18 bp, Homo sapiens
taagacttactctaagat

SEQ ID NO: 3025478 - DNA, 20 bp, Homo sapiens
taagacttactctaagatct

SEQ ID NO: 3025479 - DNA, 21 bp, Homo sapiens
taagacttcagtcctggtctg

SEQ ID NO: 3025480 - DNA, 20 bp, Homo sapiens
taagactttgggataggaaa

SEQ ID NO: 3025481 - DNA, 12 bp, Homo sapiens
taagagaaagag

SEQ ID NO: 3025482 - DNA, 18 bp, Homo sapiens
taagagactcagcctgca

SEQ ID NO: 3025483 - DNA, 14 bp, Homo sapiens
taagagattctgat

SEQ ID NO: 3025484 - DNA, 15 bp, Homo sapiens
taagagattctgatt

SEQ ID NO: 3025485 - DNA, 21 bp, Homo sapiens
taagagctgatgtgagtgtgt

SEQ ID NO: 3025486 - DNA, 21 bp, Homo sapiens
taagaggagtaggccctggtt

SEQ ID NO: 3025487 - DNA, 22 bp, Homo sapiens
taagaggagtaggccctggttc

SEQ ID NO: 3025488 - DNA, 17 bp, Homo sapiens
taagaggcagaaaattg

SEQ ID NO: 3025489 - DNA, 16 bp, Homo sapiens
taagagggcatataca

SEQ ID NO: 3025490 - DNA, 18 bp, Homo sapiens
taagaggtttttcctctt

SEQ ID NO: 3025491 - DNA, 21 bp, Homo sapiens
taagagtagaaactgcaggga

SEQ ID NO: 3025492 - DNA, 18 bp, Homo sapiens
taagagtccaagaatcca

SEQ ID NO: 3025493 - DNA, 17 bp, Homo sapiens
taagagtctccttctct

SEQ ID NO: 3025494 - DNA, 22 bp, Homo sapiens
taagagtctccttctcttctct

SEQ ID NO: 3025495 - DNA, 17 bp, Homo sapiens
taagataaaatgatgtt

SEQ ID NO: 3025496 - DNA, 21 bp, Homo sapiens
taagatatccatctttttctt

SEQ ID NO: 3025497 - DNA, 14 bp, Homo sapiens
taagatcttagatt

SEQ ID NO: 3025498 - DNA, 20 bp, Homo sapiens
taagatcttagattctctgt

SEQ ID NO: 3025499 - DNA, 20 bp, Homo sapiens
taagatggttttcaaatcat

SEQ ID NO: 3025500 - DNA, 18 bp, Homo sapiens
taagatgtgatattctaa

SEQ ID NO: 3025501 - DNA, 23 bp, Homo sapiens
taagatgtttattaatagaatga

SEQ ID NO: 3025502 - DNA, 13 bp, Homo sapiens
taagattcagttt

SEQ ID NO: 3025503 - DNA, 23 bp, Homo sapiens
taagattcagttttcccactttt

SEQ ID NO: 3025504 - DNA, 17 bp, Homo sapiens
taagattctaaaggtcc

SEQ ID NO: 3025505 - DNA, 14 bp, Homo sapiens
taagattctaatga

SEQ ID NO: 3025506 - DNA, 20 bp, Homo sapiens
taagattctctgcccagccg

SEQ ID NO: 3025507 - DNA, 14 bp, Homo sapiens
taagattctgattt

SEQ ID NO: 3025508 - DNA, 17 bp, Homo sapiens
taagattctgattttag

SEQ ID NO: 3025509 - DNA, 12 bp, Homo sapiens
taagattgaaat

SEQ ID NO: 3025510 - DNA, 13 bp, Homo sapiens
taagattgaaatt

SEQ ID NO: 3025511 - DNA, 21 bp, Homo sapiens
taagcaacgttagtagaactt

SEQ ID NO: 3025512 - DNA, 18 bp, Homo sapiens
taagcaacttgcttctaa

SEQ ID NO: 3025513 - DNA, 20 bp, Homo sapiens
taagcaaggtgtccctgcct

SEQ ID NO: 3025514 - DNA, 23 bp, Homo sapiens
taagcaaggtgtccctgccttca

SEQ ID NO: 3025515 - DNA, 16 bp, Homo sapiens
taagcaccatggcctt

SEQ ID NO: 3025516 - DNA, 16 bp, Homo sapiens
taagcactgtttttcc

SEQ ID NO: 3025517 - DNA, 16 bp, Homo sapiens
taagcagagataaata

SEQ ID NO: 3025518 - DNA, 23 bp, Homo sapiens
taagcagagataaataaaagata

SEQ ID NO: 3025519 - DNA, 15 bp, Homo sapiens
taagcagaggagggg

SEQ ID NO: 3025520 - DNA, 15 bp, Homo sapiens
taagcagagttcttt

SEQ ID NO: 3025521 - DNA, 21 bp, Homo sapiens
taagcagagttctttgcaagc

SEQ ID NO: 3025522 - DNA, 12 bp, Homo sapiens
taagcagccagg

SEQ ID NO: 3025523 - DNA, 17 bp, Homo sapiens
taagcagctaaattttc

SEQ ID NO: 3025524 - DNA, 18 bp, Homo sapiens
taagcagttttgtaaatg

SEQ ID NO: 3025525 - DNA, 19 bp, Homo sapiens
taagcagttttgtaaatgt

SEQ ID NO: 3025526 - DNA, 18 bp, Homo sapiens
taagcatactttgtaaat

SEQ ID NO: 3025527 - DNA, 17 bp, Homo sapiens
taagcatctacttcagg

SEQ ID NO: 3025528 - DNA, 15 bp, Homo sapiens
taagcattactttat

SEQ ID NO: 3025529 - DNA, 13 bp, Homo sapiens
taagccaagctgt

SEQ ID NO: 3025530 - DNA, 17 bp, Homo sapiens
taagccaagctgtgttc

SEQ ID NO: 3025531 - DNA, 18 bp, Homo sapiens
taagccaagctgtgttca

SEQ ID NO: 3025532 - DNA, 17 bp, Homo sapiens
taagccacttaaaatgt

SEQ ID NO: 3025533 - DNA, 17 bp, Homo sapiens
taagccatcttggtaaa

SEQ ID NO: 3025534 - DNA, 13 bp, Homo sapiens
taagccctcttta

SEQ ID NO: 3025535 - DNA, 13 bp, Homo sapiens
taagccctggccc

SEQ ID NO: 3025536 - DNA, 23 bp, Homo sapiens
taagccgatggtcactatagctc

SEQ ID NO: 3025537 - DNA, 13 bp, Homo sapiens
taagctccagctt

SEQ ID NO: 3025538 - DNA, 20 bp, Homo sapiens
taagctcctctgtaagacaa

SEQ ID NO: 3025539 - DNA, 19 bp, Homo sapiens
taagctctatctgcaatgt

SEQ ID NO: 3025540 - DNA, 19 bp, Homo sapiens
taagcttagattttctgta

SEQ ID NO: 3025541 - DNA, 11 bp, Homo sapiens
taaggaaacaa

SEQ ID NO: 3025542 - DNA, 14 bp, Homo sapiens
taaggaagagagaa

SEQ ID NO: 3025543 - DNA, 16 bp, Homo sapiens
taaggacaaagtgcca

SEQ ID NO: 3025544 - DNA, 21 bp, Homo sapiens
taaggacaaagtgccaaagaa

SEQ ID NO: 3025545 - DNA, 15 bp, Homo sapiens
taaggacctgaaatt

SEQ ID NO: 3025546 - DNA, 21 bp, Homo sapiens
taaggacctgaaattccaaag

SEQ ID NO: 3025547 - DNA, 12 bp, Homo sapiens
taaggacttttt

SEQ ID NO: 3025548 - DNA, 13 bp, Homo sapiens
taaggactttttc

SEQ ID NO: 3025549 - DNA, 19 bp, Homo sapiens
taaggagggagaaaggaga

SEQ ID NO: 3025550 - DNA, 13 bp, Homo sapiens
taaggatgtagct

SEQ ID NO: 3025551 - DNA, 16 bp, Homo sapiens
taaggatgtagctttt

SEQ ID NO: 3025552 - DNA, 17 bp, Homo sapiens
taaggatgtagcttttc

SEQ ID NO: 3025553 - DNA, 19 bp, Homo sapiens
taaggattctgaagtttta

SEQ ID NO: 3025554 - DNA, 15 bp, Homo sapiens
taaggcatactttta

SEQ ID NO: 3025555 - DNA, 14 bp, Homo sapiens
taaggccactgttt

SEQ ID NO: 3025556 - DNA, 20 bp, Homo sapiens
taaggccactgttttaaaag

SEQ ID NO: 3025557 - DNA, 18 bp, Homo sapiens
taaggcctaggattctaa

SEQ ID NO: 3025558 - DNA, 21 bp, Homo sapiens
taaggcctaggattctaaaat

SEQ ID NO: 3025559 - DNA, 22 bp, Homo sapiens
taaggctctgagagtctagatt

SEQ ID NO: 3025560 - DNA, 24 bp, Homo sapiens
taaggctctgagagtctagattct

SEQ ID NO: 3025561 - DNA, 20 bp, Homo sapiens
taaggctgaggaaaggccag

SEQ ID NO: 3025562 - DNA, 22 bp, Homo sapiens
taaggctttgattagttttctt

SEQ ID NO: 3025563 - DNA, 23 bp, Homo sapiens
taagggactaggaaattccaaat

SEQ ID NO: 3025564 - DNA, 19 bp, Homo sapiens
taagggacttaacttgttt

SEQ ID NO: 3025565 - DNA, 14 bp, Homo sapiens
taagggagaaaaaa

SEQ ID NO: 3025566 - DNA, 22 bp, Homo sapiens
taagggaggaggagcttctggg

SEQ ID NO: 3025567 - DNA, 16 bp, Homo sapiens
taagggatttcttagg

SEQ ID NO: 3025568 - DNA, 12 bp, Homo sapiens
taagggcagccc

SEQ ID NO: 3025569 - DNA, 16 bp, Homo sapiens
taaggggcccggccag

SEQ ID NO: 3025570 - DNA, 17 bp, Homo sapiens
taaggtcatagattctt

SEQ ID NO: 3025571 - DNA, 19 bp, Homo sapiens
taaggtcatagattcttga

SEQ ID NO: 3025572 - DNA, 21 bp, Homo sapiens
taaggtctttcagtacttttt

SEQ ID NO: 3025573 - DNA, 13 bp, Homo sapiens
taaggtctttgta

SEQ ID NO: 3025574 - DNA, 13 bp, Homo sapiens
taaggtgaagtga

SEQ ID NO: 3025575 - DNA, 15 bp, Homo sapiens
taaggtgaggcctgt

SEQ ID NO: 3025576 - DNA, 17 bp, Homo sapiens
taaggtgagttctcact

SEQ ID NO: 3025577 - DNA, 18 bp, Homo sapiens
taaggtgggagaattgct

SEQ ID NO: 3025578 - DNA, 23 bp, Homo sapiens
taaggtgggagaattgcttgagc

SEQ ID NO: 3025579 - DNA, 13 bp, Homo sapiens
taaggtgtagcca

SEQ ID NO: 3025580 - DNA, 20 bp, Homo sapiens
taaggtgttttctgtgtaac

SEQ ID NO: 3025581 - DNA, 16 bp, Homo sapiens
taagtaagtgtctgtg

SEQ ID NO: 3025582 - DNA, 15 bp, Homo sapiens
taagtagataagcag

SEQ ID NO: 3025583 - DNA, 18 bp, Homo sapiens
taagtataacaaactatg

SEQ ID NO: 3025584 - DNA, 14 bp, Homo sapiens
taagtatttctgat

SEQ ID NO: 3025585 - DNA, 20 bp, Homo sapiens
taagtcaaaaggaacaaaaa

SEQ ID NO: 3025586 - DNA, 23 bp, Homo sapiens
taagtcaaaaggaacaaaaatta

SEQ ID NO: 3025587 - DNA, 13 bp, Homo sapiens
taagtcagaacag

SEQ ID NO: 3025588 - DNA, 17 bp, Homo sapiens
taagtcatgtgtcccag

SEQ ID NO: 3025589 - DNA, 22 bp, Homo sapiens
taagtcattgaaatttactgtg

SEQ ID NO: 3025590 - DNA, 13 bp, Homo sapiens
taagtcatttaac

SEQ ID NO: 3025591 - DNA, 15 bp, Homo sapiens
taagtgaaaatctta

SEQ ID NO: 3025592 - DNA, 21 bp, Homo sapiens
taagtgacaatgcttatggaa

SEQ ID NO: 3025593 - DNA, 15 bp, Homo sapiens
taagtgagtgtgctg

SEQ ID NO: 3025594 - DNA, 23 bp, Homo sapiens
taagtgcgaagactgagccagat

SEQ ID NO: 3025595 - DNA, 13 bp, Homo sapiens
taagtggctgctg

SEQ ID NO: 3025596 - DNA, 16 bp, Homo sapiens
taagtgtcaagtcctg

SEQ ID NO: 3025597 - DNA, 17 bp, Homo sapiens
taagtgtcaagtcctga

SEQ ID NO: 3025598 - DNA, 22 bp, Homo sapiens
taagtgtgcagccatagtttgg

SEQ ID NO: 3025599 - DNA, 15 bp, Homo sapiens
taagtgttgaaaaat

SEQ ID NO: 3025600 - DNA, 17 bp, Homo sapiens
taagtgttgaaaaatat

SEQ ID NO: 3025601 - DNA, 16 bp, Homo sapiens
taagttaataagcaaa

SEQ ID NO: 3025602 - DNA, 12 bp, Homo sapiens
taagttattgca

SEQ ID NO: 3025603 - DNA, 14 bp, Homo sapiens
taagttattgcagt

SEQ ID NO: 3025604 - DNA, 15 bp, Homo sapiens
taagttattgcagtt

SEQ ID NO: 3025605 - DNA, 16 bp, Homo sapiens
taagttattgcagttt

SEQ ID NO: 3025606 - DNA, 14 bp, Homo sapiens
taagttattgttaa

SEQ ID NO: 3025607 - DNA, 17 bp, Homo sapiens
taagttcctgctgcctg

SEQ ID NO: 3025608 - DNA, 21 bp, Homo sapiens
tacattaaaataaaccaaata

SEQ ID NO: 3025609 - DNA, 19 bp, Homo sapiens
tacattaaagaaatttaat

SEQ ID NO: 3025610 - DNA, 12 bp, Homo sapiens
tacattctgtgt

SEQ ID NO: 3025611 - DNA, 17 bp, Homo sapiens
tacattctgtgtgtatc

SEQ ID NO: 3025612 - DNA, 23 bp, Homo sapiens
tacattgaaaacagatattacag

SEQ ID NO: 3025613 - DNA, 14 bp, Homo sapiens
tacattgttcaggt

SEQ ID NO: 3025614 - DNA, 17 bp, Homo sapiens
tacatttaaacaagtat

SEQ ID NO: 3025615 - DNA, 18 bp, Homo sapiens
tacatttaatacagataa

SEQ ID NO: 3025616 - DNA, 21 bp, Homo sapiens
tacatttccaaattcacaagt

SEQ ID NO: 3025617 - DNA, 14 bp, Homo sapiens
tacatttgtatttt

SEQ ID NO: 3025618 - DNA, 14 bp, Homo sapiens
tacatttgtttgta

SEQ ID NO: 3025619 - DNA, 15 bp, Homo sapiens
tacattttgctctgt

SEQ ID NO: 3025620 - DNA, 21 bp, Homo sapiens
tacattttggatttctttata

SEQ ID NO: 3025621 - DNA, 16 bp, Homo sapiens
tacatttttcaacttt

SEQ ID NO: 3025622 - DNA, 17 bp, Homo sapiens
tacatttttcaactttg

SEQ ID NO: 3025623 - DNA, 21 bp, Homo sapiens
tacatttttcaactttgaata

SEQ ID NO: 3025624 - DNA, 21 bp, Homo sapiens
taccaaacagcaaaccaagag

SEQ ID NO: 3025625 - DNA, 21 bp, Homo sapiens
taccaaagtgtcttttgacat

SEQ ID NO: 3025626 - DNA, 17 bp, Homo sapiens
taccaaatacacatttc

SEQ ID NO: 3025627 - DNA, 20 bp, Homo sapiens
taccaactgaagtcaatttg

SEQ ID NO: 3025628 - DNA, 13 bp, Homo sapiens
taccaagagaagg

SEQ ID NO: 3025629 - DNA, 13 bp, Homo sapiens
taccaatgaaaaa

SEQ ID NO: 3025630 - DNA, 17 bp, Homo sapiens
taccaatgaaaaaatgt

SEQ ID NO: 3025631 - DNA, 14 bp, Homo sapiens
taccaattatggaa

SEQ ID NO: 3025632 - DNA, 16 bp, Homo sapiens
taccaattatggaaat

SEQ ID NO: 3025633 - DNA, 20 bp, Homo sapiens
taccacacatctgtggagat

SEQ ID NO: 3025634 - DNA, 17 bp, Homo sapiens
taccacgccttgacctt

SEQ ID NO: 3025635 - DNA, 23 bp, Homo sapiens
taccactgtggaagtccctcaga

SEQ ID NO: 3025636 - DNA, 21 bp, Homo sapiens
taccactttcttattctgtat

SEQ ID NO: 3025637 - DNA, 15 bp, Homo sapiens
taccagcgaggaggc

SEQ ID NO: 3025638 - DNA, 14 bp, Homo sapiens
taccagctcagggg

SEQ ID NO: 3025639 - DNA, 17 bp, Homo sapiens
taccaggcaaattcact

SEQ ID NO: 3025640 - DNA, 21 bp, Homo sapiens
taccaggtccattttgcctga

SEQ ID NO: 3025641 - DNA, 22 bp, Homo sapiens
taccagtgaatttttgcaataa

SEQ ID NO: 3025642 - DNA, 23 bp, Homo sapiens
taccagtgaatttttgcaataat

SEQ ID NO: 3025643 - DNA, 19 bp, Homo sapiens
taccagtgggcatgtatta

SEQ ID NO: 3025644 - DNA, 18 bp, Homo sapiens
taccagtgtaaattcagt

SEQ ID NO: 3025645 - DNA, 15 bp, Homo sapiens
taccagtttctttgt

SEQ ID NO: 3025646 - DNA, 14 bp, Homo sapiens
taccataatgttcc

SEQ ID NO: 3025647 - DNA, 17 bp, Homo sapiens
taccataatgttcctta

SEQ ID NO: 3025648 - DNA, 16 bp, Homo sapiens
taccatacataaactg

SEQ ID NO: 3025649 - DNA, 16 bp, Homo sapiens
taccatatgaatgaaa

SEQ ID NO: 3025650 - DNA, 14 bp, Homo sapiens
taccatgaacagaa

SEQ ID NO: 3025651 - DNA, 20 bp, Homo sapiens
taccatgaacagaaaacatt

SEQ ID NO: 3025652 - DNA, 16 bp, Homo sapiens
taccatttttctggat

SEQ ID NO: 3025653 - DNA, 20 bp, Homo sapiens
tacccaaccccagatgcccc

SEQ ID NO: 3025654 - DNA, 15 bp, Homo sapiens
tacccaatagctgcc

SEQ ID NO: 3025655 - DNA, 14 bp, Homo sapiens
tacccagtcatgta

SEQ ID NO: 3025656 - DNA, 23 bp, Homo sapiens
tacccatacaccccctcttctga

SEQ ID NO: 3025657 - DNA, 17 bp, Homo sapiens
tacccatcttgcttcca

SEQ ID NO: 3025658 - DNA, 22 bp, Homo sapiens
taccccaccacgatgtggccct

SEQ ID NO: 3025659 - DNA, 14 bp, Homo sapiens
taccccatttgatt

SEQ ID NO: 3025660 - DNA, 13 bp, Homo sapiens
taccccctcatcc

SEQ ID NO: 3025661 - DNA, 16 bp, Homo sapiens
taccccctccttcaga

SEQ ID NO: 3025662 - DNA, 18 bp, Homo sapiens
taccccctccttcagaca

SEQ ID NO: 3025663 - DNA, 15 bp, Homo sapiens
taccccctgtgcctt

SEQ ID NO: 3025664 - DNA, 16 bp, Homo sapiens
taccccctttcccttc

SEQ ID NO: 3025665 - DNA, 21 bp, Homo sapiens
tacccctaaaatcccaccaga

SEQ ID NO: 3025666 - DNA, 16 bp, Homo sapiens
tacccctgccctgctc

SEQ ID NO: 3025667 - DNA, 14 bp, Homo sapiens
tacccgcagagttc

SEQ ID NO: 3025668 - DNA, 16 bp, Homo sapiens
tacccgtgcctgggcc

SEQ ID NO: 3025669 - DNA, 20 bp, Homo sapiens
tacccgtgcctgggcccctc

SEQ ID NO: 3025670 - DNA, 18 bp, Homo sapiens
taccctgagatctgcaca

SEQ ID NO: 3025671 - DNA, 21 bp, Homo sapiens
taccctgcgcccagtccttcc

SEQ ID NO: 3025672 - DNA, 11 bp, Homo sapiens
taccctgggtg

SEQ ID NO: 3025673 - DNA, 21 bp, Homo sapiens
taccctgggtgtccccgctgc

SEQ ID NO: 3025674 - DNA, 19 bp, Homo sapiens
tacccttgacttaactttt

SEQ ID NO: 3025675 - DNA, 16 bp, Homo sapiens
tacccttgagccctcc

SEQ ID NO: 3025676 - DNA, 19 bp, Homo sapiens
tacccttgagccctcccca

SEQ ID NO: 3025677 - DNA, 17 bp, Homo sapiens
tacccttgttttgaaac

SEQ ID NO: 3025678 - DNA, 16 bp, Homo sapiens
taccgatggtcccagg

SEQ ID NO: 3025679 - DNA, 16 bp, Homo sapiens
taccgcatggcagctg

SEQ ID NO: 3025680 - DNA, 20 bp, Homo sapiens
taccgcatggcagctgggcc

SEQ ID NO: 3025681 - DNA, 21 bp, Homo sapiens
taccgcatggcagctgggccc

SEQ ID NO: 3025682 - DNA, 22 bp, Homo sapiens
taccgcatggcagctgggccca

SEQ ID NO: 3025683 - DNA, 20 bp, Homo sapiens
taccgccctgcgggccacag

SEQ ID NO: 3025684 - DNA, 18 bp, Homo sapiens
taccgcctcgtgccagca

SEQ ID NO: 3025685 - DNA, 22 bp, Homo sapiens
taccgcctcgtgccagcagcct

SEQ ID NO: 3025686 - DNA, 20 bp, Homo sapiens
taccgtagcgtatacatttg

SEQ ID NO: 3025687 - DNA, 17 bp, Homo sapiens
taccgtgccactttcca

SEQ ID NO: 3025688 - DNA, 19 bp, Homo sapiens
taccgtgccactttccacc

SEQ ID NO: 3025689 - DNA, 20 bp, Homo sapiens
taccgtgccactttccacca

SEQ ID NO: 3025690 - DNA, 19 bp, Homo sapiens
tacctaagaatttcactgt

SEQ ID NO: 3025691 - DNA, 21 bp, Homo sapiens
tacctaagactaatgctttct

SEQ ID NO: 3025692 - DNA, 15 bp, Homo sapiens
tacctacaataaact

SEQ ID NO: 3025693 - DNA, 17 bp, Homo sapiens
tacctacaataaactgg

SEQ ID NO: 3025694 - DNA, 16 bp, Homo sapiens
tacctactggtgtaat

SEQ ID NO: 3025695 - DNA, 18 bp, Homo sapiens
tacctactggtgtaatct

SEQ ID NO: 3025696 - DNA, 22 bp, Homo sapiens
tacctagaagtaagaagaggag

SEQ ID NO: 3025697 - DNA, 16 bp, Homo sapiens
tacctataatcctcat

SEQ ID NO: 3025698 - DNA, 21 bp, Homo sapiens
tacctatcccacctccatccc

SEQ ID NO: 3025699 - DNA, 17 bp, Homo sapiens
tacctcagcctcctggg

SEQ ID NO: 3025700 - DNA, 15 bp, Homo sapiens
tacctccccttttct

SEQ ID NO: 3025701 - DNA, 23 bp, Homo sapiens
tacctccccttttctatgttgct

SEQ ID NO: 3025702 - DNA, 21 bp, Homo sapiens
tacctccctccccgtctcatt

SEQ ID NO: 3025703 - DNA, 15 bp, Homo sapiens
tacctctctgtccct

SEQ ID NO: 3025704 - DNA, 13 bp, Homo sapiens
tacctgaaagagc

SEQ ID NO: 3025705 - DNA, 22 bp, Homo sapiens
tacctgcaacacaacatttgtg

SEQ ID NO: 3025706 - DNA, 18 bp, Homo sapiens
tacctggcagcaaactgc

SEQ ID NO: 3025707 - DNA, 18 bp, Homo sapiens
tacctgggtgattacata

SEQ ID NO: 3025708 - DNA, 13 bp, Homo sapiens
tacctgtgaaata

SEQ ID NO: 3025709 - DNA, 19 bp, Homo sapiens
tacctgtgcctgagaattt

SEQ ID NO: 3025710 - DNA, 13 bp, Homo sapiens
tacctgttcctcc

SEQ ID NO: 3025711 - DNA, 13 bp, Homo sapiens
tacctgttcctta

SEQ ID NO: 3025712 - DNA, 21 bp, Homo sapiens
tacctgttgagcatcacagaa

SEQ ID NO: 3025713 - DNA, 16 bp, Homo sapiens
taccttcatatgcagt

SEQ ID NO: 3025714 - DNA, 20 bp, Homo sapiens
taccttccccagacttgcac

SEQ ID NO: 3025715 - DNA, 22 bp, Homo sapiens
taccttccccagacttgcactg

SEQ ID NO: 3025716 - DNA, 15 bp, Homo sapiens
taccttcttcaggct

SEQ ID NO: 3025717 - DNA, 23 bp, Homo sapiens
taccttgctagctagccagccaa

SEQ ID NO: 3025718 - DNA, 13 bp, Homo sapiens
taccttggttccc

SEQ ID NO: 3025719 - DNA, 22 bp, Homo sapiens
taccttgttttgccatgtagca

SEQ ID NO: 3025720 - DNA, 21 bp, Homo sapiens
taccttttaacacctgatgtg

SEQ ID NO: 3025721 - DNA, 13 bp, Homo sapiens
taccttttttccc

SEQ ID NO: 3025722 - DNA, 21 bp, Homo sapiens
taccttttttgataaagtttc

SEQ ID NO: 3025723 - DNA, 21 bp, Homo sapiens
tacgacaaagaaacattttac

SEQ ID NO: 3025724 - DNA, 13 bp, Homo sapiens
tacgactgaagaa

SEQ ID NO: 3025725 - DNA, 19 bp, Homo sapiens
tacgagagcagaggtctcc

SEQ ID NO: 3025726 - DNA, 21 bp, Homo sapiens
tacgagtgctaagtgtaggat

SEQ ID NO: 3025727 - DNA, 21 bp, Homo sapiens
tacgataaggaagaaacagaa

SEQ ID NO: 3025728 - DNA, 16 bp, Homo sapiens
tacgatctgtttccaa

SEQ ID NO: 3025729 - DNA, 13 bp, Homo sapiens
tacgcacagacag

SEQ ID NO: 3025730 - DNA, 21 bp, Homo sapiens
tacgcacagacaggttttcac

SEQ ID NO: 3025731 - DNA, 15 bp, Homo sapiens
tacgctctcctttct

SEQ ID NO: 3025732 - DNA, 19 bp, Homo sapiens
tacgctctcctttctttct

SEQ ID NO: 3025733 - DNA, 13 bp, Homo sapiens
tacgctggtgctg

SEQ ID NO: 3025734 - DNA, 15 bp, Homo sapiens
tacgctttgattcat

SEQ ID NO: 3025735 - DNA, 14 bp, Homo sapiens
tacggacaccccct

SEQ ID NO: 3025736 - DNA, 16 bp, Homo sapiens
tacgggggctgtgact

SEQ ID NO: 3025737 - DNA, 21 bp, Homo sapiens
tacgtagccacaggagccctg

SEQ ID NO: 3025738 - DNA, 21 bp, Homo sapiens
tacgtctgggagaaattgaca

SEQ ID NO: 3025739 - DNA, 20 bp, Homo sapiens
tagccattgtcgtttcattc

SEQ ID NO: 3025740 - DNA, 19 bp, Homo sapiens
tagcccaggctggagtgca

SEQ ID NO: 3025741 - DNA, 12 bp, Homo sapiens
tagccccagact

SEQ ID NO: 3025742 - DNA, 18 bp, Homo sapiens
tagccccagactgggccc

SEQ ID NO: 3025743 - DNA, 23 bp, Homo sapiens
tagccccagactgggcccaggca

SEQ ID NO: 3025744 - DNA, 22 bp, Homo sapiens
tagcccctggggtggccaccag

SEQ ID NO: 3025745 - DNA, 13 bp, Homo sapiens
tagccctcccact

SEQ ID NO: 3025746 - DNA, 17 bp, Homo sapiens
tagccctcccactttgc

SEQ ID NO: 3025747 - DNA, 17 bp, Homo sapiens
tagccgaactccaggct

SEQ ID NO: 3025748 - DNA, 23 bp, Homo sapiens
tagccgggtgtggcacgcacctg

SEQ ID NO: 3025749 - DNA, 20 bp, Homo sapiens
tagcctaacacactccaaga

SEQ ID NO: 3025750 - DNA, 19 bp, Homo sapiens
tagcctcaatttctgaaca

SEQ ID NO: 3025751 - DNA, 12 bp, Homo sapiens
tagcctccacca

SEQ ID NO: 3025752 - DNA, 14 bp, Homo sapiens
tagcctggactgct

SEQ ID NO: 3025753 - DNA, 20 bp, Homo sapiens
tagcctggatagccttgaaa

SEQ ID NO: 3025754 - DNA, 21 bp, Homo sapiens
tagccttagtgtcacctttct

SEQ ID NO: 3025755 - DNA, 16 bp, Homo sapiens
tagccttcctgacctc

SEQ ID NO: 3025756 - DNA, 18 bp, Homo sapiens
tagccttgaaaacaaaca

SEQ ID NO: 3025757 - DNA, 17 bp, Homo sapiens
tagccttgctgtagaga

SEQ ID NO: 3025758 - DNA, 20 bp, Homo sapiens
tagccttgctgtagagactt

SEQ ID NO: 3025759 - DNA, 22 bp, Homo sapiens
tagcgctgccgcaccccagagt

SEQ ID NO: 3025760 - DNA, 16 bp, Homo sapiens
tagcggatctcactca

SEQ ID NO: 3025761 - DNA, 16 bp, Homo sapiens
tagcgtcctgccctgc

SEQ ID NO: 3025762 - DNA, 18 bp, Homo sapiens
tagcgtcctgccctgccc

SEQ ID NO: 3025763 - DNA, 17 bp, Homo sapiens
tagcgtgctcactgacc

SEQ ID NO: 3025764 - DNA, 22 bp, Homo sapiens
tagctacaatcctaccttttga

SEQ ID NO: 3025765 - DNA, 16 bp, Homo sapiens
tagctactaattttaa

SEQ ID NO: 3025766 - DNA, 20 bp, Homo sapiens
tagctagaagtgggccagga

SEQ ID NO: 3025767 - DNA, 18 bp, Homo sapiens
tagctagcaccatggcat

SEQ ID NO: 3025768 - DNA, 17 bp, Homo sapiens
tagctagctatttctat

SEQ ID NO: 3025769 - DNA, 17 bp, Homo sapiens
tagctatcaagaggctg

SEQ ID NO: 3025770 - DNA, 20 bp, Homo sapiens
tagctcaatactctctgagt

SEQ ID NO: 3025771 - DNA, 15 bp, Homo sapiens
tagctccaagctgtt

SEQ ID NO: 3025772 - DNA, 16 bp, Homo sapiens
tagctccttgaagaca

SEQ ID NO: 3025773 - DNA, 17 bp, Homo sapiens
tagctccttgaagacat

SEQ ID NO: 3025774 - DNA, 14 bp, Homo sapiens
tagctctacacaac

SEQ ID NO: 3025775 - DNA, 18 bp, Homo sapiens
tagctctacacaacatgt

SEQ ID NO: 3025776 - DNA, 15 bp, Homo sapiens
tagctctatttactt

SEQ ID NO: 3025777 - DNA, 21 bp, Homo sapiens
tagctctggacgtgaaatact

SEQ ID NO: 3025778 - DNA, 15 bp, Homo sapiens
tagctcttgggcctg

SEQ ID NO: 3025779 - DNA, 12 bp, Homo sapiens
tagctgacacag

SEQ ID NO: 3025780 - DNA, 23 bp, Homo sapiens
tagctgaggctgagaaagctaaa

SEQ ID NO: 3025781 - DNA, 13 bp, Homo sapiens
tagctgaggggac

SEQ ID NO: 3025782 - DNA, 20 bp, Homo sapiens
tagctgaggggacgggcaag

SEQ ID NO: 3025783 - DNA, 23 bp, Homo sapiens
tagctgcccatttcgtgagcccc

SEQ ID NO: 3025784 - DNA, 16 bp, Homo sapiens
tagctgctacaaagaa

SEQ ID NO: 3025785 - DNA, 12 bp, Homo sapiens
tagctgggaaac

SEQ ID NO: 3025786 - DNA, 15 bp, Homo sapiens
tagctgggattttaa

SEQ ID NO: 3025787 - DNA, 21 bp, Homo sapiens
tagctgggattttaaactaga

SEQ ID NO: 3025788 - DNA, 23 bp, Homo sapiens
tagctgggattttaaactagatg

SEQ ID NO: 3025789 - DNA, 20 bp, Homo sapiens
tagctgggggtgggccaggc

SEQ ID NO: 3025790 - DNA, 21 bp, Homo sapiens
tagctgtatgatttgttttga

SEQ ID NO: 3025791 - DNA, 14 bp, Homo sapiens
tagctgtattgaat

SEQ ID NO: 3025792 - DNA, 16 bp, Homo sapiens
tagctgtattgaatca

SEQ ID NO: 3025793 - DNA, 14 bp, Homo sapiens
tagcttaagggaat

SEQ ID NO: 3025794 - DNA, 11 bp, Homo sapiens
tagcttcagga

SEQ ID NO: 3025795 - DNA, 14 bp, Homo sapiens
tagcttcctccaga

SEQ ID NO: 3025796 - DNA, 17 bp, Homo sapiens
tagcttgtttctgtcaa

SEQ ID NO: 3025797 - DNA, 17 bp, Homo sapiens
tagctttcaattccgta

SEQ ID NO: 3025798 - DNA, 22 bp, Homo sapiens
tagctttcatttactgatcatc

SEQ ID NO: 3025799 - DNA, 14 bp, Homo sapiens
tagctttcctggaa

SEQ ID NO: 3025800 - DNA, 14 bp, Homo sapiens
tagcttttcacctt

SEQ ID NO: 3025801 - DNA, 15 bp, Homo sapiens
taggaaataaaatta

SEQ ID NO: 3025802 - DNA, 17 bp, Homo sapiens
taggaagaattttaaaa

SEQ ID NO: 3025803 - DNA, 18 bp, Homo sapiens
taggaagagcaggactcc

SEQ ID NO: 3025804 - DNA, 19 bp, Homo sapiens
taggaagttcttttttgta

SEQ ID NO: 3025805 - DNA, 18 bp, Homo sapiens
taggaatactgttttatc

SEQ ID NO: 3025806 - DNA, 17 bp, Homo sapiens
taggaatctgccttcca

SEQ ID NO: 3025807 - DNA, 19 bp, Homo sapiens
taggaattcttttggggaa

SEQ ID NO: 3025808 - DNA, 19 bp, Homo sapiens
taggactcaaagtttcaga

SEQ ID NO: 3025809 - DNA, 20 bp, Homo sapiens
taggactccatttctttctt

SEQ ID NO: 3025810 - DNA, 18 bp, Homo sapiens
taggagaacgtatcaata

SEQ ID NO: 3025811 - DNA, 16 bp, Homo sapiens
taggagaagccaggaa

SEQ ID NO: 3025812 - DNA, 21 bp, Homo sapiens
taggagacagatcactcctgg

SEQ ID NO: 3025813 - DNA, 23 bp, Homo sapiens
taggagacttgccagagccgggc

SEQ ID NO: 3025814 - DNA, 19 bp, Homo sapiens
taggagagataccttgaaa

SEQ ID NO: 3025815 - DNA, 15 bp, Homo sapiens
taggagatcagaaaa

SEQ ID NO: 3025816 - DNA, 16 bp, Homo sapiens
taggagctaaggctct

SEQ ID NO: 3025817 - DNA, 18 bp, Homo sapiens
taggagctgccttggctc

SEQ ID NO: 3025818 - DNA, 17 bp, Homo sapiens
taggaggaggcatggaa

SEQ ID NO: 3025819 - DNA, 18 bp, Homo sapiens
taggaggaggcatggaaa

SEQ ID NO: 3025820 - DNA, 19 bp, Homo sapiens
taggaggaggcatggaaac

SEQ ID NO: 3025821 - DNA, 21 bp, Homo sapiens
taggagggggcggcagggctg

SEQ ID NO: 3025822 - DNA, 19 bp, Homo sapiens
taggataattagcagtatc

SEQ ID NO: 3025823 - DNA, 18 bp, Homo sapiens
taggataccacttttcat

SEQ ID NO: 3025824 - DNA, 15 bp, Homo sapiens
taggatatttctaca

SEQ ID NO: 3025825 - DNA, 17 bp, Homo sapiens
taggatattttccctac

SEQ ID NO: 3025826 - DNA, 22 bp, Homo sapiens
taggatattttccctacctaag

SEQ ID NO: 3025827 - DNA, 13 bp, Homo sapiens
taggatcctggag

SEQ ID NO: 3025828 - DNA, 12 bp, Homo sapiens
taggatttcagc

SEQ ID NO: 3025829 - DNA, 13 bp, Homo sapiens
taggatttcttaa

SEQ ID NO: 3025830 - DNA, 14 bp, Homo sapiens
taggatttcttaaa

SEQ ID NO: 3025831 - DNA, 13 bp, Homo sapiens
taggcaaaaataa

SEQ ID NO: 3025832 - DNA, 21 bp, Homo sapiens
taggcacccctttccccagcc

SEQ ID NO: 3025833 - DNA, 23 bp, Homo sapiens
taggcacccctttccccagcctc

SEQ ID NO: 3025834 - DNA, 18 bp, Homo sapiens
taggcactgtagttctaa

SEQ ID NO: 3025835 - DNA, 13 bp, Homo sapiens
taggcagaggctg

SEQ ID NO: 3025836 - DNA, 20 bp, Homo sapiens
taggcagtaggccggtgtgc

SEQ ID NO: 3025837 - DNA, 15 bp, Homo sapiens
taggcatgttatgtt

SEQ ID NO: 3025838 - DNA, 12 bp, Homo sapiens
taggcatttcct

SEQ ID NO: 3025839 - DNA, 19 bp, Homo sapiens
taggcatttttaccatcac

SEQ ID NO: 3025840 - DNA, 22 bp, Homo sapiens
taggccacagaaggtgaacttt

SEQ ID NO: 3025841 - DNA, 13 bp, Homo sapiens
taggccactcctc

SEQ ID NO: 3025842 - DNA, 9 bp, Homo sapiens
taggcccaa

SEQ ID NO: 3025843 - DNA, 13 bp, Homo sapiens
taggcccacacac

SEQ ID NO: 3025844 - DNA, 17 bp, Homo sapiens
taggcccacacacaggt

SEQ ID NO: 3025845 - DNA, 22 bp, Homo sapiens
taggccccacaaggcctggtct

SEQ ID NO: 3025846 - DNA, 14 bp, Homo sapiens
taggcccctgtgta

SEQ ID NO: 3025847 - DNA, 18 bp, Homo sapiens
taggcccttggggtggcg

SEQ ID NO: 3025848 - DNA, 14 bp, Homo sapiens
taggcctcagccag

SEQ ID NO: 3025849 - DNA, 21 bp, Homo sapiens
taggcctgccgctttgatgga

SEQ ID NO: 3025850 - DNA, 23 bp, Homo sapiens
taggccttcctctctccagatgt

SEQ ID NO: 3025851 - DNA, 14 bp, Homo sapiens
taggctattcacaa

SEQ ID NO: 3025852 - DNA, 16 bp, Homo sapiens
taggctggagcccagg

SEQ ID NO: 3025853 - DNA, 21 bp, Homo sapiens
taggctggcaagataaacact

SEQ ID NO: 3025854 - DNA, 19 bp, Homo sapiens
taggctggtggcccaggac

SEQ ID NO: 3025855 - DNA, 13 bp, Homo sapiens
tagggaaaaatgc

SEQ ID NO: 3025856 - DNA, 19 bp, Homo sapiens
tagggaaaatagggtcctt

SEQ ID NO: 3025857 - DNA, 18 bp, Homo sapiens
tagggaaaggtaaataca

SEQ ID NO: 3025858 - DNA, 16 bp, Homo sapiens
tagggaaatgaaagaa

SEQ ID NO: 3025859 - DNA, 17 bp, Homo sapiens
tagggagccatttgaga

SEQ ID NO: 3025860 - DNA, 23 bp, Homo sapiens
tagggaggaccacaggtgtgagc

SEQ ID NO: 3025861 - DNA, 18 bp, Homo sapiens
tagggcctcggaggctcc

SEQ ID NO: 3025862 - DNA, 20 bp, Homo sapiens
tagggcctcggaggctcctc

SEQ ID NO: 3025863 - DNA, 14 bp, Homo sapiens
tagggctgggaaac

SEQ ID NO: 3025864 - DNA, 15 bp, Homo sapiens
taggggatggggagg

SEQ ID NO: 3025865 - DNA, 13 bp, Homo sapiens
taggggtcctggg

SEQ ID NO: 3025866 - DNA, 18 bp, Homo sapiens
tagggtaaggtgccttct

SEQ ID NO: 3025867 - DNA, 20 bp, Homo sapiens
tagggtccttgaaacagaaa

SEQ ID NO: 3025868 - DNA, 13 bp, Homo sapiens
tagggtgcagcca

SEQ ID NO: 3025869 - DNA, 13 bp, Homo sapiens
tagggtgggaagg

SEQ ID NO: 3025870 - DNA, 21 bp, Homo sapiens
tagggttctgatcacattgca

SEQ ID NO: 3025871 - DNA, 17 bp, Homo sapiens
tatggtatatatacata

SEQ ID NO: 3025872 - DNA, 13 bp, Homo sapiens
tatggtattgtga

SEQ ID NO: 3025873 - DNA, 22 bp, Homo sapiens
tatggtattgtgagatgatttg

SEQ ID NO: 3025874 - DNA, 14 bp, Homo sapiens
tatggtgagatgca

SEQ ID NO: 3025875 - DNA, 20 bp, Homo sapiens
tatggtgagatgcagctgga

SEQ ID NO: 3025876 - DNA, 17 bp, Homo sapiens
tatggtgctaatatttt

SEQ ID NO: 3025877 - DNA, 15 bp, Homo sapiens
tatggtgctctgtct

SEQ ID NO: 3025878 - DNA, 23 bp, Homo sapiens
tatggtgctctgtctacttgctc

SEQ ID NO: 3025879 - DNA, 21 bp, Homo sapiens
tatgtaaaaggccaaacctct

SEQ ID NO: 3025880 - DNA, 22 bp, Homo sapiens
tatgtaaaaggccaaacctctg

SEQ ID NO: 3025881 - DNA, 15 bp, Homo sapiens
tatgtaaatttttca

SEQ ID NO: 3025882 - DNA, 12 bp, Homo sapiens
tatgtaacatgt

SEQ ID NO: 3025883 - DNA, 20 bp, Homo sapiens
tatgtaatgcttatgtgttg

SEQ ID NO: 3025884 - DNA, 19 bp, Homo sapiens
tatgtacagttcataaatt

SEQ ID NO: 3025885 - DNA, 23 bp, Homo sapiens
tatgtacagttcataaatttgtt

SEQ ID NO: 3025886 - DNA, 14 bp, Homo sapiens
tatgtaccaagaat

SEQ ID NO: 3025887 - DNA, 16 bp, Homo sapiens
tatgtacttgtcaaag

SEQ ID NO: 3025888 - DNA, 21 bp, Homo sapiens
tatgtacttttattttacaca

SEQ ID NO: 3025889 - DNA, 21 bp, Homo sapiens
tatgtagcaggaaataaagta

SEQ ID NO: 3025890 - DNA, 23 bp, Homo sapiens
tatgtaggtaaaagtagaagcat

SEQ ID NO: 3025891 - DNA, 20 bp, Homo sapiens
tatgtatgtgccaattttgt

SEQ ID NO: 3025892 - DNA, 20 bp, Homo sapiens
tatgtattcccttcctctga

SEQ ID NO: 3025893 - DNA, 14 bp, Homo sapiens
tatgtatttcattg

SEQ ID NO: 3025894 - DNA, 22 bp, Homo sapiens
tatgtatttcattgctgtgtca

SEQ ID NO: 3025895 - DNA, 10 bp, Homo sapiens
tatgtatttt

SEQ ID NO: 3025896 - DNA, 16 bp, Homo sapiens
tatgtattttaaaata

SEQ ID NO: 3025897 - DNA, 21 bp, Homo sapiens
tatgtcagaggaacagtcctg

SEQ ID NO: 3025898 - DNA, 21 bp, Homo sapiens
tatgtcagtgtaaatccttgt

SEQ ID NO: 3025899 - DNA, 23 bp, Homo sapiens
tatgtcatttccttcaaggcatc

SEQ ID NO: 3025900 - DNA, 23 bp, Homo sapiens
tatgtccactgtgtatagaagta

SEQ ID NO: 3025901 - DNA, 18 bp, Homo sapiens
tatgtcgagagctggcca

SEQ ID NO: 3025902 - DNA, 22 bp, Homo sapiens
tatgtcgagagctggccaaaga

SEQ ID NO: 3025903 - DNA, 12 bp, Homo sapiens
tatgtctcagga

SEQ ID NO: 3025904 - DNA, 18 bp, Homo sapiens
tatgtctgctcctttccc

SEQ ID NO: 3025905 - DNA, 14 bp, Homo sapiens
tatgtcttggacac

SEQ ID NO: 3025906 - DNA, 17 bp, Homo sapiens
tatgtcttggacactgt

SEQ ID NO: 3025907 - DNA, 19 bp, Homo sapiens
tatgtcttggacactgtac

SEQ ID NO: 3025908 - DNA, 19 bp, Homo sapiens
tatgtgaagcccagcatct

SEQ ID NO: 3025909 - DNA, 22 bp, Homo sapiens
tatgtgaatatggactcagttt

SEQ ID NO: 3025910 - DNA, 18 bp, Homo sapiens
tatgtgaatatttgtaaa

SEQ ID NO: 3025911 - DNA, 19 bp, Homo sapiens
tatgtgagtgaaagtactt

SEQ ID NO: 3025912 - DNA, 23 bp, Homo sapiens
tatgtgccaggcttgcctgggct

SEQ ID NO: 3025913 - DNA, 15 bp, Homo sapiens
tatgtggatacagtc

SEQ ID NO: 3025914 - DNA, 14 bp, Homo sapiens
tatgtgtaaataca

SEQ ID NO: 3025915 - DNA, 22 bp, Homo sapiens
tatgtgttgataattttttaat

SEQ ID NO: 3025916 - DNA, 21 bp, Homo sapiens
tatgtgttgtgtttgtagtct

SEQ ID NO: 3025917 - DNA, 15 bp, Homo sapiens
tatgtgtttgtgtgt

SEQ ID NO: 3025918 - DNA, 17 bp, Homo sapiens
tatgtgtttttcacatt

SEQ ID NO: 3025919 - DNA, 20 bp, Homo sapiens
tatgttacttaaacatcatt

SEQ ID NO: 3025920 - DNA, 13 bp, Homo sapiens
tatgttcactgtc

SEQ ID NO: 3025921 - DNA, 13 bp, Homo sapiens
tatgttcttatag

SEQ ID NO: 3025922 - DNA, 12 bp, Homo sapiens
tatgttgaatac

SEQ ID NO: 3025923 - DNA, 15 bp, Homo sapiens
tatgttgaatacttt

SEQ ID NO: 3025924 - DNA, 18 bp, Homo sapiens
tatgttgatccatccagc

SEQ ID NO: 3025925 - DNA, 21 bp, Homo sapiens
tatgttgctattgtaaggtct

SEQ ID NO: 3025926 - DNA, 22 bp, Homo sapiens
tatgttgtatatggtattgtga

SEQ ID NO: 3025927 - DNA, 16 bp, Homo sapiens
tatgttgtccaattgt

SEQ ID NO: 3025928 - DNA, 12 bp, Homo sapiens
tatgtttacaaa

SEQ ID NO: 3025929 - DNA, 12 bp, Homo sapiens
tatgttttacac

SEQ ID NO: 3025930 - DNA, 15 bp, Homo sapiens
tatgttttacactgt

SEQ ID NO: 3025931 - DNA, 17 bp, Homo sapiens
tatgttttacactgtac

SEQ ID NO: 3025932 - DNA, 23 bp, Homo sapiens
tatgttttatttggcttgtttta

SEQ ID NO: 3025933 - DNA, 18 bp, Homo sapiens
tatgtttttaatatgcat

SEQ ID NO: 3025934 - DNA, 15 bp, Homo sapiens
tatgtttttgttcaa

SEQ ID NO: 3025935 - DNA, 16 bp, Homo sapiens
tatgtttttgttcaaa

SEQ ID NO: 3025936 - DNA, 17 bp, Homo sapiens
tatgttttttaaaatat

SEQ ID NO: 3025937 - DNA, 16 bp, Homo sapiens
tattaaaatatgaagg

SEQ ID NO: 3025938 - DNA, 20 bp, Homo sapiens
tattaaacgtatgcatgtga

SEQ ID NO: 3025939 - DNA, 17 bp, Homo sapiens
tattaaatagttaatat

SEQ ID NO: 3025940 - DNA, 23 bp, Homo sapiens
tattaaatataaatatccccagg

SEQ ID NO: 3025941 - DNA, 19 bp, Homo sapiens
tattaacagaaatgtttct

SEQ ID NO: 3025942 - DNA, 14 bp, Homo sapiens
tattaactactgta

SEQ ID NO: 3025943 - DNA, 17 bp, Homo sapiens
tattaactactgtagaa

SEQ ID NO: 3025944 - DNA, 23 bp, Homo sapiens
tattaactactgtagaactgatt

SEQ ID NO: 3025945 - DNA, 23 bp, Homo sapiens
tattaacttgtagattcagtggt

SEQ ID NO: 3025946 - DNA, 18 bp, Homo sapiens
tattaagaatagtctctg

SEQ ID NO: 3025947 - DNA, 22 bp, Homo sapiens
tattaagaggcagaaaattgca

SEQ ID NO: 3025948 - DNA, 17 bp, Homo sapiens
tattaagggatttagta

SEQ ID NO: 3025949 - DNA, 16 bp, Homo sapiens
tattaaggtgtggctt

SEQ ID NO: 3025950 - DNA, 15 bp, Homo sapiens
tattaatataagttt

SEQ ID NO: 3025951 - DNA, 13 bp, Homo sapiens
tattaatgaaaat

SEQ ID NO: 3025952 - DNA, 12 bp, Homo sapiens
tattaatgcact

SEQ ID NO: 3025953 - DNA, 13 bp, Homo sapiens
tattaatgcactt

SEQ ID NO: 3025954 - DNA, 16 bp, Homo sapiens
tattaattttctatgt

SEQ ID NO: 3025955 - DNA, 18 bp, Homo sapiens
tattacaaattttcactg

SEQ ID NO: 3025956 - DNA, 19 bp, Homo sapiens
tattacaaattttcactgc

SEQ ID NO: 3025957 - DNA, 22 bp, Homo sapiens
tattacaaattttcactgctgc

SEQ ID NO: 3025958 - DNA, 18 bp, Homo sapiens
tattacataactgatcta

SEQ ID NO: 3025959 - DNA, 21 bp, Homo sapiens
tattacataactgatctattt

SEQ ID NO: 3025960 - DNA, 17 bp, Homo sapiens
tattacatctttcacat

SEQ ID NO: 3025961 - DNA, 16 bp, Homo sapiens
tattacattagttaag

SEQ ID NO: 3025962 - DNA, 17 bp, Homo sapiens
tattaccaggtccattt

SEQ ID NO: 3025963 - DNA, 21 bp, Homo sapiens
tattaccccctccttcagaca

SEQ ID NO: 3025964 - DNA, 15 bp, Homo sapiens
tattacgttgtttct

SEQ ID NO: 3025965 - DNA, 17 bp, Homo sapiens
tattactgctgctgtgc

SEQ ID NO: 3025966 - DNA, 18 bp, Homo sapiens
tattactgctgctgtgct

SEQ ID NO: 3025967 - DNA, 21 bp, Homo sapiens
tattactggcgtggattaaac

SEQ ID NO: 3025968 - DNA, 15 bp, Homo sapiens
tattacttttcatct

SEQ ID NO: 3025969 - DNA, 15 bp, Homo sapiens
tattactttttaaaa

SEQ ID NO: 3025970 - DNA, 16 bp, Homo sapiens
tattagagcattgaat

SEQ ID NO: 3025971 - DNA, 20 bp, Homo sapiens
tattagatgtgatttaatag

SEQ ID NO: 3025972 - DNA, 23 bp, Homo sapiens
tattagatgtgatttaatagtgt

SEQ ID NO: 3025973 - DNA, 23 bp, Homo sapiens
tattagccacaaaattgggaaag

SEQ ID NO: 3025974 - DNA, 17 bp, Homo sapiens
tattaggtgcaatttca

SEQ ID NO: 3025975 - DNA, 21 bp, Homo sapiens
tattagtactgctcttgtttc

SEQ ID NO: 3025976 - DNA, 14 bp, Homo sapiens
tattagttttgatt

SEQ ID NO: 3025977 - DNA, 12 bp, Homo sapiens
tattataaatgt

SEQ ID NO: 3025978 - DNA, 16 bp, Homo sapiens
tattataaatgttagt

SEQ ID NO: 3025979 - DNA, 21 bp, Homo sapiens
tattatactgttatccatatt

SEQ ID NO: 3025980 - DNA, 17 bp, Homo sapiens
tattatatttacaaatg

SEQ ID NO: 3025981 - DNA, 22 bp, Homo sapiens
tattatcatgcaaatgctgtat

SEQ ID NO: 3025982 - DNA, 14 bp, Homo sapiens
tattatccttctac

SEQ ID NO: 3025983 - DNA, 17 bp, Homo sapiens
tattatgttgttagaga

SEQ ID NO: 3025984 - DNA, 21 bp, Homo sapiens
tattattactttttaaaatgt

SEQ ID NO: 3025985 - DNA, 19 bp, Homo sapiens
tattattagttttgattta

SEQ ID NO: 3025986 - DNA, 12 bp, Homo sapiens
tattattattat

SEQ ID NO: 3025987 - DNA, 16 bp, Homo sapiens
tattattattattttc

SEQ ID NO: 3025988 - DNA, 13 bp, Homo sapiens
tattatttaactc

SEQ ID NO: 3025989 - DNA, 19 bp, Homo sapiens
tattatttctaggaagaat

SEQ ID NO: 3025990 - DNA, 14 bp, Homo sapiens
tattattttccaaa

SEQ ID NO: 3025991 - DNA, 13 bp, Homo sapiens
tattcaaactacc

SEQ ID NO: 3025992 - DNA, 18 bp, Homo sapiens
tattcaaactacctatat

SEQ ID NO: 3025993 - DNA, 14 bp, Homo sapiens
tattcaaactttta

SEQ ID NO: 3025994 - DNA, 14 bp, Homo sapiens
tattcaaagatgat

SEQ ID NO: 3025995 - DNA, 17 bp, Homo sapiens
tattcaaagcagctgta

SEQ ID NO: 3025996 - DNA, 13 bp, Homo sapiens
tattcaaatgaag

SEQ ID NO: 3025997 - DNA, 23 bp, Homo sapiens
tattcacaaaacattaaatgtcc

SEQ ID NO: 3025998 - DNA, 17 bp, Homo sapiens
tattcaccaatgttgta

SEQ ID NO: 3025999 - DNA, 20 bp, Homo sapiens
tattcagaattatgatggaa

SEQ ID NO: 3026000 - DNA, 18 bp, Homo sapiens
tattcaggcactgagaat

SEQ ID NO: 3026001 - DNA, 22 bp, Homo sapiens
tattcatagtatactgatttaa

SEQ ID NO: 3026002 - DNA, 17 bp, Homo sapiens
tattccagaatgctgta

SEQ ID NO: 3026003 - DNA, 21 bp, Homo sapiens
tcaaatctgtaatcagcaata

SEQ ID NO: 3026004 - DNA, 16 bp, Homo sapiens
tcaaatctgtagcata

SEQ ID NO: 3026005 - DNA, 13 bp, Homo sapiens
tcaaatcttacaa

SEQ ID NO: 3026006 - DNA, 20 bp, Homo sapiens
tcaaatggggccagatccag

SEQ ID NO: 3026007 - DNA, 12 bp, Homo sapiens
tcaaatgtgacc

SEQ ID NO: 3026008 - DNA, 22 bp, Homo sapiens
tcaaatgttctaagtttctaag

SEQ ID NO: 3026009 - DNA, 12 bp, Homo sapiens
tcaaattaaaaa

SEQ ID NO: 3026010 - DNA, 20 bp, Homo sapiens
tcaaattctcttctttttct

SEQ ID NO: 3026011 - DNA, 15 bp, Homo sapiens
tcaaattgaaatgac

SEQ ID NO: 3026012 - DNA, 18 bp, Homo sapiens
tcaacaaaaattgtccct

SEQ ID NO: 3026013 - DNA, 12 bp, Homo sapiens
tcaacaataaag

SEQ ID NO: 3026014 - DNA, 11 bp, Homo sapiens
tcaacaattag

SEQ ID NO: 3026015 - DNA, 13 bp, Homo sapiens
tcaacaattagag

SEQ ID NO: 3026016 - DNA, 17 bp, Homo sapiens
tcaacaattagaggaat

SEQ ID NO: 3026017 - DNA, 18 bp, Homo sapiens
tcaacaccaccgagctct

SEQ ID NO: 3026018 - DNA, 13 bp, Homo sapiens
tcaacagaatgaa

SEQ ID NO: 3026019 - DNA, 14 bp, Homo sapiens
tcaacagaatgaaa

SEQ ID NO: 3026020 - DNA, 15 bp, Homo sapiens
tcaacagaatgaaaa

SEQ ID NO: 3026021 - DNA, 23 bp, Homo sapiens
tcaacagaatgaaaaatgaaaga

SEQ ID NO: 3026022 - DNA, 12 bp, Homo sapiens
tcaacagagaag

SEQ ID NO: 3026023 - DNA, 17 bp, Homo sapiens
tcaacagagaaggcagg

SEQ ID NO: 3026024 - DNA, 22 bp, Homo sapiens
tcaacagattattttggaaagt

SEQ ID NO: 3026025 - DNA, 15 bp, Homo sapiens
tcaacagtgaagaca

SEQ ID NO: 3026026 - DNA, 15 bp, Homo sapiens
tcaacagttttccta

SEQ ID NO: 3026027 - DNA, 15 bp, Homo sapiens
tcaacatgaaacacc

SEQ ID NO: 3026028 - DNA, 14 bp, Homo sapiens
tcaacatttctcaa

SEQ ID NO: 3026029 - DNA, 19 bp, Homo sapiens
tcaaccagacagagggtca

SEQ ID NO: 3026030 - DNA, 16 bp, Homo sapiens
tcaaccccagacactg

SEQ ID NO: 3026031 - DNA, 18 bp, Homo sapiens
tcaaccccagacactggt

SEQ ID NO: 3026032 - DNA, 18 bp, Homo sapiens
tcaaccccctcgcctcct

SEQ ID NO: 3026033 - DNA, 12 bp, Homo sapiens
tcaacctcctgg

SEQ ID NO: 3026034 - DNA, 13 bp, Homo sapiens
tcaacctcctgga

SEQ ID NO: 3026035 - DNA, 16 bp, Homo sapiens
tcaacctcctgggttc

SEQ ID NO: 3026036 - DNA, 19 bp, Homo sapiens
tcaacctcttctggctcaa

SEQ ID NO: 3026037 - DNA, 15 bp, Homo sapiens
tcaaccttaagacct

SEQ ID NO: 3026038 - DNA, 14 bp, Homo sapiens
tcaacgttgtactg

SEQ ID NO: 3026039 - DNA, 17 bp, Homo sapiens
tcaacgtttcttcactt

SEQ ID NO: 3026040 - DNA, 23 bp, Homo sapiens
tcaactacctcgcatcattgcag

SEQ ID NO: 3026041 - DNA, 13 bp, Homo sapiens
tcaactgcctcag

SEQ ID NO: 3026042 - DNA, 19 bp, Homo sapiens
tcaactggggggaccaaat

SEQ ID NO: 3026043 - DNA, 14 bp, Homo sapiens
tcaacttggatcat

SEQ ID NO: 3026044 - DNA, 14 bp, Homo sapiens
tcaactttcatttg

SEQ ID NO: 3026045 - DNA, 14 bp, Homo sapiens
tcaactttgaataa

SEQ ID NO: 3026046 - DNA, 16 bp, Homo sapiens
tcaactttgaataaag

SEQ ID NO: 3026047 - DNA, 16 bp, Homo sapiens
tcaactttttattgcc

SEQ ID NO: 3026048 - DNA, 19 bp, Homo sapiens
tcaactttttattgccttc

SEQ ID NO: 3026049 - DNA, 20 bp, Homo sapiens
tcaactttttattgccttct

SEQ ID NO: 3026050 - DNA, 22 bp, Homo sapiens
tcaactttttattgccttctca

SEQ ID NO: 3026051 - DNA, 15 bp, Homo sapiens
tcaagaaaactggaa

SEQ ID NO: 3026052 - DNA, 17 bp, Homo sapiens
tcaagaaaactggaaat

SEQ ID NO: 3026053 - DNA, 12 bp, Homo sapiens
tcaagaatcaga

SEQ ID NO: 3026054 - DNA, 20 bp, Homo sapiens
tcaagacatagcatccaagt

SEQ ID NO: 3026055 - DNA, 15 bp, Homo sapiens
tcaagagactgagtc

SEQ ID NO: 3026056 - DNA, 18 bp, Homo sapiens
tcaagaggaatgaaaaaa

SEQ ID NO: 3026057 - DNA, 16 bp, Homo sapiens
tcaagaggcagagttc

SEQ ID NO: 3026058 - DNA, 18 bp, Homo sapiens
tcaagaggcgtgtgcagg

SEQ ID NO: 3026059 - DNA, 22 bp, Homo sapiens
tcaagaggcgtgtgcaggccga

SEQ ID NO: 3026060 - DNA, 16 bp, Homo sapiens
tcaagagtctctccag

SEQ ID NO: 3026061 - DNA, 17 bp, Homo sapiens
tcaagagtctctccagc

SEQ ID NO: 3026062 - DNA, 18 bp, Homo sapiens
tcaagagtctctccagcc

SEQ ID NO: 3026063 - DNA, 20 bp, Homo sapiens
tcaagagtctctccagcctc

SEQ ID NO: 3026064 - DNA, 15 bp, Homo sapiens
tcaagattttagggc

SEQ ID NO: 3026065 - DNA, 22 bp, Homo sapiens
tcaagattttagggcttttatt

SEQ ID NO: 3026066 - DNA, 16 bp, Homo sapiens
tcaagcaatcctccta

SEQ ID NO: 3026067 - DNA, 20 bp, Homo sapiens
tcaagcaatcctctcacctc

SEQ ID NO: 3026068 - DNA, 16 bp, Homo sapiens
tcaagcacttcccagg

SEQ ID NO: 3026069 - DNA, 14 bp, Homo sapiens
tcaagcagcaaaat

SEQ ID NO: 3026070 - DNA, 16 bp, Homo sapiens
tcaagcagcaaaatcc

SEQ ID NO: 3026071 - DNA, 17 bp, Homo sapiens
tcaagcaggttagagaa

SEQ ID NO: 3026072 - DNA, 19 bp, Homo sapiens
tcaagcaggtttcttgctt

SEQ ID NO: 3026073 - DNA, 15 bp, Homo sapiens
tcaagcattctgttt

SEQ ID NO: 3026074 - DNA, 19 bp, Homo sapiens
tcaagccaagcagccaagc

SEQ ID NO: 3026075 - DNA, 15 bp, Homo sapiens
tcaagcctgtgcaaa

SEQ ID NO: 3026076 - DNA, 18 bp, Homo sapiens
tcaagcctgtgcaaaaaa

SEQ ID NO: 3026077 - DNA, 15 bp, Homo sapiens
tcaagcgattctcct

SEQ ID NO: 3026078 - DNA, 21 bp, Homo sapiens
tcaagcgattctcctgcctca

SEQ ID NO: 3026079 - DNA, 15 bp, Homo sapiens
tcaagctcctcctcc

SEQ ID NO: 3026080 - DNA, 18 bp, Homo sapiens
tcaagctgagctggcttc

SEQ ID NO: 3026081 - DNA, 21 bp, Homo sapiens
tcaagctgtgagacagtggga

SEQ ID NO: 3026082 - DNA, 12 bp, Homo sapiens
tcaaggaagaaa

SEQ ID NO: 3026083 - DNA, 13 bp, Homo sapiens
tcaaggaagaaaa

SEQ ID NO: 3026084 - DNA, 17 bp, Homo sapiens
tcaaggaagaaaacgga

SEQ ID NO: 3026085 - DNA, 16 bp, Homo sapiens
tcaaggacattggtga

SEQ ID NO: 3026086 - DNA, 19 bp, Homo sapiens
tcaaggactgaattgtttt

SEQ ID NO: 3026087 - DNA, 13 bp, Homo sapiens
tcaaggagggcac

SEQ ID NO: 3026088 - DNA, 17 bp, Homo sapiens
tcaaggcaccgcagcct

SEQ ID NO: 3026089 - DNA, 16 bp, Homo sapiens
tcaaggcactctagat

SEQ ID NO: 3026090 - DNA, 17 bp, Homo sapiens
tcaaggcactctagatt

SEQ ID NO: 3026091 - DNA, 17 bp, Homo sapiens
tcaaggcatcatgcaga

SEQ ID NO: 3026092 - DNA, 12 bp, Homo sapiens
tcaaggctcaga

SEQ ID NO: 3026093 - DNA, 17 bp, Homo sapiens
tcaaggcttcagtctca

SEQ ID NO: 3026094 - DNA, 13 bp, Homo sapiens
tcaaggtgctcaa

SEQ ID NO: 3026095 - DNA, 14 bp, Homo sapiens
tcaaggttctaacc

SEQ ID NO: 3026096 - DNA, 18 bp, Homo sapiens
tcaaggttttaggttcta

SEQ ID NO: 3026097 - DNA, 21 bp, Homo sapiens
tcaaggttttaggttctaaag

SEQ ID NO: 3026098 - DNA, 14 bp, Homo sapiens
tcaagtaaaagaaa

SEQ ID NO: 3026099 - DNA, 19 bp, Homo sapiens
tcaagtaatccacctgcct

SEQ ID NO: 3026100 - DNA, 15 bp, Homo sapiens
tcaagtaattgtgaa

SEQ ID NO: 3026101 - DNA, 16 bp, Homo sapiens
tcaagtaattgtgaaa

SEQ ID NO: 3026102 - DNA, 21 bp, Homo sapiens
tcaagtacctatattgattta

SEQ ID NO: 3026103 - DNA, 23 bp, Homo sapiens
tcaagtataaagtcaggacctgg

SEQ ID NO: 3026104 - DNA, 23 bp, Homo sapiens
tcaagtcctgactgggctgggtt

SEQ ID NO: 3026105 - DNA, 16 bp, Homo sapiens
tcaagtgagtggcatg

SEQ ID NO: 3026106 - DNA, 17 bp, Homo sapiens
tcaagtgatcctcccac

SEQ ID NO: 3026107 - DNA, 18 bp, Homo sapiens
tcaagtgattctcctgcc

SEQ ID NO: 3026108 - DNA, 19 bp, Homo sapiens
tcaagtgattctcctgcct

SEQ ID NO: 3026109 - DNA, 20 bp, Homo sapiens
tcaagtgcatgctctctgca

SEQ ID NO: 3026110 - DNA, 22 bp, Homo sapiens
tcaagtgttctaaaatgaaata

SEQ ID NO: 3026111 - DNA, 15 bp, Homo sapiens
tcaagttctaagatt

SEQ ID NO: 3026112 - DNA, 17 bp, Homo sapiens
tcaagttctaagattct

SEQ ID NO: 3026113 - DNA, 18 bp, Homo sapiens
tcaagttctaagattcta

SEQ ID NO: 3026114 - DNA, 18 bp, Homo sapiens
tcaagttgtttaactgtg

SEQ ID NO: 3026115 - DNA, 18 bp, Homo sapiens
tcaagtttgaccagtgca

SEQ ID NO: 3026116 - DNA, 19 bp, Homo sapiens
tcaagtttgaccagtgcag

SEQ ID NO: 3026117 - DNA, 21 bp, Homo sapiens
tcaagttttaagtgaaagtga

SEQ ID NO: 3026118 - DNA, 22 bp, Homo sapiens
tcaataaacgatttaattctct

SEQ ID NO: 3026119 - DNA, 23 bp, Homo sapiens
tcaataaacgatttaattctctt

SEQ ID NO: 3026120 - DNA, 21 bp, Homo sapiens
tcaataaacttagaggaaaat

SEQ ID NO: 3026121 - DNA, 13 bp, Homo sapiens
tcaataaatgata

SEQ ID NO: 3026122 - DNA, 18 bp, Homo sapiens
tcaatacagtacaggcag

SEQ ID NO: 3026123 - DNA, 18 bp, Homo sapiens
tcaatagctccaagctgt

SEQ ID NO: 3026124 - DNA, 19 bp, Homo sapiens
tcaatagctccaagctgtt

SEQ ID NO: 3026125 - DNA, 21 bp, Homo sapiens
tcaatagctccaagctgttaa

SEQ ID NO: 3026126 - DNA, 21 bp, Homo sapiens
tcaataggcaaaagtgtaaca

SEQ ID NO: 3026127 - DNA, 14 bp, Homo sapiens
tcaatagttcaagg

SEQ ID NO: 3026128 - DNA, 17 bp, Homo sapiens
tcaatagttcaaggaac

SEQ ID NO: 3026129 - DNA, 22 bp, Homo sapiens
tcaatataatgtttttaatatt

SEQ ID NO: 3026130 - DNA, 13 bp, Homo sapiens
tcaatatgtatat

SEQ ID NO: 3026131 - DNA, 19 bp, Homo sapiens
tcaatatgtatatatgtat

SEQ ID NO: 3026132 - DNA, 13 bp, Homo sapiens
tcaatatttttct

SEQ ID NO: 3026133 - DNA, 14 bp, Homo sapiens
tcaatatttttcta

SEQ ID NO: 3026134 - DNA, 15 bp, Homo sapiens
tcaatcaacactacc

SEQ ID NO: 3026135 - DNA, 12 bp, Homo sapiens
tcaatcactgtc

SEQ ID NO: 3026136 - DNA, 22 bp, Homo sapiens
tcagctccagcccctttccaaa

SEQ ID NO: 3026137 - DNA, 14 bp, Homo sapiens
tcagctctgtcctg

SEQ ID NO: 3026138 - DNA, 15 bp, Homo sapiens
tcagctctgtctgct

SEQ ID NO: 3026139 - DNA, 18 bp, Homo sapiens
tcagctgcatctgataaa

SEQ ID NO: 3026140 - DNA, 16 bp, Homo sapiens
tcagctgctgttgaac

SEQ ID NO: 3026141 - DNA, 23 bp, Homo sapiens
tcagctgctgttgaactttttaa

SEQ ID NO: 3026142 - DNA, 23 bp, Homo sapiens
tcagctgggcagtgccagccaat

SEQ ID NO: 3026143 - DNA, 19 bp, Homo sapiens
tcagctggtggatggtgac

SEQ ID NO: 3026144 - DNA, 21 bp, Homo sapiens
tcagctgtcgggggccactgt

SEQ ID NO: 3026145 - DNA, 22 bp, Homo sapiens
tcagctgtcgggggccactgtg

SEQ ID NO: 3026146 - DNA, 17 bp, Homo sapiens
tcagctgttgcaggcag

SEQ ID NO: 3026147 - DNA, 23 bp, Homo sapiens
tcagctgttgcaggcagtgtctt

SEQ ID NO: 3026148 - DNA, 18 bp, Homo sapiens
tcagcttaggggctgctg

SEQ ID NO: 3026149 - DNA, 18 bp, Homo sapiens
tcagcttatgtaggtaaa

SEQ ID NO: 3026150 - DNA, 23 bp, Homo sapiens
tcagcttcagaatggcattgtac

SEQ ID NO: 3026151 - DNA, 18 bp, Homo sapiens
tcagctttatttttcttt

SEQ ID NO: 3026152 - DNA, 21 bp, Homo sapiens
tcagctttatttttctttaaa

SEQ ID NO: 3026153 - DNA, 16 bp, Homo sapiens
tcagctttcaaagcat

SEQ ID NO: 3026154 - DNA, 12 bp, Homo sapiens
tcagctttgctt

SEQ ID NO: 3026155 - DNA, 18 bp, Homo sapiens
tcagctttttgtcttttc

SEQ ID NO: 3026156 - DNA, 17 bp, Homo sapiens
tcaggaaccgaggcagg

SEQ ID NO: 3026157 - DNA, 18 bp, Homo sapiens
tcaggaaccgaggcaggg

SEQ ID NO: 3026158 - DNA, 19 bp, Homo sapiens
tcaggaacctcgagtactg

SEQ ID NO: 3026159 - DNA, 22 bp, Homo sapiens
tcaggaacctcgagtactgtgg

SEQ ID NO: 3026160 - DNA, 19 bp, Homo sapiens
tcaggaatcggaatcctgt

SEQ ID NO: 3026161 - DNA, 13 bp, Homo sapiens
tcaggaatttaaa

SEQ ID NO: 3026162 - DNA, 15 bp, Homo sapiens
tcaggacagatgcca

SEQ ID NO: 3026163 - DNA, 15 bp, Homo sapiens
tcaggacccagagga

SEQ ID NO: 3026164 - DNA, 18 bp, Homo sapiens
tcaggacctccaagccac

SEQ ID NO: 3026165 - DNA, 19 bp, Homo sapiens
tcaggacgagaatgagggt

SEQ ID NO: 3026166 - DNA, 21 bp, Homo sapiens
tcaggactcagaagcctctgg

SEQ ID NO: 3026167 - DNA, 13 bp, Homo sapiens
tcaggaggctgag

SEQ ID NO: 3026168 - DNA, 14 bp, Homo sapiens
tcaggaggctgaga

SEQ ID NO: 3026169 - DNA, 18 bp, Homo sapiens
tcaggagtccaagaccag

SEQ ID NO: 3026170 - DNA, 15 bp, Homo sapiens
tcaggagttccagtg

SEQ ID NO: 3026171 - DNA, 20 bp, Homo sapiens
tcaggatccaagctaagcac

SEQ ID NO: 3026172 - DNA, 20 bp, Homo sapiens
tcaggcaattgattgtgaat

SEQ ID NO: 3026173 - DNA, 20 bp, Homo sapiens
tcaggcagataactgctgta

SEQ ID NO: 3026174 - DNA, 17 bp, Homo sapiens
tcaggccagagccaagg

SEQ ID NO: 3026175 - DNA, 16 bp, Homo sapiens
tcaggcccggcagggc

SEQ ID NO: 3026176 - DNA, 17 bp, Homo sapiens
tcaggcccgtcggagct

SEQ ID NO: 3026177 - DNA, 19 bp, Homo sapiens
tcaggcccgtcggagctgc

SEQ ID NO: 3026178 - DNA, 22 bp, Homo sapiens
tcaggcccgtcggagctgcctg

SEQ ID NO: 3026179 - DNA, 23 bp, Homo sapiens
tcaggcccgtcggagctgcctgc

SEQ ID NO: 3026180 - DNA, 15 bp, Homo sapiens
tcaggccctcagctg

SEQ ID NO: 3026181 - DNA, 20 bp, Homo sapiens
tcaggccctctgcctgcact

SEQ ID NO: 3026182 - DNA, 16 bp, Homo sapiens
tcaggcggagctgctg

SEQ ID NO: 3026183 - DNA, 18 bp, Homo sapiens
tcaggctctgttcctcaa

SEQ ID NO: 3026184 - DNA, 24 bp, Homo sapiens
tcaggctgtcccaagctcccaaga

SEQ ID NO: 3026185 - DNA, 18 bp, Homo sapiens
tcaggcttcctggtgaga

SEQ ID NO: 3026186 - DNA, 22 bp, Homo sapiens
tcaggcttcctggtgagaactg

SEQ ID NO: 3026187 - DNA, 21 bp, Homo sapiens
tcagggaacatatttaaggaa

SEQ ID NO: 3026188 - DNA, 21 bp, Homo sapiens
tcagggacagagacacctgca

SEQ ID NO: 3026189 - DNA, 23 bp, Homo sapiens
tcagggacagagacacctgcacc

SEQ ID NO: 3026190 - DNA, 12 bp, Homo sapiens
tcagggacccct

SEQ ID NO: 3026191 - DNA, 17 bp, Homo sapiens
tcagggacccctgccct

SEQ ID NO: 3026192 - DNA, 15 bp, Homo sapiens
tcagggaggccctgt

SEQ ID NO: 3026193 - DNA, 22 bp, Homo sapiens
tcagggaggccctgtgcccctt

SEQ ID NO: 3026194 - DNA, 13 bp, Homo sapiens
tcagggaggggcc

SEQ ID NO: 3026195 - DNA, 18 bp, Homo sapiens
tcagggcagcccctgcag

SEQ ID NO: 3026196 - DNA, 19 bp, Homo sapiens
tcagggcagcccctgcaga

SEQ ID NO: 3026197 - DNA, 20 bp, Homo sapiens
tcagggcagcccctgcagac

SEQ ID NO: 3026198 - DNA, 14 bp, Homo sapiens
tcagggcagctgcc

SEQ ID NO: 3026199 - DNA, 15 bp, Homo sapiens
tcagggcagctgcct

SEQ ID NO: 3026200 - DNA, 12 bp, Homo sapiens
tcagggccagga

SEQ ID NO: 3026201 - DNA, 15 bp, Homo sapiens
tcaggggaagctgct

SEQ ID NO: 3026202 - DNA, 14 bp, Homo sapiens
tcaggggaagggca

SEQ ID NO: 3026203 - DNA, 20 bp, Homo sapiens
tcaggggacaaaccaggggt

SEQ ID NO: 3026204 - DNA, 15 bp, Homo sapiens
tcaggggacactggc

SEQ ID NO: 3026205 - DNA, 16 bp, Homo sapiens
tcaggggacactggcc

SEQ ID NO: 3026206 - DNA, 20 bp, Homo sapiens
tcaggggacactggccccac

SEQ ID NO: 3026207 - DNA, 14 bp, Homo sapiens
tcaggggatgttta

SEQ ID NO: 3026208 - DNA, 16 bp, Homo sapiens
tcaggggtcaggtgtc

SEQ ID NO: 3026209 - DNA, 23 bp, Homo sapiens
tcaggggtcaggtgtcaggcccg

SEQ ID NO: 3026210 - DNA, 14 bp, Homo sapiens
tcaggggtgacaca

SEQ ID NO: 3026211 - DNA, 18 bp, Homo sapiens
tcaggggtgacacagact

SEQ ID NO: 3026212 - DNA, 19 bp, Homo sapiens
tcaggggtgacacagactc

SEQ ID NO: 3026213 - DNA, 13 bp, Homo sapiens
tcaggggtgcaca

SEQ ID NO: 3026214 - DNA, 16 bp, Homo sapiens
tcagggtgatgccagg

SEQ ID NO: 3026215 - DNA, 14 bp, Homo sapiens
tcaggtacttgtaa

SEQ ID NO: 3026216 - DNA, 19 bp, Homo sapiens
tcaggtagttgcaattgaa

SEQ ID NO: 3026217 - DNA, 21 bp, Homo sapiens
tcaggtatgttgcctttatgg

SEQ ID NO: 3026218 - DNA, 23 bp, Homo sapiens
tcaggtcacataaaactttgtat

SEQ ID NO: 3026219 - DNA, 21 bp, Homo sapiens
tcaggtgaataataaaatcaa

SEQ ID NO: 3026220 - DNA, 23 bp, Homo sapiens
tcaggtgaataataaaatcaaaa

SEQ ID NO: 3026221 - DNA, 22 bp, Homo sapiens
tcaggtgcacacatcaccaggt

SEQ ID NO: 3026222 - DNA, 15 bp, Homo sapiens
tcaggtgcagaggaa

SEQ ID NO: 3026223 - DNA, 15 bp, Homo sapiens
tcaggtggaccctgt

SEQ ID NO: 3026224 - DNA, 18 bp, Homo sapiens
tcaggtggaccctgtaaa

SEQ ID NO: 3026225 - DNA, 19 bp, Homo sapiens
tcaggtggaccctgtaaat

SEQ ID NO: 3026226 - DNA, 22 bp, Homo sapiens
tcaggtggggtggagtcccaga

SEQ ID NO: 3026227 - DNA, 20 bp, Homo sapiens
tcaggtggtgtccttcttcc

SEQ ID NO: 3026228 - DNA, 14 bp, Homo sapiens
tcaggttgttggtg

SEQ ID NO: 3026229 - DNA, 23 bp, Homo sapiens
tcaggtttggtttttttgtacaa

SEQ ID NO: 3026230 - DNA, 17 bp, Homo sapiens
tcagtaagtataacaaa

SEQ ID NO: 3026231 - DNA, 21 bp, Homo sapiens
tcagtaatgctaaatgtgtaa

SEQ ID NO: 3026232 - DNA, 13 bp, Homo sapiens
tcagtaatgtctt

SEQ ID NO: 3026233 - DNA, 19 bp, Homo sapiens
tcagtaatttttagaagca

SEQ ID NO: 3026234 - DNA, 21 bp, Homo sapiens
tcagtacctgtgttgagaaaa

SEQ ID NO: 3026235 - DNA, 17 bp, Homo sapiens
tcagtagcatctcagtg

SEQ ID NO: 3026236 - DNA, 17 bp, Homo sapiens
tcagtatccatgctctt

SEQ ID NO: 3026237 - DNA, 20 bp, Homo sapiens
tcagtatccatgctcttgac

SEQ ID NO: 3026238 - DNA, 20 bp, Homo sapiens
tcagtatgttttacactgta

SEQ ID NO: 3026239 - DNA, 19 bp, Homo sapiens
tcagtattaaactctcctt

SEQ ID NO: 3026240 - DNA, 14 bp, Homo sapiens
tcagtatttttcct

SEQ ID NO: 3026241 - DNA, 14 bp, Homo sapiens
tcagtcccaaagcg

SEQ ID NO: 3026242 - DNA, 22 bp, Homo sapiens
tcagtcccaaagcggccgatgg

SEQ ID NO: 3026243 - DNA, 13 bp, Homo sapiens
tcagtccctatgt

SEQ ID NO: 3026244 - DNA, 23 bp, Homo sapiens
tcagtccctatgtatttgcagtt

SEQ ID NO: 3026245 - DNA, 13 bp, Homo sapiens
tcagtccctgagc

SEQ ID NO: 3026246 - DNA, 15 bp, Homo sapiens
tcagtcgccctgttc

SEQ ID NO: 3026247 - DNA, 15 bp, Homo sapiens
tcagtctctgagcag

SEQ ID NO: 3026248 - DNA, 17 bp, Homo sapiens
tcagtctctgagcagtg

SEQ ID NO: 3026249 - DNA, 21 bp, Homo sapiens
tcagtctgttcactgcattca

SEQ ID NO: 3026250 - DNA, 14 bp, Homo sapiens
tcagtgaaggccca

SEQ ID NO: 3026251 - DNA, 17 bp, Homo sapiens
tcagtgactgaaaccat

SEQ ID NO: 3026252 - DNA, 19 bp, Homo sapiens
tcagtgactgaaaccattt

SEQ ID NO: 3026253 - DNA, 16 bp, Homo sapiens
tcagtgagtaaataga

SEQ ID NO: 3026254 - DNA, 17 bp, Homo sapiens
tcagtgatggcaacact

SEQ ID NO: 3026255 - DNA, 17 bp, Homo sapiens
tcagtgcaaaatgtctt

SEQ ID NO: 3026256 - DNA, 21 bp, Homo sapiens
tcagtgcaaaatgtcttgtgt

SEQ ID NO: 3026257 - DNA, 22 bp, Homo sapiens
tcagtgcaaaatgtcttgtgta

SEQ ID NO: 3026258 - DNA, 20 bp, Homo sapiens
tcagtgcacctgcctcagct

SEQ ID NO: 3026259 - DNA, 23 bp, Homo sapiens
tcagtgcatccccacgacccctg

SEQ ID NO: 3026260 - DNA, 14 bp, Homo sapiens
tcagtgcatttgtg

SEQ ID NO: 3026261 - DNA, 16 bp, Homo sapiens
tcagtgcatttgtgct

SEQ ID NO: 3026262 - DNA, 18 bp, Homo sapiens
tcagtgccaactgtggct

SEQ ID NO: 3026263 - DNA, 13 bp, Homo sapiens
tcagtgccagccc

SEQ ID NO: 3026264 - DNA, 9 bp, Homo sapiens
tcagtgccc

SEQ ID NO: 3026265 - DNA, 16 bp, Homo sapiens
tcagtgcccaactgtt

SEQ ID NO: 3026266 - DNA, 20 bp, Homo sapiens
tcagtgccttctctcagctc

SEQ ID NO: 3026267 - DNA, 22 bp, Homo sapiens
tccatgggcagagcccaaggga

SEQ ID NO: 3026268 - DNA, 21 bp, Homo sapiens
tccatggtcctgtctgtcctt

SEQ ID NO: 3026269 - DNA, 15 bp, Homo sapiens
tccatggttctcaat

SEQ ID NO: 3026270 - DNA, 14 bp, Homo sapiens
tccatgtagcagga

SEQ ID NO: 3026271 - DNA, 16 bp, Homo sapiens
tccatgtcccctccca

SEQ ID NO: 3026272 - DNA, 17 bp, Homo sapiens
tccatgtcccctcccag

SEQ ID NO: 3026273 - DNA, 18 bp, Homo sapiens
tccatgtcccctcccaga

SEQ ID NO: 3026274 - DNA, 16 bp, Homo sapiens
tccatgtgttttgctt

SEQ ID NO: 3026275 - DNA, 19 bp, Homo sapiens
tccatgtgttttgctttta

SEQ ID NO: 3026276 - DNA, 19 bp, Homo sapiens
tccatgttggtcaggctgg

SEQ ID NO: 3026277 - DNA, 11 bp, Homo sapiens
tccatgtttta

SEQ ID NO: 3026278 - DNA, 13 bp, Homo sapiens
tccattaattaat

SEQ ID NO: 3026279 - DNA, 22 bp, Homo sapiens
tccattatttgagtttgacatt

SEQ ID NO: 3026280 - DNA, 22 bp, Homo sapiens
tccattcacagttctttgggcc

SEQ ID NO: 3026281 - DNA, 13 bp, Homo sapiens
tccattcctcagg

SEQ ID NO: 3026282 - DNA, 15 bp, Homo sapiens
tccattcctcaggga

SEQ ID NO: 3026283 - DNA, 21 bp, Homo sapiens
tccattcttggcatctactct

SEQ ID NO: 3026284 - DNA, 13 bp, Homo sapiens
tccattctttctt

SEQ ID NO: 3026285 - DNA, 15 bp, Homo sapiens
tccattctttcttcc

SEQ ID NO: 3026286 - DNA, 16 bp, Homo sapiens
tccattggatctcatt

SEQ ID NO: 3026287 - DNA, 18 bp, Homo sapiens
tccattggtccaagattc

SEQ ID NO: 3026288 - DNA, 23 bp, Homo sapiens
tccattgtaaaccacaaggctgt

SEQ ID NO: 3026289 - DNA, 18 bp, Homo sapiens
tccatttcccacatcttt

SEQ ID NO: 3026290 - DNA, 14 bp, Homo sapiens
tccatttcccctct

SEQ ID NO: 3026291 - DNA, 14 bp, Homo sapiens
tccatttctcatgt

SEQ ID NO: 3026292 - DNA, 17 bp, Homo sapiens
tccatttctcatgtttt

SEQ ID NO: 3026293 - DNA, 14 bp, Homo sapiens
tccatttgaaagaa

SEQ ID NO: 3026294 - DNA, 13 bp, Homo sapiens
tccatttggcaga

SEQ ID NO: 3026295 - DNA, 19 bp, Homo sapiens
tccatttggcagaactgct

SEQ ID NO: 3026296 - DNA, 22 bp, Homo sapiens
tccatttggcagaactgctggg

SEQ ID NO: 3026297 - DNA, 20 bp, Homo sapiens
tccattttacgttttagaaa

SEQ ID NO: 3026298 - DNA, 16 bp, Homo sapiens
tccattttcactaaaa

SEQ ID NO: 3026299 - DNA, 14 bp, Homo sapiens
tccattttgtgaag

SEQ ID NO: 3026300 - DNA, 20 bp, Homo sapiens
tccattttgtgaagccctgt

SEQ ID NO: 3026301 - DNA, 24 bp, Homo sapiens
tcccaaacgccctttcctcctcag

SEQ ID NO: 3026302 - DNA, 21 bp, Homo sapiens
tcccaaagtgctgggattaca

SEQ ID NO: 3026303 - DNA, 19 bp, Homo sapiens
tcccaaatccttcccaagt

SEQ ID NO: 3026304 - DNA, 17 bp, Homo sapiens
tcccaaatttgattgat

SEQ ID NO: 3026305 - DNA, 20 bp, Homo sapiens
tcccaaatttgattgatttg

SEQ ID NO: 3026306 - DNA, 14 bp, Homo sapiens
tcccaacaagcaag

SEQ ID NO: 3026307 - DNA, 11 bp, Homo sapiens
tcccaacagga

SEQ ID NO: 3026308 - DNA, 19 bp, Homo sapiens
tcccaacaggaggacaatt

SEQ ID NO: 3026309 - DNA, 20 bp, Homo sapiens
tcccaacaggaggacaattc

SEQ ID NO: 3026310 - DNA, 19 bp, Homo sapiens
tcccaactcccttctgctt

SEQ ID NO: 3026311 - DNA, 21 bp, Homo sapiens
tcccaactcccttctgcttgt

SEQ ID NO: 3026312 - DNA, 20 bp, Homo sapiens
tcccaagaagagagaacttt

SEQ ID NO: 3026313 - DNA, 14 bp, Homo sapiens
tcccaagatgttga

SEQ ID NO: 3026314 - DNA, 23 bp, Homo sapiens
tcccaagatgttgatttttactg

SEQ ID NO: 3026315 - DNA, 14 bp, Homo sapiens
tcccaagccttcgg

SEQ ID NO: 3026316 - DNA, 15 bp, Homo sapiens
tcccaagctcccaag

SEQ ID NO: 3026317 - DNA, 19 bp, Homo sapiens
tcccaagctcccaagagct

SEQ ID NO: 3026318 - DNA, 18 bp, Homo sapiens
tcccaaggacttccacat

SEQ ID NO: 3026319 - DNA, 22 bp, Homo sapiens
tcccaaggacttccacattttt

SEQ ID NO: 3026320 - DNA, 21 bp, Homo sapiens
tcccaaggtacagctgtatat

SEQ ID NO: 3026321 - DNA, 21 bp, Homo sapiens
tcccaaggtgaaatgaagcaa

SEQ ID NO: 3026322 - DNA, 23 bp, Homo sapiens
tcccaagtaagaggctggagttg

SEQ ID NO: 3026323 - DNA, 22 bp, Homo sapiens
tcccaatagcaacgtagcttct

SEQ ID NO: 3026324 - DNA, 21 bp, Homo sapiens
tcccaatctcaatacagcctg

SEQ ID NO: 3026325 - DNA, 21 bp, Homo sapiens
tcccaatggtgtttttcttgt

SEQ ID NO: 3026326 - DNA, 15 bp, Homo sapiens
tcccaattcacatct

SEQ ID NO: 3026327 - DNA, 23 bp, Homo sapiens
tcccaatttcagactcccattcc

SEQ ID NO: 3026328 - DNA, 14 bp, Homo sapiens
tcccacaagcctgc

SEQ ID NO: 3026329 - DNA, 17 bp, Homo sapiens
tcccacacaagacccaa

SEQ ID NO: 3026330 - DNA, 17 bp, Homo sapiens
tcccacacccaaagctg

SEQ ID NO: 3026331 - DNA, 13 bp, Homo sapiens
tcccacacctgcc

SEQ ID NO: 3026332 - DNA, 21 bp, Homo sapiens
tcccacacttgtgccagcccg

SEQ ID NO: 3026333 - DNA, 11 bp, Homo sapiens
tcccacagccc

SEQ ID NO: 3026334 - DNA, 13 bp, Homo sapiens
tcccacagcgctg

SEQ ID NO: 3026335 - DNA, 18 bp, Homo sapiens
tcccacaggacatttctc

SEQ ID NO: 3026336 - DNA, 16 bp, Homo sapiens
tcccacatcccactgg

SEQ ID NO: 3026337 - DNA, 22 bp, Homo sapiens
tcccacccacatgtgacacata

SEQ ID NO: 3026338 - DNA, 20 bp, Homo sapiens
tcccaccccacccccttcag

SEQ ID NO: 3026339 - DNA, 22 bp, Homo sapiens
tcccaccccacccccttcagtg

SEQ ID NO: 3026340 - DNA, 20 bp, Homo sapiens
tcccaccccattttctgtgg

SEQ ID NO: 3026341 - DNA, 22 bp, Homo sapiens
tcccaccccattttctgtgggc

SEQ ID NO: 3026342 - DNA, 23 bp, Homo sapiens
tcccaccccttcataccgcctcg

SEQ ID NO: 3026343 - DNA, 15 bp, Homo sapiens
tcccaccctaagggc

SEQ ID NO: 3026344 - DNA, 17 bp, Homo sapiens
tcccaccctaagggcag

SEQ ID NO: 3026345 - DNA, 21 bp, Homo sapiens
tcccaccctaagggcagccct

SEQ ID NO: 3026346 - DNA, 17 bp, Homo sapiens
tcccacctccatcccag

SEQ ID NO: 3026347 - DNA, 20 bp, Homo sapiens
tcccacctttcgggccatgt

SEQ ID NO: 3026348 - DNA, 23 bp, Homo sapiens
tcccacggggaccactgggcccc

SEQ ID NO: 3026349 - DNA, 15 bp, Homo sapiens
tcccactatctgggt

SEQ ID NO: 3026350 - DNA, 13 bp, Homo sapiens
tcccactcctaat

SEQ ID NO: 3026351 - DNA, 15 bp, Homo sapiens
tcccactgcactcca

SEQ ID NO: 3026352 - DNA, 18 bp, Homo sapiens
tcccactgcactccagcc

SEQ ID NO: 3026353 - DNA, 21 bp, Homo sapiens
tcccactgcactccagcctga

SEQ ID NO: 3026354 - DNA, 12 bp, Homo sapiens
tcccactgccag

SEQ ID NO: 3026355 - DNA, 23 bp, Homo sapiens
tcccactgccaggattttgtatt

SEQ ID NO: 3026356 - DNA, 22 bp, Homo sapiens
tcccactggggtccagggagca

SEQ ID NO: 3026357 - DNA, 13 bp, Homo sapiens
tcccactgtatga

SEQ ID NO: 3026358 - DNA, 16 bp, Homo sapiens
tcccacttctcatctt

SEQ ID NO: 3026359 - DNA, 17 bp, Homo sapiens
tcccacttggaggcctt

SEQ ID NO: 3026360 - DNA, 20 bp, Homo sapiens
tcccactttcttctaccaga

SEQ ID NO: 3026361 - DNA, 23 bp, Homo sapiens
tcccactttttggtaatatatat

SEQ ID NO: 3026362 - DNA, 17 bp, Homo sapiens
tcccagaacacactcca

SEQ ID NO: 3026363 - DNA, 19 bp, Homo sapiens
tcccagacaaggagagcgg

SEQ ID NO: 3026364 - DNA, 14 bp, Homo sapiens
tcccagacttgttt

SEQ ID NO: 3026365 - DNA, 19 bp, Homo sapiens
tcccagacttgtttcctgt

SEQ ID NO: 3026366 - DNA, 16 bp, Homo sapiens
tcccagagacaggaaa

SEQ ID NO: 3026367 - DNA, 16 bp, Homo sapiens
tcccagaggctgcccc

SEQ ID NO: 3026368 - DNA, 21 bp, Homo sapiens
tcccagcaggaatttcttttt

SEQ ID NO: 3026369 - DNA, 16 bp, Homo sapiens
tcccagcccaatccag

SEQ ID NO: 3026370 - DNA, 18 bp, Homo sapiens
tcccagcccaatccaggt

SEQ ID NO: 3026371 - DNA, 19 bp, Homo sapiens
tcccagcgagccacaggaa

SEQ ID NO: 3026372 - DNA, 16 bp, Homo sapiens
tcccagctacaccttt

SEQ ID NO: 3026373 - DNA, 14 bp, Homo sapiens
tcccagctactcag

SEQ ID NO: 3026374 - DNA, 22 bp, Homo sapiens
tcccagctactggggaggctga

SEQ ID NO: 3026375 - DNA, 18 bp, Homo sapiens
tcccagctacttgggagc

SEQ ID NO: 3026376 - DNA, 18 bp, Homo sapiens
tcccagctttaaaaagaa

SEQ ID NO: 3026377 - DNA, 14 bp, Homo sapiens
tcccaggaagcagg

SEQ ID NO: 3026378 - DNA, 18 bp, Homo sapiens
tcccaggaatatccagtg

SEQ ID NO: 3026379 - DNA, 14 bp, Homo sapiens
tcccaggaccctga

SEQ ID NO: 3026380 - DNA, 21 bp, Homo sapiens
tcccaggacctcggatgacca

SEQ ID NO: 3026381 - DNA, 10 bp, Homo sapiens
tcccaggacg

SEQ ID NO: 3026382 - DNA, 16 bp, Homo sapiens
tcccaggactcaccct

SEQ ID NO: 3026383 - DNA, 18 bp, Homo sapiens
tcccaggactcaccctcc

SEQ ID NO: 3026384 - DNA, 15 bp, Homo sapiens
tcccaggcagggaga

SEQ ID NO: 3026385 - DNA, 14 bp, Homo sapiens
tcccaggccagggc

SEQ ID NO: 3026386 - DNA, 17 bp, Homo sapiens
tcccaggccagggctgg

SEQ ID NO: 3026387 - DNA, 22 bp, Homo sapiens
tcccaggggcagccacaccact

SEQ ID NO: 3026388 - DNA, 22 bp, Homo sapiens
tcccaggtgttaacattccaag

SEQ ID NO: 3026389 - DNA, 19 bp, Homo sapiens
tcccagtagccaaggcccg

SEQ ID NO: 3026390 - DNA, 14 bp, Homo sapiens
tcccagtgggctgt

SEQ ID NO: 3026391 - DNA, 15 bp, Homo sapiens
tcccataagctatag

SEQ ID NO: 3026392 - DNA, 13 bp, Homo sapiens
tcccatatttact

SEQ ID NO: 3026393 - DNA, 21 bp, Homo sapiens
tcccatcaaagaaccttgaag

SEQ ID NO: 3026394 - DNA, 20 bp, Homo sapiens
tcccatcacgtgtactggct

SEQ ID NO: 3026395 - DNA, 23 bp, Homo sapiens
tcccatcacgtgtactggctcct

SEQ ID NO: 3026396 - DNA, 22 bp, Homo sapiens
tcccatcactggagcaccaggc

SEQ ID NO: 3026397 - DNA, 15 bp, Homo sapiens
tcccatcagggaaga

SEQ ID NO: 3026398 - DNA, 16 bp, Homo sapiens
tcctccctccctccct

SEQ ID NO: 3026399 - DNA, 14 bp, Homo sapiens
tcctccctcctcac

SEQ ID NO: 3026400 - DNA, 10 bp, Homo sapiens
tcctccctct

SEQ ID NO: 3026401 - DNA, 13 bp, Homo sapiens
tcctccctctgcc

SEQ ID NO: 3026402 - DNA, 22 bp, Homo sapiens
tcctccctgcatctgaccagca

SEQ ID NO: 3026403 - DNA, 13 bp, Homo sapiens
tcctccctgcctc

SEQ ID NO: 3026404 - DNA, 20 bp, Homo sapiens
tcctccctggctgcagcctc

SEQ ID NO: 3026405 - DNA, 14 bp, Homo sapiens
tcctcccttctgct

SEQ ID NO: 3026406 - DNA, 17 bp, Homo sapiens
tcctcccttctgctact

SEQ ID NO: 3026407 - DNA, 13 bp, Homo sapiens
tcctcctacctca

SEQ ID NO: 3026408 - DNA, 14 bp, Homo sapiens
tcctcctacctcag

SEQ ID NO: 3026409 - DNA, 20 bp, Homo sapiens
tcctcctcccagtgccttct

SEQ ID NO: 3026410 - DNA, 14 bp, Homo sapiens
tcctcctccctgca

SEQ ID NO: 3026411 - DNA, 18 bp, Homo sapiens
tcctcctccctgcatctg

SEQ ID NO: 3026412 - DNA, 13 bp, Homo sapiens
tcctcctcctggg

SEQ ID NO: 3026413 - DNA, 14 bp, Homo sapiens
tcctcctctacctc

SEQ ID NO: 3026414 - DNA, 14 bp, Homo sapiens
tcctcctctccatg

SEQ ID NO: 3026415 - DNA, 17 bp, Homo sapiens
tcctcctctccatgcaa

SEQ ID NO: 3026416 - DNA, 11 bp, Homo sapiens
tcctcctctgt

SEQ ID NO: 3026417 - DNA, 16 bp, Homo sapiens
tcctcctgactcttca

SEQ ID NO: 3026418 - DNA, 20 bp, Homo sapiens
tcctcctgggccctctctgc

SEQ ID NO: 3026419 - DNA, 14 bp, Homo sapiens
tcctccttgggcag

SEQ ID NO: 3026420 - DNA, 16 bp, Homo sapiens
tcctccttgggcaggg

SEQ ID NO: 3026421 - DNA, 11 bp, Homo sapiens
tcctcctttct

SEQ ID NO: 3026422 - DNA, 13 bp, Homo sapiens
tcctcctttctct

SEQ ID NO: 3026423 - DNA, 23 bp, Homo sapiens
tcctcgagatcccaacactgcca

SEQ ID NO: 3026424 - DNA, 17 bp, Homo sapiens
tcctcggacacccaggg

SEQ ID NO: 3026425 - DNA, 19 bp, Homo sapiens
tcctcggatcaccgagagt

SEQ ID NO: 3026426 - DNA, 18 bp, Homo sapiens
tcctcggtttcccatttg

SEQ ID NO: 3026427 - DNA, 19 bp, Homo sapiens
tcctcggtttcccatttgt

SEQ ID NO: 3026428 - DNA, 22 bp, Homo sapiens
tcctctacctctctcctctccg

SEQ ID NO: 3026429 - DNA, 17 bp, Homo sapiens
tcctctactaacaatca

SEQ ID NO: 3026430 - DNA, 18 bp, Homo sapiens
tcctctactaacaatcag

SEQ ID NO: 3026431 - DNA, 14 bp, Homo sapiens
tcctctatcttcca

SEQ ID NO: 3026432 - DNA, 14 bp, Homo sapiens
tcctctatttcttt

SEQ ID NO: 3026433 - DNA, 19 bp, Homo sapiens
tcctctcaactgcctcagc

SEQ ID NO: 3026434 - DNA, 14 bp, Homo sapiens
tcctctcagcttct

SEQ ID NO: 3026435 - DNA, 14 bp, Homo sapiens
tcctctccatgcaa

SEQ ID NO: 3026436 - DNA, 16 bp, Homo sapiens
tcctctccatgcaagt

SEQ ID NO: 3026437 - DNA, 22 bp, Homo sapiens
tcctctccatgcaagtgctgtt

SEQ ID NO: 3026438 - DNA, 20 bp, Homo sapiens
tcctctcccattgtccctct

SEQ ID NO: 3026439 - DNA, 15 bp, Homo sapiens
tcctctccccagccc

SEQ ID NO: 3026440 - DNA, 20 bp, Homo sapiens
tcctctccccagcccagaga

SEQ ID NO: 3026441 - DNA, 21 bp, Homo sapiens
tcctctccccagcccagagac

SEQ ID NO: 3026442 - DNA, 11 bp, Homo sapiens
tcctctccctt

SEQ ID NO: 3026443 - DNA, 15 bp, Homo sapiens
tcctctcccttccct

SEQ ID NO: 3026444 - DNA, 18 bp, Homo sapiens
tcctctcccttcccttcc

SEQ ID NO: 3026445 - DNA, 16 bp, Homo sapiens
tcctctccgcgccctc

SEQ ID NO: 3026446 - DNA, 14 bp, Homo sapiens
tcctctctccctgc

SEQ ID NO: 3026447 - DNA, 18 bp, Homo sapiens
tcctctctccctgcctca

SEQ ID NO: 3026448 - DNA, 12 bp, Homo sapiens
tcctctgaaaca

SEQ ID NO: 3026449 - DNA, 19 bp, Homo sapiens
tcctctgaaacagctgcct

SEQ ID NO: 3026450 - DNA, 20 bp, Homo sapiens
tcctctgaaacagctgcctt

SEQ ID NO: 3026451 - DNA, 15 bp, Homo sapiens
tcctctgaatattaa

SEQ ID NO: 3026452 - DNA, 12 bp, Homo sapiens
tcctctgccacc

SEQ ID NO: 3026453 - DNA, 22 bp, Homo sapiens
tcctctgcccgggagctcagga

SEQ ID NO: 3026454 - DNA, 11 bp, Homo sapiens
tcctctgcctc

SEQ ID NO: 3026455 - DNA, 19 bp, Homo sapiens
tcctctgtgaccaatgtct

SEQ ID NO: 3026456 - DNA, 20 bp, Homo sapiens
tcctctgtgaccaatgtctt

SEQ ID NO: 3026457 - DNA, 21 bp, Homo sapiens
tcctctgtgaccaatgtcttg

SEQ ID NO: 3026458 - DNA, 13 bp, Homo sapiens
tcctctgtggtgt

SEQ ID NO: 3026459 - DNA, 21 bp, Homo sapiens
tcctctgtggtgtctgcctgt

SEQ ID NO: 3026460 - DNA, 14 bp, Homo sapiens
tcctcttagcctct

SEQ ID NO: 3026461 - DNA, 16 bp, Homo sapiens
tcctcttagcctctgg

SEQ ID NO: 3026462 - DNA, 18 bp, Homo sapiens
tcctcttattcctttaaa

SEQ ID NO: 3026463 - DNA, 17 bp, Homo sapiens
tcctcttctgcatcttg

SEQ ID NO: 3026464 - DNA, 18 bp, Homo sapiens
tcctctttgaacatggtc

SEQ ID NO: 3026465 - DNA, 18 bp, Homo sapiens
tcctgaaagcattatttt

SEQ ID NO: 3026466 - DNA, 22 bp, Homo sapiens
tcctgaaatgccaagtgcctgc

SEQ ID NO: 3026467 - DNA, 23 bp, Homo sapiens
tcctgaacagcatggcactccct

SEQ ID NO: 3026468 - DNA, 13 bp, Homo sapiens
tcctgaagaacca

SEQ ID NO: 3026469 - DNA, 16 bp, Homo sapiens
tcctgaagaaccagtc

SEQ ID NO: 3026470 - DNA, 19 bp, Homo sapiens
tcctgaagctgctggagcc

SEQ ID NO: 3026471 - DNA, 23 bp, Homo sapiens
tcctgaatggctttgtcttgaaa

SEQ ID NO: 3026472 - DNA, 15 bp, Homo sapiens
tcctgacagcactcc

SEQ ID NO: 3026473 - DNA, 15 bp, Homo sapiens
tcctgacattgtctc

SEQ ID NO: 3026474 - DNA, 23 bp, Homo sapiens
tcctgacccggattggccctgcc

SEQ ID NO: 3026475 - DNA, 23 bp, Homo sapiens
tcctgacctgcgggtcctcagct

SEQ ID NO: 3026476 - DNA, 23 bp, Homo sapiens
tcctgactgggctgggtttgctg

SEQ ID NO: 3026477 - DNA, 17 bp, Homo sapiens
tcctgacttgagtgttc

SEQ ID NO: 3026478 - DNA, 21 bp, Homo sapiens
tcctgagaaacgtccatctct

SEQ ID NO: 3026479 - DNA, 22 bp, Homo sapiens
tcctgagaaacgtccatctctc

SEQ ID NO: 3026480 - DNA, 23 bp, Homo sapiens
tcctgagaaacgtccatctctct

SEQ ID NO: 3026481 - DNA, 18 bp, Homo sapiens
tcctgagaaagcccacct

SEQ ID NO: 3026482 - DNA, 22 bp, Homo sapiens
tcctgagaaagcccacctgggc

SEQ ID NO: 3026483 - DNA, 19 bp, Homo sapiens
tcctgagcagtccctgctt

SEQ ID NO: 3026484 - DNA, 13 bp, Homo sapiens
tcctgagctagga

SEQ ID NO: 3026485 - DNA, 24 bp, Homo sapiens
tcctgatatgatttaaaacatgta

SEQ ID NO: 3026486 - DNA, 17 bp, Homo sapiens
tcctgatgatttttatt

SEQ ID NO: 3026487 - DNA, 11 bp, Homo sapiens
tcctgcaaagt

SEQ ID NO: 3026488 - DNA, 17 bp, Homo sapiens
tcctgcacagattccca

SEQ ID NO: 3026489 - DNA, 22 bp, Homo sapiens
tcctgcacagattcccaggcca

SEQ ID NO: 3026490 - DNA, 23 bp, Homo sapiens
tcctgcacagattcccaggccag

SEQ ID NO: 3026491 - DNA, 14 bp, Homo sapiens
tcctgcaggccagg

SEQ ID NO: 3026492 - DNA, 13 bp, Homo sapiens
tcctgcatgtgta

SEQ ID NO: 3026493 - DNA, 19 bp, Homo sapiens
tcctgccacattagaactt

SEQ ID NO: 3026494 - DNA, 20 bp, Homo sapiens
tcctgccacattagaacttc

SEQ ID NO: 3026495 - DNA, 11 bp, Homo sapiens
tcctgccagcc

SEQ ID NO: 3026496 - DNA, 13 bp, Homo sapiens
tcctgccagcccg

SEQ ID NO: 3026497 - DNA, 15 bp, Homo sapiens
tcctgccagctctgt

SEQ ID NO: 3026498 - DNA, 15 bp, Homo sapiens
tcctgcccagccacc

SEQ ID NO: 3026499 - DNA, 17 bp, Homo sapiens
tcctgcccagcctgggg

SEQ ID NO: 3026500 - DNA, 23 bp, Homo sapiens
tcctgcccaggagagccagccct

SEQ ID NO: 3026501 - DNA, 11 bp, Homo sapiens
tcctgccccca

SEQ ID NO: 3026502 - DNA, 22 bp, Homo sapiens
tcctgccgcccgaggtggctgc

SEQ ID NO: 3026503 - DNA, 17 bp, Homo sapiens
tcctgccggagaggaag

SEQ ID NO: 3026504 - DNA, 19 bp, Homo sapiens
tcctgccggagaggaagag

SEQ ID NO: 3026505 - DNA, 14 bp, Homo sapiens
tcctgcctgcagta

SEQ ID NO: 3026506 - DNA, 19 bp, Homo sapiens
tcctgccttcctcctgggc

SEQ ID NO: 3026507 - DNA, 19 bp, Homo sapiens
tcctgccttggcctcccaa

SEQ ID NO: 3026508 - DNA, 11 bp, Homo sapiens
tcctgcctttg

SEQ ID NO: 3026509 - DNA, 14 bp, Homo sapiens
tcctgcctttgcct

SEQ ID NO: 3026510 - DNA, 15 bp, Homo sapiens
tcctgcctttgcctc

SEQ ID NO: 3026511 - DNA, 18 bp, Homo sapiens
tcctgcctttgcctccag

SEQ ID NO: 3026512 - DNA, 14 bp, Homo sapiens
tcctgcgcctgcct

SEQ ID NO: 3026513 - DNA, 23 bp, Homo sapiens
tcctgcgggcttttccccggtcc

SEQ ID NO: 3026514 - DNA, 18 bp, Homo sapiens
tcctgctaagttaatgtt

SEQ ID NO: 3026515 - DNA, 23 bp, Homo sapiens
tcctgctagcaggccccctagga

SEQ ID NO: 3026516 - DNA, 14 bp, Homo sapiens
tcctgctccgctgc

SEQ ID NO: 3026517 - DNA, 16 bp, Homo sapiens
tcctgctccgctgcct

SEQ ID NO: 3026518 - DNA, 22 bp, Homo sapiens
tcctgctccgctgcctggaaca

SEQ ID NO: 3026519 - DNA, 13 bp, Homo sapiens
tcctgctgctttg

SEQ ID NO: 3026520 - DNA, 15 bp, Homo sapiens
tcctgctggcctgct

SEQ ID NO: 3026521 - DNA, 16 bp, Homo sapiens
tcctgctggcctgctc

SEQ ID NO: 3026522 - DNA, 21 bp, Homo sapiens
tcctgctggcctgctcttact

SEQ ID NO: 3026523 - DNA, 21 bp, Homo sapiens
tcctgcttgtactaagccagg

SEQ ID NO: 3026524 - DNA, 23 bp, Homo sapiens
tcctgcttgtactaagccaggag

SEQ ID NO: 3026525 - DNA, 24 bp, Homo sapiens
tcctgctttacaggatcatgtaaa

SEQ ID NO: 3026526 - DNA, 15 bp, Homo sapiens
tcctgctttctcttt

SEQ ID NO: 3026527 - DNA, 21 bp, Homo sapiens
tcctggaagtcaaataaatgt

SEQ ID NO: 3026528 - DNA, 22 bp, Homo sapiens
tcctggacatgaagattctttc

SEQ ID NO: 3026529 - DNA, 20 bp, Homo sapiens
tcctggaccttgacagagca

SEQ ID NO: 3026530 - DNA, 17 bp, Homo sapiens
tctcaggccagagccaa

SEQ ID NO: 3026531 - DNA, 22 bp, Homo sapiens
tctcaggtagaaggttgacaca

SEQ ID NO: 3026532 - DNA, 13 bp, Homo sapiens
tctcaggtccagc

SEQ ID NO: 3026533 - DNA, 18 bp, Homo sapiens
tctcagtctctgagcagt

SEQ ID NO: 3026534 - DNA, 21 bp, Homo sapiens
tctcagtgccaactgtggctg

SEQ ID NO: 3026535 - DNA, 14 bp, Homo sapiens
tctcagtgccttct

SEQ ID NO: 3026536 - DNA, 18 bp, Homo sapiens
tctcagtgccttctctca

SEQ ID NO: 3026537 - DNA, 19 bp, Homo sapiens
tctcagtgccttctctcag

SEQ ID NO: 3026538 - DNA, 17 bp, Homo sapiens
tctcagtggtgtgtgaa

SEQ ID NO: 3026539 - DNA, 19 bp, Homo sapiens
tctcagtggtgtgtgaagt

SEQ ID NO: 3026540 - DNA, 15 bp, Homo sapiens
tctcagtgttttgga

SEQ ID NO: 3026541 - DNA, 23 bp, Homo sapiens
tctcagtgttttggactccatct

SEQ ID NO: 3026542 - DNA, 10 bp, Homo sapiens
tctcagtttt

SEQ ID NO: 3026543 - DNA, 15 bp, Homo sapiens
tctcatatcactgaa

SEQ ID NO: 3026544 - DNA, 15 bp, Homo sapiens
tctcatatctaactt

SEQ ID NO: 3026545 - DNA, 20 bp, Homo sapiens
tctcatcaacttaaaagtca

SEQ ID NO: 3026546 - DNA, 12 bp, Homo sapiens
tctcatcacaca

SEQ ID NO: 3026547 - DNA, 13 bp, Homo sapiens
tctcatccatcat

SEQ ID NO: 3026548 - DNA, 21 bp, Homo sapiens
tctcatcctccagtaccttgc

SEQ ID NO: 3026549 - DNA, 18 bp, Homo sapiens
tctcatcgtcttttagtt

SEQ ID NO: 3026550 - DNA, 21 bp, Homo sapiens
tctcatgggaaggggaggacc

SEQ ID NO: 3026551 - DNA, 16 bp, Homo sapiens
tctcattccccaggtg

SEQ ID NO: 3026552 - DNA, 16 bp, Homo sapiens
tctcattcctgttctt

SEQ ID NO: 3026553 - DNA, 20 bp, Homo sapiens
tctcattggacccttccatg

SEQ ID NO: 3026554 - DNA, 14 bp, Homo sapiens
tctcattttgtcca

SEQ ID NO: 3026555 - DNA, 21 bp, Homo sapiens
tctccaagaatggaagcctga

SEQ ID NO: 3026556 - DNA, 22 bp, Homo sapiens
tctccacaacactgtgtcacat

SEQ ID NO: 3026557 - DNA, 14 bp, Homo sapiens
tctccacaggagcc

SEQ ID NO: 3026558 - DNA, 16 bp, Homo sapiens
tctccacctcagcctt

SEQ ID NO: 3026559 - DNA, 22 bp, Homo sapiens
tctccacttctggtcccctgtg

SEQ ID NO: 3026560 - DNA, 14 bp, Homo sapiens
tctccagtccctgg

SEQ ID NO: 3026561 - DNA, 14 bp, Homo sapiens
tctccatactttgg

SEQ ID NO: 3026562 - DNA, 19 bp, Homo sapiens
tctccatccacatgggagc

SEQ ID NO: 3026563 - DNA, 17 bp, Homo sapiens
tctccatctggcagggt

SEQ ID NO: 3026564 - DNA, 18 bp, Homo sapiens
tctccatcttcagcttct

SEQ ID NO: 3026565 - DNA, 12 bp, Homo sapiens
tctccatgaaga

SEQ ID NO: 3026566 - DNA, 19 bp, Homo sapiens
tctccatgcaagtgctgtt

SEQ ID NO: 3026567 - DNA, 20 bp, Homo sapiens
tctcccagacttgtttcctg

SEQ ID NO: 3026568 - DNA, 10 bp, Homo sapiens
tctcccagat

SEQ ID NO: 3026569 - DNA, 21 bp, Homo sapiens
tctcccagataatgtgaaaat

SEQ ID NO: 3026570 - DNA, 20 bp, Homo sapiens
tctcccatttcaggaattta

SEQ ID NO: 3026571 - DNA, 21 bp, Homo sapiens
tctccccgaggctgccccagg

SEQ ID NO: 3026572 - DNA, 18 bp, Homo sapiens
tctcccctcagagtgcaa

SEQ ID NO: 3026573 - DNA, 21 bp, Homo sapiens
tctcccctccccatctgtgtt

SEQ ID NO: 3026574 - DNA, 23 bp, Homo sapiens
tctcccctccccatctgtgttct

SEQ ID NO: 3026575 - DNA, 18 bp, Homo sapiens
tctccccttgcagcctgg

SEQ ID NO: 3026576 - DNA, 14 bp, Homo sapiens
tctccctaccttgc

SEQ ID NO: 3026577 - DNA, 19 bp, Homo sapiens
tctccctaccttgcctcct

SEQ ID NO: 3026578 - DNA, 18 bp, Homo sapiens
tctccctctaggctctgc

SEQ ID NO: 3026579 - DNA, 12 bp, Homo sapiens
tctccctctcac

SEQ ID NO: 3026580 - DNA, 15 bp, Homo sapiens
tctccctctcctgcc

SEQ ID NO: 3026581 - DNA, 16 bp, Homo sapiens
tctccctctcctgcct

SEQ ID NO: 3026582 - DNA, 14 bp, Homo sapiens
tctccctctggccc

SEQ ID NO: 3026583 - DNA, 19 bp, Homo sapiens
tctccctctggccctgcct

SEQ ID NO: 3026584 - DNA, 20 bp, Homo sapiens
tctccctctggccctgcctt

SEQ ID NO: 3026585 - DNA, 16 bp, Homo sapiens
tctccctctttttctc

SEQ ID NO: 3026586 - DNA, 19 bp, Homo sapiens
tctccctctttttctctgt

SEQ ID NO: 3026587 - DNA, 21 bp, Homo sapiens
tctccctgcactccctcctgg

SEQ ID NO: 3026588 - DNA, 12 bp, Homo sapiens
tctccctgccgc

SEQ ID NO: 3026589 - DNA, 13 bp, Homo sapiens
tctccctgccgcc

SEQ ID NO: 3026590 - DNA, 12 bp, Homo sapiens
tctccctgcctc

SEQ ID NO: 3026591 - DNA, 14 bp, Homo sapiens
tctccctgcctcac

SEQ ID NO: 3026592 - DNA, 13 bp, Homo sapiens
tctccctgggcct

SEQ ID NO: 3026593 - DNA, 17 bp, Homo sapiens
tctcccttccacctcac

SEQ ID NO: 3026594 - DNA, 22 bp, Homo sapiens
tctcccttcggtggaagagctc

SEQ ID NO: 3026595 - DNA, 18 bp, Homo sapiens
tctcccttctttaccttc

SEQ ID NO: 3026596 - DNA, 12 bp, Homo sapiens
tctcccttggcc

SEQ ID NO: 3026597 - DNA, 13 bp, Homo sapiens
tctcccttggccc

SEQ ID NO: 3026598 - DNA, 18 bp, Homo sapiens
tctcccttggcccagaga

SEQ ID NO: 3026599 - DNA, 23 bp, Homo sapiens
tctcctatatatttctattatta

SEQ ID NO: 3026600 - DNA, 20 bp, Homo sapiens
tctcctccatgggagaaaat

SEQ ID NO: 3026601 - DNA, 14 bp, Homo sapiens
tctcctcccctact

SEQ ID NO: 3026602 - DNA, 18 bp, Homo sapiens
tctcctcctcctccctcc

SEQ ID NO: 3026603 - DNA, 20 bp, Homo sapiens
tctcctcggacacccagggt

SEQ ID NO: 3026604 - DNA, 22 bp, Homo sapiens
tctcctcggacacccagggtct

SEQ ID NO: 3026605 - DNA, 14 bp, Homo sapiens
tctcctctcagctt

SEQ ID NO: 3026606 - DNA, 16 bp, Homo sapiens
tctcctctcagcttct

SEQ ID NO: 3026607 - DNA, 21 bp, Homo sapiens
tctcctcttgtaaataaagcc

SEQ ID NO: 3026608 - DNA, 12 bp, Homo sapiens
tctcctctttga

SEQ ID NO: 3026609 - DNA, 13 bp, Homo sapiens
tctcctgactggt

SEQ ID NO: 3026610 - DNA, 15 bp, Homo sapiens
tctcctgcctactca

SEQ ID NO: 3026611 - DNA, 15 bp, Homo sapiens
tctcctgcctcagcc

SEQ ID NO: 3026612 - DNA, 17 bp, Homo sapiens
tctcctgcctcagcctc

SEQ ID NO: 3026613 - DNA, 18 bp, Homo sapiens
tctcctgcctcagcctcc

SEQ ID NO: 3026614 - DNA, 18 bp, Homo sapiens
tctcctgcctcagccttc

SEQ ID NO: 3026615 - DNA, 15 bp, Homo sapiens
tctcctgcctttgcc

SEQ ID NO: 3026616 - DNA, 16 bp, Homo sapiens
tctcctgcctttgcct

SEQ ID NO: 3026617 - DNA, 17 bp, Homo sapiens
tctcctgcctttgcctc

SEQ ID NO: 3026618 - DNA, 22 bp, Homo sapiens
tctcctggaccttgacagagca

SEQ ID NO: 3026619 - DNA, 24 bp, Homo sapiens
tctcctggaccttgacagagcagc

SEQ ID NO: 3026620 - DNA, 22 bp, Homo sapiens
tctcctggactggttatcttgt

SEQ ID NO: 3026621 - DNA, 11 bp, Homo sapiens
tctcctggagg

SEQ ID NO: 3026622 - DNA, 23 bp, Homo sapiens
tctcctggagggcgcccagcagc

SEQ ID NO: 3026623 - DNA, 14 bp, Homo sapiens
tctccttctcttct

SEQ ID NO: 3026624 - DNA, 21 bp, Homo sapiens
tctccttctcttctcttcttt

SEQ ID NO: 3026625 - DNA, 14 bp, Homo sapiens
tctccttgcagttc

SEQ ID NO: 3026626 - DNA, 17 bp, Homo sapiens
tctccttgcagttcttg

SEQ ID NO: 3026627 - DNA, 13 bp, Homo sapiens
tctcctttgatat

SEQ ID NO: 3026628 - DNA, 17 bp, Homo sapiens
tctcctttggcatgttt

SEQ ID NO: 3026629 - DNA, 19 bp, Homo sapiens
tctcctttgtactttgtgc

SEQ ID NO: 3026630 - DNA, 19 bp, Homo sapiens
tctccttttgaacttgtca

SEQ ID NO: 3026631 - DNA, 14 bp, Homo sapiens
tctcgaactcctga

SEQ ID NO: 3026632 - DNA, 14 bp, Homo sapiens
tctcgactgctttt

SEQ ID NO: 3026633 - DNA, 16 bp, Homo sapiens
tctcgactgcttttcg

SEQ ID NO: 3026634 - DNA, 19 bp, Homo sapiens
tctcgatgctgctggcctc

SEQ ID NO: 3026635 - DNA, 20 bp, Homo sapiens
tctcgcctaggatttcagcc

SEQ ID NO: 3026636 - DNA, 16 bp, Homo sapiens
tctcgctccctcccag

SEQ ID NO: 3026637 - DNA, 21 bp, Homo sapiens
tctcgctgcatcacccaggct

SEQ ID NO: 3026638 - DNA, 16 bp, Homo sapiens
tctcggagctggccca

SEQ ID NO: 3026639 - DNA, 17 bp, Homo sapiens
tctcggagctggcccag

SEQ ID NO: 3026640 - DNA, 13 bp, Homo sapiens
tctcggggcttgc

SEQ ID NO: 3026641 - DNA, 16 bp, Homo sapiens
tctcgtcaggctgcca

SEQ ID NO: 3026642 - DNA, 14 bp, Homo sapiens
tctcgttgccctaa

SEQ ID NO: 3026643 - DNA, 22 bp, Homo sapiens
tctcgttgccctaattcatctt

SEQ ID NO: 3026644 - DNA, 21 bp, Homo sapiens
tctcgtttagtgccaatgttg

SEQ ID NO: 3026645 - DNA, 17 bp, Homo sapiens
tctcgtttgtgattctt

SEQ ID NO: 3026646 - DNA, 21 bp, Homo sapiens
tctctaaaaagaagccacaga

SEQ ID NO: 3026647 - DNA, 20 bp, Homo sapiens
tctctaactcagaaacatca

SEQ ID NO: 3026648 - DNA, 17 bp, Homo sapiens
tctctacccctttctgt

SEQ ID NO: 3026649 - DNA, 15 bp, Homo sapiens
tctctactaaaaata

SEQ ID NO: 3026650 - DNA, 18 bp, Homo sapiens
tctctactccatggttct

SEQ ID NO: 3026651 - DNA, 20 bp, Homo sapiens
tctctactccatggttctca

SEQ ID NO: 3026652 - DNA, 23 bp, Homo sapiens
tctctactccatggttctcaatt

SEQ ID NO: 3026653 - DNA, 16 bp, Homo sapiens
tctctactgtggcaaa

SEQ ID NO: 3026654 - DNA, 18 bp, Homo sapiens
tctctagaagctgtctgc

SEQ ID NO: 3026655 - DNA, 13 bp, Homo sapiens
tctctagacaaaa

SEQ ID NO: 3026656 - DNA, 17 bp, Homo sapiens
tctctagttccacgcct

SEQ ID NO: 3026657 - DNA, 18 bp, Homo sapiens
tctctatcattaaagttc

SEQ ID NO: 3026658 - DNA, 14 bp, Homo sapiens
tctctattgtaatt

SEQ ID NO: 3026659 - DNA, 22 bp, Homo sapiens
tctctattgtaattttgttcct

SEQ ID NO: 3026660 - DNA, 13 bp, Homo sapiens
tctctatttgaga

SEQ ID NO: 3026661 - DNA, 22 bp, Homo sapiens
tctctcactgttgcagtggcct

SEQ ID NO: 3026662 - DNA, 11 bp, Homo sapiens
tctctcagcat

SEQ ID NO: 3026663 - DNA, 22 bp, Homo sapiens
tctgccttgaaatacctgtttc

SEQ ID NO: 3026664 - DNA, 23 bp, Homo sapiens
tctgccttgaaatacctgtttct

SEQ ID NO: 3026665 - DNA, 15 bp, Homo sapiens
tctgccttggcatcc

SEQ ID NO: 3026666 - DNA, 16 bp, Homo sapiens
tctgcctttagctttg

SEQ ID NO: 3026667 - DNA, 15 bp, Homo sapiens
tctgcctttgagtgt

SEQ ID NO: 3026668 - DNA, 14 bp, Homo sapiens
tctgcgaagtccta

SEQ ID NO: 3026669 - DNA, 22 bp, Homo sapiens
tctgcgaagtcctatggaaacc

SEQ ID NO: 3026670 - DNA, 14 bp, Homo sapiens
tctgcgattttatc

SEQ ID NO: 3026671 - DNA, 15 bp, Homo sapiens
tctgcgccaggcaga

SEQ ID NO: 3026672 - DNA, 16 bp, Homo sapiens
tctgcggcccgggccg

SEQ ID NO: 3026673 - DNA, 19 bp, Homo sapiens
tctgcggcccgggccgacc

SEQ ID NO: 3026674 - DNA, 23 bp, Homo sapiens
tctgcggggcctgaggcaagcca

SEQ ID NO: 3026675 - DNA, 15 bp, Homo sapiens
tctgcgtccaccagg

SEQ ID NO: 3026676 - DNA, 16 bp, Homo sapiens
tctgcgtccaccaggc

SEQ ID NO: 3026677 - DNA, 16 bp, Homo sapiens
tctgcgtgacaataaa

SEQ ID NO: 3026678 - DNA, 22 bp, Homo sapiens
tctgctagagcagacaggcctg

SEQ ID NO: 3026679 - DNA, 13 bp, Homo sapiens
tctgctcacttta

SEQ ID NO: 3026680 - DNA, 15 bp, Homo sapiens
tctgctcagcttctc

SEQ ID NO: 3026681 - DNA, 12 bp, Homo sapiens
tctgctcatcat

SEQ ID NO: 3026682 - DNA, 15 bp, Homo sapiens
tctgctcatcattct

SEQ ID NO: 3026683 - DNA, 18 bp, Homo sapiens
tctgctcatcattctctg

SEQ ID NO: 3026684 - DNA, 22 bp, Homo sapiens
tctgctcatcattctctgtctc

SEQ ID NO: 3026685 - DNA, 16 bp, Homo sapiens
tctgctcctttcccct

SEQ ID NO: 3026686 - DNA, 16 bp, Homo sapiens
tctgctctgcgtgtca

SEQ ID NO: 3026687 - DNA, 21 bp, Homo sapiens
tctgctgcacatagcagacta

SEQ ID NO: 3026688 - DNA, 21 bp, Homo sapiens
tctgctgccttgggtttctgt

SEQ ID NO: 3026689 - DNA, 23 bp, Homo sapiens
tctgctggagtttcatgtacaag

SEQ ID NO: 3026690 - DNA, 18 bp, Homo sapiens
tctgcttaccgttcaaga

SEQ ID NO: 3026691 - DNA, 21 bp, Homo sapiens
tctgcttccatggcttcctga

SEQ ID NO: 3026692 - DNA, 19 bp, Homo sapiens
tctgcttgacaacatctga

SEQ ID NO: 3026693 - DNA, 19 bp, Homo sapiens
tctgcttgttattagagat

SEQ ID NO: 3026694 - DNA, 14 bp, Homo sapiens
tctgctttctatta

SEQ ID NO: 3026695 - DNA, 15 bp, Homo sapiens
tctgctttctgttca

SEQ ID NO: 3026696 - DNA, 20 bp, Homo sapiens
tctgctttctgttcatctct

SEQ ID NO: 3026697 - DNA, 13 bp, Homo sapiens
tctgcttttaagt

SEQ ID NO: 3026698 - DNA, 12 bp, Homo sapiens
tctggaaagaaa

SEQ ID NO: 3026699 - DNA, 15 bp, Homo sapiens
tctggaacccagact

SEQ ID NO: 3026700 - DNA, 17 bp, Homo sapiens
tctggaacccagactca

SEQ ID NO: 3026701 - DNA, 15 bp, Homo sapiens
tctggaacctcagcc

SEQ ID NO: 3026702 - DNA, 16 bp, Homo sapiens
tctggaacctcagcct

SEQ ID NO: 3026703 - DNA, 19 bp, Homo sapiens
tctggaacctcagcctggc

SEQ ID NO: 3026704 - DNA, 20 bp, Homo sapiens
tctggaacctcagcctggcc

SEQ ID NO: 3026705 - DNA, 23 bp, Homo sapiens
tctggaacctcagcctggccaga

SEQ ID NO: 3026706 - DNA, 15 bp, Homo sapiens
tctggaagaagcagc

SEQ ID NO: 3026707 - DNA, 16 bp, Homo sapiens
tctggaagaagcagcg

SEQ ID NO: 3026708 - DNA, 13 bp, Homo sapiens
tctggaagggcca

SEQ ID NO: 3026709 - DNA, 21 bp, Homo sapiens
tctggaatttacctccccttt

SEQ ID NO: 3026710 - DNA, 14 bp, Homo sapiens
tctggacacttctt

SEQ ID NO: 3026711 - DNA, 16 bp, Homo sapiens
tctggacacttcttta

SEQ ID NO: 3026712 - DNA, 20 bp, Homo sapiens
tctggacagccccaccctgg

SEQ ID NO: 3026713 - DNA, 20 bp, Homo sapiens
tctggacatgaattaaagta

SEQ ID NO: 3026714 - DNA, 18 bp, Homo sapiens
tctggaccaaggagcatc

SEQ ID NO: 3026715 - DNA, 18 bp, Homo sapiens
tctggacgtgaaatactt

SEQ ID NO: 3026716 - DNA, 20 bp, Homo sapiens
tctggactaaccctgtggtt

SEQ ID NO: 3026717 - DNA, 11 bp, Homo sapiens
tctggagaagc

SEQ ID NO: 3026718 - DNA, 15 bp, Homo sapiens
tctggagaagcagtg

SEQ ID NO: 3026719 - DNA, 22 bp, Homo sapiens
tctggagaagcagtgagccgca

SEQ ID NO: 3026720 - DNA, 17 bp, Homo sapiens
tctggagcccctcctcc

SEQ ID NO: 3026721 - DNA, 17 bp, Homo sapiens
tctggaggttgataact

SEQ ID NO: 3026722 - DNA, 20 bp, Homo sapiens
tctggaggttgataactttg

SEQ ID NO: 3026723 - DNA, 17 bp, Homo sapiens
tctggagtattctataa

SEQ ID NO: 3026724 - DNA, 21 bp, Homo sapiens
tctggatcccgttcagaaaac

SEQ ID NO: 3026725 - DNA, 16 bp, Homo sapiens
tctggatctagaaggg

SEQ ID NO: 3026726 - DNA, 22 bp, Homo sapiens
tctggcacagcctggctgtggc

SEQ ID NO: 3026727 - DNA, 19 bp, Homo sapiens
tctggcattctacacctgg

SEQ ID NO: 3026728 - DNA, 16 bp, Homo sapiens
tctggccaggaagctt

SEQ ID NO: 3026729 - DNA, 20 bp, Homo sapiens
tctggccattttggaaagca

SEQ ID NO: 3026730 - DNA, 14 bp, Homo sapiens
tctggccctgcctt

SEQ ID NO: 3026731 - DNA, 14 bp, Homo sapiens
tctggcctcccaca

SEQ ID NO: 3026732 - DNA, 18 bp, Homo sapiens
tctggcgacagttttcct

SEQ ID NO: 3026733 - DNA, 22 bp, Homo sapiens
tctggcgacagttttccttctc

SEQ ID NO: 3026734 - DNA, 18 bp, Homo sapiens
tctggcgagcccttagcc

SEQ ID NO: 3026735 - DNA, 19 bp, Homo sapiens
tctggcgagcccttagcct

SEQ ID NO: 3026736 - DNA, 20 bp, Homo sapiens
tctggcgagcccttagcctt

SEQ ID NO: 3026737 - DNA, 16 bp, Homo sapiens
tctggcggtggccaca

SEQ ID NO: 3026738 - DNA, 17 bp, Homo sapiens
tctggctagagggccca

SEQ ID NO: 3026739 - DNA, 17 bp, Homo sapiens
tctggctccaggcagaa

SEQ ID NO: 3026740 - DNA, 20 bp, Homo sapiens
tctggctccctcttctttca

SEQ ID NO: 3026741 - DNA, 21 bp, Homo sapiens
tctggctgtaaggctctagat

SEQ ID NO: 3026742 - DNA, 22 bp, Homo sapiens
tctggctgtaaggctctagatc

SEQ ID NO: 3026743 - DNA, 18 bp, Homo sapiens
tctggcttcctgctgagt

SEQ ID NO: 3026744 - DNA, 22 bp, Homo sapiens
tctggcttcgcagctctggcct

SEQ ID NO: 3026745 - DNA, 19 bp, Homo sapiens
tctggcttctggccaggaa

SEQ ID NO: 3026746 - DNA, 19 bp, Homo sapiens
tctgggaagggagagggcc

SEQ ID NO: 3026747 - DNA, 23 bp, Homo sapiens
tctgggaagggagagggcctctg

SEQ ID NO: 3026748 - DNA, 19 bp, Homo sapiens
tctgggaccctttccttcc

SEQ ID NO: 3026749 - DNA, 21 bp, Homo sapiens
tctgggagggcagcagggcta

SEQ ID NO: 3026750 - DNA, 15 bp, Homo sapiens
tctgggagtcacaca

SEQ ID NO: 3026751 - DNA, 16 bp, Homo sapiens
tctgggagtcacacag

SEQ ID NO: 3026752 - DNA, 15 bp, Homo sapiens
tctgggcagagcctg

SEQ ID NO: 3026753 - DNA, 17 bp, Homo sapiens
tctgggcagagcctgtc

SEQ ID NO: 3026754 - DNA, 19 bp, Homo sapiens
tctgggcagagcctgtccc

SEQ ID NO: 3026755 - DNA, 12 bp, Homo sapiens
tctgggcctgac

SEQ ID NO: 3026756 - DNA, 13 bp, Homo sapiens
tctgggggcagat

SEQ ID NO: 3026757 - DNA, 19 bp, Homo sapiens
tctggggggacccagtgca

SEQ ID NO: 3026758 - DNA, 19 bp, Homo sapiens
tctggggtccccagggctg

SEQ ID NO: 3026759 - DNA, 17 bp, Homo sapiens
tctggggttatgatggc

SEQ ID NO: 3026760 - DNA, 18 bp, Homo sapiens
tctggggttcagcccctc

SEQ ID NO: 3026761 - DNA, 22 bp, Homo sapiens
tctggggttcagcccctcctct

SEQ ID NO: 3026762 - DNA, 14 bp, Homo sapiens
tctgggtagaagcc

SEQ ID NO: 3026763 - DNA, 19 bp, Homo sapiens
tctgggtagaagccaccct

SEQ ID NO: 3026764 - DNA, 15 bp, Homo sapiens
tctgggtcagaccca

SEQ ID NO: 3026765 - DNA, 18 bp, Homo sapiens
tctgggtggatgtgagca

SEQ ID NO: 3026766 - DNA, 18 bp, Homo sapiens
tctgggtgttgaccactc

SEQ ID NO: 3026767 - DNA, 16 bp, Homo sapiens
tctgggtttacaacaa

SEQ ID NO: 3026768 - DNA, 20 bp, Homo sapiens
tctgggtttacaacaaacac

SEQ ID NO: 3026769 - DNA, 16 bp, Homo sapiens
tctgggtttggcccaa

SEQ ID NO: 3026770 - DNA, 19 bp, Homo sapiens
tctgggtttggcccaagac

SEQ ID NO: 3026771 - DNA, 23 bp, Homo sapiens
tctggtataaagctctcaaatgt

SEQ ID NO: 3026772 - DNA, 17 bp, Homo sapiens
tctggtcaacctcctgg

SEQ ID NO: 3026773 - DNA, 17 bp, Homo sapiens
tctggtgataaggacat

SEQ ID NO: 3026774 - DNA, 23 bp, Homo sapiens
tctggtgccagatcctcttctca

SEQ ID NO: 3026775 - DNA, 21 bp, Homo sapiens
tctggtggaggagctgaggga

SEQ ID NO: 3026776 - DNA, 17 bp, Homo sapiens
tctggttaggatggcag

SEQ ID NO: 3026777 - DNA, 11 bp, Homo sapiens
tctggttctaa

SEQ ID NO: 3026778 - DNA, 15 bp, Homo sapiens
tctggttgaactctg

SEQ ID NO: 3026779 - DNA, 13 bp, Homo sapiens
tctgtaaaaaaga

SEQ ID NO: 3026780 - DNA, 14 bp, Homo sapiens
tctgtaaaaaagaa

SEQ ID NO: 3026781 - DNA, 14 bp, Homo sapiens
tctgtaaaaaatgt

SEQ ID NO: 3026782 - DNA, 15 bp, Homo sapiens
tctgtaaaagtgtct

SEQ ID NO: 3026783 - DNA, 16 bp, Homo sapiens
tctgtaaaagtgtctg

SEQ ID NO: 3026784 - DNA, 18 bp, Homo sapiens
tctgtaaaagtgtctgta

SEQ ID NO: 3026785 - DNA, 12 bp, Homo sapiens
tctgtaaatatg

SEQ ID NO: 3026786 - DNA, 16 bp, Homo sapiens
tctgtaaccacctctc

SEQ ID NO: 3026787 - DNA, 14 bp, Homo sapiens
tctgtaagaaacct

SEQ ID NO: 3026788 - DNA, 13 bp, Homo sapiens
tctgtaaggtctt

SEQ ID NO: 3026789 - DNA, 14 bp, Homo sapiens
tctgtaatcccagc

SEQ ID NO: 3026790 - DNA, 20 bp, Homo sapiens
tctgtaatctcgtttcaaaa

SEQ ID NO: 3026791 - DNA, 22 bp, Homo sapiens
tctgtacaaaatggtcctattt

SEQ ID NO: 3026792 - DNA, 17 bp, Homo sapiens
tctgtacacgtgtcctg

SEQ ID NO: 3026793 - DNA, 14 bp, Homo sapiens
tctgtagagccaat

SEQ ID NO: 3026794 - DNA, 15 bp, Homo sapiens
tctgtagctttctgg

SEQ ID NO: 3026795 - DNA, 16 bp, Homo sapiens
tctttgcctgttcagt

SEQ ID NO: 3026796 - DNA, 17 bp, Homo sapiens
tctttgcctgttcagtt

SEQ ID NO: 3026797 - DNA, 19 bp, Homo sapiens
tctttgcggggcctgtctc

SEQ ID NO: 3026798 - DNA, 22 bp, Homo sapiens
tctttgcggggcctgtctcagt

SEQ ID NO: 3026799 - DNA, 21 bp, Homo sapiens
tctttgctgaatgtcattatt

SEQ ID NO: 3026800 - DNA, 17 bp, Homo sapiens
tctttgctgctgtggaa

SEQ ID NO: 3026801 - DNA, 14 bp, Homo sapiens
tctttgctgtaaga

SEQ ID NO: 3026802 - DNA, 11 bp, Homo sapiens
tctttgctttg

SEQ ID NO: 3026803 - DNA, 13 bp, Homo sapiens
tctttgctttgct

SEQ ID NO: 3026804 - DNA, 15 bp, Homo sapiens
tctttgctttgtagt

SEQ ID NO: 3026805 - DNA, 19 bp, Homo sapiens
tctttggacagaagcagct

SEQ ID NO: 3026806 - DNA, 22 bp, Homo sapiens
tctttggacagaagcagctctt

SEQ ID NO: 3026807 - DNA, 20 bp, Homo sapiens
tctttggccccttgctggag

SEQ ID NO: 3026808 - DNA, 12 bp, Homo sapiens
tctttggctcta

SEQ ID NO: 3026809 - DNA, 16 bp, Homo sapiens
tctttgggccagacat

SEQ ID NO: 3026810 - DNA, 16 bp, Homo sapiens
tctttggggaaaaatt

SEQ ID NO: 3026811 - DNA, 20 bp, Homo sapiens
tctttggggaggtgttcact

SEQ ID NO: 3026812 - DNA, 16 bp, Homo sapiens
tctttggttctaagga

SEQ ID NO: 3026813 - DNA, 21 bp, Homo sapiens
tctttggttctaaggacctga

SEQ ID NO: 3026814 - DNA, 20 bp, Homo sapiens
tctttgtaagaactaaagaa

SEQ ID NO: 3026815 - DNA, 22 bp, Homo sapiens
tctttgtaagaactaaagaaga

SEQ ID NO: 3026816 - DNA, 23 bp, Homo sapiens
tctttgtaatgtcaccaccttcc

SEQ ID NO: 3026817 - DNA, 17 bp, Homo sapiens
tctttgtggactgtggg

SEQ ID NO: 3026818 - DNA, 13 bp, Homo sapiens
tctttgtggccaa

SEQ ID NO: 3026819 - DNA, 23 bp, Homo sapiens
tctttgtgtttgcttggtgctgg

SEQ ID NO: 3026820 - DNA, 15 bp, Homo sapiens
tctttgttataccat

SEQ ID NO: 3026821 - DNA, 17 bp, Homo sapiens
tctttgttcctgctttc

SEQ ID NO: 3026822 - DNA, 15 bp, Homo sapiens
tcttttacatacagt

SEQ ID NO: 3026823 - DNA, 15 bp, Homo sapiens
tcttttactaagaca

SEQ ID NO: 3026824 - DNA, 13 bp, Homo sapiens
tcttttataaaaa

SEQ ID NO: 3026825 - DNA, 15 bp, Homo sapiens
tcttttataataatg

SEQ ID NO: 3026826 - DNA, 18 bp, Homo sapiens
tcttttatagacgctctt

SEQ ID NO: 3026827 - DNA, 13 bp, Homo sapiens
tcttttatatttg

SEQ ID NO: 3026828 - DNA, 16 bp, Homo sapiens
tcttttcacattctta

SEQ ID NO: 3026829 - DNA, 22 bp, Homo sapiens
tcttttcacattcttataaata

SEQ ID NO: 3026830 - DNA, 18 bp, Homo sapiens
tcttttcatatctcttgc

SEQ ID NO: 3026831 - DNA, 18 bp, Homo sapiens
tcttttcatctgggaaag

SEQ ID NO: 3026832 - DNA, 22 bp, Homo sapiens
tcttttccaaaataaaacaaag

SEQ ID NO: 3026833 - DNA, 15 bp, Homo sapiens
tcttttcctctctgt

SEQ ID NO: 3026834 - DNA, 22 bp, Homo sapiens
tcttttctttagagaactgaaa

SEQ ID NO: 3026835 - DNA, 17 bp, Homo sapiens
tcttttgaagtgtttta

SEQ ID NO: 3026836 - DNA, 23 bp, Homo sapiens
tcttttgaatattcccaagccca

SEQ ID NO: 3026837 - DNA, 14 bp, Homo sapiens
tcttttgaattgtt

SEQ ID NO: 3026838 - DNA, 16 bp, Homo sapiens
tcttttgttcttgata

SEQ ID NO: 3026839 - DNA, 23 bp, Homo sapiens
tcttttgtttcattaagttgtaa

SEQ ID NO: 3026840 - DNA, 11 bp, Homo sapiens
tctttttaatt

SEQ ID NO: 3026841 - DNA, 21 bp, Homo sapiens
tctttttaattattttaaaat

SEQ ID NO: 3026842 - DNA, 16 bp, Homo sapiens
tctttttatactatta

SEQ ID NO: 3026843 - DNA, 13 bp, Homo sapiens
tctttttattgaa

SEQ ID NO: 3026844 - DNA, 15 bp, Homo sapiens
tctttttattgaatc

SEQ ID NO: 3026845 - DNA, 12 bp, Homo sapiens
tctttttcagtt

SEQ ID NO: 3026846 - DNA, 14 bp, Homo sapiens
tctttttcctgaaa

SEQ ID NO: 3026847 - DNA, 16 bp, Homo sapiens
tctttttctcttctgt

SEQ ID NO: 3026848 - DNA, 15 bp, Homo sapiens
tctttttcttgtcat

SEQ ID NO: 3026849 - DNA, 13 bp, Homo sapiens
tctttttgaaaat

SEQ ID NO: 3026850 - DNA, 13 bp, Homo sapiens
tctttttgtataa

SEQ ID NO: 3026851 - DNA, 15 bp, Homo sapiens
tctttttgtgtgcag

SEQ ID NO: 3026852 - DNA, 15 bp, Homo sapiens
tcttttttagcataa

SEQ ID NO: 3026853 - DNA, 16 bp, Homo sapiens
tcttttttagcataaa

SEQ ID NO: 3026854 - DNA, 20 bp, Homo sapiens
tcttttttttaatgtgctgt

SEQ ID NO: 3026855 - DNA, 16 bp, Homo sapiens
tgaaaaaaaatagatg

SEQ ID NO: 3026856 - DNA, 19 bp, Homo sapiens
tgaaaaaaaatagatgttt

SEQ ID NO: 3026857 - DNA, 21 bp, Homo sapiens
tgaaaaaaaatagatgtttta

SEQ ID NO: 3026858 - DNA, 21 bp, Homo sapiens
tgaaaaaaccgttcaaattct

SEQ ID NO: 3026859 - DNA, 17 bp, Homo sapiens
tgaaaaaatactaccta

SEQ ID NO: 3026860 - DNA, 13 bp, Homo sapiens
tgaaaaacattag

SEQ ID NO: 3026861 - DNA, 23 bp, Homo sapiens
tgaaaaactggcaacattccaag

SEQ ID NO: 3026862 - DNA, 19 bp, Homo sapiens
tgaaaaagttaatgcttaa

SEQ ID NO: 3026863 - DNA, 19 bp, Homo sapiens
tgaaaaattcctttgtgtt

SEQ ID NO: 3026864 - DNA, 19 bp, Homo sapiens
tgaaaaattgcattcattg

SEQ ID NO: 3026865 - DNA, 18 bp, Homo sapiens
tgaaaacactgtgcacat

SEQ ID NO: 3026866 - DNA, 11 bp, Homo sapiens
tgaaaacactt

SEQ ID NO: 3026867 - DNA, 12 bp, Homo sapiens
tgaaaacactta

SEQ ID NO: 3026868 - DNA, 22 bp, Homo sapiens
tgaaaacacttattttacacag

SEQ ID NO: 3026869 - DNA, 13 bp, Homo sapiens
tgaaaacatctgg

SEQ ID NO: 3026870 - DNA, 17 bp, Homo sapiens
tgaaaacatctggaagg

SEQ ID NO: 3026871 - DNA, 17 bp, Homo sapiens
tgaaaacattgatgaat

SEQ ID NO: 3026872 - DNA, 22 bp, Homo sapiens
tgaaaaccatattttattgtat

SEQ ID NO: 3026873 - DNA, 15 bp, Homo sapiens
tgaaaacccagagag

SEQ ID NO: 3026874 - DNA, 16 bp, Homo sapiens
tgaaaacccagagagg

SEQ ID NO: 3026875 - DNA, 23 bp, Homo sapiens
tgaaaacccagagaggaatcaga

SEQ ID NO: 3026876 - DNA, 15 bp, Homo sapiens
tgaaaacccctggct

SEQ ID NO: 3026877 - DNA, 20 bp, Homo sapiens
tgaaaacggagctgaacaat

SEQ ID NO: 3026878 - DNA, 16 bp, Homo sapiens
tgaaaagaaataataa

SEQ ID NO: 3026879 - DNA, 17 bp, Homo sapiens
tgaaaaggttgcctgaa

SEQ ID NO: 3026880 - DNA, 18 bp, Homo sapiens
tgaaaagttatttatgct

SEQ ID NO: 3026881 - DNA, 20 bp, Homo sapiens
tgaaaagttatttatgctat

SEQ ID NO: 3026882 - DNA, 15 bp, Homo sapiens
tgaaaataactgaac

SEQ ID NO: 3026883 - DNA, 19 bp, Homo sapiens
tgaaaataactgaaccaaa

SEQ ID NO: 3026884 - DNA, 14 bp, Homo sapiens
tgaaaatataacca

SEQ ID NO: 3026885 - DNA, 12 bp, Homo sapiens
tgaaaatattta

SEQ ID NO: 3026886 - DNA, 13 bp, Homo sapiens
tgaaaatatttaa

SEQ ID NO: 3026887 - DNA, 14 bp, Homo sapiens
tgaaaatatttaca

SEQ ID NO: 3026888 - DNA, 12 bp, Homo sapiens
tgaaaatcaaat

SEQ ID NO: 3026889 - DNA, 16 bp, Homo sapiens
tgaaaatgaagaagga

SEQ ID NO: 3026890 - DNA, 16 bp, Homo sapiens
tgaaaatgtcttgtgt

SEQ ID NO: 3026891 - DNA, 16 bp, Homo sapiens
tgaaaattatttgaaa

SEQ ID NO: 3026892 - DNA, 18 bp, Homo sapiens
tgaaaatttgtttgacaa

SEQ ID NO: 3026893 - DNA, 17 bp, Homo sapiens
tgaaacaaaaattgtct

SEQ ID NO: 3026894 - DNA, 19 bp, Homo sapiens
tgaaacaaaaattgtcttt

SEQ ID NO: 3026895 - DNA, 14 bp, Homo sapiens
tgaaacaaagaagg

SEQ ID NO: 3026896 - DNA, 16 bp, Homo sapiens
tgaaacacaataccta

SEQ ID NO: 3026897 - DNA, 14 bp, Homo sapiens
tgaaacacttgctt

SEQ ID NO: 3026898 - DNA, 15 bp, Homo sapiens
tgaaacacttttttg

SEQ ID NO: 3026899 - DNA, 10 bp, Homo sapiens
tgaaacagct

SEQ ID NO: 3026900 - DNA, 11 bp, Homo sapiens
tgaaacagctg

SEQ ID NO: 3026901 - DNA, 13 bp, Homo sapiens
tgaaacagctgcc

SEQ ID NO: 3026902 - DNA, 19 bp, Homo sapiens
tgaaacatgggctgtgatt

SEQ ID NO: 3026903 - DNA, 14 bp, Homo sapiens
tgaaacattatttt

SEQ ID NO: 3026904 - DNA, 20 bp, Homo sapiens
tgaaaccagtgttagggaag

SEQ ID NO: 3026905 - DNA, 11 bp, Homo sapiens
tgaaacccagt

SEQ ID NO: 3026906 - DNA, 17 bp, Homo sapiens
tgaaacccatttactta

SEQ ID NO: 3026907 - DNA, 13 bp, Homo sapiens
tgaaacctgatgt

SEQ ID NO: 3026908 - DNA, 19 bp, Homo sapiens
tgaaacctttttcctagta

SEQ ID NO: 3026909 - DNA, 23 bp, Homo sapiens
tgaaactagaaatctgtcctgtg

SEQ ID NO: 3026910 - DNA, 16 bp, Homo sapiens
tgaaactcccttgtgt

SEQ ID NO: 3026911 - DNA, 20 bp, Homo sapiens
tgaaactcccttgtgttcct

SEQ ID NO: 3026912 - DNA, 22 bp, Homo sapiens
tgaaactcccttgtgttccttc

SEQ ID NO: 3026913 - DNA, 15 bp, Homo sapiens
tgaaagacttccaaa

SEQ ID NO: 3026914 - DNA, 17 bp, Homo sapiens
tgaaagacttccaaaga

SEQ ID NO: 3026915 - DNA, 16 bp, Homo sapiens
tgaaagagtaaaggaa

SEQ ID NO: 3026916 - DNA, 17 bp, Homo sapiens
tgaaagagtaaaggaaa

SEQ ID NO: 3026917 - DNA, 17 bp, Homo sapiens
tgaaagatgatttgcaa

SEQ ID NO: 3026918 - DNA, 18 bp, Homo sapiens
tgaaagatgatttgcaat

SEQ ID NO: 3026919 - DNA, 21 bp, Homo sapiens
tgaaagattatttaaatgctt

SEQ ID NO: 3026920 - DNA, 14 bp, Homo sapiens
tgaaagattttatt

SEQ ID NO: 3026921 - DNA, 12 bp, Homo sapiens
tgaaagcaaaaa

SEQ ID NO: 3026922 - DNA, 12 bp, Homo sapiens
tgaaagcctgtc

SEQ ID NO: 3026923 - DNA, 13 bp, Homo sapiens
tgaaagctagaga

SEQ ID NO: 3026924 - DNA, 15 bp, Homo sapiens
tgaaaggaacatttt

SEQ ID NO: 3026925 - DNA, 22 bp, Homo sapiens
tgaaaggaagagctaataaatc

SEQ ID NO: 3026926 - DNA, 19 bp, Homo sapiens
tgaaaggagtttaaaaaca

SEQ ID NO: 3026927 - DNA, 17 bp, Homo sapiens
tgaaaggcattctctga

SEQ ID NO: 3026928 - DNA, 15 bp, Homo sapiens
tgaaaggcttttaaa

SEQ ID NO: 3026929 - DNA, 13 bp, Homo sapiens
tgacctactctca

SEQ ID NO: 3026930 - DNA, 21 bp, Homo sapiens
tgacctcaagtgatctgtcca

SEQ ID NO: 3026931 - DNA, 15 bp, Homo sapiens
tgacctcacctggtc

SEQ ID NO: 3026932 - DNA, 21 bp, Homo sapiens
tgacctcattaaccgatgctt

SEQ ID NO: 3026933 - DNA, 17 bp, Homo sapiens
tgacctccacagcttcc

SEQ ID NO: 3026934 - DNA, 17 bp, Homo sapiens
tgacctccagtcctgct

SEQ ID NO: 3026935 - DNA, 21 bp, Homo sapiens
tgacctccagtcctgctggcc

SEQ ID NO: 3026936 - DNA, 18 bp, Homo sapiens
tgacctccatactgggct

SEQ ID NO: 3026937 - DNA, 15 bp, Homo sapiens
tgacctgaactctgc

SEQ ID NO: 3026938 - DNA, 16 bp, Homo sapiens
tgacctgaactctgca

SEQ ID NO: 3026939 - DNA, 17 bp, Homo sapiens
tgacctgcatctaagcc

SEQ ID NO: 3026940 - DNA, 17 bp, Homo sapiens
tgacctgctgaggcctc

SEQ ID NO: 3026941 - DNA, 15 bp, Homo sapiens
tgacctggtccacag

SEQ ID NO: 3026942 - DNA, 16 bp, Homo sapiens
tgacctgtttctctgc

SEQ ID NO: 3026943 - DNA, 23 bp, Homo sapiens
tgaccttagtgtttctgtgcatg

SEQ ID NO: 3026944 - DNA, 20 bp, Homo sapiens
tgaccttcagagccagccgg

SEQ ID NO: 3026945 - DNA, 12 bp, Homo sapiens
tgaccttcagct

SEQ ID NO: 3026946 - DNA, 19 bp, Homo sapiens
tgaccttccaagagcctga

SEQ ID NO: 3026947 - DNA, 21 bp, Homo sapiens
tgaccttgggaccaaaggggg

SEQ ID NO: 3026948 - DNA, 19 bp, Homo sapiens
tgacctttgtacagcccag

SEQ ID NO: 3026949 - DNA, 21 bp, Homo sapiens
tgacctttgtacagcccagag

SEQ ID NO: 3026950 - DNA, 17 bp, Homo sapiens
tgaccttttatgtagta

SEQ ID NO: 3026951 - DNA, 14 bp, Homo sapiens
tgacgaactggcta

SEQ ID NO: 3026952 - DNA, 19 bp, Homo sapiens
tgacgaactggctacagta

SEQ ID NO: 3026953 - DNA, 22 bp, Homo sapiens
tgacgcagccggagggaggcac

SEQ ID NO: 3026954 - DNA, 18 bp, Homo sapiens
tgacgctgaataaatgtc

SEQ ID NO: 3026955 - DNA, 20 bp, Homo sapiens
tgacgctgaataaatgtctt

SEQ ID NO: 3026956 - DNA, 14 bp, Homo sapiens
tgacgggccaggcc

SEQ ID NO: 3026957 - DNA, 15 bp, Homo sapiens
tgacgggccaggccc

SEQ ID NO: 3026958 - DNA, 18 bp, Homo sapiens
tgacggtgcagtctgggt

SEQ ID NO: 3026959 - DNA, 13 bp, Homo sapiens
tgacgtaagctct

SEQ ID NO: 3026960 - DNA, 23 bp, Homo sapiens
tgacgtgcactgtgaatcctggc

SEQ ID NO: 3026961 - DNA, 20 bp, Homo sapiens
tgactaaaaatgcatctggc

SEQ ID NO: 3026962 - DNA, 19 bp, Homo sapiens
tgactaaactacattataa

SEQ ID NO: 3026963 - DNA, 16 bp, Homo sapiens
tgactaagccaagctg

SEQ ID NO: 3026964 - DNA, 17 bp, Homo sapiens
tgactaagccaagctgt

SEQ ID NO: 3026965 - DNA, 18 bp, Homo sapiens
tgactaagccaagctgtg

SEQ ID NO: 3026966 - DNA, 23 bp, Homo sapiens
tgactaagccaagctgtgttcat

SEQ ID NO: 3026967 - DNA, 16 bp, Homo sapiens
tgactaatggcatgag

SEQ ID NO: 3026968 - DNA, 13 bp, Homo sapiens
tgactaattgtat

SEQ ID NO: 3026969 - DNA, 19 bp, Homo sapiens
tgactaattgtataacagg

SEQ ID NO: 3026970 - DNA, 16 bp, Homo sapiens
tgactacagtcaggaa

SEQ ID NO: 3026971 - DNA, 18 bp, Homo sapiens
tgactacagtcaggaaag

SEQ ID NO: 3026972 - DNA, 23 bp, Homo sapiens
tgactagatgatggatgccaata

SEQ ID NO: 3026973 - DNA, 17 bp, Homo sapiens
tgactattatgttgtta

SEQ ID NO: 3026974 - DNA, 13 bp, Homo sapiens
tgactcagagctt

SEQ ID NO: 3026975 - DNA, 14 bp, Homo sapiens
tgactcagggctcc

SEQ ID NO: 3026976 - DNA, 19 bp, Homo sapiens
tgactcagggctcctgggt

SEQ ID NO: 3026977 - DNA, 19 bp, Homo sapiens
tgactcaggtggtgtcctt

SEQ ID NO: 3026978 - DNA, 21 bp, Homo sapiens
tgactcaggtggtgtccttct

SEQ ID NO: 3026979 - DNA, 15 bp, Homo sapiens
tgactcatgcctctg

SEQ ID NO: 3026980 - DNA, 16 bp, Homo sapiens
tgactcatgcctctga

SEQ ID NO: 3026981 - DNA, 22 bp, Homo sapiens
tgactcccattttggtgtgcat

SEQ ID NO: 3026982 - DNA, 13 bp, Homo sapiens
tgactccctcccc

SEQ ID NO: 3026983 - DNA, 14 bp, Homo sapiens
tgactccctcccca

SEQ ID NO: 3026984 - DNA, 13 bp, Homo sapiens
tgactcctttggt

SEQ ID NO: 3026985 - DNA, 17 bp, Homo sapiens
tgactctctgagctggg

SEQ ID NO: 3026986 - DNA, 20 bp, Homo sapiens
tgactcttccattcagtttt

SEQ ID NO: 3026987 - DNA, 21 bp, Homo sapiens
tgactcttccattcagtttta

SEQ ID NO: 3026988 - DNA, 17 bp, Homo sapiens
tgactgaagcgaacatc

SEQ ID NO: 3026989 - DNA, 22 bp, Homo sapiens
tgactgaagcgaacatcttcat

SEQ ID NO: 3026990 - DNA, 20 bp, Homo sapiens
tgactgagtctggcaaacat

SEQ ID NO: 3026991 - DNA, 17 bp, Homo sapiens
tgactgccccaactcct

SEQ ID NO: 3026992 - DNA, 20 bp, Homo sapiens
tgactgccccaactcctgga

SEQ ID NO: 3026993 - DNA, 13 bp, Homo sapiens
tgactgctgctcc

SEQ ID NO: 3026994 - DNA, 20 bp, Homo sapiens
tgactgctgctccccacccc

SEQ ID NO: 3026995 - DNA, 14 bp, Homo sapiens
tgactggcatttta

SEQ ID NO: 3026996 - DNA, 17 bp, Homo sapiens
tgactggcattttatag

SEQ ID NO: 3026997 - DNA, 13 bp, Homo sapiens
tgactgggctggg

SEQ ID NO: 3026998 - DNA, 22 bp, Homo sapiens
tgactgggctgggtttgctgtc

SEQ ID NO: 3026999 - DNA, 23 bp, Homo sapiens
tgactggtgttatcaccgtgggc

SEQ ID NO: 3027000 - DNA, 21 bp, Homo sapiens
tgactgtattttgttttcctt

SEQ ID NO: 3027001 - DNA, 18 bp, Homo sapiens
tgactgtcagggagggcc

SEQ ID NO: 3027002 - DNA, 20 bp, Homo sapiens
tgactgtcagggagggccag

SEQ ID NO: 3027003 - DNA, 22 bp, Homo sapiens
tgactgtcagggagggccaggg

SEQ ID NO: 3027004 - DNA, 18 bp, Homo sapiens
tgactgtcttccctctct

SEQ ID NO: 3027005 - DNA, 17 bp, Homo sapiens
tgactgtggccatggtc

SEQ ID NO: 3027006 - DNA, 21 bp, Homo sapiens
tgactgtggccctgtctggag

SEQ ID NO: 3027007 - DNA, 19 bp, Homo sapiens
tgactgtttttcggacagt

SEQ ID NO: 3027008 - DNA, 23 bp, Homo sapiens
tgacttcaatgatagtaagaaaa

SEQ ID NO: 3027009 - DNA, 16 bp, Homo sapiens
tgacttgagccctgcc

SEQ ID NO: 3027010 - DNA, 12 bp, Homo sapiens
tgacttgcttta

SEQ ID NO: 3027011 - DNA, 19 bp, Homo sapiens
tgacttggggagatggagt

SEQ ID NO: 3027012 - DNA, 15 bp, Homo sapiens
tgacttgtataacat

SEQ ID NO: 3027013 - DNA, 20 bp, Homo sapiens
tgacttgtataacatcactg

SEQ ID NO: 3027014 - DNA, 17 bp, Homo sapiens
tgactttaatttatgta

SEQ ID NO: 3027015 - DNA, 20 bp, Homo sapiens
tgactttagaaagctgacat

SEQ ID NO: 3027016 - DNA, 13 bp, Homo sapiens
tgactttggctga

SEQ ID NO: 3027017 - DNA, 13 bp, Homo sapiens
tgacttttgaaga

SEQ ID NO: 3027018 - DNA, 14 bp, Homo sapiens
tgacttttgaagaa

SEQ ID NO: 3027019 - DNA, 13 bp, Homo sapiens
tgactttttataa

SEQ ID NO: 3027020 - DNA, 14 bp, Homo sapiens
tgactttttataaa

SEQ ID NO: 3027021 - DNA, 16 bp, Homo sapiens
tgactttttgtttctt

SEQ ID NO: 3027022 - DNA, 16 bp, Homo sapiens
tgagaaacctgtatct

SEQ ID NO: 3027023 - DNA, 17 bp, Homo sapiens
tgagaaacctgtatctt

SEQ ID NO: 3027024 - DNA, 14 bp, Homo sapiens
tgagaaagggagag

SEQ ID NO: 3027025 - DNA, 21 bp, Homo sapiens
tgagaaagggagaggaagaga

SEQ ID NO: 3027026 - DNA, 23 bp, Homo sapiens
tgagaacctgggttgcagacagg

SEQ ID NO: 3027027 - DNA, 17 bp, Homo sapiens
tgagaactgcatatgtt

SEQ ID NO: 3027028 - DNA, 22 bp, Homo sapiens
tgagaactggttcttgccttcc

SEQ ID NO: 3027029 - DNA, 22 bp, Homo sapiens
tgagaagaaaatggaaccaggc

SEQ ID NO: 3027030 - DNA, 20 bp, Homo sapiens
tgagaagtactttgtgctga

SEQ ID NO: 3027031 - DNA, 16 bp, Homo sapiens
tgagaagtagccacag

SEQ ID NO: 3027032 - DNA, 20 bp, Homo sapiens
tgagaatcccaaatttgatt

SEQ ID NO: 3027033 - DNA, 21 bp, Homo sapiens
tgagaatcccaaatttgattg

SEQ ID NO: 3027034 - DNA, 20 bp, Homo sapiens
tgagaatttaatttttaaaa

SEQ ID NO: 3027035 - DNA, 20 bp, Homo sapiens
tgagaatttgagtgctctga

SEQ ID NO: 3027036 - DNA, 14 bp, Homo sapiens
tgagacaaacatgc

SEQ ID NO: 3027037 - DNA, 14 bp, Homo sapiens
tgagacacaggtgg

SEQ ID NO: 3027038 - DNA, 14 bp, Homo sapiens
tgagacagagcctc

SEQ ID NO: 3027039 - DNA, 22 bp, Homo sapiens
tgagacaggagaaacacttgaa

SEQ ID NO: 3027040 - DNA, 21 bp, Homo sapiens
tgagacagggttttttcattt

SEQ ID NO: 3027041 - DNA, 15 bp, Homo sapiens
tgagacagtcttgct

SEQ ID NO: 3027042 - DNA, 15 bp, Homo sapiens
tgagacagtgggaaa

SEQ ID NO: 3027043 - DNA, 14 bp, Homo sapiens
tgagaccagcctgg

SEQ ID NO: 3027044 - DNA, 13 bp, Homo sapiens
tgagaccaggctg

SEQ ID NO: 3027045 - DNA, 14 bp, Homo sapiens
tgagacccaggact

SEQ ID NO: 3027046 - DNA, 21 bp, Homo sapiens
tgagacccattcctatttctt

SEQ ID NO: 3027047 - DNA, 12 bp, Homo sapiens
tgagacctcagc

SEQ ID NO: 3027048 - DNA, 17 bp, Homo sapiens
tgagacctcagccatga

SEQ ID NO: 3027049 - DNA, 19 bp, Homo sapiens
tgagactacaagtgtgtgc

SEQ ID NO: 3027050 - DNA, 21 bp, Homo sapiens
tgagactccactcaggtgcac

SEQ ID NO: 3027051 - DNA, 17 bp, Homo sapiens
tgagactcggccgcagc

SEQ ID NO: 3027052 - DNA, 16 bp, Homo sapiens
tgagactgatccctgg

SEQ ID NO: 3027053 - DNA, 16 bp, Homo sapiens
tgagacttaattttgt

SEQ ID NO: 3027054 - DNA, 13 bp, Homo sapiens
tgagacttgcctt

SEQ ID NO: 3027055 - DNA, 17 bp, Homo sapiens
tgagagaagaaaacatt

SEQ ID NO: 3027056 - DNA, 18 bp, Homo sapiens
tgagagacattaactcat

SEQ ID NO: 3027057 - DNA, 19 bp, Homo sapiens
tgagagacattaactcatt

SEQ ID NO: 3027058 - DNA, 19 bp, Homo sapiens
tgagagagaatagagctgc

SEQ ID NO: 3027059 - DNA, 23 bp, Homo sapiens
tgagagagaatagagctgccact

SEQ ID NO: 3027060 - DNA, 18 bp, Homo sapiens
tgagagagagaacctttc

SEQ ID NO: 3027061 - DNA, 22 bp, Homo sapiens
tgattctgcagtaaatctttta

SEQ ID NO: 3027062 - DNA, 16 bp, Homo sapiens
tgattctgttgtgttc

SEQ ID NO: 3027063 - DNA, 12 bp, Homo sapiens
tgattgacagct

SEQ ID NO: 3027064 - DNA, 18 bp, Homo sapiens
tgattgagagttggctgt

SEQ ID NO: 3027065 - DNA, 23 bp, Homo sapiens
tgattgaggataaaaaggaagga

SEQ ID NO: 3027066 - DNA, 12 bp, Homo sapiens
tgattgatttga

SEQ ID NO: 3027067 - DNA, 13 bp, Homo sapiens
tgattgctaaatg

SEQ ID NO: 3027068 - DNA, 20 bp, Homo sapiens
tgattgctaaatgtaacagt

SEQ ID NO: 3027069 - DNA, 22 bp, Homo sapiens
tgattgctaaatgtaacagtct

SEQ ID NO: 3027070 - DNA, 21 bp, Homo sapiens
tgattgtcctttaaaaaagaa

SEQ ID NO: 3027071 - DNA, 14 bp, Homo sapiens
tgattgtgcatgga

SEQ ID NO: 3027072 - DNA, 19 bp, Homo sapiens
tgattgttaatttacagct

SEQ ID NO: 3027073 - DNA, 20 bp, Homo sapiens
tgattgtttgcacagagggc

SEQ ID NO: 3027074 - DNA, 13 bp, Homo sapiens
tgattgttttatt

SEQ ID NO: 3027075 - DNA, 23 bp, Homo sapiens
tgatttaaaagtgtattttattc

SEQ ID NO: 3027076 - DNA, 13 bp, Homo sapiens
tgatttaatgttt

SEQ ID NO: 3027077 - DNA, 21 bp, Homo sapiens
tgatttagcaatgctgtgaat

SEQ ID NO: 3027078 - DNA, 23 bp, Homo sapiens
tgatttataaacagacaatatgt

SEQ ID NO: 3027079 - DNA, 20 bp, Homo sapiens
tgatttataaatgccattta

SEQ ID NO: 3027080 - DNA, 21 bp, Homo sapiens
tgatttcagtgctgctgaact

SEQ ID NO: 3027081 - DNA, 23 bp, Homo sapiens
tgatttcccactgcactccagcc

SEQ ID NO: 3027082 - DNA, 18 bp, Homo sapiens
tgatttccctccagagaa

SEQ ID NO: 3027083 - DNA, 20 bp, Homo sapiens
tgatttccctccagagaaag

SEQ ID NO: 3027084 - DNA, 22 bp, Homo sapiens
tgatttccctccagagaaagca

SEQ ID NO: 3027085 - DNA, 14 bp, Homo sapiens
tgatttcctgtgtc

SEQ ID NO: 3027086 - DNA, 22 bp, Homo sapiens
tgatttcgatgtacagtctcaa

SEQ ID NO: 3027087 - DNA, 22 bp, Homo sapiens
tgatttgagtttcctttaaata

SEQ ID NO: 3027088 - DNA, 13 bp, Homo sapiens
tgatttgcattga

SEQ ID NO: 3027089 - DNA, 15 bp, Homo sapiens
tgatttgcattgaac

SEQ ID NO: 3027090 - DNA, 14 bp, Homo sapiens
tgatttgccactga

SEQ ID NO: 3027091 - DNA, 13 bp, Homo sapiens
tgatttggtgacc

SEQ ID NO: 3027092 - DNA, 19 bp, Homo sapiens
tgatttggtgaccaactgt

SEQ ID NO: 3027093 - DNA, 13 bp, Homo sapiens
tgatttgtacttg

SEQ ID NO: 3027094 - DNA, 14 bp, Homo sapiens
tgatttgttttgaa

SEQ ID NO: 3027095 - DNA, 15 bp, Homo sapiens
tgatttgttttgaat

SEQ ID NO: 3027096 - DNA, 16 bp, Homo sapiens
tgattttaaaaggttg

SEQ ID NO: 3027097 - DNA, 17 bp, Homo sapiens
tgattttaactctgtct

SEQ ID NO: 3027098 - DNA, 16 bp, Homo sapiens
tgattttacaaattaa

SEQ ID NO: 3027099 - DNA, 17 bp, Homo sapiens
tgattttacaaattaat

SEQ ID NO: 3027100 - DNA, 20 bp, Homo sapiens
tgattttacaaattaatatt

SEQ ID NO: 3027101 - DNA, 18 bp, Homo sapiens
tgattttagctgcagaac

SEQ ID NO: 3027102 - DNA, 21 bp, Homo sapiens
tgattttcatatcccgtgaaa

SEQ ID NO: 3027103 - DNA, 14 bp, Homo sapiens
tgattttccctcta

SEQ ID NO: 3027104 - DNA, 12 bp, Homo sapiens
tgattttgacac

SEQ ID NO: 3027105 - DNA, 12 bp, Homo sapiens
tgatttttatct

SEQ ID NO: 3027106 - DNA, 9 bp, Homo sapiens
tgatttttt

SEQ ID NO: 3027107 - DNA, 18 bp, Homo sapiens
tgattttttgttcttgtt

SEQ ID NO: 3027108 - DNA, 20 bp, Homo sapiens
tgattttttgttcttgttgt

SEQ ID NO: 3027109 - DNA, 22 bp, Homo sapiens
tgcaaaaaatactttttctaat

SEQ ID NO: 3027110 - DNA, 11 bp, Homo sapiens
tgcaaaataag

SEQ ID NO: 3027111 - DNA, 14 bp, Homo sapiens
tgcaaaatgtcttg

SEQ ID NO: 3027112 - DNA, 17 bp, Homo sapiens
tgcaaaatgtcttgtgt

SEQ ID NO: 3027113 - DNA, 21 bp, Homo sapiens
tgcaaacgctgcctgcccgta

SEQ ID NO: 3027114 - DNA, 13 bp, Homo sapiens
tgcaaagaactca

SEQ ID NO: 3027115 - DNA, 23 bp, Homo sapiens
tgcaaagatctgtcctcagcctt

SEQ ID NO: 3027116 - DNA, 13 bp, Homo sapiens
tgcaaagtactgt

SEQ ID NO: 3027117 - DNA, 17 bp, Homo sapiens
tgcaaagtattgtaaat

SEQ ID NO: 3027118 - DNA, 18 bp, Homo sapiens
tgcaaagtattgtaaatt

SEQ ID NO: 3027119 - DNA, 20 bp, Homo sapiens
tgcaaagtattgtaaattat

SEQ ID NO: 3027120 - DNA, 19 bp, Homo sapiens
tgcaaagtctccagaagaa

SEQ ID NO: 3027121 - DNA, 21 bp, Homo sapiens
tgcaaagtctccagaagaaaa

SEQ ID NO: 3027122 - DNA, 21 bp, Homo sapiens
tgcaaagtgttttgtaccagt

SEQ ID NO: 3027123 - DNA, 15 bp, Homo sapiens
tgcaaagtttgtgtc

SEQ ID NO: 3027124 - DNA, 15 bp, Homo sapiens
tgcaaatcctatgtg

SEQ ID NO: 3027125 - DNA, 15 bp, Homo sapiens
tgcaaatgctgtatt

SEQ ID NO: 3027126 - DNA, 23 bp, Homo sapiens
tgcaacaacctttccagctactt

SEQ ID NO: 3027127 - DNA, 16 bp, Homo sapiens
tgcaacacaacatttg

SEQ ID NO: 3027128 - DNA, 21 bp, Homo sapiens
tgcaacatggattccaaagca

SEQ ID NO: 3027129 - DNA, 23 bp, Homo sapiens
tgcaacatggattccaaagcatt

SEQ ID NO: 3027130 - DNA, 18 bp, Homo sapiens
tgcaaccaaaagggaaaa

SEQ ID NO: 3027131 - DNA, 19 bp, Homo sapiens
tgcaacctctgcttcccag

SEQ ID NO: 3027132 - DNA, 21 bp, Homo sapiens
tgcaacctctgcttcccaggt

SEQ ID NO: 3027133 - DNA, 18 bp, Homo sapiens
tgcaacctcttggcctga

SEQ ID NO: 3027134 - DNA, 14 bp, Homo sapiens
tgcaactcttgtat

SEQ ID NO: 3027135 - DNA, 15 bp, Homo sapiens
tgcaactcttgtatt

SEQ ID NO: 3027136 - DNA, 14 bp, Homo sapiens
tgcaacttggactt

SEQ ID NO: 3027137 - DNA, 22 bp, Homo sapiens
tgcaagaactcatcactgtggc

SEQ ID NO: 3027138 - DNA, 17 bp, Homo sapiens
tgcaagaagtctggcca

SEQ ID NO: 3027139 - DNA, 15 bp, Homo sapiens
tgcaagcagaggacc

SEQ ID NO: 3027140 - DNA, 21 bp, Homo sapiens
tgcaagcagaggaccagggcc

SEQ ID NO: 3027141 - DNA, 23 bp, Homo sapiens
tgcaagcccctgctccagaagat

SEQ ID NO: 3027142 - DNA, 18 bp, Homo sapiens
tgcaagccttctaaatga

SEQ ID NO: 3027143 - DNA, 19 bp, Homo sapiens
tgcaagctccaactcccgg

SEQ ID NO: 3027144 - DNA, 14 bp, Homo sapiens
tgcaagcttattta

SEQ ID NO: 3027145 - DNA, 18 bp, Homo sapiens
tgcaaggacattcttgta

SEQ ID NO: 3027146 - DNA, 19 bp, Homo sapiens
tgcaaggattacagaaact

SEQ ID NO: 3027147 - DNA, 22 bp, Homo sapiens
tgcaaggattacagaaactgat

SEQ ID NO: 3027148 - DNA, 18 bp, Homo sapiens
tgcaagggcccagagtga

SEQ ID NO: 3027149 - DNA, 22 bp, Homo sapiens
tgcaagggcccagagtgaaccg

SEQ ID NO: 3027150 - DNA, 13 bp, Homo sapiens
tgcaaggttccac

SEQ ID NO: 3027151 - DNA, 15 bp, Homo sapiens
tgcaaggttccacag

SEQ ID NO: 3027152 - DNA, 17 bp, Homo sapiens
tgcaagtccttttgtaa

SEQ ID NO: 3027153 - DNA, 18 bp, Homo sapiens
tgcaagtccttttgtaaa

SEQ ID NO: 3027154 - DNA, 20 bp, Homo sapiens
tgcaagtgggagatgaaaac

SEQ ID NO: 3027155 - DNA, 19 bp, Homo sapiens
tgcaataaatctgacccag

SEQ ID NO: 3027156 - DNA, 21 bp, Homo sapiens
tgcaataaatctgacccagtg

SEQ ID NO: 3027157 - DNA, 16 bp, Homo sapiens
tgcaataacttctata

SEQ ID NO: 3027158 - DNA, 17 bp, Homo sapiens
tgcaatacattgttcag

SEQ ID NO: 3027159 - DNA, 23 bp, Homo sapiens
tgcaatactgcttaattgctgat

SEQ ID NO: 3027160 - DNA, 14 bp, Homo sapiens
tgcaatagtcagag

SEQ ID NO: 3027161 - DNA, 18 bp, Homo sapiens
tgcaatatatctaaattg

SEQ ID NO: 3027162 - DNA, 15 bp, Homo sapiens
tgcaatatctgaagc

SEQ ID NO: 3027163 - DNA, 24 bp, Homo sapiens
tgcaatcacagctcactgcagcct

SEQ ID NO: 3027164 - DNA, 21 bp, Homo sapiens
tgcaatgacacagtcttggct

SEQ ID NO: 3027165 - DNA, 15 bp, Homo sapiens
tgcaatgagccatga

SEQ ID NO: 3027166 - DNA, 15 bp, Homo sapiens
tgcaatggtgactga

SEQ ID NO: 3027167 - DNA, 12 bp, Homo sapiens
tgcaatgttttt

SEQ ID NO: 3027168 - DNA, 18 bp, Homo sapiens
tgcaatgtttttgtgtag

SEQ ID NO: 3027169 - DNA, 19 bp, Homo sapiens
tgcaatgtttttgtgtaga

SEQ ID NO: 3027170 - DNA, 18 bp, Homo sapiens
tgcaattcaaaagttcca

SEQ ID NO: 3027171 - DNA, 19 bp, Homo sapiens
tgcaattcaaaagttccaa

SEQ ID NO: 3027172 - DNA, 16 bp, Homo sapiens
tgcaattcagtctgct

SEQ ID NO: 3027173 - DNA, 16 bp, Homo sapiens
tgcaattgatttcttt

SEQ ID NO: 3027174 - DNA, 20 bp, Homo sapiens
tgcaattgttaatcaaagat

SEQ ID NO: 3027175 - DNA, 23 bp, Homo sapiens
tgcacaaacttgtgagcatcaga

SEQ ID NO: 3027176 - DNA, 23 bp, Homo sapiens
tgcacaataaaaccaagcctctg

SEQ ID NO: 3027177 - DNA, 19 bp, Homo sapiens
tgcacaatattgaactttt

SEQ ID NO: 3027178 - DNA, 16 bp, Homo sapiens
tgcacacagcggctgc

SEQ ID NO: 3027179 - DNA, 21 bp, Homo sapiens
tgcacacatcaccaggtgcat

SEQ ID NO: 3027180 - DNA, 20 bp, Homo sapiens
tgcacagagggcgctcctgt

SEQ ID NO: 3027181 - DNA, 15 bp, Homo sapiens
tgcacagattcccag

SEQ ID NO: 3027182 - DNA, 22 bp, Homo sapiens
tgcacagattcccaggccaggg

SEQ ID NO: 3027183 - DNA, 24 bp, Homo sapiens
tgcacagattcccaggccagggct

SEQ ID NO: 3027184 - DNA, 16 bp, Homo sapiens
tgcacaggtctctgtt

SEQ ID NO: 3027185 - DNA, 18 bp, Homo sapiens
tgcacaggtctctgttta

SEQ ID NO: 3027186 - DNA, 16 bp, Homo sapiens
tgcacagtcaaaacga

SEQ ID NO: 3027187 - DNA, 16 bp, Homo sapiens
tgcacagtcagaagga

SEQ ID NO: 3027188 - DNA, 18 bp, Homo sapiens
tgcacagtccacagctga

SEQ ID NO: 3027189 - DNA, 14 bp, Homo sapiens
tgcacatagcagac

SEQ ID NO: 3027190 - DNA, 22 bp, Homo sapiens
tgcacatccgcgtgtgcctgtg

SEQ ID NO: 3027191 - DNA, 18 bp, Homo sapiens
tgcacatctgtgtcttgt

SEQ ID NO: 3027192 - DNA, 19 bp, Homo sapiens
tgcctgcactccctggcct

SEQ ID NO: 3027193 - DNA, 16 bp, Homo sapiens
tgcctgcagggccatg

SEQ ID NO: 3027194 - DNA, 23 bp, Homo sapiens
tgcctgcagggccatggctcagg

SEQ ID NO: 3027195 - DNA, 16 bp, Homo sapiens
tgcctgccagctgcac

SEQ ID NO: 3027196 - DNA, 11 bp, Homo sapiens
tgcctgctggg

SEQ ID NO: 3027197 - DNA, 14 bp, Homo sapiens
tgcctgctgggctc

SEQ ID NO: 3027198 - DNA, 16 bp, Homo sapiens
tgcctgctgggctctt

SEQ ID NO: 3027199 - DNA, 13 bp, Homo sapiens
tgcctgctgtgga

SEQ ID NO: 3027200 - DNA, 16 bp, Homo sapiens
tgcctggaaagtcctc

SEQ ID NO: 3027201 - DNA, 19 bp, Homo sapiens
tgcctggaacaccagcagc

SEQ ID NO: 3027202 - DNA, 14 bp, Homo sapiens
tgcctggagcaggg

SEQ ID NO: 3027203 - DNA, 14 bp, Homo sapiens
tgcctggagcccca

SEQ ID NO: 3027204 - DNA, 20 bp, Homo sapiens
tgcctggagccccactgccc

SEQ ID NO: 3027205 - DNA, 16 bp, Homo sapiens
tgcctggagtgctgtg

SEQ ID NO: 3027206 - DNA, 15 bp, Homo sapiens
tgcctggcaggctgt

SEQ ID NO: 3027207 - DNA, 15 bp, Homo sapiens
tgcctggccaggccc

SEQ ID NO: 3027208 - DNA, 16 bp, Homo sapiens
tgcctggccaggccct

SEQ ID NO: 3027209 - DNA, 16 bp, Homo sapiens
tgcctggccggccagc

SEQ ID NO: 3027210 - DNA, 22 bp, Homo sapiens
tgcctggccttgtcctcagcca

SEQ ID NO: 3027211 - DNA, 22 bp, Homo sapiens
tgcctgggcccctcccctcaga

SEQ ID NO: 3027212 - DNA, 17 bp, Homo sapiens
tgcctgggctgggcagc

SEQ ID NO: 3027213 - DNA, 19 bp, Homo sapiens
tgcctgggggagagaggca

SEQ ID NO: 3027214 - DNA, 23 bp, Homo sapiens
tgcctggggtgttagtggcaccg

SEQ ID NO: 3027215 - DNA, 22 bp, Homo sapiens
tgcctgggtggggctgctcctc

SEQ ID NO: 3027216 - DNA, 17 bp, Homo sapiens
tgcctgtaatcccagaa

SEQ ID NO: 3027217 - DNA, 19 bp, Homo sapiens
tgcctgtaatcccagaact

SEQ ID NO: 3027218 - DNA, 14 bp, Homo sapiens
tgcctgtagagcca

SEQ ID NO: 3027219 - DNA, 22 bp, Homo sapiens
tgcctgtagagccagccttggt

SEQ ID NO: 3027220 - DNA, 22 bp, Homo sapiens
tgcctgtagccccagtgacagc

SEQ ID NO: 3027221 - DNA, 20 bp, Homo sapiens
tgcctgtagtctcagctagt

SEQ ID NO: 3027222 - DNA, 22 bp, Homo sapiens
tgcctgtcctagtctcctttga

SEQ ID NO: 3027223 - DNA, 13 bp, Homo sapiens
tgcctgtctaaag

SEQ ID NO: 3027224 - DNA, 15 bp, Homo sapiens
tgcctgtctaaagcc

SEQ ID NO: 3027225 - DNA, 16 bp, Homo sapiens
tgcctgtctccatgag

SEQ ID NO: 3027226 - DNA, 11 bp, Homo sapiens
tgcctgttcag

SEQ ID NO: 3027227 - DNA, 14 bp, Homo sapiens
tgccttacctcctg

SEQ ID NO: 3027228 - DNA, 16 bp, Homo sapiens
tgccttacctcctgcc

SEQ ID NO: 3027229 - DNA, 19 bp, Homo sapiens
tgccttagcatgtgactcc

SEQ ID NO: 3027230 - DNA, 17 bp, Homo sapiens
tgccttaggaatactgt

SEQ ID NO: 3027231 - DNA, 19 bp, Homo sapiens
tgccttaggaatactgttt

SEQ ID NO: 3027232 - DNA, 21 bp, Homo sapiens
tgccttatctaaatcaccaga

SEQ ID NO: 3027233 - DNA, 16 bp, Homo sapiens
tgccttattaaagttc

SEQ ID NO: 3027234 - DNA, 23 bp, Homo sapiens
tgccttattagagtgtctttcca

SEQ ID NO: 3027235 - DNA, 18 bp, Homo sapiens
tgccttccagaaaacaaa

SEQ ID NO: 3027236 - DNA, 17 bp, Homo sapiens
tgccttccagcccagac

SEQ ID NO: 3027237 - DNA, 17 bp, Homo sapiens
tgccttcctcctgggcc

SEQ ID NO: 3027238 - DNA, 16 bp, Homo sapiens
tgccttctaaaggtgt

SEQ ID NO: 3027239 - DNA, 18 bp, Homo sapiens
tgccttctcaccagctgc

SEQ ID NO: 3027240 - DNA, 11 bp, Homo sapiens
tgccttctcag

SEQ ID NO: 3027241 - DNA, 13 bp, Homo sapiens
tgccttctccctg

SEQ ID NO: 3027242 - DNA, 21 bp, Homo sapiens
tgccttctctcagctcccagg

SEQ ID NO: 3027243 - DNA, 17 bp, Homo sapiens
tgccttcttcagggcct

SEQ ID NO: 3027244 - DNA, 23 bp, Homo sapiens
tgccttcttcggggaactcctgg

SEQ ID NO: 3027245 - DNA, 13 bp, Homo sapiens
tgccttgcatttg

SEQ ID NO: 3027246 - DNA, 19 bp, Homo sapiens
tgccttgcccacaggtgcg

SEQ ID NO: 3027247 - DNA, 17 bp, Homo sapiens
tgccttggcctcccaag

SEQ ID NO: 3027248 - DNA, 19 bp, Homo sapiens
tgcctttatctcagccatc

SEQ ID NO: 3027249 - DNA, 17 bp, Homo sapiens
tgcctttcaaatttaga

SEQ ID NO: 3027250 - DNA, 22 bp, Homo sapiens
tgcctttgctgtttagcttcct

SEQ ID NO: 3027251 - DNA, 19 bp, Homo sapiens
tgcctttgtggtgggcgct

SEQ ID NO: 3027252 - DNA, 16 bp, Homo sapiens
tgccttttaattttta

SEQ ID NO: 3027253 - DNA, 22 bp, Homo sapiens
tgcctttttatttttgttttta

SEQ ID NO: 3027254 - DNA, 16 bp, Homo sapiens
tgcctttttccttatt

SEQ ID NO: 3027255 - DNA, 20 bp, Homo sapiens
tgcctttttccttatttcaa

SEQ ID NO: 3027256 - DNA, 14 bp, Homo sapiens
tgccttttttgatc

SEQ ID NO: 3027257 - DNA, 22 bp, Homo sapiens
tgcgaatggttccattctctct

SEQ ID NO: 3027258 - DNA, 19 bp, Homo sapiens
tgcgaccctgggggcacag

SEQ ID NO: 3027259 - DNA, 19 bp, Homo sapiens
tgcgaccttaatttaactt

SEQ ID NO: 3027260 - DNA, 16 bp, Homo sapiens
tgcgatagagtctcac

SEQ ID NO: 3027261 - DNA, 19 bp, Homo sapiens
tgcgatctcggctcagtgc

SEQ ID NO: 3027262 - DNA, 13 bp, Homo sapiens
tgcgattttatct

SEQ ID NO: 3027263 - DNA, 16 bp, Homo sapiens
tgcgcacaggtgggag

SEQ ID NO: 3027264 - DNA, 17 bp, Homo sapiens
tgcgcccagtccttcca

SEQ ID NO: 3027265 - DNA, 20 bp, Homo sapiens
tgcgcccgggcaagaccttt

SEQ ID NO: 3027266 - DNA, 21 bp, Homo sapiens
tgcgcctccatccatctgtcc

SEQ ID NO: 3027267 - DNA, 22 bp, Homo sapiens
tgcgcctccatccatctgtccg

SEQ ID NO: 3027268 - DNA, 23 bp, Homo sapiens
tgcgcctccatccatctgtccgt

SEQ ID NO: 3027269 - DNA, 19 bp, Homo sapiens
tgcgctcggcaggaaggag

SEQ ID NO: 3027270 - DNA, 23 bp, Homo sapiens
tgcgctcggcaggaaggagcggc

SEQ ID NO: 3027271 - DNA, 12 bp, Homo sapiens
tgcgctgcctgg

SEQ ID NO: 3027272 - DNA, 14 bp, Homo sapiens
tgcgctgcctggcc

SEQ ID NO: 3027273 - DNA, 16 bp, Homo sapiens
tgcgctgcctggccag

SEQ ID NO: 3027274 - DNA, 20 bp, Homo sapiens
tgcgctgcctggccaggccc

SEQ ID NO: 3027275 - DNA, 17 bp, Homo sapiens
tgcgctgctttttcaaa

SEQ ID NO: 3027276 - DNA, 18 bp, Homo sapiens
tgcgctgggcacttccct

SEQ ID NO: 3027277 - DNA, 20 bp, Homo sapiens
tgcgctggttccgccaggcg

SEQ ID NO: 3027278 - DNA, 21 bp, Homo sapiens
tgcgctggttccgccaggcgc

SEQ ID NO: 3027279 - DNA, 13 bp, Homo sapiens
tgcgctttgaacg

SEQ ID NO: 3027280 - DNA, 20 bp, Homo sapiens
tgcgctttgaacgtgccagc

SEQ ID NO: 3027281 - DNA, 22 bp, Homo sapiens
tgcgctttgaacgtgccagcag

SEQ ID NO: 3027282 - DNA, 23 bp, Homo sapiens
tgcggaaaggtatttgggaaact

SEQ ID NO: 3027283 - DNA, 20 bp, Homo sapiens
tgcggacaccgtggcctggg

SEQ ID NO: 3027284 - DNA, 14 bp, Homo sapiens
tgcggagcagcctt

SEQ ID NO: 3027285 - DNA, 13 bp, Homo sapiens
tgcggaggctgct

SEQ ID NO: 3027286 - DNA, 23 bp, Homo sapiens
tgcggaggctgctcagatggcct

SEQ ID NO: 3027287 - DNA, 15 bp, Homo sapiens
tgcggagtctcctct

SEQ ID NO: 3027288 - DNA, 13 bp, Homo sapiens
tgcggatggccgg

SEQ ID NO: 3027289 - DNA, 13 bp, Homo sapiens
tgcggccaccacc

SEQ ID NO: 3027290 - DNA, 19 bp, Homo sapiens
tgcggccgcattccctgag

SEQ ID NO: 3027291 - DNA, 19 bp, Homo sapiens
tgcggcgtggagactggca

SEQ ID NO: 3027292 - DNA, 23 bp, Homo sapiens
tgcggctttatcattcctttcca

SEQ ID NO: 3027293 - DNA, 16 bp, Homo sapiens
tgcgggacagagggtg

SEQ ID NO: 3027294 - DNA, 14 bp, Homo sapiens
tgcgggctcgccca

SEQ ID NO: 3027295 - DNA, 13 bp, Homo sapiens
tgcgggctgaggg

SEQ ID NO: 3027296 - DNA, 14 bp, Homo sapiens
tgcgggctgagggc

SEQ ID NO: 3027297 - DNA, 19 bp, Homo sapiens
tgcgggctgagggcatctc

SEQ ID NO: 3027298 - DNA, 16 bp, Homo sapiens
tgcgggtcctcagctg

SEQ ID NO: 3027299 - DNA, 20 bp, Homo sapiens
tgcgggtcctcagctgctcc

SEQ ID NO: 3027300 - DNA, 15 bp, Homo sapiens
tgcggtagccagcac

SEQ ID NO: 3027301 - DNA, 18 bp, Homo sapiens
tgcggtgacggcggggtg

SEQ ID NO: 3027302 - DNA, 12 bp, Homo sapiens
tgcgtattctgt

SEQ ID NO: 3027303 - DNA, 14 bp, Homo sapiens
tgcgtattctgtgg

SEQ ID NO: 3027304 - DNA, 15 bp, Homo sapiens
tgcgtattctgtggc

SEQ ID NO: 3027305 - DNA, 16 bp, Homo sapiens
tgcgtattctgtggcc

SEQ ID NO: 3027306 - DNA, 14 bp, Homo sapiens
tgcgtccaccaggc

SEQ ID NO: 3027307 - DNA, 17 bp, Homo sapiens
tgcgtccaccaggcctc

SEQ ID NO: 3027308 - DNA, 23 bp, Homo sapiens
tgcgtccaccaggcctcactggc

SEQ ID NO: 3027309 - DNA, 14 bp, Homo sapiens
tgcgtgacaataaa

SEQ ID NO: 3027310 - DNA, 17 bp, Homo sapiens
tgcgtgacaataaaaca

SEQ ID NO: 3027311 - DNA, 22 bp, Homo sapiens
tgcgtgacaataaaacattaat

SEQ ID NO: 3027312 - DNA, 20 bp, Homo sapiens
tgcgtgacactctccttgca

SEQ ID NO: 3027313 - DNA, 17 bp, Homo sapiens
tgcgtgcccctgctgct

SEQ ID NO: 3027314 - DNA, 20 bp, Homo sapiens
tgcgtggcttccctgtccca

SEQ ID NO: 3027315 - DNA, 15 bp, Homo sapiens
tgcgtggtgtggccc

SEQ ID NO: 3027316 - DNA, 17 bp, Homo sapiens
tgcgtgtggcgtggccc

SEQ ID NO: 3027317 - DNA, 13 bp, Homo sapiens
tgcgttcccttca

SEQ ID NO: 3027318 - DNA, 12 bp, Homo sapiens
tgctaaaaatgg

SEQ ID NO: 3027319 - DNA, 17 bp, Homo sapiens
tgctaaaaatgggactt

SEQ ID NO: 3027320 - DNA, 14 bp, Homo sapiens
tgctaaaattctat

SEQ ID NO: 3027321 - DNA, 12 bp, Homo sapiens
tgctaaacactg

SEQ ID NO: 3027322 - DNA, 20 bp, Homo sapiens
tgctaaagccaaccagcctt

SEQ ID NO: 3027323 - DNA, 14 bp, Homo sapiens
tgctaaatatttct

SEQ ID NO: 3027324 - DNA, 23 bp, Homo sapiens
tggaactacattagtacacagca

SEQ ID NO: 3027325 - DNA, 13 bp, Homo sapiens
tggaactgtccca

SEQ ID NO: 3027326 - DNA, 17 bp, Homo sapiens
tggaactttagggggtg

SEQ ID NO: 3027327 - DNA, 21 bp, Homo sapiens
tggaagaaaatggaattactc

SEQ ID NO: 3027328 - DNA, 21 bp, Homo sapiens
tggaagacaggaaagttcaga

SEQ ID NO: 3027329 - DNA, 14 bp, Homo sapiens
tggaagacatatat

SEQ ID NO: 3027330 - DNA, 15 bp, Homo sapiens
tggaagatcctgtga

SEQ ID NO: 3027331 - DNA, 21 bp, Homo sapiens
tggaagatgcagaagcaataa

SEQ ID NO: 3027332 - DNA, 16 bp, Homo sapiens
tggaagcaacgtgtta

SEQ ID NO: 3027333 - DNA, 13 bp, Homo sapiens
tggaagcagagca

SEQ ID NO: 3027334 - DNA, 13 bp, Homo sapiens
tggaagccctcct

SEQ ID NO: 3027335 - DNA, 15 bp, Homo sapiens
tggaagccctccttc

SEQ ID NO: 3027336 - DNA, 16 bp, Homo sapiens
tggaagccctccttcc

SEQ ID NO: 3027337 - DNA, 20 bp, Homo sapiens
tggaagcctgaactgaggcc

SEQ ID NO: 3027338 - DNA, 19 bp, Homo sapiens
tggaagctggagggtgcta

SEQ ID NO: 3027339 - DNA, 20 bp, Homo sapiens
tggaagcttgttttccagtc

SEQ ID NO: 3027340 - DNA, 18 bp, Homo sapiens
tggaaggagcacatacta

SEQ ID NO: 3027341 - DNA, 20 bp, Homo sapiens
tggaaggagcacatactacc

SEQ ID NO: 3027342 - DNA, 16 bp, Homo sapiens
tggaaggtgccagaag

SEQ ID NO: 3027343 - DNA, 15 bp, Homo sapiens
tggaagtaaaggcat

SEQ ID NO: 3027344 - DNA, 21 bp, Homo sapiens
tggaagtaaaggcattccaca

SEQ ID NO: 3027345 - DNA, 14 bp, Homo sapiens
tggaagtatttgag

SEQ ID NO: 3027346 - DNA, 18 bp, Homo sapiens
tggaagtcaaataaatgt

SEQ ID NO: 3027347 - DNA, 17 bp, Homo sapiens
tggaagtccaatgtggc

SEQ ID NO: 3027348 - DNA, 14 bp, Homo sapiens
tggaagtccctcag

SEQ ID NO: 3027349 - DNA, 20 bp, Homo sapiens
tggaagtccctcagaggcct

SEQ ID NO: 3027350 - DNA, 13 bp, Homo sapiens
tggaagtgttcct

SEQ ID NO: 3027351 - DNA, 15 bp, Homo sapiens
tggaagtgttcctgt

SEQ ID NO: 3027352 - DNA, 16 bp, Homo sapiens
tggaagtgttcctgtc

SEQ ID NO: 3027353 - DNA, 14 bp, Homo sapiens
tggaatataaggaa

SEQ ID NO: 3027354 - DNA, 18 bp, Homo sapiens
tggaatcagagatttttg

SEQ ID NO: 3027355 - DNA, 21 bp, Homo sapiens
tggaatcagattttaacagct

SEQ ID NO: 3027356 - DNA, 18 bp, Homo sapiens
tggaatctacatgtgttt

SEQ ID NO: 3027357 - DNA, 17 bp, Homo sapiens
tggaatctggagaccag

SEQ ID NO: 3027358 - DNA, 22 bp, Homo sapiens
tggaatgcacacagcggctgcc

SEQ ID NO: 3027359 - DNA, 23 bp, Homo sapiens
tggaatgccaatgtcagcatcaa

SEQ ID NO: 3027360 - DNA, 18 bp, Homo sapiens
tggaatggttataaaagt

SEQ ID NO: 3027361 - DNA, 21 bp, Homo sapiens
tggaatggttataaaagtgat

SEQ ID NO: 3027362 - DNA, 15 bp, Homo sapiens
tggaatgtaaaataa

SEQ ID NO: 3027363 - DNA, 14 bp, Homo sapiens
tggaatgtcagtgt

SEQ ID NO: 3027364 - DNA, 15 bp, Homo sapiens
tggaatgtcagtgtt

SEQ ID NO: 3027365 - DNA, 15 bp, Homo sapiens
tggaattactccaaa

SEQ ID NO: 3027366 - DNA, 13 bp, Homo sapiens
tggaattgacatt

SEQ ID NO: 3027367 - DNA, 17 bp, Homo sapiens
tggaattgacattctct

SEQ ID NO: 3027368 - DNA, 20 bp, Homo sapiens
tggaattgatttgcattgaa

SEQ ID NO: 3027369 - DNA, 23 bp, Homo sapiens
tggaattgatttgcattgaacac

SEQ ID NO: 3027370 - DNA, 14 bp, Homo sapiens
tggaattggtgtat

SEQ ID NO: 3027371 - DNA, 18 bp, Homo sapiens
tggaattggtgtatatca

SEQ ID NO: 3027372 - DNA, 19 bp, Homo sapiens
tggaattggtgtatatcat

SEQ ID NO: 3027373 - DNA, 12 bp, Homo sapiens
tggaattttctg

SEQ ID NO: 3027374 - DNA, 13 bp, Homo sapiens
tggaattttctgt

SEQ ID NO: 3027375 - DNA, 17 bp, Homo sapiens
tggaattttctgttcat

SEQ ID NO: 3027376 - DNA, 14 bp, Homo sapiens
tggacaaagaaaac

SEQ ID NO: 3027377 - DNA, 20 bp, Homo sapiens
tggacaaatgtgaagatgca

SEQ ID NO: 3027378 - DNA, 21 bp, Homo sapiens
tggacaaatgtgaagatgcat

SEQ ID NO: 3027379 - DNA, 21 bp, Homo sapiens
tggacaacttatttaaaaata

SEQ ID NO: 3027380 - DNA, 14 bp, Homo sapiens
tggacaagtcatgg

SEQ ID NO: 3027381 - DNA, 18 bp, Homo sapiens
tggacaatctcacacctt

SEQ ID NO: 3027382 - DNA, 13 bp, Homo sapiens
tggacacaggcct

SEQ ID NO: 3027383 - DNA, 14 bp, Homo sapiens
tggacactgtgaca

SEQ ID NO: 3027384 - DNA, 14 bp, Homo sapiens
tggacacttcttta

SEQ ID NO: 3027385 - DNA, 14 bp, Homo sapiens
tggacacttttcac

SEQ ID NO: 3027386 - DNA, 16 bp, Homo sapiens
tggacagatggacgca

SEQ ID NO: 3027387 - DNA, 15 bp, Homo sapiens
tggacagatttcagt

SEQ ID NO: 3027388 - DNA, 14 bp, Homo sapiens
tggacagccccacc

SEQ ID NO: 3027389 - DNA, 18 bp, Homo sapiens
tggacaggatgaggacag

SEQ ID NO: 3027390 - DNA, 21 bp, Homo sapiens
tggacaggatgaggacagagg

SEQ ID NO: 3027391 - DNA, 23 bp, Homo sapiens
tggacaggatgaggacagagggc

SEQ ID NO: 3027392 - DNA, 13 bp, Homo sapiens
tggacaggatgtg

SEQ ID NO: 3027393 - DNA, 22 bp, Homo sapiens
tggaccaaacccttagcagccc

SEQ ID NO: 3027394 - DNA, 21 bp, Homo sapiens
tggaccaccgttcagtcattt

SEQ ID NO: 3027395 - DNA, 12 bp, Homo sapiens
tggaccactgca

SEQ ID NO: 3027396 - DNA, 16 bp, Homo sapiens
tggaccaggtcctgct

SEQ ID NO: 3027397 - DNA, 22 bp, Homo sapiens
tggaccaggtcctgctccgctg

SEQ ID NO: 3027398 - DNA, 21 bp, Homo sapiens
tggaccatttgattgttttat

SEQ ID NO: 3027399 - DNA, 14 bp, Homo sapiens
tggaccccctgccc

SEQ ID NO: 3027400 - DNA, 13 bp, Homo sapiens
tggacccctggac

SEQ ID NO: 3027401 - DNA, 14 bp, Homo sapiens
tggacctattgcca

SEQ ID NO: 3027402 - DNA, 22 bp, Homo sapiens
tggacctcaggttcctaagact

SEQ ID NO: 3027403 - DNA, 15 bp, Homo sapiens
tggacctctcttgtg

SEQ ID NO: 3027404 - DNA, 12 bp, Homo sapiens
tggacctggcag

SEQ ID NO: 3027405 - DNA, 23 bp, Homo sapiens
tggacctgtatatttgtaaagct

SEQ ID NO: 3027406 - DNA, 16 bp, Homo sapiens
tggaccttaggccttc

SEQ ID NO: 3027407 - DNA, 18 bp, Homo sapiens
tggaccttgacagagcag

SEQ ID NO: 3027408 - DNA, 16 bp, Homo sapiens
tggacgcaggccctgt

SEQ ID NO: 3027409 - DNA, 20 bp, Homo sapiens
tggacgcaggccctgtccag

SEQ ID NO: 3027410 - DNA, 15 bp, Homo sapiens
tggacggcgctgcct

SEQ ID NO: 3027411 - DNA, 19 bp, Homo sapiens
tggacggcgctgcctcagg

SEQ ID NO: 3027412 - DNA, 23 bp, Homo sapiens
tggacggcgctgcctcaggcact

SEQ ID NO: 3027413 - DNA, 21 bp, Homo sapiens
tggacggggtcggacggggca

SEQ ID NO: 3027414 - DNA, 18 bp, Homo sapiens
tggacgtgaaatacttcg

SEQ ID NO: 3027415 - DNA, 21 bp, Homo sapiens
tggactagagggacctctccc

SEQ ID NO: 3027416 - DNA, 16 bp, Homo sapiens
tggactcagctctgtc

SEQ ID NO: 3027417 - DNA, 17 bp, Homo sapiens
tggactcagctctgtct

SEQ ID NO: 3027418 - DNA, 15 bp, Homo sapiens
tggactcagggcagc

SEQ ID NO: 3027419 - DNA, 20 bp, Homo sapiens
tggactcagggcagcgccag

SEQ ID NO: 3027420 - DNA, 23 bp, Homo sapiens
tggactccagcctgcctggcagg

SEQ ID NO: 3027421 - DNA, 20 bp, Homo sapiens
tggactctcagtctctgagc

SEQ ID NO: 3027422 - DNA, 22 bp, Homo sapiens
tggactctggtgcctccagagg

SEQ ID NO: 3027423 - DNA, 19 bp, Homo sapiens
tggactgacctggtccaca

SEQ ID NO: 3027424 - DNA, 20 bp, Homo sapiens
tggactgagcgaggaaaaac

SEQ ID NO: 3027425 - DNA, 14 bp, Homo sapiens
tggactgagcggcc

SEQ ID NO: 3027426 - DNA, 13 bp, Homo sapiens
tggactgcagaag

SEQ ID NO: 3027427 - DNA, 18 bp, Homo sapiens
tggactgcagtcggcatg

SEQ ID NO: 3027428 - DNA, 18 bp, Homo sapiens
tggactggaaaatctctt

SEQ ID NO: 3027429 - DNA, 14 bp, Homo sapiens
tggactggttttca

SEQ ID NO: 3027430 - DNA, 13 bp, Homo sapiens
tggactgtctttt

SEQ ID NO: 3027431 - DNA, 18 bp, Homo sapiens
tggactgtggcacttgcc

SEQ ID NO: 3027432 - DNA, 20 bp, Homo sapiens
tggactgtggcacttgcctg

SEQ ID NO: 3027433 - DNA, 21 bp, Homo sapiens
tggactgtggcacttgcctgg

SEQ ID NO: 3027434 - DNA, 13 bp, Homo sapiens
tggacttatttaa

SEQ ID NO: 3027435 - DNA, 19 bp, Homo sapiens
tggacttcaaagcaagctg

SEQ ID NO: 3027436 - DNA, 11 bp, Homo sapiens
tggacttctga

SEQ ID NO: 3027437 - DNA, 15 bp, Homo sapiens
tggacttctgaagag

SEQ ID NO: 3027438 - DNA, 16 bp, Homo sapiens
tggacttctgaagaga

SEQ ID NO: 3027439 - DNA, 18 bp, Homo sapiens
tggacttgaactttcctg

SEQ ID NO: 3027440 - DNA, 16 bp, Homo sapiens
tggagaaaccctgtct

SEQ ID NO: 3027441 - DNA, 19 bp, Homo sapiens
tggagaacaacaaggacaa

SEQ ID NO: 3027442 - DNA, 17 bp, Homo sapiens
tggagaagatcgcatgg

SEQ ID NO: 3027443 - DNA, 19 bp, Homo sapiens
tggagaagccattgtcttc

SEQ ID NO: 3027444 - DNA, 18 bp, Homo sapiens
tggagacaatgtctgcag

SEQ ID NO: 3027445 - DNA, 19 bp, Homo sapiens
tggagacaatgtctgcagc

SEQ ID NO: 3027446 - DNA, 22 bp, Homo sapiens
tggagacaatgtctgcagccct

SEQ ID NO: 3027447 - DNA, 15 bp, Homo sapiens
tggagactggcaggc

SEQ ID NO: 3027448 - DNA, 16 bp, Homo sapiens
tggagactggcaggcg

SEQ ID NO: 3027449 - DNA, 18 bp, Homo sapiens
tggagactttctttaaat

SEQ ID NO: 3027450 - DNA, 21 bp, Homo sapiens
tggagagaccagcctttcttc

SEQ ID NO: 3027451 - DNA, 16 bp, Homo sapiens
tggagagcgaggaggc

SEQ ID NO: 3027452 - DNA, 18 bp, Homo sapiens
tggagaggatttgatttc

SEQ ID NO: 3027453 - DNA, 24 bp, Homo sapiens
tggagagggctacaaaggaggaca

SEQ ID NO: 3027454 - DNA, 19 bp, Homo sapiens
tggagagtgagagcatgtg

SEQ ID NO: 3027455 - DNA, 20 bp, Homo sapiens
tggagatctgaacccagctg

SEQ ID NO: 3027456 - DNA, 14 bp, Homo sapiens
tggcttgtcctcac

SEQ ID NO: 3027457 - DNA, 16 bp, Homo sapiens
tggcttgttgtaaagc

SEQ ID NO: 3027458 - DNA, 17 bp, Homo sapiens
tggctttaggagcagtg

SEQ ID NO: 3027459 - DNA, 16 bp, Homo sapiens
tggctttcatcctgtg

SEQ ID NO: 3027460 - DNA, 17 bp, Homo sapiens
tggctttcatcctgtgt

SEQ ID NO: 3027461 - DNA, 18 bp, Homo sapiens
tggctttcatcctgtgtc

SEQ ID NO: 3027462 - DNA, 20 bp, Homo sapiens
tggctttcatcctgtgtccc

SEQ ID NO: 3027463 - DNA, 17 bp, Homo sapiens
tggctttcattattagt

SEQ ID NO: 3027464 - DNA, 12 bp, Homo sapiens
tggctttgtctt

SEQ ID NO: 3027465 - DNA, 17 bp, Homo sapiens
tggctttgtcttgaaaa

SEQ ID NO: 3027466 - DNA, 16 bp, Homo sapiens
tggctttgttcttgtc

SEQ ID NO: 3027467 - DNA, 17 bp, Homo sapiens
tggcttttattaatgca

SEQ ID NO: 3027468 - DNA, 21 bp, Homo sapiens
tggcttttattaatgcacttt

SEQ ID NO: 3027469 - DNA, 16 bp, Homo sapiens
tggcttttatttcagt

SEQ ID NO: 3027470 - DNA, 14 bp, Homo sapiens
tggcttttctgttt

SEQ ID NO: 3027471 - DNA, 21 bp, Homo sapiens
tggcttttttttttcttttgt

SEQ ID NO: 3027472 - DNA, 18 bp, Homo sapiens
tgggaaacaaataatttg

SEQ ID NO: 3027473 - DNA, 21 bp, Homo sapiens
tgggaaaccccttctctgtga

SEQ ID NO: 3027474 - DNA, 17 bp, Homo sapiens
tgggaaaggagtagaaa

SEQ ID NO: 3027475 - DNA, 18 bp, Homo sapiens
tgggaacatttattttat

SEQ ID NO: 3027476 - DNA, 21 bp, Homo sapiens
tgggaacatttattttatgag

SEQ ID NO: 3027477 - DNA, 22 bp, Homo sapiens
tgggaacatttattttatgaga

SEQ ID NO: 3027478 - DNA, 23 bp, Homo sapiens
tgggaacatttattttatgagaa

SEQ ID NO: 3027479 - DNA, 18 bp, Homo sapiens
tgggaacgtgactgcccc

SEQ ID NO: 3027480 - DNA, 14 bp, Homo sapiens
tgggaactggaggg

SEQ ID NO: 3027481 - DNA, 17 bp, Homo sapiens
tgggaactggttcaaga

SEQ ID NO: 3027482 - DNA, 17 bp, Homo sapiens
tgggaagctggagtgct

SEQ ID NO: 3027483 - DNA, 14 bp, Homo sapiens
tgggaaggaaaggc

SEQ ID NO: 3027484 - DNA, 17 bp, Homo sapiens
tgggaaggaaaggcaga

SEQ ID NO: 3027485 - DNA, 16 bp, Homo sapiens
tgggaaggccagctgc

SEQ ID NO: 3027486 - DNA, 14 bp, Homo sapiens
tgggaagggagagg

SEQ ID NO: 3027487 - DNA, 18 bp, Homo sapiens
tgggaagggagagggcct

SEQ ID NO: 3027488 - DNA, 19 bp, Homo sapiens
tgggaaggggacccccgcc

SEQ ID NO: 3027489 - DNA, 12 bp, Homo sapiens
tgggaaggggag

SEQ ID NO: 3027490 - DNA, 15 bp, Homo sapiens
tgggaataaatatgc

SEQ ID NO: 3027491 - DNA, 21 bp, Homo sapiens
tgggaataatagacactgggg

SEQ ID NO: 3027492 - DNA, 23 bp, Homo sapiens
tgggaatacaaaaggtttgagat

SEQ ID NO: 3027493 - DNA, 14 bp, Homo sapiens
tgggaatcaagatt

SEQ ID NO: 3027494 - DNA, 13 bp, Homo sapiens
tgggaatcaggca

SEQ ID NO: 3027495 - DNA, 13 bp, Homo sapiens
tgggaatctccca

SEQ ID NO: 3027496 - DNA, 13 bp, Homo sapiens
tgggaatgaagct

SEQ ID NO: 3027497 - DNA, 20 bp, Homo sapiens
tgggaatgaagcttgtgtat

SEQ ID NO: 3027498 - DNA, 15 bp, Homo sapiens
tgggaatgagacata

SEQ ID NO: 3027499 - DNA, 20 bp, Homo sapiens
tgggaattctttacaataaa

SEQ ID NO: 3027500 - DNA, 22 bp, Homo sapiens
tgggaattctttacaataaaca

SEQ ID NO: 3027501 - DNA, 17 bp, Homo sapiens
tgggaccaaagggggag

SEQ ID NO: 3027502 - DNA, 17 bp, Homo sapiens
tgggaccacaactattt

SEQ ID NO: 3027503 - DNA, 15 bp, Homo sapiens
tgggaccccaggccc

SEQ ID NO: 3027504 - DNA, 16 bp, Homo sapiens
tgggaccccaggccca

SEQ ID NO: 3027505 - DNA, 22 bp, Homo sapiens
tgggaccccaggcccactcagg

SEQ ID NO: 3027506 - DNA, 17 bp, Homo sapiens
tgggacccccgtggggc

SEQ ID NO: 3027507 - DNA, 22 bp, Homo sapiens
tgggacccccgtggggcaggga

SEQ ID NO: 3027508 - DNA, 23 bp, Homo sapiens
tgggaccctgctttagagctagg

SEQ ID NO: 3027509 - DNA, 17 bp, Homo sapiens
tgggaccctttccttcc

SEQ ID NO: 3027510 - DNA, 18 bp, Homo sapiens
tgggaccctttccttcct

SEQ ID NO: 3027511 - DNA, 19 bp, Homo sapiens
tgggacctaggggcgccgc

SEQ ID NO: 3027512 - DNA, 17 bp, Homo sapiens
tgggacgtagagcacag

SEQ ID NO: 3027513 - DNA, 17 bp, Homo sapiens
tgggactacaggcatgc

SEQ ID NO: 3027514 - DNA, 18 bp, Homo sapiens
tgggactccaggccagct

SEQ ID NO: 3027515 - DNA, 15 bp, Homo sapiens
tgggacttcttttca

SEQ ID NO: 3027516 - DNA, 22 bp, Homo sapiens
tgggagaaaacgccagtgtgtt

SEQ ID NO: 3027517 - DNA, 13 bp, Homo sapiens
tgggagaaagcaa

SEQ ID NO: 3027518 - DNA, 16 bp, Homo sapiens
tgggagaatcagcaga

SEQ ID NO: 3027519 - DNA, 21 bp, Homo sapiens
tgggagaattcttacatgttt

SEQ ID NO: 3027520 - DNA, 20 bp, Homo sapiens
tgggagagacttggatgagg

SEQ ID NO: 3027521 - DNA, 18 bp, Homo sapiens
tgggagagtgtcaaccag

SEQ ID NO: 3027522 - DNA, 23 bp, Homo sapiens
tgggagagtgtcaaccagacaga

SEQ ID NO: 3027523 - DNA, 14 bp, Homo sapiens
tgggagatgaaaac

SEQ ID NO: 3027524 - DNA, 23 bp, Homo sapiens
tgggagatgaaaacctgcatttt

SEQ ID NO: 3027525 - DNA, 14 bp, Homo sapiens
tgggagatgtggaa

SEQ ID NO: 3027526 - DNA, 15 bp, Homo sapiens
tgggagcaagttgca

SEQ ID NO: 3027527 - DNA, 19 bp, Homo sapiens
tgggagccgggaccctcag

SEQ ID NO: 3027528 - DNA, 22 bp, Homo sapiens
tgggagccgggaccctcaggtg

SEQ ID NO: 3027529 - DNA, 16 bp, Homo sapiens
tgggagcctgaggcag

SEQ ID NO: 3027530 - DNA, 18 bp, Homo sapiens
tgggagcctgaggcagga

SEQ ID NO: 3027531 - DNA, 20 bp, Homo sapiens
tgggagcctgaggcaggaga

SEQ ID NO: 3027532 - DNA, 22 bp, Homo sapiens
tgggagcttcccacacctgcct

SEQ ID NO: 3027533 - DNA, 20 bp, Homo sapiens
tgggaggaaaagaaaagagg

SEQ ID NO: 3027534 - DNA, 18 bp, Homo sapiens
tgggaggagcagattttt

SEQ ID NO: 3027535 - DNA, 21 bp, Homo sapiens
tgggaggccaaggtgggcgga

SEQ ID NO: 3027536 - DNA, 18 bp, Homo sapiens
tgggaggccaggcgagcc

SEQ ID NO: 3027537 - DNA, 20 bp, Homo sapiens
tgggaggccaggcgagcctg

SEQ ID NO: 3027538 - DNA, 23 bp, Homo sapiens
tgggaggccaggcgagcctgact

SEQ ID NO: 3027539 - DNA, 20 bp, Homo sapiens
tgggaggctcacccccttct

SEQ ID NO: 3027540 - DNA, 17 bp, Homo sapiens
tgggaggctcctgttag

SEQ ID NO: 3027541 - DNA, 22 bp, Homo sapiens
tgggaggctcctgttagctcct

SEQ ID NO: 3027542 - DNA, 13 bp, Homo sapiens
tgggaggctgcag

SEQ ID NO: 3027543 - DNA, 15 bp, Homo sapiens
tgggaggctgcagcc

SEQ ID NO: 3027544 - DNA, 17 bp, Homo sapiens
tgggaggctgcagccag

SEQ ID NO: 3027545 - DNA, 19 bp, Homo sapiens
tgggaggctgcagccaggc

SEQ ID NO: 3027546 - DNA, 16 bp, Homo sapiens
tgggagggaggctcag

SEQ ID NO: 3027547 - DNA, 21 bp, Homo sapiens
tgggagggatggcccttcctc

SEQ ID NO: 3027548 - DNA, 17 bp, Homo sapiens
tgggagggcagcagggc

SEQ ID NO: 3027549 - DNA, 19 bp, Homo sapiens
tgggagggggcgttggatt

SEQ ID NO: 3027550 - DNA, 20 bp, Homo sapiens
tgggaggtataggggtcctg

SEQ ID NO: 3027551 - DNA, 19 bp, Homo sapiens
tgggaggtggaggttgcat

SEQ ID NO: 3027552 - DNA, 14 bp, Homo sapiens
tgggagtacaaaag

SEQ ID NO: 3027553 - DNA, 18 bp, Homo sapiens
tgggatattttgaaatga

SEQ ID NO: 3027554 - DNA, 22 bp, Homo sapiens
tgggatattttgaaatgaactt

SEQ ID NO: 3027555 - DNA, 20 bp, Homo sapiens
tgggatcacaggtgtcagcc

SEQ ID NO: 3027556 - DNA, 18 bp, Homo sapiens
tgggatcatgaaagtaga

SEQ ID NO: 3027557 - DNA, 19 bp, Homo sapiens
tgggatccctgtctttcct

SEQ ID NO: 3027558 - DNA, 23 bp, Homo sapiens
tgggatccctgtctttcctaaga

SEQ ID NO: 3027559 - DNA, 23 bp, Homo sapiens
tgggatgacaggcgcctgccatc

SEQ ID NO: 3027560 - DNA, 16 bp, Homo sapiens
tgggatggaggagaag

SEQ ID NO: 3027561 - DNA, 17 bp, Homo sapiens
tgggatggtggagggcc

SEQ ID NO: 3027562 - DNA, 18 bp, Homo sapiens
tgggatggtggagggcca

SEQ ID NO: 3027563 - DNA, 16 bp, Homo sapiens
tgggatggtgggcttc

SEQ ID NO: 3027564 - DNA, 20 bp, Homo sapiens
tgggatgtggttttcttaag

SEQ ID NO: 3027565 - DNA, 14 bp, Homo sapiens
tgggattaagtaca

SEQ ID NO: 3027566 - DNA, 21 bp, Homo sapiens
tgggattacaggcgtgagcca

SEQ ID NO: 3027567 - DNA, 20 bp, Homo sapiens
tgggattataggcatgagcc

SEQ ID NO: 3027568 - DNA, 14 bp, Homo sapiens
tgggattcagagaa

SEQ ID NO: 3027569 - DNA, 16 bp, Homo sapiens
tgggattgagtctgtg

SEQ ID NO: 3027570 - DNA, 16 bp, Homo sapiens
tgggatttgaatcaat

SEQ ID NO: 3027571 - DNA, 15 bp, Homo sapiens
tgggcaaagcctagt

SEQ ID NO: 3027572 - DNA, 15 bp, Homo sapiens
tgggcaatatagcaa

SEQ ID NO: 3027573 - DNA, 13 bp, Homo sapiens
tgggcaatttaga

SEQ ID NO: 3027574 - DNA, 16 bp, Homo sapiens
tgggcacacgcctccc

SEQ ID NO: 3027575 - DNA, 19 bp, Homo sapiens
tgggcacctgcgcacaggt

SEQ ID NO: 3027576 - DNA, 18 bp, Homo sapiens
tgggcagaatcctgggcc

SEQ ID NO: 3027577 - DNA, 22 bp, Homo sapiens
tgggcagaatcctgggccccca

SEQ ID NO: 3027578 - DNA, 15 bp, Homo sapiens
tgggcagagcctgtc

SEQ ID NO: 3027579 - DNA, 17 bp, Homo sapiens
tgggcagcacaaggcct

SEQ ID NO: 3027580 - DNA, 22 bp, Homo sapiens
tgggcagcagcatcccagcctt

SEQ ID NO: 3027581 - DNA, 23 bp, Homo sapiens
tgggcagcagcatcccagccttg

SEQ ID NO: 3027582 - DNA, 16 bp, Homo sapiens
tgggcagccatgagaa

SEQ ID NO: 3027583 - DNA, 19 bp, Homo sapiens
tgggcagctgtcccttgct

SEQ ID NO: 3027584 - DNA, 16 bp, Homo sapiens
tgggcaggagggaggt

SEQ ID NO: 3027585 - DNA, 18 bp, Homo sapiens
tgggcaggagggaggtgc

SEQ ID NO: 3027586 - DNA, 17 bp, Homo sapiens
tgggcaggagtcaccat

SEQ ID NO: 3027587 - DNA, 19 bp, Homo sapiens
tgtaaaatattttgaatca

SEQ ID NO: 3027588 - DNA, 21 bp, Homo sapiens
tgtaaaatattttgaatcaat

SEQ ID NO: 3027589 - DNA, 19 bp, Homo sapiens
tgtaaacagtgcctgctga

SEQ ID NO: 3027590 - DNA, 19 bp, Homo sapiens
tgtaaaccgctttggcctg

SEQ ID NO: 3027591 - DNA, 13 bp, Homo sapiens
tgtaaactttttg

SEQ ID NO: 3027592 - DNA, 15 bp, Homo sapiens
tgtaaagaaagagag

SEQ ID NO: 3027593 - DNA, 16 bp, Homo sapiens
tgtaaagaaagagaga

SEQ ID NO: 3027594 - DNA, 19 bp, Homo sapiens
tgtaaagaaagagagaaaa

SEQ ID NO: 3027595 - DNA, 20 bp, Homo sapiens
tgtaaagaaagagagaaaat

SEQ ID NO: 3027596 - DNA, 22 bp, Homo sapiens
tgtaaagaaagagagaaaataa

SEQ ID NO: 3027597 - DNA, 12 bp, Homo sapiens
tgtaaagcattc

SEQ ID NO: 3027598 - DNA, 13 bp, Homo sapiens
tgtaaagccatgc

SEQ ID NO: 3027599 - DNA, 22 bp, Homo sapiens
tgtaaagtagctgtaagaattt

SEQ ID NO: 3027600 - DNA, 20 bp, Homo sapiens
tgtaaagtgaagaatccttt

SEQ ID NO: 3027601 - DNA, 21 bp, Homo sapiens
tgtaaagtgaagaatcctttt

SEQ ID NO: 3027602 - DNA, 12 bp, Homo sapiens
tgtaaagttagt

SEQ ID NO: 3027603 - DNA, 17 bp, Homo sapiens
tgtaaagttagtctact

SEQ ID NO: 3027604 - DNA, 14 bp, Homo sapiens
tgtaaataaaaaga

SEQ ID NO: 3027605 - DNA, 13 bp, Homo sapiens
tgtaaataactct

SEQ ID NO: 3027606 - DNA, 21 bp, Homo sapiens
tgtaaatacacatagcatgta

SEQ ID NO: 3027607 - DNA, 13 bp, Homo sapiens
tgtaaatacataa

SEQ ID NO: 3027608 - DNA, 17 bp, Homo sapiens
tgtaaataggattttta

SEQ ID NO: 3027609 - DNA, 17 bp, Homo sapiens
tgtaaatcgggaaggat

SEQ ID NO: 3027610 - DNA, 20 bp, Homo sapiens
tgtaaatcgggaaggatggg

SEQ ID NO: 3027611 - DNA, 21 bp, Homo sapiens
tgtaaatgaagggtcatttct

SEQ ID NO: 3027612 - DNA, 13 bp, Homo sapiens
tgtaaatgctcaa

SEQ ID NO: 3027613 - DNA, 16 bp, Homo sapiens
tgtaaatgtactggta

SEQ ID NO: 3027614 - DNA, 20 bp, Homo sapiens
tgtaaatgtactggtaattg

SEQ ID NO: 3027615 - DNA, 15 bp, Homo sapiens
tgtaaatgtgttgga

SEQ ID NO: 3027616 - DNA, 17 bp, Homo sapiens
tgtaaatgttagtttct

SEQ ID NO: 3027617 - DNA, 13 bp, Homo sapiens
tgtaaattatatt

SEQ ID NO: 3027618 - DNA, 14 bp, Homo sapiens
tgtaaattcagtct

SEQ ID NO: 3027619 - DNA, 17 bp, Homo sapiens
tgtaacagaaagggcaa

SEQ ID NO: 3027620 - DNA, 14 bp, Homo sapiens
tgtaacagtctgat

SEQ ID NO: 3027621 - DNA, 11 bp, Homo sapiens
tgtaacatgta

SEQ ID NO: 3027622 - DNA, 18 bp, Homo sapiens
tgtaaccacctctctgtc

SEQ ID NO: 3027623 - DNA, 18 bp, Homo sapiens
tgtaaccagctcagtgtt

SEQ ID NO: 3027624 - DNA, 22 bp, Homo sapiens
tgtaaccattttataaagtgct

SEQ ID NO: 3027625 - DNA, 19 bp, Homo sapiens
tgtaacctcttcagaggcc

SEQ ID NO: 3027626 - DNA, 21 bp, Homo sapiens
tgtaaccttgggtggcccctg

SEQ ID NO: 3027627 - DNA, 19 bp, Homo sapiens
tgtaactatttcttcagag

SEQ ID NO: 3027628 - DNA, 23 bp, Homo sapiens
tgtaactgcattgagaactgcat

SEQ ID NO: 3027629 - DNA, 14 bp, Homo sapiens
tgtaacttaaagat

SEQ ID NO: 3027630 - DNA, 20 bp, Homo sapiens
tgtaagaaaatgctgtcaca

SEQ ID NO: 3027631 - DNA, 17 bp, Homo sapiens
tgtaagaaacacactga

SEQ ID NO: 3027632 - DNA, 22 bp, Homo sapiens
tgtaagaaacacactgaggcag

SEQ ID NO: 3027633 - DNA, 12 bp, Homo sapiens
tgtaagaaacct

SEQ ID NO: 3027634 - DNA, 12 bp, Homo sapiens
tgtaagaataat

SEQ ID NO: 3027635 - DNA, 16 bp, Homo sapiens
tgtaagaataatttat

SEQ ID NO: 3027636 - DNA, 16 bp, Homo sapiens
tgtaagaattcagaag

SEQ ID NO: 3027637 - DNA, 15 bp, Homo sapiens
tgtaagacatttcct

SEQ ID NO: 3027638 - DNA, 13 bp, Homo sapiens
tgtaagatgtctg

SEQ ID NO: 3027639 - DNA, 19 bp, Homo sapiens
tgtaagattatagattcta

SEQ ID NO: 3027640 - DNA, 20 bp, Homo sapiens
tgtaagattatagattctaa

SEQ ID NO: 3027641 - DNA, 21 bp, Homo sapiens
tgtaagattatagattctaaa

SEQ ID NO: 3027642 - DNA, 23 bp, Homo sapiens
tgtaagattatagattctaaaga

SEQ ID NO: 3027643 - DNA, 15 bp, Homo sapiens
tgtaagcaacttgct

SEQ ID NO: 3027644 - DNA, 21 bp, Homo sapiens
tgtaagcaacttgcttctaaa

SEQ ID NO: 3027645 - DNA, 13 bp, Homo sapiens
tgtaagccctctt

SEQ ID NO: 3027646 - DNA, 21 bp, Homo sapiens
tgtaagcttagattttctgta

SEQ ID NO: 3027647 - DNA, 17 bp, Homo sapiens
tgtaatataaagatgtt

SEQ ID NO: 3027648 - DNA, 13 bp, Homo sapiens
tgtaatatgaaat

SEQ ID NO: 3027649 - DNA, 14 bp, Homo sapiens
tgtaatattatata

SEQ ID NO: 3027650 - DNA, 15 bp, Homo sapiens
tgtaatatttcttca

SEQ ID NO: 3027651 - DNA, 19 bp, Homo sapiens
tgtaatatttcttcaagtg

SEQ ID NO: 3027652 - DNA, 21 bp, Homo sapiens
tgtaatatttcttcaagtgag

SEQ ID NO: 3027653 - DNA, 16 bp, Homo sapiens
tgtaatcaataaacga

SEQ ID NO: 3027654 - DNA, 19 bp, Homo sapiens
tgtaatcatttgtttacat

SEQ ID NO: 3027655 - DNA, 16 bp, Homo sapiens
tgtaatcccagcactt

SEQ ID NO: 3027656 - DNA, 13 bp, Homo sapiens
tgtaatctatgtt

SEQ ID NO: 3027657 - DNA, 17 bp, Homo sapiens
tgtaatctcaatgcaag

SEQ ID NO: 3027658 - DNA, 19 bp, Homo sapiens
tgtaatctcaatgcaagcc

SEQ ID NO: 3027659 - DNA, 17 bp, Homo sapiens
tgtaatctcgtttcaaa

SEQ ID NO: 3027660 - DNA, 19 bp, Homo sapiens
tgtaatctcgtttcaaaaa

SEQ ID NO: 3027661 - DNA, 15 bp, Homo sapiens
tgtaatctttttctc

SEQ ID NO: 3027662 - DNA, 17 bp, Homo sapiens
tgtaatctttttctcca

SEQ ID NO: 3027663 - DNA, 20 bp, Homo sapiens
tgtaatctttttctccaccc

SEQ ID NO: 3027664 - DNA, 13 bp, Homo sapiens
tgtaatgtgactt

SEQ ID NO: 3027665 - DNA, 20 bp, Homo sapiens
tgtaatgtgacttcatgcta

SEQ ID NO: 3027666 - DNA, 18 bp, Homo sapiens
tgtaatgttttctttgca

SEQ ID NO: 3027667 - DNA, 19 bp, Homo sapiens
tgtaatgttttctttgcaa

SEQ ID NO: 3027668 - DNA, 22 bp, Homo sapiens
tgtaattacttatccctgccca

SEQ ID NO: 3027669 - DNA, 19 bp, Homo sapiens
tgtaattatgtaaataact

SEQ ID NO: 3027670 - DNA, 14 bp, Homo sapiens
tgtaattcagtgta

SEQ ID NO: 3027671 - DNA, 10 bp, Homo sapiens
tgtaattgtg

SEQ ID NO: 3027672 - DNA, 15 bp, Homo sapiens
tgtaatttaaaactt

SEQ ID NO: 3027673 - DNA, 22 bp, Homo sapiens
tgtacaaaggggaaagaacata

SEQ ID NO: 3027674 - DNA, 19 bp, Homo sapiens
tgtacaagttgctttgtta

SEQ ID NO: 3027675 - DNA, 21 bp, Homo sapiens
tgtacaagttgctttgttaca

SEQ ID NO: 3027676 - DNA, 12 bp, Homo sapiens
tgtacacttttt

SEQ ID NO: 3027677 - DNA, 13 bp, Homo sapiens
tgtacactttttt

SEQ ID NO: 3027678 - DNA, 17 bp, Homo sapiens
tgtacagacatatttaa

SEQ ID NO: 3027679 - DNA, 16 bp, Homo sapiens
tgtacagtatttttca

SEQ ID NO: 3027680 - DNA, 21 bp, Homo sapiens
tgtacagtatttttcagatat

SEQ ID NO: 3027681 - DNA, 18 bp, Homo sapiens
tgtacagtctcaattttg

SEQ ID NO: 3027682 - DNA, 13 bp, Homo sapiens
tgtacagtctgtc

SEQ ID NO: 3027683 - DNA, 20 bp, Homo sapiens
tgtacagtttaacagagttt

SEQ ID NO: 3027684 - DNA, 15 bp, Homo sapiens
tgtacagtttggggc

SEQ ID NO: 3027685 - DNA, 16 bp, Homo sapiens
tgtacagttttgtgga

SEQ ID NO: 3027686 - DNA, 18 bp, Homo sapiens
tgtacatcccatgtaaca

SEQ ID NO: 3027687 - DNA, 22 bp, Homo sapiens
tgtacatcccatgtaacagaaa

SEQ ID NO: 3027688 - DNA, 14 bp, Homo sapiens
tgtacatctatttt

SEQ ID NO: 3027689 - DNA, 19 bp, Homo sapiens
tgtacatctattttggatt

SEQ ID NO: 3027690 - DNA, 20 bp, Homo sapiens
tgtacatctattttggattg

SEQ ID NO: 3027691 - DNA, 20 bp, Homo sapiens
tgtacatgaaatttttgtaa

SEQ ID NO: 3027692 - DNA, 17 bp, Homo sapiens
tgtacatggcagagttt

SEQ ID NO: 3027693 - DNA, 15 bp, Homo sapiens
tgtacatgtgtagcc

SEQ ID NO: 3027694 - DNA, 22 bp, Homo sapiens
tgtacattttggatttctttat

SEQ ID NO: 3027695 - DNA, 20 bp, Homo sapiens
tgtacatttttaaattctta

SEQ ID NO: 3027696 - DNA, 20 bp, Homo sapiens
tgtaccagtgaatttttgca

SEQ ID NO: 3027697 - DNA, 17 bp, Homo sapiens
tgtaccatatagcaaaa

SEQ ID NO: 3027698 - DNA, 19 bp, Homo sapiens
tgtacccttgttttgaaac

SEQ ID NO: 3027699 - DNA, 15 bp, Homo sapiens
tgtaccctttaagat

SEQ ID NO: 3027700 - DNA, 19 bp, Homo sapiens
tgtacctcctctcagtgtt

SEQ ID NO: 3027701 - DNA, 15 bp, Homo sapiens
tgtacctgttcctcc

SEQ ID NO: 3027702 - DNA, 16 bp, Homo sapiens
tgtacctgttcctccc

SEQ ID NO: 3027703 - DNA, 23 bp, Homo sapiens
tgtaccttttaacacctgatgtg

SEQ ID NO: 3027704 - DNA, 21 bp, Homo sapiens
tgtaccttttttgttttttca

SEQ ID NO: 3027705 - DNA, 14 bp, Homo sapiens
tgtacgtccagcct

SEQ ID NO: 3027706 - DNA, 19 bp, Homo sapiens
tgtacgtttgtatgtgtgt

SEQ ID NO: 3027707 - DNA, 15 bp, Homo sapiens
tgtactaaagccaaa

SEQ ID NO: 3027708 - DNA, 15 bp, Homo sapiens
tgtactaaggagcat

SEQ ID NO: 3027709 - DNA, 16 bp, Homo sapiens
tgtactagtgtccgca

SEQ ID NO: 3027710 - DNA, 14 bp, Homo sapiens
tgtactccagcctg

SEQ ID NO: 3027711 - DNA, 18 bp, Homo sapiens
tgtactccagcctgggca

SEQ ID NO: 3027712 - DNA, 15 bp, Homo sapiens
tgtactctaacttaa

SEQ ID NO: 3027713 - DNA, 19 bp, Homo sapiens
tgtactggagagtggcaaa

SEQ ID NO: 3027714 - DNA, 18 bp, Homo sapiens
tgtactgttactgggccc

SEQ ID NO: 3027715 - DNA, 18 bp, Homo sapiens
tgtactgttttctgggcc

SEQ ID NO: 3027716 - DNA, 16 bp, Homo sapiens
tgtacttgatgacaga

SEQ ID NO: 3027717 - DNA, 20 bp, Homo sapiens
tgtacttggtccaactgcaa

SEQ ID NO: 3027718 - DNA, 20 bp, Homo sapiens
tgtactttatttttctgata

SEQ ID NO: 3027719 - DNA, 16 bp, Homo sapiens
tgtccctctgccccat

SEQ ID NO: 3027720 - DNA, 14 bp, Homo sapiens
tgtccctgccttca

SEQ ID NO: 3027721 - DNA, 19 bp, Homo sapiens
tgtccctggggcactcccc

SEQ ID NO: 3027722 - DNA, 20 bp, Homo sapiens
tgtccctggggcactccccc

SEQ ID NO: 3027723 - DNA, 13 bp, Homo sapiens
tgtccctgtcacc

SEQ ID NO: 3027724 - DNA, 16 bp, Homo sapiens
tgtccctgtcaccaag

SEQ ID NO: 3027725 - DNA, 14 bp, Homo sapiens
tgtccgatgctgga

SEQ ID NO: 3027726 - DNA, 19 bp, Homo sapiens
tgtcctacctccactctct

SEQ ID NO: 3027727 - DNA, 19 bp, Homo sapiens
tgtcctcaagaagaaagtg

SEQ ID NO: 3027728 - DNA, 22 bp, Homo sapiens
tgtcctcaagaagaaagtgttc

SEQ ID NO: 3027729 - DNA, 13 bp, Homo sapiens
tgtcctcaccatg

SEQ ID NO: 3027730 - DNA, 14 bp, Homo sapiens
tgtcctcacgcccc

SEQ ID NO: 3027731 - DNA, 14 bp, Homo sapiens
tgtcctcagccagt

SEQ ID NO: 3027732 - DNA, 16 bp, Homo sapiens
tgtcctcagccttgcc

SEQ ID NO: 3027733 - DNA, 22 bp, Homo sapiens
tgtcctcagccttgccagagat

SEQ ID NO: 3027734 - DNA, 23 bp, Homo sapiens
tgtcctccaacaccaagcacagc

SEQ ID NO: 3027735 - DNA, 18 bp, Homo sapiens
tgtcctcccagctcctca

SEQ ID NO: 3027736 - DNA, 12 bp, Homo sapiens
tgtcctccctcc

SEQ ID NO: 3027737 - DNA, 13 bp, Homo sapiens
tgtcctcttccct

SEQ ID NO: 3027738 - DNA, 16 bp, Homo sapiens
tgtcctcttccctctc

SEQ ID NO: 3027739 - DNA, 15 bp, Homo sapiens
tgtcctgaatccagc

SEQ ID NO: 3027740 - DNA, 21 bp, Homo sapiens
tgtcctgaatccagcattgtt

SEQ ID NO: 3027741 - DNA, 17 bp, Homo sapiens
tgtcctgacagcactcc

SEQ ID NO: 3027742 - DNA, 22 bp, Homo sapiens
tgtcctgacagcactcctcggc

SEQ ID NO: 3027743 - DNA, 14 bp, Homo sapiens
tgtcctgggcctgc

SEQ ID NO: 3027744 - DNA, 17 bp, Homo sapiens
tgtcctgggcctgcaga

SEQ ID NO: 3027745 - DNA, 22 bp, Homo sapiens
tgtcctggtggctgggcccagc

SEQ ID NO: 3027746 - DNA, 19 bp, Homo sapiens
tgtcctgtgaggtttccca

SEQ ID NO: 3027747 - DNA, 20 bp, Homo sapiens
tgtccttacccatctgcacc

SEQ ID NO: 3027748 - DNA, 23 bp, Homo sapiens
tgtccttactcagagctgcgggc

SEQ ID NO: 3027749 - DNA, 14 bp, Homo sapiens
tgtccttcttcctc

SEQ ID NO: 3027750 - DNA, 18 bp, Homo sapiens
tgtcctttaaaaaagaaa

SEQ ID NO: 3027751 - DNA, 19 bp, Homo sapiens
tgtcctttctagagcactg

SEQ ID NO: 3027752 - DNA, 17 bp, Homo sapiens
tgtcctttttgttatta

SEQ ID NO: 3027753 - DNA, 21 bp, Homo sapiens
tgtcgagagctggccaaagag

SEQ ID NO: 3027754 - DNA, 14 bp, Homo sapiens
tgtcgattagactg

SEQ ID NO: 3027755 - DNA, 18 bp, Homo sapiens
tgtcgattagactggaca

SEQ ID NO: 3027756 - DNA, 13 bp, Homo sapiens
tgtcgctgtaaat

SEQ ID NO: 3027757 - DNA, 19 bp, Homo sapiens
tgtcggggaagatgaaacc

SEQ ID NO: 3027758 - DNA, 16 bp, Homo sapiens
tgtcggtggctgcctt

SEQ ID NO: 3027759 - DNA, 17 bp, Homo sapiens
tgtcggtggctgccttt

SEQ ID NO: 3027760 - DNA, 19 bp, Homo sapiens
tgtcggtggctgcctttga

SEQ ID NO: 3027761 - DNA, 22 bp, Homo sapiens
tgtcgtctctcccaccccctcc

SEQ ID NO: 3027762 - DNA, 12 bp, Homo sapiens
tgtcgtgttttc

SEQ ID NO: 3027763 - DNA, 21 bp, Homo sapiens
tgtcgttaaaaagttgtttgt

SEQ ID NO: 3027764 - DNA, 23 bp, Homo sapiens
tgtcgttaaaaagttgtttgttt

SEQ ID NO: 3027765 - DNA, 18 bp, Homo sapiens
tgtctaattaaaacactt

SEQ ID NO: 3027766 - DNA, 19 bp, Homo sapiens
tgtctactcagcatttgat

SEQ ID NO: 3027767 - DNA, 22 bp, Homo sapiens
tgtctactcagcatttgattaa

SEQ ID NO: 3027768 - DNA, 14 bp, Homo sapiens
tgtctactttctct

SEQ ID NO: 3027769 - DNA, 15 bp, Homo sapiens
tgtctactttctctt

SEQ ID NO: 3027770 - DNA, 17 bp, Homo sapiens
tgtctactttctcttgt

SEQ ID NO: 3027771 - DNA, 16 bp, Homo sapiens
tgtctagaatcctgct

SEQ ID NO: 3027772 - DNA, 21 bp, Homo sapiens
tgtctagtagaacaatgtaca

SEQ ID NO: 3027773 - DNA, 18 bp, Homo sapiens
tgtctcaaaaataatata

SEQ ID NO: 3027774 - DNA, 20 bp, Homo sapiens
tgtctcaaaaataatatact

SEQ ID NO: 3027775 - DNA, 21 bp, Homo sapiens
tgtctcaaaaataatatactt

SEQ ID NO: 3027776 - DNA, 22 bp, Homo sapiens
tgtctcaatagctccaagctgt

SEQ ID NO: 3027777 - DNA, 14 bp, Homo sapiens
tgtctcacagacgc

SEQ ID NO: 3027778 - DNA, 16 bp, Homo sapiens
tgtctcatccatcatc

SEQ ID NO: 3027779 - DNA, 21 bp, Homo sapiens
tgtctcatccatcatcatgtg

SEQ ID NO: 3027780 - DNA, 19 bp, Homo sapiens
tgtctcatttagaaacaat

SEQ ID NO: 3027781 - DNA, 18 bp, Homo sapiens
tgtctcctatatatttct

SEQ ID NO: 3027782 - DNA, 21 bp, Homo sapiens
tgtctcctttcaccccagggc

SEQ ID NO: 3027783 - DNA, 14 bp, Homo sapiens
tgtctcgtttgtga

SEQ ID NO: 3027784 - DNA, 18 bp, Homo sapiens
tgtctcgtttgtgattct

SEQ ID NO: 3027785 - DNA, 14 bp, Homo sapiens
tgtctctaaaaaga

SEQ ID NO: 3027786 - DNA, 13 bp, Homo sapiens
tgtctctctgggc

SEQ ID NO: 3027787 - DNA, 18 bp, Homo sapiens
tgtctctcttgtcacatg

SEQ ID NO: 3027788 - DNA, 16 bp, Homo sapiens
tgtctctgaagcgtga

SEQ ID NO: 3027789 - DNA, 13 bp, Homo sapiens
tgtctctgcctgg

SEQ ID NO: 3027790 - DNA, 14 bp, Homo sapiens
tgtctctgcctgga

SEQ ID NO: 3027791 - DNA, 16 bp, Homo sapiens
tgtctctgcctggagc

SEQ ID NO: 3027792 - DNA, 14 bp, Homo sapiens
tgtctctgcttcca

SEQ ID NO: 3027793 - DNA, 17 bp, Homo sapiens
tgtctctgcttccatgg

SEQ ID NO: 3027794 - DNA, 22 bp, Homo sapiens
tgtctctgtggaaaagccatct

SEQ ID NO: 3027795 - DNA, 17 bp, Homo sapiens
tgtctcttctttagaac

SEQ ID NO: 3027796 - DNA, 23 bp, Homo sapiens
tgtctctttggcgacctcctttc

SEQ ID NO: 3027797 - DNA, 19 bp, Homo sapiens
tgtctgagagaccatctcc

SEQ ID NO: 3027798 - DNA, 16 bp, Homo sapiens
tgtctgcaacatggat

SEQ ID NO: 3027799 - DNA, 22 bp, Homo sapiens
tgtctgcaacatggattccaaa

SEQ ID NO: 3027800 - DNA, 13 bp, Homo sapiens
tgtctgcagccct

SEQ ID NO: 3027801 - DNA, 16 bp, Homo sapiens
tgtctgcagccctgag

SEQ ID NO: 3027802 - DNA, 12 bp, Homo sapiens
tgtctgcagcct

SEQ ID NO: 3027803 - DNA, 13 bp, Homo sapiens
tgtctgcatttcg

SEQ ID NO: 3027804 - DNA, 13 bp, Homo sapiens
tgtctgcctggag

SEQ ID NO: 3027805 - DNA, 19 bp, Homo sapiens
tgtctgctttctccattgt

SEQ ID NO: 3027806 - DNA, 16 bp, Homo sapiens
tgtctggatccttccc

SEQ ID NO: 3027807 - DNA, 19 bp, Homo sapiens
tgtctggatccttcccaag

SEQ ID NO: 3027808 - DNA, 13 bp, Homo sapiens
tgtctggcctgag

SEQ ID NO: 3027809 - DNA, 24 bp, Homo sapiens
tgtctggcttcgcagctctggcct

SEQ ID NO: 3027810 - DNA, 15 bp, Homo sapiens
tgtctgggaagccct

SEQ ID NO: 3027811 - DNA, 18 bp, Homo sapiens
tgtctgggtttggcccaa

SEQ ID NO: 3027812 - DNA, 21 bp, Homo sapiens
tgtctgtaaaaaatgtatgct

SEQ ID NO: 3027813 - DNA, 20 bp, Homo sapiens
tgtctgtacacgtgtcctgt

SEQ ID NO: 3027814 - DNA, 21 bp, Homo sapiens
tgtctgtacacgtgtcctgta

SEQ ID NO: 3027815 - DNA, 14 bp, Homo sapiens
tgtctgtacctaaa

SEQ ID NO: 3027816 - DNA, 14 bp, Homo sapiens
tgtctgtcatctgc

SEQ ID NO: 3027817 - DNA, 21 bp, Homo sapiens
tgtctgtccttctgaagtgtg

SEQ ID NO: 3027818 - DNA, 23 bp, Homo sapiens
tgtctgtctctccccctctgtct

SEQ ID NO: 3027819 - DNA, 22 bp, Homo sapiens
tgtcttacaaggcaggcctttc

SEQ ID NO: 3027820 - DNA, 20 bp, Homo sapiens
tgtcttcaaggcttcagtct

SEQ ID NO: 3027821 - DNA, 16 bp, Homo sapiens
tgtcttcggaaacctt

SEQ ID NO: 3027822 - DNA, 20 bp, Homo sapiens
tgtcttcggaaaccttggtg

SEQ ID NO: 3027823 - DNA, 21 bp, Homo sapiens
tgtcttcggaaaccttggtgt

SEQ ID NO: 3027824 - DNA, 19 bp, Homo sapiens
tgtcttctctatcctctct

SEQ ID NO: 3027825 - DNA, 21 bp, Homo sapiens
tgtcttctctccacttctggt

SEQ ID NO: 3027826 - DNA, 22 bp, Homo sapiens
tgtcttgaaacatgttcatctg

SEQ ID NO: 3027827 - DNA, 23 bp, Homo sapiens
tgtcttgaaacatgttcatctgg

SEQ ID NO: 3027828 - DNA, 22 bp, Homo sapiens
tgtcttgatgcatgcactgttc

SEQ ID NO: 3027829 - DNA, 17 bp, Homo sapiens
tgtcttgctcctgggga

SEQ ID NO: 3027830 - DNA, 13 bp, Homo sapiens
tgtcttggacact

SEQ ID NO: 3027831 - DNA, 13 bp, Homo sapiens
tgtcttgtacatg

SEQ ID NO: 3027832 - DNA, 16 bp, Homo sapiens
tgtcttgtacatgtgt

SEQ ID NO: 3027833 - DNA, 14 bp, Homo sapiens
tgtcttgtcatttt

SEQ ID NO: 3027834 - DNA, 19 bp, Homo sapiens
tgtcttgttctgtcactca

SEQ ID NO: 3027835 - DNA, 12 bp, Homo sapiens
tgtctttactcc

SEQ ID NO: 3027836 - DNA, 15 bp, Homo sapiens
tgtctttactcctca

SEQ ID NO: 3027837 - DNA, 12 bp, Homo sapiens
tgtctttctgag

SEQ ID NO: 3027838 - DNA, 13 bp, Homo sapiens
tgtctttctttgc

SEQ ID NO: 3027839 - DNA, 19 bp, Homo sapiens
tgtctttctttgctgctgt

SEQ ID NO: 3027840 - DNA, 20 bp, Homo sapiens
tgtctttgtggactgtgggt

SEQ ID NO: 3027841 - DNA, 22 bp, Homo sapiens
tgtcttttcccctcattgcatt

SEQ ID NO: 3027842 - DNA, 17 bp, Homo sapiens
tgtcttttgacatttta

SEQ ID NO: 3027843 - DNA, 18 bp, Homo sapiens
tgtcttttttaaggctct

SEQ ID NO: 3027844 - DNA, 18 bp, Homo sapiens
tgtcttttttttaatgtg

SEQ ID NO: 3027845 - DNA, 21 bp, Homo sapiens
tgtcttttttttaatgtgctg

SEQ ID NO: 3027846 - DNA, 17 bp, Homo sapiens
tgtcttttttttcatcc

SEQ ID NO: 3027847 - DNA, 17 bp, Homo sapiens
tgtgaaaatcaaataca

SEQ ID NO: 3027848 - DNA, 14 bp, Homo sapiens
tgtgaaaatgtgtt

SEQ ID NO: 3027849 - DNA, 19 bp, Homo sapiens
tgtgaaagattatttaaat

SEQ ID NO: 3027850 - DNA, 20 bp, Homo sapiens
tgtgaaataaaactggcttt

SEQ ID NO: 3027851 - DNA, 17 bp, Homo sapiens
tgttcgaagttcatttt

SEQ ID NO: 3027852 - DNA, 23 bp, Homo sapiens
tgttcgccgtctggcgagccctt

SEQ ID NO: 3027853 - DNA, 22 bp, Homo sapiens
tgttcggagctcttctgtgccc

SEQ ID NO: 3027854 - DNA, 17 bp, Homo sapiens
tgttctaaaatgaaata

SEQ ID NO: 3027855 - DNA, 18 bp, Homo sapiens
tgttctaaaatgaaatat

SEQ ID NO: 3027856 - DNA, 18 bp, Homo sapiens
tgttctaaagctctgaca

SEQ ID NO: 3027857 - DNA, 16 bp, Homo sapiens
tgttctaacatgtaat

SEQ ID NO: 3027858 - DNA, 13 bp, Homo sapiens
tgttctaagatgt

SEQ ID NO: 3027859 - DNA, 14 bp, Homo sapiens
tgttctaaggctct

SEQ ID NO: 3027860 - DNA, 18 bp, Homo sapiens
tgttctaagtttctaaga

SEQ ID NO: 3027861 - DNA, 23 bp, Homo sapiens
tgttctaagtttctaagattcta

SEQ ID NO: 3027862 - DNA, 19 bp, Homo sapiens
tgttctactcttaatgatg

SEQ ID NO: 3027863 - DNA, 16 bp, Homo sapiens
tgttctacttgatatt

SEQ ID NO: 3027864 - DNA, 22 bp, Homo sapiens
tgttctattaatcacctctctg

SEQ ID NO: 3027865 - DNA, 18 bp, Homo sapiens
tgttctcattcctgttct

SEQ ID NO: 3027866 - DNA, 19 bp, Homo sapiens
tgttctcattcctgttctt

SEQ ID NO: 3027867 - DNA, 23 bp, Homo sapiens
tgttctcttgggaactgaactca

SEQ ID NO: 3027868 - DNA, 16 bp, Homo sapiens
tgttctctttaatgct

SEQ ID NO: 3027869 - DNA, 18 bp, Homo sapiens
tgttctgatcggccagtt

SEQ ID NO: 3027870 - DNA, 18 bp, Homo sapiens
tgttctgccccctcaggg

SEQ ID NO: 3027871 - DNA, 17 bp, Homo sapiens
tgttctgtggaaagtgt

SEQ ID NO: 3027872 - DNA, 18 bp, Homo sapiens
tgttctgtggaaagtgta

SEQ ID NO: 3027873 - DNA, 14 bp, Homo sapiens
tgttctgtttcaag

SEQ ID NO: 3027874 - DNA, 18 bp, Homo sapiens
tgttcttatagaataaaa

SEQ ID NO: 3027875 - DNA, 23 bp, Homo sapiens
tgttcttatagaataaaagctgt

SEQ ID NO: 3027876 - DNA, 18 bp, Homo sapiens
tgttcttcagtgtaatgt

SEQ ID NO: 3027877 - DNA, 20 bp, Homo sapiens
tgttcttgaagcagtagcct

SEQ ID NO: 3027878 - DNA, 13 bp, Homo sapiens
tgttcttgaattt

SEQ ID NO: 3027879 - DNA, 23 bp, Homo sapiens
tgttcttgaggtctcttttctct

SEQ ID NO: 3027880 - DNA, 13 bp, Homo sapiens
tgttctttatata

SEQ ID NO: 3027881 - DNA, 15 bp, Homo sapiens
tgttctttatataca

SEQ ID NO: 3027882 - DNA, 15 bp, Homo sapiens
tgttcttttgtttca

SEQ ID NO: 3027883 - DNA, 18 bp, Homo sapiens
tgttgaaagcaaaaatgc

SEQ ID NO: 3027884 - DNA, 17 bp, Homo sapiens
tgttgaatatttagcat

SEQ ID NO: 3027885 - DNA, 15 bp, Homo sapiens
tgttgaattcttttg

SEQ ID NO: 3027886 - DNA, 23 bp, Homo sapiens
tgttgacatatttaatgttttaa

SEQ ID NO: 3027887 - DNA, 16 bp, Homo sapiens
tgttgaccggctgccg

SEQ ID NO: 3027888 - DNA, 17 bp, Homo sapiens
tgttgaccggctgccgt

SEQ ID NO: 3027889 - DNA, 17 bp, Homo sapiens
tgttgagcatcacagaa

SEQ ID NO: 3027890 - DNA, 14 bp, Homo sapiens
tgttgataatttca

SEQ ID NO: 3027891 - DNA, 17 bp, Homo sapiens
tgttgatcatgtacttt

SEQ ID NO: 3027892 - DNA, 20 bp, Homo sapiens
tgttgatcatgtacttttta

SEQ ID NO: 3027893 - DNA, 14 bp, Homo sapiens
tgttgattgctaaa

SEQ ID NO: 3027894 - DNA, 16 bp, Homo sapiens
tgttgattgctaaatg

SEQ ID NO: 3027895 - DNA, 17 bp, Homo sapiens
tgttgattgctaaatgt

SEQ ID NO: 3027896 - DNA, 18 bp, Homo sapiens
tgttgattgctaaatgta

SEQ ID NO: 3027897 - DNA, 19 bp, Homo sapiens
tgttgcaaatcactctgca

SEQ ID NO: 3027898 - DNA, 22 bp, Homo sapiens
tgttgcaaatcactctgcaatg

SEQ ID NO: 3027899 - DNA, 17 bp, Homo sapiens
tgttgcactgaaatgga

SEQ ID NO: 3027900 - DNA, 14 bp, Homo sapiens
tgttgcaggcagtg

SEQ ID NO: 3027901 - DNA, 14 bp, Homo sapiens
tgttgcagtggcct

SEQ ID NO: 3027902 - DNA, 14 bp, Homo sapiens
tgttgcataaacaa

SEQ ID NO: 3027903 - DNA, 14 bp, Homo sapiens
tgttgcatgggcta

SEQ ID NO: 3027904 - DNA, 19 bp, Homo sapiens
tgttgccctgtttcctgct

SEQ ID NO: 3027905 - DNA, 14 bp, Homo sapiens
tgttgcctcctctc

SEQ ID NO: 3027906 - DNA, 22 bp, Homo sapiens
tgttgcctcctctctccctgcc

SEQ ID NO: 3027907 - DNA, 16 bp, Homo sapiens
tgttgcctctctttga

SEQ ID NO: 3027908 - DNA, 18 bp, Homo sapiens
tgttgcctttatggtttc

SEQ ID NO: 3027909 - DNA, 15 bp, Homo sapiens
tgttgctctaggaag

SEQ ID NO: 3027910 - DNA, 19 bp, Homo sapiens
tgttggaaagagtctccag

SEQ ID NO: 3027911 - DNA, 17 bp, Homo sapiens
tgttggaattcacttta

SEQ ID NO: 3027912 - DNA, 19 bp, Homo sapiens
tgttggacaaatgtgaaga

SEQ ID NO: 3027913 - DNA, 22 bp, Homo sapiens
tgttggacaaatgtgaagatgc

SEQ ID NO: 3027914 - DNA, 20 bp, Homo sapiens
tgttggagatgcagccttca

SEQ ID NO: 3027915 - DNA, 18 bp, Homo sapiens
tgttggcagtgtttgtat

SEQ ID NO: 3027916 - DNA, 13 bp, Homo sapiens
tgttggcgctgag

SEQ ID NO: 3027917 - DNA, 14 bp, Homo sapiens
tgttggctgctgcc

SEQ ID NO: 3027918 - DNA, 15 bp, Homo sapiens
tgttgggagaaagca

SEQ ID NO: 3027919 - DNA, 14 bp, Homo sapiens
tgttggtgcaatta

SEQ ID NO: 3027920 - DNA, 19 bp, Homo sapiens
tgttggtgttcggagctct

SEQ ID NO: 3027921 - DNA, 21 bp, Homo sapiens
tgttggttttgggggtgtgag

SEQ ID NO: 3027922 - DNA, 23 bp, Homo sapiens
tgttgtaaaacaaaatttgacta

SEQ ID NO: 3027923 - DNA, 11 bp, Homo sapiens
tgttgtagtgt

SEQ ID NO: 3027924 - DNA, 14 bp, Homo sapiens
tgttgtatttaatt

SEQ ID NO: 3027925 - DNA, 14 bp, Homo sapiens
tgttgtcatgtgta

SEQ ID NO: 3027926 - DNA, 16 bp, Homo sapiens
tgttgtcatgtgtatg

SEQ ID NO: 3027927 - DNA, 12 bp, Homo sapiens
tgttgtcccttc

SEQ ID NO: 3027928 - DNA, 21 bp, Homo sapiens
tgttgtctacattaaatcact

SEQ ID NO: 3027929 - DNA, 19 bp, Homo sapiens
tgttgtgctccatagagca

SEQ ID NO: 3027930 - DNA, 13 bp, Homo sapiens
tgttgtgctttta

SEQ ID NO: 3027931 - DNA, 17 bp, Homo sapiens
tgttgtggtttaaatac

SEQ ID NO: 3027932 - DNA, 15 bp, Homo sapiens
tgttgtggtttttag

SEQ ID NO: 3027933 - DNA, 14 bp, Homo sapiens
tgttgtgttcacca

SEQ ID NO: 3027934 - DNA, 15 bp, Homo sapiens
tgttgtgtttgtagt

SEQ ID NO: 3027935 - DNA, 12 bp, Homo sapiens
tgttgttagaga

SEQ ID NO: 3027936 - DNA, 13 bp, Homo sapiens
tgttgttctgcct

SEQ ID NO: 3027937 - DNA, 13 bp, Homo sapiens
tgttgtttacctg

SEQ ID NO: 3027938 - DNA, 17 bp, Homo sapiens
tgttgtttatatgaaaa

SEQ ID NO: 3027939 - DNA, 23 bp, Homo sapiens
tgttgtttatatgaaaacactca

SEQ ID NO: 3027940 - DNA, 12 bp, Homo sapiens
tgttgtttgcca

SEQ ID NO: 3027941 - DNA, 16 bp, Homo sapiens
tgttgtttttgataat

SEQ ID NO: 3027942 - DNA, 22 bp, Homo sapiens
tgttgttttttcatagtgcctt

SEQ ID NO: 3027943 - DNA, 15 bp, Homo sapiens
tgtttaaaaaaagaa

SEQ ID NO: 3027944 - DNA, 15 bp, Homo sapiens
tgtttaaaacatcat

SEQ ID NO: 3027945 - DNA, 14 bp, Homo sapiens
tgtttaaaaggatt

SEQ ID NO: 3027946 - DNA, 16 bp, Homo sapiens
tgtttaaaattctctt

SEQ ID NO: 3027947 - DNA, 22 bp, Homo sapiens
tgtttaaatataaatctgatca

SEQ ID NO: 3027948 - DNA, 13 bp, Homo sapiens
tgtttaactgtgc

SEQ ID NO: 3027949 - DNA, 15 bp, Homo sapiens
tgtttaactgtgcat

SEQ ID NO: 3027950 - DNA, 15 bp, Homo sapiens
tgtttaatgtgaact

SEQ ID NO: 3027951 - DNA, 16 bp, Homo sapiens
tgtttaatgttctgtg

SEQ ID NO: 3027952 - DNA, 23 bp, Homo sapiens
tgtttacagacaaggcaggcctg

SEQ ID NO: 3027953 - DNA, 22 bp, Homo sapiens
tgtttacatttgatgcatgtct

SEQ ID NO: 3027954 - DNA, 14 bp, Homo sapiens
tgtttacctggtgc

SEQ ID NO: 3027955 - DNA, 13 bp, Homo sapiens
tgtttactaggga

SEQ ID NO: 3027956 - DNA, 13 bp, Homo sapiens
tgtttactgtaaa

SEQ ID NO: 3027957 - DNA, 14 bp, Homo sapiens
tgtttactgtaaat

SEQ ID NO: 3027958 - DNA, 15 bp, Homo sapiens
tgtttactgtaaatt

SEQ ID NO: 3027959 - DNA, 13 bp, Homo sapiens
tgtttagcttcct

SEQ ID NO: 3027960 - DNA, 21 bp, Homo sapiens
tgtttagtaaatacatcactg

SEQ ID NO: 3027961 - DNA, 16 bp, Homo sapiens
tgtttatacagagtaa

SEQ ID NO: 3027962 - DNA, 13 bp, Homo sapiens
tgtttatagcatt

SEQ ID NO: 3027963 - DNA, 22 bp, Homo sapiens
tgtttatgatatttcttgcttt

SEQ ID NO: 3027964 - DNA, 13 bp, Homo sapiens
tgtttatgttctt

SEQ ID NO: 3027965 - DNA, 23 bp, Homo sapiens
tgtttatgttcttatagaataaa

SEQ ID NO: 3027966 - DNA, 13 bp, Homo sapiens
tgtttattaaata

SEQ ID NO: 3027967 - DNA, 16 bp, Homo sapiens
tgtttatttcatttta

SEQ ID NO: 3027968 - DNA, 13 bp, Homo sapiens
tgtttattttaga

SEQ ID NO: 3027969 - DNA, 18 bp, Homo sapiens
tgtttcaaatgcagaaac

SEQ ID NO: 3027970 - DNA, 20 bp, Homo sapiens
tgtttcaaggcactctagat

SEQ ID NO: 3027971 - DNA, 14 bp, Homo sapiens
tgtttcaatcactg

SEQ ID NO: 3027972 - DNA, 19 bp, Homo sapiens
tgtttcactggaaaggaaa

SEQ ID NO: 3027973 - DNA, 21 bp, Homo sapiens
tgtttcactggaaaggaaaga

SEQ ID NO: 3027974 - DNA, 13 bp, Homo sapiens
tgtttcccccact

SEQ ID NO: 3027975 - DNA, 18 bp, Homo sapiens
tgtttccctagactctgt

SEQ ID NO: 3027976 - DNA, 16 bp, Homo sapiens
tgtttcctgcaggcca

SEQ ID NO: 3027977 - DNA, 23 bp, Homo sapiens
tgtttcctgtgcccatcatctct

SEQ ID NO: 3027978 - DNA, 23 bp, Homo sapiens
tgtttccttgcctgctttctcca

SEQ ID NO: 3027979 - DNA, 21 bp, Homo sapiens
tgtttcgctgatatatgtgtt

SEQ ID NO: 3027980 - DNA, 16 bp, Homo sapiens
tgtttctatacaaata

SEQ ID NO: 3027981 - DNA, 23 bp, Homo sapiens
tgtttctgaaaagaaataataat

SEQ ID NO: 3027982 - DNA, 22 bp, Homo sapiens
tgtttctgaatgtttgtgtctg

SEQ ID NO: 3027983 - DNA, 13 bp, Homo sapiens
tgtttctgtgctc

SEQ ID NO: 3027984 - DNA, 19 bp, Homo sapiens
ttaccaaatacacatttca

SEQ ID NO: 3027985 - DNA, 21 bp, Homo sapiens
ttaccaaatacacatttcaca

SEQ ID NO: 3027986 - DNA, 14 bp, Homo sapiens
ttaccaagagaagg

SEQ ID NO: 3027987 - DNA, 19 bp, Homo sapiens
ttaccacagagttttttaa

SEQ ID NO: 3027988 - DNA, 23 bp, Homo sapiens
ttaccactgtggaagtccctcag

SEQ ID NO: 3027989 - DNA, 24 bp, Homo sapiens
ttaccagggaccctggagtatttg

SEQ ID NO: 3027990 - DNA, 16 bp, Homo sapiens
ttaccagtttctttgt

SEQ ID NO: 3027991 - DNA, 21 bp, Homo sapiens
ttaccattacttgtataaata

SEQ ID NO: 3027992 - DNA, 13 bp, Homo sapiens
ttaccattttatc

SEQ ID NO: 3027993 - DNA, 16 bp, Homo sapiens
ttaccatttttctgga

SEQ ID NO: 3027994 - DNA, 13 bp, Homo sapiens
ttacccaagcaaa

SEQ ID NO: 3027995 - DNA, 21 bp, Homo sapiens
ttacccagtattactgctgct

SEQ ID NO: 3027996 - DNA, 14 bp, Homo sapiens
ttacccatcttgct

SEQ ID NO: 3027997 - DNA, 20 bp, Homo sapiens
ttacccatcttgcttccaag

SEQ ID NO: 3027998 - DNA, 13 bp, Homo sapiens
ttacccatgaaaa

SEQ ID NO: 3027999 - DNA, 22 bp, Homo sapiens
ttaccctagttctcttatcttt

SEQ ID NO: 3028000 - DNA, 15 bp, Homo sapiens
ttacccttcctcatc

SEQ ID NO: 3028001 - DNA, 20 bp, Homo sapiens
ttacccttgagccctcccca

SEQ ID NO: 3028002 - DNA, 16 bp, Homo sapiens
ttaccctttagactgt

SEQ ID NO: 3028003 - DNA, 21 bp, Homo sapiens
ttaccgtgagtgacatagcct

SEQ ID NO: 3028004 - DNA, 11 bp, Homo sapiens
ttacctcctga

SEQ ID NO: 3028005 - DNA, 14 bp, Homo sapiens
ttacctctaaattt

SEQ ID NO: 3028006 - DNA, 18 bp, Homo sapiens
ttacctgaaaacactgtg

SEQ ID NO: 3028007 - DNA, 13 bp, Homo sapiens
ttacctgagaacc

SEQ ID NO: 3028008 - DNA, 17 bp, Homo sapiens
ttacctgatcaatgaca

SEQ ID NO: 3028009 - DNA, 23 bp, Homo sapiens
ttacctgatcaatgacagagcct

SEQ ID NO: 3028010 - DNA, 20 bp, Homo sapiens
ttaccttcatttcatcctgt

SEQ ID NO: 3028011 - DNA, 20 bp, Homo sapiens
ttacgatctgtttccaaatc

SEQ ID NO: 3028012 - DNA, 16 bp, Homo sapiens
ttacggacaccccctc

SEQ ID NO: 3028013 - DNA, 14 bp, Homo sapiens
ttacgggtacctga

SEQ ID NO: 3028014 - DNA, 19 bp, Homo sapiens
ttacgttgtttcttataga

SEQ ID NO: 3028015 - DNA, 13 bp, Homo sapiens
ttactaaaagatc

SEQ ID NO: 3028016 - DNA, 23 bp, Homo sapiens
ttactaagatgacattgctaaga

SEQ ID NO: 3028017 - DNA, 23 bp, Homo sapiens
ttactagggatccctcatctgtc

SEQ ID NO: 3028018 - DNA, 15 bp, Homo sapiens
ttactataagaactt

SEQ ID NO: 3028019 - DNA, 13 bp, Homo sapiens
ttactatgcctgt

SEQ ID NO: 3028020 - DNA, 13 bp, Homo sapiens
ttactcaaccaaa

SEQ ID NO: 3028021 - DNA, 23 bp, Homo sapiens
ttactcaaccaaattaaaaattt

SEQ ID NO: 3028022 - DNA, 12 bp, Homo sapiens
ttactcagccct

SEQ ID NO: 3028023 - DNA, 17 bp, Homo sapiens
ttactcaggaagaacac

SEQ ID NO: 3028024 - DNA, 14 bp, Homo sapiens
ttactcaggggatg

SEQ ID NO: 3028025 - DNA, 11 bp, Homo sapiens
ttactccaaaa

SEQ ID NO: 3028026 - DNA, 23 bp, Homo sapiens
ttactccaaaaagacaagtgctc

SEQ ID NO: 3028027 - DNA, 19 bp, Homo sapiens
ttactctaagatcttagat

SEQ ID NO: 3028028 - DNA, 21 bp, Homo sapiens
ttactctaagatcttagattc

SEQ ID NO: 3028029 - DNA, 18 bp, Homo sapiens
ttactctagatacctaaa

SEQ ID NO: 3028030 - DNA, 13 bp, Homo sapiens
ttactctgaaggg

SEQ ID NO: 3028031 - DNA, 22 bp, Homo sapiens
ttactgaaatcttgtaagtatt

SEQ ID NO: 3028032 - DNA, 19 bp, Homo sapiens
ttactgaaggtaaaattga

SEQ ID NO: 3028033 - DNA, 21 bp, Homo sapiens
ttactgagcgcaagccacagc

SEQ ID NO: 3028034 - DNA, 21 bp, Homo sapiens
ttactgataaaaatgatattg

SEQ ID NO: 3028035 - DNA, 13 bp, Homo sapiens
ttactgcaatcac

SEQ ID NO: 3028036 - DNA, 17 bp, Homo sapiens
ttactgctgctgtgctt

SEQ ID NO: 3028037 - DNA, 15 bp, Homo sapiens
ttactggcgtggatt

SEQ ID NO: 3028038 - DNA, 23 bp, Homo sapiens
ttactggcgtggattaaacttat

SEQ ID NO: 3028039 - DNA, 13 bp, Homo sapiens
ttactgtaaattt

SEQ ID NO: 3028040 - DNA, 15 bp, Homo sapiens
ttactgtaagacatt

SEQ ID NO: 3028041 - DNA, 14 bp, Homo sapiens
ttactgtgttttat

SEQ ID NO: 3028042 - DNA, 23 bp, Homo sapiens
ttactgttacctgatcaatgaca

SEQ ID NO: 3028043 - DNA, 14 bp, Homo sapiens
ttactgttgataat

SEQ ID NO: 3028044 - DNA, 14 bp, Homo sapiens
ttactgttgtgacc

SEQ ID NO: 3028045 - DNA, 14 bp, Homo sapiens
ttacttaaagattt

SEQ ID NO: 3028046 - DNA, 17 bp, Homo sapiens
ttacttacaaaaatggg

SEQ ID NO: 3028047 - DNA, 23 bp, Homo sapiens
ttacttatcatccacattgtttt

SEQ ID NO: 3028048 - DNA, 12 bp, Homo sapiens
ttacttccagca

SEQ ID NO: 3028049 - DNA, 14 bp, Homo sapiens
ttacttccagcaaa

SEQ ID NO: 3028050 - DNA, 19 bp, Homo sapiens
ttacttccagcaaaatcca

SEQ ID NO: 3028051 - DNA, 20 bp, Homo sapiens
ttacttccagcaaaatccaa

SEQ ID NO: 3028052 - DNA, 23 bp, Homo sapiens
ttacttgccaagcagtgcacatt

SEQ ID NO: 3028053 - DNA, 19 bp, Homo sapiens
ttacttggtgtaattaata

SEQ ID NO: 3028054 - DNA, 20 bp, Homo sapiens
ttacttgtaaataaagtcta

SEQ ID NO: 3028055 - DNA, 16 bp, Homo sapiens
ttacttgttcatttct

SEQ ID NO: 3028056 - DNA, 14 bp, Homo sapiens
ttactttcagtttt

SEQ ID NO: 3028057 - DNA, 13 bp, Homo sapiens
ttactttcttaat

SEQ ID NO: 3028058 - DNA, 20 bp, Homo sapiens
ttagaaaaagaacatgcagt

SEQ ID NO: 3028059 - DNA, 22 bp, Homo sapiens
ttagaaaactcagaatgaaaat

SEQ ID NO: 3028060 - DNA, 20 bp, Homo sapiens
ttagaaacaaacaaaactct

SEQ ID NO: 3028061 - DNA, 14 bp, Homo sapiens
ttagaaacaatgtt

SEQ ID NO: 3028062 - DNA, 21 bp, Homo sapiens
ttagaaaggaaatgaatggtt

SEQ ID NO: 3028063 - DNA, 21 bp, Homo sapiens
ttagaaccaccaaaattatag

SEQ ID NO: 3028064 - DNA, 16 bp, Homo sapiens
ttagaacccttctgct

SEQ ID NO: 3028065 - DNA, 16 bp, Homo sapiens
ttagaagcctaattgt

SEQ ID NO: 3028066 - DNA, 13 bp, Homo sapiens
ttagaagtgtcat

SEQ ID NO: 3028067 - DNA, 17 bp, Homo sapiens
ttagaagtgtcatgttt

SEQ ID NO: 3028068 - DNA, 21 bp, Homo sapiens
ttagaatccacgtattcccct

SEQ ID NO: 3028069 - DNA, 14 bp, Homo sapiens
ttagaattgatttc

SEQ ID NO: 3028070 - DNA, 17 bp, Homo sapiens
ttagacaccttcatttt

SEQ ID NO: 3028071 - DNA, 17 bp, Homo sapiens
ttagaccccatacaagt

SEQ ID NO: 3028072 - DNA, 18 bp, Homo sapiens
ttagactacatttagaga

SEQ ID NO: 3028073 - DNA, 22 bp, Homo sapiens
ttagactcatggtgtgttacac

SEQ ID NO: 3028074 - DNA, 15 bp, Homo sapiens
ttagactggaacttg

SEQ ID NO: 3028075 - DNA, 17 bp, Homo sapiens
ttagactggacagcttg

SEQ ID NO: 3028076 - DNA, 19 bp, Homo sapiens
ttagactggacagcttgtg

SEQ ID NO: 3028077 - DNA, 14 bp, Homo sapiens
ttagactgtagcct

SEQ ID NO: 3028078 - DNA, 22 bp, Homo sapiens
ttagactttaaaatgagctact

SEQ ID NO: 3028079 - DNA, 15 bp, Homo sapiens
ttagagaaactttga

SEQ ID NO: 3028080 - DNA, 14 bp, Homo sapiens
ttagagaactgaaa

SEQ ID NO: 3028081 - DNA, 15 bp, Homo sapiens
ttagaggcattgtta

SEQ ID NO: 3028082 - DNA, 20 bp, Homo sapiens
ttagaggcattgttagttta

SEQ ID NO: 3028083 - DNA, 21 bp, Homo sapiens
ttagaggtgagttttaaagaa

SEQ ID NO: 3028084 - DNA, 19 bp, Homo sapiens
ttagagtaagaaatttcag

SEQ ID NO: 3028085 - DNA, 18 bp, Homo sapiens
ttagagtcgtcactctct

SEQ ID NO: 3028086 - DNA, 22 bp, Homo sapiens
ttagagttttttttttctttca

SEQ ID NO: 3028087 - DNA, 18 bp, Homo sapiens
ttagatcccatatttact

SEQ ID NO: 3028088 - DNA, 20 bp, Homo sapiens
ttagatcccatatttactta

SEQ ID NO: 3028089 - DNA, 15 bp, Homo sapiens
ttagatctggcatgt

SEQ ID NO: 3028090 - DNA, 20 bp, Homo sapiens
ttagatgggaggatgaattg

SEQ ID NO: 3028091 - DNA, 19 bp, Homo sapiens
ttagatgttgccatgtgtt

SEQ ID NO: 3028092 - DNA, 14 bp, Homo sapiens
ttagatgtttatat

SEQ ID NO: 3028093 - DNA, 20 bp, Homo sapiens
ttagattctctgtgtctaag

SEQ ID NO: 3028094 - DNA, 12 bp, Homo sapiens
ttagattctgta

SEQ ID NO: 3028095 - DNA, 14 bp, Homo sapiens
ttagattctgtatg

SEQ ID NO: 3028096 - DNA, 23 bp, Homo sapiens
ttagattgaaaacttttctcaga

SEQ ID NO: 3028097 - DNA, 19 bp, Homo sapiens
ttagattgatgtgcactgc

SEQ ID NO: 3028098 - DNA, 17 bp, Homo sapiens
ttagattgggccatggc

SEQ ID NO: 3028099 - DNA, 13 bp, Homo sapiens
ttagattgtaaac

SEQ ID NO: 3028100 - DNA, 21 bp, Homo sapiens
ttagattttctggttctaaca

SEQ ID NO: 3028101 - DNA, 21 bp, Homo sapiens
ttagattttctgtaaatgaag

SEQ ID NO: 3028102 - DNA, 17 bp, Homo sapiens
ttagcagaagaaaggaa

SEQ ID NO: 3028103 - DNA, 18 bp, Homo sapiens
ttagcataaatttaatgt

SEQ ID NO: 3028104 - DNA, 19 bp, Homo sapiens
ttagcatttaccaacatgt

SEQ ID NO: 3028105 - DNA, 20 bp, Homo sapiens
ttagcatttaccaacatgta

SEQ ID NO: 3028106 - DNA, 19 bp, Homo sapiens
ttagccaggtaatgtgaat

SEQ ID NO: 3028107 - DNA, 15 bp, Homo sapiens
ttagccagtcattgt

SEQ ID NO: 3028108 - DNA, 17 bp, Homo sapiens
ttagccgcccatgcact

SEQ ID NO: 3028109 - DNA, 14 bp, Homo sapiens
ttagcctctggatc

SEQ ID NO: 3028110 - DNA, 23 bp, Homo sapiens
ttagccttgctgtagagacttcc

SEQ ID NO: 3028111 - DNA, 23 bp, Homo sapiens
ttagcctttgacattgatgtgtt

SEQ ID NO: 3028112 - DNA, 19 bp, Homo sapiens
ttagctacaatcctacctt

SEQ ID NO: 3028113 - DNA, 14 bp, Homo sapiens
ttagctaggatttg

SEQ ID NO: 3028114 - DNA, 18 bp, Homo sapiens
ttagctaggatttgaaca

SEQ ID NO: 3028115 - DNA, 13 bp, Homo sapiens
ttagctccttgaa

SEQ ID NO: 3028116 - DNA, 20 bp, Homo sapiens
ttcatcctgttggctgctgc

SEQ ID NO: 3028117 - DNA, 20 bp, Homo sapiens
ttcatccttttttctcttct

SEQ ID NO: 3028118 - DNA, 22 bp, Homo sapiens
ttcatccttttttctcttctgt

SEQ ID NO: 3028119 - DNA, 18 bp, Homo sapiens
ttcatcgaatctactaat

SEQ ID NO: 3028120 - DNA, 22 bp, Homo sapiens
ttcatctcccacctagcagcac

SEQ ID NO: 3028121 - DNA, 18 bp, Homo sapiens
ttcatctctttgtcctga

SEQ ID NO: 3028122 - DNA, 17 bp, Homo sapiens
ttcatcttttaatcatg

SEQ ID NO: 3028123 - DNA, 21 bp, Homo sapiens
ttcatgaacttcgcatcaaaa

SEQ ID NO: 3028124 - DNA, 17 bp, Homo sapiens
ttcatgcctgatgaaag

SEQ ID NO: 3028125 - DNA, 21 bp, Homo sapiens
ttcatgtacaagatgaaggag

SEQ ID NO: 3028126 - DNA, 21 bp, Homo sapiens
ttcatgtgtgccaaggctgat

SEQ ID NO: 3028127 - DNA, 14 bp, Homo sapiens
ttcatgttcatcaa

SEQ ID NO: 3028128 - DNA, 12 bp, Homo sapiens
ttcatgtttctt

SEQ ID NO: 3028129 - DNA, 13 bp, Homo sapiens
ttcattaaacttg

SEQ ID NO: 3028130 - DNA, 13 bp, Homo sapiens
ttcattaaatgtt

SEQ ID NO: 3028131 - DNA, 14 bp, Homo sapiens
ttcattaaatgttt

SEQ ID NO: 3028132 - DNA, 16 bp, Homo sapiens
ttcattaaatgtttgt

SEQ ID NO: 3028133 - DNA, 13 bp, Homo sapiens
ttcattacctttt

SEQ ID NO: 3028134 - DNA, 21 bp, Homo sapiens
ttcattaccttttttgataaa

SEQ ID NO: 3028135 - DNA, 13 bp, Homo sapiens
ttcattattctca

SEQ ID NO: 3028136 - DNA, 12 bp, Homo sapiens
ttcattcatatc

SEQ ID NO: 3028137 - DNA, 12 bp, Homo sapiens
ttcattccacag

SEQ ID NO: 3028138 - DNA, 20 bp, Homo sapiens
ttcattctcctcctcctccc

SEQ ID NO: 3028139 - DNA, 14 bp, Homo sapiens
ttcattctctttta

SEQ ID NO: 3028140 - DNA, 18 bp, Homo sapiens
ttcattctgcaagtatac

SEQ ID NO: 3028141 - DNA, 19 bp, Homo sapiens
ttcattggcattctttgca

SEQ ID NO: 3028142 - DNA, 22 bp, Homo sapiens
ttcattggcattctttgcaata

SEQ ID NO: 3028143 - DNA, 14 bp, Homo sapiens
ttcattggttaaaa

SEQ ID NO: 3028144 - DNA, 16 bp, Homo sapiens
ttcattggttaatttt

SEQ ID NO: 3028145 - DNA, 10 bp, Homo sapiens
ttcattgttt

SEQ ID NO: 3028146 - DNA, 22 bp, Homo sapiens
ttcatttactgatcatctgctg

SEQ ID NO: 3028147 - DNA, 20 bp, Homo sapiens
ttcatttctgtctcccctac

SEQ ID NO: 3028148 - DNA, 23 bp, Homo sapiens
ttcatttgtggtgatatagaatt

SEQ ID NO: 3028149 - DNA, 18 bp, Homo sapiens
ttcattttatattgaaaa

SEQ ID NO: 3028150 - DNA, 16 bp, Homo sapiens
ttcatttttaaatgtg

SEQ ID NO: 3028151 - DNA, 17 bp, Homo sapiens
ttcatttttaatcatga

SEQ ID NO: 3028152 - DNA, 21 bp, Homo sapiens
ttcatttttatcccttcctgt

SEQ ID NO: 3028153 - DNA, 17 bp, Homo sapiens
ttcatttttccatgaca

SEQ ID NO: 3028154 - DNA, 21 bp, Homo sapiens
ttcatttttccatgacatttt

SEQ ID NO: 3028155 - DNA, 18 bp, Homo sapiens
ttccaaaagtggcctctt

SEQ ID NO: 3028156 - DNA, 13 bp, Homo sapiens
ttccaaagaatgt

SEQ ID NO: 3028157 - DNA, 21 bp, Homo sapiens
ttccaaagaatgttagagcac

SEQ ID NO: 3028158 - DNA, 17 bp, Homo sapiens
ttccaaagtctctaatt

SEQ ID NO: 3028159 - DNA, 17 bp, Homo sapiens
ttccaaatgcccaagga

SEQ ID NO: 3028160 - DNA, 15 bp, Homo sapiens
ttccaaattcacaag

SEQ ID NO: 3028161 - DNA, 21 bp, Homo sapiens
ttccaacaaagggttttaatg

SEQ ID NO: 3028162 - DNA, 22 bp, Homo sapiens
ttccaacaggcgtgggatcaga

SEQ ID NO: 3028163 - DNA, 22 bp, Homo sapiens
ttccaactcgtatagcatgcat

SEQ ID NO: 3028164 - DNA, 22 bp, Homo sapiens
ttccaactgtatatattcccaa

SEQ ID NO: 3028165 - DNA, 17 bp, Homo sapiens
ttccaacttggctgcag

SEQ ID NO: 3028166 - DNA, 17 bp, Homo sapiens
ttccaagaccatttgta

SEQ ID NO: 3028167 - DNA, 22 bp, Homo sapiens
ttccaagaccatttgtagtgag

SEQ ID NO: 3028168 - DNA, 17 bp, Homo sapiens
ttccaagactctagagt

SEQ ID NO: 3028169 - DNA, 21 bp, Homo sapiens
ttccaagactctagagtccaa

SEQ ID NO: 3028170 - DNA, 15 bp, Homo sapiens
ttccaagagtctaaa

SEQ ID NO: 3028171 - DNA, 17 bp, Homo sapiens
ttccaagagtctaaaga

SEQ ID NO: 3028172 - DNA, 20 bp, Homo sapiens
ttccaagctgtgttaactgt

SEQ ID NO: 3028173 - DNA, 13 bp, Homo sapiens
ttccaaggcttct

SEQ ID NO: 3028174 - DNA, 18 bp, Homo sapiens
ttccaagtgtattttaaa

SEQ ID NO: 3028175 - DNA, 13 bp, Homo sapiens
ttccaatgtgaaa

SEQ ID NO: 3028176 - DNA, 22 bp, Homo sapiens
ttccacaagtgccgcaaattgt

SEQ ID NO: 3028177 - DNA, 15 bp, Homo sapiens
ttccacaccttttat

SEQ ID NO: 3028178 - DNA, 17 bp, Homo sapiens
ttccacactatgtgtgt

SEQ ID NO: 3028179 - DNA, 20 bp, Homo sapiens
ttccacagagtaagacattg

SEQ ID NO: 3028180 - DNA, 21 bp, Homo sapiens
ttccacaggacgaatgcatat

SEQ ID NO: 3028181 - DNA, 22 bp, Homo sapiens
ttccacaggacgaatgcatatt

SEQ ID NO: 3028182 - DNA, 18 bp, Homo sapiens
ttccacaggatcatcatt

SEQ ID NO: 3028183 - DNA, 19 bp, Homo sapiens
ttccacatttttgcacaga

SEQ ID NO: 3028184 - DNA, 21 bp, Homo sapiens
ttccaccaactttttccaagt

SEQ ID NO: 3028185 - DNA, 15 bp, Homo sapiens
ttccacctcacctct

SEQ ID NO: 3028186 - DNA, 16 bp, Homo sapiens
ttccaccttttgtttt

SEQ ID NO: 3028187 - DNA, 22 bp, Homo sapiens
ttccaccttttgtttttccagt

SEQ ID NO: 3028188 - DNA, 22 bp, Homo sapiens
ttccacggagccactcctctga

SEQ ID NO: 3028189 - DNA, 24 bp, Homo sapiens
ttccacggagccactcctctgact

SEQ ID NO: 3028190 - DNA, 17 bp, Homo sapiens
ttccacgtcttcctcca

SEQ ID NO: 3028191 - DNA, 17 bp, Homo sapiens
ttccactcaaatgtcct

SEQ ID NO: 3028192 - DNA, 16 bp, Homo sapiens
ttccactcctcctagc

SEQ ID NO: 3028193 - DNA, 21 bp, Homo sapiens
ttccactcctcctagccaccc

SEQ ID NO: 3028194 - DNA, 16 bp, Homo sapiens
ttccactgaagtagtg

SEQ ID NO: 3028195 - DNA, 16 bp, Homo sapiens
ttccactgagggcagt

SEQ ID NO: 3028196 - DNA, 20 bp, Homo sapiens
ttccacttttttttgtatgt

SEQ ID NO: 3028197 - DNA, 18 bp, Homo sapiens
ttccagaaggatttcttg

SEQ ID NO: 3028198 - DNA, 21 bp, Homo sapiens
ttccagaaggatttcttgtat

SEQ ID NO: 3028199 - DNA, 22 bp, Homo sapiens
ttccagagttaaaatgtttact

SEQ ID NO: 3028200 - DNA, 15 bp, Homo sapiens
ttccagcaaaatcca

SEQ ID NO: 3028201 - DNA, 16 bp, Homo sapiens
ttccagcaaaatccaa

SEQ ID NO: 3028202 - DNA, 20 bp, Homo sapiens
ttccagcaaaatccaaactg

SEQ ID NO: 3028203 - DNA, 22 bp, Homo sapiens
ttccagcaaaatccaaactgct

SEQ ID NO: 3028204 - DNA, 14 bp, Homo sapiens
ttccagcaattctc

SEQ ID NO: 3028205 - DNA, 19 bp, Homo sapiens
ttccagctcattcatttta

SEQ ID NO: 3028206 - DNA, 13 bp, Homo sapiens
ttccagcttagaa

SEQ ID NO: 3028207 - DNA, 18 bp, Homo sapiens
ttccaggactctctgctt

SEQ ID NO: 3028208 - DNA, 17 bp, Homo sapiens
ttccagtgcagagatcc

SEQ ID NO: 3028209 - DNA, 16 bp, Homo sapiens
ttccagttaacctatt

SEQ ID NO: 3028210 - DNA, 11 bp, Homo sapiens
ttccagttccc

SEQ ID NO: 3028211 - DNA, 13 bp, Homo sapiens
ttccatagttttg

SEQ ID NO: 3028212 - DNA, 23 bp, Homo sapiens
ttccatagttttgatgactggca

SEQ ID NO: 3028213 - DNA, 15 bp, Homo sapiens
ttccatatatccttt

SEQ ID NO: 3028214 - DNA, 18 bp, Homo sapiens
ttccatatatccttttct

SEQ ID NO: 3028215 - DNA, 13 bp, Homo sapiens
ttccatcttctcc

SEQ ID NO: 3028216 - DNA, 15 bp, Homo sapiens
ttccatcttctccat

SEQ ID NO: 3028217 - DNA, 12 bp, Homo sapiens
ttccatcttgta

SEQ ID NO: 3028218 - DNA, 18 bp, Homo sapiens
ttccatctttacaaaact

SEQ ID NO: 3028219 - DNA, 20 bp, Homo sapiens
ttccatgaatcgcttctctt

SEQ ID NO: 3028220 - DNA, 12 bp, Homo sapiens
ttccatgacatt

SEQ ID NO: 3028221 - DNA, 13 bp, Homo sapiens
ttccatgacattt

SEQ ID NO: 3028222 - DNA, 17 bp, Homo sapiens
ttccatgattctattta

SEQ ID NO: 3028223 - DNA, 18 bp, Homo sapiens
ttccatgattctatttat

SEQ ID NO: 3028224 - DNA, 17 bp, Homo sapiens
ttccatgctcccaactc

SEQ ID NO: 3028225 - DNA, 15 bp, Homo sapiens
ttccatggccctcat

SEQ ID NO: 3028226 - DNA, 22 bp, Homo sapiens
ttccatgggaccacaactattt

SEQ ID NO: 3028227 - DNA, 12 bp, Homo sapiens
ttccatgtgttt

SEQ ID NO: 3028228 - DNA, 18 bp, Homo sapiens
ttccatgtgttttgcttt

SEQ ID NO: 3028229 - DNA, 19 bp, Homo sapiens
ttccattagtaaaacacaa

SEQ ID NO: 3028230 - DNA, 19 bp, Homo sapiens
ttccattcttggcatctac

SEQ ID NO: 3028231 - DNA, 20 bp, Homo sapiens
ttccattcttggcatctact

SEQ ID NO: 3028232 - DNA, 14 bp, Homo sapiens
ttccattctttctt

SEQ ID NO: 3028233 - DNA, 16 bp, Homo sapiens
ttccattctttcttcc

SEQ ID NO: 3028234 - DNA, 21 bp, Homo sapiens
ttccattgctttgaaaaagtt

SEQ ID NO: 3028235 - DNA, 17 bp, Homo sapiens
ttccattgtttgaaaca

SEQ ID NO: 3028236 - DNA, 18 bp, Homo sapiens
ttcccaacccccagcccc

SEQ ID NO: 3028237 - DNA, 17 bp, Homo sapiens
ttcccaactctagctgg

SEQ ID NO: 3028238 - DNA, 23 bp, Homo sapiens
ttcccaagccttcgggcgtctgt

SEQ ID NO: 3028239 - DNA, 17 bp, Homo sapiens
ttcccaaggccttaagc

SEQ ID NO: 3028240 - DNA, 20 bp, Homo sapiens
ttcccaatagcaacgtagct

SEQ ID NO: 3028241 - DNA, 12 bp, Homo sapiens
ttcccaatggtg

SEQ ID NO: 3028242 - DNA, 14 bp, Homo sapiens
ttcccacaagcctg

SEQ ID NO: 3028243 - DNA, 16 bp, Homo sapiens
ttcccacacctgcctg

SEQ ID NO: 3028244 - DNA, 18 bp, Homo sapiens
ttcccacacctgcctgcg

SEQ ID NO: 3028245 - DNA, 21 bp, Homo sapiens
ttcccacccaattcaaaacat

SEQ ID NO: 3028246 - DNA, 10 bp, Homo sapiens
ttcccactgc

SEQ ID NO: 3028247 - DNA, 17 bp, Homo sapiens
ttcccactttcattcaa

SEQ ID NO: 3028248 - DNA, 22 bp, Homo sapiens
ttcttttggtaaagactggctt

SEQ ID NO: 3028249 - DNA, 15 bp, Homo sapiens
ttctttttattgaat

SEQ ID NO: 3028250 - DNA, 12 bp, Homo sapiens
ttctttttcaaa

SEQ ID NO: 3028251 - DNA, 16 bp, Homo sapiens
ttcttttttgtacagt

SEQ ID NO: 3028252 - DNA, 18 bp, Homo sapiens
ttctttttttccttttta

SEQ ID NO: 3028253 - DNA, 19 bp, Homo sapiens
ttctttttttcctttttaa

SEQ ID NO: 3028254 - DNA, 16 bp, Homo sapiens
ttctttttttcttggc

SEQ ID NO: 3028255 - DNA, 19 bp, Homo sapiens
ttgaaaaaaaatagatgtt

SEQ ID NO: 3028256 - DNA, 20 bp, Homo sapiens
ttgaaaaaaaatagatgttt

SEQ ID NO: 3028257 - DNA, 17 bp, Homo sapiens
ttgaaaaaaagaaagca

SEQ ID NO: 3028258 - DNA, 23 bp, Homo sapiens
ttgaaaaaaagtttctatttagt

SEQ ID NO: 3028259 - DNA, 13 bp, Homo sapiens
ttgaaaaaagtta

SEQ ID NO: 3028260 - DNA, 18 bp, Homo sapiens
ttgaaaaagttaatgctt

SEQ ID NO: 3028261 - DNA, 13 bp, Homo sapiens
ttgaaaacagata

SEQ ID NO: 3028262 - DNA, 19 bp, Homo sapiens
ttgaaaacagatattacag

SEQ ID NO: 3028263 - DNA, 16 bp, Homo sapiens
ttgaaaacttttctca

SEQ ID NO: 3028264 - DNA, 23 bp, Homo sapiens
ttgaaacaatactcataatgtga

SEQ ID NO: 3028265 - DNA, 17 bp, Homo sapiens
ttgaaacacaataccta

SEQ ID NO: 3028266 - DNA, 12 bp, Homo sapiens
ttgaaacagaaa

SEQ ID NO: 3028267 - DNA, 14 bp, Homo sapiens
ttgaaacctgtata

SEQ ID NO: 3028268 - DNA, 18 bp, Homo sapiens
ttgaaagattttattgta

SEQ ID NO: 3028269 - DNA, 17 bp, Homo sapiens
ttgaaagcaaaaatgct

SEQ ID NO: 3028270 - DNA, 20 bp, Homo sapiens
ttgaaaggcattctctgaag

SEQ ID NO: 3028271 - DNA, 21 bp, Homo sapiens
ttgaaaggcattctctgaaga

SEQ ID NO: 3028272 - DNA, 19 bp, Homo sapiens
ttgaaaggtccaaatgttt

SEQ ID NO: 3028273 - DNA, 20 bp, Homo sapiens
ttgaaatacctttgtagtta

SEQ ID NO: 3028274 - DNA, 14 bp, Homo sapiens
ttgaaatgtaattt

SEQ ID NO: 3028275 - DNA, 20 bp, Homo sapiens
ttgaaattaagaaggcaaaa

SEQ ID NO: 3028276 - DNA, 18 bp, Homo sapiens
ttgaacacaaactgtaaa

SEQ ID NO: 3028277 - DNA, 20 bp, Homo sapiens
ttgaacacttggtgctggga

SEQ ID NO: 3028278 - DNA, 12 bp, Homo sapiens
ttgaaccaataa

SEQ ID NO: 3028279 - DNA, 12 bp, Homo sapiens
ttgaacccagga

SEQ ID NO: 3028280 - DNA, 13 bp, Homo sapiens
ttgaacccaggag

SEQ ID NO: 3028281 - DNA, 13 bp, Homo sapiens
ttgaacctgggag

SEQ ID NO: 3028282 - DNA, 22 bp, Homo sapiens
ttgaacgcccccccccacccct

SEQ ID NO: 3028283 - DNA, 16 bp, Homo sapiens
ttgaacgtgccagcag

SEQ ID NO: 3028284 - DNA, 17 bp, Homo sapiens
ttgaacgtgccagcagc

SEQ ID NO: 3028285 - DNA, 22 bp, Homo sapiens
ttgaactccatgggattttatc

SEQ ID NO: 3028286 - DNA, 16 bp, Homo sapiens
ttgaactgagcttgga

SEQ ID NO: 3028287 - DNA, 20 bp, Homo sapiens
ttgaactgatagttactgtt

SEQ ID NO: 3028288 - DNA, 16 bp, Homo sapiens
ttgaacttcacctgca

SEQ ID NO: 3028289 - DNA, 14 bp, Homo sapiens
ttgaactttggaac

SEQ ID NO: 3028290 - DNA, 13 bp, Homo sapiens
ttgaactttttaa

SEQ ID NO: 3028291 - DNA, 22 bp, Homo sapiens
ttgaagaaattataaagataaa

SEQ ID NO: 3028292 - DNA, 19 bp, Homo sapiens
ttgaagaatgttaagactt

SEQ ID NO: 3028293 - DNA, 19 bp, Homo sapiens
ttgaagacatatcatgtgt

SEQ ID NO: 3028294 - DNA, 14 bp, Homo sapiens
ttgaagaccagctt

SEQ ID NO: 3028295 - DNA, 20 bp, Homo sapiens
ttgaagacccgctacaaaac

SEQ ID NO: 3028296 - DNA, 18 bp, Homo sapiens
ttgaagatagtaactgta

SEQ ID NO: 3028297 - DNA, 12 bp, Homo sapiens
ttgaagcagctc

SEQ ID NO: 3028298 - DNA, 18 bp, Homo sapiens
ttgaagcagctctgcctt

SEQ ID NO: 3028299 - DNA, 23 bp, Homo sapiens
ttgaagctgttgctatttgtatt

SEQ ID NO: 3028300 - DNA, 15 bp, Homo sapiens
ttgaagggaggggct

SEQ ID NO: 3028301 - DNA, 17 bp, Homo sapiens
ttgaagggccagagcca

SEQ ID NO: 3028302 - DNA, 17 bp, Homo sapiens
ttgaaggttaaaggaaa

SEQ ID NO: 3028303 - DNA, 23 bp, Homo sapiens
ttgaaggttaaaggaaaagcaca

SEQ ID NO: 3028304 - DNA, 13 bp, Homo sapiens
ttgaagtccagga

SEQ ID NO: 3028305 - DNA, 12 bp, Homo sapiens
ttgaataataag

SEQ ID NO: 3028306 - DNA, 13 bp, Homo sapiens
ttgaatacttttt

SEQ ID NO: 3028307 - DNA, 21 bp, Homo sapiens
ttgaatataatatatttgtgt

SEQ ID NO: 3028308 - DNA, 21 bp, Homo sapiens
ttgaatcagtttccaattatt

SEQ ID NO: 3028309 - DNA, 22 bp, Homo sapiens
ttgaatcatgtagtatcaaata

SEQ ID NO: 3028310 - DNA, 18 bp, Homo sapiens
ttgaatccattgaaagtg

SEQ ID NO: 3028311 - DNA, 15 bp, Homo sapiens
ttgaatctatttaag

SEQ ID NO: 3028312 - DNA, 19 bp, Homo sapiens
ttgaatgcctcataaatta

SEQ ID NO: 3028313 - DNA, 22 bp, Homo sapiens
ttgaatggagattctgattcag

SEQ ID NO: 3028314 - DNA, 17 bp, Homo sapiens
ttgaatggcttttctta

SEQ ID NO: 3028315 - DNA, 15 bp, Homo sapiens
ttgaatgggtccatt

SEQ ID NO: 3028316 - DNA, 12 bp, Homo sapiens
ttgaatgtcttt

SEQ ID NO: 3028317 - DNA, 23 bp, Homo sapiens
ttgaatgtgatcatctttgctga

SEQ ID NO: 3028318 - DNA, 19 bp, Homo sapiens
ttgaattaaatgttcatct

SEQ ID NO: 3028319 - DNA, 17 bp, Homo sapiens
ttgaattaaattaggaa

SEQ ID NO: 3028320 - DNA, 23 bp, Homo sapiens
ttgaattatccacatgaaaataa

SEQ ID NO: 3028321 - DNA, 21 bp, Homo sapiens
ttgaattcttggttgaggaaa

SEQ ID NO: 3028322 - DNA, 22 bp, Homo sapiens
ttgaattttgtttttattttca

SEQ ID NO: 3028323 - DNA, 20 bp, Homo sapiens
ttgacaaagtcaagccacat

SEQ ID NO: 3028324 - DNA, 13 bp, Homo sapiens
ttgacaacatctg

SEQ ID NO: 3028325 - DNA, 14 bp, Homo sapiens
ttgacacctttgaa

SEQ ID NO: 3028326 - DNA, 17 bp, Homo sapiens
ttgacagatcaagctgt

SEQ ID NO: 3028327 - DNA, 18 bp, Homo sapiens
ttgacagatcaagctgtg

SEQ ID NO: 3028328 - DNA, 19 bp, Homo sapiens
ttgacagctttgctgctga

SEQ ID NO: 3028329 - DNA, 17 bp, Homo sapiens
ttgacatgaccctctgt

SEQ ID NO: 3028330 - DNA, 15 bp, Homo sapiens
ttgacatgggtattt

SEQ ID NO: 3028331 - DNA, 15 bp, Homo sapiens
ttgacattatagaca

SEQ ID NO: 3028332 - DNA, 14 bp, Homo sapiens
ttgacattgcgttt

SEQ ID NO: 3028333 - DNA, 14 bp, Homo sapiens
ttgacatttatatt

SEQ ID NO: 3028334 - DNA, 24 bp, Homo sapiens
ttgacatttatattaaataacatg

SEQ ID NO: 3028335 - DNA, 21 bp, Homo sapiens
ttgaccactgtctttttctta

SEQ ID NO: 3028336 - DNA, 14 bp, Homo sapiens
ttgaccagtttctt

SEQ ID NO: 3028337 - DNA, 20 bp, Homo sapiens
ttgaccgcgactaatttcaa

SEQ ID NO: 3028338 - DNA, 14 bp, Homo sapiens
ttgaccggctgccg

SEQ ID NO: 3028339 - DNA, 18 bp, Homo sapiens
ttgacctgaactctgcaa

SEQ ID NO: 3028340 - DNA, 14 bp, Homo sapiens
ttgacctttgtaca

SEQ ID NO: 3028341 - DNA, 15 bp, Homo sapiens
ttgacgaactggcta

SEQ ID NO: 3028342 - DNA, 14 bp, Homo sapiens
ttgacgggccaggc

SEQ ID NO: 3028343 - DNA, 17 bp, Homo sapiens
ttgacgggccaggccct

SEQ ID NO: 3028344 - DNA, 18 bp, Homo sapiens
ttgacgggccaggccctg

SEQ ID NO: 3028345 - DNA, 15 bp, Homo sapiens
ttgactaattttaca

SEQ ID NO: 3028346 - DNA, 19 bp, Homo sapiens
ttgactgaagcgaacatct

SEQ ID NO: 3028347 - DNA, 20 bp, Homo sapiens
ttgactgaagcgaacatctt

SEQ ID NO: 3028348 - DNA, 19 bp, Homo sapiens
ttgactggctgtgtgacct

SEQ ID NO: 3028349 - DNA, 22 bp, Homo sapiens
ttgacttgtataacatcactgt

SEQ ID NO: 3028350 - DNA, 14 bp, Homo sapiens
ttgactttaaagat

SEQ ID NO: 3028351 - DNA, 15 bp, Homo sapiens
ttgactttaaagatg

SEQ ID NO: 3028352 - DNA, 16 bp, Homo sapiens
ttgactttatttctga

SEQ ID NO: 3028353 - DNA, 15 bp, Homo sapiens
ttgagaactccagct

SEQ ID NO: 3028354 - DNA, 22 bp, Homo sapiens
ttgagaactccagctggtgccc

SEQ ID NO: 3028355 - DNA, 16 bp, Homo sapiens
ttgagaatattgaagt

SEQ ID NO: 3028356 - DNA, 23 bp, Homo sapiens
ttgagacaaatcctttctgcccc

SEQ ID NO: 3028357 - DNA, 22 bp, Homo sapiens
ttgagacagagtctcgctctgt

SEQ ID NO: 3028358 - DNA, 15 bp, Homo sapiens
ttgagacctcagcca

SEQ ID NO: 3028359 - DNA, 18 bp, Homo sapiens
ttgagactcggccgcagc

SEQ ID NO: 3028360 - DNA, 19 bp, Homo sapiens
ttgagagagagaacctttc

SEQ ID NO: 3028361 - DNA, 14 bp, Homo sapiens
ttgagagctttctg

SEQ ID NO: 3028362 - DNA, 13 bp, Homo sapiens
ttgagagtgtgac

SEQ ID NO: 3028363 - DNA, 16 bp, Homo sapiens
ttgagatactattttc

SEQ ID NO: 3028364 - DNA, 16 bp, Homo sapiens
ttgagcagaatacaat

SEQ ID NO: 3028365 - DNA, 16 bp, Homo sapiens
ttgagcatcacagaat

SEQ ID NO: 3028366 - DNA, 14 bp, Homo sapiens
ttgagccctcccca

SEQ ID NO: 3028367 - DNA, 15 bp, Homo sapiens
ttgagcgtgattctg

SEQ ID NO: 3028368 - DNA, 15 bp, Homo sapiens
ttgagctattgctgt

SEQ ID NO: 3028369 - DNA, 23 bp, Homo sapiens
ttgagctcagacccccactctca

SEQ ID NO: 3028370 - DNA, 19 bp, Homo sapiens
ttgagctctgctctcagca

SEQ ID NO: 3028371 - DNA, 15 bp, Homo sapiens
ttgagcttgcttctt

SEQ ID NO: 3028372 - DNA, 13 bp, Homo sapiens
ttgaggaaaacaa

SEQ ID NO: 3028373 - DNA, 18 bp, Homo sapiens
ttgaggatttagaagtgt

SEQ ID NO: 3028374 - DNA, 18 bp, Homo sapiens
ttgaggctttaaaaagaa

SEQ ID NO: 3028375 - DNA, 16 bp, Homo sapiens
ttgaggtctcttttct

SEQ ID NO: 3028376 - DNA, 23 bp, Homo sapiens
ttgagtctatttttgtacaaaag

SEQ ID NO: 3028377 - DNA, 12 bp, Homo sapiens
ttgagtctctga

SEQ ID NO: 3028378 - DNA, 14 bp, Homo sapiens
ttgagtctgtgcca

SEQ ID NO: 3028379 - DNA, 14 bp, Homo sapiens
ttgagtgctctgat

SEQ ID NO: 3028380 - DNA, 19 bp, Homo sapiens
ttgagtgtgggactccagg

SEQ ID NO: 3028381 - DNA, 21 bp, Homo sapiens
ttgtcatcgttccccacccct

SEQ ID NO: 3028382 - DNA, 15 bp, Homo sapiens
ttgtcatgtgtatga

SEQ ID NO: 3028383 - DNA, 16 bp, Homo sapiens
ttgtcattacaaatct

SEQ ID NO: 3028384 - DNA, 22 bp, Homo sapiens
ttgtccaaacaggtgctggccc

SEQ ID NO: 3028385 - DNA, 17 bp, Homo sapiens
ttgtccaagttcacagt

SEQ ID NO: 3028386 - DNA, 13 bp, Homo sapiens
ttgtccaggaagt

SEQ ID NO: 3028387 - DNA, 20 bp, Homo sapiens
ttgtccaggctggagtgcaa

SEQ ID NO: 3028388 - DNA, 11 bp, Homo sapiens
ttgtccccagt

SEQ ID NO: 3028389 - DNA, 10 bp, Homo sapiens
ttgtccctgg

SEQ ID NO: 3028390 - DNA, 22 bp, Homo sapiens
ttgtccctggggcactccccca

SEQ ID NO: 3028391 - DNA, 18 bp, Homo sapiens
ttgtccgtgttcatacat

SEQ ID NO: 3028392 - DNA, 15 bp, Homo sapiens
ttgtcctaagtgtca

SEQ ID NO: 3028393 - DNA, 22 bp, Homo sapiens
ttgtcctcagccccgcgtggaa

SEQ ID NO: 3028394 - DNA, 21 bp, Homo sapiens
ttgtcctgaatggctttgtct

SEQ ID NO: 3028395 - DNA, 22 bp, Homo sapiens
ttgtcctgaatggctttgtctt

SEQ ID NO: 3028396 - DNA, 16 bp, Homo sapiens
ttgtccttcctgtgcc

SEQ ID NO: 3028397 - DNA, 15 bp, Homo sapiens
ttgtcctttatattt

SEQ ID NO: 3028398 - DNA, 17 bp, Homo sapiens
ttgtctaaaacaataaa

SEQ ID NO: 3028399 - DNA, 18 bp, Homo sapiens
ttgtctaaaacaataaaa

SEQ ID NO: 3028400 - DNA, 17 bp, Homo sapiens
ttgtctcgtttgtgatt

SEQ ID NO: 3028401 - DNA, 15 bp, Homo sapiens
ttgtctgtaaaaaat

SEQ ID NO: 3028402 - DNA, 23 bp, Homo sapiens
ttgtctgtaaaaaatgtatgcta

SEQ ID NO: 3028403 - DNA, 15 bp, Homo sapiens
ttgtcttgaatgtct

SEQ ID NO: 3028404 - DNA, 19 bp, Homo sapiens
ttgtctttgttataaatga

SEQ ID NO: 3028405 - DNA, 17 bp, Homo sapiens
ttgtcttttttttcatc

SEQ ID NO: 3028406 - DNA, 20 bp, Homo sapiens
ttgtcttttttttcatcctt

SEQ ID NO: 3028407 - DNA, 19 bp, Homo sapiens
ttgtgaactcagccaagca

SEQ ID NO: 3028408 - DNA, 23 bp, Homo sapiens
ttgtgaactcagccaagcacagt

SEQ ID NO: 3028409 - DNA, 21 bp, Homo sapiens
ttgtgaagttaggttcttaaa

SEQ ID NO: 3028410 - DNA, 13 bp, Homo sapiens
ttgtgaatgtgac

SEQ ID NO: 3028411 - DNA, 20 bp, Homo sapiens
ttgtgaccaatacatttgta

SEQ ID NO: 3028412 - DNA, 16 bp, Homo sapiens
ttgtgacctgaagttc

SEQ ID NO: 3028413 - DNA, 17 bp, Homo sapiens
ttgtgaccttagtgttt

SEQ ID NO: 3028414 - DNA, 20 bp, Homo sapiens
ttgtgaccttagtgtttctg

SEQ ID NO: 3028415 - DNA, 16 bp, Homo sapiens
ttgtgactaattgtat

SEQ ID NO: 3028416 - DNA, 22 bp, Homo sapiens
ttgtgactaattgtataacagg

SEQ ID NO: 3028417 - DNA, 14 bp, Homo sapiens
ttgtgactttttaa

SEQ ID NO: 3028418 - DNA, 20 bp, Homo sapiens
ttgtgagacttctgtttgat

SEQ ID NO: 3028419 - DNA, 14 bp, Homo sapiens
ttgtgagatgattt

SEQ ID NO: 3028420 - DNA, 19 bp, Homo sapiens
ttgtgagatgatttgtact

SEQ ID NO: 3028421 - DNA, 17 bp, Homo sapiens
ttgtgagcatcagaggg

SEQ ID NO: 3028422 - DNA, 21 bp, Homo sapiens
ttgtgagccctctagggcagg

SEQ ID NO: 3028423 - DNA, 17 bp, Homo sapiens
ttgtgagcctctttgta

SEQ ID NO: 3028424 - DNA, 22 bp, Homo sapiens
ttgtgagggagagaactgagca

SEQ ID NO: 3028425 - DNA, 24 bp, Homo sapiens
ttgtgagggagagaactgagcatc

SEQ ID NO: 3028426 - DNA, 21 bp, Homo sapiens
ttgtgatattgaccatgtgat

SEQ ID NO: 3028427 - DNA, 21 bp, Homo sapiens
ttgtgatgaatctacatttgt

SEQ ID NO: 3028428 - DNA, 22 bp, Homo sapiens
ttgtgatgtttgctcagaggaa

SEQ ID NO: 3028429 - DNA, 21 bp, Homo sapiens
ttgtgattcttccagatgtga

SEQ ID NO: 3028430 - DNA, 15 bp, Homo sapiens
ttgtgcagaatctct

SEQ ID NO: 3028431 - DNA, 17 bp, Homo sapiens
ttgtgcagcttttggtc

SEQ ID NO: 3028432 - DNA, 21 bp, Homo sapiens
ttgtgccatgtcaaacaaata

SEQ ID NO: 3028433 - DNA, 16 bp, Homo sapiens
ttgtgcctcccttccc

SEQ ID NO: 3028434 - DNA, 14 bp, Homo sapiens
ttgtgctatagtat

SEQ ID NO: 3028435 - DNA, 22 bp, Homo sapiens
ttgtgctcagtcgccctgttct

SEQ ID NO: 3028436 - DNA, 14 bp, Homo sapiens
ttgtgctccataga

SEQ ID NO: 3028437 - DNA, 17 bp, Homo sapiens
ttgtgctctttcctgcc

SEQ ID NO: 3028438 - DNA, 21 bp, Homo sapiens
ttgtggatgttttaattccat

SEQ ID NO: 3028439 - DNA, 15 bp, Homo sapiens
ttgtggatttcagtt

SEQ ID NO: 3028440 - DNA, 19 bp, Homo sapiens
ttgtggatttcagttttaa

SEQ ID NO: 3028441 - DNA, 19 bp, Homo sapiens
ttgtggccaaggagctgct

SEQ ID NO: 3028442 - DNA, 20 bp, Homo sapiens
ttgtggccaaggagctgcta

SEQ ID NO: 3028443 - DNA, 17 bp, Homo sapiens
ttgtggggacctcagcc

SEQ ID NO: 3028444 - DNA, 20 bp, Homo sapiens
ttgtggggaggctgcactgg

SEQ ID NO: 3028445 - DNA, 16 bp, Homo sapiens
ttgtgtaaaaaatgga

SEQ ID NO: 3028446 - DNA, 15 bp, Homo sapiens
ttgtgtctgtacacg

SEQ ID NO: 3028447 - DNA, 14 bp, Homo sapiens
ttgtgtgcgctgcc

SEQ ID NO: 3028448 - DNA, 17 bp, Homo sapiens
ttgtgtgcgctgcctgg

SEQ ID NO: 3028449 - DNA, 19 bp, Homo sapiens
ttgtgtgcgctgcctggcc

SEQ ID NO: 3028450 - DNA, 22 bp, Homo sapiens
ttgtgtgtaccacaccctgcct

SEQ ID NO: 3028451 - DNA, 16 bp, Homo sapiens
ttgtgtgtcaggccct

SEQ ID NO: 3028452 - DNA, 15 bp, Homo sapiens
ttgtgtgtgtttcta

SEQ ID NO: 3028453 - DNA, 15 bp, Homo sapiens
ttgtgttcaccagag

SEQ ID NO: 3028454 - DNA, 15 bp, Homo sapiens
ttgtgttccttctgt

SEQ ID NO: 3028455 - DNA, 16 bp, Homo sapiens
ttgtgttccttctgtg

SEQ ID NO: 3028456 - DNA, 15 bp, Homo sapiens
ttgtgttctctttaa

SEQ ID NO: 3028457 - DNA, 15 bp, Homo sapiens
ttgtgtttggatttg

SEQ ID NO: 3028458 - DNA, 13 bp, Homo sapiens
ttgttaacagagc

SEQ ID NO: 3028459 - DNA, 19 bp, Homo sapiens
ttgttaacatgcctgggat

SEQ ID NO: 3028460 - DNA, 22 bp, Homo sapiens
ttgttaacgtgatgtgccacta

SEQ ID NO: 3028461 - DNA, 18 bp, Homo sapiens
ttgttaactgtactgaag

SEQ ID NO: 3028462 - DNA, 18 bp, Homo sapiens
ttgttaataataattatt

SEQ ID NO: 3028463 - DNA, 20 bp, Homo sapiens
ttgttaattatgtacaacat

SEQ ID NO: 3028464 - DNA, 15 bp, Homo sapiens
ttgttacaataaaac

SEQ ID NO: 3028465 - DNA, 21 bp, Homo sapiens
ttgttaccaaatacacatttc

SEQ ID NO: 3028466 - DNA, 17 bp, Homo sapiens
ttgttaccacagagttt

SEQ ID NO: 3028467 - DNA, 15 bp, Homo sapiens
ttgttactttgaata

SEQ ID NO: 3028468 - DNA, 17 bp, Homo sapiens
ttgttactttgaatagt

SEQ ID NO: 3028469 - DNA, 18 bp, Homo sapiens
ttgttagtggacttgttt

SEQ ID NO: 3028470 - DNA, 14 bp, Homo sapiens
ttgttatggcttaa

SEQ ID NO: 3028471 - DNA, 14 bp, Homo sapiens
ttgttatttgcact

SEQ ID NO: 3028472 - DNA, 14 bp, Homo sapiens
ttgttcacactcct

SEQ ID NO: 3028473 - DNA, 13 bp, Homo sapiens
ttgttcctgcttt

SEQ ID NO: 3028474 - DNA, 15 bp, Homo sapiens
ttgttcctgctttct

SEQ ID NO: 3028475 - DNA, 14 bp, Homo sapiens
ttgttcctgtttat

SEQ ID NO: 3028476 - DNA, 13 bp, Homo sapiens
ttgttctcttctg

SEQ ID NO: 3028477 - DNA, 12 bp, Homo sapiens
ttgttctgaggg

SEQ ID NO: 3028478 - DNA, 18 bp, Homo sapiens
ttgttctgggtgatttct

SEQ ID NO: 3028479 - DNA, 22 bp, Homo sapiens
ttgttctgggtgatttctagaa

SEQ ID NO: 3028480 - DNA, 22 bp, Homo sapiens
ttgttcttcagagatcatggaa

SEQ ID NO: 3028481 - DNA, 12 bp, Homo sapiens
ttgttcttgata

SEQ ID NO: 3028482 - DNA, 20 bp, Homo sapiens
ttgttgcaccaattaagtgt

SEQ ID NO: 3028483 - DNA, 23 bp, Homo sapiens
ttgttgcccccaaagcccatgcc

SEQ ID NO: 3028484 - DNA, 20 bp, Homo sapiens
ttgttgctggcttgttgtaa

SEQ ID NO: 3028485 - DNA, 12 bp, Homo sapiens
ttgttgctttgt

SEQ ID NO: 3028486 - DNA, 22 bp, Homo sapiens
ttgttgtacccttgttttgaaa

SEQ ID NO: 3028487 - DNA, 17 bp, Homo sapiens
ttgttgtcaagtataaa

SEQ ID NO: 3028488 - DNA, 13 bp, Homo sapiens
ttgttgtgctttt

SEQ ID NO: 3028489 - DNA, 14 bp, Homo sapiens
ttgttgtgctttta

SEQ ID NO: 3028490 - DNA, 11 bp, Homo sapiens
ttgttgtgggt

SEQ ID NO: 3028491 - DNA, 22 bp, Homo sapiens
ttgttgtgggttctatgtttac

SEQ ID NO: 3028492 - DNA, 14 bp, Homo sapiens
ttgttgttcccctt

SEQ ID NO: 3028493 - DNA, 14 bp, Homo sapiens
ttgttgtttgccat

SEQ ID NO: 3028494 - DNA, 13 bp, Homo sapiens
ttgtttaaaattc

SEQ ID NO: 3028495 - DNA, 17 bp, Homo sapiens
ttgtttacaatatagat

SEQ ID NO: 3028496 - DNA, 23 bp, Homo sapiens
ttgtttacttaaagatttatcaa

SEQ ID NO: 3028497 - DNA, 21 bp, Homo sapiens
ttgtttagaaagaatattcat

SEQ ID NO: 3028498 - DNA, 13 bp, Homo sapiens
ttgtttagagaat

SEQ ID NO: 3028499 - DNA, 19 bp, Homo sapiens
ttgtttatatgcccattct

SEQ ID NO: 3028500 - DNA, 15 bp, Homo sapiens
ttgtttattagatga

SEQ ID NO: 3028501 - DNA, 11 bp, Homo sapiens
ttgtttcagtg

SEQ ID NO: 3028502 - DNA, 12 bp, Homo sapiens
ttgtttcagtga

SEQ ID NO: 3028503 - DNA, 23 bp, Homo sapiens
ttgtttctactttgatatgactg

SEQ ID NO: 3028504 - DNA, 14 bp, Homo sapiens
ttgtttctgtgggc

SEQ ID NO: 3028505 - DNA, 15 bp, Homo sapiens
ttgtttcttatagat

SEQ ID NO: 3028506 - DNA, 18 bp, Homo sapiens
ttgtttcttatagatttt

SEQ ID NO: 3028507 - DNA, 15 bp, Homo sapiens
ttgtttgcacagagg

SEQ ID NO: 3028508 - DNA, 16 bp, Homo sapiens
ttgtttgccatacttt

SEQ ID NO: 3028509 - DNA, 11 bp, Homo sapiens
ttgtttggatt

SEQ ID NO: 3028510 - DNA, 18 bp, Homo sapiens
ttgtttgtagctttcctg

SEQ ID NO: 3028511 - DNA, 22 bp, Homo sapiens
ttgtttgtattcatgttcatgt

SEQ ID NO: 3028512 - DNA, 16 bp, Homo sapiens
ttgtttgtcagcatct

SEQ ID NO: 3028513 - DNA, 22 bp, Homo sapiens
tttaataactttgctggaaaat

SEQ ID NO: 3028514 - DNA, 20 bp, Homo sapiens
tttaataattatttttaatt

SEQ ID NO: 3028515 - DNA, 17 bp, Homo sapiens
tttaatagtgttaatca

SEQ ID NO: 3028516 - DNA, 22 bp, Homo sapiens
tttaatagtgttaatcaattta

SEQ ID NO: 3028517 - DNA, 14 bp, Homo sapiens
tttaatatgttgac

SEQ ID NO: 3028518 - DNA, 15 bp, Homo sapiens
tttaatatgttgact

SEQ ID NO: 3028519 - DNA, 20 bp, Homo sapiens
tttaatatgttgactttatt

SEQ ID NO: 3028520 - DNA, 15 bp, Homo sapiens
tttaatcaagcagtt

SEQ ID NO: 3028521 - DNA, 12 bp, Homo sapiens
tttaatcaatgt

SEQ ID NO: 3028522 - DNA, 12 bp, Homo sapiens
tttaatcatgaa

SEQ ID NO: 3028523 - DNA, 15 bp, Homo sapiens
tttaatcgtttttgt

SEQ ID NO: 3028524 - DNA, 17 bp, Homo sapiens
tttaatcgtttttgttt

SEQ ID NO: 3028525 - DNA, 13 bp, Homo sapiens
tttaatgtgaaga

SEQ ID NO: 3028526 - DNA, 18 bp, Homo sapiens
tttaatgtgctgtgtaaa

SEQ ID NO: 3028527 - DNA, 20 bp, Homo sapiens
tttaatgtgctgtgtaaagt

SEQ ID NO: 3028528 - DNA, 22 bp, Homo sapiens
tttaatgtgctgtgtaaagtta

SEQ ID NO: 3028529 - DNA, 16 bp, Homo sapiens
tttaatgtttaaaaca

SEQ ID NO: 3028530 - DNA, 21 bp, Homo sapiens
tttaattaaaaactagtagtt

SEQ ID NO: 3028531 - DNA, 22 bp, Homo sapiens
tttaattatttaaatgtactta

SEQ ID NO: 3028532 - DNA, 12 bp, Homo sapiens
tttaattatttt

SEQ ID NO: 3028533 - DNA, 16 bp, Homo sapiens
tttaattcatgtttct

SEQ ID NO: 3028534 - DNA, 11 bp, Homo sapiens
tttaattctct

SEQ ID NO: 3028535 - DNA, 18 bp, Homo sapiens
tttaatttagtaaatgtt

SEQ ID NO: 3028536 - DNA, 21 bp, Homo sapiens
tttaatttattaattgctttg

SEQ ID NO: 3028537 - DNA, 16 bp, Homo sapiens
tttaattttgtatttt

SEQ ID NO: 3028538 - DNA, 18 bp, Homo sapiens
tttaattttttttagtat

SEQ ID NO: 3028539 - DNA, 17 bp, Homo sapiens
tttacaacaaacactgt

SEQ ID NO: 3028540 - DNA, 17 bp, Homo sapiens
tttacaagggagaagac

SEQ ID NO: 3028541 - DNA, 15 bp, Homo sapiens
tttacaattgaaatg

SEQ ID NO: 3028542 - DNA, 14 bp, Homo sapiens
tttacacagaaaca

SEQ ID NO: 3028543 - DNA, 18 bp, Homo sapiens
tttacacagcaattttgt

SEQ ID NO: 3028544 - DNA, 15 bp, Homo sapiens
tttacaccacacttt

SEQ ID NO: 3028545 - DNA, 17 bp, Homo sapiens
tttacaccacactttca

SEQ ID NO: 3028546 - DNA, 18 bp, Homo sapiens
tttacacgtatctcttgg

SEQ ID NO: 3028547 - DNA, 11 bp, Homo sapiens
tttacactgta

SEQ ID NO: 3028548 - DNA, 12 bp, Homo sapiens
tttacagaaaaa

SEQ ID NO: 3028549 - DNA, 20 bp, Homo sapiens
tttacagctctgactttaca

SEQ ID NO: 3028550 - DNA, 15 bp, Homo sapiens
tttacagctgtgtta

SEQ ID NO: 3028551 - DNA, 20 bp, Homo sapiens
tttacagctttcatgattag

SEQ ID NO: 3028552 - DNA, 19 bp, Homo sapiens
tttacaggaaagatgcatt

SEQ ID NO: 3028553 - DNA, 22 bp, Homo sapiens
tttacaggatcatgtaaatgct

SEQ ID NO: 3028554 - DNA, 20 bp, Homo sapiens
tttacagttagggttttgca

SEQ ID NO: 3028555 - DNA, 21 bp, Homo sapiens
tttacatacagtgatatggta

SEQ ID NO: 3028556 - DNA, 14 bp, Homo sapiens
tttacattctgtgt

SEQ ID NO: 3028557 - DNA, 23 bp, Homo sapiens
tttaccaaaggtttttaaagtaa

SEQ ID NO: 3028558 - DNA, 23 bp, Homo sapiens
tttaccaacatgtatctgtctac

SEQ ID NO: 3028559 - DNA, 19 bp, Homo sapiens
tttacccacacacagataa

SEQ ID NO: 3028560 - DNA, 18 bp, Homo sapiens
tttacccctgcacagttt

SEQ ID NO: 3028561 - DNA, 22 bp, Homo sapiens
tttaccttcatttcatcctgtt

SEQ ID NO: 3028562 - DNA, 13 bp, Homo sapiens
tttacggacaccc

SEQ ID NO: 3028563 - DNA, 17 bp, Homo sapiens
tttacggacaccccctc

SEQ ID NO: 3028564 - DNA, 18 bp, Homo sapiens
tttacgtctgggagaaat

SEQ ID NO: 3028565 - DNA, 15 bp, Homo sapiens
tttactaagatgaca

SEQ ID NO: 3028566 - DNA, 23 bp, Homo sapiens
tttactaagatgacattgctaag

SEQ ID NO: 3028567 - DNA, 15 bp, Homo sapiens
tttactatctcactg

SEQ ID NO: 3028568 - DNA, 15 bp, Homo sapiens
tttactatgcctgtg

SEQ ID NO: 3028569 - DNA, 18 bp, Homo sapiens
tttactgaccctggggct

SEQ ID NO: 3028570 - DNA, 22 bp, Homo sapiens
tttactgttacaatattaggtg

SEQ ID NO: 3028571 - DNA, 15 bp, Homo sapiens
tttacttaaagattt

SEQ ID NO: 3028572 - DNA, 20 bp, Homo sapiens
tttacttaaagatttatcaa

SEQ ID NO: 3028573 - DNA, 12 bp, Homo sapiens
tttacttacaaa

SEQ ID NO: 3028574 - DNA, 16 bp, Homo sapiens
tttacttctaatctta

SEQ ID NO: 3028575 - DNA, 20 bp, Homo sapiens
tttactttagaagcacagta

SEQ ID NO: 3028576 - DNA, 15 bp, Homo sapiens
tttactttttaaaca

SEQ ID NO: 3028577 - DNA, 20 bp, Homo sapiens
tttacttttttacactgagt

SEQ ID NO: 3028578 - DNA, 20 bp, Homo sapiens
tttagaaaaagaacatgcag

SEQ ID NO: 3028579 - DNA, 21 bp, Homo sapiens
tttagaaaaagaacatgcagt

SEQ ID NO: 3028580 - DNA, 18 bp, Homo sapiens
tttagaaaacccaagttt

SEQ ID NO: 3028581 - DNA, 16 bp, Homo sapiens
tttagaaaattttatg

SEQ ID NO: 3028582 - DNA, 16 bp, Homo sapiens
tttagaaagctgacat

SEQ ID NO: 3028583 - DNA, 15 bp, Homo sapiens
tttagaaataataaa

SEQ ID NO: 3028584 - DNA, 15 bp, Homo sapiens
tttagaagtgtcatg

SEQ ID NO: 3028585 - DNA, 16 bp, Homo sapiens
tttagacaaatactca

SEQ ID NO: 3028586 - DNA, 21 bp, Homo sapiens
tttagacaaatactcatgtgt

SEQ ID NO: 3028587 - DNA, 22 bp, Homo sapiens
tttagacaaatactcatgtgta

SEQ ID NO: 3028588 - DNA, 23 bp, Homo sapiens
tttagacaaatactcatgtgtat

SEQ ID NO: 3028589 - DNA, 16 bp, Homo sapiens
tttagacagtctcact

SEQ ID NO: 3028590 - DNA, 14 bp, Homo sapiens
tttagagcaatgca

SEQ ID NO: 3028591 - DNA, 12 bp, Homo sapiens
tttagagcatta

SEQ ID NO: 3028592 - DNA, 19 bp, Homo sapiens
tttagagtaagaaatttca

SEQ ID NO: 3028593 - DNA, 20 bp, Homo sapiens
tttagattattttatctggt

SEQ ID NO: 3028594 - DNA, 22 bp, Homo sapiens
tttagattgaaaacttttctca

SEQ ID NO: 3028595 - DNA, 19 bp, Homo sapiens
tttagattttctggttcta

SEQ ID NO: 3028596 - DNA, 15 bp, Homo sapiens
tttagcaatgctgtg

SEQ ID NO: 3028597 - DNA, 14 bp, Homo sapiens
tttagcataaattt

SEQ ID NO: 3028598 - DNA, 20 bp, Homo sapiens
tttagcataaatttaatgta

SEQ ID NO: 3028599 - DNA, 20 bp, Homo sapiens
tttagccattgtcgtttcat

SEQ ID NO: 3028600 - DNA, 15 bp, Homo sapiens
tttagcttcctccag

SEQ ID NO: 3028601 - DNA, 17 bp, Homo sapiens
tttagcttcctccagag

SEQ ID NO: 3028602 - DNA, 11 bp, Homo sapiens
tttaggttcta

SEQ ID NO: 3028603 - DNA, 13 bp, Homo sapiens
tttaggttctaaa

SEQ ID NO: 3028604 - DNA, 23 bp, Homo sapiens
tttaggttctaaagttctaagat

SEQ ID NO: 3028605 - DNA, 20 bp, Homo sapiens
tttagtaaatacatcactgt

SEQ ID NO: 3028606 - DNA, 21 bp, Homo sapiens
tttagtaaatacatcactgta

SEQ ID NO: 3028607 - DNA, 16 bp, Homo sapiens
tttagtaaatgttatc

SEQ ID NO: 3028608 - DNA, 17 bp, Homo sapiens
tttagtaaatgttatct

SEQ ID NO: 3028609 - DNA, 14 bp, Homo sapiens
tttagtatgtaaat

SEQ ID NO: 3028610 - DNA, 21 bp, Homo sapiens
tttagtattgaatacttacat

SEQ ID NO: 3028611 - DNA, 15 bp, Homo sapiens
tttagtgaattaaat

SEQ ID NO: 3028612 - DNA, 16 bp, Homo sapiens
tttagtgtattttctg

SEQ ID NO: 3028613 - DNA, 15 bp, Homo sapiens
tttagtgtgtgtgca

SEQ ID NO: 3028614 - DNA, 16 bp, Homo sapiens
tttagttacagctgtg

SEQ ID NO: 3028615 - DNA, 16 bp, Homo sapiens
tttagttccaacaaag

SEQ ID NO: 3028616 - DNA, 18 bp, Homo sapiens
tttagttgaattccaagt

SEQ ID NO: 3028617 - DNA, 13 bp, Homo sapiens
tttagtttaaaat

SEQ ID NO: 3028618 - DNA, 11 bp, Homo sapiens
tttagtttgtt

SEQ ID NO: 3028619 - DNA, 16 bp, Homo sapiens
tttataaaatggctgt

SEQ ID NO: 3028620 - DNA, 20 bp, Homo sapiens
tttataaagtgcttgtgtaa

SEQ ID NO: 3028621 - DNA, 20 bp, Homo sapiens
tttataaataaactgttgct

SEQ ID NO: 3028622 - DNA, 16 bp, Homo sapiens
tttataactattcagt

SEQ ID NO: 3028623 - DNA, 20 bp, Homo sapiens
tttataactattcagttgtg

SEQ ID NO: 3028624 - DNA, 15 bp, Homo sapiens
tttataatgttgtat

SEQ ID NO: 3028625 - DNA, 13 bp, Homo sapiens
tttataattaatc

SEQ ID NO: 3028626 - DNA, 19 bp, Homo sapiens
tttataattcagtatgttt

SEQ ID NO: 3028627 - DNA, 15 bp, Homo sapiens
tttatacaacagtgc

SEQ ID NO: 3028628 - DNA, 16 bp, Homo sapiens
tttatacaacagtgct

SEQ ID NO: 3028629 - DNA, 18 bp, Homo sapiens
tttatacaacagtgctaa

SEQ ID NO: 3028630 - DNA, 23 bp, Homo sapiens
tttatacaacagtgctaaaaatg

SEQ ID NO: 3028631 - DNA, 17 bp, Homo sapiens
tttatacagtgtacatg

SEQ ID NO: 3028632 - DNA, 21 bp, Homo sapiens
tttataccattataccagcaa

SEQ ID NO: 3028633 - DNA, 18 bp, Homo sapiens
tttatactctcttccctt

SEQ ID NO: 3028634 - DNA, 16 bp, Homo sapiens
tttatactgcacttta

SEQ ID NO: 3028635 - DNA, 15 bp, Homo sapiens
tttatactgtgaagt

SEQ ID NO: 3028636 - DNA, 19 bp, Homo sapiens
tttatactgtgaagttaca

SEQ ID NO: 3028637 - DNA, 23 bp, Homo sapiens
tttatactgtgaagttacatgca

SEQ ID NO: 3028638 - DNA, 13 bp, Homo sapiens
tttatagttgtat

SEQ ID NO: 3028639 - DNA, 14 bp, Homo sapiens
tttatataaggtca

SEQ ID NO: 3028640 - DNA, 15 bp, Homo sapiens
tttatatagaaacac

SEQ ID NO: 3028641 - DNA, 13 bp, Homo sapiens
tttatatatacag

SEQ ID NO: 3028642 - DNA, 13 bp, Homo sapiens
tttatatcaaatg

SEQ ID NO: 3028643 - DNA, 15 bp, Homo sapiens
tttatatgaaaacac

SEQ ID NO: 3028644 - DNA, 18 bp, Homo sapiens
tttatatgaagcaagctg

SEQ ID NO: 3028645 - DNA, 22 bp, Homo sapiens
tttatatgaagcaagctgtgtt

SEQ ID NO: 3028646 - DNA, 15 bp, Homo sapiens
tttgatgctgtttga

SEQ ID NO: 3028647 - DNA, 18 bp, Homo sapiens
tttgatggctgggtcctt

SEQ ID NO: 3028648 - DNA, 15 bp, Homo sapiens
tttgatgttaacaca

SEQ ID NO: 3028649 - DNA, 19 bp, Homo sapiens
tttgattaacaatgtattt

SEQ ID NO: 3028650 - DNA, 16 bp, Homo sapiens
tttgattcaaggctca

SEQ ID NO: 3028651 - DNA, 19 bp, Homo sapiens
tttgatttgtttagttttg

SEQ ID NO: 3028652 - DNA, 15 bp, Homo sapiens
tttgcaaagtactgt

SEQ ID NO: 3028653 - DNA, 16 bp, Homo sapiens
tttgcaaagtactgta

SEQ ID NO: 3028654 - DNA, 23 bp, Homo sapiens
tttgcaagcttatttagcacatt

SEQ ID NO: 3028655 - DNA, 17 bp, Homo sapiens
tttgcaataacttctat

SEQ ID NO: 3028656 - DNA, 16 bp, Homo sapiens
tttgcaataatgcagt

SEQ ID NO: 3028657 - DNA, 15 bp, Homo sapiens
tttgcaatactgctt

SEQ ID NO: 3028658 - DNA, 16 bp, Homo sapiens
tttgcacagagggcgc

SEQ ID NO: 3028659 - DNA, 22 bp, Homo sapiens
tttgcacagagggcgctcctgt

SEQ ID NO: 3028660 - DNA, 14 bp, Homo sapiens
tttgcactgtctgt

SEQ ID NO: 3028661 - DNA, 12 bp, Homo sapiens
tttgcagagcct

SEQ ID NO: 3028662 - DNA, 21 bp, Homo sapiens
tttgcaggatttttagagcat

SEQ ID NO: 3028663 - DNA, 19 bp, Homo sapiens
tttgcaggggactgggcca

SEQ ID NO: 3028664 - DNA, 16 bp, Homo sapiens
tttgcataacaattcc

SEQ ID NO: 3028665 - DNA, 11 bp, Homo sapiens
tttgcatgtgt

SEQ ID NO: 3028666 - DNA, 18 bp, Homo sapiens
tttgcattaaattcacaa

SEQ ID NO: 3028667 - DNA, 19 bp, Homo sapiens
tttgcattgaacacaaact

SEQ ID NO: 3028668 - DNA, 21 bp, Homo sapiens
tttgccaaaagaagaagaatt

SEQ ID NO: 3028669 - DNA, 15 bp, Homo sapiens
tttgcccttcactgt

SEQ ID NO: 3028670 - DNA, 15 bp, Homo sapiens
tttgcctgttcagtt

SEQ ID NO: 3028671 - DNA, 20 bp, Homo sapiens
tttgcctgttcagttacaga

SEQ ID NO: 3028672 - DNA, 22 bp, Homo sapiens
tttgcctgttcagttacagaaa

SEQ ID NO: 3028673 - DNA, 23 bp, Homo sapiens
tttgcctgttcagttacagaaag

SEQ ID NO: 3028674 - DNA, 16 bp, Homo sapiens
tttgcggggcctgtct

SEQ ID NO: 3028675 - DNA, 20 bp, Homo sapiens
tttgcggggcctgtctcagt

SEQ ID NO: 3028676 - DNA, 17 bp, Homo sapiens
tttgctaaggagaagct

SEQ ID NO: 3028677 - DNA, 19 bp, Homo sapiens
tttgctatcttaattttgg

SEQ ID NO: 3028678 - DNA, 21 bp, Homo sapiens
tttgctgctataattctatac

SEQ ID NO: 3028679 - DNA, 21 bp, Homo sapiens
tttgctgctgtggaaaggatt

SEQ ID NO: 3028680 - DNA, 12 bp, Homo sapiens
tttgctgtaaga

SEQ ID NO: 3028681 - DNA, 20 bp, Homo sapiens
tttgctgttttaaattgcat

SEQ ID NO: 3028682 - DNA, 16 bp, Homo sapiens
tttgcttagaaaagaa

SEQ ID NO: 3028683 - DNA, 21 bp, Homo sapiens
tttgcttgcagtagattttct

SEQ ID NO: 3028684 - DNA, 9 bp, Homo sapiens
tttgctttc

SEQ ID NO: 3028685 - DNA, 18 bp, Homo sapiens
tttggaagcaacgtgtta

SEQ ID NO: 3028686 - DNA, 13 bp, Homo sapiens
tttggaatacttt

SEQ ID NO: 3028687 - DNA, 20 bp, Homo sapiens
tttggaattgacattctcta

SEQ ID NO: 3028688 - DNA, 22 bp, Homo sapiens
tttggaatttttgcttgacttc

SEQ ID NO: 3028689 - DNA, 19 bp, Homo sapiens
tttggactgagatttctta

SEQ ID NO: 3028690 - DNA, 20 bp, Homo sapiens
tttggactgagatttcttaa

SEQ ID NO: 3028691 - DNA, 14 bp, Homo sapiens
tttggagactttct

SEQ ID NO: 3028692 - DNA, 15 bp, Homo sapiens
tttggagactttctt

SEQ ID NO: 3028693 - DNA, 16 bp, Homo sapiens
tttggataatcttaaa

SEQ ID NO: 3028694 - DNA, 20 bp, Homo sapiens
tttggatctccaattgcctc

SEQ ID NO: 3028695 - DNA, 14 bp, Homo sapiens
tttggattgtatat

SEQ ID NO: 3028696 - DNA, 20 bp, Homo sapiens
tttggatttacgactgaaga

SEQ ID NO: 3028697 - DNA, 16 bp, Homo sapiens
tttggatttgacattg

SEQ ID NO: 3028698 - DNA, 14 bp, Homo sapiens
tttggatttttaat

SEQ ID NO: 3028699 - DNA, 16 bp, Homo sapiens
tttggcaacagaaaac

SEQ ID NO: 3028700 - DNA, 23 bp, Homo sapiens
tttggcaaggaaaggggagaagg

SEQ ID NO: 3028701 - DNA, 13 bp, Homo sapiens
tttggcatgttta

SEQ ID NO: 3028702 - DNA, 13 bp, Homo sapiens
tttggcccaagac

SEQ ID NO: 3028703 - DNA, 17 bp, Homo sapiens
tttggcccctggaacct

SEQ ID NO: 3028704 - DNA, 16 bp, Homo sapiens
tttgggaaacttgtca

SEQ ID NO: 3028705 - DNA, 20 bp, Homo sapiens
tttgggaagtgaagactgga

SEQ ID NO: 3028706 - DNA, 15 bp, Homo sapiens
tttgggaccctgctt

SEQ ID NO: 3028707 - DNA, 17 bp, Homo sapiens
tttgggatccctgtctt

SEQ ID NO: 3028708 - DNA, 14 bp, Homo sapiens
tttgggccctgcat

SEQ ID NO: 3028709 - DNA, 13 bp, Homo sapiens
tttggggaaaaat

SEQ ID NO: 3028710 - DNA, 17 bp, Homo sapiens
tttggggaaaaattctt

SEQ ID NO: 3028711 - DNA, 16 bp, Homo sapiens
tttggggatatgctta

SEQ ID NO: 3028712 - DNA, 18 bp, Homo sapiens
tttggggtgcccctctcc

SEQ ID NO: 3028713 - DNA, 15 bp, Homo sapiens
tttggggtgggcgtt

SEQ ID NO: 3028714 - DNA, 16 bp, Homo sapiens
tttgggttcaggcctg

SEQ ID NO: 3028715 - DNA, 14 bp, Homo sapiens
tttgggttctgcct

SEQ ID NO: 3028716 - DNA, 15 bp, Homo sapiens
tttgggttctgcctg

SEQ ID NO: 3028717 - DNA, 16 bp, Homo sapiens
tttggtaatatatata

SEQ ID NO: 3028718 - DNA, 17 bp, Homo sapiens
tttggtaggtaaatcta

SEQ ID NO: 3028719 - DNA, 22 bp, Homo sapiens
tttggtaggtaaatctagagtt

SEQ ID NO: 3028720 - DNA, 14 bp, Homo sapiens
tttggtagtttctg

SEQ ID NO: 3028721 - DNA, 16 bp, Homo sapiens
tttggtcacccagact

SEQ ID NO: 3028722 - DNA, 16 bp, Homo sapiens
tttggtgaacagtttt

SEQ ID NO: 3028723 - DNA, 15 bp, Homo sapiens
tttggtggagataaa

SEQ ID NO: 3028724 - DNA, 21 bp, Homo sapiens
tttggtgtcattattccatct

SEQ ID NO: 3028725 - DNA, 20 bp, Homo sapiens
tttggttcattaattctata

SEQ ID NO: 3028726 - DNA, 13 bp, Homo sapiens
tttggttctaagg

SEQ ID NO: 3028727 - DNA, 18 bp, Homo sapiens
tttggttgtattctttga

SEQ ID NO: 3028728 - DNA, 13 bp, Homo sapiens
tttggttgtttgc

SEQ ID NO: 3028729 - DNA, 16 bp, Homo sapiens
tttggtttttttgtac

SEQ ID NO: 3028730 - DNA, 21 bp, Homo sapiens
tttgtaaaaacagcattgctt

SEQ ID NO: 3028731 - DNA, 12 bp, Homo sapiens
tttgtaaaatct

SEQ ID NO: 3028732 - DNA, 17 bp, Homo sapiens
tttgtaaactaaggatt

SEQ ID NO: 3028733 - DNA, 22 bp, Homo sapiens
tttgtaaagtgtggtcccaaca

SEQ ID NO: 3028734 - DNA, 16 bp, Homo sapiens
tttgtaaatgtactgg

SEQ ID NO: 3028735 - DNA, 20 bp, Homo sapiens
tttgtaaatgtactggtaat

SEQ ID NO: 3028736 - DNA, 19 bp, Homo sapiens
tttgtaagaactaaagaag

SEQ ID NO: 3028737 - DNA, 17 bp, Homo sapiens
tttgtaagcaacttgct

SEQ ID NO: 3028738 - DNA, 20 bp, Homo sapiens
tttgtaatgaattcctagaa

SEQ ID NO: 3028739 - DNA, 13 bp, Homo sapiens
tttgtaattgtgt

SEQ ID NO: 3028740 - DNA, 14 bp, Homo sapiens
tttgtaattttagt

SEQ ID NO: 3028741 - DNA, 23 bp, Homo sapiens
tttgtacaaggggccatttggca

SEQ ID NO: 3028742 - DNA, 21 bp, Homo sapiens
tttgtacaatatgaaaaggat

SEQ ID NO: 3028743 - DNA, 12 bp, Homo sapiens
tttgtacatttt

SEQ ID NO: 3028744 - DNA, 22 bp, Homo sapiens
tttgtaccagtgaatttttgca

SEQ ID NO: 3028745 - DNA, 13 bp, Homo sapiens
tttgtactgttta

SEQ ID NO: 3028746 - DNA, 19 bp, Homo sapiens
tttgtagatggcactttag

SEQ ID NO: 3028747 - DNA, 17 bp, Homo sapiens
tttgtagggttctgctt

SEQ ID NO: 3028748 - DNA, 17 bp, Homo sapiens
tttgtaggttattttat

SEQ ID NO: 3028749 - DNA, 22 bp, Homo sapiens
tttgtagtgatttttatgccac

SEQ ID NO: 3028750 - DNA, 13 bp, Homo sapiens
tttgtataattgt

SEQ ID NO: 3028751 - DNA, 16 bp, Homo sapiens
tttgtataattgtatc

SEQ ID NO: 3028752 - DNA, 21 bp, Homo sapiens
tttgtatgaaattataatctg

SEQ ID NO: 3028753 - DNA, 16 bp, Homo sapiens
tttgtatgaagtactt

SEQ ID NO: 3028754 - DNA, 17 bp, Homo sapiens
tttgtatgaagtacttt

SEQ ID NO: 3028755 - DNA, 10 bp, Homo sapiens
tttgtatgtt

SEQ ID NO: 3028756 - DNA, 18 bp, Homo sapiens
tttgtatgttttttttct

SEQ ID NO: 3028757 - DNA, 20 bp, Homo sapiens
tttgtattcatgttcatgtg

SEQ ID NO: 3028758 - DNA, 16 bp, Homo sapiens
tttgtattctctgagc

SEQ ID NO: 3028759 - DNA, 12 bp, Homo sapiens
tttgtattgcca

SEQ ID NO: 3028760 - DNA, 10 bp, Homo sapiens
tttgtatttt

SEQ ID NO: 3028761 - DNA, 15 bp, Homo sapiens
tttgtattttgtgat

SEQ ID NO: 3028762 - DNA, 16 bp, Homo sapiens
tttgtcaaactgtaga

SEQ ID NO: 3028763 - DNA, 17 bp, Homo sapiens
tttgtcaaactgtagaa

SEQ ID NO: 3028764 - DNA, 19 bp, Homo sapiens
tttgtcaatttatgaatat

SEQ ID NO: 3028765 - DNA, 20 bp, Homo sapiens
tttgtcagaactagaatttg

SEQ ID NO: 3028766 - DNA, 22 bp, Homo sapiens
tttgtcagaactagaatttgat

SEQ ID NO: 3028767 - DNA, 19 bp, Homo sapiens
tttgtcagagaagaaaaac

SEQ ID NO: 3028768 - DNA, 23 bp, Homo sapiens
tttgtcagcatctgaccatctgt

SEQ ID NO: 3028769 - DNA, 12 bp, Homo sapiens
tttgtcagtgtt

SEQ ID NO: 3028770 - DNA, 14 bp, Homo sapiens
tttgtcccttgaaa

SEQ ID NO: 3028771 - DNA, 16 bp, Homo sapiens
tttgtctcacttttca

SEQ ID NO: 3028772 - DNA, 14 bp, Homo sapiens
tttgtctgaaaaat

SEQ ID NO: 3028773 - DNA, 15 bp, Homo sapiens
tttgtgaagccctgt

SEQ ID NO: 3028774 - DNA, 18 bp, Homo sapiens
tttgtgagccttgctgcc

SEQ ID NO: 3028775 - DNA, 22 bp, Homo sapiens
tttgtgatgaatctacatttgt

SEQ ID NO: 3028776 - DNA, 11 bp, Homo sapiens
tttgtgcagaa

SEQ ID NO: 3028777 - DNA, 14 bp, Homo sapiens
tttgtgctagaaat

SEQ ID NO: 3028778 - DNA, 15 bp, Homo sapiens
tttgtgctctttcct

SEQ ID NO: 3028779 - DNA, 18 bp, Homo sapiens
aaaatggcgaacatgtgt

SEQ ID NO: 3028780 - DNA, 20 bp, Homo sapiens
aaaatgggaaaaataaaaga

SEQ ID NO: 3028781 - DNA, 19 bp, Homo sapiens
aaaatgggacttcttttca

SEQ ID NO: 3028782 - DNA, 16 bp, Homo sapiens
aaaatgtaaaaaacaa

SEQ ID NO: 3028783 - DNA, 17 bp, Homo sapiens
aaaatgtaaaaaacaaa

SEQ ID NO: 3028784 - DNA, 18 bp, Homo sapiens
aaaatgtaaaaaacaaaa

SEQ ID NO: 3028785 - DNA, 21 bp, Homo sapiens
aaaatgtataatgacttttaa

SEQ ID NO: 3028786 - DNA, 17 bp, Homo sapiens
aaaatgtatatgcactt

SEQ ID NO: 3028787 - DNA, 12 bp, Homo sapiens
aaaatgtctgta

SEQ ID NO: 3028788 - DNA, 15 bp, Homo sapiens
aaaatgtcttcaagg

SEQ ID NO: 3028789 - DNA, 23 bp, Homo sapiens
aaaatgtgaaatttttccacact

SEQ ID NO: 3028790 - DNA, 19 bp, Homo sapiens
aaaatgtgatgttctaagg

SEQ ID NO: 3028791 - DNA, 20 bp, Homo sapiens
aaaatgtgatgttctaaggc

SEQ ID NO: 3028792 - DNA, 18 bp, Homo sapiens
aaaatgtgtctgcaacat

SEQ ID NO: 3028793 - DNA, 16 bp, Homo sapiens
aaaatgttggtgcaat

SEQ ID NO: 3028794 - DNA, 19 bp, Homo sapiens
aaaatgtttactgtaaatt

SEQ ID NO: 3028795 - DNA, 12 bp, Homo sapiens
aaaatgttttaa

SEQ ID NO: 3028796 - DNA, 15 bp, Homo sapiens
aaaatgttttagcaa

SEQ ID NO: 3028797 - DNA, 12 bp, Homo sapiens
aaaattaaaatg

SEQ ID NO: 3028798 - DNA, 16 bp, Homo sapiens
aaaattaagtagaaca

SEQ ID NO: 3028799 - DNA, 18 bp, Homo sapiens
aaaattaagtagaacaaa

SEQ ID NO: 3028800 - DNA, 14 bp, Homo sapiens
aaaattacaactaa

SEQ ID NO: 3028801 - DNA, 16 bp, Homo sapiens
aaaattagacaaatgc

SEQ ID NO: 3028802 - DNA, 15 bp, Homo sapiens
aaaattagccgggca

SEQ ID NO: 3028803 - DNA, 18 bp, Homo sapiens
aaaattatagatgggaat

SEQ ID NO: 3028804 - DNA, 15 bp, Homo sapiens
aaaattatatagcaa

SEQ ID NO: 3028805 - DNA, 18 bp, Homo sapiens
aaaattatatagcaaaga

SEQ ID NO: 3028806 - DNA, 13 bp, Homo sapiens
aaaattcatttct

SEQ ID NO: 3028807 - DNA, 15 bp, Homo sapiens
aaaattcatttctaa

SEQ ID NO: 3028808 - DNA, 13 bp, Homo sapiens
aaaattcttggaa

SEQ ID NO: 3028809 - DNA, 20 bp, Homo sapiens
aaaattcttggttattctgc

SEQ ID NO: 3028810 - DNA, 23 bp, Homo sapiens
aaaattgacttagatattaaaat

SEQ ID NO: 3028811 - DNA, 15 bp, Homo sapiens
aaaattgcaaatctt

SEQ ID NO: 3028812 - DNA, 17 bp, Homo sapiens
aaaattgctgcaccaat

SEQ ID NO: 3028813 - DNA, 12 bp, Homo sapiens
aaaattgtataa

SEQ ID NO: 3028814 - DNA, 18 bp, Homo sapiens
aaaatttaatttctgaaa

SEQ ID NO: 3028815 - DNA, 22 bp, Homo sapiens
aaaatttacatttaatacagat

SEQ ID NO: 3028816 - DNA, 13 bp, Homo sapiens
aaaatttatattt

SEQ ID NO: 3028817 - DNA, 20 bp, Homo sapiens
aaaatttattctacttttaa

SEQ ID NO: 3028818 - DNA, 20 bp, Homo sapiens
aaaatttgccaatctttcct

SEQ ID NO: 3028819 - DNA, 15 bp, Homo sapiens
aaaatttgtagaatt

SEQ ID NO: 3028820 - DNA, 13 bp, Homo sapiens
aaaatttgttgca

SEQ ID NO: 3028821 - DNA, 15 bp, Homo sapiens
aaaatttgtttgaca

SEQ ID NO: 3028822 - DNA, 16 bp, Homo sapiens
aaacaaaaaaaacaac

SEQ ID NO: 3028823 - DNA, 22 bp, Homo sapiens
aaacaaaaccaattcatgaagt

SEQ ID NO: 3028824 - DNA, 15 bp, Homo sapiens
aaacaaaactcttaa

SEQ ID NO: 3028825 - DNA, 17 bp, Homo sapiens
aaacaaaatggcttcag

SEQ ID NO: 3028826 - DNA, 12 bp, Homo sapiens
aaacaaaatttg

SEQ ID NO: 3028827 - DNA, 13 bp, Homo sapiens
aaacaaaatttga

SEQ ID NO: 3028828 - DNA, 14 bp, Homo sapiens
aaacaaataaataa

SEQ ID NO: 3028829 - DNA, 11 bp, Homo sapiens
aaacaacaaaa

SEQ ID NO: 3028830 - DNA, 13 bp, Homo sapiens
aaacaacaaataa

SEQ ID NO: 3028831 - DNA, 13 bp, Homo sapiens
aaacaaccttcag

SEQ ID NO: 3028832 - DNA, 19 bp, Homo sapiens
aaacaagcaagttctgaga

SEQ ID NO: 3028833 - DNA, 21 bp, Homo sapiens
aaacaatactcataatgtgaa

SEQ ID NO: 3028834 - DNA, 22 bp, Homo sapiens
aaacaatccaaatgcattcatg

SEQ ID NO: 3028835 - DNA, 16 bp, Homo sapiens
aaacaatgaatgtctt

SEQ ID NO: 3028836 - DNA, 22 bp, Homo sapiens
aaacaattggttgtatataaag

SEQ ID NO: 3028837 - DNA, 20 bp, Homo sapiens
aaacaatttaaattgttata

SEQ ID NO: 3028838 - DNA, 17 bp, Homo sapiens
aaacacaacacaagaaa

SEQ ID NO: 3028839 - DNA, 14 bp, Homo sapiens
aaacacaataccta

SEQ ID NO: 3028840 - DNA, 17 bp, Homo sapiens
aaacacaatacctacaa

SEQ ID NO: 3028841 - DNA, 16 bp, Homo sapiens
aaacacactgaggcag

SEQ ID NO: 3028842 - DNA, 20 bp, Homo sapiens
aaacacagtgtttttgtaaa

SEQ ID NO: 3028843 - DNA, 17 bp, Homo sapiens
aaacaccgggttccagc

SEQ ID NO: 3028844 - DNA, 19 bp, Homo sapiens
aaacactatttgtgacttt

SEQ ID NO: 3028845 - DNA, 13 bp, Homo sapiens
aaacactccttgc

SEQ ID NO: 3028846 - DNA, 16 bp, Homo sapiens
aaacactccttgcatc

SEQ ID NO: 3028847 - DNA, 23 bp, Homo sapiens
aaacactgccatcttagtttgga

SEQ ID NO: 3028848 - DNA, 17 bp, Homo sapiens
aaacactgcctttttat

SEQ ID NO: 3028849 - DNA, 22 bp, Homo sapiens
aaacactgcctttttatttata

SEQ ID NO: 3028850 - DNA, 21 bp, Homo sapiens
aaacactgcgctttattttct

SEQ ID NO: 3028851 - DNA, 13 bp, Homo sapiens
aaacactgtgcac

SEQ ID NO: 3028852 - DNA, 15 bp, Homo sapiens
aaacacttcaataat

SEQ ID NO: 3028853 - DNA, 17 bp, Homo sapiens
aaacacttccagtctgg

SEQ ID NO: 3028854 - DNA, 15 bp, Homo sapiens
aaacacttctgtcct

SEQ ID NO: 3028855 - DNA, 15 bp, Homo sapiens
aaacacttgcaacct

SEQ ID NO: 3028856 - DNA, 16 bp, Homo sapiens
aaacactttcctggat

SEQ ID NO: 3028857 - DNA, 14 bp, Homo sapiens
aaacacttttttgg

SEQ ID NO: 3028858 - DNA, 14 bp, Homo sapiens
aaacagaaaagtag

SEQ ID NO: 3028859 - DNA, 21 bp, Homo sapiens
aaacagaacatcattagaaca

SEQ ID NO: 3028860 - DNA, 22 bp, Homo sapiens
aaacagaataaaagttcctctc

SEQ ID NO: 3028861 - DNA, 16 bp, Homo sapiens
aaacagaggtaaaaaa

SEQ ID NO: 3028862 - DNA, 22 bp, Homo sapiens
aaacagaggtaaaaaaaagaag

SEQ ID NO: 3028863 - DNA, 14 bp, Homo sapiens
aaacagatgtccct

SEQ ID NO: 3028864 - DNA, 16 bp, Homo sapiens
aaacagattgtttgca

SEQ ID NO: 3028865 - DNA, 14 bp, Homo sapiens
aaacagcaaacagt

SEQ ID NO: 3028866 - DNA, 17 bp, Homo sapiens
aaacagcaaaccaagag

SEQ ID NO: 3028867 - DNA, 23 bp, Homo sapiens
aaacagcaaaccaagagattgct

SEQ ID NO: 3028868 - DNA, 24 bp, Homo sapiens
aaacagcaaaccaagagattgcta

SEQ ID NO: 3028869 - DNA, 17 bp, Homo sapiens
aaacagcattgctttct

SEQ ID NO: 3028870 - DNA, 11 bp, Homo sapiens
aaacagctgcc

SEQ ID NO: 3028871 - DNA, 15 bp, Homo sapiens
aaacagctgccttag

SEQ ID NO: 3028872 - DNA, 17 bp, Homo sapiens
aaacagctgccttagct

SEQ ID NO: 3028873 - DNA, 18 bp, Homo sapiens
aaacagctgccttagctt

SEQ ID NO: 3028874 - DNA, 21 bp, Homo sapiens
aaacagctgccttagcttcag

SEQ ID NO: 3028875 - DNA, 22 bp, Homo sapiens
aaacagctgccttagcttcagg

SEQ ID NO: 3028876 - DNA, 17 bp, Homo sapiens
aaacagggacaaagaaa

SEQ ID NO: 3028877 - DNA, 16 bp, Homo sapiens
aaacaggtgctggccc

SEQ ID NO: 3028878 - DNA, 17 bp, Homo sapiens
aaacaggtgctggccca

SEQ ID NO: 3028879 - DNA, 18 bp, Homo sapiens
aaacaggtgctggcccag

SEQ ID NO: 3028880 - DNA, 20 bp, Homo sapiens
aaacaggtgctggcccagca

SEQ ID NO: 3028881 - DNA, 23 bp, Homo sapiens
aaacaggtgctggcccagcatgg

SEQ ID NO: 3028882 - DNA, 13 bp, Homo sapiens
aaacagtgtttat

SEQ ID NO: 3028883 - DNA, 14 bp, Homo sapiens
aaacataaaaagca

SEQ ID NO: 3028884 - DNA, 15 bp, Homo sapiens
aaacatacaagcaac

SEQ ID NO: 3028885 - DNA, 14 bp, Homo sapiens
aaacatagaaaaat

SEQ ID NO: 3028886 - DNA, 22 bp, Homo sapiens
aaacatattttacatctgaaca

SEQ ID NO: 3028887 - DNA, 16 bp, Homo sapiens
aaacatcagttactct

SEQ ID NO: 3028888 - DNA, 20 bp, Homo sapiens
aaacatcagttactctgaag

SEQ ID NO: 3028889 - DNA, 20 bp, Homo sapiens
aaacatctattctctccaaa

SEQ ID NO: 3028890 - DNA, 17 bp, Homo sapiens
aaacatgaaaacattga

SEQ ID NO: 3028891 - DNA, 15 bp, Homo sapiens
aaacatgagatgtgt

SEQ ID NO: 3028892 - DNA, 12 bp, Homo sapiens
aaacatgtatgt

SEQ ID NO: 3028893 - DNA, 13 bp, Homo sapiens
aaacattccagat

SEQ ID NO: 3028894 - DNA, 16 bp, Homo sapiens
aaacattgaagtaatg

SEQ ID NO: 3028895 - DNA, 16 bp, Homo sapiens
aaacattgatgaatga

SEQ ID NO: 3028896 - DNA, 19 bp, Homo sapiens
aaacattgcctttgaatgt

SEQ ID NO: 3028897 - DNA, 14 bp, Homo sapiens
aaacatttatgaca

SEQ ID NO: 3028898 - DNA, 19 bp, Homo sapiens
aaacattttcagaaatatt

SEQ ID NO: 3028899 - DNA, 14 bp, Homo sapiens
aaaccaaaatgata

SEQ ID NO: 3028900 - DNA, 22 bp, Homo sapiens
aaaccaaactggttcacctgaa

SEQ ID NO: 3028901 - DNA, 14 bp, Homo sapiens
aaaccaacatcttt

SEQ ID NO: 3028902 - DNA, 22 bp, Homo sapiens
aaaccaacctaatatattgtat

SEQ ID NO: 3028903 - DNA, 22 bp, Homo sapiens
aaaccaagattttgaaggaaat

SEQ ID NO: 3028904 - DNA, 16 bp, Homo sapiens
aaaccaagcctctgga

SEQ ID NO: 3028905 - DNA, 19 bp, Homo sapiens
aaaccaattttttgttctt

SEQ ID NO: 3028906 - DNA, 19 bp, Homo sapiens
aaaccacaaacggagcccc

SEQ ID NO: 3028907 - DNA, 19 bp, Homo sapiens
aaaccacagtttcattatt

SEQ ID NO: 3028908 - DNA, 19 bp, Homo sapiens
aaaccactttattgcaatg

SEQ ID NO: 3028909 - DNA, 23 bp, Homo sapiens
aaaccactttattgcaatgcaga

SEQ ID NO: 3028910 - DNA, 19 bp, Homo sapiens
aaaccagtgttagggaagg

SEQ ID NO: 3028911 - DNA, 17 bp, Homo sapiens
aaaccatattttattgt

SEQ ID NO: 3028912 - DNA, 18 bp, Homo sapiens
aaatacttcgatgatgat

SEQ ID NO: 3028913 - DNA, 19 bp, Homo sapiens
aaatacttttccttacctt

SEQ ID NO: 3028914 - DNA, 16 bp, Homo sapiens
aaatagaaaagttatt

SEQ ID NO: 3028915 - DNA, 17 bp, Homo sapiens
aaatagaaaagttatta

SEQ ID NO: 3028916 - DNA, 16 bp, Homo sapiens
aaatagaaccactatg

SEQ ID NO: 3028917 - DNA, 23 bp, Homo sapiens
aaatagaggctttgagcaactaa

SEQ ID NO: 3028918 - DNA, 14 bp, Homo sapiens
aaatagatactttt

SEQ ID NO: 3028919 - DNA, 15 bp, Homo sapiens
aaatagatgctgtgt

SEQ ID NO: 3028920 - DNA, 22 bp, Homo sapiens
aaatagatgctgtgtatatggt

SEQ ID NO: 3028921 - DNA, 17 bp, Homo sapiens
aaatagatgttttaact

SEQ ID NO: 3028922 - DNA, 23 bp, Homo sapiens
aaatagatgttttaacttattta

SEQ ID NO: 3028923 - DNA, 16 bp, Homo sapiens
aaatagcaatcctaaa

SEQ ID NO: 3028924 - DNA, 16 bp, Homo sapiens
aaataggaaacaagtg

SEQ ID NO: 3028925 - DNA, 16 bp, Homo sapiens
aaataggatcctggag

SEQ ID NO: 3028926 - DNA, 14 bp, Homo sapiens
aaataggcaggaag

SEQ ID NO: 3028927 - DNA, 16 bp, Homo sapiens
aaatagtctagtgtag

SEQ ID NO: 3028928 - DNA, 17 bp, Homo sapiens
aaatagttaagacatga

SEQ ID NO: 3028929 - DNA, 23 bp, Homo sapiens
aaatataaacaaagattcatgat

SEQ ID NO: 3028930 - DNA, 13 bp, Homo sapiens
aaatataaatctt

SEQ ID NO: 3028931 - DNA, 15 bp, Homo sapiens
aaatatactgtaaag

SEQ ID NO: 3028932 - DNA, 21 bp, Homo sapiens
aaatatactgtaaagaaagag

SEQ ID NO: 3028933 - DNA, 23 bp, Homo sapiens
aaatatactgtaaagaaagagag

SEQ ID NO: 3028934 - DNA, 22 bp, Homo sapiens
aaatatagttgtctttctttgc

SEQ ID NO: 3028935 - DNA, 17 bp, Homo sapiens
aaatatatagcttgaaa

SEQ ID NO: 3028936 - DNA, 15 bp, Homo sapiens
aaatatatgaacatt

SEQ ID NO: 3028937 - DNA, 18 bp, Homo sapiens
aaatatatgctaagtctt

SEQ ID NO: 3028938 - DNA, 14 bp, Homo sapiens
aaatatattttctt

SEQ ID NO: 3028939 - DNA, 21 bp, Homo sapiens
aaatatccctttttcacatat

SEQ ID NO: 3028940 - DNA, 20 bp, Homo sapiens
aaatatctttgcatcataga

SEQ ID NO: 3028941 - DNA, 12 bp, Homo sapiens
aaatatgaagct

SEQ ID NO: 3028942 - DNA, 12 bp, Homo sapiens
aaatatgaatgc

SEQ ID NO: 3028943 - DNA, 15 bp, Homo sapiens
aaatatgcagaatct

SEQ ID NO: 3028944 - DNA, 13 bp, Homo sapiens
aaatatgcctctc

SEQ ID NO: 3028945 - DNA, 21 bp, Homo sapiens
aaatatgcctctcctttgtat

SEQ ID NO: 3028946 - DNA, 15 bp, Homo sapiens
aaatatggacactta

SEQ ID NO: 3028947 - DNA, 20 bp, Homo sapiens
aaatatggacacttaatact

SEQ ID NO: 3028948 - DNA, 13 bp, Homo sapiens
aaatatgtaccaa

SEQ ID NO: 3028949 - DNA, 17 bp, Homo sapiens
aaatatgtagaatgtaa

SEQ ID NO: 3028950 - DNA, 24 bp, Homo sapiens
aaatatgtatacacaaatatatac

SEQ ID NO: 3028951 - DNA, 22 bp, Homo sapiens
aaatatgtgaagcccagcatct

SEQ ID NO: 3028952 - DNA, 15 bp, Homo sapiens
aaatatgttaaagtt

SEQ ID NO: 3028953 - DNA, 13 bp, Homo sapiens
aaatatgttttta

SEQ ID NO: 3028954 - DNA, 15 bp, Homo sapiens
aaatattagatgtga

SEQ ID NO: 3028955 - DNA, 18 bp, Homo sapiens
aaatattccctagaaact

SEQ ID NO: 3028956 - DNA, 15 bp, Homo sapiens
aaatattctgtacat

SEQ ID NO: 3028957 - DNA, 13 bp, Homo sapiens
aaatattgtaaat

SEQ ID NO: 3028958 - DNA, 21 bp, Homo sapiens
aaatattgtcatgtttattct

SEQ ID NO: 3028959 - DNA, 15 bp, Homo sapiens
aaatatttcagatat

SEQ ID NO: 3028960 - DNA, 13 bp, Homo sapiens
aaatatttcctga

SEQ ID NO: 3028961 - DNA, 12 bp, Homo sapiens
aaatatttctta

SEQ ID NO: 3028962 - DNA, 20 bp, Homo sapiens
aaatatttcttaagtataaa

SEQ ID NO: 3028963 - DNA, 12 bp, Homo sapiens
aaatatttggag

SEQ ID NO: 3028964 - DNA, 18 bp, Homo sapiens
aaatatttgttcttataa

SEQ ID NO: 3028965 - DNA, 11 bp, Homo sapiens
aaatattttct

SEQ ID NO: 3028966 - DNA, 14 bp, Homo sapiens
aaatattttctatt

SEQ ID NO: 3028967 - DNA, 15 bp, Homo sapiens
aaatattttctattt

SEQ ID NO: 3028968 - DNA, 17 bp, Homo sapiens
aaatattttctatttta

SEQ ID NO: 3028969 - DNA, 15 bp, Homo sapiens
aaatattttgaatca

SEQ ID NO: 3028970 - DNA, 15 bp, Homo sapiens
aaatatttttccctc

SEQ ID NO: 3028971 - DNA, 22 bp, Homo sapiens
aaatcaactttttattgccttc

SEQ ID NO: 3028972 - DNA, 14 bp, Homo sapiens
aaatcaagaataaa

SEQ ID NO: 3028973 - DNA, 17 bp, Homo sapiens
aaatcaagtttgaccag

SEQ ID NO: 3028974 - DNA, 21 bp, Homo sapiens
aaatcaagtttgaccagtgca

SEQ ID NO: 3028975 - DNA, 11 bp, Homo sapiens
aaatcaatttt

SEQ ID NO: 3028976 - DNA, 12 bp, Homo sapiens
aaatcaattttt

SEQ ID NO: 3028977 - DNA, 14 bp, Homo sapiens
aaatcacatcctta

SEQ ID NO: 3028978 - DNA, 15 bp, Homo sapiens
aaatcacattctgca

SEQ ID NO: 3028979 - DNA, 21 bp, Homo sapiens
aaatcacattctgcatactaa

SEQ ID NO: 3028980 - DNA, 19 bp, Homo sapiens
aaatcaccacaaactgtaa

SEQ ID NO: 3028981 - DNA, 13 bp, Homo sapiens
aaatcagaataaa

SEQ ID NO: 3028982 - DNA, 21 bp, Homo sapiens
aaatcagaataaattaatatt

SEQ ID NO: 3028983 - DNA, 18 bp, Homo sapiens
aaatcagtattccatcag

SEQ ID NO: 3028984 - DNA, 23 bp, Homo sapiens
aaatcatgttgatcatgtacttt

SEQ ID NO: 3028985 - DNA, 23 bp, Homo sapiens
aaatcatgttttttctgcaatga

SEQ ID NO: 3028986 - DNA, 16 bp, Homo sapiens
aaatccaaactgctgt

SEQ ID NO: 3028987 - DNA, 18 bp, Homo sapiens
aaatccacaggctcctgt

SEQ ID NO: 3028988 - DNA, 15 bp, Homo sapiens
aaatcccaccagaat

SEQ ID NO: 3028989 - DNA, 18 bp, Homo sapiens
aaatccccccttcagaac

SEQ ID NO: 3028990 - DNA, 21 bp, Homo sapiens
aaatccgccagtgtttctgaa

SEQ ID NO: 3028991 - DNA, 16 bp, Homo sapiens
aaatcctatgtgattt

SEQ ID NO: 3028992 - DNA, 21 bp, Homo sapiens
aaatcctatgtgattttaact

SEQ ID NO: 3028993 - DNA, 11 bp, Homo sapiens
aaatcctctgg

SEQ ID NO: 3028994 - DNA, 15 bp, Homo sapiens
aaatccttacttcca

SEQ ID NO: 3028995 - DNA, 16 bp, Homo sapiens
aaatccttacttccag

SEQ ID NO: 3028996 - DNA, 17 bp, Homo sapiens
aaatccttacttccagc

SEQ ID NO: 3028997 - DNA, 18 bp, Homo sapiens
aaatccttacttccagca

SEQ ID NO: 3028998 - DNA, 19 bp, Homo sapiens
aaatccttagatctggcat

SEQ ID NO: 3028999 - DNA, 17 bp, Homo sapiens
aaatcgccttatgagaa

SEQ ID NO: 3029000 - DNA, 14 bp, Homo sapiens
aaatcgggaaggat

SEQ ID NO: 3029001 - DNA, 21 bp, Homo sapiens
aaatcgtttaatgtttataca

SEQ ID NO: 3029002 - DNA, 21 bp, Homo sapiens
aaatctaaatagatacttttg

SEQ ID NO: 3029003 - DNA, 14 bp, Homo sapiens
aaatctatgattcc

SEQ ID NO: 3029004 - DNA, 14 bp, Homo sapiens
aaatctcaaaactg

SEQ ID NO: 3029005 - DNA, 20 bp, Homo sapiens
aaatctcttgattataaatg

SEQ ID NO: 3029006 - DNA, 21 bp, Homo sapiens
aaatctcttgattataaatgt

SEQ ID NO: 3029007 - DNA, 15 bp, Homo sapiens
aaatctgaattttaa

SEQ ID NO: 3029008 - DNA, 14 bp, Homo sapiens
aaatctgacccagt

SEQ ID NO: 3029009 - DNA, 20 bp, Homo sapiens
aaatctgacccagtgccccc

SEQ ID NO: 3029010 - DNA, 22 bp, Homo sapiens
aaatctggtctaatttattaat

SEQ ID NO: 3029011 - DNA, 15 bp, Homo sapiens
aaatctgtataaatg

SEQ ID NO: 3029012 - DNA, 17 bp, Homo sapiens
aaatctgtataaatgtc

SEQ ID NO: 3029013 - DNA, 19 bp, Homo sapiens
aaatctgtcctctgtagta

SEQ ID NO: 3029014 - DNA, 14 bp, Homo sapiens
aaatctgtcctgtg

SEQ ID NO: 3029015 - DNA, 23 bp, Homo sapiens
aaatctgtctttgcggggcctgt

SEQ ID NO: 3029016 - DNA, 12 bp, Homo sapiens
aaatcttaaaaa

SEQ ID NO: 3029017 - DNA, 17 bp, Homo sapiens
aaatcttataatttaaa

SEQ ID NO: 3029018 - DNA, 20 bp, Homo sapiens
aaatcttatagttctaggca

SEQ ID NO: 3029019 - DNA, 13 bp, Homo sapiens
aaatcttcagctg

SEQ ID NO: 3029020 - DNA, 16 bp, Homo sapiens
aaatcttcagctggtg

SEQ ID NO: 3029021 - DNA, 19 bp, Homo sapiens
aaatcttcagctggtggat

SEQ ID NO: 3029022 - DNA, 13 bp, Homo sapiens
aaatcttgaaatt

SEQ ID NO: 3029023 - DNA, 13 bp, Homo sapiens
aaatcttgtaagt

SEQ ID NO: 3029024 - DNA, 18 bp, Homo sapiens
aaatcttgtaagtattta

SEQ ID NO: 3029025 - DNA, 14 bp, Homo sapiens
aaatctttttgata

SEQ ID NO: 3029026 - DNA, 22 bp, Homo sapiens
aaatctttttgataagcacatt

SEQ ID NO: 3029027 - DNA, 16 bp, Homo sapiens
aaatgaaaatgtcttg

SEQ ID NO: 3029028 - DNA, 17 bp, Homo sapiens
aaatgaaaatgtcttgt

SEQ ID NO: 3029029 - DNA, 17 bp, Homo sapiens
aaatgaagatctttata

SEQ ID NO: 3029030 - DNA, 19 bp, Homo sapiens
aaatgaagatctttatatt

SEQ ID NO: 3029031 - DNA, 11 bp, Homo sapiens
aaatgaagcaa

SEQ ID NO: 3029032 - DNA, 20 bp, Homo sapiens
aaatgaagtaacacaatcag

SEQ ID NO: 3029033 - DNA, 14 bp, Homo sapiens
aaatgaatagcttg

SEQ ID NO: 3029034 - DNA, 23 bp, Homo sapiens
aaatgaatagcttgtttctgtca

SEQ ID NO: 3029035 - DNA, 14 bp, Homo sapiens
aaatgacaaagtgt

SEQ ID NO: 3029036 - DNA, 19 bp, Homo sapiens
aaatgacaaatgtattaat

SEQ ID NO: 3029037 - DNA, 20 bp, Homo sapiens
aaatgacagccccttaagca

SEQ ID NO: 3029038 - DNA, 19 bp, Homo sapiens
aaatgagctacttcttatt

SEQ ID NO: 3029039 - DNA, 20 bp, Homo sapiens
aaatgagtcaggcaattgat

SEQ ID NO: 3029040 - DNA, 22 bp, Homo sapiens
aaatgagtttttatggggctga

SEQ ID NO: 3029041 - DNA, 20 bp, Homo sapiens
aaatgatagaactgtactgt

SEQ ID NO: 3029042 - DNA, 20 bp, Homo sapiens
aaatgatagatttgacctcc

SEQ ID NO: 3029043 - DNA, 17 bp, Homo sapiens
aaatgatagttttctag

SEQ ID NO: 3029044 - DNA, 22 bp, Homo sapiens
aaatgatccccaagtgtgaaca

SEQ ID NO: 3029045 - DNA, 20 bp, Homo sapiens
aaccaattttttgttcttca

SEQ ID NO: 3029046 - DNA, 21 bp, Homo sapiens
aaccacaccacatctaagcct

SEQ ID NO: 3029047 - DNA, 21 bp, Homo sapiens
aaccacatttcctctgttctt

SEQ ID NO: 3029048 - DNA, 17 bp, Homo sapiens
aaccacattttaggatc

SEQ ID NO: 3029049 - DNA, 21 bp, Homo sapiens
aaccaccccggccccctgccc

SEQ ID NO: 3029050 - DNA, 17 bp, Homo sapiens
aaccacctaggcaatga

SEQ ID NO: 3029051 - DNA, 22 bp, Homo sapiens
aaccacctaggcaatgaagaat

SEQ ID NO: 3029052 - DNA, 20 bp, Homo sapiens
aaccacgtaccaagccaccg

SEQ ID NO: 3029053 - DNA, 16 bp, Homo sapiens
aaccactgcaagtcct

SEQ ID NO: 3029054 - DNA, 20 bp, Homo sapiens
aaccactgcaagtccttttg

SEQ ID NO: 3029055 - DNA, 21 bp, Homo sapiens
aaccagactttgaaaaattgt

SEQ ID NO: 3029056 - DNA, 21 bp, Homo sapiens
aaccagatttgaggctggttt

SEQ ID NO: 3029057 - DNA, 12 bp, Homo sapiens
aaccagcctcag

SEQ ID NO: 3029058 - DNA, 22 bp, Homo sapiens
aaccagcctcatgctctgatta

SEQ ID NO: 3029059 - DNA, 12 bp, Homo sapiens
aaccaggaaaaa

SEQ ID NO: 3029060 - DNA, 12 bp, Homo sapiens
aaccatatgccc

SEQ ID NO: 3029061 - DNA, 22 bp, Homo sapiens
aaccatgcaggaaggaaaacta

SEQ ID NO: 3029062 - DNA, 17 bp, Homo sapiens
aaccatgtagaaaattt

SEQ ID NO: 3029063 - DNA, 22 bp, Homo sapiens
aaccatgtgactaaaaatgcat

SEQ ID NO: 3029064 - DNA, 15 bp, Homo sapiens
aaccattctaaataa

SEQ ID NO: 3029065 - DNA, 14 bp, Homo sapiens
aaccattggacaga

SEQ ID NO: 3029066 - DNA, 19 bp, Homo sapiens
aaccattggacagatttca

SEQ ID NO: 3029067 - DNA, 22 bp, Homo sapiens
aaccattggacagatttcagta

SEQ ID NO: 3029068 - DNA, 22 bp, Homo sapiens
aaccattttataaagtgcttgt

SEQ ID NO: 3029069 - DNA, 18 bp, Homo sapiens
aaccatttttgaacctta

SEQ ID NO: 3029070 - DNA, 15 bp, Homo sapiens
aacccaagacatcat

SEQ ID NO: 3029071 - DNA, 15 bp, Homo sapiens
aacccaagcttagaa

SEQ ID NO: 3029072 - DNA, 16 bp, Homo sapiens
aacccaagtgggggca

SEQ ID NO: 3029073 - DNA, 22 bp, Homo sapiens
aacccagacctgttagcagaca

SEQ ID NO: 3029074 - DNA, 14 bp, Homo sapiens
aacccagactcaga

SEQ ID NO: 3029075 - DNA, 15 bp, Homo sapiens
aacccagactcagac

SEQ ID NO: 3029076 - DNA, 12 bp, Homo sapiens
aacccagagagg

SEQ ID NO: 3029077 - DNA, 18 bp, Homo sapiens
aacccaggacctctggac

SEQ ID NO: 3029078 - DNA, 15 bp, Homo sapiens
aacccagtcgccctt

SEQ ID NO: 3029079 - DNA, 23 bp, Homo sapiens
aacccagtcgcccttacttcttg

SEQ ID NO: 3029080 - DNA, 19 bp, Homo sapiens
aacccatcagaaggagaag

SEQ ID NO: 3029081 - DNA, 19 bp, Homo sapiens
aacccattaatcttttgta

SEQ ID NO: 3029082 - DNA, 15 bp, Homo sapiens
aaccccagacactgg

SEQ ID NO: 3029083 - DNA, 18 bp, Homo sapiens
aaccccagaggcagaggt

SEQ ID NO: 3029084 - DNA, 15 bp, Homo sapiens
aacccccacacacac

SEQ ID NO: 3029085 - DNA, 14 bp, Homo sapiens
aacccccagccccc

SEQ ID NO: 3029086 - DNA, 21 bp, Homo sapiens
aaccccttcccacgacaaaaa

SEQ ID NO: 3029087 - DNA, 16 bp, Homo sapiens
aaccccttctctgtga

SEQ ID NO: 3029088 - DNA, 18 bp, Homo sapiens
aaccccttctctgtgacc

SEQ ID NO: 3029089 - DNA, 16 bp, Homo sapiens
aacccgacagagggaa

SEQ ID NO: 3029090 - DNA, 18 bp, Homo sapiens
aacccggtgctccctctg

SEQ ID NO: 3029091 - DNA, 22 bp, Homo sapiens
aaccctaatctttcacttgaaa

SEQ ID NO: 3029092 - DNA, 16 bp, Homo sapiens
aaccctggaaactacc

SEQ ID NO: 3029093 - DNA, 22 bp, Homo sapiens
aaccctgtcttgtcctcctgtt

SEQ ID NO: 3029094 - DNA, 16 bp, Homo sapiens
aaccctgttacaaagc

SEQ ID NO: 3029095 - DNA, 14 bp, Homo sapiens
aacccttagcagcc

SEQ ID NO: 3029096 - DNA, 22 bp, Homo sapiens
aacccttcaacgtttcttcact

SEQ ID NO: 3029097 - DNA, 14 bp, Homo sapiens
aacccttctgcttt

SEQ ID NO: 3029098 - DNA, 13 bp, Homo sapiens
aaccgcaggaagc

SEQ ID NO: 3029099 - DNA, 22 bp, Homo sapiens
aaccgcattcagtgcacctgcc

SEQ ID NO: 3029100 - DNA, 12 bp, Homo sapiens
aaccgtccctga

SEQ ID NO: 3029101 - DNA, 18 bp, Homo sapiens
aaccgttttgaagctact

SEQ ID NO: 3029102 - DNA, 13 bp, Homo sapiens
aacctaactgtat

SEQ ID NO: 3029103 - DNA, 17 bp, Homo sapiens
aacctaactgtatcttg

SEQ ID NO: 3029104 - DNA, 14 bp, Homo sapiens
aacctattttgtgt

SEQ ID NO: 3029105 - DNA, 19 bp, Homo sapiens
aacctcacgcacctcccat

SEQ ID NO: 3029106 - DNA, 11 bp, Homo sapiens
aacctcagcct

SEQ ID NO: 3029107 - DNA, 12 bp, Homo sapiens
aacctcagcctg

SEQ ID NO: 3029108 - DNA, 16 bp, Homo sapiens
aacctcaggccacatc

SEQ ID NO: 3029109 - DNA, 22 bp, Homo sapiens
aacctcccttaagcagcaacag

SEQ ID NO: 3029110 - DNA, 17 bp, Homo sapiens
aacctcgagtactgtgg

SEQ ID NO: 3029111 - DNA, 14 bp, Homo sapiens
aacctcgctggact

SEQ ID NO: 3029112 - DNA, 14 bp, Homo sapiens
aacctctctatttt

SEQ ID NO: 3029113 - DNA, 20 bp, Homo sapiens
aacctctgcctcctgggttc

SEQ ID NO: 3029114 - DNA, 16 bp, Homo sapiens
aacctctgcttcccag

SEQ ID NO: 3029115 - DNA, 18 bp, Homo sapiens
aacctctgttcagtgtaa

SEQ ID NO: 3029116 - DNA, 14 bp, Homo sapiens
aacctgcaaaaaat

SEQ ID NO: 3029117 - DNA, 24 bp, Homo sapiens
aacctgctcccttcgctctgctgg

SEQ ID NO: 3029118 - DNA, 20 bp, Homo sapiens
aacctgggattcaggaatgt

SEQ ID NO: 3029119 - DNA, 21 bp, Homo sapiens
aacctgggattcaggaatgtg

SEQ ID NO: 3029120 - DNA, 20 bp, Homo sapiens
aacctgggttgcagacagga

SEQ ID NO: 3029121 - DNA, 13 bp, Homo sapiens
aacctgtatcttt

SEQ ID NO: 3029122 - DNA, 16 bp, Homo sapiens
aacctgtgtctgcgaa

SEQ ID NO: 3029123 - DNA, 13 bp, Homo sapiens
aaccttaagacct

SEQ ID NO: 3029124 - DNA, 21 bp, Homo sapiens
aaccttcagctttatttttct

SEQ ID NO: 3029125 - DNA, 13 bp, Homo sapiens
aaccttctctatg

SEQ ID NO: 3029126 - DNA, 12 bp, Homo sapiens
aaccttctggcc

SEQ ID NO: 3029127 - DNA, 18 bp, Homo sapiens
aaccttgccttagaaaca

SEQ ID NO: 3029128 - DNA, 15 bp, Homo sapiens
aaccttgggccctgg

SEQ ID NO: 3029129 - DNA, 20 bp, Homo sapiens
aaccttggtgtagttgaact

SEQ ID NO: 3029130 - DNA, 22 bp, Homo sapiens
aaccttgtcaataaaaataaat

SEQ ID NO: 3029131 - DNA, 16 bp, Homo sapiens
aaccttgtttgtttta

SEQ ID NO: 3029132 - DNA, 12 bp, Homo sapiens
aacctttaaaaa

SEQ ID NO: 3029133 - DNA, 22 bp, Homo sapiens
aacctttaaaaatgtataatga

SEQ ID NO: 3029134 - DNA, 14 bp, Homo sapiens
aacctttaagaaaa

SEQ ID NO: 3029135 - DNA, 23 bp, Homo sapiens
aacctttaagaaaagccctgaga

SEQ ID NO: 3029136 - DNA, 13 bp, Homo sapiens
aacctttatccct

SEQ ID NO: 3029137 - DNA, 15 bp, Homo sapiens
aacctttccatttta

SEQ ID NO: 3029138 - DNA, 14 bp, Homo sapiens
aacctttcccattt

SEQ ID NO: 3029139 - DNA, 14 bp, Homo sapiens
aacctttctgacat

SEQ ID NO: 3029140 - DNA, 19 bp, Homo sapiens
aacctttctgacatcagca

SEQ ID NO: 3029141 - DNA, 11 bp, Homo sapiens
aacctttgcta

SEQ ID NO: 3029142 - DNA, 19 bp, Homo sapiens
aacctttgcttaccttgtt

SEQ ID NO: 3029143 - DNA, 16 bp, Homo sapiens
aacctttttcctagta

SEQ ID NO: 3029144 - DNA, 11 bp, Homo sapiens
aacctttttct

SEQ ID NO: 3029145 - DNA, 17 bp, Homo sapiens
aacctttttcttgatct

SEQ ID NO: 3029146 - DNA, 22 bp, Homo sapiens
aacctttttcttgatcttaaag

SEQ ID NO: 3029147 - DNA, 14 bp, Homo sapiens
aacgaaaacctgac

SEQ ID NO: 3029148 - DNA, 18 bp, Homo sapiens
aacgaacccctagaaagg

SEQ ID NO: 3029149 - DNA, 15 bp, Homo sapiens
aacgagcctggaagc

SEQ ID NO: 3029150 - DNA, 16 bp, Homo sapiens
aacgcaattaaaaata

SEQ ID NO: 3029151 - DNA, 14 bp, Homo sapiens
aacgcgcagatgtg

SEQ ID NO: 3029152 - DNA, 22 bp, Homo sapiens
aacgctgaagcggtcagactgg

SEQ ID NO: 3029153 - DNA, 12 bp, Homo sapiens
aacgctgcctgc

SEQ ID NO: 3029154 - DNA, 14 bp, Homo sapiens
aacgctgcctgccc

SEQ ID NO: 3029155 - DNA, 15 bp, Homo sapiens
aacgctgcctgccca

SEQ ID NO: 3029156 - DNA, 14 bp, Homo sapiens
aacggagaaaggtg

SEQ ID NO: 3029157 - DNA, 19 bp, Homo sapiens
aacggaggcctgcgaccct

SEQ ID NO: 3029158 - DNA, 15 bp, Homo sapiens
aacggattccaaaga

SEQ ID NO: 3029159 - DNA, 21 bp, Homo sapiens
aacgggcgtcaggggtgcaca

SEQ ID NO: 3029160 - DNA, 21 bp, Homo sapiens
aacgggcttgactttggctga

SEQ ID NO: 3029161 - DNA, 17 bp, Homo sapiens
aacgggtcgtaatgact

SEQ ID NO: 3029162 - DNA, 19 bp, Homo sapiens
aacgtaagcactgtttttc

SEQ ID NO: 3029163 - DNA, 19 bp, Homo sapiens
aacgtacctcttaaaattc

SEQ ID NO: 3029164 - DNA, 16 bp, Homo sapiens
aacgtatgtgctctta

SEQ ID NO: 3029165 - DNA, 15 bp, Homo sapiens
aacgtcacccaaaag

SEQ ID NO: 3029166 - DNA, 12 bp, Homo sapiens
aacgtctcccag

SEQ ID NO: 3029167 - DNA, 15 bp, Homo sapiens
aacgtgatgtgccac

SEQ ID NO: 3029168 - DNA, 11 bp, Homo sapiens
aacgtgcaact

SEQ ID NO: 3029169 - DNA, 13 bp, Homo sapiens
aacgtgccagcag

SEQ ID NO: 3029170 - DNA, 14 bp, Homo sapiens
aacgtgccagcagc

SEQ ID NO: 3029171 - DNA, 19 bp, Homo sapiens
aacgttgatgtaatgaaat

SEQ ID NO: 3029172 - DNA, 21 bp, Homo sapiens
aacgttttttcttcttttaaa

SEQ ID NO: 3029173 - DNA, 19 bp, Homo sapiens
aactaaagaagatctgtaa

SEQ ID NO: 3029174 - DNA, 13 bp, Homo sapiens
aactaaagcaata

SEQ ID NO: 3029175 - DNA, 19 bp, Homo sapiens
aactaacacgtgatgtgat

SEQ ID NO: 3029176 - DNA, 16 bp, Homo sapiens
aactaagaagtggtgt

SEQ ID NO: 3029177 - DNA, 22 bp, Homo sapiens
aactaaggtgctaaatctgcga

SEQ ID NO: 3029178 - DNA, 14 bp, Homo sapiens
aagaatttcacaag

SEQ ID NO: 3029179 - DNA, 14 bp, Homo sapiens
aagaattttaaaaa

SEQ ID NO: 3029180 - DNA, 18 bp, Homo sapiens
aagacaaattctgtttct

SEQ ID NO: 3029181 - DNA, 15 bp, Homo sapiens
aagacaacagaaaga

SEQ ID NO: 3029182 - DNA, 19 bp, Homo sapiens
aagacaatcactgaaacaa

SEQ ID NO: 3029183 - DNA, 14 bp, Homo sapiens
aagacacctggttg

SEQ ID NO: 3029184 - DNA, 12 bp, Homo sapiens
aagacactgcct

SEQ ID NO: 3029185 - DNA, 17 bp, Homo sapiens
aagacactgcctgggct

SEQ ID NO: 3029186 - DNA, 19 bp, Homo sapiens
aagacactggtgtatctca

SEQ ID NO: 3029187 - DNA, 23 bp, Homo sapiens
aagacagtgaaagaaaataacaa

SEQ ID NO: 3029188 - DNA, 18 bp, Homo sapiens
aagacagtgtatgtagaa

SEQ ID NO: 3029189 - DNA, 20 bp, Homo sapiens
aagacagtgtatgtagaagc

SEQ ID NO: 3029190 - DNA, 12 bp, Homo sapiens
aagacatatatt

SEQ ID NO: 3029191 - DNA, 17 bp, Homo sapiens
aagacatatattatata

SEQ ID NO: 3029192 - DNA, 14 bp, Homo sapiens
aagacatatcatgt

SEQ ID NO: 3029193 - DNA, 18 bp, Homo sapiens
aagacatatcatgtgtga

SEQ ID NO: 3029194 - DNA, 22 bp, Homo sapiens
aagacatcatgtatcgcatatt

SEQ ID NO: 3029195 - DNA, 17 bp, Homo sapiens
aagacatccataaagaa

SEQ ID NO: 3029196 - DNA, 15 bp, Homo sapiens
aagacatgatttcct

SEQ ID NO: 3029197 - DNA, 16 bp, Homo sapiens
aagacatgatttcctt

SEQ ID NO: 3029198 - DNA, 17 bp, Homo sapiens
aagacatgttttagaca

SEQ ID NO: 3029199 - DNA, 23 bp, Homo sapiens
aagaccagagatagtggggagac

SEQ ID NO: 3029200 - DNA, 16 bp, Homo sapiens
aagaccatttgtagtg

SEQ ID NO: 3029201 - DNA, 15 bp, Homo sapiens
aagacctcagggcac

SEQ ID NO: 3029202 - DNA, 13 bp, Homo sapiens
aagacctcatctc

SEQ ID NO: 3029203 - DNA, 15 bp, Homo sapiens
aagacgtgtttgtgt

SEQ ID NO: 3029204 - DNA, 20 bp, Homo sapiens
aagactaatgctttctgtgg

SEQ ID NO: 3029205 - DNA, 13 bp, Homo sapiens
aagactacctggg

SEQ ID NO: 3029206 - DNA, 16 bp, Homo sapiens
aagactcaaatgttct

SEQ ID NO: 3029207 - DNA, 21 bp, Homo sapiens
aagactcccgccccgggctgg

SEQ ID NO: 3029208 - DNA, 13 bp, Homo sapiens
aagactctagagt

SEQ ID NO: 3029209 - DNA, 19 bp, Homo sapiens
aagactgaagatggctttt

SEQ ID NO: 3029210 - DNA, 14 bp, Homo sapiens
aagactgagccaga

SEQ ID NO: 3029211 - DNA, 21 bp, Homo sapiens
aagactgagccagattggcca

SEQ ID NO: 3029212 - DNA, 13 bp, Homo sapiens
aagactgcctccc

SEQ ID NO: 3029213 - DNA, 15 bp, Homo sapiens
aagactgcctccctc

SEQ ID NO: 3029214 - DNA, 22 bp, Homo sapiens
aagactggaagctaatttgcat

SEQ ID NO: 3029215 - DNA, 13 bp, Homo sapiens
aagactggagaaa

SEQ ID NO: 3029216 - DNA, 18 bp, Homo sapiens
aagactggagaaatgctt

SEQ ID NO: 3029217 - DNA, 23 bp, Homo sapiens
aagactgtgcggcacaggaaaca

SEQ ID NO: 3029218 - DNA, 18 bp, Homo sapiens
aagacttccaaagaatgt

SEQ ID NO: 3029219 - DNA, 18 bp, Homo sapiens
aagacttccctaacactt

SEQ ID NO: 3029220 - DNA, 16 bp, Homo sapiens
aagagaaagaggccag

SEQ ID NO: 3029221 - DNA, 19 bp, Homo sapiens
aagagaacaaagagtgaaa

SEQ ID NO: 3029222 - DNA, 12 bp, Homo sapiens
aagagactcagc

SEQ ID NO: 3029223 - DNA, 15 bp, Homo sapiens
aagagagaaaataaa

SEQ ID NO: 3029224 - DNA, 21 bp, Homo sapiens
aagagagaaaataaaaagtta

SEQ ID NO: 3029225 - DNA, 22 bp, Homo sapiens
aagagagaaaataaaaagttaa

SEQ ID NO: 3029226 - DNA, 17 bp, Homo sapiens
aagagagaaagaagata

SEQ ID NO: 3029227 - DNA, 18 bp, Homo sapiens
aagagagaacctaactgt

SEQ ID NO: 3029228 - DNA, 17 bp, Homo sapiens
aagagagaattctgttc

SEQ ID NO: 3029229 - DNA, 12 bp, Homo sapiens
aagagaggaagg

SEQ ID NO: 3029230 - DNA, 13 bp, Homo sapiens
aagagaggaagga

SEQ ID NO: 3029231 - DNA, 17 bp, Homo sapiens
aagagaggaaggacccc

SEQ ID NO: 3029232 - DNA, 22 bp, Homo sapiens
aagagaggaaggacccctcacc

SEQ ID NO: 3029233 - DNA, 14 bp, Homo sapiens
aagagatatgggaa

SEQ ID NO: 3029234 - DNA, 21 bp, Homo sapiens
aagagatgggggtgtattgga

SEQ ID NO: 3029235 - DNA, 22 bp, Homo sapiens
aagagatgggggtgtattggaa

SEQ ID NO: 3029236 - DNA, 22 bp, Homo sapiens
aagagattgcacagtcaaaacg

SEQ ID NO: 3029237 - DNA, 14 bp, Homo sapiens
aagagattgctaat

SEQ ID NO: 3029238 - DNA, 15 bp, Homo sapiens
aagagattgctaatt

SEQ ID NO: 3029239 - DNA, 21 bp, Homo sapiens
aagagcagcttcggtgtgcag

SEQ ID NO: 3029240 - DNA, 22 bp, Homo sapiens
aagagcaggactccaggcccaa

SEQ ID NO: 3029241 - DNA, 14 bp, Homo sapiens
aagagcctttccaa

SEQ ID NO: 3029242 - DNA, 15 bp, Homo sapiens
aagagctaataaatc

SEQ ID NO: 3029243 - DNA, 12 bp, Homo sapiens
aagagctctggt

SEQ ID NO: 3029244 - DNA, 10 bp, Homo sapiens
aagaggaaaa

SEQ ID NO: 3029245 - DNA, 22 bp, Homo sapiens
aagaggaaaagctgtaagaaaa

SEQ ID NO: 3029246 - DNA, 14 bp, Homo sapiens
aagaggaaagaatg

SEQ ID NO: 3029247 - DNA, 18 bp, Homo sapiens
aagaggaacagtgtggtt

SEQ ID NO: 3029248 - DNA, 16 bp, Homo sapiens
aagaggagaggaaaac

SEQ ID NO: 3029249 - DNA, 13 bp, Homo sapiens
aagaggagcctca

SEQ ID NO: 3029250 - DNA, 15 bp, Homo sapiens
aagaggagcctcaga

SEQ ID NO: 3029251 - DNA, 12 bp, Homo sapiens
aagaggaggagg

SEQ ID NO: 3029252 - DNA, 14 bp, Homo sapiens
aagaggcaagaggc

SEQ ID NO: 3029253 - DNA, 22 bp, Homo sapiens
aagaggcagagttctgtgaaga

SEQ ID NO: 3029254 - DNA, 19 bp, Homo sapiens
aagaggcaggttagaagaa

SEQ ID NO: 3029255 - DNA, 16 bp, Homo sapiens
aagaggccattgtaaa

SEQ ID NO: 3029256 - DNA, 20 bp, Homo sapiens
aagaggcgtgtgcaggccga

SEQ ID NO: 3029257 - DNA, 20 bp, Homo sapiens
aagaggcgttgctttcactc

SEQ ID NO: 3029258 - DNA, 22 bp, Homo sapiens
aagaggctgaggctggcacagg

SEQ ID NO: 3029259 - DNA, 16 bp, Homo sapiens
aagagggacgcctggg

SEQ ID NO: 3029260 - DNA, 22 bp, Homo sapiens
aagagtacaagctcttgtttct

SEQ ID NO: 3029261 - DNA, 15 bp, Homo sapiens
aagagtagccgattt

SEQ ID NO: 3029262 - DNA, 13 bp, Homo sapiens
aagagtcattttc

SEQ ID NO: 3029263 - DNA, 15 bp, Homo sapiens
aagagtcctctgaat

SEQ ID NO: 3029264 - DNA, 13 bp, Homo sapiens
aagagtctaaaga

SEQ ID NO: 3029265 - DNA, 14 bp, Homo sapiens
aagagtctaaagat

SEQ ID NO: 3029266 - DNA, 20 bp, Homo sapiens
aagagtctagattcaaaggt

SEQ ID NO: 3029267 - DNA, 19 bp, Homo sapiens
aagagtctccttctcttct

SEQ ID NO: 3029268 - DNA, 15 bp, Homo sapiens
aagagtctctggctc

SEQ ID NO: 3029269 - DNA, 21 bp, Homo sapiens
aagagtgaaatattgtaaatg

SEQ ID NO: 3029270 - DNA, 23 bp, Homo sapiens
aagagtgtcctaggagtatcctc

SEQ ID NO: 3029271 - DNA, 21 bp, Homo sapiens
aagagttgccccgtctctgtt

SEQ ID NO: 3029272 - DNA, 15 bp, Homo sapiens
aagataaaatgatgt

SEQ ID NO: 3029273 - DNA, 18 bp, Homo sapiens
aagataaaatgatgttat

SEQ ID NO: 3029274 - DNA, 21 bp, Homo sapiens
aagatacactgacttggtgca

SEQ ID NO: 3029275 - DNA, 19 bp, Homo sapiens
aagatacataaaagtgctt

SEQ ID NO: 3029276 - DNA, 17 bp, Homo sapiens
aagatacttacatgttc

SEQ ID NO: 3029277 - DNA, 17 bp, Homo sapiens
aagatagacttattctt

SEQ ID NO: 3029278 - DNA, 17 bp, Homo sapiens
aagataggctctcagta

SEQ ID NO: 3029279 - DNA, 16 bp, Homo sapiens
aagatatcttttcttt

SEQ ID NO: 3029280 - DNA, 19 bp, Homo sapiens
aagatatcttttctttaga

SEQ ID NO: 3029281 - DNA, 20 bp, Homo sapiens
aagatatttttattcaaact

SEQ ID NO: 3029282 - DNA, 20 bp, Homo sapiens
aagatcattgaagaccagct

SEQ ID NO: 3029283 - DNA, 20 bp, Homo sapiens
aagatccaaatgctgtgcaa

SEQ ID NO: 3029284 - DNA, 21 bp, Homo sapiens
aagatccaaatgctgtgcaaa

SEQ ID NO: 3029285 - DNA, 23 bp, Homo sapiens
aagatccaaatgctgtgcaaaca

SEQ ID NO: 3029286 - DNA, 14 bp, Homo sapiens
aagatcctgtgagg

SEQ ID NO: 3029287 - DNA, 13 bp, Homo sapiens
aagatctacatga

SEQ ID NO: 3029288 - DNA, 17 bp, Homo sapiens
aagatctacctgcaaca

SEQ ID NO: 3029289 - DNA, 21 bp, Homo sapiens
aagatctacctgcaacacaac

SEQ ID NO: 3029290 - DNA, 19 bp, Homo sapiens
aagatctgtcctcagcctt

SEQ ID NO: 3029291 - DNA, 15 bp, Homo sapiens
aagatcttagattct

SEQ ID NO: 3029292 - DNA, 19 bp, Homo sapiens
aagatgaaaccgtccctga

SEQ ID NO: 3029293 - DNA, 17 bp, Homo sapiens
aagatgatgctcagttt

SEQ ID NO: 3029294 - DNA, 15 bp, Homo sapiens
aagatgattgttctt

SEQ ID NO: 3029295 - DNA, 14 bp, Homo sapiens
aagatgcagaagca

SEQ ID NO: 3029296 - DNA, 15 bp, Homo sapiens
aagatgcattgtagt

SEQ ID NO: 3029297 - DNA, 18 bp, Homo sapiens
aagatgcattgtagttta

SEQ ID NO: 3029298 - DNA, 21 bp, Homo sapiens
aagatgctcatctgagccagc

SEQ ID NO: 3029299 - DNA, 21 bp, Homo sapiens
aagatgctctatcttgctctg

SEQ ID NO: 3029300 - DNA, 12 bp, Homo sapiens
aagatgctttta

SEQ ID NO: 3029301 - DNA, 16 bp, Homo sapiens
aagatggagtttctaa

SEQ ID NO: 3029302 - DNA, 18 bp, Homo sapiens
aagatggataaactgagc

SEQ ID NO: 3029303 - DNA, 11 bp, Homo sapiens
aagatgggagg

SEQ ID NO: 3029304 - DNA, 14 bp, Homo sapiens
aagatgggaggaga

SEQ ID NO: 3029305 - DNA, 16 bp, Homo sapiens
aagatggtatatttgg

SEQ ID NO: 3029306 - DNA, 15 bp, Homo sapiens
aagatgtaaggaatt

SEQ ID NO: 3029307 - DNA, 16 bp, Homo sapiens
aagatgtcaaagatat

SEQ ID NO: 3029308 - DNA, 18 bp, Homo sapiens
aagatgtgatattctaag

SEQ ID NO: 3029309 - DNA, 15 bp, Homo sapiens
aagatgttctcctga

SEQ ID NO: 3029310 - DNA, 17 bp, Homo sapiens
aagattatagattctaa

SEQ ID NO: 3029311 - DNA, 23 bp, Homo sapiens
aagggcctcctcacccaccctgt

SEQ ID NO: 3029312 - DNA, 11 bp, Homo sapiens
aagggcctggc

SEQ ID NO: 3029313 - DNA, 13 bp, Homo sapiens
aagggcctggcca

SEQ ID NO: 3029314 - DNA, 19 bp, Homo sapiens
aagggcgcaaagggcatgg

SEQ ID NO: 3029315 - DNA, 16 bp, Homo sapiens
aagggctatgtaaata

SEQ ID NO: 3029316 - DNA, 19 bp, Homo sapiens
aaggggctagggaggacca

SEQ ID NO: 3029317 - DNA, 13 bp, Homo sapiens
aaggggcttcagg

SEQ ID NO: 3029318 - DNA, 16 bp, Homo sapiens
aagggtcaaacctgta

SEQ ID NO: 3029319 - DNA, 21 bp, Homo sapiens
aagggtcgaaagctctagaat

SEQ ID NO: 3029320 - DNA, 22 bp, Homo sapiens
aagggtcgaaagctctagaatc

SEQ ID NO: 3029321 - DNA, 16 bp, Homo sapiens
aagggtctagggagag

SEQ ID NO: 3029322 - DNA, 18 bp, Homo sapiens
aagggtctagggagagac

SEQ ID NO: 3029323 - DNA, 20 bp, Homo sapiens
aagggtctagggagagaccc

SEQ ID NO: 3029324 - DNA, 15 bp, Homo sapiens
aagggtcttgggaaa

SEQ ID NO: 3029325 - DNA, 18 bp, Homo sapiens
aagggtggcaggtcactg

SEQ ID NO: 3029326 - DNA, 20 bp, Homo sapiens
aagggtgggtttgagatgtt

SEQ ID NO: 3029327 - DNA, 20 bp, Homo sapiens
aagggttgcttctgagtggt

SEQ ID NO: 3029328 - DNA, 16 bp, Homo sapiens
aaggtaaaattgaaag

SEQ ID NO: 3029329 - DNA, 16 bp, Homo sapiens
aaggtataaataataa

SEQ ID NO: 3029330 - DNA, 14 bp, Homo sapiens
aaggtatctggtat

SEQ ID NO: 3029331 - DNA, 14 bp, Homo sapiens
aaggtatcttttta

SEQ ID NO: 3029332 - DNA, 23 bp, Homo sapiens
aaggtcatggccacactgtgaca

SEQ ID NO: 3029333 - DNA, 19 bp, Homo sapiens
aaggtccggtgttctaaga

SEQ ID NO: 3029334 - DNA, 21 bp, Homo sapiens
aaggtccggtgttctaagatg

SEQ ID NO: 3029335 - DNA, 13 bp, Homo sapiens
aaggtctatgcag

SEQ ID NO: 3029336 - DNA, 18 bp, Homo sapiens
aaggtctcacactcctcc

SEQ ID NO: 3029337 - DNA, 22 bp, Homo sapiens
aaggtctcacactcctcctgcc

SEQ ID NO: 3029338 - DNA, 15 bp, Homo sapiens
aaggtctgatttgca

SEQ ID NO: 3029339 - DNA, 16 bp, Homo sapiens
aaggtctgatttgcag

SEQ ID NO: 3029340 - DNA, 11 bp, Homo sapiens
aaggtctttgt

SEQ ID NO: 3029341 - DNA, 12 bp, Homo sapiens
aaggtctttgta

SEQ ID NO: 3029342 - DNA, 12 bp, Homo sapiens
aaggtgaacttt

SEQ ID NO: 3029343 - DNA, 20 bp, Homo sapiens
aaggtgacagaaggaccagc

SEQ ID NO: 3029344 - DNA, 17 bp, Homo sapiens
aaggtgaggcctgtctg

SEQ ID NO: 3029345 - DNA, 22 bp, Homo sapiens
aaggtgaggcctgtctgtgacc

SEQ ID NO: 3029346 - DNA, 12 bp, Homo sapiens
aaggtgcagctg

SEQ ID NO: 3029347 - DNA, 11 bp, Homo sapiens
aaggtgcctgt

SEQ ID NO: 3029348 - DNA, 18 bp, Homo sapiens
aaggtgcctgtgaggcag

SEQ ID NO: 3029349 - DNA, 18 bp, Homo sapiens
aaggtgctgacggccagg

SEQ ID NO: 3029350 - DNA, 12 bp, Homo sapiens
aaggtgggcgga

SEQ ID NO: 3029351 - DNA, 21 bp, Homo sapiens
aaggtggggtctttgtgagag

SEQ ID NO: 3029352 - DNA, 15 bp, Homo sapiens
aaggtggtgtttctg

SEQ ID NO: 3029353 - DNA, 20 bp, Homo sapiens
aaggtgtagccacaccagga

SEQ ID NO: 3029354 - DNA, 14 bp, Homo sapiens
aaggtgtgctacag

SEQ ID NO: 3029355 - DNA, 18 bp, Homo sapiens
aaggtgtgctatttgtca

SEQ ID NO: 3029356 - DNA, 16 bp, Homo sapiens
aaggtgttttctgtgt

SEQ ID NO: 3029357 - DNA, 14 bp, Homo sapiens
aaggttaaaggaaa

SEQ ID NO: 3029358 - DNA, 17 bp, Homo sapiens
aaggttaaaggaaaagc

SEQ ID NO: 3029359 - DNA, 22 bp, Homo sapiens
aaggttactcagcagcagagag

SEQ ID NO: 3029360 - DNA, 22 bp, Homo sapiens
aaggttatagtaacatcaaaga

SEQ ID NO: 3029361 - DNA, 18 bp, Homo sapiens
aaggttccaactgtatat

SEQ ID NO: 3029362 - DNA, 21 bp, Homo sapiens
aaggttgactcaagtttttac

SEQ ID NO: 3029363 - DNA, 15 bp, Homo sapiens
aaggtttaggctggt

SEQ ID NO: 3029364 - DNA, 20 bp, Homo sapiens
aaggtttaggctggtggccc

SEQ ID NO: 3029365 - DNA, 21 bp, Homo sapiens
aaggtttaggctggtggccca

SEQ ID NO: 3029366 - DNA, 21 bp, Homo sapiens
aaggtttcgtttctgtataca

SEQ ID NO: 3029367 - DNA, 16 bp, Homo sapiens
aaggttttaggttcta

SEQ ID NO: 3029368 - DNA, 17 bp, Homo sapiens
aaggttttaggttctaa

SEQ ID NO: 3029369 - DNA, 13 bp, Homo sapiens
aagtaaaaaaaca

SEQ ID NO: 3029370 - DNA, 14 bp, Homo sapiens
aagtaaaaaaacaa

SEQ ID NO: 3029371 - DNA, 15 bp, Homo sapiens
aagtaaaagaaaagc

SEQ ID NO: 3029372 - DNA, 16 bp, Homo sapiens
aagtaaagaactgcac

SEQ ID NO: 3029373 - DNA, 12 bp, Homo sapiens
aagtaaatctct

SEQ ID NO: 3029374 - DNA, 14 bp, Homo sapiens
aagtaaatctcttt

SEQ ID NO: 3029375 - DNA, 19 bp, Homo sapiens
aagtaacatcagccatttt

SEQ ID NO: 3029376 - DNA, 19 bp, Homo sapiens
aagtaactataacaaaaaa

SEQ ID NO: 3029377 - DNA, 22 bp, Homo sapiens
aagtaactataacaaaaaaaga

SEQ ID NO: 3029378 - DNA, 15 bp, Homo sapiens
aagtaactttattct

SEQ ID NO: 3029379 - DNA, 21 bp, Homo sapiens
aagtaactttattcttgaaag

SEQ ID NO: 3029380 - DNA, 20 bp, Homo sapiens
aagtaagaaagtgaagcaaa

SEQ ID NO: 3029381 - DNA, 21 bp, Homo sapiens
aagtaagaaagtgaagcaaat

SEQ ID NO: 3029382 - DNA, 15 bp, Homo sapiens
aagtaagagactcag

SEQ ID NO: 3029383 - DNA, 15 bp, Homo sapiens
aagtaagaggctgga

SEQ ID NO: 3029384 - DNA, 16 bp, Homo sapiens
aagtaatcactaaccc

SEQ ID NO: 3029385 - DNA, 23 bp, Homo sapiens
aagtaatgccacacattgtgctt

SEQ ID NO: 3029386 - DNA, 19 bp, Homo sapiens
aagtacaaactaaggtgct

SEQ ID NO: 3029387 - DNA, 18 bp, Homo sapiens
aagtacgtcccagcggcc

SEQ ID NO: 3029388 - DNA, 17 bp, Homo sapiens
aagtacttatctttatt

SEQ ID NO: 3029389 - DNA, 19 bp, Homo sapiens
aagtagatctgctttctgt

SEQ ID NO: 3029390 - DNA, 17 bp, Homo sapiens
aagtagctgctaccttc

SEQ ID NO: 3029391 - DNA, 14 bp, Homo sapiens
aagtagctgggttt

SEQ ID NO: 3029392 - DNA, 15 bp, Homo sapiens
aagtagtaaaaatta

SEQ ID NO: 3029393 - DNA, 20 bp, Homo sapiens
aagtagtgagttaaagctac

SEQ ID NO: 3029394 - DNA, 15 bp, Homo sapiens
aagtagtgtgcagtt

SEQ ID NO: 3029395 - DNA, 14 bp, Homo sapiens
aagtataaacctta

SEQ ID NO: 3029396 - DNA, 18 bp, Homo sapiens
aagtatctaaaagtgtca

SEQ ID NO: 3029397 - DNA, 15 bp, Homo sapiens
aagtattattttcca

SEQ ID NO: 3029398 - DNA, 21 bp, Homo sapiens
aagtattctgtactcttagat

SEQ ID NO: 3029399 - DNA, 13 bp, Homo sapiens
aagtattgtaaat

SEQ ID NO: 3029400 - DNA, 20 bp, Homo sapiens
aagtattgtaaattatattt

SEQ ID NO: 3029401 - DNA, 13 bp, Homo sapiens
aagtattgtttac

SEQ ID NO: 3029402 - DNA, 17 bp, Homo sapiens
aagtattgtttacatta

SEQ ID NO: 3029403 - DNA, 13 bp, Homo sapiens
aagtatttcaaat

SEQ ID NO: 3029404 - DNA, 22 bp, Homo sapiens
aagtatttcaaattggagcttc

SEQ ID NO: 3029405 - DNA, 12 bp, Homo sapiens
aagtatttctga

SEQ ID NO: 3029406 - DNA, 18 bp, Homo sapiens
aagtatttttgattaaca

SEQ ID NO: 3029407 - DNA, 15 bp, Homo sapiens
aagtcaaaaggaaca

SEQ ID NO: 3029408 - DNA, 19 bp, Homo sapiens
aagtcaaaaggaacaaaaa

SEQ ID NO: 3029409 - DNA, 22 bp, Homo sapiens
aagtcaaaatatttttaaaaga

SEQ ID NO: 3029410 - DNA, 20 bp, Homo sapiens
aagtcaaagcaaggaaacta

SEQ ID NO: 3029411 - DNA, 18 bp, Homo sapiens
aagtcaaataaatgtttc

SEQ ID NO: 3029412 - DNA, 22 bp, Homo sapiens
aagtcaaataaatgtttccccc

SEQ ID NO: 3029413 - DNA, 15 bp, Homo sapiens
aagtcacaatgttct

SEQ ID NO: 3029414 - DNA, 15 bp, Homo sapiens
aagtcacagattctt

SEQ ID NO: 3029415 - DNA, 13 bp, Homo sapiens
aagtcacttctcc

SEQ ID NO: 3029416 - DNA, 18 bp, Homo sapiens
aagtcagaacagcagact

SEQ ID NO: 3029417 - DNA, 13 bp, Homo sapiens
aagtcagaatttt

SEQ ID NO: 3029418 - DNA, 16 bp, Homo sapiens
aagtcagagaaaacac

SEQ ID NO: 3029419 - DNA, 14 bp, Homo sapiens
aagtcagctacaaa

SEQ ID NO: 3029420 - DNA, 20 bp, Homo sapiens
aagtcagctacaaaagttaa

SEQ ID NO: 3029421 - DNA, 15 bp, Homo sapiens
aagtcaggccaggtg

SEQ ID NO: 3029422 - DNA, 15 bp, Homo sapiens
aagtcatggacattc

SEQ ID NO: 3029423 - DNA, 18 bp, Homo sapiens
aagtcatggacattcatg

SEQ ID NO: 3029424 - DNA, 17 bp, Homo sapiens
aagtcatgggaacgcag

SEQ ID NO: 3029425 - DNA, 20 bp, Homo sapiens
aagtcatgggaacgcagcct

SEQ ID NO: 3029426 - DNA, 19 bp, Homo sapiens
aagtcatgtaaatactgtt

SEQ ID NO: 3029427 - DNA, 13 bp, Homo sapiens
aagtcattaaact

SEQ ID NO: 3029428 - DNA, 14 bp, Homo sapiens
aagtcattaaactg

SEQ ID NO: 3029429 - DNA, 20 bp, Homo sapiens
aagtcatttccgtccccccc

SEQ ID NO: 3029430 - DNA, 22 bp, Homo sapiens
aagtcatttccgtcccccccca

SEQ ID NO: 3029431 - DNA, 12 bp, Homo sapiens
aagtcatttttg

SEQ ID NO: 3029432 - DNA, 19 bp, Homo sapiens
aagtccagctttctgcaga

SEQ ID NO: 3029433 - DNA, 22 bp, Homo sapiens
aagtccagctttctgcagactg

SEQ ID NO: 3029434 - DNA, 14 bp, Homo sapiens
aagtccaggactgg

SEQ ID NO: 3029435 - DNA, 21 bp, Homo sapiens
aagtccccaggccccaggaag

SEQ ID NO: 3029436 - DNA, 13 bp, Homo sapiens
aagtcccttcctg

SEQ ID NO: 3029437 - DNA, 14 bp, Homo sapiens
aagtcccttcctgc

SEQ ID NO: 3029438 - DNA, 14 bp, Homo sapiens
aagtcctatggaaa

SEQ ID NO: 3029439 - DNA, 18 bp, Homo sapiens
aagtcctgactgggctgg

SEQ ID NO: 3029440 - DNA, 20 bp, Homo sapiens
aagtcctgactgggctgggt

SEQ ID NO: 3029441 - DNA, 16 bp, Homo sapiens
aagtcctgcctttggg

SEQ ID NO: 3029442 - DNA, 20 bp, Homo sapiens
aagtcctgggaggatcctga

SEQ ID NO: 3029443 - DNA, 20 bp, Homo sapiens
aagtcctgtatgtctgtcat

SEQ ID NO: 3029444 - DNA, 19 bp, Homo sapiens
aatatttcttaagtataaa

SEQ ID NO: 3029445 - DNA, 15 bp, Homo sapiens
aatatttcttttttc

SEQ ID NO: 3029446 - DNA, 14 bp, Homo sapiens
aatatttgaatgta

SEQ ID NO: 3029447 - DNA, 23 bp, Homo sapiens
aatatttgaatgtatgcttcata

SEQ ID NO: 3029448 - DNA, 14 bp, Homo sapiens
aatatttgatcact

SEQ ID NO: 3029449 - DNA, 19 bp, Homo sapiens
aatatttgtgctttgaaaa

SEQ ID NO: 3029450 - DNA, 18 bp, Homo sapiens
aatattttatattaaaat

SEQ ID NO: 3029451 - DNA, 23 bp, Homo sapiens
aatattttatttgaaaaaagtta

SEQ ID NO: 3029452 - DNA, 16 bp, Homo sapiens
aatattttctgtgtaa

SEQ ID NO: 3029453 - DNA, 13 bp, Homo sapiens
aatattttgaatc

SEQ ID NO: 3029454 - DNA, 14 bp, Homo sapiens
aatattttgaatca

SEQ ID NO: 3029455 - DNA, 16 bp, Homo sapiens
aatattttgaatcaat

SEQ ID NO: 3029456 - DNA, 18 bp, Homo sapiens
aatattttgaatcaataa

SEQ ID NO: 3029457 - DNA, 15 bp, Homo sapiens
aatatttttaaaaga

SEQ ID NO: 3029458 - DNA, 16 bp, Homo sapiens
aatatttttccctccg

SEQ ID NO: 3029459 - DNA, 22 bp, Homo sapiens
aatatttttccctccgggcagg

SEQ ID NO: 3029460 - DNA, 15 bp, Homo sapiens
aatcaaaatccaaaa

SEQ ID NO: 3029461 - DNA, 21 bp, Homo sapiens
aatcaaacaagtgagtagctc

SEQ ID NO: 3029462 - DNA, 22 bp, Homo sapiens
aatcaaacctttttatatttta

SEQ ID NO: 3029463 - DNA, 22 bp, Homo sapiens
aatcaacaccaccgagctctgt

SEQ ID NO: 3029464 - DNA, 21 bp, Homo sapiens
aatcaacctatcaaagcttca

SEQ ID NO: 3029465 - DNA, 15 bp, Homo sapiens
aatcaacttgcttat

SEQ ID NO: 3029466 - DNA, 18 bp, Homo sapiens
aatcaacttgcttatcaa

SEQ ID NO: 3029467 - DNA, 18 bp, Homo sapiens
aatcaactttttattgcc

SEQ ID NO: 3029468 - DNA, 19 bp, Homo sapiens
aatcaactttttattgcct

SEQ ID NO: 3029469 - DNA, 20 bp, Homo sapiens
aatcaagatttaatcctaga

SEQ ID NO: 3029470 - DNA, 18 bp, Homo sapiens
aatcaagattttagggct

SEQ ID NO: 3029471 - DNA, 23 bp, Homo sapiens
aatcaagtacctatattgattta

SEQ ID NO: 3029472 - DNA, 15 bp, Homo sapiens
aatcaagtctgttta

SEQ ID NO: 3029473 - DNA, 21 bp, Homo sapiens
aatcaagtctgtttactgcaa

SEQ ID NO: 3029474 - DNA, 23 bp, Homo sapiens
aatcaagttttaagtgaaagtga

SEQ ID NO: 3029475 - DNA, 13 bp, Homo sapiens
aatcaataaacga

SEQ ID NO: 3029476 - DNA, 12 bp, Homo sapiens
aatcaataatat

SEQ ID NO: 3029477 - DNA, 20 bp, Homo sapiens
aatcaatttaaacccatttt

SEQ ID NO: 3029478 - DNA, 22 bp, Homo sapiens
aatcaatttaaacccattttag

SEQ ID NO: 3029479 - DNA, 14 bp, Homo sapiens
aatcaatttaaatg

SEQ ID NO: 3029480 - DNA, 17 bp, Homo sapiens
aatcaatttaaatgttt

SEQ ID NO: 3029481 - DNA, 22 bp, Homo sapiens
aatcacccacaaccctctggaa

SEQ ID NO: 3029482 - DNA, 16 bp, Homo sapiens
aatcactctgcaatgg

SEQ ID NO: 3029483 - DNA, 16 bp, Homo sapiens
aatcacttgattcata

SEQ ID NO: 3029484 - DNA, 19 bp, Homo sapiens
aatcagaacagatgctgag

SEQ ID NO: 3029485 - DNA, 11 bp, Homo sapiens
aatcagaactc

SEQ ID NO: 3029486 - DNA, 23 bp, Homo sapiens
aatcagaactcaaatggggccag

SEQ ID NO: 3029487 - DNA, 21 bp, Homo sapiens
aatcagaagtgcaaaggtgtg

SEQ ID NO: 3029488 - DNA, 12 bp, Homo sapiens
aatcagaataaa

SEQ ID NO: 3029489 - DNA, 16 bp, Homo sapiens
aatcagaatttttaga

SEQ ID NO: 3029490 - DNA, 20 bp, Homo sapiens
aatcagaccctaccccacca

SEQ ID NO: 3029491 - DNA, 19 bp, Homo sapiens
aatcagcaaacacaataag

SEQ ID NO: 3029492 - DNA, 17 bp, Homo sapiens
aatcagctgcagctgct

SEQ ID NO: 3029493 - DNA, 21 bp, Homo sapiens
aatcagtcagtgcaaatgtca

SEQ ID NO: 3029494 - DNA, 21 bp, Homo sapiens
aatcagtgactgaaaccattt

SEQ ID NO: 3029495 - DNA, 20 bp, Homo sapiens
aatcagttgattaagttaat

SEQ ID NO: 3029496 - DNA, 23 bp, Homo sapiens
aatcagtttattaaatctgaatt

SEQ ID NO: 3029497 - DNA, 14 bp, Homo sapiens
aatcataacatagt

SEQ ID NO: 3029498 - DNA, 21 bp, Homo sapiens
aatcataacatagttgaaaaa

SEQ ID NO: 3029499 - DNA, 14 bp, Homo sapiens
aatcatatttgaaa

SEQ ID NO: 3029500 - DNA, 15 bp, Homo sapiens
aatcatcaagtcttt

SEQ ID NO: 3029501 - DNA, 19 bp, Homo sapiens
aatcatgaatctttgtttc

SEQ ID NO: 3029502 - DNA, 22 bp, Homo sapiens
aatcatgagcctgtttattgcc

SEQ ID NO: 3029503 - DNA, 18 bp, Homo sapiens
aatcatggaatggttata

SEQ ID NO: 3029504 - DNA, 13 bp, Homo sapiens
aatcatgtagtat

SEQ ID NO: 3029505 - DNA, 23 bp, Homo sapiens
aatcatgtagtatcaaatattag

SEQ ID NO: 3029506 - DNA, 22 bp, Homo sapiens
aatcatgttgatcatgtacttt

SEQ ID NO: 3029507 - DNA, 20 bp, Homo sapiens
aatcatgttttttctgcaat

SEQ ID NO: 3029508 - DNA, 12 bp, Homo sapiens
aatcatttctat

SEQ ID NO: 3029509 - DNA, 20 bp, Homo sapiens
aatcatttctatttctcctc

SEQ ID NO: 3029510 - DNA, 14 bp, Homo sapiens
aatcatttgtttac

SEQ ID NO: 3029511 - DNA, 22 bp, Homo sapiens
aatcatttgtttacatttgatg

SEQ ID NO: 3029512 - DNA, 13 bp, Homo sapiens
aatccaaactgct

SEQ ID NO: 3029513 - DNA, 16 bp, Homo sapiens
aatccaaactgctgtc

SEQ ID NO: 3029514 - DNA, 19 bp, Homo sapiens
aatccaaactgctgtctct

SEQ ID NO: 3029515 - DNA, 20 bp, Homo sapiens
aatccaaactgctgtctctt

SEQ ID NO: 3029516 - DNA, 19 bp, Homo sapiens
aatccaatcaatttaaatg

SEQ ID NO: 3029517 - DNA, 21 bp, Homo sapiens
aatccaatcaatttaaatgtt

SEQ ID NO: 3029518 - DNA, 23 bp, Homo sapiens
aatccaatcagagaccaggccct

SEQ ID NO: 3029519 - DNA, 21 bp, Homo sapiens
aatccaggcagatccaggact

SEQ ID NO: 3029520 - DNA, 15 bp, Homo sapiens
aatccagtagggaaa

SEQ ID NO: 3029521 - DNA, 19 bp, Homo sapiens
aatccatcagcaatgcttc

SEQ ID NO: 3029522 - DNA, 17 bp, Homo sapiens
aatccatccatgtactt

SEQ ID NO: 3029523 - DNA, 18 bp, Homo sapiens
aatccatccatgtacttc

SEQ ID NO: 3029524 - DNA, 14 bp, Homo sapiens
aatccatgggtctg

SEQ ID NO: 3029525 - DNA, 16 bp, Homo sapiens
aatccatgggtctggc

SEQ ID NO: 3029526 - DNA, 23 bp, Homo sapiens
aatccatttggcagaactgctgg

SEQ ID NO: 3029527 - DNA, 17 bp, Homo sapiens
aatcccacccacatgtg

SEQ ID NO: 3029528 - DNA, 14 bp, Homo sapiens
aatcccagctactg

SEQ ID NO: 3029529 - DNA, 15 bp, Homo sapiens
aatccccagatattt

SEQ ID NO: 3029530 - DNA, 15 bp, Homo sapiens
aatccctctccaact

SEQ ID NO: 3029531 - DNA, 19 bp, Homo sapiens
aatccctgggcattgcttt

SEQ ID NO: 3029532 - DNA, 12 bp, Homo sapiens
aatccgaacctc

SEQ ID NO: 3029533 - DNA, 13 bp, Homo sapiens
aatccgaacctcc

SEQ ID NO: 3029534 - DNA, 18 bp, Homo sapiens
aatccgccagtgtttctg

SEQ ID NO: 3029535 - DNA, 14 bp, Homo sapiens
aatcctacatacag

SEQ ID NO: 3029536 - DNA, 20 bp, Homo sapiens
aatcctccccgctctgccgc

SEQ ID NO: 3029537 - DNA, 19 bp, Homo sapiens
aatcctgctctaaaataca

SEQ ID NO: 3029538 - DNA, 11 bp, Homo sapiens
aatcctgggcc

SEQ ID NO: 3029539 - DNA, 21 bp, Homo sapiens
aatcctgtcgattagactgga

SEQ ID NO: 3029540 - DNA, 19 bp, Homo sapiens
aatccttagatctggcatg

SEQ ID NO: 3029541 - DNA, 20 bp, Homo sapiens
aatccttagatctggcatgt

SEQ ID NO: 3029542 - DNA, 12 bp, Homo sapiens
aatccttttgta

SEQ ID NO: 3029543 - DNA, 22 bp, Homo sapiens
aatcgcatcccggctgaccctg

SEQ ID NO: 3029544 - DNA, 17 bp, Homo sapiens
aatcgcttgaacctggg

SEQ ID NO: 3029545 - DNA, 19 bp, Homo sapiens
aatcggcagtattttctgt

SEQ ID NO: 3029546 - DNA, 22 bp, Homo sapiens
aatcggcccacagctcccaccc

SEQ ID NO: 3029547 - DNA, 15 bp, Homo sapiens
aatcgtttaatgttt

SEQ ID NO: 3029548 - DNA, 16 bp, Homo sapiens
aatcgtttaatgttta

SEQ ID NO: 3029549 - DNA, 18 bp, Homo sapiens
aatctaaatagatacttt

SEQ ID NO: 3029550 - DNA, 22 bp, Homo sapiens
aatctaatgtgagtgtgaagct

SEQ ID NO: 3029551 - DNA, 12 bp, Homo sapiens
aatctacatttg

SEQ ID NO: 3029552 - DNA, 15 bp, Homo sapiens
aatctacatttgttt

SEQ ID NO: 3029553 - DNA, 15 bp, Homo sapiens
aatctactaattcca

SEQ ID NO: 3029554 - DNA, 17 bp, Homo sapiens
aatctacttgttaaaaa

SEQ ID NO: 3029555 - DNA, 12 bp, Homo sapiens
aatctagagttt

SEQ ID NO: 3029556 - DNA, 22 bp, Homo sapiens
aatctagagtttatacagtgta

SEQ ID NO: 3029557 - DNA, 11 bp, Homo sapiens
aatctatttaa

SEQ ID NO: 3029558 - DNA, 13 bp, Homo sapiens
aatctcaatgcaa

SEQ ID NO: 3029559 - DNA, 22 bp, Homo sapiens
aatctcagttgattttctggat

SEQ ID NO: 3029560 - DNA, 19 bp, Homo sapiens
aatctcgtcaggctgccag

SEQ ID NO: 3029561 - DNA, 15 bp, Homo sapiens
aatctcgtttagtgc

SEQ ID NO: 3029562 - DNA, 20 bp, Homo sapiens
aatctcgtttagtgccaatg

SEQ ID NO: 3029563 - DNA, 15 bp, Homo sapiens
aatctcgtttcaaaa

SEQ ID NO: 3029564 - DNA, 16 bp, Homo sapiens
aatctcttgattataa

SEQ ID NO: 3029565 - DNA, 17 bp, Homo sapiens
aatctcttgattataaa

SEQ ID NO: 3029566 - DNA, 19 bp, Homo sapiens
aatctcttgattataaatg

SEQ ID NO: 3029567 - DNA, 17 bp, Homo sapiens
aatctgacccagtgccc

SEQ ID NO: 3029568 - DNA, 18 bp, Homo sapiens
aatctgagaaactctaca

SEQ ID NO: 3029569 - DNA, 17 bp, Homo sapiens
aatctgaggcctcctct

SEQ ID NO: 3029570 - DNA, 13 bp, Homo sapiens
aatctgccttcca

SEQ ID NO: 3029571 - DNA, 22 bp, Homo sapiens
aatctgccttccagcccagacc

SEQ ID NO: 3029572 - DNA, 14 bp, Homo sapiens
aatctgctcacttt

SEQ ID NO: 3029573 - DNA, 21 bp, Homo sapiens
aatctggcttctggccaggaa

SEQ ID NO: 3029574 - DNA, 23 bp, Homo sapiens
aatctggcttctggccaggaagc

SEQ ID NO: 3029575 - DNA, 16 bp, Homo sapiens
aatctgtacaaaatgg

SEQ ID NO: 3029576 - DNA, 21 bp, Homo sapiens
aattgatttcttttcttcctg

SEQ ID NO: 3029577 - DNA, 22 bp, Homo sapiens
aattgatttcttttcttcctgg

SEQ ID NO: 3029578 - DNA, 14 bp, Homo sapiens
aattgcaatacatt

SEQ ID NO: 3029579 - DNA, 20 bp, Homo sapiens
aattgcacagaagtcctgta

SEQ ID NO: 3029580 - DNA, 13 bp, Homo sapiens
aattgcactgaag

SEQ ID NO: 3029581 - DNA, 15 bp, Homo sapiens
aattgcactgaagtt

SEQ ID NO: 3029582 - DNA, 21 bp, Homo sapiens
aattgcactgaagtttttgaa

SEQ ID NO: 3029583 - DNA, 22 bp, Homo sapiens
aattgcactgaagtttttgaaa

SEQ ID NO: 3029584 - DNA, 20 bp, Homo sapiens
aattgcagataactttgact

SEQ ID NO: 3029585 - DNA, 14 bp, Homo sapiens
aattgcatttctat

SEQ ID NO: 3029586 - DNA, 13 bp, Homo sapiens
aattgccaatctt

SEQ ID NO: 3029587 - DNA, 16 bp, Homo sapiens
aattgccaatcttgtt

SEQ ID NO: 3029588 - DNA, 16 bp, Homo sapiens
aattgcctcttgcagg

SEQ ID NO: 3029589 - DNA, 16 bp, Homo sapiens
aattgcgttggtctct

SEQ ID NO: 3029590 - DNA, 20 bp, Homo sapiens
aattgcgttggtctctgcat

SEQ ID NO: 3029591 - DNA, 18 bp, Homo sapiens
aattgctgttgaaagcaa

SEQ ID NO: 3029592 - DNA, 21 bp, Homo sapiens
aattgctgttgaaagcaaaaa

SEQ ID NO: 3029593 - DNA, 10 bp, Homo sapiens
aattgctttg

SEQ ID NO: 3029594 - DNA, 16 bp, Homo sapiens
aattggccttcgattt

SEQ ID NO: 3029595 - DNA, 18 bp, Homo sapiens
aattgggtcatagaaatt

SEQ ID NO: 3029596 - DNA, 16 bp, Homo sapiens
aattggtgtatatcat

SEQ ID NO: 3029597 - DNA, 16 bp, Homo sapiens
aattggttgtatataa

SEQ ID NO: 3029598 - DNA, 11 bp, Homo sapiens
aattgtaatag

SEQ ID NO: 3029599 - DNA, 22 bp, Homo sapiens
aattgtaccttttttgtttttt

SEQ ID NO: 3029600 - DNA, 16 bp, Homo sapiens
aattgtactaaagcca

SEQ ID NO: 3029601 - DNA, 22 bp, Homo sapiens
aattgtatcgtatagctgtatt

SEQ ID NO: 3029602 - DNA, 18 bp, Homo sapiens
aattgtcacatcaagcat

SEQ ID NO: 3029603 - DNA, 16 bp, Homo sapiens
aattgtcagcatgaca

SEQ ID NO: 3029604 - DNA, 22 bp, Homo sapiens
aattgtgaccaatacatttgta

SEQ ID NO: 3029605 - DNA, 22 bp, Homo sapiens
aattgtggaaggattgtaacat

SEQ ID NO: 3029606 - DNA, 23 bp, Homo sapiens
aattgtggatcttgagctctgct

SEQ ID NO: 3029607 - DNA, 16 bp, Homo sapiens
aattgtggttgtgttc

SEQ ID NO: 3029608 - DNA, 15 bp, Homo sapiens
aattgtgtaaaaaat

SEQ ID NO: 3029609 - DNA, 21 bp, Homo sapiens
aattgtgtaaaaaatggaaaa

SEQ ID NO: 3029610 - DNA, 16 bp, Homo sapiens
aattgttccttgcttt

SEQ ID NO: 3029611 - DNA, 20 bp, Homo sapiens
aattgttccttgcttttata

SEQ ID NO: 3029612 - DNA, 22 bp, Homo sapiens
aattgttccttgcttttatagt

SEQ ID NO: 3029613 - DNA, 23 bp, Homo sapiens
aattgttcgtttcatcaggctct

SEQ ID NO: 3029614 - DNA, 18 bp, Homo sapiens
aattgttctgggtgattt

SEQ ID NO: 3029615 - DNA, 22 bp, Homo sapiens
aattgttgaacaggtgtttttc

SEQ ID NO: 3029616 - DNA, 13 bp, Homo sapiens
aattgttgacagt

SEQ ID NO: 3029617 - DNA, 18 bp, Homo sapiens
aattgttgacagttctga

SEQ ID NO: 3029618 - DNA, 19 bp, Homo sapiens
aattgttgtggtttaaata

SEQ ID NO: 3029619 - DNA, 20 bp, Homo sapiens
aattgtttcaaaataaaaac

SEQ ID NO: 3029620 - DNA, 16 bp, Homo sapiens
aatttaaaaaagcaaa

SEQ ID NO: 3029621 - DNA, 13 bp, Homo sapiens
aatttaaaattaa

SEQ ID NO: 3029622 - DNA, 17 bp, Homo sapiens
aatttaaacccatttta

SEQ ID NO: 3029623 - DNA, 13 bp, Homo sapiens
aatttaaattgtt

SEQ ID NO: 3029624 - DNA, 14 bp, Homo sapiens
aatttaaattgtta

SEQ ID NO: 3029625 - DNA, 15 bp, Homo sapiens
aatttaagcttaagc

SEQ ID NO: 3029626 - DNA, 19 bp, Homo sapiens
aatttaagttggctagagc

SEQ ID NO: 3029627 - DNA, 17 bp, Homo sapiens
aatttaataacttttta

SEQ ID NO: 3029628 - DNA, 18 bp, Homo sapiens
aatttacaaaaatataaa

SEQ ID NO: 3029629 - DNA, 16 bp, Homo sapiens
aatttacctgatttct

SEQ ID NO: 3029630 - DNA, 17 bp, Homo sapiens
aatttactttttaaaca

SEQ ID NO: 3029631 - DNA, 22 bp, Homo sapiens
aatttactttttaaacagtgtt

SEQ ID NO: 3029632 - DNA, 18 bp, Homo sapiens
aatttagaaactaattga

SEQ ID NO: 3029633 - DNA, 15 bp, Homo sapiens
aatttagtcattatt

SEQ ID NO: 3029634 - DNA, 22 bp, Homo sapiens
aatttagtcccttaaaaattaa

SEQ ID NO: 3029635 - DNA, 15 bp, Homo sapiens
aatttagtggattaa

SEQ ID NO: 3029636 - DNA, 17 bp, Homo sapiens
aatttataattcagtat

SEQ ID NO: 3029637 - DNA, 14 bp, Homo sapiens
aatttatatgaaaa

SEQ ID NO: 3029638 - DNA, 22 bp, Homo sapiens
aatttatgcacttataaggtgt

SEQ ID NO: 3029639 - DNA, 17 bp, Homo sapiens
aatttatttcttaacct

SEQ ID NO: 3029640 - DNA, 18 bp, Homo sapiens
aatttatttcttaacctt

SEQ ID NO: 3029641 - DNA, 16 bp, Homo sapiens
aatttcaaaatgcttt

SEQ ID NO: 3029642 - DNA, 14 bp, Homo sapiens
aatttcaaggttct

SEQ ID NO: 3029643 - DNA, 18 bp, Homo sapiens
aatttcaaggttctaacc

SEQ ID NO: 3029644 - DNA, 19 bp, Homo sapiens
aatttcaggctccccagat

SEQ ID NO: 3029645 - DNA, 17 bp, Homo sapiens
aatttcaggttgttggt

SEQ ID NO: 3029646 - DNA, 16 bp, Homo sapiens
aatttcccaggaccct

SEQ ID NO: 3029647 - DNA, 17 bp, Homo sapiens
aatttcccaggaccctg

SEQ ID NO: 3029648 - DNA, 22 bp, Homo sapiens
aatttcccaggaccctgaaggg

SEQ ID NO: 3029649 - DNA, 17 bp, Homo sapiens
aatttccccaacagtgt

SEQ ID NO: 3029650 - DNA, 19 bp, Homo sapiens
aatttccccaacagtgtga

SEQ ID NO: 3029651 - DNA, 22 bp, Homo sapiens
aatttccccaacagtgtgaagt

SEQ ID NO: 3029652 - DNA, 18 bp, Homo sapiens
aatttcctggtgtgaagg

SEQ ID NO: 3029653 - DNA, 20 bp, Homo sapiens
aatttcctgttggatttgtt

SEQ ID NO: 3029654 - DNA, 22 bp, Homo sapiens
aatttctgcacaggtctctgtt

SEQ ID NO: 3029655 - DNA, 13 bp, Homo sapiens
aatttcttcctat

SEQ ID NO: 3029656 - DNA, 17 bp, Homo sapiens
aatttctttaaaaaaga

SEQ ID NO: 3029657 - DNA, 18 bp, Homo sapiens
aatttctttaaaaaagaa

SEQ ID NO: 3029658 - DNA, 20 bp, Homo sapiens
aatttctttaaaaaagaaat

SEQ ID NO: 3029659 - DNA, 12 bp, Homo sapiens
aatttgaacttt

SEQ ID NO: 3029660 - DNA, 17 bp, Homo sapiens
aatttgagtttgctgtt

SEQ ID NO: 3029661 - DNA, 21 bp, Homo sapiens
aatttgatacatatgtgaata

SEQ ID NO: 3029662 - DNA, 15 bp, Homo sapiens
aatttgatagatgtt

SEQ ID NO: 3029663 - DNA, 17 bp, Homo sapiens
aatttgattattaacat

SEQ ID NO: 3029664 - DNA, 13 bp, Homo sapiens
aatttgattgatt

SEQ ID NO: 3029665 - DNA, 16 bp, Homo sapiens
aatttgattgatttga

SEQ ID NO: 3029666 - DNA, 10 bp, Homo sapiens
aatttgcaaa

SEQ ID NO: 3029667 - DNA, 11 bp, Homo sapiens
aatttgcaaag

SEQ ID NO: 3029668 - DNA, 12 bp, Homo sapiens
aatttgcaaagt

SEQ ID NO: 3029669 - DNA, 15 bp, Homo sapiens
aatttgcaaagtact

SEQ ID NO: 3029670 - DNA, 16 bp, Homo sapiens
aatttgcaaagtactg

SEQ ID NO: 3029671 - DNA, 11 bp, Homo sapiens
aatttgcatgt

SEQ ID NO: 3029672 - DNA, 13 bp, Homo sapiens
aatttgcatgtct

SEQ ID NO: 3029673 - DNA, 15 bp, Homo sapiens
aatttgcattaaatt

SEQ ID NO: 3029674 - DNA, 21 bp, Homo sapiens
aatttgcattaaattcacaaa

SEQ ID NO: 3029675 - DNA, 23 bp, Homo sapiens
aatttgcattaaattcacaaact

SEQ ID NO: 3029676 - DNA, 20 bp, Homo sapiens
aatttgccctgggaaacccc

SEQ ID NO: 3029677 - DNA, 20 bp, Homo sapiens
aatttggataataaaaattg

SEQ ID NO: 3029678 - DNA, 20 bp, Homo sapiens
aatttggatttacgactgaa

SEQ ID NO: 3029679 - DNA, 23 bp, Homo sapiens
aatttgggctaaaacttagaaaa

SEQ ID NO: 3029680 - DNA, 16 bp, Homo sapiens
aatttgggcttcctgt

SEQ ID NO: 3029681 - DNA, 15 bp, Homo sapiens
aatttggtctgtata

SEQ ID NO: 3029682 - DNA, 16 bp, Homo sapiens
aatttggtgcttataa

SEQ ID NO: 3029683 - DNA, 22 bp, Homo sapiens
aatttgtaagcaacttgcttct

SEQ ID NO: 3029684 - DNA, 20 bp, Homo sapiens
aatttgtctcctactctgtg

SEQ ID NO: 3029685 - DNA, 16 bp, Homo sapiens
aatttgtcttgcctta

SEQ ID NO: 3029686 - DNA, 12 bp, Homo sapiens
aatttgttaatt

SEQ ID NO: 3029687 - DNA, 14 bp, Homo sapiens
aattttaaaaatga

SEQ ID NO: 3029688 - DNA, 21 bp, Homo sapiens
aattttaaaaatgaatcctac

SEQ ID NO: 3029689 - DNA, 20 bp, Homo sapiens
aattttacatgtttataaat

SEQ ID NO: 3029690 - DNA, 17 bp, Homo sapiens
aattttaccctttagac

SEQ ID NO: 3029691 - DNA, 15 bp, Homo sapiens
aattttataaacaaa

SEQ ID NO: 3029692 - DNA, 23 bp, Homo sapiens
aattttatctacccagtcatgta

SEQ ID NO: 3029693 - DNA, 13 bp, Homo sapiens
aattttatgtatt

SEQ ID NO: 3029694 - DNA, 19 bp, Homo sapiens
aattttcaagtaattgtga

SEQ ID NO: 3029695 - DNA, 13 bp, Homo sapiens
aattttcactgct

SEQ ID NO: 3029696 - DNA, 19 bp, Homo sapiens
aattttctatgtgttgtgt

SEQ ID NO: 3029697 - DNA, 23 bp, Homo sapiens
aattttctttttgtttcactgga

SEQ ID NO: 3029698 - DNA, 20 bp, Homo sapiens
aattttggtcatagcattca

SEQ ID NO: 3029699 - DNA, 19 bp, Homo sapiens
aattttggttgtattcttt

SEQ ID NO: 3029700 - DNA, 12 bp, Homo sapiens
aattttgtattt

SEQ ID NO: 3029701 - DNA, 17 bp, Homo sapiens
aattttgtattttccaa

SEQ ID NO: 3029702 - DNA, 23 bp, Homo sapiens
aattttgtattttccaagtgtgc

SEQ ID NO: 3029703 - DNA, 17 bp, Homo sapiens
aattttgtgcaaaaagg

SEQ ID NO: 3029704 - DNA, 12 bp, Homo sapiens
aattttgttcct

SEQ ID NO: 3029705 - DNA, 18 bp, Homo sapiens
aattttgttcctgtttat

SEQ ID NO: 3029706 - DNA, 22 bp, Homo sapiens
aattttgtttttattttcaaga

SEQ ID NO: 3029707 - DNA, 14 bp, Homo sapiens
aatttttaactgta

SEQ ID NO: 3029708 - DNA, 20 bp, Homo sapiens
acagaatgaaaaatgaaaga

SEQ ID NO: 3029709 - DNA, 22 bp, Homo sapiens
acagaatgaaaaatgaaagatg

SEQ ID NO: 3029710 - DNA, 14 bp, Homo sapiens
acagacacaattta

SEQ ID NO: 3029711 - DNA, 13 bp, Homo sapiens
acagacaggagaa

SEQ ID NO: 3029712 - DNA, 21 bp, Homo sapiens
acagacatccttgcagtttaa

SEQ ID NO: 3029713 - DNA, 22 bp, Homo sapiens
acagactcacaacctgaaccta

SEQ ID NO: 3029714 - DNA, 15 bp, Homo sapiens
acagactcatcctga

SEQ ID NO: 3029715 - DNA, 20 bp, Homo sapiens
acagactcttccaccagagc

SEQ ID NO: 3029716 - DNA, 16 bp, Homo sapiens
acagagaagacaaaat

SEQ ID NO: 3029717 - DNA, 17 bp, Homo sapiens
acagagaatatgtctgc

SEQ ID NO: 3029718 - DNA, 14 bp, Homo sapiens
acagagagaaaaag

SEQ ID NO: 3029719 - DNA, 23 bp, Homo sapiens
acagagcaaagcgcccacccagg

SEQ ID NO: 3029720 - DNA, 20 bp, Homo sapiens
acagaggatgagctctaccc

SEQ ID NO: 3029721 - DNA, 15 bp, Homo sapiens
acagaggccccagcc

SEQ ID NO: 3029722 - DNA, 22 bp, Homo sapiens
acagagggtcacagtgtttaca

SEQ ID NO: 3029723 - DNA, 14 bp, Homo sapiens
acagaggtaaaaaa

SEQ ID NO: 3029724 - DNA, 17 bp, Homo sapiens
acagaggtaaaaaaaag

SEQ ID NO: 3029725 - DNA, 23 bp, Homo sapiens
acagaggtcgtcgaaaggtgcag

SEQ ID NO: 3029726 - DNA, 23 bp, Homo sapiens
acagaggttgtagtgagccaaga

SEQ ID NO: 3029727 - DNA, 19 bp, Homo sapiens
acagagtaattataggaag

SEQ ID NO: 3029728 - DNA, 23 bp, Homo sapiens
acagagtatgaacacctgggctt

SEQ ID NO: 3029729 - DNA, 23 bp, Homo sapiens
acagagtgtgtttttgcactgtc

SEQ ID NO: 3029730 - DNA, 13 bp, Homo sapiens
acagagttttctg

SEQ ID NO: 3029731 - DNA, 21 bp, Homo sapiens
acagagttttttaaacaaatg

SEQ ID NO: 3029732 - DNA, 15 bp, Homo sapiens
acagatactgtgagc

SEQ ID NO: 3029733 - DNA, 18 bp, Homo sapiens
acagatatctttttcatt

SEQ ID NO: 3029734 - DNA, 18 bp, Homo sapiens
acagatattacagcttat

SEQ ID NO: 3029735 - DNA, 15 bp, Homo sapiens
acagatcaagctgtg

SEQ ID NO: 3029736 - DNA, 18 bp, Homo sapiens
acagatcactcctggagg

SEQ ID NO: 3029737 - DNA, 20 bp, Homo sapiens
acagatctggaacctcagcc

SEQ ID NO: 3029738 - DNA, 21 bp, Homo sapiens
acagatctggaacctcagcct

SEQ ID NO: 3029739 - DNA, 18 bp, Homo sapiens
acagatgccacacaagga

SEQ ID NO: 3029740 - DNA, 13 bp, Homo sapiens
acagatgctggcc

SEQ ID NO: 3029741 - DNA, 14 bp, Homo sapiens
acagatgctggcct

SEQ ID NO: 3029742 - DNA, 15 bp, Homo sapiens
acagatgctggcctc

SEQ ID NO: 3029743 - DNA, 15 bp, Homo sapiens
acagatgctgtgtaa

SEQ ID NO: 3029744 - DNA, 14 bp, Homo sapiens
acagatgtaaatcg

SEQ ID NO: 3029745 - DNA, 22 bp, Homo sapiens
acagatgtaaatcgggaaggat

SEQ ID NO: 3029746 - DNA, 12 bp, Homo sapiens
acagatgttatt

SEQ ID NO: 3029747 - DNA, 19 bp, Homo sapiens
acagatgttcccccatctc

SEQ ID NO: 3029748 - DNA, 21 bp, Homo sapiens
acagatgttcggtttttttcc

SEQ ID NO: 3029749 - DNA, 14 bp, Homo sapiens
acagattatgtatt

SEQ ID NO: 3029750 - DNA, 21 bp, Homo sapiens
acagattcccaggccagggct

SEQ ID NO: 3029751 - DNA, 22 bp, Homo sapiens
acagattcccaggccagggctg

SEQ ID NO: 3029752 - DNA, 14 bp, Homo sapiens
acagattgtttcta

SEQ ID NO: 3029753 - DNA, 14 bp, Homo sapiens
acagattgtttgca

SEQ ID NO: 3029754 - DNA, 19 bp, Homo sapiens
acagatttcagtaatgtct

SEQ ID NO: 3029755 - DNA, 13 bp, Homo sapiens
acagatttgtgaa

SEQ ID NO: 3029756 - DNA, 20 bp, Homo sapiens
acagattttggggttgtgtt

SEQ ID NO: 3029757 - DNA, 22 bp, Homo sapiens
acagattttggggttgtgttgt

SEQ ID NO: 3029758 - DNA, 11 bp, Homo sapiens
acagcaaacag

SEQ ID NO: 3029759 - DNA, 13 bp, Homo sapiens
acagcaaaccaag

SEQ ID NO: 3029760 - DNA, 15 bp, Homo sapiens
acagcaaaccaagag

SEQ ID NO: 3029761 - DNA, 16 bp, Homo sapiens
acagcaaaccaagaga

SEQ ID NO: 3029762 - DNA, 21 bp, Homo sapiens
acagcaaaccaagagattgct

SEQ ID NO: 3029763 - DNA, 23 bp, Homo sapiens
acagcaaaccaagagattgctaa

SEQ ID NO: 3029764 - DNA, 15 bp, Homo sapiens
acagcaattcctcag

SEQ ID NO: 3029765 - DNA, 21 bp, Homo sapiens
acagcacagagaagacaaaat

SEQ ID NO: 3029766 - DNA, 15 bp, Homo sapiens
acagcactcctcggc

SEQ ID NO: 3029767 - DNA, 22 bp, Homo sapiens
acagcagcctggggctggcctc

SEQ ID NO: 3029768 - DNA, 13 bp, Homo sapiens
acagcagcctgtg

SEQ ID NO: 3029769 - DNA, 17 bp, Homo sapiens
acagcagggtttgagca

SEQ ID NO: 3029770 - DNA, 19 bp, Homo sapiens
acagcagggtttgagcaca

SEQ ID NO: 3029771 - DNA, 17 bp, Homo sapiens
acagcatggcactccct

SEQ ID NO: 3029772 - DNA, 12 bp, Homo sapiens
acagcattgctt

SEQ ID NO: 3029773 - DNA, 20 bp, Homo sapiens
acagccaacacgcacctgcc

SEQ ID NO: 3029774 - DNA, 19 bp, Homo sapiens
acagccaactagcccctgg

SEQ ID NO: 3029775 - DNA, 13 bp, Homo sapiens
acagccacacaca

SEQ ID NO: 3029776 - DNA, 16 bp, Homo sapiens
acagccacacacacag

SEQ ID NO: 3029777 - DNA, 23 bp, Homo sapiens
acagccacacacacagaaaatat

SEQ ID NO: 3029778 - DNA, 16 bp, Homo sapiens
acagccactccccggc

SEQ ID NO: 3029779 - DNA, 20 bp, Homo sapiens
acagccactcccctccactc

SEQ ID NO: 3029780 - DNA, 21 bp, Homo sapiens
acagccagttttactgtgatt

SEQ ID NO: 3029781 - DNA, 15 bp, Homo sapiens
acagcccaggcctcc

SEQ ID NO: 3029782 - DNA, 12 bp, Homo sapiens
acagccccaccc

SEQ ID NO: 3029783 - DNA, 15 bp, Homo sapiens
acagccccaccctgg

SEQ ID NO: 3029784 - DNA, 16 bp, Homo sapiens
acagcccccaccccag

SEQ ID NO: 3029785 - DNA, 19 bp, Homo sapiens
acagccgattcacctgagc

SEQ ID NO: 3029786 - DNA, 14 bp, Homo sapiens
acagcctcacagaa

SEQ ID NO: 3029787 - DNA, 12 bp, Homo sapiens
acagcctcactt

SEQ ID NO: 3029788 - DNA, 23 bp, Homo sapiens
acagcctcacttggtctgccagg

SEQ ID NO: 3029789 - DNA, 14 bp, Homo sapiens
acagcctccaagtc

SEQ ID NO: 3029790 - DNA, 15 bp, Homo sapiens
acagcctcccctgcc

SEQ ID NO: 3029791 - DNA, 17 bp, Homo sapiens
acagcctcccctgccag

SEQ ID NO: 3029792 - DNA, 18 bp, Homo sapiens
acagcctcccctgccagg

SEQ ID NO: 3029793 - DNA, 13 bp, Homo sapiens
acagcctctgact

SEQ ID NO: 3029794 - DNA, 13 bp, Homo sapiens
acagcctcttttt

SEQ ID NO: 3029795 - DNA, 17 bp, Homo sapiens
acagcctgaataaacca

SEQ ID NO: 3029796 - DNA, 12 bp, Homo sapiens
acagcctgggcc

SEQ ID NO: 3029797 - DNA, 13 bp, Homo sapiens
acagcctgtctct

SEQ ID NO: 3029798 - DNA, 21 bp, Homo sapiens
acagcctgtcttgtcaggtgg

SEQ ID NO: 3029799 - DNA, 15 bp, Homo sapiens
acagccttattttgt

SEQ ID NO: 3029800 - DNA, 18 bp, Homo sapiens
acagccttgggcctttca

SEQ ID NO: 3029801 - DNA, 13 bp, Homo sapiens
acagcggctgcct

SEQ ID NO: 3029802 - DNA, 18 bp, Homo sapiens
acagcggctggacttgga

SEQ ID NO: 3029803 - DNA, 21 bp, Homo sapiens
acagcggctggacttggaggt

SEQ ID NO: 3029804 - DNA, 22 bp, Homo sapiens
acagcggctggacttggaggta

SEQ ID NO: 3029805 - DNA, 14 bp, Homo sapiens
acagctacaacagc

SEQ ID NO: 3029806 - DNA, 17 bp, Homo sapiens
acagctcactgcagcct

SEQ ID NO: 3029807 - DNA, 13 bp, Homo sapiens
acagctcccaccc

SEQ ID NO: 3029808 - DNA, 18 bp, Homo sapiens
acagctcccaccccaccc

SEQ ID NO: 3029809 - DNA, 18 bp, Homo sapiens
acagctcctcccctgccg

SEQ ID NO: 3029810 - DNA, 22 bp, Homo sapiens
acagctcctcccctgccgcctc

SEQ ID NO: 3029811 - DNA, 15 bp, Homo sapiens
acagctctgacttta

SEQ ID NO: 3029812 - DNA, 12 bp, Homo sapiens
acagctcttgtt

SEQ ID NO: 3029813 - DNA, 14 bp, Homo sapiens
acagctgccttagc

SEQ ID NO: 3029814 - DNA, 17 bp, Homo sapiens
acagctgccttagcttc

SEQ ID NO: 3029815 - DNA, 21 bp, Homo sapiens
acagctgccttagcttcagga

SEQ ID NO: 3029816 - DNA, 10 bp, Homo sapiens
acagctgctc

SEQ ID NO: 3029817 - DNA, 21 bp, Homo sapiens
acagctgctcctagagggagg

SEQ ID NO: 3029818 - DNA, 23 bp, Homo sapiens
acagctgctcctagagggagggg

SEQ ID NO: 3029819 - DNA, 12 bp, Homo sapiens
acagctggtgcc

SEQ ID NO: 3029820 - DNA, 17 bp, Homo sapiens
acagctgtttacagaca

SEQ ID NO: 3029821 - DNA, 19 bp, Homo sapiens
acagcttatttttttctac

SEQ ID NO: 3029822 - DNA, 11 bp, Homo sapiens
acagcttcctg

SEQ ID NO: 3029823 - DNA, 14 bp, Homo sapiens
acagcttgccaggg

SEQ ID NO: 3029824 - DNA, 22 bp, Homo sapiens
acagcttgccagggatgggcag

SEQ ID NO: 3029825 - DNA, 20 bp, Homo sapiens
acagctttcatgattagcaa

SEQ ID NO: 3029826 - DNA, 19 bp, Homo sapiens
acagctttcctcaaaaagc

SEQ ID NO: 3029827 - DNA, 14 bp, Homo sapiens
acagctttctgacc

SEQ ID NO: 3029828 - DNA, 19 bp, Homo sapiens
acagctttctgaccttcag

SEQ ID NO: 3029829 - DNA, 14 bp, Homo sapiens
acagctttgccttg

SEQ ID NO: 3029830 - DNA, 12 bp, Homo sapiens
acagctttgctg

SEQ ID NO: 3029831 - DNA, 19 bp, Homo sapiens
acagctttgtttctgcatc

SEQ ID NO: 3029832 - DNA, 23 bp, Homo sapiens
acaggaaaatcctctggctggct

SEQ ID NO: 3029833 - DNA, 18 bp, Homo sapiens
acaggaaagttcagagtt

SEQ ID NO: 3029834 - DNA, 15 bp, Homo sapiens
acaggaacggccctg

SEQ ID NO: 3029835 - DNA, 23 bp, Homo sapiens
acaggaacggccctgcaggagca

SEQ ID NO: 3029836 - DNA, 12 bp, Homo sapiens
acaggaagcctc

SEQ ID NO: 3029837 - DNA, 17 bp, Homo sapiens
acaggaaggtctgattt

SEQ ID NO: 3029838 - DNA, 20 bp, Homo sapiens
acaggaaggtctgatttgca

SEQ ID NO: 3029839 - DNA, 11 bp, Homo sapiens
acaggagaaat

SEQ ID NO: 3029840 - DNA, 15 bp, Homo sapiens
acaggagacccaaca

SEQ ID NO: 3029841 - DNA, 14 bp, Homo sapiens
acatgccagggaaa

SEQ ID NO: 3029842 - DNA, 21 bp, Homo sapiens
acatgcccacaacttgtcacc

SEQ ID NO: 3029843 - DNA, 14 bp, Homo sapiens
acatgccccaggct

SEQ ID NO: 3029844 - DNA, 22 bp, Homo sapiens
acatgcggtagccagcacacag

SEQ ID NO: 3029845 - DNA, 16 bp, Homo sapiens
acatgctaaataacta

SEQ ID NO: 3029846 - DNA, 22 bp, Homo sapiens
acatgctcagtacctgtgttga

SEQ ID NO: 3029847 - DNA, 22 bp, Homo sapiens
acatgctgcgcatgttttcttc

SEQ ID NO: 3029848 - DNA, 15 bp, Homo sapiens
acatgcttcaatagt

SEQ ID NO: 3029849 - DNA, 14 bp, Homo sapiens
acatgcttttactt

SEQ ID NO: 3029850 - DNA, 15 bp, Homo sapiens
acatgcttttacttt

SEQ ID NO: 3029851 - DNA, 18 bp, Homo sapiens
acatgcttttactttatt

SEQ ID NO: 3029852 - DNA, 16 bp, Homo sapiens
acatgcttttcttcct

SEQ ID NO: 3029853 - DNA, 15 bp, Homo sapiens
acatggactcagaga

SEQ ID NO: 3029854 - DNA, 11 bp, Homo sapiens
acatggagctc

SEQ ID NO: 3029855 - DNA, 14 bp, Homo sapiens
acatggaggttcta

SEQ ID NO: 3029856 - DNA, 20 bp, Homo sapiens
acatggctctaaaaagtttt

SEQ ID NO: 3029857 - DNA, 23 bp, Homo sapiens
acatggcttctcctttggcatgt

SEQ ID NO: 3029858 - DNA, 23 bp, Homo sapiens
acatggtgaaaccccgtctctac

SEQ ID NO: 3029859 - DNA, 23 bp, Homo sapiens
acatggtgctacgcctgcatgta

SEQ ID NO: 3029860 - DNA, 21 bp, Homo sapiens
acatggtggcatgcacctgca

SEQ ID NO: 3029861 - DNA, 23 bp, Homo sapiens
acatggtgtggccatcactcagc

SEQ ID NO: 3029862 - DNA, 18 bp, Homo sapiens
acatgtaatataaagatg

SEQ ID NO: 3029863 - DNA, 18 bp, Homo sapiens
acatgtaccccctttccc

SEQ ID NO: 3029864 - DNA, 20 bp, Homo sapiens
acatgtaccccctttccctt

SEQ ID NO: 3029865 - DNA, 16 bp, Homo sapiens
acatgtatctgtctac

SEQ ID NO: 3029866 - DNA, 18 bp, Homo sapiens
acatgtatctgtctactt

SEQ ID NO: 3029867 - DNA, 21 bp, Homo sapiens
acatgtatctgtctactttct

SEQ ID NO: 3029868 - DNA, 11 bp, Homo sapiens
acatgtatgtg

SEQ ID NO: 3029869 - DNA, 14 bp, Homo sapiens
acatgtatgtggat

SEQ ID NO: 3029870 - DNA, 15 bp, Homo sapiens
acatgtatgtggata

SEQ ID NO: 3029871 - DNA, 20 bp, Homo sapiens
acatgtcctaattcttctgt

SEQ ID NO: 3029872 - DNA, 22 bp, Homo sapiens
acatgtcctaattcttctgtcc

SEQ ID NO: 3029873 - DNA, 21 bp, Homo sapiens
acatgtcctatccaaaggaat

SEQ ID NO: 3029874 - DNA, 15 bp, Homo sapiens
acatgtgcaactctt

SEQ ID NO: 3029875 - DNA, 19 bp, Homo sapiens
acatgtgcaactcttgtat

SEQ ID NO: 3029876 - DNA, 16 bp, Homo sapiens
acatgtggcagcaggc

SEQ ID NO: 3029877 - DNA, 17 bp, Homo sapiens
acatgtggcagcaggca

SEQ ID NO: 3029878 - DNA, 19 bp, Homo sapiens
acatgtggccatggcctct

SEQ ID NO: 3029879 - DNA, 18 bp, Homo sapiens
acatgtgtagcctgtgca

SEQ ID NO: 3029880 - DNA, 20 bp, Homo sapiens
acatgtgtagcctgtgcatg

SEQ ID NO: 3029881 - DNA, 22 bp, Homo sapiens
acatgtgttttcatcatttcag

SEQ ID NO: 3029882 - DNA, 14 bp, Homo sapiens
acatgttgtacatt

SEQ ID NO: 3029883 - DNA, 21 bp, Homo sapiens
acatgtttaataaataaaaat

SEQ ID NO: 3029884 - DNA, 13 bp, Homo sapiens
acatgtttataaa

SEQ ID NO: 3029885 - DNA, 18 bp, Homo sapiens
acatgtttcaagaaccgc

SEQ ID NO: 3029886 - DNA, 16 bp, Homo sapiens
acatgtttctctataa

SEQ ID NO: 3029887 - DNA, 17 bp, Homo sapiens
acatgttttagacaaat

SEQ ID NO: 3029888 - DNA, 22 bp, Homo sapiens
acatgttttagacaaatactca

SEQ ID NO: 3029889 - DNA, 15 bp, Homo sapiens
acatgttttgataaa

SEQ ID NO: 3029890 - DNA, 14 bp, Homo sapiens
acattaaaaagcct

SEQ ID NO: 3029891 - DNA, 21 bp, Homo sapiens
acattaaaaagccttacagtt

SEQ ID NO: 3029892 - DNA, 23 bp, Homo sapiens
acattaaaaagccttacagttat

SEQ ID NO: 3029893 - DNA, 18 bp, Homo sapiens
acattaaaagacaaatat

SEQ ID NO: 3029894 - DNA, 14 bp, Homo sapiens
acattaaggagcag

SEQ ID NO: 3029895 - DNA, 15 bp, Homo sapiens
acattaatgcccagc

SEQ ID NO: 3029896 - DNA, 12 bp, Homo sapiens
acattagaactt

SEQ ID NO: 3029897 - DNA, 14 bp, Homo sapiens
acattagaagacaa

SEQ ID NO: 3029898 - DNA, 23 bp, Homo sapiens
acattatcttttggctctgaaga

SEQ ID NO: 3029899 - DNA, 21 bp, Homo sapiens
acattatgtggttttagattt

SEQ ID NO: 3029900 - DNA, 22 bp, Homo sapiens
acattatgtggttttagatttt

SEQ ID NO: 3029901 - DNA, 13 bp, Homo sapiens
acattcacctgcc

SEQ ID NO: 3029902 - DNA, 14 bp, Homo sapiens
acattcacctgccc

SEQ ID NO: 3029903 - DNA, 13 bp, Homo sapiens
acattcaggagct

SEQ ID NO: 3029904 - DNA, 15 bp, Homo sapiens
acattccaagacagt

SEQ ID NO: 3029905 - DNA, 16 bp, Homo sapiens
acattccaagactcta

SEQ ID NO: 3029906 - DNA, 17 bp, Homo sapiens
acattcccctggggacc

SEQ ID NO: 3029907 - DNA, 23 bp, Homo sapiens
acattccgaggggctcagttctg

SEQ ID NO: 3029908 - DNA, 18 bp, Homo sapiens
acattctcgttgcctctg

SEQ ID NO: 3029909 - DNA, 19 bp, Homo sapiens
acattctcgttgcctctga

SEQ ID NO: 3029910 - DNA, 14 bp, Homo sapiens
acattctctaataa

SEQ ID NO: 3029911 - DNA, 19 bp, Homo sapiens
acattctctaataagaaaa

SEQ ID NO: 3029912 - DNA, 20 bp, Homo sapiens
acattctctaataagaaaac

SEQ ID NO: 3029913 - DNA, 19 bp, Homo sapiens
acattctgatttggaaaaa

SEQ ID NO: 3029914 - DNA, 18 bp, Homo sapiens
acattctgctttcatctt

SEQ ID NO: 3029915 - DNA, 13 bp, Homo sapiens
acattctgtgtgt

SEQ ID NO: 3029916 - DNA, 14 bp, Homo sapiens
acattcttataaat

SEQ ID NO: 3029917 - DNA, 22 bp, Homo sapiens
acattcttataaatatgaagct

SEQ ID NO: 3029918 - DNA, 23 bp, Homo sapiens
acattcttataaatatgaagctc

SEQ ID NO: 3029919 - DNA, 20 bp, Homo sapiens
acattcttggcttaatcatt

SEQ ID NO: 3029920 - DNA, 22 bp, Homo sapiens
acattcttggcttaatcatttt

SEQ ID NO: 3029921 - DNA, 23 bp, Homo sapiens
acattcttggcttaatcattttc

SEQ ID NO: 3029922 - DNA, 15 bp, Homo sapiens
acattgaagtaatga

SEQ ID NO: 3029923 - DNA, 18 bp, Homo sapiens
acattgataagatggttt

SEQ ID NO: 3029924 - DNA, 14 bp, Homo sapiens
acattgatgtgttc

SEQ ID NO: 3029925 - DNA, 15 bp, Homo sapiens
acattgccttgcatt

SEQ ID NO: 3029926 - DNA, 12 bp, Homo sapiens
acattgcctttg

SEQ ID NO: 3029927 - DNA, 17 bp, Homo sapiens
acattgcctttgaatgt

SEQ ID NO: 3029928 - DNA, 18 bp, Homo sapiens
acattgcctttgaatgtt

SEQ ID NO: 3029929 - DNA, 15 bp, Homo sapiens
acattgcgtttgacc

SEQ ID NO: 3029930 - DNA, 18 bp, Homo sapiens
acattgctggtcatcctt

SEQ ID NO: 3029931 - DNA, 21 bp, Homo sapiens
acattggcacctaatccaggc

SEQ ID NO: 3029932 - DNA, 16 bp, Homo sapiens
acattgggtctattcc

SEQ ID NO: 3029933 - DNA, 18 bp, Homo sapiens
acattgggtctattccag

SEQ ID NO: 3029934 - DNA, 20 bp, Homo sapiens
acattgggtctattccagct

SEQ ID NO: 3029935 - DNA, 19 bp, Homo sapiens
acattgtctcctatatatt

SEQ ID NO: 3029936 - DNA, 22 bp, Homo sapiens
acattgtctcctatatatttct

SEQ ID NO: 3029937 - DNA, 11 bp, Homo sapiens
acattgtgcca

SEQ ID NO: 3029938 - DNA, 16 bp, Homo sapiens
acattgtgcttggccc

SEQ ID NO: 3029939 - DNA, 16 bp, Homo sapiens
acattgttatttctgt

SEQ ID NO: 3029940 - DNA, 15 bp, Homo sapiens
acattgttattttca

SEQ ID NO: 3029941 - DNA, 13 bp, Homo sapiens
acattgttttaaa

SEQ ID NO: 3029942 - DNA, 14 bp, Homo sapiens
acatttaaatacaa

SEQ ID NO: 3029943 - DNA, 21 bp, Homo sapiens
acatttaaatacaaagttctt

SEQ ID NO: 3029944 - DNA, 16 bp, Homo sapiens
acatttaaatccttgt

SEQ ID NO: 3029945 - DNA, 22 bp, Homo sapiens
acatttacaccacactttcaaa

SEQ ID NO: 3029946 - DNA, 16 bp, Homo sapiens
acatttacatgtatta

SEQ ID NO: 3029947 - DNA, 14 bp, Homo sapiens
acatttaccagcaa

SEQ ID NO: 3029948 - DNA, 23 bp, Homo sapiens
acatttagatcctggtttcataa

SEQ ID NO: 3029949 - DNA, 14 bp, Homo sapiens
acatttagatttag

SEQ ID NO: 3029950 - DNA, 17 bp, Homo sapiens
acatttatatattgtct

SEQ ID NO: 3029951 - DNA, 11 bp, Homo sapiens
acatttatatt

SEQ ID NO: 3029952 - DNA, 15 bp, Homo sapiens
acatttatctaaaag

SEQ ID NO: 3029953 - DNA, 22 bp, Homo sapiens
acatttatgacaagctgtatca

SEQ ID NO: 3029954 - DNA, 15 bp, Homo sapiens
acatttatgtgttga

SEQ ID NO: 3029955 - DNA, 16 bp, Homo sapiens
acatttatgtgttgat

SEQ ID NO: 3029956 - DNA, 19 bp, Homo sapiens
acatttcaagatccaaatg

SEQ ID NO: 3029957 - DNA, 22 bp, Homo sapiens
acatttgatgcatgtcttttaa

SEQ ID NO: 3029958 - DNA, 16 bp, Homo sapiens
acatttggaatacttt

SEQ ID NO: 3029959 - DNA, 19 bp, Homo sapiens
acatttgtgccgacactgt

SEQ ID NO: 3029960 - DNA, 20 bp, Homo sapiens
acatttgtgtaatatgaaat

SEQ ID NO: 3029961 - DNA, 21 bp, Homo sapiens
acattttaacaagaagatgaa

SEQ ID NO: 3029962 - DNA, 13 bp, Homo sapiens
acattttaggatc

SEQ ID NO: 3029963 - DNA, 14 bp, Homo sapiens
acattttcagccaa

SEQ ID NO: 3029964 - DNA, 19 bp, Homo sapiens
acattttcttgaaagggga

SEQ ID NO: 3029965 - DNA, 15 bp, Homo sapiens
acattttgagaacaa

SEQ ID NO: 3029966 - DNA, 15 bp, Homo sapiens
acattttggatttct

SEQ ID NO: 3029967 - DNA, 20 bp, Homo sapiens
acattttggatttctttata

SEQ ID NO: 3029968 - DNA, 13 bp, Homo sapiens
acattttgtataa

SEQ ID NO: 3029969 - DNA, 19 bp, Homo sapiens
acattttgtataattgtat

SEQ ID NO: 3029970 - DNA, 16 bp, Homo sapiens
acatttttcaactttg

SEQ ID NO: 3029971 - DNA, 19 bp, Homo sapiens
acatttttcaactttgaat

SEQ ID NO: 3029972 - DNA, 21 bp, Homo sapiens
acatttttcaactttgaataa

SEQ ID NO: 3029973 - DNA, 21 bp, Homo sapiens
accctttccttccttccctgg

SEQ ID NO: 3029974 - DNA, 22 bp, Homo sapiens
accctttccttccttccctggc

SEQ ID NO: 3029975 - DNA, 17 bp, Homo sapiens
accgaaacagcgctggg

SEQ ID NO: 3029976 - DNA, 14 bp, Homo sapiens
accgaccccgggcc

SEQ ID NO: 3029977 - DNA, 18 bp, Homo sapiens
accgacccgaggcccaga

SEQ ID NO: 3029978 - DNA, 23 bp, Homo sapiens
accgacctggtttttaaatagag

SEQ ID NO: 3029979 - DNA, 18 bp, Homo sapiens
accgacgttgccatcaaa

SEQ ID NO: 3029980 - DNA, 13 bp, Homo sapiens
accgactgcccag

SEQ ID NO: 3029981 - DNA, 14 bp, Homo sapiens
accgactgcccagc

SEQ ID NO: 3029982 - DNA, 23 bp, Homo sapiens
accgagagtagccgagagcctgc

SEQ ID NO: 3029983 - DNA, 23 bp, Homo sapiens
accgagctctgtgggaaaaaaga

SEQ ID NO: 3029984 - DNA, 19 bp, Homo sapiens
accgaggaacaacttggaa

SEQ ID NO: 3029985 - DNA, 14 bp, Homo sapiens
accgaggggccttt

SEQ ID NO: 3029986 - DNA, 15 bp, Homo sapiens
accgcagctgctgcc

SEQ ID NO: 3029987 - DNA, 17 bp, Homo sapiens
accgcagctgctgccac

SEQ ID NO: 3029988 - DNA, 19 bp, Homo sapiens
accgcagctgctgccactc

SEQ ID NO: 3029989 - DNA, 13 bp, Homo sapiens
accgcaggaagct

SEQ ID NO: 3029990 - DNA, 14 bp, Homo sapiens
accgcaggaagctg

SEQ ID NO: 3029991 - DNA, 14 bp, Homo sapiens
accgcatggcagct

SEQ ID NO: 3029992 - DNA, 19 bp, Homo sapiens
accgcatggcagctgggcc

SEQ ID NO: 3029993 - DNA, 23 bp, Homo sapiens
accgccagcagcgcgcaggcctg

SEQ ID NO: 3029994 - DNA, 24 bp, Homo sapiens
accgccagcagcgcgcaggcctgc

SEQ ID NO: 3029995 - DNA, 11 bp, Homo sapiens
accgcccgtct

SEQ ID NO: 3029996 - DNA, 13 bp, Homo sapiens
accgcccgtctgt

SEQ ID NO: 3029997 - DNA, 21 bp, Homo sapiens
accgccctgcgggccacaggg

SEQ ID NO: 3029998 - DNA, 18 bp, Homo sapiens
accgcccttttcccctac

SEQ ID NO: 3029999 - DNA, 19 bp, Homo sapiens
accgccggctttcagggca

SEQ ID NO: 3030000 - DNA, 21 bp, Homo sapiens
accgccggctttcagggcagc

SEQ ID NO: 3030001 - DNA, 17 bp, Homo sapiens
accgccggggtcctggg

SEQ ID NO: 3030002 - DNA, 18 bp, Homo sapiens
accgccggggtcctggga

SEQ ID NO: 3030003 - DNA, 20 bp, Homo sapiens
accgcctccccacctccagg

SEQ ID NO: 3030004 - DNA, 21 bp, Homo sapiens
accgcctccccacctccaggc

SEQ ID NO: 3030005 - DNA, 16 bp, Homo sapiens
accgcctcctacagcc

SEQ ID NO: 3030006 - DNA, 16 bp, Homo sapiens
accgcgactaatttca

SEQ ID NO: 3030007 - DNA, 17 bp, Homo sapiens
accgcggacgtgctggc

SEQ ID NO: 3030008 - DNA, 20 bp, Homo sapiens
accgctgagaggctgcctcc

SEQ ID NO: 3030009 - DNA, 14 bp, Homo sapiens
accgctttggcctg

SEQ ID NO: 3030010 - DNA, 18 bp, Homo sapiens
accggatgctgtgcctgg

SEQ ID NO: 3030011 - DNA, 22 bp, Homo sapiens
accgggccagtatctatatatg

SEQ ID NO: 3030012 - DNA, 21 bp, Homo sapiens
accgggctgcaggtgctgctg

SEQ ID NO: 3030013 - DNA, 14 bp, Homo sapiens
accggggcaagagg

SEQ ID NO: 3030014 - DNA, 18 bp, Homo sapiens
accggggcaagagggaag

SEQ ID NO: 3030015 - DNA, 17 bp, Homo sapiens
accgggggtggctctgt

SEQ ID NO: 3030016 - DNA, 17 bp, Homo sapiens
accgggttctcctgatt

SEQ ID NO: 3030017 - DNA, 18 bp, Homo sapiens
accgtgagcgacaaagat

SEQ ID NO: 3030018 - DNA, 19 bp, Homo sapiens
accgtgagtgacatagcct

SEQ ID NO: 3030019 - DNA, 22 bp, Homo sapiens
accgtgccaaccccacccagct

SEQ ID NO: 3030020 - DNA, 14 bp, Homo sapiens
accgtggcctgggc

SEQ ID NO: 3030021 - DNA, 16 bp, Homo sapiens
accgtgggcagggagc

SEQ ID NO: 3030022 - DNA, 14 bp, Homo sapiens
accgtgggctccct

SEQ ID NO: 3030023 - DNA, 14 bp, Homo sapiens
accgtggggaaggg

SEQ ID NO: 3030024 - DNA, 14 bp, Homo sapiens
accgttcaagaggc

SEQ ID NO: 3030025 - DNA, 14 bp, Homo sapiens
accgttctgtgcac

SEQ ID NO: 3030026 - DNA, 15 bp, Homo sapiens
acctaacccctttcc

SEQ ID NO: 3030027 - DNA, 16 bp, Homo sapiens
acctaacccctttcct

SEQ ID NO: 3030028 - DNA, 15 bp, Homo sapiens
acctaaccctctgtc

SEQ ID NO: 3030029 - DNA, 12 bp, Homo sapiens
acctaacctgtg

SEQ ID NO: 3030030 - DNA, 16 bp, Homo sapiens
acctaacctgtgtctg

SEQ ID NO: 3030031 - DNA, 16 bp, Homo sapiens
acctaactgtatcttg

SEQ ID NO: 3030032 - DNA, 18 bp, Homo sapiens
acctaagaatttcactgt

SEQ ID NO: 3030033 - DNA, 23 bp, Homo sapiens
acctaagggacatgttttgataa

SEQ ID NO: 3030034 - DNA, 15 bp, Homo sapiens
acctaatccaggcag

SEQ ID NO: 3030035 - DNA, 21 bp, Homo sapiens
acctaatccaggcagatccag

SEQ ID NO: 3030036 - DNA, 20 bp, Homo sapiens
acctacagacagacatacat

SEQ ID NO: 3030037 - DNA, 19 bp, Homo sapiens
acctacatgttattctagt

SEQ ID NO: 3030038 - DNA, 15 bp, Homo sapiens
acctacctgttgagc

SEQ ID NO: 3030039 - DNA, 16 bp, Homo sapiens
acctactgactgatga

SEQ ID NO: 3030040 - DNA, 14 bp, Homo sapiens
acctactgtctaag

SEQ ID NO: 3030041 - DNA, 15 bp, Homo sapiens
acctactgttctaaa

SEQ ID NO: 3030042 - DNA, 23 bp, Homo sapiens
acctactgttctaaagctctgac

SEQ ID NO: 3030043 - DNA, 20 bp, Homo sapiens
acctacttagatatttcatg

SEQ ID NO: 3030044 - DNA, 20 bp, Homo sapiens
acctagaagtaagaagagga

SEQ ID NO: 3030045 - DNA, 21 bp, Homo sapiens
acctagcagcaccgttctgtg

SEQ ID NO: 3030046 - DNA, 22 bp, Homo sapiens
acctagcagcaccgttctgtgc

SEQ ID NO: 3030047 - DNA, 17 bp, Homo sapiens
acctagccaacatggtg

SEQ ID NO: 3030048 - DNA, 12 bp, Homo sapiens
acctagccggaa

SEQ ID NO: 3030049 - DNA, 18 bp, Homo sapiens
acctaggccactcctcca

SEQ ID NO: 3030050 - DNA, 15 bp, Homo sapiens
acctagggtctattt

SEQ ID NO: 3030051 - DNA, 15 bp, Homo sapiens
acctagtgccccaga

SEQ ID NO: 3030052 - DNA, 14 bp, Homo sapiens
acctataggaaagt

SEQ ID NO: 3030053 - DNA, 22 bp, Homo sapiens
acctataggaaagtctgtcagg

SEQ ID NO: 3030054 - DNA, 20 bp, Homo sapiens
acctatccctaacaggctgt

SEQ ID NO: 3030055 - DNA, 15 bp, Homo sapiens
acctatctcagccat

SEQ ID NO: 3030056 - DNA, 22 bp, Homo sapiens
acctattgccaggaatgtttca

SEQ ID NO: 3030057 - DNA, 12 bp, Homo sapiens
acctatttccat

SEQ ID NO: 3030058 - DNA, 23 bp, Homo sapiens
acctatttcttaaacacttgcaa

SEQ ID NO: 3030059 - DNA, 17 bp, Homo sapiens
acctcaactaaccctta

SEQ ID NO: 3030060 - DNA, 22 bp, Homo sapiens
acctcaactaacccttaaaaat

SEQ ID NO: 3030061 - DNA, 23 bp, Homo sapiens
acctcaagtgatctgtccacctc

SEQ ID NO: 3030062 - DNA, 14 bp, Homo sapiens
acctcacaactcct

SEQ ID NO: 3030063 - DNA, 20 bp, Homo sapiens
acctcacaactccttccatc

SEQ ID NO: 3030064 - DNA, 18 bp, Homo sapiens
acctcaccccgaggccct

SEQ ID NO: 3030065 - DNA, 16 bp, Homo sapiens
acctcacctctttgtt

SEQ ID NO: 3030066 - DNA, 13 bp, Homo sapiens
acctcacctggtc

SEQ ID NO: 3030067 - DNA, 14 bp, Homo sapiens
acctcacctggtcc

SEQ ID NO: 3030068 - DNA, 18 bp, Homo sapiens
acctcacgcacctcccat

SEQ ID NO: 3030069 - DNA, 12 bp, Homo sapiens
acctcagcattt

SEQ ID NO: 3030070 - DNA, 14 bp, Homo sapiens
acctcagccatgag

SEQ ID NO: 3030071 - DNA, 23 bp, Homo sapiens
acctcagccatgaggagttgctg

SEQ ID NO: 3030072 - DNA, 14 bp, Homo sapiens
acctcagcctccca

SEQ ID NO: 3030073 - DNA, 12 bp, Homo sapiens
acctcagcctgc

SEQ ID NO: 3030074 - DNA, 15 bp, Homo sapiens
acctcagcctgcacc

SEQ ID NO: 3030075 - DNA, 19 bp, Homo sapiens
acctcagcctggccagaca

SEQ ID NO: 3030076 - DNA, 20 bp, Homo sapiens
acctcagcctggccagacac

SEQ ID NO: 3030077 - DNA, 15 bp, Homo sapiens
acctcagggctatgt

SEQ ID NO: 3030078 - DNA, 15 bp, Homo sapiens
acctcaggtgatcca

SEQ ID NO: 3030079 - DNA, 22 bp, Homo sapiens
acctcagttattacatgtaatt

SEQ ID NO: 3030080 - DNA, 15 bp, Homo sapiens
acctcatccaaacaa

SEQ ID NO: 3030081 - DNA, 17 bp, Homo sapiens
acctcatgaggaccagg

SEQ ID NO: 3030082 - DNA, 21 bp, Homo sapiens
acctcattaaccgatgcttta

SEQ ID NO: 3030083 - DNA, 17 bp, Homo sapiens
acctccaagccactgag

SEQ ID NO: 3030084 - DNA, 13 bp, Homo sapiens
acctccacagctt

SEQ ID NO: 3030085 - DNA, 14 bp, Homo sapiens
acctccacatcctc

SEQ ID NO: 3030086 - DNA, 16 bp, Homo sapiens
acctccacatcctcca

SEQ ID NO: 3030087 - DNA, 19 bp, Homo sapiens
acctccacgccactgcctc

SEQ ID NO: 3030088 - DNA, 13 bp, Homo sapiens
acctccccccact

SEQ ID NO: 3030089 - DNA, 14 bp, Homo sapiens
acctccccccactg

SEQ ID NO: 3030090 - DNA, 15 bp, Homo sapiens
acctccccccactgc

SEQ ID NO: 3030091 - DNA, 14 bp, Homo sapiens
acctcccctatcca

SEQ ID NO: 3030092 - DNA, 20 bp, Homo sapiens
acctcccctatccacccagc

SEQ ID NO: 3030093 - DNA, 23 bp, Homo sapiens
acctcccctatccacccagccca

SEQ ID NO: 3030094 - DNA, 14 bp, Homo sapiens
acctccccttttct

SEQ ID NO: 3030095 - DNA, 11 bp, Homo sapiens
acctccctccc

SEQ ID NO: 3030096 - DNA, 22 bp, Homo sapiens
acctcccttaagcagcaacagc

SEQ ID NO: 3030097 - DNA, 23 bp, Homo sapiens
acctcctcccccctcctctgaaa

SEQ ID NO: 3030098 - DNA, 14 bp, Homo sapiens
acctcctctgtgaa

SEQ ID NO: 3030099 - DNA, 18 bp, Homo sapiens
acctcctctgtgaagcat

SEQ ID NO: 3030100 - DNA, 13 bp, Homo sapiens
acctcctgagaaa

SEQ ID NO: 3030101 - DNA, 16 bp, Homo sapiens
acctcctgcccaggag

SEQ ID NO: 3030102 - DNA, 19 bp, Homo sapiens
acctcctgcccaggagagc

SEQ ID NO: 3030103 - DNA, 14 bp, Homo sapiens
acctcgagtactgt

SEQ ID NO: 3030104 - DNA, 16 bp, Homo sapiens
acctcgagtactgtgg

SEQ ID NO: 3030105 - DNA, 15 bp, Homo sapiens
acctcgcatcattgc

SEQ ID NO: 3030106 - DNA, 20 bp, Homo sapiens
acggagcccagccctcccca

SEQ ID NO: 3030107 - DNA, 20 bp, Homo sapiens
acggaggcctgcgaccctgg

SEQ ID NO: 3030108 - DNA, 22 bp, Homo sapiens
acggcacggtcttccctcttcc

SEQ ID NO: 3030109 - DNA, 21 bp, Homo sapiens
acggcaggacaacgaggaagc

SEQ ID NO: 3030110 - DNA, 21 bp, Homo sapiens
acggcaggcgtgtggcagcca

SEQ ID NO: 3030111 - DNA, 17 bp, Homo sapiens
acggccagggagaagct

SEQ ID NO: 3030112 - DNA, 13 bp, Homo sapiens
acggcccagggag

SEQ ID NO: 3030113 - DNA, 14 bp, Homo sapiens
acggcccagggagg

SEQ ID NO: 3030114 - DNA, 15 bp, Homo sapiens
acggcccagggaggg

SEQ ID NO: 3030115 - DNA, 21 bp, Homo sapiens
acggccccgaagggcccccac

SEQ ID NO: 3030116 - DNA, 17 bp, Homo sapiens
acggcccggcccctcac

SEQ ID NO: 3030117 - DNA, 22 bp, Homo sapiens
acggcccggcccctcaccctct

SEQ ID NO: 3030118 - DNA, 19 bp, Homo sapiens
acggctcgatttctccagg

SEQ ID NO: 3030119 - DNA, 23 bp, Homo sapiens
acggctgccattggtccaccctt

SEQ ID NO: 3030120 - DNA, 22 bp, Homo sapiens
acggctgggcacacgcctccca

SEQ ID NO: 3030121 - DNA, 17 bp, Homo sapiens
acggctgtgggaccagg

SEQ ID NO: 3030122 - DNA, 17 bp, Homo sapiens
acgggagtgacccagct

SEQ ID NO: 3030123 - DNA, 19 bp, Homo sapiens
acgggcaagtgagagggga

SEQ ID NO: 3030124 - DNA, 23 bp, Homo sapiens
acgggcatgcacacggctggtca

SEQ ID NO: 3030125 - DNA, 22 bp, Homo sapiens
acggggaccactgggcccctca

SEQ ID NO: 3030126 - DNA, 21 bp, Homo sapiens
acgggtgcccgtaatcccagc

SEQ ID NO: 3030127 - DNA, 22 bp, Homo sapiens
acggtgaccgcctcctgctctg

SEQ ID NO: 3030128 - DNA, 23 bp, Homo sapiens
acggtgaccgcctcctgctctgc

SEQ ID NO: 3030129 - DNA, 17 bp, Homo sapiens
acggtgcagtctgggtg

SEQ ID NO: 3030130 - DNA, 17 bp, Homo sapiens
acggtgtcttgttctgt

SEQ ID NO: 3030131 - DNA, 20 bp, Homo sapiens
acggtgtcttgttctgtcac

SEQ ID NO: 3030132 - DNA, 22 bp, Homo sapiens
acggtgtcttgttctgtcactc

SEQ ID NO: 3030133 - DNA, 12 bp, Homo sapiens
acggttcaatgg

SEQ ID NO: 3030134 - DNA, 21 bp, Homo sapiens
acgtaaaatttacagtcaatc

SEQ ID NO: 3030135 - DNA, 11 bp, Homo sapiens
acgtaaatgtt

SEQ ID NO: 3030136 - DNA, 14 bp, Homo sapiens
acgtaaatgttttt

SEQ ID NO: 3030137 - DNA, 15 bp, Homo sapiens
acgtaagcactgttt

SEQ ID NO: 3030138 - DNA, 17 bp, Homo sapiens
acgtaagcactgttttt

SEQ ID NO: 3030139 - DNA, 19 bp, Homo sapiens
acgtaattcttcctgtttg

SEQ ID NO: 3030140 - DNA, 23 bp, Homo sapiens
acgtaccaagccaccgcagctgc

SEQ ID NO: 3030141 - DNA, 17 bp, Homo sapiens
acgtactagagggcatt

SEQ ID NO: 3030142 - DNA, 13 bp, Homo sapiens
acgtagccacagg

SEQ ID NO: 3030143 - DNA, 14 bp, Homo sapiens
acgtagtgactcag

SEQ ID NO: 3030144 - DNA, 20 bp, Homo sapiens
acgtatcaatacagtttata

SEQ ID NO: 3030145 - DNA, 14 bp, Homo sapiens
acgtatgcatgtga

SEQ ID NO: 3030146 - DNA, 20 bp, Homo sapiens
acgtatgtatatacacacat

SEQ ID NO: 3030147 - DNA, 16 bp, Homo sapiens
acgtatttcacagagc

SEQ ID NO: 3030148 - DNA, 14 bp, Homo sapiens
acgtcaaacatgaa

SEQ ID NO: 3030149 - DNA, 16 bp, Homo sapiens
acgtcacccaaaagca

SEQ ID NO: 3030150 - DNA, 18 bp, Homo sapiens
acgtccacgcggccacct

SEQ ID NO: 3030151 - DNA, 13 bp, Homo sapiens
acgtccatctctc

SEQ ID NO: 3030152 - DNA, 15 bp, Homo sapiens
acgtccatctctctc

SEQ ID NO: 3030153 - DNA, 17 bp, Homo sapiens
acgtccatctctctccc

SEQ ID NO: 3030154 - DNA, 19 bp, Homo sapiens
acgtcccagcggcctcagg

SEQ ID NO: 3030155 - DNA, 18 bp, Homo sapiens
acgtcgaggaccgggcac

SEQ ID NO: 3030156 - DNA, 14 bp, Homo sapiens
acgtctacgtatgc

SEQ ID NO: 3030157 - DNA, 15 bp, Homo sapiens
acgtctcaagactga

SEQ ID NO: 3030158 - DNA, 17 bp, Homo sapiens
acgtctcaagactgaaa

SEQ ID NO: 3030159 - DNA, 12 bp, Homo sapiens
acgtctcccaga

SEQ ID NO: 3030160 - DNA, 20 bp, Homo sapiens
acgtctctctgcctgctggg

SEQ ID NO: 3030161 - DNA, 17 bp, Homo sapiens
acgtctgggagaaattg

SEQ ID NO: 3030162 - DNA, 21 bp, Homo sapiens
acgtgaaaggaatacacttgt

SEQ ID NO: 3030163 - DNA, 13 bp, Homo sapiens
acgtgaaatactt

SEQ ID NO: 3030164 - DNA, 23 bp, Homo sapiens
acgtgaaatacttcgatgatgat

SEQ ID NO: 3030165 - DNA, 16 bp, Homo sapiens
acgtgactcagagctt

SEQ ID NO: 3030166 - DNA, 23 bp, Homo sapiens
acgtgagagtgtcttcacggcag

SEQ ID NO: 3030167 - DNA, 23 bp, Homo sapiens
acgtgcactgtgaatcctggcaa

SEQ ID NO: 3030168 - DNA, 19 bp, Homo sapiens
acgtgcaggacagctcttg

SEQ ID NO: 3030169 - DNA, 13 bp, Homo sapiens
acgtgccaggccc

SEQ ID NO: 3030170 - DNA, 14 bp, Homo sapiens
acgtgccaggcccg

SEQ ID NO: 3030171 - DNA, 21 bp, Homo sapiens
acgtgccaggcccggggctgg

SEQ ID NO: 3030172 - DNA, 14 bp, Homo sapiens
acgtgccttaggaa

SEQ ID NO: 3030173 - DNA, 15 bp, Homo sapiens
acgtggctctgctgg

SEQ ID NO: 3030174 - DNA, 22 bp, Homo sapiens
acgtggctgcgtgcccctgctg

SEQ ID NO: 3030175 - DNA, 13 bp, Homo sapiens
acgtgtcccgagc

SEQ ID NO: 3030176 - DNA, 13 bp, Homo sapiens
acgtgtgaaatct

SEQ ID NO: 3030177 - DNA, 18 bp, Homo sapiens
acgtgtgaaatctgtctt

SEQ ID NO: 3030178 - DNA, 12 bp, Homo sapiens
acgtgtgatttt

SEQ ID NO: 3030179 - DNA, 17 bp, Homo sapiens
acgttaaaagtgtacaa

SEQ ID NO: 3030180 - DNA, 14 bp, Homo sapiens
acgttgtttcttat

SEQ ID NO: 3030181 - DNA, 19 bp, Homo sapiens
acgttgtttcttatagatt

SEQ ID NO: 3030182 - DNA, 17 bp, Homo sapiens
acgtttaatcccagcac

SEQ ID NO: 3030183 - DNA, 12 bp, Homo sapiens
acgtttctcatt

SEQ ID NO: 3030184 - DNA, 23 bp, Homo sapiens
acgtttggaagatcctgtgagga

SEQ ID NO: 3030185 - DNA, 19 bp, Homo sapiens
acgttttagaaaattttat

SEQ ID NO: 3030186 - DNA, 19 bp, Homo sapiens
acgttttatattatataag

SEQ ID NO: 3030187 - DNA, 18 bp, Homo sapiens
acgttttttcctcagtgc

SEQ ID NO: 3030188 - DNA, 16 bp, Homo sapiens
actaaaaacaaaccct

SEQ ID NO: 3030189 - DNA, 15 bp, Homo sapiens
actaaaaataagaaa

SEQ ID NO: 3030190 - DNA, 18 bp, Homo sapiens
actaaacacgtgacacaa

SEQ ID NO: 3030191 - DNA, 21 bp, Homo sapiens
actaaagaaaatatctgaaat

SEQ ID NO: 3030192 - DNA, 12 bp, Homo sapiens
actaaaggaatc

SEQ ID NO: 3030193 - DNA, 19 bp, Homo sapiens
actaaataagaaaataaca

SEQ ID NO: 3030194 - DNA, 14 bp, Homo sapiens
actaaatgtgtaca

SEQ ID NO: 3030195 - DNA, 19 bp, Homo sapiens
actaaccacattttaggat

SEQ ID NO: 3030196 - DNA, 21 bp, Homo sapiens
actaaccacattttaggatct

SEQ ID NO: 3030197 - DNA, 13 bp, Homo sapiens
actaaccttttat

SEQ ID NO: 3030198 - DNA, 22 bp, Homo sapiens
actaactaaccacattttagga

SEQ ID NO: 3030199 - DNA, 23 bp, Homo sapiens
actaactaaccacattttaggat

SEQ ID NO: 3030200 - DNA, 23 bp, Homo sapiens
actaactatgcatggtgccccag

SEQ ID NO: 3030201 - DNA, 17 bp, Homo sapiens
actaacttgacttttaa

SEQ ID NO: 3030202 - DNA, 12 bp, Homo sapiens
actaagaagtgg

SEQ ID NO: 3030203 - DNA, 16 bp, Homo sapiens
actaagaattcaaact

SEQ ID NO: 3030204 - DNA, 17 bp, Homo sapiens
actaagatgacattgct

SEQ ID NO: 3030205 - DNA, 18 bp, Homo sapiens
actaagatgacattgcta

SEQ ID NO: 3030206 - DNA, 14 bp, Homo sapiens
actaagcagaggag

SEQ ID NO: 3030207 - DNA, 11 bp, Homo sapiens
actaagccagg

SEQ ID NO: 3030208 - DNA, 12 bp, Homo sapiens
actaagccagga

SEQ ID NO: 3030209 - DNA, 16 bp, Homo sapiens
actaagccaggaggct

SEQ ID NO: 3030210 - DNA, 21 bp, Homo sapiens
actaaggggcccggccagcca

SEQ ID NO: 3030211 - DNA, 19 bp, Homo sapiens
actaaggtgactttctgaa

SEQ ID NO: 3030212 - DNA, 20 bp, Homo sapiens
actaaggtgactttctgaaa

SEQ ID NO: 3030213 - DNA, 17 bp, Homo sapiens
actaaggtgctaaatct

SEQ ID NO: 3030214 - DNA, 15 bp, Homo sapiens
actaagttattgtta

SEQ ID NO: 3030215 - DNA, 22 bp, Homo sapiens
actaagtttccttttaattcta

SEQ ID NO: 3030216 - DNA, 13 bp, Homo sapiens
actaagttttgtg

SEQ ID NO: 3030217 - DNA, 20 bp, Homo sapiens
actaagttttgtgtgtatat

SEQ ID NO: 3030218 - DNA, 19 bp, Homo sapiens
actaatccaatacctcttg

SEQ ID NO: 3030219 - DNA, 21 bp, Homo sapiens
actaatccaatacctcttgga

SEQ ID NO: 3030220 - DNA, 19 bp, Homo sapiens
actaatgttagaattgatt

SEQ ID NO: 3030221 - DNA, 17 bp, Homo sapiens
actaattatactacttt

SEQ ID NO: 3030222 - DNA, 13 bp, Homo sapiens
actaattccacac

SEQ ID NO: 3030223 - DNA, 15 bp, Homo sapiens
actaattccacacct

SEQ ID NO: 3030224 - DNA, 22 bp, Homo sapiens
actaattgtataacaggttatt

SEQ ID NO: 3030225 - DNA, 15 bp, Homo sapiens
actaattttaaaatg

SEQ ID NO: 3030226 - DNA, 16 bp, Homo sapiens
actacaaccaatggaa

SEQ ID NO: 3030227 - DNA, 20 bp, Homo sapiens
actacacagtctgcaagatt

SEQ ID NO: 3030228 - DNA, 20 bp, Homo sapiens
actacatgagaacaaacaga

SEQ ID NO: 3030229 - DNA, 13 bp, Homo sapiens
actacattttttc

SEQ ID NO: 3030230 - DNA, 19 bp, Homo sapiens
actaccagtgggcatgtat

SEQ ID NO: 3030231 - DNA, 20 bp, Homo sapiens
actacccaaaacaagcctgg

SEQ ID NO: 3030232 - DNA, 12 bp, Homo sapiens
actacctagaag

SEQ ID NO: 3030233 - DNA, 21 bp, Homo sapiens
actacctgccctcagcttgga

SEQ ID NO: 3030234 - DNA, 19 bp, Homo sapiens
actacctgtgagcatggga

SEQ ID NO: 3030235 - DNA, 18 bp, Homo sapiens
actaccttggttccccca

SEQ ID NO: 3030236 - DNA, 16 bp, Homo sapiens
actactactgttatca

SEQ ID NO: 3030237 - DNA, 14 bp, Homo sapiens
actactatttttct

SEQ ID NO: 3030238 - DNA, 10 bp, Homo sapiens
actgctacac

SEQ ID NO: 3030239 - DNA, 14 bp, Homo sapiens
actgctcagctctg

SEQ ID NO: 3030240 - DNA, 17 bp, Homo sapiens
actgctcagctctggtc

SEQ ID NO: 3030241 - DNA, 18 bp, Homo sapiens
actgctgagatacataca

SEQ ID NO: 3030242 - DNA, 23 bp, Homo sapiens
actgctgatgctgaaataaacta

SEQ ID NO: 3030243 - DNA, 14 bp, Homo sapiens
actgctgcctcagc

SEQ ID NO: 3030244 - DNA, 15 bp, Homo sapiens
actgctgcctcagct

SEQ ID NO: 3030245 - DNA, 16 bp, Homo sapiens
actgctgcctcagctc

SEQ ID NO: 3030246 - DNA, 12 bp, Homo sapiens
actgctgctccc

SEQ ID NO: 3030247 - DNA, 12 bp, Homo sapiens
actgctgctcct

SEQ ID NO: 3030248 - DNA, 15 bp, Homo sapiens
actgctgctcctctt

SEQ ID NO: 3030249 - DNA, 10 bp, Homo sapiens
actgctggct

SEQ ID NO: 3030250 - DNA, 15 bp, Homo sapiens
actgctggggctggt

SEQ ID NO: 3030251 - DNA, 18 bp, Homo sapiens
actgctggggctggtgag

SEQ ID NO: 3030252 - DNA, 14 bp, Homo sapiens
actgctgtctctta

SEQ ID NO: 3030253 - DNA, 19 bp, Homo sapiens
actgcttcctctgaatatt

SEQ ID NO: 3030254 - DNA, 18 bp, Homo sapiens
actgcttctcggccagcc

SEQ ID NO: 3030255 - DNA, 18 bp, Homo sapiens
actgcttcttatggtggt

SEQ ID NO: 3030256 - DNA, 16 bp, Homo sapiens
actgcttgagcatcag

SEQ ID NO: 3030257 - DNA, 18 bp, Homo sapiens
actgcttgaggaaaacaa

SEQ ID NO: 3030258 - DNA, 22 bp, Homo sapiens
actgcttgcttacaatctttat

SEQ ID NO: 3030259 - DNA, 13 bp, Homo sapiens
actgcttggagct

SEQ ID NO: 3030260 - DNA, 20 bp, Homo sapiens
actgcttttgcccatataaa

SEQ ID NO: 3030261 - DNA, 18 bp, Homo sapiens
actggaaaaatgaactgt

SEQ ID NO: 3030262 - DNA, 15 bp, Homo sapiens
actggaaaggaaaga

SEQ ID NO: 3030263 - DNA, 19 bp, Homo sapiens
actggaacatgcttttact

SEQ ID NO: 3030264 - DNA, 21 bp, Homo sapiens
actggaagcatgtaggagaat

SEQ ID NO: 3030265 - DNA, 16 bp, Homo sapiens
actggaagctaatttg

SEQ ID NO: 3030266 - DNA, 18 bp, Homo sapiens
actggactccggccctcc

SEQ ID NO: 3030267 - DNA, 19 bp, Homo sapiens
actggactccggccctcct

SEQ ID NO: 3030268 - DNA, 23 bp, Homo sapiens
actggagagtggcaaaagtctga

SEQ ID NO: 3030269 - DNA, 13 bp, Homo sapiens
actggagcaccag

SEQ ID NO: 3030270 - DNA, 20 bp, Homo sapiens
actggaggagagaagaatga

SEQ ID NO: 3030271 - DNA, 21 bp, Homo sapiens
actggagtggctcgccaggcc

SEQ ID NO: 3030272 - DNA, 23 bp, Homo sapiens
actggcactggtggtttttgctc

SEQ ID NO: 3030273 - DNA, 14 bp, Homo sapiens
actggcagactgtg

SEQ ID NO: 3030274 - DNA, 17 bp, Homo sapiens
actggcagcctgcacct

SEQ ID NO: 3030275 - DNA, 16 bp, Homo sapiens
actggcatagtttcat

SEQ ID NO: 3030276 - DNA, 23 bp, Homo sapiens
actggcattttatagacaccctg

SEQ ID NO: 3030277 - DNA, 21 bp, Homo sapiens
actggcatttttagctccttg

SEQ ID NO: 3030278 - DNA, 19 bp, Homo sapiens
actggccaagaaaattgcc

SEQ ID NO: 3030279 - DNA, 22 bp, Homo sapiens
actggccagggccacgctccag

SEQ ID NO: 3030280 - DNA, 17 bp, Homo sapiens
actggccgggcaggcgt

SEQ ID NO: 3030281 - DNA, 15 bp, Homo sapiens
actggccgtggctcc

SEQ ID NO: 3030282 - DNA, 17 bp, Homo sapiens
actggccgtggctccag

SEQ ID NO: 3030283 - DNA, 15 bp, Homo sapiens
actggcgccttctcg

SEQ ID NO: 3030284 - DNA, 21 bp, Homo sapiens
actggcgccttctcggagctg

SEQ ID NO: 3030285 - DNA, 14 bp, Homo sapiens
actggctacagtac

SEQ ID NO: 3030286 - DNA, 16 bp, Homo sapiens
actggctcatgcccct

SEQ ID NO: 3030287 - DNA, 9 bp, Homo sapiens
actggctga

SEQ ID NO: 3030288 - DNA, 17 bp, Homo sapiens
actggctgtcagtatga

SEQ ID NO: 3030289 - DNA, 15 bp, Homo sapiens
actggcttgtacatt

SEQ ID NO: 3030290 - DNA, 18 bp, Homo sapiens
actggcttgtacattttt

SEQ ID NO: 3030291 - DNA, 20 bp, Homo sapiens
actggcttgtacatttttaa

SEQ ID NO: 3030292 - DNA, 18 bp, Homo sapiens
actggcttttattaatgc

SEQ ID NO: 3030293 - DNA, 19 bp, Homo sapiens
actggcttttattaatgca

SEQ ID NO: 3030294 - DNA, 20 bp, Homo sapiens
actgggaagctggagtgctg

SEQ ID NO: 3030295 - DNA, 17 bp, Homo sapiens
actgggatcacaggtgt

SEQ ID NO: 3030296 - DNA, 19 bp, Homo sapiens
actgggcccaggcaggtct

SEQ ID NO: 3030297 - DNA, 20 bp, Homo sapiens
actgggcccaggcaggtctg

SEQ ID NO: 3030298 - DNA, 14 bp, Homo sapiens
actgggcccctcag

SEQ ID NO: 3030299 - DNA, 16 bp, Homo sapiens
actgggcccctcaggg

SEQ ID NO: 3030300 - DNA, 17 bp, Homo sapiens
actgggcctgtagctca

SEQ ID NO: 3030301 - DNA, 21 bp, Homo sapiens
actgggctaaggaagtatcag

SEQ ID NO: 3030302 - DNA, 20 bp, Homo sapiens
actgggctcaagtgatcctc

SEQ ID NO: 3030303 - DNA, 16 bp, Homo sapiens
actgggctctggctct

SEQ ID NO: 3030304 - DNA, 19 bp, Homo sapiens
actggggaaaactccacct

SEQ ID NO: 3030305 - DNA, 19 bp, Homo sapiens
actggggaggctgaggcag

SEQ ID NO: 3030306 - DNA, 21 bp, Homo sapiens
actggggcctacagctttgat

SEQ ID NO: 3030307 - DNA, 16 bp, Homo sapiens
actggggcctccagaa

SEQ ID NO: 3030308 - DNA, 19 bp, Homo sapiens
actggggctggggaaggaa

SEQ ID NO: 3030309 - DNA, 23 bp, Homo sapiens
actggggggaccaaatagccacc

SEQ ID NO: 3030310 - DNA, 14 bp, Homo sapiens
actgggtctgacct

SEQ ID NO: 3030311 - DNA, 19 bp, Homo sapiens
actgggtctgacctggtgg

SEQ ID NO: 3030312 - DNA, 20 bp, Homo sapiens
actgggtctgacctggtggg

SEQ ID NO: 3030313 - DNA, 15 bp, Homo sapiens
actggtaattgtaca

SEQ ID NO: 3030314 - DNA, 11 bp, Homo sapiens
actggtaccat

SEQ ID NO: 3030315 - DNA, 18 bp, Homo sapiens
actggtatgaataattgc

SEQ ID NO: 3030316 - DNA, 20 bp, Homo sapiens
actggtgagagaagaaaaca

SEQ ID NO: 3030317 - DNA, 22 bp, Homo sapiens
actggtgagagaagaaaacatt

SEQ ID NO: 3030318 - DNA, 17 bp, Homo sapiens
actggtgtaatctcaat

SEQ ID NO: 3030319 - DNA, 21 bp, Homo sapiens
actggttatcctgtgctacag

SEQ ID NO: 3030320 - DNA, 22 bp, Homo sapiens
actggttatcttgttattattg

SEQ ID NO: 3030321 - DNA, 14 bp, Homo sapiens
actggttcacctga

SEQ ID NO: 3030322 - DNA, 17 bp, Homo sapiens
actggttctcaatgaaa

SEQ ID NO: 3030323 - DNA, 14 bp, Homo sapiens
actggttcttgcct

SEQ ID NO: 3030324 - DNA, 15 bp, Homo sapiens
actggttcttgcctt

SEQ ID NO: 3030325 - DNA, 20 bp, Homo sapiens
actggtttgaagaatgttaa

SEQ ID NO: 3030326 - DNA, 16 bp, Homo sapiens
actggttttacttaca

SEQ ID NO: 3030327 - DNA, 13 bp, Homo sapiens
actgtaaagaaag

SEQ ID NO: 3030328 - DNA, 15 bp, Homo sapiens
actgtaaagaaagag

SEQ ID NO: 3030329 - DNA, 21 bp, Homo sapiens
actgtaaagaaagagagaaaa

SEQ ID NO: 3030330 - DNA, 23 bp, Homo sapiens
actgtaaagaaagagagaaaata

SEQ ID NO: 3030331 - DNA, 13 bp, Homo sapiens
actgtaaagcaaa

SEQ ID NO: 3030332 - DNA, 17 bp, Homo sapiens
actgtaaatatgaatct

SEQ ID NO: 3030333 - DNA, 12 bp, Homo sapiens
actgtaaatcat

SEQ ID NO: 3030334 - DNA, 13 bp, Homo sapiens
actgtaaattttt

SEQ ID NO: 3030335 - DNA, 20 bp, Homo sapiens
actgtaagaataatttatag

SEQ ID NO: 3030336 - DNA, 19 bp, Homo sapiens
actgtaccatatagcaaaa

SEQ ID NO: 3030337 - DNA, 12 bp, Homo sapiens
actgtactgaat

SEQ ID NO: 3030338 - DNA, 15 bp, Homo sapiens
actgtagaactgatt

SEQ ID NO: 3030339 - DNA, 21 bp, Homo sapiens
actgtagaactgattttacaa

SEQ ID NO: 3030340 - DNA, 13 bp, Homo sapiens
actgtagatgatg

SEQ ID NO: 3030341 - DNA, 17 bp, Homo sapiens
actgtagcctggatatt

SEQ ID NO: 3030342 - DNA, 17 bp, Homo sapiens
actgtagttctaagact

SEQ ID NO: 3030343 - DNA, 23 bp, Homo sapiens
actgtatgggggagattgaactt

SEQ ID NO: 3030344 - DNA, 14 bp, Homo sapiens
actgtatgtgatga

SEQ ID NO: 3030345 - DNA, 16 bp, Homo sapiens
actgtatgtgatgaat

SEQ ID NO: 3030346 - DNA, 20 bp, Homo sapiens
actgtattcgtgcatttttg

SEQ ID NO: 3030347 - DNA, 21 bp, Homo sapiens
actgtatttaaggaatcaaat

SEQ ID NO: 3030348 - DNA, 13 bp, Homo sapiens
actgtatttgtga

SEQ ID NO: 3030349 - DNA, 17 bp, Homo sapiens
actgtatttgtgactaa

SEQ ID NO: 3030350 - DNA, 20 bp, Homo sapiens
actgtatttgtgactaattg

SEQ ID NO: 3030351 - DNA, 20 bp, Homo sapiens
actgtattttgttttccttt

SEQ ID NO: 3030352 - DNA, 20 bp, Homo sapiens
actgtatttttacctttttc

SEQ ID NO: 3030353 - DNA, 13 bp, Homo sapiens
actgtcactgccg

SEQ ID NO: 3030354 - DNA, 12 bp, Homo sapiens
actgtccctcct

SEQ ID NO: 3030355 - DNA, 13 bp, Homo sapiens
actgtccctcctg

SEQ ID NO: 3030356 - DNA, 22 bp, Homo sapiens
actgtccctgctttctggtata

SEQ ID NO: 3030357 - DNA, 17 bp, Homo sapiens
actgtcctgggcctgca

SEQ ID NO: 3030358 - DNA, 17 bp, Homo sapiens
actgtcggaggaaagac

SEQ ID NO: 3030359 - DNA, 20 bp, Homo sapiens
actgtcggaggaaagacaac

SEQ ID NO: 3030360 - DNA, 18 bp, Homo sapiens
actgtctagagcaacttt

SEQ ID NO: 3030361 - DNA, 22 bp, Homo sapiens
actgtctccatggccctgcaaa

SEQ ID NO: 3030362 - DNA, 19 bp, Homo sapiens
actgtcttaaatcagttta

SEQ ID NO: 3030363 - DNA, 20 bp, Homo sapiens
actgtgaagttacatgcata

SEQ ID NO: 3030364 - DNA, 23 bp, Homo sapiens
actgtgacacactacaccacaca

SEQ ID NO: 3030365 - DNA, 19 bp, Homo sapiens
actgtgacccccagctccg

SEQ ID NO: 3030366 - DNA, 12 bp, Homo sapiens
actgtgagactg

SEQ ID NO: 3030367 - DNA, 13 bp, Homo sapiens
actgtgatgaagc

SEQ ID NO: 3030368 - DNA, 18 bp, Homo sapiens
actgtgatgccctgccct

SEQ ID NO: 3030369 - DNA, 23 bp, Homo sapiens
actgtgatgttgggaagctattt

SEQ ID NO: 3030370 - DNA, 16 bp, Homo sapiens
agaacagatcttttac

SEQ ID NO: 3030371 - DNA, 20 bp, Homo sapiens
agaacagctgttcctgtgtt

SEQ ID NO: 3030372 - DNA, 19 bp, Homo sapiens
agaacatccctgccagctc

SEQ ID NO: 3030373 - DNA, 14 bp, Homo sapiens
agaacatgcagttt

SEQ ID NO: 3030374 - DNA, 19 bp, Homo sapiens
agaacatgcagtttgaaat

SEQ ID NO: 3030375 - DNA, 22 bp, Homo sapiens
agaacatgcagtttgaaattct

SEQ ID NO: 3030376 - DNA, 18 bp, Homo sapiens
agaacatggtgtgtgtct

SEQ ID NO: 3030377 - DNA, 13 bp, Homo sapiens
agaaccaaattaa

SEQ ID NO: 3030378 - DNA, 15 bp, Homo sapiens
agaacccttctgctt

SEQ ID NO: 3030379 - DNA, 17 bp, Homo sapiens
agaacctaactgtatct

SEQ ID NO: 3030380 - DNA, 18 bp, Homo sapiens
agaacctcacgcacctcc

SEQ ID NO: 3030381 - DNA, 13 bp, Homo sapiens
agaacctggaact

SEQ ID NO: 3030382 - DNA, 20 bp, Homo sapiens
agaacctggaacttggggag

SEQ ID NO: 3030383 - DNA, 21 bp, Homo sapiens
agaacctgggttgcagacagg

SEQ ID NO: 3030384 - DNA, 14 bp, Homo sapiens
agaaccttctctat

SEQ ID NO: 3030385 - DNA, 22 bp, Homo sapiens
agaacgtattggtccagcttgc

SEQ ID NO: 3030386 - DNA, 19 bp, Homo sapiens
agaacgtggctctgctggc

SEQ ID NO: 3030387 - DNA, 12 bp, Homo sapiens
agaactaaactc

SEQ ID NO: 3030388 - DNA, 16 bp, Homo sapiens
agaactaaactcattt

SEQ ID NO: 3030389 - DNA, 18 bp, Homo sapiens
agaactaaactcatttat

SEQ ID NO: 3030390 - DNA, 20 bp, Homo sapiens
agaactcaaacttctggctc

SEQ ID NO: 3030391 - DNA, 20 bp, Homo sapiens
agaactcaaatggggccaga

SEQ ID NO: 3030392 - DNA, 14 bp, Homo sapiens
agaactcactgggg

SEQ ID NO: 3030393 - DNA, 23 bp, Homo sapiens
agaactcatcactgtggctgtct

SEQ ID NO: 3030394 - DNA, 14 bp, Homo sapiens
agaactctctgtct

SEQ ID NO: 3030395 - DNA, 23 bp, Homo sapiens
agaactctctgtcttctctccac

SEQ ID NO: 3030396 - DNA, 10 bp, Homo sapiens
agaactgaaa

SEQ ID NO: 3030397 - DNA, 15 bp, Homo sapiens
agaactgaaaagaga

SEQ ID NO: 3030398 - DNA, 16 bp, Homo sapiens
agaactgattttacaa

SEQ ID NO: 3030399 - DNA, 19 bp, Homo sapiens
agaactgcacatgaagaaa

SEQ ID NO: 3030400 - DNA, 20 bp, Homo sapiens
agaactgcacatgaagaaat

SEQ ID NO: 3030401 - DNA, 21 bp, Homo sapiens
agaactgcacatgaagaaata

SEQ ID NO: 3030402 - DNA, 13 bp, Homo sapiens
agaactgctgggg

SEQ ID NO: 3030403 - DNA, 14 bp, Homo sapiens
agaactgctggggc

SEQ ID NO: 3030404 - DNA, 15 bp, Homo sapiens
agaactgctggggct

SEQ ID NO: 3030405 - DNA, 17 bp, Homo sapiens
agaactggttcttgcct

SEQ ID NO: 3030406 - DNA, 18 bp, Homo sapiens
agaactggttcttgcctt

SEQ ID NO: 3030407 - DNA, 19 bp, Homo sapiens
agaactgtactgttttctg

SEQ ID NO: 3030408 - DNA, 19 bp, Homo sapiens
agaactgtcggaggaaaga

SEQ ID NO: 3030409 - DNA, 14 bp, Homo sapiens
agaacttcacagtg

SEQ ID NO: 3030410 - DNA, 15 bp, Homo sapiens
agaacttgaccctga

SEQ ID NO: 3030411 - DNA, 18 bp, Homo sapiens
agaacttggatgtacctg

SEQ ID NO: 3030412 - DNA, 23 bp, Homo sapiens
agaacttggatgtacctgccccc

SEQ ID NO: 3030413 - DNA, 20 bp, Homo sapiens
agaactttgagctactgccg

SEQ ID NO: 3030414 - DNA, 23 bp, Homo sapiens
agaagaaaatggaaccaggcttg

SEQ ID NO: 3030415 - DNA, 20 bp, Homo sapiens
agaagaaaggccaaggtgct

SEQ ID NO: 3030416 - DNA, 16 bp, Homo sapiens
agaagaagtcagagag

SEQ ID NO: 3030417 - DNA, 17 bp, Homo sapiens
agaagaagtcagagagg

SEQ ID NO: 3030418 - DNA, 20 bp, Homo sapiens
agaagaattgaacccaggag

SEQ ID NO: 3030419 - DNA, 15 bp, Homo sapiens
agaagacaattgaca

SEQ ID NO: 3030420 - DNA, 14 bp, Homo sapiens
agaagacatgtttt

SEQ ID NO: 3030421 - DNA, 15 bp, Homo sapiens
agaagacatgtttta

SEQ ID NO: 3030422 - DNA, 17 bp, Homo sapiens
agaagacatgttttaga

SEQ ID NO: 3030423 - DNA, 14 bp, Homo sapiens
agaagacccttctc

SEQ ID NO: 3030424 - DNA, 18 bp, Homo sapiens
agaagactcctaggccct

SEQ ID NO: 3030425 - DNA, 19 bp, Homo sapiens
agaagactcctaggccctt

SEQ ID NO: 3030426 - DNA, 22 bp, Homo sapiens
agaagagaatattagctttact

SEQ ID NO: 3030427 - DNA, 15 bp, Homo sapiens
agaagagagaaatag

SEQ ID NO: 3030428 - DNA, 13 bp, Homo sapiens
agaagagccacag

SEQ ID NO: 3030429 - DNA, 14 bp, Homo sapiens
agaagagccacagt

SEQ ID NO: 3030430 - DNA, 22 bp, Homo sapiens
agaagagccacagtgagggaga

SEQ ID NO: 3030431 - DNA, 15 bp, Homo sapiens
agaagaggagcctca

SEQ ID NO: 3030432 - DNA, 20 bp, Homo sapiens
agaagaggagcctcagaaga

SEQ ID NO: 3030433 - DNA, 21 bp, Homo sapiens
agaagaggagcctcagaagaa

SEQ ID NO: 3030434 - DNA, 13 bp, Homo sapiens
agaagagggggag

SEQ ID NO: 3030435 - DNA, 20 bp, Homo sapiens
agaagagggggaggggaagc

SEQ ID NO: 3030436 - DNA, 20 bp, Homo sapiens
agaagagtttttattacaaa

SEQ ID NO: 3030437 - DNA, 17 bp, Homo sapiens
agaagatagtgagattt

SEQ ID NO: 3030438 - DNA, 14 bp, Homo sapiens
agaagatcctgtca

SEQ ID NO: 3030439 - DNA, 13 bp, Homo sapiens
agaagatgaatgg

SEQ ID NO: 3030440 - DNA, 14 bp, Homo sapiens
agaagatgctccag

SEQ ID NO: 3030441 - DNA, 23 bp, Homo sapiens
agaagatgctccagcaacacagc

SEQ ID NO: 3030442 - DNA, 19 bp, Homo sapiens
agaagatggttagaaccag

SEQ ID NO: 3030443 - DNA, 21 bp, Homo sapiens
agaagcaattatttaaagaaa

SEQ ID NO: 3030444 - DNA, 22 bp, Homo sapiens
agaagcaattatttaaagaaag

SEQ ID NO: 3030445 - DNA, 10 bp, Homo sapiens
agaagcagcg

SEQ ID NO: 3030446 - DNA, 12 bp, Homo sapiens
agaagcagctct

SEQ ID NO: 3030447 - DNA, 23 bp, Homo sapiens
agaagcagtgagccgcatcttct

SEQ ID NO: 3030448 - DNA, 14 bp, Homo sapiens
agaagccacagaaa

SEQ ID NO: 3030449 - DNA, 17 bp, Homo sapiens
agaagccacccttccct

SEQ ID NO: 3030450 - DNA, 21 bp, Homo sapiens
agaagccacccttccctgcct

SEQ ID NO: 3030451 - DNA, 22 bp, Homo sapiens
agaagccaggaatttcccagga

SEQ ID NO: 3030452 - DNA, 22 bp, Homo sapiens
agaagccatggaaaaacttcct

SEQ ID NO: 3030453 - DNA, 15 bp, Homo sapiens
agaagccattgtctt

SEQ ID NO: 3030454 - DNA, 20 bp, Homo sapiens
agaagccattgtcttcggaa

SEQ ID NO: 3030455 - DNA, 23 bp, Homo sapiens
agaagcccccagctaagaacctg

SEQ ID NO: 3030456 - DNA, 15 bp, Homo sapiens
agaagccctgttctc

SEQ ID NO: 3030457 - DNA, 16 bp, Homo sapiens
agaagccctgttctcg

SEQ ID NO: 3030458 - DNA, 17 bp, Homo sapiens
agaagcctaattgtcac

SEQ ID NO: 3030459 - DNA, 21 bp, Homo sapiens
agaagcctaattgtcacatca

SEQ ID NO: 3030460 - DNA, 20 bp, Homo sapiens
agaagcctccttacattaaa

SEQ ID NO: 3030461 - DNA, 21 bp, Homo sapiens
agaagcctccttacattaaaa

SEQ ID NO: 3030462 - DNA, 23 bp, Homo sapiens
agaagcctctgggtcagtggtcc

SEQ ID NO: 3030463 - DNA, 17 bp, Homo sapiens
agaagcctgatgctgac

SEQ ID NO: 3030464 - DNA, 21 bp, Homo sapiens
agaagcctgatgctgacattc

SEQ ID NO: 3030465 - DNA, 19 bp, Homo sapiens
agaagcgatttaagttaca

SEQ ID NO: 3030466 - DNA, 20 bp, Homo sapiens
agaagctcctctccccagcc

SEQ ID NO: 3030467 - DNA, 19 bp, Homo sapiens
agaagctctcgggctagga

SEQ ID NO: 3030468 - DNA, 15 bp, Homo sapiens
agaaggaaaaaggat

SEQ ID NO: 3030469 - DNA, 15 bp, Homo sapiens
agaaggagaaggaag

SEQ ID NO: 3030470 - DNA, 16 bp, Homo sapiens
agaaggagacaggcag

SEQ ID NO: 3030471 - DNA, 15 bp, Homo sapiens
agaaggcaaaaatgt

SEQ ID NO: 3030472 - DNA, 21 bp, Homo sapiens
agaaggcaacttgaagaaacg

SEQ ID NO: 3030473 - DNA, 23 bp, Homo sapiens
agaaggcaacttgaagaaacgct

SEQ ID NO: 3030474 - DNA, 18 bp, Homo sapiens
agaaggcatttgcagggt

SEQ ID NO: 3030475 - DNA, 19 bp, Homo sapiens
agaaggctagaaaaaaaga

SEQ ID NO: 3030476 - DNA, 20 bp, Homo sapiens
agaagggagacattgtttgg

SEQ ID NO: 3030477 - DNA, 19 bp, Homo sapiens
agaagggagctagccagag

SEQ ID NO: 3030478 - DNA, 18 bp, Homo sapiens
agaaggtggacctggcag

SEQ ID NO: 3030479 - DNA, 19 bp, Homo sapiens
agaaggtggacctggcagt

SEQ ID NO: 3030480 - DNA, 18 bp, Homo sapiens
agaaggttaccaagaagc

SEQ ID NO: 3030481 - DNA, 17 bp, Homo sapiens
agaaggttgacacagtt

SEQ ID NO: 3030482 - DNA, 21 bp, Homo sapiens
agaagtaacttattttgtact

SEQ ID NO: 3030483 - DNA, 14 bp, Homo sapiens
agaagtatggaatt

SEQ ID NO: 3030484 - DNA, 15 bp, Homo sapiens
agaagtattgtttac

SEQ ID NO: 3030485 - DNA, 22 bp, Homo sapiens
agaagtcagagagggtgacaag

SEQ ID NO: 3030486 - DNA, 19 bp, Homo sapiens
agaagtcctgtatgtctgt

SEQ ID NO: 3030487 - DNA, 12 bp, Homo sapiens
agaagtgacagg

SEQ ID NO: 3030488 - DNA, 14 bp, Homo sapiens
agaagtgacaggga

SEQ ID NO: 3030489 - DNA, 16 bp, Homo sapiens
agaagtgacagggaag

SEQ ID NO: 3030490 - DNA, 23 bp, Homo sapiens
agaagtgacagggaagctacagg

SEQ ID NO: 3030491 - DNA, 21 bp, Homo sapiens
agaagtgagaataggcagccc

SEQ ID NO: 3030492 - DNA, 19 bp, Homo sapiens
agaagtgcatgaaaaacca

SEQ ID NO: 3030493 - DNA, 18 bp, Homo sapiens
agaagtggaccaggacag

SEQ ID NO: 3030494 - DNA, 17 bp, Homo sapiens
agaagtgggccaggaca

SEQ ID NO: 3030495 - DNA, 18 bp, Homo sapiens
agaagtgggccaggacag

SEQ ID NO: 3030496 - DNA, 19 bp, Homo sapiens
agaagtggggaccccaccc

SEQ ID NO: 3030497 - DNA, 16 bp, Homo sapiens
agaagtgtagtatgct

SEQ ID NO: 3030498 - DNA, 15 bp, Homo sapiens
agaagtgtcatgttt

SEQ ID NO: 3030499 - DNA, 14 bp, Homo sapiens
agaagtgtgattgg

SEQ ID NO: 3030500 - DNA, 22 bp, Homo sapiens
agaagtgtgattgggaataaat

SEQ ID NO: 3030501 - DNA, 13 bp, Homo sapiens
agagccagagaag

SEQ ID NO: 3030502 - DNA, 12 bp, Homo sapiens
agagccagccct

SEQ ID NO: 3030503 - DNA, 14 bp, Homo sapiens
agagccagccctcc

SEQ ID NO: 3030504 - DNA, 20 bp, Homo sapiens
agagccagccctccctgtcc

SEQ ID NO: 3030505 - DNA, 22 bp, Homo sapiens
agagccagccctccctgtcctc

SEQ ID NO: 3030506 - DNA, 15 bp, Homo sapiens
agagccagcggctcc

SEQ ID NO: 3030507 - DNA, 18 bp, Homo sapiens
agagccagcggctccaac

SEQ ID NO: 3030508 - DNA, 19 bp, Homo sapiens
agagccagcggctccaact

SEQ ID NO: 3030509 - DNA, 22 bp, Homo sapiens
agagccaggggggtgaggagct

SEQ ID NO: 3030510 - DNA, 22 bp, Homo sapiens
agagccatataagtttgaagga

SEQ ID NO: 3030511 - DNA, 17 bp, Homo sapiens
agagcccagcccaggag

SEQ ID NO: 3030512 - DNA, 11 bp, Homo sapiens
agagcccagct

SEQ ID NO: 3030513 - DNA, 13 bp, Homo sapiens
agagcccagctcc

SEQ ID NO: 3030514 - DNA, 13 bp, Homo sapiens
agagcccagctct

SEQ ID NO: 3030515 - DNA, 18 bp, Homo sapiens
agagcccagctcttgctc

SEQ ID NO: 3030516 - DNA, 22 bp, Homo sapiens
agagccgggcacattgagctgt

SEQ ID NO: 3030517 - DNA, 15 bp, Homo sapiens
agagcctgaatttgt

SEQ ID NO: 3030518 - DNA, 13 bp, Homo sapiens
agagcctgctccc

SEQ ID NO: 3030519 - DNA, 15 bp, Homo sapiens
agagcctgtccccgc

SEQ ID NO: 3030520 - DNA, 17 bp, Homo sapiens
agagcctgtccccgcct

SEQ ID NO: 3030521 - DNA, 19 bp, Homo sapiens
agagccttggtgtccacct

SEQ ID NO: 3030522 - DNA, 20 bp, Homo sapiens
agagccttggtgtccacctg

SEQ ID NO: 3030523 - DNA, 11 bp, Homo sapiens
agagcctttga

SEQ ID NO: 3030524 - DNA, 14 bp, Homo sapiens
agagcgcctgcccc

SEQ ID NO: 3030525 - DNA, 14 bp, Homo sapiens
agagcgcggctggc

SEQ ID NO: 3030526 - DNA, 18 bp, Homo sapiens
agagcgcggctggctctg

SEQ ID NO: 3030527 - DNA, 12 bp, Homo sapiens
agagcggaggag

SEQ ID NO: 3030528 - DNA, 15 bp, Homo sapiens
agagcgggagggagt

SEQ ID NO: 3030529 - DNA, 14 bp, Homo sapiens
agagctaataaatc

SEQ ID NO: 3030530 - DNA, 17 bp, Homo sapiens
agagctcaagggacaag

SEQ ID NO: 3030531 - DNA, 20 bp, Homo sapiens
agagctcccctacggaccag

SEQ ID NO: 3030532 - DNA, 21 bp, Homo sapiens
agagctcccctacggaccagg

SEQ ID NO: 3030533 - DNA, 14 bp, Homo sapiens
agagctctgaccca

SEQ ID NO: 3030534 - DNA, 22 bp, Homo sapiens
agagctctgacccacagcctcc

SEQ ID NO: 3030535 - DNA, 23 bp, Homo sapiens
agagctctgacccacagcctcca

SEQ ID NO: 3030536 - DNA, 16 bp, Homo sapiens
agagctgagccagttg

SEQ ID NO: 3030537 - DNA, 21 bp, Homo sapiens
agagctgagccagttgtccta

SEQ ID NO: 3030538 - DNA, 17 bp, Homo sapiens
agagctgagggccctgt

SEQ ID NO: 3030539 - DNA, 18 bp, Homo sapiens
agagctgagggccctgtg

SEQ ID NO: 3030540 - DNA, 19 bp, Homo sapiens
agagctgagggccctgtgg

SEQ ID NO: 3030541 - DNA, 21 bp, Homo sapiens
agagctgatgtgagtgtgtgt

SEQ ID NO: 3030542 - DNA, 23 bp, Homo sapiens
agagctgatgtgagtgtgtgtga

SEQ ID NO: 3030543 - DNA, 12 bp, Homo sapiens
agagctgccact

SEQ ID NO: 3030544 - DNA, 22 bp, Homo sapiens
agagctgccactgggcacctgc

SEQ ID NO: 3030545 - DNA, 16 bp, Homo sapiens
agagctgccatcgctg

SEQ ID NO: 3030546 - DNA, 21 bp, Homo sapiens
agagctgcctccccaatccat

SEQ ID NO: 3030547 - DNA, 20 bp, Homo sapiens
agagctgcgggctgagggca

SEQ ID NO: 3030548 - DNA, 23 bp, Homo sapiens
agagctgcgggctgagggcatct

SEQ ID NO: 3030549 - DNA, 20 bp, Homo sapiens
agagctgggaaattcatgtg

SEQ ID NO: 3030550 - DNA, 21 bp, Homo sapiens
agagctgggatcccacagccc

SEQ ID NO: 3030551 - DNA, 19 bp, Homo sapiens
agagctgtattaagccact

SEQ ID NO: 3030552 - DNA, 17 bp, Homo sapiens
agagcttccagagctct

SEQ ID NO: 3030553 - DNA, 13 bp, Homo sapiens
agagcttccctga

SEQ ID NO: 3030554 - DNA, 15 bp, Homo sapiens
agagctttctgcctt

SEQ ID NO: 3030555 - DNA, 20 bp, Homo sapiens
agagcttttcgaactgtgct

SEQ ID NO: 3030556 - DNA, 18 bp, Homo sapiens
agaggaaaaaaattacaa

SEQ ID NO: 3030557 - DNA, 16 bp, Homo sapiens
agaggaagagacactc

SEQ ID NO: 3030558 - DNA, 13 bp, Homo sapiens
agaggaaggaccc

SEQ ID NO: 3030559 - DNA, 16 bp, Homo sapiens
agaggaaggacccctc

SEQ ID NO: 3030560 - DNA, 15 bp, Homo sapiens
agaggaaggggccag

SEQ ID NO: 3030561 - DNA, 20 bp, Homo sapiens
agaggaaggggccagaggct

SEQ ID NO: 3030562 - DNA, 23 bp, Homo sapiens
agaggaaggggccagaggctcgt

SEQ ID NO: 3030563 - DNA, 13 bp, Homo sapiens
agaggaagggtgg

SEQ ID NO: 3030564 - DNA, 17 bp, Homo sapiens
agaggaatgaaaaaagc

SEQ ID NO: 3030565 - DNA, 18 bp, Homo sapiens
agaggaatgaaaaaagct

SEQ ID NO: 3030566 - DNA, 16 bp, Homo sapiens
agaggaatgatgggct

SEQ ID NO: 3030567 - DNA, 19 bp, Homo sapiens
agaggaatgatgggctttt

SEQ ID NO: 3030568 - DNA, 21 bp, Homo sapiens
agaggaatgatgggcttttgt

SEQ ID NO: 3030569 - DNA, 17 bp, Homo sapiens
agaggaccagggccttt

SEQ ID NO: 3030570 - DNA, 13 bp, Homo sapiens
agaggagagccag

SEQ ID NO: 3030571 - DNA, 15 bp, Homo sapiens
agaggagagccagag

SEQ ID NO: 3030572 - DNA, 16 bp, Homo sapiens
agaggagagccagaga

SEQ ID NO: 3030573 - DNA, 17 bp, Homo sapiens
agaggagagccagagaa

SEQ ID NO: 3030574 - DNA, 19 bp, Homo sapiens
agaggagcccagtgggctg

SEQ ID NO: 3030575 - DNA, 14 bp, Homo sapiens
agaggagcctcaga

SEQ ID NO: 3030576 - DNA, 15 bp, Homo sapiens
agaggagcctcagaa

SEQ ID NO: 3030577 - DNA, 16 bp, Homo sapiens
agaggagcctcagaag

SEQ ID NO: 3030578 - DNA, 21 bp, Homo sapiens
agaggagcctcagaagaaaac

SEQ ID NO: 3030579 - DNA, 23 bp, Homo sapiens
agaggagcctttttaaaacacat

SEQ ID NO: 3030580 - DNA, 15 bp, Homo sapiens
agaggagctgcttgt

SEQ ID NO: 3030581 - DNA, 13 bp, Homo sapiens
agaggaggagaaa

SEQ ID NO: 3030582 - DNA, 19 bp, Homo sapiens
agaggagggcgtgactcac

SEQ ID NO: 3030583 - DNA, 14 bp, Homo sapiens
agaggaggggccgc

SEQ ID NO: 3030584 - DNA, 18 bp, Homo sapiens
agaggaggggccgctgcc

SEQ ID NO: 3030585 - DNA, 15 bp, Homo sapiens
agaggagttctttgg

SEQ ID NO: 3030586 - DNA, 22 bp, Homo sapiens
agaggatgaaggctgtgaaaaa

SEQ ID NO: 3030587 - DNA, 20 bp, Homo sapiens
agaggcagaaaattgcacaa

SEQ ID NO: 3030588 - DNA, 14 bp, Homo sapiens
agaggcagtggcca

SEQ ID NO: 3030589 - DNA, 22 bp, Homo sapiens
agaggcataaacctgtgctgaa

SEQ ID NO: 3030590 - DNA, 16 bp, Homo sapiens
agaggcatttaaaatg

SEQ ID NO: 3030591 - DNA, 12 bp, Homo sapiens
agaggccccagc

SEQ ID NO: 3030592 - DNA, 13 bp, Homo sapiens
agaggccccagcc

SEQ ID NO: 3030593 - DNA, 16 bp, Homo sapiens
agaggccccagcctcc

SEQ ID NO: 3030594 - DNA, 24 bp, Homo sapiens
agaggccctctggagtggccacta

SEQ ID NO: 3030595 - DNA, 22 bp, Homo sapiens
agaggcctcttttcctgaagaa

SEQ ID NO: 3030596 - DNA, 22 bp, Homo sapiens
agaggcctgggggacccctggc

SEQ ID NO: 3030597 - DNA, 15 bp, Homo sapiens
agaggcctgttcata

SEQ ID NO: 3030598 - DNA, 22 bp, Homo sapiens
agaggcgtctcacatttttact

SEQ ID NO: 3030599 - DNA, 22 bp, Homo sapiens
agaggctcgttgactggctgtg

SEQ ID NO: 3030600 - DNA, 16 bp, Homo sapiens
agaggctgaggctggc

SEQ ID NO: 3030601 - DNA, 19 bp, Homo sapiens
agaggctgaggctggcaca

SEQ ID NO: 3030602 - DNA, 16 bp, Homo sapiens
agaggctgcagccagg

SEQ ID NO: 3030603 - DNA, 14 bp, Homo sapiens
agaggctgcctccg

SEQ ID NO: 3030604 - DNA, 20 bp, Homo sapiens
agaggctgcctccgcacctg

SEQ ID NO: 3030605 - DNA, 19 bp, Homo sapiens
agaggctggaggcagggcc

SEQ ID NO: 3030606 - DNA, 15 bp, Homo sapiens
agaggctgtgtccct

SEQ ID NO: 3030607 - DNA, 18 bp, Homo sapiens
agaggctgtgtccctgct

SEQ ID NO: 3030608 - DNA, 15 bp, Homo sapiens
agagggaagccagga

SEQ ID NO: 3030609 - DNA, 21 bp, Homo sapiens
agagggacggccaagaatgta

SEQ ID NO: 3030610 - DNA, 22 bp, Homo sapiens
agagggacggccaagaatgtac

SEQ ID NO: 3030611 - DNA, 17 bp, Homo sapiens
agagggaggcaagccct

SEQ ID NO: 3030612 - DNA, 16 bp, Homo sapiens
agagggaggggcctag

SEQ ID NO: 3030613 - DNA, 18 bp, Homo sapiens
agagggaggggcctaggc

SEQ ID NO: 3030614 - DNA, 16 bp, Homo sapiens
agagggatgggagagt

SEQ ID NO: 3030615 - DNA, 19 bp, Homo sapiens
agagggccacggggaggcc

SEQ ID NO: 3030616 - DNA, 18 bp, Homo sapiens
agagggcctctgcctggg

SEQ ID NO: 3030617 - DNA, 20 bp, Homo sapiens
agagggcctctgcctgggac

SEQ ID NO: 3030618 - DNA, 22 bp, Homo sapiens
agagggctttcagcgcccccag

SEQ ID NO: 3030619 - DNA, 23 bp, Homo sapiens
agagggctttcagcgcccccagg

SEQ ID NO: 3030620 - DNA, 17 bp, Homo sapiens
agaggggacgcaggccc

SEQ ID NO: 3030621 - DNA, 18 bp, Homo sapiens
agaggggacgcaggcccc

SEQ ID NO: 3030622 - DNA, 21 bp, Homo sapiens
agaggggcctgatgagactcc

SEQ ID NO: 3030623 - DNA, 21 bp, Homo sapiens
agaggggctgaatagcagaag

SEQ ID NO: 3030624 - DNA, 14 bp, Homo sapiens
agagggtgctgccc

SEQ ID NO: 3030625 - DNA, 23 bp, Homo sapiens
agagggtgctgccccatgaagcc

SEQ ID NO: 3030626 - DNA, 18 bp, Homo sapiens
agagggtgggtgttcata

SEQ ID NO: 3030627 - DNA, 19 bp, Homo sapiens
agagggttcacacagccca

SEQ ID NO: 3030628 - DNA, 21 bp, Homo sapiens
agagggttcacacagcccagt

SEQ ID NO: 3030629 - DNA, 12 bp, Homo sapiens
agaggtaaaaaa

SEQ ID NO: 3030630 - DNA, 16 bp, Homo sapiens
agaggtaaaaaaaaga

SEQ ID NO: 3030631 - DNA, 15 bp, Homo sapiens
agaggtaccctgggt

SEQ ID NO: 3030632 - DNA, 17 bp, Homo sapiens
agaggtgaaaatgaaga

SEQ ID NO: 3030633 - DNA, 20 bp, Homo sapiens
agcaagtcttaacaaaccaa

SEQ ID NO: 3030634 - DNA, 20 bp, Homo sapiens
agcaagttctgagagccagg

SEQ ID NO: 3030635 - DNA, 15 bp, Homo sapiens
agcaagttttcttcc

SEQ ID NO: 3030636 - DNA, 13 bp, Homo sapiens
agcaataaatgaa

SEQ ID NO: 3030637 - DNA, 17 bp, Homo sapiens
agcaatacgtttgtgca

SEQ ID NO: 3030638 - DNA, 14 bp, Homo sapiens
agcaatagaaacaa

SEQ ID NO: 3030639 - DNA, 17 bp, Homo sapiens
agcaatatgagacacag

SEQ ID NO: 3030640 - DNA, 17 bp, Homo sapiens
agcaatcagaacttcag

SEQ ID NO: 3030641 - DNA, 13 bp, Homo sapiens
agcaatctgaccc

SEQ ID NO: 3030642 - DNA, 15 bp, Homo sapiens
agcaatgcattctgg

SEQ ID NO: 3030643 - DNA, 15 bp, Homo sapiens
agcaatgcctgccca

SEQ ID NO: 3030644 - DNA, 16 bp, Homo sapiens
agcaatggatatttgt

SEQ ID NO: 3030645 - DNA, 18 bp, Homo sapiens
agcaattatttaaagaaa

SEQ ID NO: 3030646 - DNA, 23 bp, Homo sapiens
agcaatttaatattttgcacagt

SEQ ID NO: 3030647 - DNA, 24 bp, Homo sapiens
agcaatttaatattttgcacagtt

SEQ ID NO: 3030648 - DNA, 12 bp, Homo sapiens
agcacaaacaca

SEQ ID NO: 3030649 - DNA, 13 bp, Homo sapiens
agcacaaacacaa

SEQ ID NO: 3030650 - DNA, 15 bp, Homo sapiens
agcacaaacacaagg

SEQ ID NO: 3030651 - DNA, 16 bp, Homo sapiens
agcacaaacacaaggt

SEQ ID NO: 3030652 - DNA, 18 bp, Homo sapiens
agcacaaacacaaggtca

SEQ ID NO: 3030653 - DNA, 19 bp, Homo sapiens
agcacaactttaagaggac

SEQ ID NO: 3030654 - DNA, 22 bp, Homo sapiens
agcacaaggccttgcctggcct

SEQ ID NO: 3030655 - DNA, 19 bp, Homo sapiens
agcacaagttatttaaatc

SEQ ID NO: 3030656 - DNA, 21 bp, Homo sapiens
agcacaagttatttaaatctg

SEQ ID NO: 3030657 - DNA, 14 bp, Homo sapiens
agcacaatctgttc

SEQ ID NO: 3030658 - DNA, 14 bp, Homo sapiens
agcacactcatccc

SEQ ID NO: 3030659 - DNA, 17 bp, Homo sapiens
agcacactctggtcttg

SEQ ID NO: 3030660 - DNA, 15 bp, Homo sapiens
agcacagagaagaca

SEQ ID NO: 3030661 - DNA, 17 bp, Homo sapiens
agcacagagaagacaaa

SEQ ID NO: 3030662 - DNA, 10 bp, Homo sapiens
agcacagcag

SEQ ID NO: 3030663 - DNA, 12 bp, Homo sapiens
agcacagcagcc

SEQ ID NO: 3030664 - DNA, 13 bp, Homo sapiens
agcacagcagcct

SEQ ID NO: 3030665 - DNA, 23 bp, Homo sapiens
agcacagcagcctggggctggcc

SEQ ID NO: 3030666 - DNA, 23 bp, Homo sapiens
agcacagccaacacgcacctgcc

SEQ ID NO: 3030667 - DNA, 17 bp, Homo sapiens
agcacagtggtggcagg

SEQ ID NO: 3030668 - DNA, 17 bp, Homo sapiens
agcacatactacctaga

SEQ ID NO: 3030669 - DNA, 14 bp, Homo sapiens
agcacatcacctct

SEQ ID NO: 3030670 - DNA, 23 bp, Homo sapiens
agcacatgccagggaaaaagacc

SEQ ID NO: 3030671 - DNA, 21 bp, Homo sapiens
agcacatgttaccatgtctga

SEQ ID NO: 3030672 - DNA, 14 bp, Homo sapiens
agcaccaaataaat

SEQ ID NO: 3030673 - DNA, 20 bp, Homo sapiens
agcaccaccaggtctcccgg

SEQ ID NO: 3030674 - DNA, 21 bp, Homo sapiens
agcaccacggccagaagtaac

SEQ ID NO: 3030675 - DNA, 14 bp, Homo sapiens
agcaccagaatgta

SEQ ID NO: 3030676 - DNA, 20 bp, Homo sapiens
agcaccatccgccagggccc

SEQ ID NO: 3030677 - DNA, 17 bp, Homo sapiens
agcaccatggccttgat

SEQ ID NO: 3030678 - DNA, 18 bp, Homo sapiens
agcacccagtcctctgcc

SEQ ID NO: 3030679 - DNA, 16 bp, Homo sapiens
agcaccccctctcctg

SEQ ID NO: 3030680 - DNA, 19 bp, Homo sapiens
agcaccccctctcctggag

SEQ ID NO: 3030681 - DNA, 22 bp, Homo sapiens
agcaccccctctcctggagggc

SEQ ID NO: 3030682 - DNA, 13 bp, Homo sapiens
agcaccctgccct

SEQ ID NO: 3030683 - DNA, 21 bp, Homo sapiens
agcacccttgccatcccaagc

SEQ ID NO: 3030684 - DNA, 12 bp, Homo sapiens
agcaccgccggc

SEQ ID NO: 3030685 - DNA, 16 bp, Homo sapiens
agcaccgttctgtgca

SEQ ID NO: 3030686 - DNA, 18 bp, Homo sapiens
agcaccgttctgtgcaca

SEQ ID NO: 3030687 - DNA, 22 bp, Homo sapiens
agcacctgccgacctcgtcctc

SEQ ID NO: 3030688 - DNA, 13 bp, Homo sapiens
agcacctggaccc

SEQ ID NO: 3030689 - DNA, 22 bp, Homo sapiens
agcacctggaccccctgcccgc

SEQ ID NO: 3030690 - DNA, 21 bp, Homo sapiens
agcaccttatctatgatgttt

SEQ ID NO: 3030691 - DNA, 20 bp, Homo sapiens
agcaccttggcccaggagct

SEQ ID NO: 3030692 - DNA, 14 bp, Homo sapiens
agcacgcctgccat

SEQ ID NO: 3030693 - DNA, 15 bp, Homo sapiens
agcacgcctgccatc

SEQ ID NO: 3030694 - DNA, 16 bp, Homo sapiens
agcacgcctgccatct

SEQ ID NO: 3030695 - DNA, 17 bp, Homo sapiens
agcacgcctgccatctt

SEQ ID NO: 3030696 - DNA, 15 bp, Homo sapiens
agcacggcccggccc

SEQ ID NO: 3030697 - DNA, 21 bp, Homo sapiens
agcacggcccggcccctcacc

SEQ ID NO: 3030698 - DNA, 19 bp, Homo sapiens
agcacggtgactctgtcca

SEQ ID NO: 3030699 - DNA, 20 bp, Homo sapiens
agcactagaaattgggcagt

SEQ ID NO: 3030700 - DNA, 17 bp, Homo sapiens
agcactcaggctctcca

SEQ ID NO: 3030701 - DNA, 14 bp, Homo sapiens
agcactcctcggca

SEQ ID NO: 3030702 - DNA, 18 bp, Homo sapiens
agcactcctgatttttat

SEQ ID NO: 3030703 - DNA, 19 bp, Homo sapiens
agcactcctgatttttatc

SEQ ID NO: 3030704 - DNA, 15 bp, Homo sapiens
agcactctcacccca

SEQ ID NO: 3030705 - DNA, 19 bp, Homo sapiens
agcactgggaagctggagt

SEQ ID NO: 3030706 - DNA, 14 bp, Homo sapiens
agcacttaaacaga

SEQ ID NO: 3030707 - DNA, 14 bp, Homo sapiens
agcacttcccagga

SEQ ID NO: 3030708 - DNA, 15 bp, Homo sapiens
agcacttcccaggat

SEQ ID NO: 3030709 - DNA, 13 bp, Homo sapiens
agcacttgtatat

SEQ ID NO: 3030710 - DNA, 17 bp, Homo sapiens
agcactttaccagaggc

SEQ ID NO: 3030711 - DNA, 15 bp, Homo sapiens
agcactttgcaagga

SEQ ID NO: 3030712 - DNA, 18 bp, Homo sapiens
agcagaaaataaaggaag

SEQ ID NO: 3030713 - DNA, 20 bp, Homo sapiens
agcagaaggacaggtctctg

SEQ ID NO: 3030714 - DNA, 23 bp, Homo sapiens
agcagaaggacaggtctctgaga

SEQ ID NO: 3030715 - DNA, 17 bp, Homo sapiens
agcagaatacaatggga

SEQ ID NO: 3030716 - DNA, 14 bp, Homo sapiens
agcagaattttaat

SEQ ID NO: 3030717 - DNA, 17 bp, Homo sapiens
agcagaattttaatgtg

SEQ ID NO: 3030718 - DNA, 12 bp, Homo sapiens
agcagacaggcc

SEQ ID NO: 3030719 - DNA, 19 bp, Homo sapiens
agcagactcagctctgaca

SEQ ID NO: 3030720 - DNA, 20 bp, Homo sapiens
agcagagaatataacatgaa

SEQ ID NO: 3030721 - DNA, 18 bp, Homo sapiens
agcagagaggtggccacc

SEQ ID NO: 3030722 - DNA, 17 bp, Homo sapiens
agcagaggaccagggcc

SEQ ID NO: 3030723 - DNA, 18 bp, Homo sapiens
agcagaggaccagggcct

SEQ ID NO: 3030724 - DNA, 19 bp, Homo sapiens
agcagaggaggggccgctg

SEQ ID NO: 3030725 - DNA, 19 bp, Homo sapiens
agcagaggcagtggccacg

SEQ ID NO: 3030726 - DNA, 15 bp, Homo sapiens
agcagatactgctgt

SEQ ID NO: 3030727 - DNA, 14 bp, Homo sapiens
agcagatgcaaaga

SEQ ID NO: 3030728 - DNA, 17 bp, Homo sapiens
agcagatgcaaagaggc

SEQ ID NO: 3030729 - DNA, 18 bp, Homo sapiens
agcagatgcaaagaggca

SEQ ID NO: 3030730 - DNA, 19 bp, Homo sapiens
agcagatgcaatgactcag

SEQ ID NO: 3030731 - DNA, 19 bp, Homo sapiens
agcagatggtttccacatt

SEQ ID NO: 3030732 - DNA, 14 bp, Homo sapiens
agcagattggaagg

SEQ ID NO: 3030733 - DNA, 17 bp, Homo sapiens
agcagattggaaggaga

SEQ ID NO: 3030734 - DNA, 19 bp, Homo sapiens
agcagattggaaggagaca

SEQ ID NO: 3030735 - DNA, 20 bp, Homo sapiens
agcagattttcctaaggcca

SEQ ID NO: 3030736 - DNA, 22 bp, Homo sapiens
agcagcaaaatccttacttcca

SEQ ID NO: 3030737 - DNA, 14 bp, Homo sapiens
agcagcaaatagca

SEQ ID NO: 3030738 - DNA, 18 bp, Homo sapiens
agcagcaaatagcaaatg

SEQ ID NO: 3030739 - DNA, 16 bp, Homo sapiens
agcagcaagaaaaaaa

SEQ ID NO: 3030740 - DNA, 20 bp, Homo sapiens
agcagcaagaaaaaaaaatg

SEQ ID NO: 3030741 - DNA, 15 bp, Homo sapiens
agcagcactggaacc

SEQ ID NO: 3030742 - DNA, 22 bp, Homo sapiens
agcagcactggaaccacctgga

SEQ ID NO: 3030743 - DNA, 15 bp, Homo sapiens
agcagcagcctactg

SEQ ID NO: 3030744 - DNA, 12 bp, Homo sapiens
agcagcagctca

SEQ ID NO: 3030745 - DNA, 14 bp, Homo sapiens
agcagcatcccagc

SEQ ID NO: 3030746 - DNA, 19 bp, Homo sapiens
agcagcatcccagccttga

SEQ ID NO: 3030747 - DNA, 13 bp, Homo sapiens
agcagccaggagg

SEQ ID NO: 3030748 - DNA, 20 bp, Homo sapiens
agcagcccaccctgctgctg

SEQ ID NO: 3030749 - DNA, 12 bp, Homo sapiens
agcagcccagca

SEQ ID NO: 3030750 - DNA, 13 bp, Homo sapiens
agcagcccagcat

SEQ ID NO: 3030751 - DNA, 13 bp, Homo sapiens
agcagccctcctc

SEQ ID NO: 3030752 - DNA, 16 bp, Homo sapiens
agcagccctcctcacc

SEQ ID NO: 3030753 - DNA, 12 bp, Homo sapiens
agcagccctctg

SEQ ID NO: 3030754 - DNA, 15 bp, Homo sapiens
agcagccctctgcct

SEQ ID NO: 3030755 - DNA, 23 bp, Homo sapiens
agcagcccttgtttatatgccca

SEQ ID NO: 3030756 - DNA, 22 bp, Homo sapiens
agcagcctcgcacaggccctag

SEQ ID NO: 3030757 - DNA, 24 bp, Homo sapiens
agcagcctcgcacaggccctagct

SEQ ID NO: 3030758 - DNA, 13 bp, Homo sapiens
agcagcctgagca

SEQ ID NO: 3030759 - DNA, 19 bp, Homo sapiens
agcagcctgagcaactctt

SEQ ID NO: 3030760 - DNA, 10 bp, Homo sapiens
agcagcctgc

SEQ ID NO: 3030761 - DNA, 20 bp, Homo sapiens
agcagcctgtgagggagtgc

SEQ ID NO: 3030762 - DNA, 14 bp, Homo sapiens
agcagcggctctgg

SEQ ID NO: 3030763 - DNA, 18 bp, Homo sapiens
agcagcggctctggtcct

SEQ ID NO: 3030764 - DNA, 20 bp, Homo sapiens
agcagctaactccgagagca

SEQ ID NO: 3030765 - DNA, 20 bp, Homo sapiens
agcagctcacaccctacctt

SEQ ID NO: 3030766 - DNA, 15 bp, Homo sapiens
agcgtctttaagaga

SEQ ID NO: 3030767 - DNA, 17 bp, Homo sapiens
agcgtctttaagagact

SEQ ID NO: 3030768 - DNA, 20 bp, Homo sapiens
agcgtctttaagagactcac

SEQ ID NO: 3030769 - DNA, 18 bp, Homo sapiens
agcgtgaaggacttagcc

SEQ ID NO: 3030770 - DNA, 22 bp, Homo sapiens
agcgtgctggcgacactcaggg

SEQ ID NO: 3030771 - DNA, 17 bp, Homo sapiens
agcgtgctttaaaaaat

SEQ ID NO: 3030772 - DNA, 15 bp, Homo sapiens
agcgtttaaagtact

SEQ ID NO: 3030773 - DNA, 12 bp, Homo sapiens
agctaaaaatat

SEQ ID NO: 3030774 - DNA, 22 bp, Homo sapiens
agctaaaagcatggccctgctg

SEQ ID NO: 3030775 - DNA, 18 bp, Homo sapiens
agctaaacggattccaaa

SEQ ID NO: 3030776 - DNA, 21 bp, Homo sapiens
agctaaagtttggttttgaca

SEQ ID NO: 3030777 - DNA, 14 bp, Homo sapiens
agctaagaacctgg

SEQ ID NO: 3030778 - DNA, 10 bp, Homo sapiens
agctaaggct

SEQ ID NO: 3030779 - DNA, 19 bp, Homo sapiens
agctaataaatctcttctt

SEQ ID NO: 3030780 - DNA, 20 bp, Homo sapiens
agctaataaatctcttcttt

SEQ ID NO: 3030781 - DNA, 13 bp, Homo sapiens
agctaatttttgt

SEQ ID NO: 3030782 - DNA, 12 bp, Homo sapiens
agctacaaatgc

SEQ ID NO: 3030783 - DNA, 15 bp, Homo sapiens
agctacaacagcctc

SEQ ID NO: 3030784 - DNA, 16 bp, Homo sapiens
agctacaacagcctca

SEQ ID NO: 3030785 - DNA, 19 bp, Homo sapiens
agctacaacagcctcactt

SEQ ID NO: 3030786 - DNA, 14 bp, Homo sapiens
agctacaggttaca

SEQ ID NO: 3030787 - DNA, 19 bp, Homo sapiens
agctacaggttacaacaga

SEQ ID NO: 3030788 - DNA, 20 bp, Homo sapiens
agctacaggttacaacagat

SEQ ID NO: 3030789 - DNA, 22 bp, Homo sapiens
agctacaggttacaacagattt

SEQ ID NO: 3030790 - DNA, 16 bp, Homo sapiens
agctacctcaaacttc

SEQ ID NO: 3030791 - DNA, 19 bp, Homo sapiens
agctactaattttaaaatg

SEQ ID NO: 3030792 - DNA, 15 bp, Homo sapiens
agctactcaggaggc

SEQ ID NO: 3030793 - DNA, 17 bp, Homo sapiens
agctactcaggaggctg

SEQ ID NO: 3030794 - DNA, 22 bp, Homo sapiens
agctactcaggaggctgagaca

SEQ ID NO: 3030795 - DNA, 22 bp, Homo sapiens
agctactcgggaggctgaggca

SEQ ID NO: 3030796 - DNA, 23 bp, Homo sapiens
agctactctccccacgagggctg

SEQ ID NO: 3030797 - DNA, 23 bp, Homo sapiens
agctactgccgtcagtgctgtgc

SEQ ID NO: 3030798 - DNA, 14 bp, Homo sapiens
agctactggggagg

SEQ ID NO: 3030799 - DNA, 18 bp, Homo sapiens
agctactggggaggctga

SEQ ID NO: 3030800 - DNA, 20 bp, Homo sapiens
agctactggggaggctgagg

SEQ ID NO: 3030801 - DNA, 15 bp, Homo sapiens
agctactgtgtgtgt

SEQ ID NO: 3030802 - DNA, 19 bp, Homo sapiens
agctactgtgtgtgtgaat

SEQ ID NO: 3030803 - DNA, 23 bp, Homo sapiens
agctactgtgtgtgtgaatgaac

SEQ ID NO: 3030804 - DNA, 18 bp, Homo sapiens
agctacttagctggccaa

SEQ ID NO: 3030805 - DNA, 15 bp, Homo sapiens
agctagaagtgggcc

SEQ ID NO: 3030806 - DNA, 21 bp, Homo sapiens
agctagaagtgggccaggaca

SEQ ID NO: 3030807 - DNA, 22 bp, Homo sapiens
agctagaagtgggccaggacag

SEQ ID NO: 3030808 - DNA, 24 bp, Homo sapiens
agctagaagtgggccaggacaggc

SEQ ID NO: 3030809 - DNA, 12 bp, Homo sapiens
agctagaggaac

SEQ ID NO: 3030810 - DNA, 17 bp, Homo sapiens
agctagccagaggactg

SEQ ID NO: 3030811 - DNA, 14 bp, Homo sapiens
agctagccagccaa

SEQ ID NO: 3030812 - DNA, 14 bp, Homo sapiens
agctagcgctgccg

SEQ ID NO: 3030813 - DNA, 19 bp, Homo sapiens
agctagctatttctatgta

SEQ ID NO: 3030814 - DNA, 18 bp, Homo sapiens
agctagtcctagtgaacc

SEQ ID NO: 3030815 - DNA, 22 bp, Homo sapiens
agctagtgtacctcctctcagt

SEQ ID NO: 3030816 - DNA, 16 bp, Homo sapiens
agctagttctcagctt

SEQ ID NO: 3030817 - DNA, 15 bp, Homo sapiens
agctatcaagaggct

SEQ ID NO: 3030818 - DNA, 19 bp, Homo sapiens
agctatcaagaggctgaga

SEQ ID NO: 3030819 - DNA, 24 bp, Homo sapiens
agctatctggtcaacctcctggac

SEQ ID NO: 3030820 - DNA, 18 bp, Homo sapiens
agctatgttatattgaaa

SEQ ID NO: 3030821 - DNA, 16 bp, Homo sapiens
agctatttatgggccc

SEQ ID NO: 3030822 - DNA, 16 bp, Homo sapiens
agctatttctatgtat

SEQ ID NO: 3030823 - DNA, 17 bp, Homo sapiens
agctcaaataaaaataa

SEQ ID NO: 3030824 - DNA, 19 bp, Homo sapiens
agctcaagcattctgttta

SEQ ID NO: 3030825 - DNA, 22 bp, Homo sapiens
agctcacaccctaccttcccca

SEQ ID NO: 3030826 - DNA, 16 bp, Homo sapiens
agctcacctgttgctt

SEQ ID NO: 3030827 - DNA, 23 bp, Homo sapiens
agctcacctgttgcttacaattt

SEQ ID NO: 3030828 - DNA, 16 bp, Homo sapiens
agctcagcatttccac

SEQ ID NO: 3030829 - DNA, 20 bp, Homo sapiens
agctcagctttttgtctttt

SEQ ID NO: 3030830 - DNA, 23 bp, Homo sapiens
agctcaggagtttgagaccaggc

SEQ ID NO: 3030831 - DNA, 19 bp, Homo sapiens
agctcaggggacactggcc

SEQ ID NO: 3030832 - DNA, 15 bp, Homo sapiens
agctccaacctgcaa

SEQ ID NO: 3030833 - DNA, 18 bp, Homo sapiens
agctccaacctgcaaaga

SEQ ID NO: 3030834 - DNA, 22 bp, Homo sapiens
agctccaacctgcaaagatctg

SEQ ID NO: 3030835 - DNA, 13 bp, Homo sapiens
agctccaagctgt

SEQ ID NO: 3030836 - DNA, 17 bp, Homo sapiens
agctccaagctgttaaa

SEQ ID NO: 3030837 - DNA, 21 bp, Homo sapiens
agctccaagctgttaaagata

SEQ ID NO: 3030838 - DNA, 15 bp, Homo sapiens
agctccaccctggcc

SEQ ID NO: 3030839 - DNA, 14 bp, Homo sapiens
agctccagcccctt

SEQ ID NO: 3030840 - DNA, 19 bp, Homo sapiens
agctccagcccctttccaa

SEQ ID NO: 3030841 - DNA, 15 bp, Homo sapiens
agctccagttttcgt

SEQ ID NO: 3030842 - DNA, 21 bp, Homo sapiens
agctcccaagagcttccagag

SEQ ID NO: 3030843 - DNA, 23 bp, Homo sapiens
agctcccaagagcttccagagct

SEQ ID NO: 3030844 - DNA, 13 bp, Homo sapiens
agctcccaggcca

SEQ ID NO: 3030845 - DNA, 15 bp, Homo sapiens
agctcccaggtgcag

SEQ ID NO: 3030846 - DNA, 18 bp, Homo sapiens
agctccgacctctctcag

SEQ ID NO: 3030847 - DNA, 16 bp, Homo sapiens
agctcctcactcacct

SEQ ID NO: 3030848 - DNA, 15 bp, Homo sapiens
agctcctcactgtgg

SEQ ID NO: 3030849 - DNA, 13 bp, Homo sapiens
agctcctcccctg

SEQ ID NO: 3030850 - DNA, 16 bp, Homo sapiens
agctcctcccctgccg

SEQ ID NO: 3030851 - DNA, 13 bp, Homo sapiens
agctcctcctccc

SEQ ID NO: 3030852 - DNA, 16 bp, Homo sapiens
agctcctcctccctgc

SEQ ID NO: 3030853 - DNA, 21 bp, Homo sapiens
agctcctcctccctgcatctg

SEQ ID NO: 3030854 - DNA, 13 bp, Homo sapiens
agctcctggggcg

SEQ ID NO: 3030855 - DNA, 22 bp, Homo sapiens
agctcctggggcgtccaggccg

SEQ ID NO: 3030856 - DNA, 16 bp, Homo sapiens
agctccttaaggctct

SEQ ID NO: 3030857 - DNA, 19 bp, Homo sapiens
agctccttcctggagactg

SEQ ID NO: 3030858 - DNA, 22 bp, Homo sapiens
agctccttgggaggccccactg

SEQ ID NO: 3030859 - DNA, 22 bp, Homo sapiens
agctcggttaagtacccgaggc

SEQ ID NO: 3030860 - DNA, 19 bp, Homo sapiens
agctctaagcagccaggag

SEQ ID NO: 3030861 - DNA, 18 bp, Homo sapiens
agctctacacaacatgta

SEQ ID NO: 3030862 - DNA, 15 bp, Homo sapiens
agctctacccagggc

SEQ ID NO: 3030863 - DNA, 17 bp, Homo sapiens
agctctacccagggcct

SEQ ID NO: 3030864 - DNA, 19 bp, Homo sapiens
agctctacccagggcctgc

SEQ ID NO: 3030865 - DNA, 15 bp, Homo sapiens
agctctcaaatgtga

SEQ ID NO: 3030866 - DNA, 15 bp, Homo sapiens
agctctcatctgagg

SEQ ID NO: 3030867 - DNA, 16 bp, Homo sapiens
agctctccaggccagg

SEQ ID NO: 3030868 - DNA, 18 bp, Homo sapiens
agctctccaggccaggtg

SEQ ID NO: 3030869 - DNA, 19 bp, Homo sapiens
agctctccaggccaggtgg

SEQ ID NO: 3030870 - DNA, 15 bp, Homo sapiens
agctctcccctcaga

SEQ ID NO: 3030871 - DNA, 14 bp, Homo sapiens
agctctccctctgg

SEQ ID NO: 3030872 - DNA, 15 bp, Homo sapiens
agctctccctctggc

SEQ ID NO: 3030873 - DNA, 19 bp, Homo sapiens
agctctccctctggccctg

SEQ ID NO: 3030874 - DNA, 20 bp, Homo sapiens
agctctccctctggccctgc

SEQ ID NO: 3030875 - DNA, 23 bp, Homo sapiens
agctctccctctggccctgcctt

SEQ ID NO: 3030876 - DNA, 14 bp, Homo sapiens
agctctgacccaca

SEQ ID NO: 3030877 - DNA, 15 bp, Homo sapiens
agctctgcagcaata

SEQ ID NO: 3030878 - DNA, 21 bp, Homo sapiens
agctctgcagcaatattctga

SEQ ID NO: 3030879 - DNA, 15 bp, Homo sapiens
agctctgcctcaact

SEQ ID NO: 3030880 - DNA, 19 bp, Homo sapiens
agctctgcctcaactccac

SEQ ID NO: 3030881 - DNA, 17 bp, Homo sapiens
agctctgcgccaggcag

SEQ ID NO: 3030882 - DNA, 22 bp, Homo sapiens
agctctgcgccaggcagagctg

SEQ ID NO: 3030883 - DNA, 20 bp, Homo sapiens
agctctggacgtgaaatact

SEQ ID NO: 3030884 - DNA, 23 bp, Homo sapiens
agctctggacgtgaaatacttcg

SEQ ID NO: 3030885 - DNA, 23 bp, Homo sapiens
agctctgtatcaggacccagagg

SEQ ID NO: 3030886 - DNA, 15 bp, Homo sapiens
agctcttcacttcct

SEQ ID NO: 3030887 - DNA, 16 bp, Homo sapiens
agctcttcacttcctc

SEQ ID NO: 3030888 - DNA, 19 bp, Homo sapiens
agctcttcacttcctccag

SEQ ID NO: 3030889 - DNA, 22 bp, Homo sapiens
agctcttctgccggccctgggg

SEQ ID NO: 3030890 - DNA, 23 bp, Homo sapiens
agctcttctgccggccctggggc

SEQ ID NO: 3030891 - DNA, 16 bp, Homo sapiens
agctcttctgggcaga

SEQ ID NO: 3030892 - DNA, 20 bp, Homo sapiens
agctcttctgggcagagcct

SEQ ID NO: 3030893 - DNA, 17 bp, Homo sapiens
agctcttgggcctgacc

SEQ ID NO: 3030894 - DNA, 14 bp, Homo sapiens
agctcttgggtcag

SEQ ID NO: 3030895 - DNA, 17 bp, Homo sapiens
agctcttgggtcagaga

SEQ ID NO: 3030896 - DNA, 13 bp, Homo sapiens
agctcttgtttct

SEQ ID NO: 3030897 - DNA, 22 bp, Homo sapiens
aggccgacaccactcctgccag

SEQ ID NO: 3030898 - DNA, 15 bp, Homo sapiens
aggccgcggcctccc

SEQ ID NO: 3030899 - DNA, 14 bp, Homo sapiens
aggccggagcccag

SEQ ID NO: 3030900 - DNA, 15 bp, Homo sapiens
aggccggagcccaga

SEQ ID NO: 3030901 - DNA, 13 bp, Homo sapiens
aggccggccctgc

SEQ ID NO: 3030902 - DNA, 15 bp, Homo sapiens
aggccggccctgccc

SEQ ID NO: 3030903 - DNA, 19 bp, Homo sapiens
aggccggccctgcccctcc

SEQ ID NO: 3030904 - DNA, 24 bp, Homo sapiens
aggccggccctgcccctccctaga

SEQ ID NO: 3030905 - DNA, 20 bp, Homo sapiens
aggccggcgagccctgtgga

SEQ ID NO: 3030906 - DNA, 15 bp, Homo sapiens
aggccgggcctgtac

SEQ ID NO: 3030907 - DNA, 18 bp, Homo sapiens
aggccgggcctgtacagt

SEQ ID NO: 3030908 - DNA, 14 bp, Homo sapiens
aggccggtgtgcct

SEQ ID NO: 3030909 - DNA, 22 bp, Homo sapiens
aggccgtgtgtttagaagccta

SEQ ID NO: 3030910 - DNA, 17 bp, Homo sapiens
aggcctaggattctaaa

SEQ ID NO: 3030911 - DNA, 15 bp, Homo sapiens
aggcctaggctagga

SEQ ID NO: 3030912 - DNA, 18 bp, Homo sapiens
aggcctatgttgatccat

SEQ ID NO: 3030913 - DNA, 17 bp, Homo sapiens
aggcctcaaatgacagt

SEQ ID NO: 3030914 - DNA, 22 bp, Homo sapiens
aggcctcaaatgacagtagcat

SEQ ID NO: 3030915 - DNA, 14 bp, Homo sapiens
aggcctcactggct

SEQ ID NO: 3030916 - DNA, 15 bp, Homo sapiens
aggcctcactggctc

SEQ ID NO: 3030917 - DNA, 20 bp, Homo sapiens
aggcctcactggctcatgcc

SEQ ID NO: 3030918 - DNA, 15 bp, Homo sapiens
aggcctccctagcca

SEQ ID NO: 3030919 - DNA, 17 bp, Homo sapiens
aggcctccctgcctcag

SEQ ID NO: 3030920 - DNA, 19 bp, Homo sapiens
aggcctccctgcctcagct

SEQ ID NO: 3030921 - DNA, 14 bp, Homo sapiens
aggcctcctggccc

SEQ ID NO: 3030922 - DNA, 20 bp, Homo sapiens
aggcctcgaaaaccatcaca

SEQ ID NO: 3030923 - DNA, 19 bp, Homo sapiens
aggcctcgcacttgcagag

SEQ ID NO: 3030924 - DNA, 18 bp, Homo sapiens
aggcctcgcctgccctcc

SEQ ID NO: 3030925 - DNA, 20 bp, Homo sapiens
aggcctcgcctgccctcctc

SEQ ID NO: 3030926 - DNA, 21 bp, Homo sapiens
aggcctctcggtgctccatct

SEQ ID NO: 3030927 - DNA, 23 bp, Homo sapiens
aggcctctcggtgctccatctcc

SEQ ID NO: 3030928 - DNA, 18 bp, Homo sapiens
aggcctcttttcctgaag

SEQ ID NO: 3030929 - DNA, 18 bp, Homo sapiens
aggcctgaaaggagccct

SEQ ID NO: 3030930 - DNA, 13 bp, Homo sapiens
aggcctgccctgc

SEQ ID NO: 3030931 - DNA, 17 bp, Homo sapiens
aggcctgccgctttgat

SEQ ID NO: 3030932 - DNA, 15 bp, Homo sapiens
aggcctgccttctca

SEQ ID NO: 3030933 - DNA, 19 bp, Homo sapiens
aggcctgccttctcaggga

SEQ ID NO: 3030934 - DNA, 18 bp, Homo sapiens
aggcctgcgaccctgggg

SEQ ID NO: 3030935 - DNA, 20 bp, Homo sapiens
aggcctgcgaccctgggggc

SEQ ID NO: 3030936 - DNA, 17 bp, Homo sapiens
aggcctgcgtgcgctgg

SEQ ID NO: 3030937 - DNA, 21 bp, Homo sapiens
aggcctggcgtagcacccaca

SEQ ID NO: 3030938 - DNA, 24 bp, Homo sapiens
aggcctggctccccgagggctcag

SEQ ID NO: 3030939 - DNA, 12 bp, Homo sapiens
aggcctggtctg

SEQ ID NO: 3030940 - DNA, 17 bp, Homo sapiens
aggcctggtctgggagt

SEQ ID NO: 3030941 - DNA, 13 bp, Homo sapiens
aggcctgtctgtg

SEQ ID NO: 3030942 - DNA, 14 bp, Homo sapiens
aggcctgtggggag

SEQ ID NO: 3030943 - DNA, 17 bp, Homo sapiens
aggccttggggtggggg

SEQ ID NO: 3030944 - DNA, 22 bp, Homo sapiens
aggccttggggtgggggccagg

SEQ ID NO: 3030945 - DNA, 14 bp, Homo sapiens
aggccttgtcccag

SEQ ID NO: 3030946 - DNA, 16 bp, Homo sapiens
aggcgagcctgactct

SEQ ID NO: 3030947 - DNA, 19 bp, Homo sapiens
aggcgcctataatcccagc

SEQ ID NO: 3030948 - DNA, 22 bp, Homo sapiens
aggcgcgcacaccacgcccagc

SEQ ID NO: 3030949 - DNA, 13 bp, Homo sapiens
aggcgcggcctcc

SEQ ID NO: 3030950 - DNA, 21 bp, Homo sapiens
aggcgcggcggctctgcccac

SEQ ID NO: 3030951 - DNA, 14 bp, Homo sapiens
aggcggcagctctt

SEQ ID NO: 3030952 - DNA, 12 bp, Homo sapiens
aggcggccaggg

SEQ ID NO: 3030953 - DNA, 15 bp, Homo sapiens
aggcggccctcagtg

SEQ ID NO: 3030954 - DNA, 21 bp, Homo sapiens
aggcggggggggcgcctggag

SEQ ID NO: 3030955 - DNA, 14 bp, Homo sapiens
aggcggtgggcacc

SEQ ID NO: 3030956 - DNA, 21 bp, Homo sapiens
aggcgtcccgcacctgtctga

SEQ ID NO: 3030957 - DNA, 12 bp, Homo sapiens
aggcgtgatcca

SEQ ID NO: 3030958 - DNA, 13 bp, Homo sapiens
aggcgtgtgcagg

SEQ ID NO: 3030959 - DNA, 16 bp, Homo sapiens
aggcgttctcctgctt

SEQ ID NO: 3030960 - DNA, 18 bp, Homo sapiens
aggcgttctcctgcttgt

SEQ ID NO: 3030961 - DNA, 15 bp, Homo sapiens
aggcgttgctttcac

SEQ ID NO: 3030962 - DNA, 17 bp, Homo sapiens
aggcgttgctttcactc

SEQ ID NO: 3030963 - DNA, 20 bp, Homo sapiens
aggctaattcagtgtcacat

SEQ ID NO: 3030964 - DNA, 14 bp, Homo sapiens
aggctaggacgttg

SEQ ID NO: 3030965 - DNA, 20 bp, Homo sapiens
aggctcatttacttgaaatg

SEQ ID NO: 3030966 - DNA, 14 bp, Homo sapiens
aggctccagagggc

SEQ ID NO: 3030967 - DNA, 15 bp, Homo sapiens
aggctcccctgagga

SEQ ID NO: 3030968 - DNA, 15 bp, Homo sapiens
aggctcctccctctg

SEQ ID NO: 3030969 - DNA, 20 bp, Homo sapiens
aggctctatgagtctagatg

SEQ ID NO: 3030970 - DNA, 23 bp, Homo sapiens
aggctctcgggtgggggagccag

SEQ ID NO: 3030971 - DNA, 22 bp, Homo sapiens
aggctctgagagtctagattct

SEQ ID NO: 3030972 - DNA, 13 bp, Homo sapiens
aggctctgcccag

SEQ ID NO: 3030973 - DNA, 15 bp, Homo sapiens
aggctctgtgccttg

SEQ ID NO: 3030974 - DNA, 23 bp, Homo sapiens
aggctcttctccttggaggacag

SEQ ID NO: 3030975 - DNA, 13 bp, Homo sapiens
aggctgaccacag

SEQ ID NO: 3030976 - DNA, 16 bp, Homo sapiens
aggctgaccacagcac

SEQ ID NO: 3030977 - DNA, 21 bp, Homo sapiens
aggctgaccacagcacagcca

SEQ ID NO: 3030978 - DNA, 14 bp, Homo sapiens
aggctgacctcaac

SEQ ID NO: 3030979 - DNA, 17 bp, Homo sapiens
aggctgaggcagaagaa

SEQ ID NO: 3030980 - DNA, 14 bp, Homo sapiens
aggctgaggcagga

SEQ ID NO: 3030981 - DNA, 17 bp, Homo sapiens
aggctgaggcaggagaa

SEQ ID NO: 3030982 - DNA, 15 bp, Homo sapiens
aggctgaggtggcta

SEQ ID NO: 3030983 - DNA, 21 bp, Homo sapiens
aggctgaggtggctaaggggg

SEQ ID NO: 3030984 - DNA, 17 bp, Homo sapiens
aggctgcagccaggcct

SEQ ID NO: 3030985 - DNA, 18 bp, Homo sapiens
aggctgcagccaggcctc

SEQ ID NO: 3030986 - DNA, 23 bp, Homo sapiens
aggctgcagccaggcctcgcctg

SEQ ID NO: 3030987 - DNA, 14 bp, Homo sapiens
aggctgcaggaggg

SEQ ID NO: 3030988 - DNA, 15 bp, Homo sapiens
aggctgcaggagggc

SEQ ID NO: 3030989 - DNA, 16 bp, Homo sapiens
aggctgccccaggccg

SEQ ID NO: 3030990 - DNA, 15 bp, Homo sapiens
aggctgcctccgcac

SEQ ID NO: 3030991 - DNA, 22 bp, Homo sapiens
aggctgcctgctgtgctgggag

SEQ ID NO: 3030992 - DNA, 12 bp, Homo sapiens
aggctgctgcca

SEQ ID NO: 3030993 - DNA, 22 bp, Homo sapiens
aggctgctgggatggtgggctt

SEQ ID NO: 3030994 - DNA, 22 bp, Homo sapiens
aggctgctggggcctcagacga

SEQ ID NO: 3030995 - DNA, 15 bp, Homo sapiens
aggctgctttccaaa

SEQ ID NO: 3030996 - DNA, 21 bp, Homo sapiens
aggctgctttccaaagccaat

SEQ ID NO: 3030997 - DNA, 16 bp, Homo sapiens
aggctggaatgaggga

SEQ ID NO: 3030998 - DNA, 13 bp, Homo sapiens
aggctggagccca

SEQ ID NO: 3030999 - DNA, 18 bp, Homo sapiens
aggctggagcccagggag

SEQ ID NO: 3031000 - DNA, 15 bp, Homo sapiens
aggctggaggcaggg

SEQ ID NO: 3031001 - DNA, 17 bp, Homo sapiens
aggctggaggcagggcc

SEQ ID NO: 3031002 - DNA, 22 bp, Homo sapiens
aggctggagtgcaatggtgtga

SEQ ID NO: 3031003 - DNA, 18 bp, Homo sapiens
aggctggagttgtcactg

SEQ ID NO: 3031004 - DNA, 21 bp, Homo sapiens
aggctggcaagataaacactt

SEQ ID NO: 3031005 - DNA, 18 bp, Homo sapiens
aggctggcacaggacatg

SEQ ID NO: 3031006 - DNA, 12 bp, Homo sapiens
aggctggcatga

SEQ ID NO: 3031007 - DNA, 17 bp, Homo sapiens
aggctggccagtgctgc

SEQ ID NO: 3031008 - DNA, 19 bp, Homo sapiens
aggctggctcgtaggcctg

SEQ ID NO: 3031009 - DNA, 13 bp, Homo sapiens
aggctgggccgca

SEQ ID NO: 3031010 - DNA, 18 bp, Homo sapiens
aggctgggcgtagtggct

SEQ ID NO: 3031011 - DNA, 21 bp, Homo sapiens
aggctgggctgagccaaagcc

SEQ ID NO: 3031012 - DNA, 18 bp, Homo sapiens
aggctggggatggtagga

SEQ ID NO: 3031013 - DNA, 19 bp, Homo sapiens
aggctggtccgagctgagg

SEQ ID NO: 3031014 - DNA, 21 bp, Homo sapiens
aggctggtctcgaactcctga

SEQ ID NO: 3031015 - DNA, 11 bp, Homo sapiens
aggctggtctt

SEQ ID NO: 3031016 - DNA, 13 bp, Homo sapiens
aggctggtggccc

SEQ ID NO: 3031017 - DNA, 15 bp, Homo sapiens
aggctggtggcccag

SEQ ID NO: 3031018 - DNA, 17 bp, Homo sapiens
aggctggtggcccagga

SEQ ID NO: 3031019 - DNA, 22 bp, Homo sapiens
aggctggtgtatgcactgctca

SEQ ID NO: 3031020 - DNA, 21 bp, Homo sapiens
aggctggttttgatggctggg

SEQ ID NO: 3031021 - DNA, 15 bp, Homo sapiens
aggctgtcccaagct

SEQ ID NO: 3031022 - DNA, 19 bp, Homo sapiens
aggctgtccttacccatct

SEQ ID NO: 3031023 - DNA, 17 bp, Homo sapiens
aggctgtctggccaggc

SEQ ID NO: 3031024 - DNA, 16 bp, Homo sapiens
aggctgtgctgccctg

SEQ ID NO: 3031025 - DNA, 21 bp, Homo sapiens
aggctgtgctgccctgaagaa

SEQ ID NO: 3031026 - DNA, 11 bp, Homo sapiens
aggctgtgtcc

SEQ ID NO: 3031027 - DNA, 14 bp, Homo sapiens
aggctgtgtccctg

SEQ ID NO: 3031028 - DNA, 11 bp, Homo sapiens
aggctgtgttt

SEQ ID NO: 3031029 - DNA, 20 bp, Homo sapiens
aggctgtgtttagattgtat

SEQ ID NO: 3031030 - DNA, 15 bp, Homo sapiens
aggtggctgagcccc

SEQ ID NO: 3031031 - DNA, 14 bp, Homo sapiens
aggtgggagctgaa

SEQ ID NO: 3031032 - DNA, 23 bp, Homo sapiens
aggtgggaggaaagggcctggcc

SEQ ID NO: 3031033 - DNA, 16 bp, Homo sapiens
aggtgggaggccaggc

SEQ ID NO: 3031034 - DNA, 15 bp, Homo sapiens
aggtgggcggacaaa

SEQ ID NO: 3031035 - DNA, 13 bp, Homo sapiens
aggtggggagtca

SEQ ID NO: 3031036 - DNA, 21 bp, Homo sapiens
aggtggggtctttgtgagagt

SEQ ID NO: 3031037 - DNA, 22 bp, Homo sapiens
aggtggggtgatggccagagga

SEQ ID NO: 3031038 - DNA, 20 bp, Homo sapiens
aggtggggtggagtcccaga

SEQ ID NO: 3031039 - DNA, 21 bp, Homo sapiens
aggtggggtggagtcccagag

SEQ ID NO: 3031040 - DNA, 22 bp, Homo sapiens
aggtgggttttcttcccatcac

SEQ ID NO: 3031041 - DNA, 23 bp, Homo sapiens
aggtgggttttcttcccatcact

SEQ ID NO: 3031042 - DNA, 21 bp, Homo sapiens
aggtggtagtaaaacacagag

SEQ ID NO: 3031043 - DNA, 17 bp, Homo sapiens
aggtggtgtcactgtcc

SEQ ID NO: 3031044 - DNA, 23 bp, Homo sapiens
aggtggtgtcactgtccctcctg

SEQ ID NO: 3031045 - DNA, 16 bp, Homo sapiens
aggtggtgtccttctt

SEQ ID NO: 3031046 - DNA, 19 bp, Homo sapiens
aggtgtaaccatttgttaa

SEQ ID NO: 3031047 - DNA, 20 bp, Homo sapiens
aggtgtagccacaccaggat

SEQ ID NO: 3031048 - DNA, 15 bp, Homo sapiens
aggtgtagctgagct

SEQ ID NO: 3031049 - DNA, 13 bp, Homo sapiens
aggtgtcaggccc

SEQ ID NO: 3031050 - DNA, 14 bp, Homo sapiens
aggtgtccaaattt

SEQ ID NO: 3031051 - DNA, 18 bp, Homo sapiens
aggtgtctgccacttctg

SEQ ID NO: 3031052 - DNA, 16 bp, Homo sapiens
aggtgtgactctagca

SEQ ID NO: 3031053 - DNA, 13 bp, Homo sapiens
aggtgtgctacag

SEQ ID NO: 3031054 - DNA, 15 bp, Homo sapiens
aggtgttcattttgt

SEQ ID NO: 3031055 - DNA, 21 bp, Homo sapiens
aggtgttgaagaaattataaa

SEQ ID NO: 3031056 - DNA, 15 bp, Homo sapiens
aggtgttggtgacaa

SEQ ID NO: 3031057 - DNA, 16 bp, Homo sapiens
aggtgttggtgacaat

SEQ ID NO: 3031058 - DNA, 18 bp, Homo sapiens
aggtgttggttttggggg

SEQ ID NO: 3031059 - DNA, 15 bp, Homo sapiens
aggtgttgtcccttc

SEQ ID NO: 3031060 - DNA, 12 bp, Homo sapiens
aggttaaaaaaa

SEQ ID NO: 3031061 - DNA, 15 bp, Homo sapiens
aggttaaaaaaatgg

SEQ ID NO: 3031062 - DNA, 21 bp, Homo sapiens
aggttaaaaaaatggcagtga

SEQ ID NO: 3031063 - DNA, 17 bp, Homo sapiens
aggttaaggctgaggaa

SEQ ID NO: 3031064 - DNA, 15 bp, Homo sapiens
aggttaccaagaagc

SEQ ID NO: 3031065 - DNA, 16 bp, Homo sapiens
aggttaccaagaagcc

SEQ ID NO: 3031066 - DNA, 18 bp, Homo sapiens
aggttactcagcagcaga

SEQ ID NO: 3031067 - DNA, 17 bp, Homo sapiens
aggttaggaaggcagca

SEQ ID NO: 3031068 - DNA, 12 bp, Homo sapiens
aggttataagaa

SEQ ID NO: 3031069 - DNA, 14 bp, Homo sapiens
aggttatttaaaat

SEQ ID NO: 3031070 - DNA, 17 bp, Homo sapiens
aggttattttagtttct

SEQ ID NO: 3031071 - DNA, 19 bp, Homo sapiens
aggttattttagtttctgt

SEQ ID NO: 3031072 - DNA, 14 bp, Homo sapiens
aggttattttatat

SEQ ID NO: 3031073 - DNA, 23 bp, Homo sapiens
aggttattttctttatcattgct

SEQ ID NO: 3031074 - DNA, 17 bp, Homo sapiens
aggttcacagcagcttt

SEQ ID NO: 3031075 - DNA, 20 bp, Homo sapiens
aggttcagtattatgtagtt

SEQ ID NO: 3031076 - DNA, 12 bp, Homo sapiens
aggttccacaga

SEQ ID NO: 3031077 - DNA, 14 bp, Homo sapiens
aggttccacagagt

SEQ ID NO: 3031078 - DNA, 16 bp, Homo sapiens
aggttcccaagctcag

SEQ ID NO: 3031079 - DNA, 17 bp, Homo sapiens
aggttcctaggttttga

SEQ ID NO: 3031080 - DNA, 13 bp, Homo sapiens
aggttctaaagtt

SEQ ID NO: 3031081 - DNA, 17 bp, Homo sapiens
aggttctaaagttctaa

SEQ ID NO: 3031082 - DNA, 19 bp, Homo sapiens
aggttctaaagttctaaga

SEQ ID NO: 3031083 - DNA, 15 bp, Homo sapiens
aggttctaaggccta

SEQ ID NO: 3031084 - DNA, 19 bp, Homo sapiens
aggttctaggtttcaaaga

SEQ ID NO: 3031085 - DNA, 18 bp, Homo sapiens
aggttctctctcactgcc

SEQ ID NO: 3031086 - DNA, 19 bp, Homo sapiens
aggttctgtagagccaatt

SEQ ID NO: 3031087 - DNA, 22 bp, Homo sapiens
aggttctgtagagccaattaga

SEQ ID NO: 3031088 - DNA, 23 bp, Homo sapiens
aggttcttcttcctgaagctgag

SEQ ID NO: 3031089 - DNA, 19 bp, Homo sapiens
aggttgataactttgcttg

SEQ ID NO: 3031090 - DNA, 19 bp, Homo sapiens
aggttgatatcggtgctat

SEQ ID NO: 3031091 - DNA, 17 bp, Homo sapiens
aggttgcctgaaaaatg

SEQ ID NO: 3031092 - DNA, 23 bp, Homo sapiens
aggttggaaaagaaatcaatttt

SEQ ID NO: 3031093 - DNA, 20 bp, Homo sapiens
aggttggcaaacgggcttga

SEQ ID NO: 3031094 - DNA, 22 bp, Homo sapiens
aggttggtttaatgcaatagaa

SEQ ID NO: 3031095 - DNA, 17 bp, Homo sapiens
aggtttcgtttctgtat

SEQ ID NO: 3031096 - DNA, 17 bp, Homo sapiens
aggtttgaccaggaaag

SEQ ID NO: 3031097 - DNA, 21 bp, Homo sapiens
aggtttgggacccctggtggt

SEQ ID NO: 3031098 - DNA, 14 bp, Homo sapiens
aggtttgtttcttg

SEQ ID NO: 3031099 - DNA, 18 bp, Homo sapiens
aggttttaggttctaaag

SEQ ID NO: 3031100 - DNA, 19 bp, Homo sapiens
aggttttaggttctaaagt

SEQ ID NO: 3031101 - DNA, 16 bp, Homo sapiens
aggttttgtttgctat

SEQ ID NO: 3031102 - DNA, 18 bp, Homo sapiens
agtaaaaacatttaaata

SEQ ID NO: 3031103 - DNA, 19 bp, Homo sapiens
agtaaaaatacaaaaatta

SEQ ID NO: 3031104 - DNA, 12 bp, Homo sapiens
agtaaaacacaa

SEQ ID NO: 3031105 - DNA, 13 bp, Homo sapiens
agtaaaagacatt

SEQ ID NO: 3031106 - DNA, 14 bp, Homo sapiens
agtaaactatttat

SEQ ID NO: 3031107 - DNA, 16 bp, Homo sapiens
agtaaactatttatct

SEQ ID NO: 3031108 - DNA, 15 bp, Homo sapiens
agtaaactgcagtcc

SEQ ID NO: 3031109 - DNA, 17 bp, Homo sapiens
agtaaaggcattccaca

SEQ ID NO: 3031110 - DNA, 13 bp, Homo sapiens
agtaaagtaatgc

SEQ ID NO: 3031111 - DNA, 18 bp, Homo sapiens
agtaaagtaatgcatttg

SEQ ID NO: 3031112 - DNA, 13 bp, Homo sapiens
agtaaatctcttt

SEQ ID NO: 3031113 - DNA, 10 bp, Homo sapiens
agtaaatgtt

SEQ ID NO: 3031114 - DNA, 14 bp, Homo sapiens
agtaacattctact

SEQ ID NO: 3031115 - DNA, 14 bp, Homo sapiens
agtaaccatttgca

SEQ ID NO: 3031116 - DNA, 20 bp, Homo sapiens
agtaacccccactggactga

SEQ ID NO: 3031117 - DNA, 21 bp, Homo sapiens
agtaacgggtcgtaatgactt

SEQ ID NO: 3031118 - DNA, 14 bp, Homo sapiens
agtaactcccactc

SEQ ID NO: 3031119 - DNA, 16 bp, Homo sapiens
agtaactcccactcct

SEQ ID NO: 3031120 - DNA, 17 bp, Homo sapiens
agtaacttcttatggaa

SEQ ID NO: 3031121 - DNA, 19 bp, Homo sapiens
agtaacttcttatggaatt

SEQ ID NO: 3031122 - DNA, 16 bp, Homo sapiens
agtaactttatgtgta

SEQ ID NO: 3031123 - DNA, 20 bp, Homo sapiens
agtaagaaagtgaagcaaat

SEQ ID NO: 3031124 - DNA, 17 bp, Homo sapiens
agtaagaaatttcaggt

SEQ ID NO: 3031125 - DNA, 24 bp, Homo sapiens
agtaagacattgggtctattccag

SEQ ID NO: 3031126 - DNA, 11 bp, Homo sapiens
agtaagagact

SEQ ID NO: 3031127 - DNA, 21 bp, Homo sapiens
agtaagagtactattaataga

SEQ ID NO: 3031128 - DNA, 14 bp, Homo sapiens
agtaaggcatgtta

SEQ ID NO: 3031129 - DNA, 17 bp, Homo sapiens
agtaagtataacaaact

SEQ ID NO: 3031130 - DNA, 14 bp, Homo sapiens
agtaagtgcgaaga

SEQ ID NO: 3031131 - DNA, 22 bp, Homo sapiens
agtaatatgcctgctatttgaa

SEQ ID NO: 3031132 - DNA, 22 bp, Homo sapiens
agtaatgaatttttatgatatt

SEQ ID NO: 3031133 - DNA, 21 bp, Homo sapiens
agtaatgagtttaaaaatcaa

SEQ ID NO: 3031134 - DNA, 13 bp, Homo sapiens
agtaatgcctctg

SEQ ID NO: 3031135 - DNA, 20 bp, Homo sapiens
agtaatgcctctgtctagca

SEQ ID NO: 3031136 - DNA, 19 bp, Homo sapiens
agtaatgctaaatgtgtaa

SEQ ID NO: 3031137 - DNA, 17 bp, Homo sapiens
agtaatgctacgtgtga

SEQ ID NO: 3031138 - DNA, 15 bp, Homo sapiens
agtaattataggaag

SEQ ID NO: 3031139 - DNA, 19 bp, Homo sapiens
agtaattattatttaactc

SEQ ID NO: 3031140 - DNA, 18 bp, Homo sapiens
agtaattgacatgtgcca

SEQ ID NO: 3031141 - DNA, 16 bp, Homo sapiens
agtaattgtgaaaaag

SEQ ID NO: 3031142 - DNA, 21 bp, Homo sapiens
agtaatttctttttttccttt

SEQ ID NO: 3031143 - DNA, 20 bp, Homo sapiens
agtacaagctcttgtttctg

SEQ ID NO: 3031144 - DNA, 22 bp, Homo sapiens
agtacaaggacagacagcaggc

SEQ ID NO: 3031145 - DNA, 15 bp, Homo sapiens
agtacaattcattgt

SEQ ID NO: 3031146 - DNA, 23 bp, Homo sapiens
agtacaattcattgttttgcaaa

SEQ ID NO: 3031147 - DNA, 18 bp, Homo sapiens
agtacactgtgtctctat

SEQ ID NO: 3031148 - DNA, 21 bp, Homo sapiens
agtacagacgtctcaagactg

SEQ ID NO: 3031149 - DNA, 12 bp, Homo sapiens
agtacagtatat

SEQ ID NO: 3031150 - DNA, 13 bp, Homo sapiens
agtacagtggtgc

SEQ ID NO: 3031151 - DNA, 17 bp, Homo sapiens
agtacataattgattaa

SEQ ID NO: 3031152 - DNA, 23 bp, Homo sapiens
agtacataattgattaaaatctc

SEQ ID NO: 3031153 - DNA, 15 bp, Homo sapiens
agtaccactcttggt

SEQ ID NO: 3031154 - DNA, 19 bp, Homo sapiens
agtaccagtgtaaattcag

SEQ ID NO: 3031155 - DNA, 23 bp, Homo sapiens
agtaccccctcaaaccctgccct

SEQ ID NO: 3031156 - DNA, 14 bp, Homo sapiens
agtacctgaaaagt

SEQ ID NO: 3031157 - DNA, 15 bp, Homo sapiens
agtacctgaaaagta

SEQ ID NO: 3031158 - DNA, 14 bp, Homo sapiens
agtactaagcattt

SEQ ID NO: 3031159 - DNA, 20 bp, Homo sapiens
agtactaaggtgactttctg

SEQ ID NO: 3031160 - DNA, 21 bp, Homo sapiens
agtactaaggtgactttctga

SEQ ID NO: 3031161 - DNA, 22 bp, Homo sapiens
agtactaaggtgactttctgaa

SEQ ID NO: 3031162 - DNA, 15 bp, Homo sapiens
agtgctatttcagca

SEQ ID NO: 3031163 - DNA, 20 bp, Homo sapiens
agtgctccatagtttggcat

SEQ ID NO: 3031164 - DNA, 18 bp, Homo sapiens
agtgctcccctctgaaag

SEQ ID NO: 3031165 - DNA, 11 bp, Homo sapiens
agtgctccctc

SEQ ID NO: 3031166 - DNA, 17 bp, Homo sapiens
agtgctccctcacatgt

SEQ ID NO: 3031167 - DNA, 18 bp, Homo sapiens
agtgctctgaccctgggc

SEQ ID NO: 3031168 - DNA, 21 bp, Homo sapiens
agtgctctgatccctctacag

SEQ ID NO: 3031169 - DNA, 13 bp, Homo sapiens
agtgctctgcctc

SEQ ID NO: 3031170 - DNA, 19 bp, Homo sapiens
agtgctggcccacccagtc

SEQ ID NO: 3031171 - DNA, 20 bp, Homo sapiens
agtgctggcccacccagtcc

SEQ ID NO: 3031172 - DNA, 20 bp, Homo sapiens
agtgctgggattacaggcgt

SEQ ID NO: 3031173 - DNA, 14 bp, Homo sapiens
agtgcttcttgtaa

SEQ ID NO: 3031174 - DNA, 19 bp, Homo sapiens
agtgcttgagtttggggaa

SEQ ID NO: 3031175 - DNA, 18 bp, Homo sapiens
agtgcttggcacatagtg

SEQ ID NO: 3031176 - DNA, 22 bp, Homo sapiens
agtgcttgtgtaatttatgtga

SEQ ID NO: 3031177 - DNA, 18 bp, Homo sapiens
agtgctttaagaatgaac

SEQ ID NO: 3031178 - DNA, 20 bp, Homo sapiens
agtgctttaagaatgaacac

SEQ ID NO: 3031179 - DNA, 22 bp, Homo sapiens
agtggaacacaaatgaaaatga

SEQ ID NO: 3031180 - DNA, 22 bp, Homo sapiens
agtggaaccgttgccaaccgag

SEQ ID NO: 3031181 - DNA, 22 bp, Homo sapiens
agtggacaagtcatggacattc

SEQ ID NO: 3031182 - DNA, 14 bp, Homo sapiens
agtggaccaggaca

SEQ ID NO: 3031183 - DNA, 21 bp, Homo sapiens
agtggaccgcccttttcccct

SEQ ID NO: 3031184 - DNA, 16 bp, Homo sapiens
agtggactcagggcag

SEQ ID NO: 3031185 - DNA, 15 bp, Homo sapiens
agtggacttctgaaa

SEQ ID NO: 3031186 - DNA, 22 bp, Homo sapiens
agtggacttgttttaattttag

SEQ ID NO: 3031187 - DNA, 14 bp, Homo sapiens
agtggagagggcta

SEQ ID NO: 3031188 - DNA, 22 bp, Homo sapiens
agtggaggttaaggctgaggaa

SEQ ID NO: 3031189 - DNA, 23 bp, Homo sapiens
agtggaggttgagtgagccggga

SEQ ID NO: 3031190 - DNA, 15 bp, Homo sapiens
agtggatgatgtttc

SEQ ID NO: 3031191 - DNA, 14 bp, Homo sapiens
agtggatgctgtgc

SEQ ID NO: 3031192 - DNA, 16 bp, Homo sapiens
agtggatgggaatttg

SEQ ID NO: 3031193 - DNA, 18 bp, Homo sapiens
agtggcaccgcctcccca

SEQ ID NO: 3031194 - DNA, 17 bp, Homo sapiens
agtggccacggcccagg

SEQ ID NO: 3031195 - DNA, 20 bp, Homo sapiens
agtggccacgttcagggagg

SEQ ID NO: 3031196 - DNA, 19 bp, Homo sapiens
agtggccactaagcagagg

SEQ ID NO: 3031197 - DNA, 10 bp, Homo sapiens
agtggccagc

SEQ ID NO: 3031198 - DNA, 17 bp, Homo sapiens
agtggccgggccggacg

SEQ ID NO: 3031199 - DNA, 17 bp, Homo sapiens
agtggcctagagcactc

SEQ ID NO: 3031200 - DNA, 20 bp, Homo sapiens
agtggcctcttggataccag

SEQ ID NO: 3031201 - DNA, 13 bp, Homo sapiens
agtggcctggccg

SEQ ID NO: 3031202 - DNA, 22 bp, Homo sapiens
agtggcctggccgttcagcctg

SEQ ID NO: 3031203 - DNA, 17 bp, Homo sapiens
agtggcgtgagctgccc

SEQ ID NO: 3031204 - DNA, 15 bp, Homo sapiens
agtggcgttgttcat

SEQ ID NO: 3031205 - DNA, 18 bp, Homo sapiens
agtggctaaagagatgag

SEQ ID NO: 3031206 - DNA, 11 bp, Homo sapiens
agtggctgctg

SEQ ID NO: 3031207 - DNA, 14 bp, Homo sapiens
agtggctgctgact

SEQ ID NO: 3031208 - DNA, 16 bp, Homo sapiens
agtggctggaagaacc

SEQ ID NO: 3031209 - DNA, 18 bp, Homo sapiens
agtggcttagctgccatc

SEQ ID NO: 3031210 - DNA, 15 bp, Homo sapiens
agtggcttctttcca

SEQ ID NO: 3031211 - DNA, 17 bp, Homo sapiens
agtggctttaatgaata

SEQ ID NO: 3031212 - DNA, 20 bp, Homo sapiens
agtgggaacgtgactgcccc

SEQ ID NO: 3031213 - DNA, 15 bp, Homo sapiens
agtgggagatgaaaa

SEQ ID NO: 3031214 - DNA, 17 bp, Homo sapiens
agtgggagatgaaaacc

SEQ ID NO: 3031215 - DNA, 20 bp, Homo sapiens
agtgggattatcgagcatgt

SEQ ID NO: 3031216 - DNA, 13 bp, Homo sapiens
agtgggcaggtgg

SEQ ID NO: 3031217 - DNA, 22 bp, Homo sapiens
agtgggccttcattaaatgttt

SEQ ID NO: 3031218 - DNA, 15 bp, Homo sapiens
agtgggctgcacgct

SEQ ID NO: 3031219 - DNA, 14 bp, Homo sapiens
agtgggctggtatt

SEQ ID NO: 3031220 - DNA, 21 bp, Homo sapiens
agtgggctggtattctctcta

SEQ ID NO: 3031221 - DNA, 19 bp, Homo sapiens
agtggggtctccctctcct

SEQ ID NO: 3031222 - DNA, 20 bp, Homo sapiens
agtggggtctccctctcctg

SEQ ID NO: 3031223 - DNA, 23 bp, Homo sapiens
agtggggtctccctctcctgcct

SEQ ID NO: 3031224 - DNA, 18 bp, Homo sapiens
agtggtagaggtgtgtgc

SEQ ID NO: 3031225 - DNA, 18 bp, Homo sapiens
agtggtctcctctcagct

SEQ ID NO: 3031226 - DNA, 20 bp, Homo sapiens
agtggtgacaaatcaagaat

SEQ ID NO: 3031227 - DNA, 13 bp, Homo sapiens
agtggtgctcagt

SEQ ID NO: 3031228 - DNA, 16 bp, Homo sapiens
agtggtgctcagttgt

SEQ ID NO: 3031229 - DNA, 22 bp, Homo sapiens
agtggtgctcagttgtagaatg

SEQ ID NO: 3031230 - DNA, 14 bp, Homo sapiens
agtggtggcagggc

SEQ ID NO: 3031231 - DNA, 18 bp, Homo sapiens
agtggtggtaaccctggt

SEQ ID NO: 3031232 - DNA, 18 bp, Homo sapiens
agtggtgtgatcccagct

SEQ ID NO: 3031233 - DNA, 19 bp, Homo sapiens
agtggtgttccatgacttc

SEQ ID NO: 3031234 - DNA, 17 bp, Homo sapiens
agtggttcagtctagaa

SEQ ID NO: 3031235 - DNA, 18 bp, Homo sapiens
agtgtaaaatattttgaa

SEQ ID NO: 3031236 - DNA, 21 bp, Homo sapiens
agtgtaaaatattttgaatca

SEQ ID NO: 3031237 - DNA, 17 bp, Homo sapiens
agtgtaaagcattccaa

SEQ ID NO: 3031238 - DNA, 14 bp, Homo sapiens
agtgtaaattcagt

SEQ ID NO: 3031239 - DNA, 17 bp, Homo sapiens
agtgtaagctagaagaa

SEQ ID NO: 3031240 - DNA, 14 bp, Homo sapiens
agtgtaatgtgact

SEQ ID NO: 3031241 - DNA, 15 bp, Homo sapiens
agtgtaatgtgactt

SEQ ID NO: 3031242 - DNA, 17 bp, Homo sapiens
agtgtaatgtgacttca

SEQ ID NO: 3031243 - DNA, 16 bp, Homo sapiens
agtgtaatttctttgc

SEQ ID NO: 3031244 - DNA, 20 bp, Homo sapiens
agtgtaatttctttgcctgt

SEQ ID NO: 3031245 - DNA, 17 bp, Homo sapiens
agtgtacaagttgcttt

SEQ ID NO: 3031246 - DNA, 15 bp, Homo sapiens
agtgtacatgtacat

SEQ ID NO: 3031247 - DNA, 16 bp, Homo sapiens
agtgtaccatttgcct

SEQ ID NO: 3031248 - DNA, 15 bp, Homo sapiens
agtgtacctcctctc

SEQ ID NO: 3031249 - DNA, 17 bp, Homo sapiens
agtgtacctcctctcag

SEQ ID NO: 3031250 - DNA, 18 bp, Homo sapiens
agtgtatgagtgtgagtg

SEQ ID NO: 3031251 - DNA, 21 bp, Homo sapiens
agtgtatgagtgtgagtgtgt

SEQ ID NO: 3031252 - DNA, 20 bp, Homo sapiens
agtgtatggcgttggtttgt

SEQ ID NO: 3031253 - DNA, 18 bp, Homo sapiens
agtgtattttaaaataga

SEQ ID NO: 3031254 - DNA, 13 bp, Homo sapiens
agtgtcaaccaga

SEQ ID NO: 3031255 - DNA, 16 bp, Homo sapiens
agtgtcaaccagacag

SEQ ID NO: 3031256 - DNA, 15 bp, Homo sapiens
agtgtcagtactaag

SEQ ID NO: 3031257 - DNA, 16 bp, Homo sapiens
agtgtcagtactaagg

SEQ ID NO: 3031258 - DNA, 21 bp, Homo sapiens
agtgtccagaagcggcctgtg

SEQ ID NO: 3031259 - DNA, 22 bp, Homo sapiens
agtgtccattttgtgaagccct

SEQ ID NO: 3031260 - DNA, 13 bp, Homo sapiens
agtgtctctgcct

SEQ ID NO: 3031261 - DNA, 15 bp, Homo sapiens
agtgtctctgcctgg

SEQ ID NO: 3031262 - DNA, 12 bp, Homo sapiens
agtgtctggctg

SEQ ID NO: 3031263 - DNA, 19 bp, Homo sapiens
agtgtctgtaggtacgttt

SEQ ID NO: 3031264 - DNA, 19 bp, Homo sapiens
agtgtcttcacggcaggac

SEQ ID NO: 3031265 - DNA, 23 bp, Homo sapiens
agtgtctttccacggagccactc

SEQ ID NO: 3031266 - DNA, 15 bp, Homo sapiens
agtgtcttttgacat

SEQ ID NO: 3031267 - DNA, 15 bp, Homo sapiens
agtgtgaagttagaa

SEQ ID NO: 3031268 - DNA, 20 bp, Homo sapiens
agtgtgaagttagaattcct

SEQ ID NO: 3031269 - DNA, 19 bp, Homo sapiens
agtgtgaccaaaagttaca

SEQ ID NO: 3031270 - DNA, 15 bp, Homo sapiens
agtgtgaggccaggg

SEQ ID NO: 3031271 - DNA, 13 bp, Homo sapiens
agtgtgagggcag

SEQ ID NO: 3031272 - DNA, 19 bp, Homo sapiens
agtgtgagtgtgtgtgcat

SEQ ID NO: 3031273 - DNA, 22 bp, Homo sapiens
agtgtgattgggaataaatatg

SEQ ID NO: 3031274 - DNA, 22 bp, Homo sapiens
agtgtgcactaaggggcccggc

SEQ ID NO: 3031275 - DNA, 18 bp, Homo sapiens
agtgtgcatattgtacac

SEQ ID NO: 3031276 - DNA, 12 bp, Homo sapiens
agtgtgctgaac

SEQ ID NO: 3031277 - DNA, 15 bp, Homo sapiens
agtgtgctgaacaca

SEQ ID NO: 3031278 - DNA, 20 bp, Homo sapiens
agtgtgctgctgtaagaaat

SEQ ID NO: 3031279 - DNA, 15 bp, Homo sapiens
agtgtgggaagggag

SEQ ID NO: 3031280 - DNA, 17 bp, Homo sapiens
agtgtgggaagggagag

SEQ ID NO: 3031281 - DNA, 18 bp, Homo sapiens
agtgtgggagtgcagaga

SEQ ID NO: 3031282 - DNA, 20 bp, Homo sapiens
agtgtgggagtgcagagaaa

SEQ ID NO: 3031283 - DNA, 20 bp, Homo sapiens
agtgtgggcgctctccctac

SEQ ID NO: 3031284 - DNA, 23 bp, Homo sapiens
agtgtggtgtttcctgcaggcca

SEQ ID NO: 3031285 - DNA, 21 bp, Homo sapiens
agtgtgtcagagcccagggga

SEQ ID NO: 3031286 - DNA, 20 bp, Homo sapiens
agtgtgtgtgcagagtccat

SEQ ID NO: 3031287 - DNA, 16 bp, Homo sapiens
agtgtgtgtgcatgga

SEQ ID NO: 3031288 - DNA, 16 bp, Homo sapiens
agtgtgtgttgcaaat

SEQ ID NO: 3031289 - DNA, 24 bp, Homo sapiens
agtgtgtgttgcaaatcactctgc

SEQ ID NO: 3031290 - DNA, 20 bp, Homo sapiens
agtgtgtttccttcagtgca

SEQ ID NO: 3031291 - DNA, 21 bp, Homo sapiens
agtgtgtttttgcactgtctg

SEQ ID NO: 3031292 - DNA, 15 bp, Homo sapiens
agtgttaaatgtgat

SEQ ID NO: 3031293 - DNA, 16 bp, Homo sapiens
agtgttaatactagtt

SEQ ID NO: 3031294 - DNA, 14 bp, Homo sapiens
ataaaactaggaat

SEQ ID NO: 3031295 - DNA, 13 bp, Homo sapiens
ataaaactgtgca

SEQ ID NO: 3031296 - DNA, 15 bp, Homo sapiens
ataaaagacagtgaa

SEQ ID NO: 3031297 - DNA, 16 bp, Homo sapiens
ataaaagacagtgaaa

SEQ ID NO: 3031298 - DNA, 12 bp, Homo sapiens
ataaaagctgtg

SEQ ID NO: 3031299 - DNA, 17 bp, Homo sapiens
ataaaaggaagccaaag

SEQ ID NO: 3031300 - DNA, 20 bp, Homo sapiens
ataaaaggaagccaaagagt

SEQ ID NO: 3031301 - DNA, 19 bp, Homo sapiens
ataaaaggcaaatgtgtac

SEQ ID NO: 3031302 - DNA, 20 bp, Homo sapiens
ataaaaggcaaatgtgtaca

SEQ ID NO: 3031303 - DNA, 17 bp, Homo sapiens
ataaaagggtcaaacct

SEQ ID NO: 3031304 - DNA, 18 bp, Homo sapiens
ataaaagtgattgttggc

SEQ ID NO: 3031305 - DNA, 15 bp, Homo sapiens
ataaaagtttgcatg

SEQ ID NO: 3031306 - DNA, 14 bp, Homo sapiens
ataaaataaaataa

SEQ ID NO: 3031307 - DNA, 16 bp, Homo sapiens
ataaaatactaaacta

SEQ ID NO: 3031308 - DNA, 16 bp, Homo sapiens
ataaaatggctgtaat

SEQ ID NO: 3031309 - DNA, 14 bp, Homo sapiens
ataaaatgttcctt

SEQ ID NO: 3031310 - DNA, 21 bp, Homo sapiens
ataaaattatagatgggaatg

SEQ ID NO: 3031311 - DNA, 14 bp, Homo sapiens
ataaaatttacatt

SEQ ID NO: 3031312 - DNA, 15 bp, Homo sapiens
ataaaatttacattt

SEQ ID NO: 3031313 - DNA, 18 bp, Homo sapiens
ataaaatttacatttaat

SEQ ID NO: 3031314 - DNA, 17 bp, Homo sapiens
ataaaattttttttcat

SEQ ID NO: 3031315 - DNA, 16 bp, Homo sapiens
ataaacaaagattcat

SEQ ID NO: 3031316 - DNA, 11 bp, Homo sapiens
ataaacagcag

SEQ ID NO: 3031317 - DNA, 15 bp, Homo sapiens
ataaacagcagggtt

SEQ ID NO: 3031318 - DNA, 22 bp, Homo sapiens
ataaacagttttacttgtgtca

SEQ ID NO: 3031319 - DNA, 22 bp, Homo sapiens
ataaacatttgtagcatcctct

SEQ ID NO: 3031320 - DNA, 13 bp, Homo sapiens
ataaaccaagaca

SEQ ID NO: 3031321 - DNA, 14 bp, Homo sapiens
ataaaccattggac

SEQ ID NO: 3031322 - DNA, 16 bp, Homo sapiens
ataaaccattggacag

SEQ ID NO: 3031323 - DNA, 21 bp, Homo sapiens
ataaacccagttgccatctgc

SEQ ID NO: 3031324 - DNA, 14 bp, Homo sapiens
ataaaccttatgaa

SEQ ID NO: 3031325 - DNA, 21 bp, Homo sapiens
ataaaccttatgaactacagt

SEQ ID NO: 3031326 - DNA, 19 bp, Homo sapiens
ataaaccttgtcaataaaa

SEQ ID NO: 3031327 - DNA, 20 bp, Homo sapiens
ataaaccttgtttctttctg

SEQ ID NO: 3031328 - DNA, 15 bp, Homo sapiens
ataaacgatttaatt

SEQ ID NO: 3031329 - DNA, 18 bp, Homo sapiens
ataaacgatttaattctc

SEQ ID NO: 3031330 - DNA, 12 bp, Homo sapiens
ataaactgagcc

SEQ ID NO: 3031331 - DNA, 21 bp, Homo sapiens
ataaactggtatgaataattg

SEQ ID NO: 3031332 - DNA, 18 bp, Homo sapiens
ataaacttagaggaaaat

SEQ ID NO: 3031333 - DNA, 11 bp, Homo sapiens
ataaagacagg

SEQ ID NO: 3031334 - DNA, 15 bp, Homo sapiens
ataaagatgtgaaaa

SEQ ID NO: 3031335 - DNA, 15 bp, Homo sapiens
ataaagatgttaaaa

SEQ ID NO: 3031336 - DNA, 12 bp, Homo sapiens
ataaagccaaga

SEQ ID NO: 3031337 - DNA, 15 bp, Homo sapiens
ataaagccaagaatt

SEQ ID NO: 3031338 - DNA, 19 bp, Homo sapiens
ataaagctctcaaatgtga

SEQ ID NO: 3031339 - DNA, 21 bp, Homo sapiens
ataaagctgccccatctgggg

SEQ ID NO: 3031340 - DNA, 21 bp, Homo sapiens
ataaagctgttattcttgtta

SEQ ID NO: 3031341 - DNA, 14 bp, Homo sapiens
ataaagctgttctc

SEQ ID NO: 3031342 - DNA, 21 bp, Homo sapiens
ataaagctgttctcattcctg

SEQ ID NO: 3031343 - DNA, 15 bp, Homo sapiens
ataaaggagaggtta

SEQ ID NO: 3031344 - DNA, 21 bp, Homo sapiens
ataaaggagaggttaaagcaa

SEQ ID NO: 3031345 - DNA, 13 bp, Homo sapiens
ataaaggatgtga

SEQ ID NO: 3031346 - DNA, 14 bp, Homo sapiens
ataaaggatgtgat

SEQ ID NO: 3031347 - DNA, 13 bp, Homo sapiens
ataaagggaacat

SEQ ID NO: 3031348 - DNA, 15 bp, Homo sapiens
ataaagtacttgact

SEQ ID NO: 3031349 - DNA, 13 bp, Homo sapiens
ataaagtagaaat

SEQ ID NO: 3031350 - DNA, 13 bp, Homo sapiens
ataaagtagtaaa

SEQ ID NO: 3031351 - DNA, 13 bp, Homo sapiens
ataaagttaaagt

SEQ ID NO: 3031352 - DNA, 15 bp, Homo sapiens
ataaagttctgtact

SEQ ID NO: 3031353 - DNA, 14 bp, Homo sapiens
ataaagttgagaga

SEQ ID NO: 3031354 - DNA, 22 bp, Homo sapiens
ataaagtttgtaagaaaatgtt

SEQ ID NO: 3031355 - DNA, 14 bp, Homo sapiens
ataaataaaaataa

SEQ ID NO: 3031356 - DNA, 14 bp, Homo sapiens
ataaataaaagcct

SEQ ID NO: 3031357 - DNA, 14 bp, Homo sapiens
ataaataaattcca

SEQ ID NO: 3031358 - DNA, 21 bp, Homo sapiens
ataaataatcggcccacagct

SEQ ID NO: 3031359 - DNA, 14 bp, Homo sapiens
ataaatacaaatct

SEQ ID NO: 3031360 - DNA, 17 bp, Homo sapiens
ataaatacaagttcttt

SEQ ID NO: 3031361 - DNA, 17 bp, Homo sapiens
ataaatactgacaatgt

SEQ ID NO: 3031362 - DNA, 15 bp, Homo sapiens
ataaatagtagaaaa

SEQ ID NO: 3031363 - DNA, 22 bp, Homo sapiens
ataaatatgcctctcctttgta

SEQ ID NO: 3031364 - DNA, 22 bp, Homo sapiens
ataaatattatattatatatat

SEQ ID NO: 3031365 - DNA, 21 bp, Homo sapiens
ataaatatttggtaattctgt

SEQ ID NO: 3031366 - DNA, 16 bp, Homo sapiens
ataaatctgacccagt

SEQ ID NO: 3031367 - DNA, 18 bp, Homo sapiens
ataaatctgacccagtgc

SEQ ID NO: 3031368 - DNA, 15 bp, Homo sapiens
ataaatgaggtcact

SEQ ID NO: 3031369 - DNA, 20 bp, Homo sapiens
ataaatgtctattattatga

SEQ ID NO: 3031370 - DNA, 21 bp, Homo sapiens
ataaatgtctattattatgaa

SEQ ID NO: 3031371 - DNA, 22 bp, Homo sapiens
ataaatgtcttttttttaatgt

SEQ ID NO: 3031372 - DNA, 23 bp, Homo sapiens
ataaatgtcttttttttaatgtg

SEQ ID NO: 3031373 - DNA, 15 bp, Homo sapiens
ataaatgttaagaaa

SEQ ID NO: 3031374 - DNA, 16 bp, Homo sapiens
ataaatgttaagaaaa

SEQ ID NO: 3031375 - DNA, 16 bp, Homo sapiens
ataaatgttagttcta

SEQ ID NO: 3031376 - DNA, 20 bp, Homo sapiens
ataaatgtttcccccactcc

SEQ ID NO: 3031377 - DNA, 14 bp, Homo sapiens
ataaatgtttggaa

SEQ ID NO: 3031378 - DNA, 16 bp, Homo sapiens
ataaatgtttggaaag

SEQ ID NO: 3031379 - DNA, 23 bp, Homo sapiens
ataaattccccatatttgtgttc

SEQ ID NO: 3031380 - DNA, 19 bp, Homo sapiens
ataaattctactaagttat

SEQ ID NO: 3031381 - DNA, 14 bp, Homo sapiens
ataaatttaatgta

SEQ ID NO: 3031382 - DNA, 22 bp, Homo sapiens
ataaatttactctgttgaatat

SEQ ID NO: 3031383 - DNA, 14 bp, Homo sapiens
ataaattttgtgca

SEQ ID NO: 3031384 - DNA, 16 bp, Homo sapiens
ataaattttttgaaac

SEQ ID NO: 3031385 - DNA, 17 bp, Homo sapiens
ataacaaagatatcttt

SEQ ID NO: 3031386 - DNA, 20 bp, Homo sapiens
ataacaaagatatcttttct

SEQ ID NO: 3031387 - DNA, 13 bp, Homo sapiens
ataacacctgcca

SEQ ID NO: 3031388 - DNA, 13 bp, Homo sapiens
ataacaggttatt

SEQ ID NO: 3031389 - DNA, 12 bp, Homo sapiens
ataacatagttg

SEQ ID NO: 3031390 - DNA, 14 bp, Homo sapiens
ataacatatatgga

SEQ ID NO: 3031391 - DNA, 15 bp, Homo sapiens
ataacatatctaaag

SEQ ID NO: 3031392 - DNA, 14 bp, Homo sapiens
ataacatatgcagt

SEQ ID NO: 3031393 - DNA, 16 bp, Homo sapiens
ataacattttgtttat

SEQ ID NO: 3031394 - DNA, 17 bp, Homo sapiens
ataacattttgtttatg

SEQ ID NO: 3031395 - DNA, 22 bp, Homo sapiens
ataacattttgtttatgttact

SEQ ID NO: 3031396 - DNA, 23 bp, Homo sapiens
ataaccacaaagcacagtttgaa

SEQ ID NO: 3031397 - DNA, 14 bp, Homo sapiens
ataaccactgaagg

SEQ ID NO: 3031398 - DNA, 13 bp, Homo sapiens
ataaccctgttac

SEQ ID NO: 3031399 - DNA, 22 bp, Homo sapiens
ataacctgatgccataaataca

SEQ ID NO: 3031400 - DNA, 18 bp, Homo sapiens
ataacggttaagaaagca

SEQ ID NO: 3031401 - DNA, 17 bp, Homo sapiens
ataactaatgaattgaa

SEQ ID NO: 3031402 - DNA, 19 bp, Homo sapiens
ataactaatgaattgaaat

SEQ ID NO: 3031403 - DNA, 17 bp, Homo sapiens
ataactacttagcactg

SEQ ID NO: 3031404 - DNA, 19 bp, Homo sapiens
ataactatcaggcagaaga

SEQ ID NO: 3031405 - DNA, 23 bp, Homo sapiens
ataactatcaggcagaagaatct

SEQ ID NO: 3031406 - DNA, 16 bp, Homo sapiens
ataactgaaggagaag

SEQ ID NO: 3031407 - DNA, 19 bp, Homo sapiens
ataactgatctatttatta

SEQ ID NO: 3031408 - DNA, 16 bp, Homo sapiens
ataactgctcttttac

SEQ ID NO: 3031409 - DNA, 21 bp, Homo sapiens
ataactgctcttttactaaga

SEQ ID NO: 3031410 - DNA, 16 bp, Homo sapiens
ataactgctgtattca

SEQ ID NO: 3031411 - DNA, 19 bp, Homo sapiens
ataacttccttcacatctc

SEQ ID NO: 3031412 - DNA, 23 bp, Homo sapiens
ataacttccttcacatctcccat

SEQ ID NO: 3031413 - DNA, 18 bp, Homo sapiens
ataacttctcatgtatat

SEQ ID NO: 3031414 - DNA, 20 bp, Homo sapiens
ataacttctcatgtatatta

SEQ ID NO: 3031415 - DNA, 19 bp, Homo sapiens
ataactttatgaagtgcta

SEQ ID NO: 3031416 - DNA, 17 bp, Homo sapiens
ataactttgactttctt

SEQ ID NO: 3031417 - DNA, 23 bp, Homo sapiens
ataactttgctggaaaatctgta

SEQ ID NO: 3031418 - DNA, 12 bp, Homo sapiens
ataactttgctt

SEQ ID NO: 3031419 - DNA, 21 bp, Homo sapiens
ataactttgcttgcagtagat

SEQ ID NO: 3031420 - DNA, 21 bp, Homo sapiens
ataactttttttcaatttttt

SEQ ID NO: 3031421 - DNA, 11 bp, Homo sapiens
ataagaaaaag

SEQ ID NO: 3031422 - DNA, 12 bp, Homo sapiens
ataagaaaaagg

SEQ ID NO: 3031423 - DNA, 15 bp, Homo sapiens
ataagaaatactaga

SEQ ID NO: 3031424 - DNA, 17 bp, Homo sapiens
ataagaattattttgat

SEQ ID NO: 3031425 - DNA, 15 bp, Homo sapiens
ataagagaatcaaca

SEQ ID NO: 3031426 - DNA, 18 bp, Homo sapiens
ataagagtctccttctct

SEQ ID NO: 3031427 - DNA, 15 bp, Homo sapiens
atatatatatatgca

SEQ ID NO: 3031428 - DNA, 13 bp, Homo sapiens
atatatatattga

SEQ ID NO: 3031429 - DNA, 12 bp, Homo sapiens
atatatcagtgt

SEQ ID NO: 3031430 - DNA, 17 bp, Homo sapiens
atatatcctgaaagcat

SEQ ID NO: 3031431 - DNA, 14 bp, Homo sapiens
atatatctttatac

SEQ ID NO: 3031432 - DNA, 15 bp, Homo sapiens
atatatcttttgtaa

SEQ ID NO: 3031433 - DNA, 21 bp, Homo sapiens
atatatgattgtttgcacaga

SEQ ID NO: 3031434 - DNA, 10 bp, Homo sapiens
atatatgtat

SEQ ID NO: 3031435 - DNA, 16 bp, Homo sapiens
atatattatatataga

SEQ ID NO: 3031436 - DNA, 15 bp, Homo sapiens
atatattcaccaatg

SEQ ID NO: 3031437 - DNA, 20 bp, Homo sapiens
atatattcactttcattttt

SEQ ID NO: 3031438 - DNA, 21 bp, Homo sapiens
atatattcactttcatttttg

SEQ ID NO: 3031439 - DNA, 15 bp, Homo sapiens
atatattcccaatag

SEQ ID NO: 3031440 - DNA, 18 bp, Homo sapiens
atatatttaacatgtgga

SEQ ID NO: 3031441 - DNA, 23 bp, Homo sapiens
atatatttaacatgtggaagaaa

SEQ ID NO: 3031442 - DNA, 23 bp, Homo sapiens
atatatttctattattaattgca

SEQ ID NO: 3031443 - DNA, 13 bp, Homo sapiens
atatatttgtgta

SEQ ID NO: 3031444 - DNA, 14 bp, Homo sapiens
atatcaaaattcta

SEQ ID NO: 3031445 - DNA, 22 bp, Homo sapiens
atatcaagaagtcagagaaaac

SEQ ID NO: 3031446 - DNA, 18 bp, Homo sapiens
atatcaagtactacattt

SEQ ID NO: 3031447 - DNA, 18 bp, Homo sapiens
atatcacatgttttctct

SEQ ID NO: 3031448 - DNA, 14 bp, Homo sapiens
atatcagcaagtct

SEQ ID NO: 3031449 - DNA, 16 bp, Homo sapiens
atatcagtgacagttg

SEQ ID NO: 3031450 - DNA, 15 bp, Homo sapiens
atatcagtgttgtct

SEQ ID NO: 3031451 - DNA, 17 bp, Homo sapiens
atatcagttactcagcc

SEQ ID NO: 3031452 - DNA, 21 bp, Homo sapiens
atatcagttactcagccctgg

SEQ ID NO: 3031453 - DNA, 23 bp, Homo sapiens
atatcagttactcagccctgggc

SEQ ID NO: 3031454 - DNA, 21 bp, Homo sapiens
atatcatcaatgtgacattta

SEQ ID NO: 3031455 - DNA, 21 bp, Homo sapiens
atatcatgaagccttgctgaa

SEQ ID NO: 3031456 - DNA, 13 bp, Homo sapiens
atatcatgctaaa

SEQ ID NO: 3031457 - DNA, 19 bp, Homo sapiens
atatcatgctaaaattcta

SEQ ID NO: 3031458 - DNA, 12 bp, Homo sapiens
atatccatcttt

SEQ ID NO: 3031459 - DNA, 13 bp, Homo sapiens
atatccatctttt

SEQ ID NO: 3031460 - DNA, 20 bp, Homo sapiens
atatcccaaactgtgatgaa

SEQ ID NO: 3031461 - DNA, 17 bp, Homo sapiens
atatcccgtgaaagttt

SEQ ID NO: 3031462 - DNA, 21 bp, Homo sapiens
atatccttttcttctatgtag

SEQ ID NO: 3031463 - DNA, 19 bp, Homo sapiens
atatcggtgctatgtgttt

SEQ ID NO: 3031464 - DNA, 19 bp, Homo sapiens
atatctaaagttatatttc

SEQ ID NO: 3031465 - DNA, 18 bp, Homo sapiens
atatctaaattgaataat

SEQ ID NO: 3031466 - DNA, 15 bp, Homo sapiens
atatctagatttcta

SEQ ID NO: 3031467 - DNA, 15 bp, Homo sapiens
atatctatatatata

SEQ ID NO: 3031468 - DNA, 18 bp, Homo sapiens
atatctccatagctggga

SEQ ID NO: 3031469 - DNA, 21 bp, Homo sapiens
atatctccatagctgggaaac

SEQ ID NO: 3031470 - DNA, 13 bp, Homo sapiens
atatctctatttg

SEQ ID NO: 3031471 - DNA, 14 bp, Homo sapiens
atatctctatttga

SEQ ID NO: 3031472 - DNA, 13 bp, Homo sapiens
atatctctccctt

SEQ ID NO: 3031473 - DNA, 15 bp, Homo sapiens
atatctgaaatgtga

SEQ ID NO: 3031474 - DNA, 13 bp, Homo sapiens
atatctgaagatt

SEQ ID NO: 3031475 - DNA, 13 bp, Homo sapiens
atatctgtatgta

SEQ ID NO: 3031476 - DNA, 21 bp, Homo sapiens
atatctgtatgtattagtgat

SEQ ID NO: 3031477 - DNA, 19 bp, Homo sapiens
atatcttctgatttgtccc

SEQ ID NO: 3031478 - DNA, 15 bp, Homo sapiens
atatcttctgtttca

SEQ ID NO: 3031479 - DNA, 16 bp, Homo sapiens
atatcttctgtttcat

SEQ ID NO: 3031480 - DNA, 12 bp, Homo sapiens
atatctttgcat

SEQ ID NO: 3031481 - DNA, 21 bp, Homo sapiens
atatcttttctttagagaact

SEQ ID NO: 3031482 - DNA, 22 bp, Homo sapiens
atatcttttctttagagaactg

SEQ ID NO: 3031483 - DNA, 19 bp, Homo sapiens
atatcttttgtaagacatt

SEQ ID NO: 3031484 - DNA, 13 bp, Homo sapiens
atatgaaaacact

SEQ ID NO: 3031485 - DNA, 14 bp, Homo sapiens
atatgaaaacactc

SEQ ID NO: 3031486 - DNA, 21 bp, Homo sapiens
atatgaaactctacatttaaa

SEQ ID NO: 3031487 - DNA, 17 bp, Homo sapiens
atatgaaatattttgaa

SEQ ID NO: 3031488 - DNA, 15 bp, Homo sapiens
atatgaagacataaa

SEQ ID NO: 3031489 - DNA, 16 bp, Homo sapiens
atatgaagacataaac

SEQ ID NO: 3031490 - DNA, 11 bp, Homo sapiens
atatgaagcaa

SEQ ID NO: 3031491 - DNA, 16 bp, Homo sapiens
atatgaagcaagctgt

SEQ ID NO: 3031492 - DNA, 17 bp, Homo sapiens
atatgaagcaagctgtg

SEQ ID NO: 3031493 - DNA, 19 bp, Homo sapiens
atatgaagttactttctta

SEQ ID NO: 3031494 - DNA, 16 bp, Homo sapiens
atatgaattgctgtct

SEQ ID NO: 3031495 - DNA, 14 bp, Homo sapiens
atatgacagctgtc

SEQ ID NO: 3031496 - DNA, 21 bp, Homo sapiens
atatgacagctgtccctgtca

SEQ ID NO: 3031497 - DNA, 14 bp, Homo sapiens
atatgagaagatcc

SEQ ID NO: 3031498 - DNA, 23 bp, Homo sapiens
atatgagaaggtgcctcaagaat

SEQ ID NO: 3031499 - DNA, 13 bp, Homo sapiens
atatgataaaaca

SEQ ID NO: 3031500 - DNA, 16 bp, Homo sapiens
atatgattctctgtgg

SEQ ID NO: 3031501 - DNA, 17 bp, Homo sapiens
atatgcaccttgtgtct

SEQ ID NO: 3031502 - DNA, 16 bp, Homo sapiens
atatgcactatgtata

SEQ ID NO: 3031503 - DNA, 20 bp, Homo sapiens
atatgcagtaaaagaaagaa

SEQ ID NO: 3031504 - DNA, 16 bp, Homo sapiens
atatgcagttttcctt

SEQ ID NO: 3031505 - DNA, 22 bp, Homo sapiens
atatgcccacatttagtctctt

SEQ ID NO: 3031506 - DNA, 16 bp, Homo sapiens
atatggaagtaaaggc

SEQ ID NO: 3031507 - DNA, 16 bp, Homo sapiens
atatggacactgtgac

SEQ ID NO: 3031508 - DNA, 18 bp, Homo sapiens
atatggactcagttttct

SEQ ID NO: 3031509 - DNA, 23 bp, Homo sapiens
atatggccacagtagtcttgatg

SEQ ID NO: 3031510 - DNA, 23 bp, Homo sapiens
atatgggaacactggcagactgt

SEQ ID NO: 3031511 - DNA, 16 bp, Homo sapiens
atatgggcgggcagtc

SEQ ID NO: 3031512 - DNA, 19 bp, Homo sapiens
atatggtactaaggagaat

SEQ ID NO: 3031513 - DNA, 19 bp, Homo sapiens
atatggtatatatacatat

SEQ ID NO: 3031514 - DNA, 16 bp, Homo sapiens
atatgtacagttatct

SEQ ID NO: 3031515 - DNA, 18 bp, Homo sapiens
atatgtagaaacatttag

SEQ ID NO: 3031516 - DNA, 15 bp, Homo sapiens
atatgtatacacaaa

SEQ ID NO: 3031517 - DNA, 21 bp, Homo sapiens
atatgtatatatatatatgca

SEQ ID NO: 3031518 - DNA, 11 bp, Homo sapiens
atatgtatttt

SEQ ID NO: 3031519 - DNA, 17 bp, Homo sapiens
atatgtatttttatata

SEQ ID NO: 3031520 - DNA, 16 bp, Homo sapiens
atatgtattttttgaa

SEQ ID NO: 3031521 - DNA, 19 bp, Homo sapiens
atatgtattttttgaatct

SEQ ID NO: 3031522 - DNA, 16 bp, Homo sapiens
atatgtctgctccttt

SEQ ID NO: 3031523 - DNA, 20 bp, Homo sapiens
atatgtgagtgaaagtactt

SEQ ID NO: 3031524 - DNA, 16 bp, Homo sapiens
atatgtgtatgtacgt

SEQ ID NO: 3031525 - DNA, 11 bp, Homo sapiens
atatgttaaag

SEQ ID NO: 3031526 - DNA, 14 bp, Homo sapiens
atatgttaaagttt

SEQ ID NO: 3031527 - DNA, 14 bp, Homo sapiens
atatgttcactgtc

SEQ ID NO: 3031528 - DNA, 15 bp, Homo sapiens
atatgttgaatactt

SEQ ID NO: 3031529 - DNA, 13 bp, Homo sapiens
atatgttgaatgt

SEQ ID NO: 3031530 - DNA, 17 bp, Homo sapiens
atatgtttttaaaggtg

SEQ ID NO: 3031531 - DNA, 18 bp, Homo sapiens
atattaaaaatatacaag

SEQ ID NO: 3031532 - DNA, 22 bp, Homo sapiens
atattaaaatatgaaggtttga

SEQ ID NO: 3031533 - DNA, 17 bp, Homo sapiens
atattaaaggtgaaaat

SEQ ID NO: 3031534 - DNA, 13 bp, Homo sapiens
atattaaataaca

SEQ ID NO: 3031535 - DNA, 16 bp, Homo sapiens
atattaaataacatgt

SEQ ID NO: 3031536 - DNA, 15 bp, Homo sapiens
atattaactactgta

SEQ ID NO: 3031537 - DNA, 21 bp, Homo sapiens
atattaactactgtagaactg

SEQ ID NO: 3031538 - DNA, 16 bp, Homo sapiens
atattaagaaaaatat

SEQ ID NO: 3031539 - DNA, 13 bp, Homo sapiens
atattaagaaaca

SEQ ID NO: 3031540 - DNA, 14 bp, Homo sapiens
atattaagaaacaa

SEQ ID NO: 3031541 - DNA, 16 bp, Homo sapiens
atattaagaaacaatt

SEQ ID NO: 3031542 - DNA, 19 bp, Homo sapiens
atattaatataagtttctt

SEQ ID NO: 3031543 - DNA, 16 bp, Homo sapiens
atattacagcttattt

SEQ ID NO: 3031544 - DNA, 16 bp, Homo sapiens
atattacccaatggaa

SEQ ID NO: 3031545 - DNA, 21 bp, Homo sapiens
atattaccttaagatttttct

SEQ ID NO: 3031546 - DNA, 18 bp, Homo sapiens
atattacgttgtttctta

SEQ ID NO: 3031547 - DNA, 20 bp, Homo sapiens
atattacgttgtttcttata

SEQ ID NO: 3031548 - DNA, 19 bp, Homo sapiens
atattactgtcttttctat

SEQ ID NO: 3031549 - DNA, 15 bp, Homo sapiens
atattagatgtgatt

SEQ ID NO: 3031550 - DNA, 20 bp, Homo sapiens
atattagatgtgatttaata

SEQ ID NO: 3031551 - DNA, 16 bp, Homo sapiens
atattagcaaagaagc

SEQ ID NO: 3031552 - DNA, 17 bp, Homo sapiens
atattagcaaagaagct

SEQ ID NO: 3031553 - DNA, 21 bp, Homo sapiens
atattagctttactgtttgtt

SEQ ID NO: 3031554 - DNA, 14 bp, Homo sapiens
atattatatataga

SEQ ID NO: 3031555 - DNA, 16 bp, Homo sapiens
atattatatatagaaa

SEQ ID NO: 3031556 - DNA, 14 bp, Homo sapiens
atattatgagatgc

SEQ ID NO: 3031557 - DNA, 22 bp, Homo sapiens
atattatgtggcttttatttca

SEQ ID NO: 3031558 - DNA, 19 bp, Homo sapiens
atattattagttttgattt

SEQ ID NO: 3031559 - DNA, 22 bp, Homo sapiens
atattattccgtattacatttt

SEQ ID NO: 3031560 - DNA, 19 bp, Homo sapiens
atctagacccatcttcttt

SEQ ID NO: 3031561 - DNA, 23 bp, Homo sapiens
atctagagtttatacagtgtaca

SEQ ID NO: 3031562 - DNA, 16 bp, Homo sapiens
atctagatttctagaa

SEQ ID NO: 3031563 - DNA, 14 bp, Homo sapiens
atctatatatataa

SEQ ID NO: 3031564 - DNA, 16 bp, Homo sapiens
atctatatatgtgtat

SEQ ID NO: 3031565 - DNA, 16 bp, Homo sapiens
atctatatgtacttgt

SEQ ID NO: 3031566 - DNA, 19 bp, Homo sapiens
atctatgaacctgaaaagg

SEQ ID NO: 3031567 - DNA, 15 bp, Homo sapiens
atctatgatgtttct

SEQ ID NO: 3031568 - DNA, 23 bp, Homo sapiens
atctatgatgtttcttttgcaat

SEQ ID NO: 3031569 - DNA, 15 bp, Homo sapiens
atctatgtttataat

SEQ ID NO: 3031570 - DNA, 21 bp, Homo sapiens
atctatgtttataatactact

SEQ ID NO: 3031571 - DNA, 16 bp, Homo sapiens
atctatttgtgtgtgt

SEQ ID NO: 3031572 - DNA, 16 bp, Homo sapiens
atctcaaatgttttct

SEQ ID NO: 3031573 - DNA, 18 bp, Homo sapiens
atctcaaatgttttctgc

SEQ ID NO: 3031574 - DNA, 18 bp, Homo sapiens
atctcaagtatatgtcat

SEQ ID NO: 3031575 - DNA, 19 bp, Homo sapiens
atctcaagtatatgtcatt

SEQ ID NO: 3031576 - DNA, 17 bp, Homo sapiens
atctcaatacagcctga

SEQ ID NO: 3031577 - DNA, 14 bp, Homo sapiens
atctcaatgcaagc

SEQ ID NO: 3031578 - DNA, 17 bp, Homo sapiens
atctcacaccttagcta

SEQ ID NO: 3031579 - DNA, 12 bp, Homo sapiens
atctcactctgc

SEQ ID NO: 3031580 - DNA, 14 bp, Homo sapiens
atctcagccatagg

SEQ ID NO: 3031581 - DNA, 12 bp, Homo sapiens
atctcagccatt

SEQ ID NO: 3031582 - DNA, 14 bp, Homo sapiens
atctcaggccagag

SEQ ID NO: 3031583 - DNA, 17 bp, Homo sapiens
atctcaggccagagcca

SEQ ID NO: 3031584 - DNA, 16 bp, Homo sapiens
atctcagtggtgtgtg

SEQ ID NO: 3031585 - DNA, 19 bp, Homo sapiens
atctcagttgattttctgg

SEQ ID NO: 3031586 - DNA, 21 bp, Homo sapiens
atctcagttgattttctggat

SEQ ID NO: 3031587 - DNA, 21 bp, Homo sapiens
atctcatgcccctggctggga

SEQ ID NO: 3031588 - DNA, 15 bp, Homo sapiens
atctcattggaccct

SEQ ID NO: 3031589 - DNA, 20 bp, Homo sapiens
atctcattggacccttccat

SEQ ID NO: 3031590 - DNA, 21 bp, Homo sapiens
atctcatttttccgtaaaaat

SEQ ID NO: 3031591 - DNA, 15 bp, Homo sapiens
atctcccacaagtat

SEQ ID NO: 3031592 - DNA, 18 bp, Homo sapiens
atctcccacctagcagca

SEQ ID NO: 3031593 - DNA, 21 bp, Homo sapiens
atctcccagacttgtttcctg

SEQ ID NO: 3031594 - DNA, 19 bp, Homo sapiens
atctcccagataatgtgaa

SEQ ID NO: 3031595 - DNA, 20 bp, Homo sapiens
atctcccagataatgtgaaa

SEQ ID NO: 3031596 - DNA, 13 bp, Homo sapiens
atctccctgccat

SEQ ID NO: 3031597 - DNA, 15 bp, Homo sapiens
atctccctgccatcc

SEQ ID NO: 3031598 - DNA, 17 bp, Homo sapiens
atctccctgccatcccc

SEQ ID NO: 3031599 - DNA, 23 bp, Homo sapiens
atctccctgccatccccctctca

SEQ ID NO: 3031600 - DNA, 19 bp, Homo sapiens
atctccctgcttcatatct

SEQ ID NO: 3031601 - DNA, 22 bp, Homo sapiens
atctcccttccacctcacaact

SEQ ID NO: 3031602 - DNA, 22 bp, Homo sapiens
atctccgcctccacactgacca

SEQ ID NO: 3031603 - DNA, 17 bp, Homo sapiens
atctcctagggctatgg

SEQ ID NO: 3031604 - DNA, 20 bp, Homo sapiens
atctcctatcttttatttca

SEQ ID NO: 3031605 - DNA, 20 bp, Homo sapiens
atctcctcgcaagctgggta

SEQ ID NO: 3031606 - DNA, 18 bp, Homo sapiens
atctcgcctggaaacaga

SEQ ID NO: 3031607 - DNA, 20 bp, Homo sapiens
atctcgcctggaaacagagg

SEQ ID NO: 3031608 - DNA, 14 bp, Homo sapiens
atctcggggctgct

SEQ ID NO: 3031609 - DNA, 17 bp, Homo sapiens
atctcgtcaggctgcca

SEQ ID NO: 3031610 - DNA, 15 bp, Homo sapiens
atctcgtttcaaaaa

SEQ ID NO: 3031611 - DNA, 17 bp, Homo sapiens
atctcgtttcaaaaaca

SEQ ID NO: 3031612 - DNA, 13 bp, Homo sapiens
atctctatactgc

SEQ ID NO: 3031613 - DNA, 17 bp, Homo sapiens
atctctcatcctccagt

SEQ ID NO: 3031614 - DNA, 21 bp, Homo sapiens
atctctcatcctccagtacct

SEQ ID NO: 3031615 - DNA, 14 bp, Homo sapiens
atctctctgcccaa

SEQ ID NO: 3031616 - DNA, 17 bp, Homo sapiens
atctctgagtgtctctg

SEQ ID NO: 3031617 - DNA, 21 bp, Homo sapiens
atctctgagtgtctctgcctg

SEQ ID NO: 3031618 - DNA, 22 bp, Homo sapiens
atctctgcaggaaatggctgtg

SEQ ID NO: 3031619 - DNA, 19 bp, Homo sapiens
atctctgcctagaatcttt

SEQ ID NO: 3031620 - DNA, 21 bp, Homo sapiens
atctctgcctagaatctttat

SEQ ID NO: 3031621 - DNA, 12 bp, Homo sapiens
atctctgccttt

SEQ ID NO: 3031622 - DNA, 13 bp, Homo sapiens
atctctgcctttg

SEQ ID NO: 3031623 - DNA, 15 bp, Homo sapiens
atctcttaaactctc

SEQ ID NO: 3031624 - DNA, 20 bp, Homo sapiens
atctcttcttttggcttcca

SEQ ID NO: 3031625 - DNA, 17 bp, Homo sapiens
atctcttgataaaggag

SEQ ID NO: 3031626 - DNA, 18 bp, Homo sapiens
atctcttgattataaatg

SEQ ID NO: 3031627 - DNA, 12 bp, Homo sapiens
atctcttgcttt

SEQ ID NO: 3031628 - DNA, 19 bp, Homo sapiens
atctctttaaaaacaaaca

SEQ ID NO: 3031629 - DNA, 12 bp, Homo sapiens
atctcttttata

SEQ ID NO: 3031630 - DNA, 23 bp, Homo sapiens
atctcttttccactccattgtcg

SEQ ID NO: 3031631 - DNA, 19 bp, Homo sapiens
atctctttttaagatagac

SEQ ID NO: 3031632 - DNA, 17 bp, Homo sapiens
atctgaaaatacatttc

SEQ ID NO: 3031633 - DNA, 13 bp, Homo sapiens
atctgaaatgtga

SEQ ID NO: 3031634 - DNA, 13 bp, Homo sapiens
atctgaacatctg

SEQ ID NO: 3031635 - DNA, 22 bp, Homo sapiens
atctgaagtggttcagtctaga

SEQ ID NO: 3031636 - DNA, 20 bp, Homo sapiens
atctgaatgaaaataactga

SEQ ID NO: 3031637 - DNA, 17 bp, Homo sapiens
atctgaattaaataaat

SEQ ID NO: 3031638 - DNA, 20 bp, Homo sapiens
atctgaccagcagcgccttt

SEQ ID NO: 3031639 - DNA, 17 bp, Homo sapiens
atctgaccatctgtgac

SEQ ID NO: 3031640 - DNA, 21 bp, Homo sapiens
atctgacccttctccaaaggc

SEQ ID NO: 3031641 - DNA, 21 bp, Homo sapiens
atctgagaaactctacatgta

SEQ ID NO: 3031642 - DNA, 13 bp, Homo sapiens
atctgagcaagga

SEQ ID NO: 3031643 - DNA, 20 bp, Homo sapiens
atctgagcgtttaaagtact

SEQ ID NO: 3031644 - DNA, 22 bp, Homo sapiens
atctgagcgtttaaagtactga

SEQ ID NO: 3031645 - DNA, 16 bp, Homo sapiens
atctgagctgagccag

SEQ ID NO: 3031646 - DNA, 17 bp, Homo sapiens
atctgagctgagccagg

SEQ ID NO: 3031647 - DNA, 19 bp, Homo sapiens
atctgagctgagccaggct

SEQ ID NO: 3031648 - DNA, 20 bp, Homo sapiens
atctgaggtcctgtgatctt

SEQ ID NO: 3031649 - DNA, 22 bp, Homo sapiens
atctgataaagttgagagacag

SEQ ID NO: 3031650 - DNA, 20 bp, Homo sapiens
atctgatcacccccctgctt

SEQ ID NO: 3031651 - DNA, 11 bp, Homo sapiens
atctgcaaagg

SEQ ID NO: 3031652 - DNA, 18 bp, Homo sapiens
atctgcacagtcagaagg

SEQ ID NO: 3031653 - DNA, 19 bp, Homo sapiens
atctgcacagtcagaagga

SEQ ID NO: 3031654 - DNA, 15 bp, Homo sapiens
atctgcacccccctg

SEQ ID NO: 3031655 - DNA, 17 bp, Homo sapiens
atctgcacccccctggg

SEQ ID NO: 3031656 - DNA, 19 bp, Homo sapiens
atctgcaggcaccgggctg

SEQ ID NO: 3031657 - DNA, 20 bp, Homo sapiens
atctgcaggcaccgggctgg

SEQ ID NO: 3031658 - DNA, 21 bp, Homo sapiens
atctgcatgtaaaatcttcag

SEQ ID NO: 3031659 - DNA, 22 bp, Homo sapiens
atctgcatgtaaaatcttcagc

SEQ ID NO: 3031660 - DNA, 20 bp, Homo sapiens
atctgcattgcccagtcttt

SEQ ID NO: 3031661 - DNA, 22 bp, Homo sapiens
atctgccatctaatggcttcag

SEQ ID NO: 3031662 - DNA, 14 bp, Homo sapiens
atctgcccaactgt

SEQ ID NO: 3031663 - DNA, 21 bp, Homo sapiens
atctgcccaactgtgtagcat

SEQ ID NO: 3031664 - DNA, 21 bp, Homo sapiens
atctgcccgcctgcccacctg

SEQ ID NO: 3031665 - DNA, 22 bp, Homo sapiens
atctgcccgcctgcccacctgc

SEQ ID NO: 3031666 - DNA, 23 bp, Homo sapiens
atctgcccgcctgcccacctgcc

SEQ ID NO: 3031667 - DNA, 15 bp, Homo sapiens
atctgcgatcatcgt

SEQ ID NO: 3031668 - DNA, 21 bp, Homo sapiens
atctgcgtgacaataaaacat

SEQ ID NO: 3031669 - DNA, 23 bp, Homo sapiens
atctgcgtgacaataaaacatta

SEQ ID NO: 3031670 - DNA, 20 bp, Homo sapiens
atctgctagggaatatcaat

SEQ ID NO: 3031671 - DNA, 19 bp, Homo sapiens
atctgctattaaccttgcc

SEQ ID NO: 3031672 - DNA, 16 bp, Homo sapiens
atctgctgcacatagc

SEQ ID NO: 3031673 - DNA, 13 bp, Homo sapiens
atctgctttctgt

SEQ ID NO: 3031674 - DNA, 19 bp, Homo sapiens
atctgctttctgttcatct

SEQ ID NO: 3031675 - DNA, 17 bp, Homo sapiens
atctggaacccagactc

SEQ ID NO: 3031676 - DNA, 19 bp, Homo sapiens
atctggaacccagactcag

SEQ ID NO: 3031677 - DNA, 17 bp, Homo sapiens
atctggaacctcagcct

SEQ ID NO: 3031678 - DNA, 21 bp, Homo sapiens
atctggaagggccaaggtctg

SEQ ID NO: 3031679 - DNA, 20 bp, Homo sapiens
atctggaaggggatcccacc

SEQ ID NO: 3031680 - DNA, 15 bp, Homo sapiens
atctggacacttctt

SEQ ID NO: 3031681 - DNA, 17 bp, Homo sapiens
atctggacacttcttta

SEQ ID NO: 3031682 - DNA, 21 bp, Homo sapiens
atctggagaccagggagcctt

SEQ ID NO: 3031683 - DNA, 21 bp, Homo sapiens
atctggcattctacacctgga

SEQ ID NO: 3031684 - DNA, 16 bp, Homo sapiens
atctggctgcctttgc

SEQ ID NO: 3031685 - DNA, 16 bp, Homo sapiens
atctgggaccctttcc

SEQ ID NO: 3031686 - DNA, 17 bp, Homo sapiens
atctgggaccctttcct

SEQ ID NO: 3031687 - DNA, 20 bp, Homo sapiens
atctgggaccctttccttcc

SEQ ID NO: 3031688 - DNA, 21 bp, Homo sapiens
atctgggtgggataatggact

SEQ ID NO: 3031689 - DNA, 20 bp, Homo sapiens
atctggtagggggaaaatgt

SEQ ID NO: 3031690 - DNA, 16 bp, Homo sapiens
atctggtgtccagcat

SEQ ID NO: 3031691 - DNA, 20 bp, Homo sapiens
atgccaaagccattctcccc

SEQ ID NO: 3031692 - DNA, 16 bp, Homo sapiens
atgccaacaagaatgc

SEQ ID NO: 3031693 - DNA, 18 bp, Homo sapiens
atgccaacaagaatgcat

SEQ ID NO: 3031694 - DNA, 13 bp, Homo sapiens
atgccaaccagct

SEQ ID NO: 3031695 - DNA, 15 bp, Homo sapiens
atgccacccacatct

SEQ ID NO: 3031696 - DNA, 15 bp, Homo sapiens
atgccaggacccgcc

SEQ ID NO: 3031697 - DNA, 22 bp, Homo sapiens
atgccaggttaggaaggcagca

SEQ ID NO: 3031698 - DNA, 19 bp, Homo sapiens
atgccaggttctatttgga

SEQ ID NO: 3031699 - DNA, 11 bp, Homo sapiens
atgccataata

SEQ ID NO: 3031700 - DNA, 12 bp, Homo sapiens
atgccataatac

SEQ ID NO: 3031701 - DNA, 14 bp, Homo sapiens
atgccatgatgcct

SEQ ID NO: 3031702 - DNA, 22 bp, Homo sapiens
atgcccacaacttgtcacccaa

SEQ ID NO: 3031703 - DNA, 12 bp, Homo sapiens
atgcccagccag

SEQ ID NO: 3031704 - DNA, 22 bp, Homo sapiens
atgcccagccagccacccctgc

SEQ ID NO: 3031705 - DNA, 12 bp, Homo sapiens
atgcccagttca

SEQ ID NO: 3031706 - DNA, 14 bp, Homo sapiens
atgcccattctttt

SEQ ID NO: 3031707 - DNA, 14 bp, Homo sapiens
atgccccaggctct

SEQ ID NO: 3031708 - DNA, 13 bp, Homo sapiens
atgcccccagctg

SEQ ID NO: 3031709 - DNA, 16 bp, Homo sapiens
atgcccccagctggcc

SEQ ID NO: 3031710 - DNA, 19 bp, Homo sapiens
atgccctcaagtaaaagaa

SEQ ID NO: 3031711 - DNA, 16 bp, Homo sapiens
atgccgtcttctgccc

SEQ ID NO: 3031712 - DNA, 15 bp, Homo sapiens
atgcctcactaattt

SEQ ID NO: 3031713 - DNA, 16 bp, Homo sapiens
atgcctcactaatttt

SEQ ID NO: 3031714 - DNA, 21 bp, Homo sapiens
atgcctcactaatttttgtat

SEQ ID NO: 3031715 - DNA, 13 bp, Homo sapiens
atgcctcagccct

SEQ ID NO: 3031716 - DNA, 22 bp, Homo sapiens
atgcctcataaattaatgattc

SEQ ID NO: 3031717 - DNA, 13 bp, Homo sapiens
atgcctccaccgc

SEQ ID NO: 3031718 - DNA, 14 bp, Homo sapiens
atgcctctgtctag

SEQ ID NO: 3031719 - DNA, 20 bp, Homo sapiens
atgcctgactaatttttgta

SEQ ID NO: 3031720 - DNA, 16 bp, Homo sapiens
atgcctgattttaaaa

SEQ ID NO: 3031721 - DNA, 23 bp, Homo sapiens
atgcctggaagctttgtcccctg

SEQ ID NO: 3031722 - DNA, 15 bp, Homo sapiens
atgcctggcctgcca

SEQ ID NO: 3031723 - DNA, 18 bp, Homo sapiens
atgcctgtaatcccagaa

SEQ ID NO: 3031724 - DNA, 13 bp, Homo sapiens
atgcctttgctgt

SEQ ID NO: 3031725 - DNA, 22 bp, Homo sapiens
atgcgattatctacccacgtcc

SEQ ID NO: 3031726 - DNA, 17 bp, Homo sapiens
atgcgcgcgctctctct

SEQ ID NO: 3031727 - DNA, 18 bp, Homo sapiens
atgcgcgcgctctctctc

SEQ ID NO: 3031728 - DNA, 20 bp, Homo sapiens
atgcggagccagcaggcctc

SEQ ID NO: 3031729 - DNA, 18 bp, Homo sapiens
atgcggggacaggctgga

SEQ ID NO: 3031730 - DNA, 15 bp, Homo sapiens
atgcggtagccagca

SEQ ID NO: 3031731 - DNA, 14 bp, Homo sapiens
atgcgtattctgtg

SEQ ID NO: 3031732 - DNA, 13 bp, Homo sapiens
atgcgtcccaaga

SEQ ID NO: 3031733 - DNA, 19 bp, Homo sapiens
atgcgtcccaagatgttga

SEQ ID NO: 3031734 - DNA, 14 bp, Homo sapiens
atgctaaaattcta

SEQ ID NO: 3031735 - DNA, 12 bp, Homo sapiens
atgctaaataac

SEQ ID NO: 3031736 - DNA, 15 bp, Homo sapiens
atgctaaataactat

SEQ ID NO: 3031737 - DNA, 13 bp, Homo sapiens
atgctaaatgtgt

SEQ ID NO: 3031738 - DNA, 17 bp, Homo sapiens
atgctaaatgtgtaata

SEQ ID NO: 3031739 - DNA, 19 bp, Homo sapiens
atgctaatattaaaagtca

SEQ ID NO: 3031740 - DNA, 16 bp, Homo sapiens
atgctacattaatgtt

SEQ ID NO: 3031741 - DNA, 19 bp, Homo sapiens
atgctacgtgtgatttttc

SEQ ID NO: 3031742 - DNA, 22 bp, Homo sapiens
atgctacgtgtgatttttctgg

SEQ ID NO: 3031743 - DNA, 14 bp, Homo sapiens
atgctactgtctca

SEQ ID NO: 3031744 - DNA, 19 bp, Homo sapiens
atgctacttcccactgtat

SEQ ID NO: 3031745 - DNA, 19 bp, Homo sapiens
atgctagaaaaatgttctt

SEQ ID NO: 3031746 - DNA, 14 bp, Homo sapiens
atgctagaaaaggc

SEQ ID NO: 3031747 - DNA, 16 bp, Homo sapiens
atgctagaagaaaaca

SEQ ID NO: 3031748 - DNA, 19 bp, Homo sapiens
atgctagcgcgttgcctgt

SEQ ID NO: 3031749 - DNA, 22 bp, Homo sapiens
atgctataaattttttgaaaca

SEQ ID NO: 3031750 - DNA, 13 bp, Homo sapiens
atgctattaaagt

SEQ ID NO: 3031751 - DNA, 19 bp, Homo sapiens
atgctatttcagccaatct

SEQ ID NO: 3031752 - DNA, 15 bp, Homo sapiens
atgctatttgaacaa

SEQ ID NO: 3031753 - DNA, 14 bp, Homo sapiens
atgctcagaccagc

SEQ ID NO: 3031754 - DNA, 21 bp, Homo sapiens
atgctcagttgctaaacactg

SEQ ID NO: 3031755 - DNA, 17 bp, Homo sapiens
atgctccaagattctag

SEQ ID NO: 3031756 - DNA, 21 bp, Homo sapiens
atgctccagcaacacagcctg

SEQ ID NO: 3031757 - DNA, 13 bp, Homo sapiens
atgctccagggtc

SEQ ID NO: 3031758 - DNA, 20 bp, Homo sapiens
atgctcccacctgaatttgt

SEQ ID NO: 3031759 - DNA, 22 bp, Homo sapiens
atgctcccacctgaatttgtat

SEQ ID NO: 3031760 - DNA, 17 bp, Homo sapiens
atgctctagtgccttct

SEQ ID NO: 3031761 - DNA, 19 bp, Homo sapiens
atgctctatcttgctctgt

SEQ ID NO: 3031762 - DNA, 21 bp, Homo sapiens
atgctctctgcagccagccca

SEQ ID NO: 3031763 - DNA, 22 bp, Homo sapiens
atgctctctgcagccagcccag

SEQ ID NO: 3031764 - DNA, 22 bp, Homo sapiens
atgctctgaaaggatgtagaaa

SEQ ID NO: 3031765 - DNA, 13 bp, Homo sapiens
atgctcttctgtg

SEQ ID NO: 3031766 - DNA, 14 bp, Homo sapiens
atgctcttctgtgg

SEQ ID NO: 3031767 - DNA, 21 bp, Homo sapiens
atgctcttgaccttgtagaga

SEQ ID NO: 3031768 - DNA, 21 bp, Homo sapiens
atgctcttggggttcataggg

SEQ ID NO: 3031769 - DNA, 13 bp, Homo sapiens
atgctctttcaat

SEQ ID NO: 3031770 - DNA, 16 bp, Homo sapiens
atgctctttcccagga

SEQ ID NO: 3031771 - DNA, 13 bp, Homo sapiens
atgctgacagctc

SEQ ID NO: 3031772 - DNA, 21 bp, Homo sapiens
atgctgacctcacctggtcct

SEQ ID NO: 3031773 - DNA, 17 bp, Homo sapiens
atgctgagggtgtttct

SEQ ID NO: 3031774 - DNA, 19 bp, Homo sapiens
atgctgatcatcgccagag

SEQ ID NO: 3031775 - DNA, 22 bp, Homo sapiens
atgctgatcatcgccagaggtg

SEQ ID NO: 3031776 - DNA, 21 bp, Homo sapiens
atgctgatgaatcactgtttt

SEQ ID NO: 3031777 - DNA, 15 bp, Homo sapiens
atgctgatgttcagt

SEQ ID NO: 3031778 - DNA, 18 bp, Homo sapiens
atgctgatgttcagtgta

SEQ ID NO: 3031779 - DNA, 21 bp, Homo sapiens
atgctgatgttcagtgtaatt

SEQ ID NO: 3031780 - DNA, 12 bp, Homo sapiens
atgctgcccctc

SEQ ID NO: 3031781 - DNA, 11 bp, Homo sapiens
atgctgcctga

SEQ ID NO: 3031782 - DNA, 21 bp, Homo sapiens
atgctgcgcatgttttcttca

SEQ ID NO: 3031783 - DNA, 14 bp, Homo sapiens
atgctgctggcctc

SEQ ID NO: 3031784 - DNA, 15 bp, Homo sapiens
atgctgctggcctcc

SEQ ID NO: 3031785 - DNA, 22 bp, Homo sapiens
atgctgctgttgaagctttgaa

SEQ ID NO: 3031786 - DNA, 15 bp, Homo sapiens
atgctggaggccctc

SEQ ID NO: 3031787 - DNA, 17 bp, Homo sapiens
atgctggatgtctgcca

SEQ ID NO: 3031788 - DNA, 19 bp, Homo sapiens
atgctggatgtctgccaat

SEQ ID NO: 3031789 - DNA, 16 bp, Homo sapiens
atgctggcccagggcc

SEQ ID NO: 3031790 - DNA, 19 bp, Homo sapiens
atgctggcccagggcccag

SEQ ID NO: 3031791 - DNA, 11 bp, Homo sapiens
atgctggcctc

SEQ ID NO: 3031792 - DNA, 21 bp, Homo sapiens
atgctggcctcttggcacctg

SEQ ID NO: 3031793 - DNA, 16 bp, Homo sapiens
atgctggggtacacag

SEQ ID NO: 3031794 - DNA, 23 bp, Homo sapiens
atgctgtacatctattttggatt

SEQ ID NO: 3031795 - DNA, 14 bp, Homo sapiens
atgctgtctttgtg

SEQ ID NO: 3031796 - DNA, 21 bp, Homo sapiens
atgctgtgagtctttggttct

SEQ ID NO: 3031797 - DNA, 19 bp, Homo sapiens
atgctgtgcaaacagtgta

SEQ ID NO: 3031798 - DNA, 18 bp, Homo sapiens
atgctgtgctacgtgtga

SEQ ID NO: 3031799 - DNA, 21 bp, Homo sapiens
atgctgtgctacgtgtgaaat

SEQ ID NO: 3031800 - DNA, 18 bp, Homo sapiens
atgctgtgctatgaattt

SEQ ID NO: 3031801 - DNA, 17 bp, Homo sapiens
atgctgtgtaacagaac

SEQ ID NO: 3031802 - DNA, 23 bp, Homo sapiens
atgctgttcgttcaaaagtggag

SEQ ID NO: 3031803 - DNA, 18 bp, Homo sapiens
atgctgttgattgctaaa

SEQ ID NO: 3031804 - DNA, 21 bp, Homo sapiens
atgctgttgattgctaaatgt

SEQ ID NO: 3031805 - DNA, 23 bp, Homo sapiens
atgctgttgattgctaaatgtaa

SEQ ID NO: 3031806 - DNA, 15 bp, Homo sapiens
atgctgttgcctcat

SEQ ID NO: 3031807 - DNA, 16 bp, Homo sapiens
atgctgttgcctcatc

SEQ ID NO: 3031808 - DNA, 23 bp, Homo sapiens
atgcttaataataattgaagaat

SEQ ID NO: 3031809 - DNA, 14 bp, Homo sapiens
atgcttagtaatgc

SEQ ID NO: 3031810 - DNA, 10 bp, Homo sapiens
atgcttcata

SEQ ID NO: 3031811 - DNA, 11 bp, Homo sapiens
atgcttcatac

SEQ ID NO: 3031812 - DNA, 15 bp, Homo sapiens
atgcttcatacaggg

SEQ ID NO: 3031813 - DNA, 22 bp, Homo sapiens
atgcttcatcattccctctcat

SEQ ID NO: 3031814 - DNA, 13 bp, Homo sapiens
atgcttctgattt

SEQ ID NO: 3031815 - DNA, 16 bp, Homo sapiens
atgcttgcaaaaacta

SEQ ID NO: 3031816 - DNA, 19 bp, Homo sapiens
atgcttggagcaatcagaa

SEQ ID NO: 3031817 - DNA, 22 bp, Homo sapiens
atgcttgtttatgatatttctt

SEQ ID NO: 3031818 - DNA, 16 bp, Homo sapiens
atgctttgaaacagaa

SEQ ID NO: 3031819 - DNA, 17 bp, Homo sapiens
atgctttgaaacagaaa

SEQ ID NO: 3031820 - DNA, 16 bp, Homo sapiens
atgctttgctttgtct

SEQ ID NO: 3031821 - DNA, 17 bp, Homo sapiens
atgcttttactgaactt

SEQ ID NO: 3031822 - DNA, 21 bp, Homo sapiens
atgcttttactgaactttctt

SEQ ID NO: 3031823 - DNA, 13 bp, Homo sapiens
atgcttttctctc

SEQ ID NO: 3031824 - DNA, 15 bp, Homo sapiens
atgtggcctgcccag

SEQ ID NO: 3031825 - DNA, 22 bp, Homo sapiens
atgtggctgtatcttgtttttc

SEQ ID NO: 3031826 - DNA, 17 bp, Homo sapiens
atgtggggctgagctgg

SEQ ID NO: 3031827 - DNA, 18 bp, Homo sapiens
atgtgggtctttttctct

SEQ ID NO: 3031828 - DNA, 21 bp, Homo sapiens
atgtgggtctttttctcttct

SEQ ID NO: 3031829 - DNA, 15 bp, Homo sapiens
atgtggtctgccaat

SEQ ID NO: 3031830 - DNA, 22 bp, Homo sapiens
atgtggtctgccaatctgtaca

SEQ ID NO: 3031831 - DNA, 16 bp, Homo sapiens
atgtggttgaagagca

SEQ ID NO: 3031832 - DNA, 17 bp, Homo sapiens
atgtggttttcttaagg

SEQ ID NO: 3031833 - DNA, 10 bp, Homo sapiens
atgtgtacac

SEQ ID NO: 3031834 - DNA, 19 bp, Homo sapiens
atgtgtacatcccatgtaa

SEQ ID NO: 3031835 - DNA, 14 bp, Homo sapiens
atgtgtagcctgtg

SEQ ID NO: 3031836 - DNA, 17 bp, Homo sapiens
atgtgtagcctgtgcat

SEQ ID NO: 3031837 - DNA, 23 bp, Homo sapiens
atgtgtagcctgtgcatgtatgt

SEQ ID NO: 3031838 - DNA, 22 bp, Homo sapiens
atgtgtaggcagtttagtgcat

SEQ ID NO: 3031839 - DNA, 15 bp, Homo sapiens
atgtgtatatatgtc

SEQ ID NO: 3031840 - DNA, 22 bp, Homo sapiens
atgtgtatggtatcatgtatct

SEQ ID NO: 3031841 - DNA, 14 bp, Homo sapiens
atgtgtatttctta

SEQ ID NO: 3031842 - DNA, 21 bp, Homo sapiens
atgtgtcaacttcaacattta

SEQ ID NO: 3031843 - DNA, 21 bp, Homo sapiens
atgtgtcagtggggctctctg

SEQ ID NO: 3031844 - DNA, 22 bp, Homo sapiens
atgtgtcagtggggctctctga

SEQ ID NO: 3031845 - DNA, 15 bp, Homo sapiens
atgtgtcatgcatga

SEQ ID NO: 3031846 - DNA, 17 bp, Homo sapiens
atgtgtccctggcgctg

SEQ ID NO: 3031847 - DNA, 22 bp, Homo sapiens
atgtgtgagataacttccttca

SEQ ID NO: 3031848 - DNA, 23 bp, Homo sapiens
atgtgtgagataacttccttcac

SEQ ID NO: 3031849 - DNA, 15 bp, Homo sapiens
atgtgtgccttgttc

SEQ ID NO: 3031850 - DNA, 19 bp, Homo sapiens
atgtgtgtagacaaatatt

SEQ ID NO: 3031851 - DNA, 20 bp, Homo sapiens
atgtgtgtagacaaatattt

SEQ ID NO: 3031852 - DNA, 17 bp, Homo sapiens
atgtgtgtattttttca

SEQ ID NO: 3031853 - DNA, 13 bp, Homo sapiens
atgtgtgttgttt

SEQ ID NO: 3031854 - DNA, 21 bp, Homo sapiens
atgtgtgttgtttccatagct

SEQ ID NO: 3031855 - DNA, 20 bp, Homo sapiens
atgtgttctcggagtgtgta

SEQ ID NO: 3031856 - DNA, 19 bp, Homo sapiens
atgtgttgcataaacaatc

SEQ ID NO: 3031857 - DNA, 22 bp, Homo sapiens
atgtgttggacaaatgtgaaga

SEQ ID NO: 3031858 - DNA, 20 bp, Homo sapiens
atgtgttgtgtttgtagtct

SEQ ID NO: 3031859 - DNA, 14 bp, Homo sapiens
atgtgtttcaaact

SEQ ID NO: 3031860 - DNA, 12 bp, Homo sapiens
atgtgtttgctt

SEQ ID NO: 3031861 - DNA, 16 bp, Homo sapiens
atgtgtttgctttctg

SEQ ID NO: 3031862 - DNA, 22 bp, Homo sapiens
atgtgtttggtttataatttga

SEQ ID NO: 3031863 - DNA, 16 bp, Homo sapiens
atgtgttttcagtctt

SEQ ID NO: 3031864 - DNA, 21 bp, Homo sapiens
atgtgttttcatcatttcagc

SEQ ID NO: 3031865 - DNA, 15 bp, Homo sapiens
atgtgttttgctttt

SEQ ID NO: 3031866 - DNA, 15 bp, Homo sapiens
atgttaaagtttaag

SEQ ID NO: 3031867 - DNA, 15 bp, Homo sapiens
atgttaacacatttt

SEQ ID NO: 3031868 - DNA, 22 bp, Homo sapiens
atgttaacacattttgtataat

SEQ ID NO: 3031869 - DNA, 21 bp, Homo sapiens
atgttaagcagctaaattttc

SEQ ID NO: 3031870 - DNA, 16 bp, Homo sapiens
atgttaataaactgca

SEQ ID NO: 3031871 - DNA, 19 bp, Homo sapiens
atgttaataaactgcaaat

SEQ ID NO: 3031872 - DNA, 13 bp, Homo sapiens
atgttaatttcat

SEQ ID NO: 3031873 - DNA, 19 bp, Homo sapiens
atgttacttccccacccct

SEQ ID NO: 3031874 - DNA, 19 bp, Homo sapiens
atgttagaattgatttcca

SEQ ID NO: 3031875 - DNA, 17 bp, Homo sapiens
atgttatcttaacactg

SEQ ID NO: 3031876 - DNA, 18 bp, Homo sapiens
atgttatcttaacactga

SEQ ID NO: 3031877 - DNA, 19 bp, Homo sapiens
atgttatcttaacactgaa

SEQ ID NO: 3031878 - DNA, 16 bp, Homo sapiens
atgttatcttctcaag

SEQ ID NO: 3031879 - DNA, 20 bp, Homo sapiens
atgttatcttctcaagttct

SEQ ID NO: 3031880 - DNA, 21 bp, Homo sapiens
atgttatcttctcaagttcta

SEQ ID NO: 3031881 - DNA, 22 bp, Homo sapiens
atgttatcttctcaagttctaa

SEQ ID NO: 3031882 - DNA, 13 bp, Homo sapiens
atgttatgtaaaa

SEQ ID NO: 3031883 - DNA, 14 bp, Homo sapiens
atgttatgtaaaag

SEQ ID NO: 3031884 - DNA, 18 bp, Homo sapiens
atgttattttctgttgaa

SEQ ID NO: 3031885 - DNA, 16 bp, Homo sapiens
atgttatttttgtatt

SEQ ID NO: 3031886 - DNA, 22 bp, Homo sapiens
atgttcacttttgacaaaggca

SEQ ID NO: 3031887 - DNA, 21 bp, Homo sapiens
atgttcagacatttatgtgtt

SEQ ID NO: 3031888 - DNA, 15 bp, Homo sapiens
atgttcagatttcta

SEQ ID NO: 3031889 - DNA, 11 bp, Homo sapiens
atgttcattta

SEQ ID NO: 3031890 - DNA, 13 bp, Homo sapiens
atgttccttttga

SEQ ID NO: 3031891 - DNA, 15 bp, Homo sapiens
atgttctaaggctct

SEQ ID NO: 3031892 - DNA, 16 bp, Homo sapiens
atgttctaaggctctg

SEQ ID NO: 3031893 - DNA, 22 bp, Homo sapiens
atgttctaaggctctgagagtc

SEQ ID NO: 3031894 - DNA, 18 bp, Homo sapiens
atgttctaagtctttcca

SEQ ID NO: 3031895 - DNA, 19 bp, Homo sapiens
atgttctaagtttctaaga

SEQ ID NO: 3031896 - DNA, 20 bp, Homo sapiens
atgttctaagtttctaagat

SEQ ID NO: 3031897 - DNA, 18 bp, Homo sapiens
atgttctattaatcacct

SEQ ID NO: 3031898 - DNA, 17 bp, Homo sapiens
atgttcttatagaataa

SEQ ID NO: 3031899 - DNA, 18 bp, Homo sapiens
atgttcttatagaataaa

SEQ ID NO: 3031900 - DNA, 19 bp, Homo sapiens
atgttcttatagaataaaa

SEQ ID NO: 3031901 - DNA, 11 bp, Homo sapiens
atgttctttat

SEQ ID NO: 3031902 - DNA, 13 bp, Homo sapiens
atgttctttatat

SEQ ID NO: 3031903 - DNA, 16 bp, Homo sapiens
atgttgagccatgagt

SEQ ID NO: 3031904 - DNA, 14 bp, Homo sapiens
atgttgagggaaca

SEQ ID NO: 3031905 - DNA, 20 bp, Homo sapiens
atgttgagggaacagacagg

SEQ ID NO: 3031906 - DNA, 14 bp, Homo sapiens
atgttgataatttc

SEQ ID NO: 3031907 - DNA, 23 bp, Homo sapiens
atgttgatccatccagcttgcca

SEQ ID NO: 3031908 - DNA, 16 bp, Homo sapiens
atgttgatttttactg

SEQ ID NO: 3031909 - DNA, 17 bp, Homo sapiens
atgttgatttttactgt

SEQ ID NO: 3031910 - DNA, 20 bp, Homo sapiens
atgttgatttttactgtgtt

SEQ ID NO: 3031911 - DNA, 16 bp, Homo sapiens
atgttgccatgtgttt

SEQ ID NO: 3031912 - DNA, 18 bp, Homo sapiens
atgttgccatgtgtttta

SEQ ID NO: 3031913 - DNA, 19 bp, Homo sapiens
atgttgctgttattatatt

SEQ ID NO: 3031914 - DNA, 17 bp, Homo sapiens
atgttggacacctttag

SEQ ID NO: 3031915 - DNA, 12 bp, Homo sapiens
atgttggtcagg

SEQ ID NO: 3031916 - DNA, 23 bp, Homo sapiens
atgttgtttcctaatatcaaatg

SEQ ID NO: 3031917 - DNA, 14 bp, Homo sapiens
atgtttaaaacatc

SEQ ID NO: 3031918 - DNA, 14 bp, Homo sapiens
atgtttaaacattt

SEQ ID NO: 3031919 - DNA, 15 bp, Homo sapiens
atgtttaaagagaag

SEQ ID NO: 3031920 - DNA, 18 bp, Homo sapiens
atgtttaatgtgaactct

SEQ ID NO: 3031921 - DNA, 16 bp, Homo sapiens
atgtttaattgtgata

SEQ ID NO: 3031922 - DNA, 18 bp, Homo sapiens
atgtttaattgtgatatt

SEQ ID NO: 3031923 - DNA, 16 bp, Homo sapiens
atgtttacctggtgct

SEQ ID NO: 3031924 - DNA, 13 bp, Homo sapiens
atgtttactgtaa

SEQ ID NO: 3031925 - DNA, 15 bp, Homo sapiens
atgtttatacagagt

SEQ ID NO: 3031926 - DNA, 14 bp, Homo sapiens
atgtttatatcaaa

SEQ ID NO: 3031927 - DNA, 15 bp, Homo sapiens
atgtttatgttctta

SEQ ID NO: 3031928 - DNA, 18 bp, Homo sapiens
atgtttattcttctagag

SEQ ID NO: 3031929 - DNA, 19 bp, Homo sapiens
atgtttattcttctagagt

SEQ ID NO: 3031930 - DNA, 17 bp, Homo sapiens
atgtttcacaaggtctt

SEQ ID NO: 3031931 - DNA, 22 bp, Homo sapiens
atgtttcagctgcagttgaaga

SEQ ID NO: 3031932 - DNA, 21 bp, Homo sapiens
atgtttcatttacctctaaat

SEQ ID NO: 3031933 - DNA, 11 bp, Homo sapiens
atgtttccccc

SEQ ID NO: 3031934 - DNA, 16 bp, Homo sapiens
atgtttcccccactcc

SEQ ID NO: 3031935 - DNA, 13 bp, Homo sapiens
atgtttcctggaa

SEQ ID NO: 3031936 - DNA, 22 bp, Homo sapiens
atgtttcgctgatatatgtgtt

SEQ ID NO: 3031937 - DNA, 20 bp, Homo sapiens
atgtttcgtgaagtatactg

SEQ ID NO: 3031938 - DNA, 14 bp, Homo sapiens
atgtttctgtgtca

SEQ ID NO: 3031939 - DNA, 18 bp, Homo sapiens
atgtttcttaaatgggct

SEQ ID NO: 3031940 - DNA, 16 bp, Homo sapiens
atgtttgccaaataaa

SEQ ID NO: 3031941 - DNA, 22 bp, Homo sapiens
atgtttgctgttccacaaagca

SEQ ID NO: 3031942 - DNA, 17 bp, Homo sapiens
atgtttgcttttcactg

SEQ ID NO: 3031943 - DNA, 22 bp, Homo sapiens
atgtttgtacacaacacctaaa

SEQ ID NO: 3031944 - DNA, 13 bp, Homo sapiens
atgtttgtatcat

SEQ ID NO: 3031945 - DNA, 22 bp, Homo sapiens
atgtttgtctcacttttcatct

SEQ ID NO: 3031946 - DNA, 12 bp, Homo sapiens
atgtttgtgtct

SEQ ID NO: 3031947 - DNA, 17 bp, Homo sapiens
atgtttgttaaaaataa

SEQ ID NO: 3031948 - DNA, 16 bp, Homo sapiens
atgttttaaaagtttg

SEQ ID NO: 3031949 - DNA, 22 bp, Homo sapiens
atgttttaaagaatatgacttt

SEQ ID NO: 3031950 - DNA, 18 bp, Homo sapiens
atgttttaaatgtacaga

SEQ ID NO: 3031951 - DNA, 15 bp, Homo sapiens
atgttttaacaaaaa

SEQ ID NO: 3031952 - DNA, 16 bp, Homo sapiens
atgttttaacaaaaac

SEQ ID NO: 3031953 - DNA, 22 bp, Homo sapiens
atgttttaacttatttatatga

SEQ ID NO: 3031954 - DNA, 23 bp, Homo sapiens
atgttttaacttatttatatgaa

SEQ ID NO: 3031955 - DNA, 14 bp, Homo sapiens
atgttttaattcca

SEQ ID NO: 3031956 - DNA, 16 bp, Homo sapiens
attctgaaaccacagt

SEQ ID NO: 3031957 - DNA, 20 bp, Homo sapiens
attctgaagcttatgtttct

SEQ ID NO: 3031958 - DNA, 22 bp, Homo sapiens
attctgaagcttatgtttctta

SEQ ID NO: 3031959 - DNA, 16 bp, Homo sapiens
attctgaagttttatt

SEQ ID NO: 3031960 - DNA, 15 bp, Homo sapiens
attctgaatttgcaa

SEQ ID NO: 3031961 - DNA, 19 bp, Homo sapiens
attctgaatttgcaaagta

SEQ ID NO: 3031962 - DNA, 14 bp, Homo sapiens
attctgagaccaaa

SEQ ID NO: 3031963 - DNA, 14 bp, Homo sapiens
attctgagagctgt

SEQ ID NO: 3031964 - DNA, 17 bp, Homo sapiens
attctgataatgtattg

SEQ ID NO: 3031965 - DNA, 18 bp, Homo sapiens
attctgataatgtattgc

SEQ ID NO: 3031966 - DNA, 20 bp, Homo sapiens
attctgattcgaatgacact

SEQ ID NO: 3031967 - DNA, 19 bp, Homo sapiens
attctgatttggaaaaaga

SEQ ID NO: 3031968 - DNA, 14 bp, Homo sapiens
attctgcaagtata

SEQ ID NO: 3031969 - DNA, 21 bp, Homo sapiens
attctgccataacagattatg

SEQ ID NO: 3031970 - DNA, 16 bp, Homo sapiens
attctgcccaaaaata

SEQ ID NO: 3031971 - DNA, 18 bp, Homo sapiens
attctgcccaaaaatatg

SEQ ID NO: 3031972 - DNA, 13 bp, Homo sapiens
attctgccctgtg

SEQ ID NO: 3031973 - DNA, 17 bp, Homo sapiens
attctgcctctctagga

SEQ ID NO: 3031974 - DNA, 17 bp, Homo sapiens
attctgctctattatat

SEQ ID NO: 3031975 - DNA, 19 bp, Homo sapiens
attctggccagactcgatg

SEQ ID NO: 3031976 - DNA, 17 bp, Homo sapiens
attctgtagattctgtg

SEQ ID NO: 3031977 - DNA, 17 bp, Homo sapiens
attctgtggaacaagcc

SEQ ID NO: 3031978 - DNA, 22 bp, Homo sapiens
attctgtgtcagagcccagccc

SEQ ID NO: 3031979 - DNA, 17 bp, Homo sapiens
attctgttctaaaactc

SEQ ID NO: 3031980 - DNA, 13 bp, Homo sapiens
attctgttggaag

SEQ ID NO: 3031981 - DNA, 12 bp, Homo sapiens
attctgtttctt

SEQ ID NO: 3031982 - DNA, 16 bp, Homo sapiens
attcttaacaaactct

SEQ ID NO: 3031983 - DNA, 17 bp, Homo sapiens
attcttaatttggatct

SEQ ID NO: 3031984 - DNA, 19 bp, Homo sapiens
attcttaatttggatctat

SEQ ID NO: 3031985 - DNA, 16 bp, Homo sapiens
attcttactctggagc

SEQ ID NO: 3031986 - DNA, 18 bp, Homo sapiens
attcttataaatatgaag

SEQ ID NO: 3031987 - DNA, 22 bp, Homo sapiens
attcttatgtagcaggaaataa

SEQ ID NO: 3031988 - DNA, 12 bp, Homo sapiens
attcttcaactt

SEQ ID NO: 3031989 - DNA, 21 bp, Homo sapiens
attcttcaagagacccttcaa

SEQ ID NO: 3031990 - DNA, 17 bp, Homo sapiens
attcttcacgcagagat

SEQ ID NO: 3031991 - DNA, 18 bp, Homo sapiens
attcttccagatgtgatg

SEQ ID NO: 3031992 - DNA, 20 bp, Homo sapiens
attcttcccttttaaacaca

SEQ ID NO: 3031993 - DNA, 22 bp, Homo sapiens
attcttcccttttaaacacatt

SEQ ID NO: 3031994 - DNA, 12 bp, Homo sapiens
attcttctagag

SEQ ID NO: 3031995 - DNA, 13 bp, Homo sapiens
attcttctagagt

SEQ ID NO: 3031996 - DNA, 15 bp, Homo sapiens
attcttctcttcctt

SEQ ID NO: 3031997 - DNA, 21 bp, Homo sapiens
attcttctcttccttttatca

SEQ ID NO: 3031998 - DNA, 13 bp, Homo sapiens
attcttctgtcct

SEQ ID NO: 3031999 - DNA, 15 bp, Homo sapiens
attcttctgtcctga

SEQ ID NO: 3032000 - DNA, 14 bp, Homo sapiens
attcttctgtgttt

SEQ ID NO: 3032001 - DNA, 20 bp, Homo sapiens
attcttgggggttgccattc

SEQ ID NO: 3032002 - DNA, 20 bp, Homo sapiens
attcttggttattctgccat

SEQ ID NO: 3032003 - DNA, 18 bp, Homo sapiens
attcttggttgaggaaac

SEQ ID NO: 3032004 - DNA, 18 bp, Homo sapiens
attcttgtaaggctttga

SEQ ID NO: 3032005 - DNA, 13 bp, Homo sapiens
attctttatacaa

SEQ ID NO: 3032006 - DNA, 19 bp, Homo sapiens
attctttcaactgggtttt

SEQ ID NO: 3032007 - DNA, 18 bp, Homo sapiens
attctttgatgttaacac

SEQ ID NO: 3032008 - DNA, 19 bp, Homo sapiens
attcttttccaaaataaaa

SEQ ID NO: 3032009 - DNA, 20 bp, Homo sapiens
attcttttccagaaagaaaa

SEQ ID NO: 3032010 - DNA, 16 bp, Homo sapiens
attcttttgtaattta

SEQ ID NO: 3032011 - DNA, 14 bp, Homo sapiens
attgaaaaaataga

SEQ ID NO: 3032012 - DNA, 18 bp, Homo sapiens
attgaaaaaatagagcct

SEQ ID NO: 3032013 - DNA, 12 bp, Homo sapiens
attgaaacactt

SEQ ID NO: 3032014 - DNA, 16 bp, Homo sapiens
attgaaagaattatcc

SEQ ID NO: 3032015 - DNA, 18 bp, Homo sapiens
attgaaaggcattctctg

SEQ ID NO: 3032016 - DNA, 16 bp, Homo sapiens
attgaaatattataga

SEQ ID NO: 3032017 - DNA, 16 bp, Homo sapiens
attgaaatgactaaaa

SEQ ID NO: 3032018 - DNA, 20 bp, Homo sapiens
attgaaatttttctctttaa

SEQ ID NO: 3032019 - DNA, 19 bp, Homo sapiens
attgaacacaaactgtaaa

SEQ ID NO: 3032020 - DNA, 20 bp, Homo sapiens
attgaacacaaactgtaaat

SEQ ID NO: 3032021 - DNA, 18 bp, Homo sapiens
attgaaggatcatctgaa

SEQ ID NO: 3032022 - DNA, 14 bp, Homo sapiens
attgaatctattta

SEQ ID NO: 3032023 - DNA, 20 bp, Homo sapiens
attgaatgtgtgatgtgaac

SEQ ID NO: 3032024 - DNA, 11 bp, Homo sapiens
attgaatttag

SEQ ID NO: 3032025 - DNA, 16 bp, Homo sapiens
attgaatttagtcatt

SEQ ID NO: 3032026 - DNA, 13 bp, Homo sapiens
attgacagaagct

SEQ ID NO: 3032027 - DNA, 18 bp, Homo sapiens
attgacagatcaagctgt

SEQ ID NO: 3032028 - DNA, 13 bp, Homo sapiens
attgacagctttg

SEQ ID NO: 3032029 - DNA, 16 bp, Homo sapiens
attgacagctttgctg

SEQ ID NO: 3032030 - DNA, 17 bp, Homo sapiens
attgaccatgtgattat

SEQ ID NO: 3032031 - DNA, 20 bp, Homo sapiens
attgaccgcgactaatttca

SEQ ID NO: 3032032 - DNA, 18 bp, Homo sapiens
attgactggttaaaaact

SEQ ID NO: 3032033 - DNA, 19 bp, Homo sapiens
attgacttagatattaaaa

SEQ ID NO: 3032034 - DNA, 20 bp, Homo sapiens
attgacttagatattaaaat

SEQ ID NO: 3032035 - DNA, 21 bp, Homo sapiens
attgactttagaaagctgaca

SEQ ID NO: 3032036 - DNA, 19 bp, Homo sapiens
attgagacagtgcacatga

SEQ ID NO: 3032037 - DNA, 20 bp, Homo sapiens
attgagagttttgtcttgaa

SEQ ID NO: 3032038 - DNA, 22 bp, Homo sapiens
attgagattgtcctcatttctc

SEQ ID NO: 3032039 - DNA, 19 bp, Homo sapiens
attgagtaatgggatttga

SEQ ID NO: 3032040 - DNA, 15 bp, Homo sapiens
attgagtcaaatggt

SEQ ID NO: 3032041 - DNA, 16 bp, Homo sapiens
attgagttacagggga

SEQ ID NO: 3032042 - DNA, 15 bp, Homo sapiens
attgagttttcagtg

SEQ ID NO: 3032043 - DNA, 13 bp, Homo sapiens
attgatattgtga

SEQ ID NO: 3032044 - DNA, 14 bp, Homo sapiens
attgatattgtgaa

SEQ ID NO: 3032045 - DNA, 15 bp, Homo sapiens
attgatattgtgaac

SEQ ID NO: 3032046 - DNA, 19 bp, Homo sapiens
attgatattgtgaacattt

SEQ ID NO: 3032047 - DNA, 13 bp, Homo sapiens
attgatcttaaac

SEQ ID NO: 3032048 - DNA, 17 bp, Homo sapiens
attgatcttaaactgga

SEQ ID NO: 3032049 - DNA, 13 bp, Homo sapiens
attgatggggaag

SEQ ID NO: 3032050 - DNA, 16 bp, Homo sapiens
attgatgtgcactgca

SEQ ID NO: 3032051 - DNA, 14 bp, Homo sapiens
attgattaaaatct

SEQ ID NO: 3032052 - DNA, 16 bp, Homo sapiens
attgattaaaatctct

SEQ ID NO: 3032053 - DNA, 19 bp, Homo sapiens
attgattaaggctttcttt

SEQ ID NO: 3032054 - DNA, 17 bp, Homo sapiens
attgatttaaaagtgta

SEQ ID NO: 3032055 - DNA, 13 bp, Homo sapiens
attgatttcctgt

SEQ ID NO: 3032056 - DNA, 16 bp, Homo sapiens
attgatttgaagaaca

SEQ ID NO: 3032057 - DNA, 17 bp, Homo sapiens
attgcaaatcttgaaat

SEQ ID NO: 3032058 - DNA, 19 bp, Homo sapiens
attgcaaatcttgaaatta

SEQ ID NO: 3032059 - DNA, 14 bp, Homo sapiens
attgcaatatctga

SEQ ID NO: 3032060 - DNA, 11 bp, Homo sapiens
attgcacaata

SEQ ID NO: 3032061 - DNA, 16 bp, Homo sapiens
attgcacagaagtcct

SEQ ID NO: 3032062 - DNA, 17 bp, Homo sapiens
attgcacccagcccaga

SEQ ID NO: 3032063 - DNA, 20 bp, Homo sapiens
attgcacctatctcagccat

SEQ ID NO: 3032064 - DNA, 22 bp, Homo sapiens
attgcacctatctcagccatag

SEQ ID NO: 3032065 - DNA, 20 bp, Homo sapiens
attgcactccagcctgggtg

SEQ ID NO: 3032066 - DNA, 14 bp, Homo sapiens
attgcactgaagtt

SEQ ID NO: 3032067 - DNA, 19 bp, Homo sapiens
attgcactgaagtttttga

SEQ ID NO: 3032068 - DNA, 17 bp, Homo sapiens
attgcaggatggtgtct

SEQ ID NO: 3032069 - DNA, 19 bp, Homo sapiens
attgcagttctgattcatt

SEQ ID NO: 3032070 - DNA, 22 bp, Homo sapiens
attgcatctcccagataatgtg

SEQ ID NO: 3032071 - DNA, 23 bp, Homo sapiens
attgcatctcccagataatgtga

SEQ ID NO: 3032072 - DNA, 13 bp, Homo sapiens
attgcatgtgact

SEQ ID NO: 3032073 - DNA, 17 bp, Homo sapiens
attgcatgtgactctga

SEQ ID NO: 3032074 - DNA, 18 bp, Homo sapiens
attgcatgtgactctgaa

SEQ ID NO: 3032075 - DNA, 9 bp, Homo sapiens
attgcattt

SEQ ID NO: 3032076 - DNA, 15 bp, Homo sapiens
attgcatttattgca

SEQ ID NO: 3032077 - DNA, 16 bp, Homo sapiens
attgccaaaaaggata

SEQ ID NO: 3032078 - DNA, 19 bp, Homo sapiens
attgccaatcttgttttaa

SEQ ID NO: 3032079 - DNA, 14 bp, Homo sapiens
attgcccaggctgg

SEQ ID NO: 3032080 - DNA, 20 bp, Homo sapiens
attgcccaggctggtcttga

SEQ ID NO: 3032081 - DNA, 16 bp, Homo sapiens
attgcccagtctttca

SEQ ID NO: 3032082 - DNA, 21 bp, Homo sapiens
attgcctagcctataaataaa

SEQ ID NO: 3032083 - DNA, 19 bp, Homo sapiens
attgcctcttgcaggctga

SEQ ID NO: 3032084 - DNA, 18 bp, Homo sapiens
attgccttctcaccagct

SEQ ID NO: 3032085 - DNA, 19 bp, Homo sapiens
attgccttctcaccagctg

SEQ ID NO: 3032086 - DNA, 18 bp, Homo sapiens
attgcctttgaatgttaa

SEQ ID NO: 3032087 - DNA, 13 bp, Homo sapiens
attgcgttggtct

SEQ ID NO: 3032088 - DNA, 20 bp, Homo sapiens
attgcgttggtctctgcatt

SEQ ID NO: 3032089 - DNA, 21 bp, Homo sapiens
atttggtccaaaaaaaggaaa

SEQ ID NO: 3032090 - DNA, 18 bp, Homo sapiens
atttgtaagcaacttgct

SEQ ID NO: 3032091 - DNA, 21 bp, Homo sapiens
atttgtaagcaacttgcttct

SEQ ID NO: 3032092 - DNA, 22 bp, Homo sapiens
atttgtaagcaacttgcttcta

SEQ ID NO: 3032093 - DNA, 20 bp, Homo sapiens
atttgtactattagcaagaa

SEQ ID NO: 3032094 - DNA, 16 bp, Homo sapiens
atttgtatatgactgc

SEQ ID NO: 3032095 - DNA, 21 bp, Homo sapiens
atttgtatatgactgcatttg

SEQ ID NO: 3032096 - DNA, 23 bp, Homo sapiens
atttgtattaccattacttgtat

SEQ ID NO: 3032097 - DNA, 21 bp, Homo sapiens
atttgtatttctcttgtcctt

SEQ ID NO: 3032098 - DNA, 18 bp, Homo sapiens
atttgtattttgtgatga

SEQ ID NO: 3032099 - DNA, 20 bp, Homo sapiens
atttgtcaatttatgaatat

SEQ ID NO: 3032100 - DNA, 18 bp, Homo sapiens
atttgtcagagaagaaaa

SEQ ID NO: 3032101 - DNA, 21 bp, Homo sapiens
atttgtcatcgttccccaccc

SEQ ID NO: 3032102 - DNA, 14 bp, Homo sapiens
atttgtctttttgt

SEQ ID NO: 3032103 - DNA, 21 bp, Homo sapiens
atttgtgaactcagccaagca

SEQ ID NO: 3032104 - DNA, 18 bp, Homo sapiens
atttgtgactaattgtat

SEQ ID NO: 3032105 - DNA, 21 bp, Homo sapiens
atttgtgccgacactgttctc

SEQ ID NO: 3032106 - DNA, 21 bp, Homo sapiens
atttgtgctatagtatttgat

SEQ ID NO: 3032107 - DNA, 16 bp, Homo sapiens
atttgtgctttgaaaa

SEQ ID NO: 3032108 - DNA, 22 bp, Homo sapiens
atttgtggggacctcagcctgc

SEQ ID NO: 3032109 - DNA, 18 bp, Homo sapiens
atttgtgtaatatgaaat

SEQ ID NO: 3032110 - DNA, 16 bp, Homo sapiens
atttgtgtcactgtac

SEQ ID NO: 3032111 - DNA, 21 bp, Homo sapiens
atttgtgtgtgtgtgtgtgtt

SEQ ID NO: 3032112 - DNA, 22 bp, Homo sapiens
atttgtgtgttataccttgatt

SEQ ID NO: 3032113 - DNA, 14 bp, Homo sapiens
atttgttaaaatac

SEQ ID NO: 3032114 - DNA, 16 bp, Homo sapiens
atttgttaattaaata

SEQ ID NO: 3032115 - DNA, 22 bp, Homo sapiens
atttgttactcatcgggcccag

SEQ ID NO: 3032116 - DNA, 21 bp, Homo sapiens
atttgttatggcagatgacaa

SEQ ID NO: 3032117 - DNA, 16 bp, Homo sapiens
atttgttattttgcaa

SEQ ID NO: 3032118 - DNA, 22 bp, Homo sapiens
atttgttgagagtgtgaccaaa

SEQ ID NO: 3032119 - DNA, 11 bp, Homo sapiens
atttgttgcat

SEQ ID NO: 3032120 - DNA, 14 bp, Homo sapiens
atttgttgctgctg

SEQ ID NO: 3032121 - DNA, 20 bp, Homo sapiens
atttgttggagatgcagcct

SEQ ID NO: 3032122 - DNA, 16 bp, Homo sapiens
atttgttgtcatgtgt

SEQ ID NO: 3032123 - DNA, 15 bp, Homo sapiens
atttgtttaaaagga

SEQ ID NO: 3032124 - DNA, 23 bp, Homo sapiens
atttgtttccttttggcctcctg

SEQ ID NO: 3032125 - DNA, 19 bp, Homo sapiens
atttgtttgattttcatat

SEQ ID NO: 3032126 - DNA, 14 bp, Homo sapiens
atttgtttgtagct

SEQ ID NO: 3032127 - DNA, 20 bp, Homo sapiens
atttgttttgttttaaaata

SEQ ID NO: 3032128 - DNA, 13 bp, Homo sapiens
attttaaaaatgg

SEQ ID NO: 3032129 - DNA, 16 bp, Homo sapiens
attttaaaaatggtgg

SEQ ID NO: 3032130 - DNA, 15 bp, Homo sapiens
attttaaaatattta

SEQ ID NO: 3032131 - DNA, 18 bp, Homo sapiens
attttaaaatatttaaac

SEQ ID NO: 3032132 - DNA, 14 bp, Homo sapiens
attttaaactagat

SEQ ID NO: 3032133 - DNA, 16 bp, Homo sapiens
attttaaactagatga

SEQ ID NO: 3032134 - DNA, 16 bp, Homo sapiens
attttaaatatttgtt

SEQ ID NO: 3032135 - DNA, 13 bp, Homo sapiens
attttaaatgaaa

SEQ ID NO: 3032136 - DNA, 15 bp, Homo sapiens
attttaaatgaaagt

SEQ ID NO: 3032137 - DNA, 22 bp, Homo sapiens
attttaacagtacctgtgcctg

SEQ ID NO: 3032138 - DNA, 20 bp, Homo sapiens
attttaactgccaatcctta

SEQ ID NO: 3032139 - DNA, 14 bp, Homo sapiens
attttaagcattgt

SEQ ID NO: 3032140 - DNA, 15 bp, Homo sapiens
attttaagcattgtg

SEQ ID NO: 3032141 - DNA, 20 bp, Homo sapiens
attttaagccctatcactga

SEQ ID NO: 3032142 - DNA, 22 bp, Homo sapiens
attttaagccctatcactgaca

SEQ ID NO: 3032143 - DNA, 13 bp, Homo sapiens
attttaataacat

SEQ ID NO: 3032144 - DNA, 14 bp, Homo sapiens
attttaatgtgaag

SEQ ID NO: 3032145 - DNA, 15 bp, Homo sapiens
attttaatgtgaaga

SEQ ID NO: 3032146 - DNA, 21 bp, Homo sapiens
attttaatttagtaaatgtta

SEQ ID NO: 3032147 - DNA, 21 bp, Homo sapiens
attttacaattgaaatgacta

SEQ ID NO: 3032148 - DNA, 23 bp, Homo sapiens
attttacacagaaacactgcctt

SEQ ID NO: 3032149 - DNA, 14 bp, Homo sapiens
attttacagttaag

SEQ ID NO: 3032150 - DNA, 17 bp, Homo sapiens
attttactttttcctgg

SEQ ID NO: 3032151 - DNA, 18 bp, Homo sapiens
attttagcgtgctcactg

SEQ ID NO: 3032152 - DNA, 19 bp, Homo sapiens
attttaggagctaaggctc

SEQ ID NO: 3032153 - DNA, 20 bp, Homo sapiens
attttaggagctaaggctct

SEQ ID NO: 3032154 - DNA, 17 bp, Homo sapiens
attttaggatctcgcct

SEQ ID NO: 3032155 - DNA, 18 bp, Homo sapiens
attttagttacagctgtg

SEQ ID NO: 3032156 - DNA, 14 bp, Homo sapiens
attttagtttctgt

SEQ ID NO: 3032157 - DNA, 19 bp, Homo sapiens
attttagtttctgttctgt

SEQ ID NO: 3032158 - DNA, 21 bp, Homo sapiens
attttagtttctgttctgtgg

SEQ ID NO: 3032159 - DNA, 23 bp, Homo sapiens
attttagtttctgttctgtggaa

SEQ ID NO: 3032160 - DNA, 21 bp, Homo sapiens
attttataaagtgcttgtgta

SEQ ID NO: 3032161 - DNA, 18 bp, Homo sapiens
attttatacccttgactt

SEQ ID NO: 3032162 - DNA, 15 bp, Homo sapiens
attttatactgcact

SEQ ID NO: 3032163 - DNA, 19 bp, Homo sapiens
attttatagctactaattt

SEQ ID NO: 3032164 - DNA, 20 bp, Homo sapiens
attttatatgattttctcca

SEQ ID NO: 3032165 - DNA, 17 bp, Homo sapiens
attttatatttgagttg

SEQ ID NO: 3032166 - DNA, 20 bp, Homo sapiens
attttatgacatgaaaagtt

SEQ ID NO: 3032167 - DNA, 15 bp, Homo sapiens
attttatgagaaatg

SEQ ID NO: 3032168 - DNA, 16 bp, Homo sapiens
attttatgagaaatgt

SEQ ID NO: 3032169 - DNA, 17 bp, Homo sapiens
attttatggcactattt

SEQ ID NO: 3032170 - DNA, 14 bp, Homo sapiens
attttatggtgcat

SEQ ID NO: 3032171 - DNA, 16 bp, Homo sapiens
attttatggtgcatta

SEQ ID NO: 3032172 - DNA, 18 bp, Homo sapiens
attttattcaagaatgcc

SEQ ID NO: 3032173 - DNA, 19 bp, Homo sapiens
attttattcagtagtttga

SEQ ID NO: 3032174 - DNA, 15 bp, Homo sapiens
attttattgtataaa

SEQ ID NO: 3032175 - DNA, 15 bp, Homo sapiens
attttattgtatttt

SEQ ID NO: 3032176 - DNA, 17 bp, Homo sapiens
attttatttatttaatt

SEQ ID NO: 3032177 - DNA, 14 bp, Homo sapiens
attttatttttgca

SEQ ID NO: 3032178 - DNA, 17 bp, Homo sapiens
attttatttttgcaaaa

SEQ ID NO: 3032179 - DNA, 15 bp, Homo sapiens
attttcacattcttg

SEQ ID NO: 3032180 - DNA, 19 bp, Homo sapiens
attttcacattcttggctt

SEQ ID NO: 3032181 - DNA, 20 bp, Homo sapiens
attttcacattcttggctta

SEQ ID NO: 3032182 - DNA, 18 bp, Homo sapiens
attttcaccctctgtacc

SEQ ID NO: 3032183 - DNA, 16 bp, Homo sapiens
attttcactaaaagtg

SEQ ID NO: 3032184 - DNA, 15 bp, Homo sapiens
attttcagagtgaca

SEQ ID NO: 3032185 - DNA, 19 bp, Homo sapiens
attttcagcattaagctgt

SEQ ID NO: 3032186 - DNA, 19 bp, Homo sapiens
attttcagcgaacatgcct

SEQ ID NO: 3032187 - DNA, 20 bp, Homo sapiens
attttcaggtagtactaaga

SEQ ID NO: 3032188 - DNA, 12 bp, Homo sapiens
attttcagtgat

SEQ ID NO: 3032189 - DNA, 21 bp, Homo sapiens
attttcataagtatttcaaat

SEQ ID NO: 3032190 - DNA, 19 bp, Homo sapiens
attttcatatcccgtgaaa

SEQ ID NO: 3032191 - DNA, 12 bp, Homo sapiens
attttcattaaa

SEQ ID NO: 3032192 - DNA, 16 bp, Homo sapiens
attttcattaaacttg

SEQ ID NO: 3032193 - DNA, 19 bp, Homo sapiens
attttcattaaacttgaag

SEQ ID NO: 3032194 - DNA, 20 bp, Homo sapiens
attttcccatcatcctttgt

SEQ ID NO: 3032195 - DNA, 13 bp, Homo sapiens
attttccttccat

SEQ ID NO: 3032196 - DNA, 15 bp, Homo sapiens
attttccttccatgc

SEQ ID NO: 3032197 - DNA, 18 bp, Homo sapiens
attttccttccatgctcc

SEQ ID NO: 3032198 - DNA, 17 bp, Homo sapiens
attttcctttgtcattt

SEQ ID NO: 3032199 - DNA, 21 bp, Homo sapiens
attttcggaacacatttccct

SEQ ID NO: 3032200 - DNA, 17 bp, Homo sapiens
attttctagtttcctgc

SEQ ID NO: 3032201 - DNA, 14 bp, Homo sapiens
attttctataattt

SEQ ID NO: 3032202 - DNA, 17 bp, Homo sapiens
attttctataatttaaa

SEQ ID NO: 3032203 - DNA, 20 bp, Homo sapiens
attttctatttctctgtgta

SEQ ID NO: 3032204 - DNA, 21 bp, Homo sapiens
attttctatttctctgtgtat

SEQ ID NO: 3032205 - DNA, 17 bp, Homo sapiens
attttctctgtactttt

SEQ ID NO: 3032206 - DNA, 21 bp, Homo sapiens
attttctctttaaaagaaagt

SEQ ID NO: 3032207 - DNA, 20 bp, Homo sapiens
attttctgccaggctcaaca

SEQ ID NO: 3032208 - DNA, 15 bp, Homo sapiens
attttctggttctaa

SEQ ID NO: 3032209 - DNA, 17 bp, Homo sapiens
attttctgtaaatgaag

SEQ ID NO: 3032210 - DNA, 13 bp, Homo sapiens
attttctgtcact

SEQ ID NO: 3032211 - DNA, 16 bp, Homo sapiens
attttctgtcactgta

SEQ ID NO: 3032212 - DNA, 11 bp, Homo sapiens
attttctgtgg

SEQ ID NO: 3032213 - DNA, 19 bp, Homo sapiens
attttctgtgggcaggcct

SEQ ID NO: 3032214 - DNA, 19 bp, Homo sapiens
attttcttgtcaatggaag

SEQ ID NO: 3032215 - DNA, 15 bp, Homo sapiens
attttctttaaaaga

SEQ ID NO: 3032216 - DNA, 20 bp, Homo sapiens
attttctttttaataaaaag

SEQ ID NO: 3032217 - DNA, 14 bp, Homo sapiens
attttgaaaacact

SEQ ID NO: 3032218 - DNA, 15 bp, Homo sapiens
attttgaaaacactt

SEQ ID NO: 3032219 - DNA, 16 bp, Homo sapiens
attttgaaaacactta

SEQ ID NO: 3032220 - DNA, 16 bp, Homo sapiens
attttgaaaacccctg

SEQ ID NO: 3032221 - DNA, 19 bp, Homo sapiens
caaatgtgtcccagtgaac

SEQ ID NO: 3032222 - DNA, 15 bp, Homo sapiens
caaatgttctaagtt

SEQ ID NO: 3032223 - DNA, 22 bp, Homo sapiens
caaatgttctaagtttctaaga

SEQ ID NO: 3032224 - DNA, 18 bp, Homo sapiens
caaatgtttaaacatttt

SEQ ID NO: 3032225 - DNA, 15 bp, Homo sapiens
caaattaaaaaagct

SEQ ID NO: 3032226 - DNA, 15 bp, Homo sapiens
caaattaaaaatttt

SEQ ID NO: 3032227 - DNA, 17 bp, Homo sapiens
caaattaatatttgtgc

SEQ ID NO: 3032228 - DNA, 12 bp, Homo sapiens
caaattagaaac

SEQ ID NO: 3032229 - DNA, 18 bp, Homo sapiens
caaattctcttctttttc

SEQ ID NO: 3032230 - DNA, 17 bp, Homo sapiens
caaattcttttgaattg

SEQ ID NO: 3032231 - DNA, 18 bp, Homo sapiens
caaattcttttgaattgt

SEQ ID NO: 3032232 - DNA, 14 bp, Homo sapiens
caaattgagacagt

SEQ ID NO: 3032233 - DNA, 14 bp, Homo sapiens
caaattgcactgaa

SEQ ID NO: 3032234 - DNA, 23 bp, Homo sapiens
caaattgcttctaggagtcaact

SEQ ID NO: 3032235 - DNA, 21 bp, Homo sapiens
caaattggagcttcatggcag

SEQ ID NO: 3032236 - DNA, 22 bp, Homo sapiens
caaatttagaaactaattgact

SEQ ID NO: 3032237 - DNA, 21 bp, Homo sapiens
caaatttatttttttcttttg

SEQ ID NO: 3032238 - DNA, 18 bp, Homo sapiens
caaattttcactgctgct

SEQ ID NO: 3032239 - DNA, 16 bp, Homo sapiens
caaattttgaggtctt

SEQ ID NO: 3032240 - DNA, 14 bp, Homo sapiens
caacaaaaaaagtt

SEQ ID NO: 3032241 - DNA, 12 bp, Homo sapiens
caacaaacactg

SEQ ID NO: 3032242 - DNA, 14 bp, Homo sapiens
caacaaagaacact

SEQ ID NO: 3032243 - DNA, 17 bp, Homo sapiens
caacaaagtcacagtcg

SEQ ID NO: 3032244 - DNA, 16 bp, Homo sapiens
caacaataaaatagca

SEQ ID NO: 3032245 - DNA, 17 bp, Homo sapiens
caacaatcctagtgctt

SEQ ID NO: 3032246 - DNA, 18 bp, Homo sapiens
caacaatgattaatcagc

SEQ ID NO: 3032247 - DNA, 18 bp, Homo sapiens
caacaatgtgaggggtcc

SEQ ID NO: 3032248 - DNA, 14 bp, Homo sapiens
caacaattagagga

SEQ ID NO: 3032249 - DNA, 18 bp, Homo sapiens
caacaattagaggaattt

SEQ ID NO: 3032250 - DNA, 20 bp, Homo sapiens
caacaatttctactttgaag

SEQ ID NO: 3032251 - DNA, 17 bp, Homo sapiens
caacacaacatttgtgt

SEQ ID NO: 3032252 - DNA, 14 bp, Homo sapiens
caacacaagaaaac

SEQ ID NO: 3032253 - DNA, 15 bp, Homo sapiens
caacacactgcctta

SEQ ID NO: 3032254 - DNA, 16 bp, Homo sapiens
caacacagcctgggcc

SEQ ID NO: 3032255 - DNA, 22 bp, Homo sapiens
caacacagcctgggccccagct

SEQ ID NO: 3032256 - DNA, 15 bp, Homo sapiens
caacaccccgcctgc

SEQ ID NO: 3032257 - DNA, 21 bp, Homo sapiens
caacactgtgggtgtgtgact

SEQ ID NO: 3032258 - DNA, 12 bp, Homo sapiens
caacagaaagag

SEQ ID NO: 3032259 - DNA, 21 bp, Homo sapiens
caacagacacaatttatactg

SEQ ID NO: 3032260 - DNA, 19 bp, Homo sapiens
caacagacctggtgctcta

SEQ ID NO: 3032261 - DNA, 13 bp, Homo sapiens
caacagatctgga

SEQ ID NO: 3032262 - DNA, 17 bp, Homo sapiens
caacagatctggaacct

SEQ ID NO: 3032263 - DNA, 14 bp, Homo sapiens
caacagatttgtga

SEQ ID NO: 3032264 - DNA, 16 bp, Homo sapiens
caacagatttgtgaac

SEQ ID NO: 3032265 - DNA, 19 bp, Homo sapiens
caacagatttgtgaactca

SEQ ID NO: 3032266 - DNA, 17 bp, Homo sapiens
caacagcaaatcacgac

SEQ ID NO: 3032267 - DNA, 15 bp, Homo sapiens
caacagctacaacag

SEQ ID NO: 3032268 - DNA, 18 bp, Homo sapiens
caacagcttttcccagga

SEQ ID NO: 3032269 - DNA, 20 bp, Homo sapiens
caacagcttttcccaggaga

SEQ ID NO: 3032270 - DNA, 14 bp, Homo sapiens
caacaggagctggg

SEQ ID NO: 3032271 - DNA, 22 bp, Homo sapiens
caacaggagctgggatcctaag

SEQ ID NO: 3032272 - DNA, 15 bp, Homo sapiens
caacaggaggacaat

SEQ ID NO: 3032273 - DNA, 23 bp, Homo sapiens
caacaggaggacaattcatgaac

SEQ ID NO: 3032274 - DNA, 23 bp, Homo sapiens
caacagtaattattatttaactc

SEQ ID NO: 3032275 - DNA, 14 bp, Homo sapiens
caacagtcatgttt

SEQ ID NO: 3032276 - DNA, 13 bp, Homo sapiens
caacagtgctaaa

SEQ ID NO: 3032277 - DNA, 14 bp, Homo sapiens
caacagtgctaaaa

SEQ ID NO: 3032278 - DNA, 16 bp, Homo sapiens
caacagtgctaaaaat

SEQ ID NO: 3032279 - DNA, 17 bp, Homo sapiens
caacagtgctaaaaatg

SEQ ID NO: 3032280 - DNA, 12 bp, Homo sapiens
caacagtgtgaa

SEQ ID NO: 3032281 - DNA, 19 bp, Homo sapiens
caacagtgtgaagttagaa

SEQ ID NO: 3032282 - DNA, 15 bp, Homo sapiens
caacagtgtgatcat

SEQ ID NO: 3032283 - DNA, 16 bp, Homo sapiens
caacagttacataatt

SEQ ID NO: 3032284 - DNA, 12 bp, Homo sapiens
caacagttttcc

SEQ ID NO: 3032285 - DNA, 21 bp, Homo sapiens
caacatagtattcatgactat

SEQ ID NO: 3032286 - DNA, 17 bp, Homo sapiens
caacatcccattgccct

SEQ ID NO: 3032287 - DNA, 13 bp, Homo sapiens
caacatcttttta

SEQ ID NO: 3032288 - DNA, 22 bp, Homo sapiens
caacatggagaaaccctgtctc

SEQ ID NO: 3032289 - DNA, 23 bp, Homo sapiens
caacatggagaaaccctgtctct

SEQ ID NO: 3032290 - DNA, 17 bp, Homo sapiens
caacatggatgtgttgc

SEQ ID NO: 3032291 - DNA, 20 bp, Homo sapiens
caacatggattccaaagcat

SEQ ID NO: 3032292 - DNA, 19 bp, Homo sapiens
caacatggcttctcctttg

SEQ ID NO: 3032293 - DNA, 22 bp, Homo sapiens
caacatggtgaaacccccatct

SEQ ID NO: 3032294 - DNA, 13 bp, Homo sapiens
caacatgtatctg

SEQ ID NO: 3032295 - DNA, 15 bp, Homo sapiens
caacatgtatctgtc

SEQ ID NO: 3032296 - DNA, 17 bp, Homo sapiens
caacatgtatgtggata

SEQ ID NO: 3032297 - DNA, 14 bp, Homo sapiens
caacatttccaaaa

SEQ ID NO: 3032298 - DNA, 16 bp, Homo sapiens
caacatttctcaataa

SEQ ID NO: 3032299 - DNA, 17 bp, Homo sapiens
caacatttctcaataat

SEQ ID NO: 3032300 - DNA, 16 bp, Homo sapiens
caacatttgtgtcact

SEQ ID NO: 3032301 - DNA, 13 bp, Homo sapiens
caaccaaggaagg

SEQ ID NO: 3032302 - DNA, 14 bp, Homo sapiens
caaccaaggaagga

SEQ ID NO: 3032303 - DNA, 17 bp, Homo sapiens
caaccaaggaaggagcc

SEQ ID NO: 3032304 - DNA, 22 bp, Homo sapiens
caaccaaggaaggagcccctga

SEQ ID NO: 3032305 - DNA, 21 bp, Homo sapiens
caaccactaagaattcaaact

SEQ ID NO: 3032306 - DNA, 18 bp, Homo sapiens
caaccagacagagggtca

SEQ ID NO: 3032307 - DNA, 20 bp, Homo sapiens
caaccagtaggatatttcta

SEQ ID NO: 3032308 - DNA, 17 bp, Homo sapiens
caacccaataggagtct

SEQ ID NO: 3032309 - DNA, 22 bp, Homo sapiens
caacccatgatgagctcctctt

SEQ ID NO: 3032310 - DNA, 16 bp, Homo sapiens
caaccccacccagctc

SEQ ID NO: 3032311 - DNA, 17 bp, Homo sapiens
caaccccacccagctcc

SEQ ID NO: 3032312 - DNA, 12 bp, Homo sapiens
caacccccatct

SEQ ID NO: 3032313 - DNA, 15 bp, Homo sapiens
caacccccatctccc

SEQ ID NO: 3032314 - DNA, 17 bp, Homo sapiens
caacccccatctcccta

SEQ ID NO: 3032315 - DNA, 15 bp, Homo sapiens
caaccccgcggccca

SEQ ID NO: 3032316 - DNA, 11 bp, Homo sapiens
caacccctccc

SEQ ID NO: 3032317 - DNA, 14 bp, Homo sapiens
caaccctctggaag

SEQ ID NO: 3032318 - DNA, 19 bp, Homo sapiens
caaccctggcattatgtcc

SEQ ID NO: 3032319 - DNA, 23 bp, Homo sapiens
caaccgagagaatgctgacctga

SEQ ID NO: 3032320 - DNA, 22 bp, Homo sapiens
caaccggctttgtggcactggg

SEQ ID NO: 3032321 - DNA, 16 bp, Homo sapiens
caacctaacctgtgtc

SEQ ID NO: 3032322 - DNA, 19 bp, Homo sapiens
caacctaacctgtgtctgc

SEQ ID NO: 3032323 - DNA, 13 bp, Homo sapiens
caacctactgtct

SEQ ID NO: 3032324 - DNA, 20 bp, Homo sapiens
caacctccgcctcctgggtt

SEQ ID NO: 3032325 - DNA, 20 bp, Homo sapiens
caacctccgccttccgggtt

SEQ ID NO: 3032326 - DNA, 13 bp, Homo sapiens
caacctcctgggt

SEQ ID NO: 3032327 - DNA, 16 bp, Homo sapiens
caacctctgcttccca

SEQ ID NO: 3032328 - DNA, 12 bp, Homo sapiens
caacctgaacct

SEQ ID NO: 3032329 - DNA, 16 bp, Homo sapiens
caacctgaacctagga

SEQ ID NO: 3032330 - DNA, 22 bp, Homo sapiens
caacctgaaggtcccctggcag

SEQ ID NO: 3032331 - DNA, 22 bp, Homo sapiens
caaccttcctttttttaaattt

SEQ ID NO: 3032332 - DNA, 23 bp, Homo sapiens
caaccttcctttttttaaatttt

SEQ ID NO: 3032333 - DNA, 15 bp, Homo sapiens
caacgtagcttctac

SEQ ID NO: 3032334 - DNA, 13 bp, Homo sapiens
caacgtgttaatt

SEQ ID NO: 3032335 - DNA, 23 bp, Homo sapiens
caacgttgtactgtatgtgatga

SEQ ID NO: 3032336 - DNA, 22 bp, Homo sapiens
caacgtttggaagatcctgtga

SEQ ID NO: 3032337 - DNA, 17 bp, Homo sapiens
caactacccaaaacaag

SEQ ID NO: 3032338 - DNA, 21 bp, Homo sapiens
caactacccaaaacaagcctg

SEQ ID NO: 3032339 - DNA, 17 bp, Homo sapiens
caactacccccagctgt

SEQ ID NO: 3032340 - DNA, 19 bp, Homo sapiens
caactacccccagctgtgc

SEQ ID NO: 3032341 - DNA, 20 bp, Homo sapiens
caactactatctcagagata

SEQ ID NO: 3032342 - DNA, 19 bp, Homo sapiens
caactcagaatgggggctt

SEQ ID NO: 3032343 - DNA, 21 bp, Homo sapiens
caactcagaatgggggctttc

SEQ ID NO: 3032344 - DNA, 17 bp, Homo sapiens
caactccaccctctgcg

SEQ ID NO: 3032345 - DNA, 18 bp, Homo sapiens
caactccaccctctgcga

SEQ ID NO: 3032346 - DNA, 20 bp, Homo sapiens
caactcccttctgcttgtcc

SEQ ID NO: 3032347 - DNA, 22 bp, Homo sapiens
caactcccttctgcttgtccca

SEQ ID NO: 3032348 - DNA, 19 bp, Homo sapiens
caactcgtatagcatgcat

SEQ ID NO: 3032349 - DNA, 18 bp, Homo sapiens
caactctcccctgacctg

SEQ ID NO: 3032350 - DNA, 13 bp, Homo sapiens
caactctggctcc

SEQ ID NO: 3032351 - DNA, 13 bp, Homo sapiens
caactctttgaga

SEQ ID NO: 3032352 - DNA, 14 bp, Homo sapiens
caactctttgagaa

SEQ ID NO: 3032353 - DNA, 16 bp, Homo sapiens
caactctttgagaaac

SEQ ID NO: 3032354 - DNA, 20 bp, Homo sapiens
caatctcacaccttagctat

SEQ ID NO: 3032355 - DNA, 19 bp, Homo sapiens
caatctcgccttcctgcag

SEQ ID NO: 3032356 - DNA, 19 bp, Homo sapiens
caatctcgtcaggctgcca

SEQ ID NO: 3032357 - DNA, 18 bp, Homo sapiens
caatctcgtttagtgcca

SEQ ID NO: 3032358 - DNA, 12 bp, Homo sapiens
caatctgttcta

SEQ ID NO: 3032359 - DNA, 23 bp, Homo sapiens
caatcttaagcagagataaataa

SEQ ID NO: 3032360 - DNA, 16 bp, Homo sapiens
caatctttattatgca

SEQ ID NO: 3032361 - DNA, 14 bp, Homo sapiens
caatctttgaaaga

SEQ ID NO: 3032362 - DNA, 20 bp, Homo sapiens
caatgaaatatgtgaagccc

SEQ ID NO: 3032363 - DNA, 13 bp, Homo sapiens
caatgaaccccca

SEQ ID NO: 3032364 - DNA, 17 bp, Homo sapiens
caatgaattaattcaga

SEQ ID NO: 3032365 - DNA, 11 bp, Homo sapiens
caatgagccat

SEQ ID NO: 3032366 - DNA, 18 bp, Homo sapiens
caatgatagtaagaaaag

SEQ ID NO: 3032367 - DNA, 16 bp, Homo sapiens
caatgattaatcagct

SEQ ID NO: 3032368 - DNA, 12 bp, Homo sapiens
caatgcagcacc

SEQ ID NO: 3032369 - DNA, 17 bp, Homo sapiens
caatgccattgtgcaga

SEQ ID NO: 3032370 - DNA, 21 bp, Homo sapiens
caatgctgatttggtgaccaa

SEQ ID NO: 3032371 - DNA, 14 bp, Homo sapiens
caatgcttatggaa

SEQ ID NO: 3032372 - DNA, 22 bp, Homo sapiens
caatggatttgatgctgtttga

SEQ ID NO: 3032373 - DNA, 11 bp, Homo sapiens
caatggccttt

SEQ ID NO: 3032374 - DNA, 11 bp, Homo sapiens
caatgggaaaa

SEQ ID NO: 3032375 - DNA, 14 bp, Homo sapiens
caatgggaaaagag

SEQ ID NO: 3032376 - DNA, 20 bp, Homo sapiens
caatgggagaatcagcagaa

SEQ ID NO: 3032377 - DNA, 19 bp, Homo sapiens
caatgggagctgaggccac

SEQ ID NO: 3032378 - DNA, 21 bp, Homo sapiens
caatgggagctgaggccacac

SEQ ID NO: 3032379 - DNA, 18 bp, Homo sapiens
caatgggattttctagtt

SEQ ID NO: 3032380 - DNA, 17 bp, Homo sapiens
caatgggtcttagctct

SEQ ID NO: 3032381 - DNA, 22 bp, Homo sapiens
caatggtagattcgctgtcccc

SEQ ID NO: 3032382 - DNA, 23 bp, Homo sapiens
caatggtgtttttcttgtaaatg

SEQ ID NO: 3032383 - DNA, 17 bp, Homo sapiens
caatggtttttaaattt

SEQ ID NO: 3032384 - DNA, 15 bp, Homo sapiens
caatgtacaaggtat

SEQ ID NO: 3032385 - DNA, 17 bp, Homo sapiens
caatgtagaaagctttg

SEQ ID NO: 3032386 - DNA, 19 bp, Homo sapiens
caatgtagaggggaaaaga

SEQ ID NO: 3032387 - DNA, 12 bp, Homo sapiens
caatgtattttg

SEQ ID NO: 3032388 - DNA, 13 bp, Homo sapiens
caatgtctgcagc

SEQ ID NO: 3032389 - DNA, 18 bp, Homo sapiens
caatgtctgcagccctga

SEQ ID NO: 3032390 - DNA, 19 bp, Homo sapiens
caatgtctgcagccctgag

SEQ ID NO: 3032391 - DNA, 23 bp, Homo sapiens
caatgtgaaagattatttaaatg

SEQ ID NO: 3032392 - DNA, 14 bp, Homo sapiens
caatgtgaatcaga

SEQ ID NO: 3032393 - DNA, 18 bp, Homo sapiens
caatgtgaatcagaccct

SEQ ID NO: 3032394 - DNA, 20 bp, Homo sapiens
caatgtgaggggtccctagc

SEQ ID NO: 3032395 - DNA, 15 bp, Homo sapiens
caatgtgattttgta

SEQ ID NO: 3032396 - DNA, 23 bp, Homo sapiens
caatgtgctactgattgtttcat

SEQ ID NO: 3032397 - DNA, 19 bp, Homo sapiens
caatgtgtggctgaagact

SEQ ID NO: 3032398 - DNA, 22 bp, Homo sapiens
caatgtgtttctggtatgaaac

SEQ ID NO: 3032399 - DNA, 14 bp, Homo sapiens
caatgttctttata

SEQ ID NO: 3032400 - DNA, 18 bp, Homo sapiens
caatgtttcttttatcac

SEQ ID NO: 3032401 - DNA, 22 bp, Homo sapiens
caatgtttgcttttcactggca

SEQ ID NO: 3032402 - DNA, 15 bp, Homo sapiens
caatgtttttgtgta

SEQ ID NO: 3032403 - DNA, 12 bp, Homo sapiens
caattaaaaata

SEQ ID NO: 3032404 - DNA, 13 bp, Homo sapiens
caattaaaaataa

SEQ ID NO: 3032405 - DNA, 13 bp, Homo sapiens
caattaaatttat

SEQ ID NO: 3032406 - DNA, 13 bp, Homo sapiens
caattaactctgg

SEQ ID NO: 3032407 - DNA, 17 bp, Homo sapiens
caattagacttgaaata

SEQ ID NO: 3032408 - DNA, 18 bp, Homo sapiens
caattagaggaatttaaa

SEQ ID NO: 3032409 - DNA, 23 bp, Homo sapiens
caattaggcagactctttatgct

SEQ ID NO: 3032410 - DNA, 14 bp, Homo sapiens
caattatagtttct

SEQ ID NO: 3032411 - DNA, 18 bp, Homo sapiens
caattatagtttctgagg

SEQ ID NO: 3032412 - DNA, 13 bp, Homo sapiens
caattatggaaat

SEQ ID NO: 3032413 - DNA, 14 bp, Homo sapiens
caattatttaaaga

SEQ ID NO: 3032414 - DNA, 17 bp, Homo sapiens
caattatttaaagaaag

SEQ ID NO: 3032415 - DNA, 17 bp, Homo sapiens
caattcaaaagttccaa

SEQ ID NO: 3032416 - DNA, 21 bp, Homo sapiens
caattcacagcctttctgaac

SEQ ID NO: 3032417 - DNA, 13 bp, Homo sapiens
caattcagtgttc

SEQ ID NO: 3032418 - DNA, 13 bp, Homo sapiens
caattcatgaact

SEQ ID NO: 3032419 - DNA, 15 bp, Homo sapiens
caattcatgaagtga

SEQ ID NO: 3032420 - DNA, 16 bp, Homo sapiens
caattcatgaagtgaa

SEQ ID NO: 3032421 - DNA, 16 bp, Homo sapiens
caattccactctgata

SEQ ID NO: 3032422 - DNA, 16 bp, Homo sapiens
caattcctggccctgt

SEQ ID NO: 3032423 - DNA, 21 bp, Homo sapiens
caattctcctgcctcagcctc

SEQ ID NO: 3032424 - DNA, 17 bp, Homo sapiens
caattctcgagcttggg

SEQ ID NO: 3032425 - DNA, 14 bp, Homo sapiens
caattctgttttta

SEQ ID NO: 3032426 - DNA, 12 bp, Homo sapiens
caattctttata

SEQ ID NO: 3032427 - DNA, 23 bp, Homo sapiens
caattctttatacaacagtgcta

SEQ ID NO: 3032428 - DNA, 22 bp, Homo sapiens
caattgacaacagttacataat

SEQ ID NO: 3032429 - DNA, 14 bp, Homo sapiens
caattgattgtgaa

SEQ ID NO: 3032430 - DNA, 15 bp, Homo sapiens
caattgattgtgaat

SEQ ID NO: 3032431 - DNA, 14 bp, Homo sapiens
caattgcatctccc

SEQ ID NO: 3032432 - DNA, 13 bp, Homo sapiens
caattgctcccat

SEQ ID NO: 3032433 - DNA, 13 bp, Homo sapiens
caatttaaaacaa

SEQ ID NO: 3032434 - DNA, 13 bp, Homo sapiens
caatttaaatgtt

SEQ ID NO: 3032435 - DNA, 15 bp, Homo sapiens
caatttaaatgttta

SEQ ID NO: 3032436 - DNA, 17 bp, Homo sapiens
caatttaaatgtttact

SEQ ID NO: 3032437 - DNA, 22 bp, Homo sapiens
caatttaaatgtttactataga

SEQ ID NO: 3032438 - DNA, 22 bp, Homo sapiens
caatttactttttaaacagtgt

SEQ ID NO: 3032439 - DNA, 13 bp, Homo sapiens
caatttatactgc

SEQ ID NO: 3032440 - DNA, 19 bp, Homo sapiens
caatttatttggggggaaa

SEQ ID NO: 3032441 - DNA, 16 bp, Homo sapiens
caatttctactttgaa

SEQ ID NO: 3032442 - DNA, 18 bp, Homo sapiens
caatttgggcttcctgtt

SEQ ID NO: 3032443 - DNA, 23 bp, Homo sapiens
caatttgtaaaaacagcattgct

SEQ ID NO: 3032444 - DNA, 19 bp, Homo sapiens
caattttaatttagtaaat

SEQ ID NO: 3032445 - DNA, 12 bp, Homo sapiens
caattttcttgt

SEQ ID NO: 3032446 - DNA, 14 bp, Homo sapiens
caattttgtcacag

SEQ ID NO: 3032447 - DNA, 13 bp, Homo sapiens
caatttttgcctt

SEQ ID NO: 3032448 - DNA, 14 bp, Homo sapiens
caatttttgccttc

SEQ ID NO: 3032449 - DNA, 16 bp, Homo sapiens
caatttttgccttcat

SEQ ID NO: 3032450 - DNA, 14 bp, Homo sapiens
caattttttaaacc

SEQ ID NO: 3032451 - DNA, 15 bp, Homo sapiens
cacaaaaaggagcgg

SEQ ID NO: 3032452 - DNA, 22 bp, Homo sapiens
cacaaaaaggagcgggcagggc

SEQ ID NO: 3032453 - DNA, 11 bp, Homo sapiens
cacaaaaagtc

SEQ ID NO: 3032454 - DNA, 18 bp, Homo sapiens
cacaaaagctgtgtctct

SEQ ID NO: 3032455 - DNA, 22 bp, Homo sapiens
cacaaaataaccaatcctggac

SEQ ID NO: 3032456 - DNA, 17 bp, Homo sapiens
cacaaaatggattttag

SEQ ID NO: 3032457 - DNA, 13 bp, Homo sapiens
cacaaacacaagg

SEQ ID NO: 3032458 - DNA, 14 bp, Homo sapiens
cacaaacggagccc

SEQ ID NO: 3032459 - DNA, 23 bp, Homo sapiens
cacaaactctatcggagaacatg

SEQ ID NO: 3032460 - DNA, 23 bp, Homo sapiens
cacaaactgtaaataaaaagaaa

SEQ ID NO: 3032461 - DNA, 17 bp, Homo sapiens
cacaaactgtaatacaa

SEQ ID NO: 3032462 - DNA, 14 bp, Homo sapiens
cacaaagcaaaggc

SEQ ID NO: 3032463 - DNA, 17 bp, Homo sapiens
cacaaagcaaaggcagt

SEQ ID NO: 3032464 - DNA, 22 bp, Homo sapiens
cacaaagcacagtttgaacaaa

SEQ ID NO: 3032465 - DNA, 20 bp, Homo sapiens
cacaaaggatttgatgcttt

SEQ ID NO: 3032466 - DNA, 11 bp, Homo sapiens
cacaaatgaaa

SEQ ID NO: 3032467 - DNA, 14 bp, Homo sapiens
cacaaatgtgtccc

SEQ ID NO: 3032468 - DNA, 21 bp, Homo sapiens
cacaaatgtgtcccagtgaac

SEQ ID NO: 3032469 - DNA, 19 bp, Homo sapiens
cacaacaaacctattgtag

SEQ ID NO: 3032470 - DNA, 18 bp, Homo sapiens
cacaacccaataggagtc

SEQ ID NO: 3032471 - DNA, 17 bp, Homo sapiens
cacaaccctctggaagt

SEQ ID NO: 3032472 - DNA, 18 bp, Homo sapiens
cacaactagttttgttta

SEQ ID NO: 3032473 - DNA, 23 bp, Homo sapiens
cacaacttgtcacccaaagcctg

SEQ ID NO: 3032474 - DNA, 12 bp, Homo sapiens
cacaagaaaaag

SEQ ID NO: 3032475 - DNA, 16 bp, Homo sapiens
cacaagaaactttgga

SEQ ID NO: 3032476 - DNA, 20 bp, Homo sapiens
cacaagacccaagtagctgc

SEQ ID NO: 3032477 - DNA, 13 bp, Homo sapiens
cacaagagctgga

SEQ ID NO: 3032478 - DNA, 15 bp, Homo sapiens
cacaagattcccaga

SEQ ID NO: 3032479 - DNA, 16 bp, Homo sapiens
cacaagattcccagag

SEQ ID NO: 3032480 - DNA, 17 bp, Homo sapiens
cacaagattcccagaga

SEQ ID NO: 3032481 - DNA, 21 bp, Homo sapiens
cacaagcctcgaggtgccttc

SEQ ID NO: 3032482 - DNA, 22 bp, Homo sapiens
cacaagcctgcctcgccttgtg

SEQ ID NO: 3032483 - DNA, 17 bp, Homo sapiens
cacaaggatagatgctg

SEQ ID NO: 3032484 - DNA, 18 bp, Homo sapiens
cacaaggatagatgctgg

SEQ ID NO: 3032485 - DNA, 21 bp, Homo sapiens
cacaaggatagatgctggccc

SEQ ID NO: 3032486 - DNA, 16 bp, Homo sapiens
cacaaggcctggtctg

SEQ ID NO: 3032487 - DNA, 22 bp, Homo sapiens
cacgcagagattttcatctatt

SEQ ID NO: 3032488 - DNA, 22 bp, Homo sapiens
cacgcaggcctccctgcctcag

SEQ ID NO: 3032489 - DNA, 15 bp, Homo sapiens
cacgcaggcggccag

SEQ ID NO: 3032490 - DNA, 15 bp, Homo sapiens
cacgccactgcctcc

SEQ ID NO: 3032491 - DNA, 17 bp, Homo sapiens
cacgccactgcctcccc

SEQ ID NO: 3032492 - DNA, 21 bp, Homo sapiens
cacgccattctcctgcctcag

SEQ ID NO: 3032493 - DNA, 22 bp, Homo sapiens
cacgccattctcctgcctcagc

SEQ ID NO: 3032494 - DNA, 17 bp, Homo sapiens
cacgccccctgtgactt

SEQ ID NO: 3032495 - DNA, 21 bp, Homo sapiens
cacgccgggagaagccacctt

SEQ ID NO: 3032496 - DNA, 17 bp, Homo sapiens
cacgccgtctgtcctca

SEQ ID NO: 3032497 - DNA, 17 bp, Homo sapiens
cacgcctcccactgggg

SEQ ID NO: 3032498 - DNA, 14 bp, Homo sapiens
cacgcctgccatct

SEQ ID NO: 3032499 - DNA, 22 bp, Homo sapiens
cacgcctgtaatcccagcactt

SEQ ID NO: 3032500 - DNA, 14 bp, Homo sapiens
cacgcgtatttaca

SEQ ID NO: 3032501 - DNA, 15 bp, Homo sapiens
cacgctccagctgcc

SEQ ID NO: 3032502 - DNA, 14 bp, Homo sapiens
cacgctcccctcca

SEQ ID NO: 3032503 - DNA, 14 bp, Homo sapiens
cacgcttcacagtg

SEQ ID NO: 3032504 - DNA, 15 bp, Homo sapiens
cacggagccactcct

SEQ ID NO: 3032505 - DNA, 17 bp, Homo sapiens
cacggagccactcctct

SEQ ID NO: 3032506 - DNA, 19 bp, Homo sapiens
cacggagccactcctctga

SEQ ID NO: 3032507 - DNA, 23 bp, Homo sapiens
cacggaggcatcctacccttttc

SEQ ID NO: 3032508 - DNA, 20 bp, Homo sapiens
cacggatccatgtagcagga

SEQ ID NO: 3032509 - DNA, 23 bp, Homo sapiens
cacggatccatgtagcaggactg

SEQ ID NO: 3032510 - DNA, 23 bp, Homo sapiens
cacggcaggacaacgaggaagcc

SEQ ID NO: 3032511 - DNA, 22 bp, Homo sapiens
cacggcaggcgtgtggcagcca

SEQ ID NO: 3032512 - DNA, 13 bp, Homo sapiens
cacggccacatca

SEQ ID NO: 3032513 - DNA, 19 bp, Homo sapiens
cacggcccggcccctcacc

SEQ ID NO: 3032514 - DNA, 20 bp, Homo sapiens
cacggctcctcgagatccca

SEQ ID NO: 3032515 - DNA, 24 bp, Homo sapiens
cacggctggtcactctgccctctg

SEQ ID NO: 3032516 - DNA, 16 bp, Homo sapiens
cacgggaatcacaggt

SEQ ID NO: 3032517 - DNA, 20 bp, Homo sapiens
cacgggcggtcctgcacaga

SEQ ID NO: 3032518 - DNA, 19 bp, Homo sapiens
cacggggaccactgggccc

SEQ ID NO: 3032519 - DNA, 13 bp, Homo sapiens
cacggtccgcggc

SEQ ID NO: 3032520 - DNA, 13 bp, Homo sapiens
cacggttcaatgg

SEQ ID NO: 3032521 - DNA, 21 bp, Homo sapiens
cacggtttcgaagtcattaaa

SEQ ID NO: 3032522 - DNA, 16 bp, Homo sapiens
cacggtttctgttctg

SEQ ID NO: 3032523 - DNA, 19 bp, Homo sapiens
cacgtaatgaaacttggat

SEQ ID NO: 3032524 - DNA, 23 bp, Homo sapiens
cacgtaccaagccaccgcagctg

SEQ ID NO: 3032525 - DNA, 20 bp, Homo sapiens
cacgtcacgtgtagtgtcca

SEQ ID NO: 3032526 - DNA, 18 bp, Homo sapiens
cacgtctctctgcctgct

SEQ ID NO: 3032527 - DNA, 20 bp, Homo sapiens
cacgtctctctgcctgctgg

SEQ ID NO: 3032528 - DNA, 21 bp, Homo sapiens
cacgtctctctgcctgctggg

SEQ ID NO: 3032529 - DNA, 13 bp, Homo sapiens
cacgtgcaggaca

SEQ ID NO: 3032530 - DNA, 18 bp, Homo sapiens
cacgtgcaggacagctct

SEQ ID NO: 3032531 - DNA, 19 bp, Homo sapiens
cacgtgcaggacagctctt

SEQ ID NO: 3032532 - DNA, 13 bp, Homo sapiens
cacgtgccaggcc

SEQ ID NO: 3032533 - DNA, 18 bp, Homo sapiens
cacgtttaatcccagcac

SEQ ID NO: 3032534 - DNA, 19 bp, Homo sapiens
cacgtttaatcccagcact

SEQ ID NO: 3032535 - DNA, 20 bp, Homo sapiens
cactaaaagaaaatctatta

SEQ ID NO: 3032536 - DNA, 21 bp, Homo sapiens
cactaagcagaggaggggccg

SEQ ID NO: 3032537 - DNA, 15 bp, Homo sapiens
cactaaggacttaaa

SEQ ID NO: 3032538 - DNA, 12 bp, Homo sapiens
cactaaggggcc

SEQ ID NO: 3032539 - DNA, 13 bp, Homo sapiens
cactaaggggccc

SEQ ID NO: 3032540 - DNA, 23 bp, Homo sapiens
cactaaggggcccggccagccat

SEQ ID NO: 3032541 - DNA, 18 bp, Homo sapiens
cactaattctgcatctgg

SEQ ID NO: 3032542 - DNA, 17 bp, Homo sapiens
cactacaagtttataag

SEQ ID NO: 3032543 - DNA, 15 bp, Homo sapiens
cactacaccacacac

SEQ ID NO: 3032544 - DNA, 17 bp, Homo sapiens
cactacaccacacacaa

SEQ ID NO: 3032545 - DNA, 21 bp, Homo sapiens
cactacaccacacacaacagc

SEQ ID NO: 3032546 - DNA, 20 bp, Homo sapiens
cactactccgcagctctagt

SEQ ID NO: 3032547 - DNA, 22 bp, Homo sapiens
cactagggaaaggtaaatacaa

SEQ ID NO: 3032548 - DNA, 17 bp, Homo sapiens
cactatgaagctacctc

SEQ ID NO: 3032549 - DNA, 18 bp, Homo sapiens
cactatgcactgctgtaa

SEQ ID NO: 3032550 - DNA, 12 bp, Homo sapiens
cactatgtgtgt

SEQ ID NO: 3032551 - DNA, 14 bp, Homo sapiens
cactatgtgtgttg

SEQ ID NO: 3032552 - DNA, 19 bp, Homo sapiens
cactatgtgtgttgtttcc

SEQ ID NO: 3032553 - DNA, 14 bp, Homo sapiens
cactcaacaataaa

SEQ ID NO: 3032554 - DNA, 14 bp, Homo sapiens
cactcaacatgagt

SEQ ID NO: 3032555 - DNA, 16 bp, Homo sapiens
cactcaagccaagcag

SEQ ID NO: 3032556 - DNA, 11 bp, Homo sapiens
cactcaaggcg

SEQ ID NO: 3032557 - DNA, 17 bp, Homo sapiens
cactcaaggcggtgctt

SEQ ID NO: 3032558 - DNA, 14 bp, Homo sapiens
cactcaagttgttt

SEQ ID NO: 3032559 - DNA, 16 bp, Homo sapiens
cactcacccttcctgg

SEQ ID NO: 3032560 - DNA, 22 bp, Homo sapiens
cactcactgaagcccagacctc

SEQ ID NO: 3032561 - DNA, 22 bp, Homo sapiens
cactcagcacaaggccatctgg

SEQ ID NO: 3032562 - DNA, 12 bp, Homo sapiens
cactcagcccct

SEQ ID NO: 3032563 - DNA, 22 bp, Homo sapiens
cactcagcccctacccctgccc

SEQ ID NO: 3032564 - DNA, 14 bp, Homo sapiens
cactcagggcagct

SEQ ID NO: 3032565 - DNA, 20 bp, Homo sapiens
cactcagggcagctgcctgg

SEQ ID NO: 3032566 - DNA, 20 bp, Homo sapiens
cactcaggggtcactgaggc

SEQ ID NO: 3032567 - DNA, 16 bp, Homo sapiens
cactcatcccctcact

SEQ ID NO: 3032568 - DNA, 23 bp, Homo sapiens
cactccaacctaacctgtgtctg

SEQ ID NO: 3032569 - DNA, 19 bp, Homo sapiens
cactccaagatatggacac

SEQ ID NO: 3032570 - DNA, 11 bp, Homo sapiens
cactccaccac

SEQ ID NO: 3032571 - DNA, 12 bp, Homo sapiens
cactccagagaa

SEQ ID NO: 3032572 - DNA, 12 bp, Homo sapiens
cactccagcctg

SEQ ID NO: 3032573 - DNA, 17 bp, Homo sapiens
cactcccactgccagga

SEQ ID NO: 3032574 - DNA, 18 bp, Homo sapiens
cactccccgaagtctttt

SEQ ID NO: 3032575 - DNA, 20 bp, Homo sapiens
cactccctaggcccaagtct

SEQ ID NO: 3032576 - DNA, 14 bp, Homo sapiens
cactccctccagca

SEQ ID NO: 3032577 - DNA, 15 bp, Homo sapiens
cactccctccagcac

SEQ ID NO: 3032578 - DNA, 17 bp, Homo sapiens
cactccctccagcacaa

SEQ ID NO: 3032579 - DNA, 22 bp, Homo sapiens
cactccctcctggagctctgtg

SEQ ID NO: 3032580 - DNA, 14 bp, Homo sapiens
cactccctggcctt

SEQ ID NO: 3032581 - DNA, 16 bp, Homo sapiens
cactccctggccttgc

SEQ ID NO: 3032582 - DNA, 20 bp, Homo sapiens
cactcccttgggctccctgt

SEQ ID NO: 3032583 - DNA, 16 bp, Homo sapiens
cactcctaatcaagag

SEQ ID NO: 3032584 - DNA, 12 bp, Homo sapiens
cactcctccctc

SEQ ID NO: 3032585 - DNA, 17 bp, Homo sapiens
cactcctcctgccagct

SEQ ID NO: 3032586 - DNA, 19 bp, Homo sapiens
cactcctcctgccagctct

SEQ ID NO: 3032587 - DNA, 13 bp, Homo sapiens
cactcctctgact

SEQ ID NO: 3032588 - DNA, 14 bp, Homo sapiens
cactcctgccaagg

SEQ ID NO: 3032589 - DNA, 12 bp, Homo sapiens
cactcctgccag

SEQ ID NO: 3032590 - DNA, 13 bp, Homo sapiens
cactcctgccagc

SEQ ID NO: 3032591 - DNA, 14 bp, Homo sapiens
cactcctgccagcc

SEQ ID NO: 3032592 - DNA, 21 bp, Homo sapiens
cactccttccccttgtccctg

SEQ ID NO: 3032593 - DNA, 12 bp, Homo sapiens
cactcgcaggac

SEQ ID NO: 3032594 - DNA, 13 bp, Homo sapiens
cactcgcaggacc

SEQ ID NO: 3032595 - DNA, 21 bp, Homo sapiens
cactcgccatttcctcacgtg

SEQ ID NO: 3032596 - DNA, 22 bp, Homo sapiens
cactcgccatttcctcacgtgc

SEQ ID NO: 3032597 - DNA, 24 bp, Homo sapiens
cactcgccatttcctcacgtgcag

SEQ ID NO: 3032598 - DNA, 14 bp, Homo sapiens
cactcggctttgga

SEQ ID NO: 3032599 - DNA, 14 bp, Homo sapiens
cactctagattcca

SEQ ID NO: 3032600 - DNA, 22 bp, Homo sapiens
cactctcaccccaagcggcctt

SEQ ID NO: 3032601 - DNA, 18 bp, Homo sapiens
cactctcattccccaggt

SEQ ID NO: 3032602 - DNA, 11 bp, Homo sapiens
cactctgcccc

SEQ ID NO: 3032603 - DNA, 23 bp, Homo sapiens
cactctgccccccccccccatct

SEQ ID NO: 3032604 - DNA, 13 bp, Homo sapiens
cactctgccctct

SEQ ID NO: 3032605 - DNA, 16 bp, Homo sapiens
cactctgccctctgct

SEQ ID NO: 3032606 - DNA, 18 bp, Homo sapiens
cactctgccctctgctgc

SEQ ID NO: 3032607 - DNA, 20 bp, Homo sapiens
cactctgccctctgctgctg

SEQ ID NO: 3032608 - DNA, 12 bp, Homo sapiens
cactctgcctgc

SEQ ID NO: 3032609 - DNA, 13 bp, Homo sapiens
cactctgcctgcc

SEQ ID NO: 3032610 - DNA, 14 bp, Homo sapiens
cactctgcctgcct

SEQ ID NO: 3032611 - DNA, 18 bp, Homo sapiens
cactctggtcttggaatt

SEQ ID NO: 3032612 - DNA, 19 bp, Homo sapiens
cactcttaggcactttggg

SEQ ID NO: 3032613 - DNA, 13 bp, Homo sapiens
cactcttctctcc

SEQ ID NO: 3032614 - DNA, 18 bp, Homo sapiens
cactcttgaagtccagga

SEQ ID NO: 3032615 - DNA, 14 bp, Homo sapiens
cactcttggagcct

SEQ ID NO: 3032616 - DNA, 14 bp, Homo sapiens
cactcttggctcgt

SEQ ID NO: 3032617 - DNA, 15 bp, Homo sapiens
cactcttttgcttta

SEQ ID NO: 3032618 - DNA, 23 bp, Homo sapiens
cactcttttgctttattccagaa

SEQ ID NO: 3032619 - DNA, 23 bp, Homo sapiens
cactgaaacaaaaattgtcttta

SEQ ID NO: 3032620 - DNA, 14 bp, Homo sapiens
cagatgtgcagcag

SEQ ID NO: 3032621 - DNA, 18 bp, Homo sapiens
cagatgtggagccaggcg

SEQ ID NO: 3032622 - DNA, 23 bp, Homo sapiens
cagatgttatttttgtattttta

SEQ ID NO: 3032623 - DNA, 14 bp, Homo sapiens
cagatgtttccaga

SEQ ID NO: 3032624 - DNA, 20 bp, Homo sapiens
cagatgttttacgcaaggaa

SEQ ID NO: 3032625 - DNA, 21 bp, Homo sapiens
cagatgttttacgcaaggaag

SEQ ID NO: 3032626 - DNA, 23 bp, Homo sapiens
cagatgttttacgcaaggaagga

SEQ ID NO: 3032627 - DNA, 18 bp, Homo sapiens
cagatgttttacgtctgg

SEQ ID NO: 3032628 - DNA, 23 bp, Homo sapiens
cagatgttttggtcaagtagttt

SEQ ID NO: 3032629 - DNA, 17 bp, Homo sapiens
cagattcccaggccagg

SEQ ID NO: 3032630 - DNA, 17 bp, Homo sapiens
cagattgcagttctgat

SEQ ID NO: 3032631 - DNA, 13 bp, Homo sapiens
cagattgcatgtg

SEQ ID NO: 3032632 - DNA, 18 bp, Homo sapiens
cagattgcatgtgactct

SEQ ID NO: 3032633 - DNA, 21 bp, Homo sapiens
cagattgcatgtgactctgaa

SEQ ID NO: 3032634 - DNA, 23 bp, Homo sapiens
cagattgcatgtgactctgaagc

SEQ ID NO: 3032635 - DNA, 12 bp, Homo sapiens
cagattggaagg

SEQ ID NO: 3032636 - DNA, 21 bp, Homo sapiens
cagattggaaggagacacaga

SEQ ID NO: 3032637 - DNA, 22 bp, Homo sapiens
cagattggaaggagacacagat

SEQ ID NO: 3032638 - DNA, 21 bp, Homo sapiens
cagattggggctagtttaaga

SEQ ID NO: 3032639 - DNA, 16 bp, Homo sapiens
cagattgtgccactgc

SEQ ID NO: 3032640 - DNA, 13 bp, Homo sapiens
cagattgtttgca

SEQ ID NO: 3032641 - DNA, 19 bp, Homo sapiens
cagatttcagtaatgtctt

SEQ ID NO: 3032642 - DNA, 12 bp, Homo sapiens
cagatttcctca

SEQ ID NO: 3032643 - DNA, 19 bp, Homo sapiens
cagatttgaggctggtttt

SEQ ID NO: 3032644 - DNA, 17 bp, Homo sapiens
cagattttatattttct

SEQ ID NO: 3032645 - DNA, 17 bp, Homo sapiens
cagattttcctaaggcc

SEQ ID NO: 3032646 - DNA, 20 bp, Homo sapiens
cagattttggggttgtgttg

SEQ ID NO: 3032647 - DNA, 21 bp, Homo sapiens
cagattttggggttgtgttgt

SEQ ID NO: 3032648 - DNA, 13 bp, Homo sapiens
cagcaaaatccaa

SEQ ID NO: 3032649 - DNA, 19 bp, Homo sapiens
cagcaaaatccaaactgct

SEQ ID NO: 3032650 - DNA, 21 bp, Homo sapiens
cagcaaaatccttacttccag

SEQ ID NO: 3032651 - DNA, 23 bp, Homo sapiens
cagcaaaatccttacttccagca

SEQ ID NO: 3032652 - DNA, 16 bp, Homo sapiens
cagcaaaccaagagat

SEQ ID NO: 3032653 - DNA, 19 bp, Homo sapiens
cagcaaatagcaaatgaaa

SEQ ID NO: 3032654 - DNA, 14 bp, Homo sapiens
cagcaaattccaga

SEQ ID NO: 3032655 - DNA, 13 bp, Homo sapiens
cagcaaattttca

SEQ ID NO: 3032656 - DNA, 19 bp, Homo sapiens
cagcaacacagcctgggcc

SEQ ID NO: 3032657 - DNA, 13 bp, Homo sapiens
cagcaaccccagg

SEQ ID NO: 3032658 - DNA, 11 bp, Homo sapiens
cagcaagaaaa

SEQ ID NO: 3032659 - DNA, 13 bp, Homo sapiens
cagcaagaaaaaa

SEQ ID NO: 3032660 - DNA, 19 bp, Homo sapiens
cagcaagaaaaaaaaatgc

SEQ ID NO: 3032661 - DNA, 16 bp, Homo sapiens
cagcaagaagggagtt

SEQ ID NO: 3032662 - DNA, 15 bp, Homo sapiens
cagcaagtcagggtt

SEQ ID NO: 3032663 - DNA, 13 bp, Homo sapiens
cagcaagtcccag

SEQ ID NO: 3032664 - DNA, 14 bp, Homo sapiens
cagcaagtctcttt

SEQ ID NO: 3032665 - DNA, 19 bp, Homo sapiens
cagcaatcgcatcccggct

SEQ ID NO: 3032666 - DNA, 21 bp, Homo sapiens
cagcaatcgcatcccggctga

SEQ ID NO: 3032667 - DNA, 12 bp, Homo sapiens
cagcacaaaatg

SEQ ID NO: 3032668 - DNA, 11 bp, Homo sapiens
cagcacaaaca

SEQ ID NO: 3032669 - DNA, 14 bp, Homo sapiens
cagcacaaacacaa

SEQ ID NO: 3032670 - DNA, 13 bp, Homo sapiens
cagcacaaggcca

SEQ ID NO: 3032671 - DNA, 13 bp, Homo sapiens
cagcacacagggc

SEQ ID NO: 3032672 - DNA, 15 bp, Homo sapiens
cagcacactgtgaaa

SEQ ID NO: 3032673 - DNA, 17 bp, Homo sapiens
cagcacactgtgaaaat

SEQ ID NO: 3032674 - DNA, 14 bp, Homo sapiens
cagcacagctcctc

SEQ ID NO: 3032675 - DNA, 14 bp, Homo sapiens
cagcacatcacctc

SEQ ID NO: 3032676 - DNA, 15 bp, Homo sapiens
cagcacatgcgggct

SEQ ID NO: 3032677 - DNA, 15 bp, Homo sapiens
cagcaccaccaggtc

SEQ ID NO: 3032678 - DNA, 16 bp, Homo sapiens
cagcaccaccaggtct

SEQ ID NO: 3032679 - DNA, 20 bp, Homo sapiens
cagcaccatccgccagggcc

SEQ ID NO: 3032680 - DNA, 15 bp, Homo sapiens
cagcaccgtgccaac

SEQ ID NO: 3032681 - DNA, 18 bp, Homo sapiens
cagcaccgttctgtgcac

SEQ ID NO: 3032682 - DNA, 15 bp, Homo sapiens
cagcacctcagcctg

SEQ ID NO: 3032683 - DNA, 20 bp, Homo sapiens
cagcaccttggcccaggagc

SEQ ID NO: 3032684 - DNA, 15 bp, Homo sapiens
cagcaccttgtgcct

SEQ ID NO: 3032685 - DNA, 18 bp, Homo sapiens
cagcaccttgtgcctggg

SEQ ID NO: 3032686 - DNA, 17 bp, Homo sapiens
cagcacggcccggcccc

SEQ ID NO: 3032687 - DNA, 20 bp, Homo sapiens
cagcacggcccggcccctca

SEQ ID NO: 3032688 - DNA, 21 bp, Homo sapiens
cagcacggcccggcccctcac

SEQ ID NO: 3032689 - DNA, 17 bp, Homo sapiens
cagcactcctcggcagg

SEQ ID NO: 3032690 - DNA, 16 bp, Homo sapiens
cagcactgctgcctca

SEQ ID NO: 3032691 - DNA, 19 bp, Homo sapiens
cagcactgctgcctcagct

SEQ ID NO: 3032692 - DNA, 16 bp, Homo sapiens
cagcactgcttgagga

SEQ ID NO: 3032693 - DNA, 19 bp, Homo sapiens
cagcactggaaccacctgg

SEQ ID NO: 3032694 - DNA, 17 bp, Homo sapiens
cagcactgggaagctgg

SEQ ID NO: 3032695 - DNA, 18 bp, Homo sapiens
cagcactgggaagctgga

SEQ ID NO: 3032696 - DNA, 21 bp, Homo sapiens
cagcactgggaagctggagtg

SEQ ID NO: 3032697 - DNA, 12 bp, Homo sapiens
cagcacttccat

SEQ ID NO: 3032698 - DNA, 13 bp, Homo sapiens
cagcacttccatg

SEQ ID NO: 3032699 - DNA, 19 bp, Homo sapiens
cagcacttgtccagctgag

SEQ ID NO: 3032700 - DNA, 15 bp, Homo sapiens
cagcactttaccaga

SEQ ID NO: 3032701 - DNA, 18 bp, Homo sapiens
cagcactttgagaggctg

SEQ ID NO: 3032702 - DNA, 23 bp, Homo sapiens
cagcactttgagaggctgaggtg

SEQ ID NO: 3032703 - DNA, 16 bp, Homo sapiens
cagcactttgggaggc

SEQ ID NO: 3032704 - DNA, 17 bp, Homo sapiens
cagcactttttccttct

SEQ ID NO: 3032705 - DNA, 16 bp, Homo sapiens
cagcagaatggaggca

SEQ ID NO: 3032706 - DNA, 21 bp, Homo sapiens
cagcagactcagctctgacat

SEQ ID NO: 3032707 - DNA, 14 bp, Homo sapiens
cagcagattggaag

SEQ ID NO: 3032708 - DNA, 15 bp, Homo sapiens
cagcagattggaagg

SEQ ID NO: 3032709 - DNA, 18 bp, Homo sapiens
cagcagattggaaggaga

SEQ ID NO: 3032710 - DNA, 15 bp, Homo sapiens
cagcagcaaattttc

SEQ ID NO: 3032711 - DNA, 11 bp, Homo sapiens
cagcagcaaga

SEQ ID NO: 3032712 - DNA, 13 bp, Homo sapiens
cagcagcagctca

SEQ ID NO: 3032713 - DNA, 11 bp, Homo sapiens
cagcagcatcc

SEQ ID NO: 3032714 - DNA, 17 bp, Homo sapiens
cagcagcatcccagcct

SEQ ID NO: 3032715 - DNA, 23 bp, Homo sapiens
cagcagccccggcaactctggct

SEQ ID NO: 3032716 - DNA, 14 bp, Homo sapiens
cagcagccctcctc

SEQ ID NO: 3032717 - DNA, 18 bp, Homo sapiens
cagcagcctcgcacaggc

SEQ ID NO: 3032718 - DNA, 20 bp, Homo sapiens
cagcagcctcgcacaggccc

SEQ ID NO: 3032719 - DNA, 12 bp, Homo sapiens
cagcagcctgcc

SEQ ID NO: 3032720 - DNA, 12 bp, Homo sapiens
cagcagcctgtg

SEQ ID NO: 3032721 - DNA, 17 bp, Homo sapiens
cagcagcctgtgaggga

SEQ ID NO: 3032722 - DNA, 15 bp, Homo sapiens
cagcaggaggccagg

SEQ ID NO: 3032723 - DNA, 17 bp, Homo sapiens
cagcaggcatggcttcc

SEQ ID NO: 3032724 - DNA, 15 bp, Homo sapiens
cagcagggatgccct

SEQ ID NO: 3032725 - DNA, 21 bp, Homo sapiens
cagcagggatgccctggaggt

SEQ ID NO: 3032726 - DNA, 22 bp, Homo sapiens
cagcagggatgccctggaggtg

SEQ ID NO: 3032727 - DNA, 22 bp, Homo sapiens
cagcagggtcttttcatctggg

SEQ ID NO: 3032728 - DNA, 16 bp, Homo sapiens
cagcagtctctgcctt

SEQ ID NO: 3032729 - DNA, 17 bp, Homo sapiens
cagcagtctctgccttg

SEQ ID NO: 3032730 - DNA, 18 bp, Homo sapiens
cagcagtggcctttgcaa

SEQ ID NO: 3032731 - DNA, 19 bp, Homo sapiens
cagcagtgtgaggccaggg

SEQ ID NO: 3032732 - DNA, 20 bp, Homo sapiens
cagcagtgtgaggccagggc

SEQ ID NO: 3032733 - DNA, 18 bp, Homo sapiens
cagcagttgactcagagt

SEQ ID NO: 3032734 - DNA, 22 bp, Homo sapiens
cagcagttgaggtggggtagtg

SEQ ID NO: 3032735 - DNA, 19 bp, Homo sapiens
cagcagtttccgaggctga

SEQ ID NO: 3032736 - DNA, 18 bp, Homo sapiens
cagcatactccgtgaggc

SEQ ID NO: 3032737 - DNA, 17 bp, Homo sapiens
cagcatcaaacatgaaa

SEQ ID NO: 3032738 - DNA, 22 bp, Homo sapiens
cagcatcaagccccacagttct

SEQ ID NO: 3032739 - DNA, 17 bp, Homo sapiens
cagcatcacctgcctgt

SEQ ID NO: 3032740 - DNA, 19 bp, Homo sapiens
cagcatcacctgcctgtta

SEQ ID NO: 3032741 - DNA, 17 bp, Homo sapiens
cagcatcccagccttga

SEQ ID NO: 3032742 - DNA, 19 bp, Homo sapiens
cagcatccccttgaactct

SEQ ID NO: 3032743 - DNA, 12 bp, Homo sapiens
cagcatccgcag

SEQ ID NO: 3032744 - DNA, 20 bp, Homo sapiens
cagcatccgcaggtgctggt

SEQ ID NO: 3032745 - DNA, 12 bp, Homo sapiens
cagcatggaatc

SEQ ID NO: 3032746 - DNA, 13 bp, Homo sapiens
cagcatgttttct

SEQ ID NO: 3032747 - DNA, 14 bp, Homo sapiens
cagcatgttttctg

SEQ ID NO: 3032748 - DNA, 12 bp, Homo sapiens
cagcattgcttt

SEQ ID NO: 3032749 - DNA, 17 bp, Homo sapiens
cagcattgtaattatgt

SEQ ID NO: 3032750 - DNA, 20 bp, Homo sapiens
cagcatttccacaccaagca

SEQ ID NO: 3032751 - DNA, 20 bp, Homo sapiens
cagcatttgattaacatttg

SEQ ID NO: 3032752 - DNA, 17 bp, Homo sapiens
cagccaaacagtatgat

SEQ ID NO: 3032753 - DNA, 19 bp, Homo sapiens
cagggacagagacacctgc

SEQ ID NO: 3032754 - DNA, 18 bp, Homo sapiens
cagggacagaggccccag

SEQ ID NO: 3032755 - DNA, 22 bp, Homo sapiens
cagggacatgccctgtgtggct

SEQ ID NO: 3032756 - DNA, 15 bp, Homo sapiens
cagggacccaaagca

SEQ ID NO: 3032757 - DNA, 14 bp, Homo sapiens
cagggacccctgcc

SEQ ID NO: 3032758 - DNA, 20 bp, Homo sapiens
cagggacccggggtctcctg

SEQ ID NO: 3032759 - DNA, 22 bp, Homo sapiens
cagggacccggggtctcctgga

SEQ ID NO: 3032760 - DNA, 23 bp, Homo sapiens
cagggaccctggagtatttggaa

SEQ ID NO: 3032761 - DNA, 23 bp, Homo sapiens
cagggacgaagaagagccacagt

SEQ ID NO: 3032762 - DNA, 15 bp, Homo sapiens
cagggactcggccca

SEQ ID NO: 3032763 - DNA, 23 bp, Homo sapiens
cagggactgaaaacctctcctca

SEQ ID NO: 3032764 - DNA, 13 bp, Homo sapiens
cagggagaagctc

SEQ ID NO: 3032765 - DNA, 23 bp, Homo sapiens
cagggagacggtttccagggagg

SEQ ID NO: 3032766 - DNA, 18 bp, Homo sapiens
cagggagcaccacggcca

SEQ ID NO: 3032767 - DNA, 19 bp, Homo sapiens
cagggagcctagaagctgg

SEQ ID NO: 3032768 - DNA, 17 bp, Homo sapiens
cagggagcggaaagcag

SEQ ID NO: 3032769 - DNA, 15 bp, Homo sapiens
cagggagcggccggc

SEQ ID NO: 3032770 - DNA, 17 bp, Homo sapiens
cagggagcggccggcca

SEQ ID NO: 3032771 - DNA, 19 bp, Homo sapiens
cagggagcggccggccagc

SEQ ID NO: 3032772 - DNA, 16 bp, Homo sapiens
cagggagctgggcccg

SEQ ID NO: 3032773 - DNA, 22 bp, Homo sapiens
cagggagctgggcccgacatgg

SEQ ID NO: 3032774 - DNA, 21 bp, Homo sapiens
cagggaggcagagcgggaggg

SEQ ID NO: 3032775 - DNA, 17 bp, Homo sapiens
cagggaggccctgtgcc

SEQ ID NO: 3032776 - DNA, 14 bp, Homo sapiens
cagggagggccagg

SEQ ID NO: 3032777 - DNA, 14 bp, Homo sapiens
cagggaggggccgg

SEQ ID NO: 3032778 - DNA, 21 bp, Homo sapiens
cagggaggggccggccctgtg

SEQ ID NO: 3032779 - DNA, 14 bp, Homo sapiens
cagggagggtgagc

SEQ ID NO: 3032780 - DNA, 13 bp, Homo sapiens
cagggatgccctg

SEQ ID NO: 3032781 - DNA, 23 bp, Homo sapiens
cagggatgccctggaggtggctg

SEQ ID NO: 3032782 - DNA, 21 bp, Homo sapiens
cagggatgtgggaatctccca

SEQ ID NO: 3032783 - DNA, 21 bp, Homo sapiens
cagggcagcctcccccggctc

SEQ ID NO: 3032784 - DNA, 17 bp, Homo sapiens
cagggcagcgccaggct

SEQ ID NO: 3032785 - DNA, 22 bp, Homo sapiens
cagggcagcgccaggctgacca

SEQ ID NO: 3032786 - DNA, 14 bp, Homo sapiens
cagggcagctgcct

SEQ ID NO: 3032787 - DNA, 15 bp, Homo sapiens
cagggcagctgcctg

SEQ ID NO: 3032788 - DNA, 16 bp, Homo sapiens
cagggcagctgcctgg

SEQ ID NO: 3032789 - DNA, 19 bp, Homo sapiens
cagggcagctgcctggcca

SEQ ID NO: 3032790 - DNA, 13 bp, Homo sapiens
cagggcaggtggg

SEQ ID NO: 3032791 - DNA, 21 bp, Homo sapiens
cagggcagtcattggctgtct

SEQ ID NO: 3032792 - DNA, 16 bp, Homo sapiens
cagggccacgctccag

SEQ ID NO: 3032793 - DNA, 18 bp, Homo sapiens
cagggccacgctccagct

SEQ ID NO: 3032794 - DNA, 20 bp, Homo sapiens
cagggccacgctccagctgc

SEQ ID NO: 3032795 - DNA, 22 bp, Homo sapiens
cagggccacgctccagctgccc

SEQ ID NO: 3032796 - DNA, 15 bp, Homo sapiens
cagggccacgtgcca

SEQ ID NO: 3032797 - DNA, 16 bp, Homo sapiens
cagggccaggaaggac

SEQ ID NO: 3032798 - DNA, 11 bp, Homo sapiens
cagggccaggc

SEQ ID NO: 3032799 - DNA, 22 bp, Homo sapiens
cagggccatggctcagggtggt

SEQ ID NO: 3032800 - DNA, 16 bp, Homo sapiens
cagggcccagagccca

SEQ ID NO: 3032801 - DNA, 13 bp, Homo sapiens
cagggcccaggcc

SEQ ID NO: 3032802 - DNA, 14 bp, Homo sapiens
cagggcccaggcca

SEQ ID NO: 3032803 - DNA, 15 bp, Homo sapiens
cagggcccaggccat

SEQ ID NO: 3032804 - DNA, 14 bp, Homo sapiens
cagggcccaggcct

SEQ ID NO: 3032805 - DNA, 16 bp, Homo sapiens
cagggcccaggcctgg

SEQ ID NO: 3032806 - DNA, 18 bp, Homo sapiens
cagggcccaggcctggag

SEQ ID NO: 3032807 - DNA, 16 bp, Homo sapiens
cagggcccccatctca

SEQ ID NO: 3032808 - DNA, 21 bp, Homo sapiens
cagggcccccatctcatgccc

SEQ ID NO: 3032809 - DNA, 18 bp, Homo sapiens
cagggcccctgaccctcc

SEQ ID NO: 3032810 - DNA, 22 bp, Homo sapiens
cagggccgccagggagacctgg

SEQ ID NO: 3032811 - DNA, 16 bp, Homo sapiens
cagggccgctcgatgc

SEQ ID NO: 3032812 - DNA, 22 bp, Homo sapiens
cagggccgctcgatgcctttgc

SEQ ID NO: 3032813 - DNA, 19 bp, Homo sapiens
cagggcctagctgctacaa

SEQ ID NO: 3032814 - DNA, 22 bp, Homo sapiens
cagggcctagctgctacaaaga

SEQ ID NO: 3032815 - DNA, 16 bp, Homo sapiens
cagggcctgagcctgg

SEQ ID NO: 3032816 - DNA, 18 bp, Homo sapiens
cagggcctgagcctggcc

SEQ ID NO: 3032817 - DNA, 22 bp, Homo sapiens
cagggcctgcaggacctgcctg

SEQ ID NO: 3032818 - DNA, 16 bp, Homo sapiens
cagggccttgcccaga

SEQ ID NO: 3032819 - DNA, 20 bp, Homo sapiens
cagggccttgcccagagatg

SEQ ID NO: 3032820 - DNA, 24 bp, Homo sapiens
cagggccttgcccagagatgcctc

SEQ ID NO: 3032821 - DNA, 13 bp, Homo sapiens
cagggcggccagg

SEQ ID NO: 3032822 - DNA, 16 bp, Homo sapiens
cagggcggccagggac

SEQ ID NO: 3032823 - DNA, 19 bp, Homo sapiens
cagggcggccagggaccca

SEQ ID NO: 3032824 - DNA, 22 bp, Homo sapiens
cagggcggccagggacccaaag

SEQ ID NO: 3032825 - DNA, 13 bp, Homo sapiens
cagggcggctgcc

SEQ ID NO: 3032826 - DNA, 15 bp, Homo sapiens
cagggcggctgccga

SEQ ID NO: 3032827 - DNA, 16 bp, Homo sapiens
cagggcgggcagaggg

SEQ ID NO: 3032828 - DNA, 17 bp, Homo sapiens
cagggcgggcagagggc

SEQ ID NO: 3032829 - DNA, 16 bp, Homo sapiens
cagggctaccctgagc

SEQ ID NO: 3032830 - DNA, 19 bp, Homo sapiens
cagggctaccctgagctga

SEQ ID NO: 3032831 - DNA, 22 bp, Homo sapiens
cagggctagtgaagtggcctct

SEQ ID NO: 3032832 - DNA, 17 bp, Homo sapiens
cagggctcctgtggcag

SEQ ID NO: 3032833 - DNA, 23 bp, Homo sapiens
cagggctcctgtggcagctgccc

SEQ ID NO: 3032834 - DNA, 14 bp, Homo sapiens
cagggctctggggg

SEQ ID NO: 3032835 - DNA, 21 bp, Homo sapiens
cagggctgctgggggcaactg

SEQ ID NO: 3032836 - DNA, 23 bp, Homo sapiens
cagggctgctgggggcaactggc

SEQ ID NO: 3032837 - DNA, 16 bp, Homo sapiens
cagggctgggccttgt

SEQ ID NO: 3032838 - DNA, 19 bp, Homo sapiens
cagggctgggtcacaggaa

SEQ ID NO: 3032839 - DNA, 20 bp, Homo sapiens
cagggctgggtcacaggaag

SEQ ID NO: 3032840 - DNA, 13 bp, Homo sapiens
cagggctggtttg

SEQ ID NO: 3032841 - DNA, 15 bp, Homo sapiens
cagggctgtcatctg

SEQ ID NO: 3032842 - DNA, 19 bp, Homo sapiens
caggggaagctgctagggg

SEQ ID NO: 3032843 - DNA, 12 bp, Homo sapiens
caggggaagggc

SEQ ID NO: 3032844 - DNA, 15 bp, Homo sapiens
caggggaagggcagg

SEQ ID NO: 3032845 - DNA, 17 bp, Homo sapiens
caggggacaagggaggc

SEQ ID NO: 3032846 - DNA, 18 bp, Homo sapiens
caggggacactggcccca

SEQ ID NO: 3032847 - DNA, 17 bp, Homo sapiens
caggggacgtgggccct

SEQ ID NO: 3032848 - DNA, 22 bp, Homo sapiens
caggggacgtgggccctgcagg

SEQ ID NO: 3032849 - DNA, 11 bp, Homo sapiens
caggggactgg

SEQ ID NO: 3032850 - DNA, 17 bp, Homo sapiens
caggggagagggtctgg

SEQ ID NO: 3032851 - DNA, 14 bp, Homo sapiens
caggggagccaggg

SEQ ID NO: 3032852 - DNA, 23 bp, Homo sapiens
caggggatacaggcccctgggtt

SEQ ID NO: 3032853 - DNA, 18 bp, Homo sapiens
caggggatgtttacctgg

SEQ ID NO: 3032854 - DNA, 21 bp, Homo sapiens
caggggatgtttacctggtgc

SEQ ID NO: 3032855 - DNA, 13 bp, Homo sapiens
caggggcagccac

SEQ ID NO: 3032856 - DNA, 23 bp, Homo sapiens
caggggcagccacaccactgcca

SEQ ID NO: 3032857 - DNA, 14 bp, Homo sapiens
caggggcaggaggg

SEQ ID NO: 3032858 - DNA, 17 bp, Homo sapiens
caggggctgctgggggc

SEQ ID NO: 3032859 - DNA, 16 bp, Homo sapiens
cagggggcctggagca

SEQ ID NO: 3032860 - DNA, 19 bp, Homo sapiens
cagggggcctggagcatgg

SEQ ID NO: 3032861 - DNA, 15 bp, Homo sapiens
caggggggtgaggag

SEQ ID NO: 3032862 - DNA, 19 bp, Homo sapiens
caggggggtgaggagctgg

SEQ ID NO: 3032863 - DNA, 16 bp, Homo sapiens
caggggtcactgaggc

SEQ ID NO: 3032864 - DNA, 21 bp, Homo sapiens
caggggtcaggtgtcaggccc

SEQ ID NO: 3032865 - DNA, 23 bp, Homo sapiens
caggggtcaggtgtcaggcccgt

SEQ ID NO: 3032866 - DNA, 18 bp, Homo sapiens
caggggtgacacagactc

SEQ ID NO: 3032867 - DNA, 13 bp, Homo sapiens
caggggtgagagc

SEQ ID NO: 3032868 - DNA, 16 bp, Homo sapiens
caggggtgagagcacc

SEQ ID NO: 3032869 - DNA, 20 bp, Homo sapiens
caggggtgagagcacccact

SEQ ID NO: 3032870 - DNA, 16 bp, Homo sapiens
caggggtgcacagtcc

SEQ ID NO: 3032871 - DNA, 20 bp, Homo sapiens
caggggttatgtggaagtgt

SEQ ID NO: 3032872 - DNA, 19 bp, Homo sapiens
caggggttcttgagccagc

SEQ ID NO: 3032873 - DNA, 15 bp, Homo sapiens
cagggtagagcaaag

SEQ ID NO: 3032874 - DNA, 18 bp, Homo sapiens
cagggtattgcttgccac

SEQ ID NO: 3032875 - DNA, 16 bp, Homo sapiens
cagggtcagaaacagg

SEQ ID NO: 3032876 - DNA, 17 bp, Homo sapiens
cagggtcagtgtatcta

SEQ ID NO: 3032877 - DNA, 14 bp, Homo sapiens
cagggtcccctgcc

SEQ ID NO: 3032878 - DNA, 17 bp, Homo sapiens
cagggtcccctgccacc

SEQ ID NO: 3032879 - DNA, 20 bp, Homo sapiens
cagggtcctcttctgggcct

SEQ ID NO: 3032880 - DNA, 24 bp, Homo sapiens
cagggtctaaggagcgctagtgcc

SEQ ID NO: 3032881 - DNA, 16 bp, Homo sapiens
cagggtctctgctcca

SEQ ID NO: 3032882 - DNA, 19 bp, Homo sapiens
cagggtctctgctccagca

SEQ ID NO: 3032883 - DNA, 17 bp, Homo sapiens
cagggtcttttcatctg

SEQ ID NO: 3032884 - DNA, 19 bp, Homo sapiens
cataaaagtgattcttttt

SEQ ID NO: 3032885 - DNA, 22 bp, Homo sapiens
cataaaattttctactcttttt

SEQ ID NO: 3032886 - DNA, 21 bp, Homo sapiens
cataaacccagttgccatctg

SEQ ID NO: 3032887 - DNA, 11 bp, Homo sapiens
cataaagaagc

SEQ ID NO: 3032888 - DNA, 12 bp, Homo sapiens
cataaagaagca

SEQ ID NO: 3032889 - DNA, 18 bp, Homo sapiens
cataaatagtagaaaaat

SEQ ID NO: 3032890 - DNA, 18 bp, Homo sapiens
cataaatctgaagtggtt

SEQ ID NO: 3032891 - DNA, 18 bp, Homo sapiens
cataaatgcagcccattt

SEQ ID NO: 3032892 - DNA, 21 bp, Homo sapiens
cataaatgcagcccatttctc

SEQ ID NO: 3032893 - DNA, 17 bp, Homo sapiens
cataaattatgagattt

SEQ ID NO: 3032894 - DNA, 16 bp, Homo sapiens
cataaccccttgaaac

SEQ ID NO: 3032895 - DNA, 22 bp, Homo sapiens
cataacgccaccatcaacttaa

SEQ ID NO: 3032896 - DNA, 21 bp, Homo sapiens
cataacggttaagaaagcact

SEQ ID NO: 3032897 - DNA, 13 bp, Homo sapiens
cataactgatcta

SEQ ID NO: 3032898 - DNA, 17 bp, Homo sapiens
cataactgatctattta

SEQ ID NO: 3032899 - DNA, 15 bp, Homo sapiens
cataagaaaaagaat

SEQ ID NO: 3032900 - DNA, 22 bp, Homo sapiens
cataagaggagtaggccctggt

SEQ ID NO: 3032901 - DNA, 17 bp, Homo sapiens
cataagatcactgccag

SEQ ID NO: 3032902 - DNA, 16 bp, Homo sapiens
cataagcattacttta

SEQ ID NO: 3032903 - DNA, 18 bp, Homo sapiens
cataagcttatgcttaaa

SEQ ID NO: 3032904 - DNA, 15 bp, Homo sapiens
cataaggcttcaaaa

SEQ ID NO: 3032905 - DNA, 19 bp, Homo sapiens
cataaggcttcaaaatgtt

SEQ ID NO: 3032906 - DNA, 15 bp, Homo sapiens
cataaggtttcgttt

SEQ ID NO: 3032907 - DNA, 22 bp, Homo sapiens
cataaggtttcgtttctgtata

SEQ ID NO: 3032908 - DNA, 19 bp, Homo sapiens
cataagtttaactttaaaa

SEQ ID NO: 3032909 - DNA, 14 bp, Homo sapiens
cataatacaaaagg

SEQ ID NO: 3032910 - DNA, 20 bp, Homo sapiens
cataatacacttgccctgct

SEQ ID NO: 3032911 - DNA, 18 bp, Homo sapiens
cataatccagtaaaataa

SEQ ID NO: 3032912 - DNA, 15 bp, Homo sapiens
cataatccttctgca

SEQ ID NO: 3032913 - DNA, 18 bp, Homo sapiens
cataatgcagaagtattc

SEQ ID NO: 3032914 - DNA, 19 bp, Homo sapiens
cataatgcagaagtattct

SEQ ID NO: 3032915 - DNA, 14 bp, Homo sapiens
cataatgctactgt

SEQ ID NO: 3032916 - DNA, 15 bp, Homo sapiens
cataatgctactgtc

SEQ ID NO: 3032917 - DNA, 21 bp, Homo sapiens
cataatgggccactgaaatct

SEQ ID NO: 3032918 - DNA, 23 bp, Homo sapiens
cataatgggccactgaaatctgt

SEQ ID NO: 3032919 - DNA, 12 bp, Homo sapiens
cataatgtgaaa

SEQ ID NO: 3032920 - DNA, 13 bp, Homo sapiens
cataatgtgaagt

SEQ ID NO: 3032921 - DNA, 17 bp, Homo sapiens
cataatgtgaagtgtta

SEQ ID NO: 3032922 - DNA, 14 bp, Homo sapiens
cataatgttcctta

SEQ ID NO: 3032923 - DNA, 14 bp, Homo sapiens
cataattcactctg

SEQ ID NO: 3032924 - DNA, 22 bp, Homo sapiens
cataattccgaaacaaaactgt

SEQ ID NO: 3032925 - DNA, 15 bp, Homo sapiens
cataattgattaaaa

SEQ ID NO: 3032926 - DNA, 20 bp, Homo sapiens
cataattgattaaaatctct

SEQ ID NO: 3032927 - DNA, 23 bp, Homo sapiens
cataattgtgaccaatacatttg

SEQ ID NO: 3032928 - DNA, 15 bp, Homo sapiens
cataatttgtttaaa

SEQ ID NO: 3032929 - DNA, 18 bp, Homo sapiens
cataatttgtttaaaatt

SEQ ID NO: 3032930 - DNA, 22 bp, Homo sapiens
cataatttgtttaaaattctct

SEQ ID NO: 3032931 - DNA, 13 bp, Homo sapiens
catacaaaataaa

SEQ ID NO: 3032932 - DNA, 18 bp, Homo sapiens
catacaaaataaaactgt

SEQ ID NO: 3032933 - DNA, 19 bp, Homo sapiens
catacaagtttataaagag

SEQ ID NO: 3032934 - DNA, 21 bp, Homo sapiens
catacacacacacacacagcc

SEQ ID NO: 3032935 - DNA, 21 bp, Homo sapiens
catacaccccctcttctgagc

SEQ ID NO: 3032936 - DNA, 22 bp, Homo sapiens
catacaccccctcttctgagca

SEQ ID NO: 3032937 - DNA, 23 bp, Homo sapiens
catacaccccctcttctgagcac

SEQ ID NO: 3032938 - DNA, 23 bp, Homo sapiens
catacagaattactgtaactgat

SEQ ID NO: 3032939 - DNA, 14 bp, Homo sapiens
cataccaatgaaaa

SEQ ID NO: 3032940 - DNA, 23 bp, Homo sapiens
cataccgcctcgtgccagcagcc

SEQ ID NO: 3032941 - DNA, 16 bp, Homo sapiens
catactacctagaagt

SEQ ID NO: 3032942 - DNA, 20 bp, Homo sapiens
catactccttccatcaaata

SEQ ID NO: 3032943 - DNA, 16 bp, Homo sapiens
catactctgttgcctc

SEQ ID NO: 3032944 - DNA, 17 bp, Homo sapiens
catactctgttgcctcc

SEQ ID NO: 3032945 - DNA, 18 bp, Homo sapiens
catactctgttgcctcct

SEQ ID NO: 3032946 - DNA, 21 bp, Homo sapiens
catactctgttgcctcctctc

SEQ ID NO: 3032947 - DNA, 14 bp, Homo sapiens
catacttgaagggc

SEQ ID NO: 3032948 - DNA, 17 bp, Homo sapiens
catacttgaagggccag

SEQ ID NO: 3032949 - DNA, 21 bp, Homo sapiens
catacttgaagggccagagcc

SEQ ID NO: 3032950 - DNA, 14 bp, Homo sapiens
catactttcctgta

SEQ ID NO: 3032951 - DNA, 12 bp, Homo sapiens
catactttgtct

SEQ ID NO: 3032952 - DNA, 16 bp, Homo sapiens
catactttgtctgaaa

SEQ ID NO: 3032953 - DNA, 18 bp, Homo sapiens
catactttgtctgaaaaa

SEQ ID NO: 3032954 - DNA, 20 bp, Homo sapiens
catagaaatggaaattttgc

SEQ ID NO: 3032955 - DNA, 18 bp, Homo sapiens
catagaacagaaatatat

SEQ ID NO: 3032956 - DNA, 17 bp, Homo sapiens
catagacatttcaaaat

SEQ ID NO: 3032957 - DNA, 21 bp, Homo sapiens
catagaccctctttcttgttt

SEQ ID NO: 3032958 - DNA, 14 bp, Homo sapiens
catagagaaacctg

SEQ ID NO: 3032959 - DNA, 22 bp, Homo sapiens
catagagaacaaagtaaaagta

SEQ ID NO: 3032960 - DNA, 22 bp, Homo sapiens
catagagagggagaagaagtca

SEQ ID NO: 3032961 - DNA, 20 bp, Homo sapiens
catagagcagtgcacatctg

SEQ ID NO: 3032962 - DNA, 14 bp, Homo sapiens
catagatattggaa

SEQ ID NO: 3032963 - DNA, 16 bp, Homo sapiens
catagatattggaaga

SEQ ID NO: 3032964 - DNA, 18 bp, Homo sapiens
catagatattggaagaga

SEQ ID NO: 3032965 - DNA, 20 bp, Homo sapiens
catagatattggaagagaga

SEQ ID NO: 3032966 - DNA, 22 bp, Homo sapiens
catagatttgaagatctgattt

SEQ ID NO: 3032967 - DNA, 15 bp, Homo sapiens
catagcatgacattt

SEQ ID NO: 3032968 - DNA, 17 bp, Homo sapiens
catagcatgacatttct

SEQ ID NO: 3032969 - DNA, 18 bp, Homo sapiens
catagcctaatccctggg

SEQ ID NO: 3032970 - DNA, 17 bp, Homo sapiens
catagcctcatgttctg

SEQ ID NO: 3032971 - DNA, 19 bp, Homo sapiens
catagcctcatgttctgtg

SEQ ID NO: 3032972 - DNA, 15 bp, Homo sapiens
catagcgtcctgccc

SEQ ID NO: 3032973 - DNA, 16 bp, Homo sapiens
catagctaataagtag

SEQ ID NO: 3032974 - DNA, 13 bp, Homo sapiens
catagctgggaaa

SEQ ID NO: 3032975 - DNA, 17 bp, Homo sapiens
catagctttccagttcc

SEQ ID NO: 3032976 - DNA, 23 bp, Homo sapiens
cataggactcaaagtttcagaga

SEQ ID NO: 3032977 - DNA, 18 bp, Homo sapiens
cataggcccacacacagg

SEQ ID NO: 3032978 - DNA, 16 bp, Homo sapiens
cataggtaggtatctt

SEQ ID NO: 3032979 - DNA, 20 bp, Homo sapiens
cataggtaggtatctttata

SEQ ID NO: 3032980 - DNA, 17 bp, Homo sapiens
catagtaaagtattttt

SEQ ID NO: 3032981 - DNA, 20 bp, Homo sapiens
catagtaaagtatttttgat

SEQ ID NO: 3032982 - DNA, 23 bp, Homo sapiens
catagtaacttcttatggaattg

SEQ ID NO: 3032983 - DNA, 20 bp, Homo sapiens
catagtatactgatttaatt

SEQ ID NO: 3032984 - DNA, 23 bp, Homo sapiens
catagtcccaccttggagcattt

SEQ ID NO: 3032985 - DNA, 21 bp, Homo sapiens
catagtgaacacagcagacct

SEQ ID NO: 3032986 - DNA, 14 bp, Homo sapiens
catagtgccttttt

SEQ ID NO: 3032987 - DNA, 15 bp, Homo sapiens
catagtggtgcagag

SEQ ID NO: 3032988 - DNA, 18 bp, Homo sapiens
catagttatttacttgaa

SEQ ID NO: 3032989 - DNA, 23 bp, Homo sapiens
catagttgaaaaaagaagtttgg

SEQ ID NO: 3032990 - DNA, 14 bp, Homo sapiens
catagttgcaaaat

SEQ ID NO: 3032991 - DNA, 13 bp, Homo sapiens
catagtttggcat

SEQ ID NO: 3032992 - DNA, 17 bp, Homo sapiens
catagtttttcctgggt

SEQ ID NO: 3032993 - DNA, 14 bp, Homo sapiens
catataaaataatg

SEQ ID NO: 3032994 - DNA, 21 bp, Homo sapiens
catataaaataatgcaaagaa

SEQ ID NO: 3032995 - DNA, 22 bp, Homo sapiens
catataaaataatgcaaagaat

SEQ ID NO: 3032996 - DNA, 14 bp, Homo sapiens
catataaattcccc

SEQ ID NO: 3032997 - DNA, 21 bp, Homo sapiens
catataagtttgaaggaaaca

SEQ ID NO: 3032998 - DNA, 13 bp, Homo sapiens
catatacacacac

SEQ ID NO: 3032999 - DNA, 15 bp, Homo sapiens
catatacacacacac

SEQ ID NO: 3033000 - DNA, 19 bp, Homo sapiens
catatagaaaacaaaggag

SEQ ID NO: 3033001 - DNA, 21 bp, Homo sapiens
catatagcaaaacttttaaac

SEQ ID NO: 3033002 - DNA, 16 bp, Homo sapiens
catatatattacaagg

SEQ ID NO: 3033003 - DNA, 22 bp, Homo sapiens
catatatccttttcttctatgt

SEQ ID NO: 3033004 - DNA, 14 bp, Homo sapiens
catatcactgaagg

SEQ ID NO: 3033005 - DNA, 14 bp, Homo sapiens
catatcatgctttg

SEQ ID NO: 3033006 - DNA, 23 bp, Homo sapiens
catatcctccgccctttttgtcc

SEQ ID NO: 3033007 - DNA, 20 bp, Homo sapiens
catatctctagtccctgtgt

SEQ ID NO: 3033008 - DNA, 17 bp, Homo sapiens
catatctctcccttctt

SEQ ID NO: 3033009 - DNA, 23 bp, Homo sapiens
catatctcttgcccttcctactc

SEQ ID NO: 3033010 - DNA, 17 bp, Homo sapiens
catatgaatgaaacatg

SEQ ID NO: 3033011 - DNA, 23 bp, Homo sapiens
catatgattctcttagacacttt

SEQ ID NO: 3033012 - DNA, 20 bp, Homo sapiens
catatgcaccttgtgtctgt

SEQ ID NO: 3033013 - DNA, 14 bp, Homo sapiens
catatggacactgt

SEQ ID NO: 3033014 - DNA, 16 bp, Homo sapiens
catatggacactgtga

SEQ ID NO: 3033015 - DNA, 21 bp, Homo sapiens
catgctgttgattgctaaatg

SEQ ID NO: 3033016 - DNA, 22 bp, Homo sapiens
catgctgtttatgacacaatga

SEQ ID NO: 3033017 - DNA, 22 bp, Homo sapiens
catgcttcaatagttcaaggaa

SEQ ID NO: 3033018 - DNA, 14 bp, Homo sapiens
catgcttcatcatt

SEQ ID NO: 3033019 - DNA, 22 bp, Homo sapiens
catgctttgaaaaatcacttga

SEQ ID NO: 3033020 - DNA, 18 bp, Homo sapiens
catggaaaagccttctta

SEQ ID NO: 3033021 - DNA, 16 bp, Homo sapiens
catggaaggtgccaga

SEQ ID NO: 3033022 - DNA, 21 bp, Homo sapiens
catggaaggtgccagaaggaa

SEQ ID NO: 3033023 - DNA, 22 bp, Homo sapiens
catggaaggtgccagaaggaag

SEQ ID NO: 3033024 - DNA, 14 bp, Homo sapiens
catggacagaattt

SEQ ID NO: 3033025 - DNA, 18 bp, Homo sapiens
catggacaggctggctcc

SEQ ID NO: 3033026 - DNA, 12 bp, Homo sapiens
catggacagtgt

SEQ ID NO: 3033027 - DNA, 17 bp, Homo sapiens
catggacccctcgccca

SEQ ID NO: 3033028 - DNA, 23 bp, Homo sapiens
catggaggagacaggaagcctca

SEQ ID NO: 3033029 - DNA, 18 bp, Homo sapiens
catggaggcactgaagcc

SEQ ID NO: 3033030 - DNA, 13 bp, Homo sapiens
catggaggttcta

SEQ ID NO: 3033031 - DNA, 15 bp, Homo sapiens
catggaggttctaag

SEQ ID NO: 3033032 - DNA, 16 bp, Homo sapiens
catggaggttctaagg

SEQ ID NO: 3033033 - DNA, 13 bp, Homo sapiens
catggagtgtttg

SEQ ID NO: 3033034 - DNA, 15 bp, Homo sapiens
catggagtgtttgac

SEQ ID NO: 3033035 - DNA, 14 bp, Homo sapiens
catggatgaaacct

SEQ ID NO: 3033036 - DNA, 17 bp, Homo sapiens
catggattccaaagcat

SEQ ID NO: 3033037 - DNA, 22 bp, Homo sapiens
catggattccaaagcattttca

SEQ ID NO: 3033038 - DNA, 18 bp, Homo sapiens
catggcaatggcatgccc

SEQ ID NO: 3033039 - DNA, 18 bp, Homo sapiens
catggcactccctccagc

SEQ ID NO: 3033040 - DNA, 20 bp, Homo sapiens
catggcactccctccagcac

SEQ ID NO: 3033041 - DNA, 21 bp, Homo sapiens
catggcagaaagggggcatct

SEQ ID NO: 3033042 - DNA, 18 bp, Homo sapiens
catggcagagtttgtgtg

SEQ ID NO: 3033043 - DNA, 18 bp, Homo sapiens
catggcagctgggcccac

SEQ ID NO: 3033044 - DNA, 19 bp, Homo sapiens
catggcagctgggcccaca

SEQ ID NO: 3033045 - DNA, 16 bp, Homo sapiens
catggccacactgtga

SEQ ID NO: 3033046 - DNA, 18 bp, Homo sapiens
catggccacactgtgaca

SEQ ID NO: 3033047 - DNA, 20 bp, Homo sapiens
catggccacactgtgacaca

SEQ ID NO: 3033048 - DNA, 22 bp, Homo sapiens
catggccacactgtgacacact

SEQ ID NO: 3033049 - DNA, 14 bp, Homo sapiens
catggccctgggcg

SEQ ID NO: 3033050 - DNA, 16 bp, Homo sapiens
catggcctatgcacat

SEQ ID NO: 3033051 - DNA, 19 bp, Homo sapiens
catggcctatgcacatatg

SEQ ID NO: 3033052 - DNA, 16 bp, Homo sapiens
catggcctctgcaact

SEQ ID NO: 3033053 - DNA, 22 bp, Homo sapiens
catggcgtagagggtgctgccc

SEQ ID NO: 3033054 - DNA, 17 bp, Homo sapiens
catggctccggcctctg

SEQ ID NO: 3033055 - DNA, 16 bp, Homo sapiens
catggctgcacagttg

SEQ ID NO: 3033056 - DNA, 13 bp, Homo sapiens
catggctggggga

SEQ ID NO: 3033057 - DNA, 13 bp, Homo sapiens
catggctggtgcc

SEQ ID NO: 3033058 - DNA, 14 bp, Homo sapiens
catggcttctcctt

SEQ ID NO: 3033059 - DNA, 18 bp, Homo sapiens
catgggaacgcagcctcc

SEQ ID NO: 3033060 - DNA, 16 bp, Homo sapiens
catgggaaggggagga

SEQ ID NO: 3033061 - DNA, 17 bp, Homo sapiens
catgggaaggggaggac

SEQ ID NO: 3033062 - DNA, 19 bp, Homo sapiens
catgggactgattctgttg

SEQ ID NO: 3033063 - DNA, 14 bp, Homo sapiens
catgggaggctcac

SEQ ID NO: 3033064 - DNA, 19 bp, Homo sapiens
catgggccccccatgcata

SEQ ID NO: 3033065 - DNA, 19 bp, Homo sapiens
catggggatcaattttcat

SEQ ID NO: 3033066 - DNA, 15 bp, Homo sapiens
catggggcatgtcct

SEQ ID NO: 3033067 - DNA, 20 bp, Homo sapiens
catgggtatagttcatgtct

SEQ ID NO: 3033068 - DNA, 15 bp, Homo sapiens
catgggtcctcggcc

SEQ ID NO: 3033069 - DNA, 23 bp, Homo sapiens
catgggtcctcggcccatctgtc

SEQ ID NO: 3033070 - DNA, 13 bp, Homo sapiens
catgggtcgggag

SEQ ID NO: 3033071 - DNA, 16 bp, Homo sapiens
catgggtcgggagagg

SEQ ID NO: 3033072 - DNA, 18 bp, Homo sapiens
catgggtcgggagagggg

SEQ ID NO: 3033073 - DNA, 15 bp, Homo sapiens
catgggtctggcctg

SEQ ID NO: 3033074 - DNA, 23 bp, Homo sapiens
catgggtctggctagagggccca

SEQ ID NO: 3033075 - DNA, 17 bp, Homo sapiens
catggtaacgaacccct

SEQ ID NO: 3033076 - DNA, 15 bp, Homo sapiens
catggtcacacactg

SEQ ID NO: 3033077 - DNA, 16 bp, Homo sapiens
catggtcacacactga

SEQ ID NO: 3033078 - DNA, 16 bp, Homo sapiens
catggtcagccctagg

SEQ ID NO: 3033079 - DNA, 16 bp, Homo sapiens
catggtccccaagacc

SEQ ID NO: 3033080 - DNA, 14 bp, Homo sapiens
catggtccctagca

SEQ ID NO: 3033081 - DNA, 18 bp, Homo sapiens
catggtcctgtctgtcct

SEQ ID NO: 3033082 - DNA, 19 bp, Homo sapiens
catggtcctgtctgtcctt

SEQ ID NO: 3033083 - DNA, 23 bp, Homo sapiens
catggtcctgtctgtccttctga

SEQ ID NO: 3033084 - DNA, 15 bp, Homo sapiens
catggtctgtcctga

SEQ ID NO: 3033085 - DNA, 22 bp, Homo sapiens
catggtctgtcctgacagcact

SEQ ID NO: 3033086 - DNA, 20 bp, Homo sapiens
catggtgaaacccccatctc

SEQ ID NO: 3033087 - DNA, 21 bp, Homo sapiens
catggtgaaacccccatctct

SEQ ID NO: 3033088 - DNA, 19 bp, Homo sapiens
catggtgagcctagccctg

SEQ ID NO: 3033089 - DNA, 16 bp, Homo sapiens
catggtgccccaggac

SEQ ID NO: 3033090 - DNA, 17 bp, Homo sapiens
catggtggcgcaagcct

SEQ ID NO: 3033091 - DNA, 18 bp, Homo sapiens
catggtggcgcaagcctg

SEQ ID NO: 3033092 - DNA, 20 bp, Homo sapiens
catggtggcgcaagcctgta

SEQ ID NO: 3033093 - DNA, 21 bp, Homo sapiens
catggtgggtccatgggcaga

SEQ ID NO: 3033094 - DNA, 18 bp, Homo sapiens
catggtgtgatcgtctga

SEQ ID NO: 3033095 - DNA, 14 bp, Homo sapiens
catggtgtggccat

SEQ ID NO: 3033096 - DNA, 16 bp, Homo sapiens
catggttaagagtcca

SEQ ID NO: 3033097 - DNA, 19 bp, Homo sapiens
catggttaagagtccaaga

SEQ ID NO: 3033098 - DNA, 21 bp, Homo sapiens
catggttccaattttttttaa

SEQ ID NO: 3033099 - DNA, 22 bp, Homo sapiens
catgtaaacacgcctgcaaacg

SEQ ID NO: 3033100 - DNA, 13 bp, Homo sapiens
catgtaaagaaaa

SEQ ID NO: 3033101 - DNA, 15 bp, Homo sapiens
catgtaaataagatg

SEQ ID NO: 3033102 - DNA, 15 bp, Homo sapiens
catgtaactatttct

SEQ ID NO: 3033103 - DNA, 19 bp, Homo sapiens
catgtaactatttcttcag

SEQ ID NO: 3033104 - DNA, 21 bp, Homo sapiens
catgtaactatttcttcagag

SEQ ID NO: 3033105 - DNA, 14 bp, Homo sapiens
catgtaatcctcaa

SEQ ID NO: 3033106 - DNA, 15 bp, Homo sapiens
catgtaatgatcttg

SEQ ID NO: 3033107 - DNA, 15 bp, Homo sapiens
catgtacaaaaccat

SEQ ID NO: 3033108 - DNA, 16 bp, Homo sapiens
catgtacagacagaga

SEQ ID NO: 3033109 - DNA, 20 bp, Homo sapiens
catgtacatagtaaagtatt

SEQ ID NO: 3033110 - DNA, 21 bp, Homo sapiens
catgtacatagtaaagtattt

SEQ ID NO: 3033111 - DNA, 20 bp, Homo sapiens
catgtagaaaatttgttatt

SEQ ID NO: 3033112 - DNA, 17 bp, Homo sapiens
catgtagaataaatgaa

SEQ ID NO: 3033113 - DNA, 19 bp, Homo sapiens
catgtagaataaatgaaga

SEQ ID NO: 3033114 - DNA, 21 bp, Homo sapiens
catgtagcagacaacacacaa

SEQ ID NO: 3033115 - DNA, 13 bp, Homo sapiens
catgtagccccct

SEQ ID NO: 3033116 - DNA, 17 bp, Homo sapiens
catgtagccccctggcc

SEQ ID NO: 3033117 - DNA, 21 bp, Homo sapiens
catgtagccccctggcctctg

SEQ ID NO: 3033118 - DNA, 22 bp, Homo sapiens
catgtagccccctggcctctgt

SEQ ID NO: 3033119 - DNA, 16 bp, Homo sapiens
catgtagtatcaaata

SEQ ID NO: 3033120 - DNA, 18 bp, Homo sapiens
catgtatcataattacca

SEQ ID NO: 3033121 - DNA, 15 bp, Homo sapiens
catgtattatttcat

SEQ ID NO: 3033122 - DNA, 20 bp, Homo sapiens
catgtcaaacatgagatgtg

SEQ ID NO: 3033123 - DNA, 20 bp, Homo sapiens
catgtcaccggatcctgggt

SEQ ID NO: 3033124 - DNA, 19 bp, Homo sapiens
catgtccagcaccttgtgc

SEQ ID NO: 3033125 - DNA, 20 bp, Homo sapiens
catgtccagcaccttgtgcc

SEQ ID NO: 3033126 - DNA, 10 bp, Homo sapiens
catgtccccc

SEQ ID NO: 3033127 - DNA, 18 bp, Homo sapiens
catgtcctttccatctgt

SEQ ID NO: 3033128 - DNA, 19 bp, Homo sapiens
catgtcctttccatctgtc

SEQ ID NO: 3033129 - DNA, 17 bp, Homo sapiens
catgtctctcagaattc

SEQ ID NO: 3033130 - DNA, 13 bp, Homo sapiens
catgtctctgctt

SEQ ID NO: 3033131 - DNA, 15 bp, Homo sapiens
catgtctgcctggag

SEQ ID NO: 3033132 - DNA, 16 bp, Homo sapiens
catgtctgcctggagt

SEQ ID NO: 3033133 - DNA, 15 bp, Homo sapiens
catgtctgtgctgtg

SEQ ID NO: 3033134 - DNA, 16 bp, Homo sapiens
catgtctgtgctgtgt

SEQ ID NO: 3033135 - DNA, 19 bp, Homo sapiens
catgtgaaaatcaaataca

SEQ ID NO: 3033136 - DNA, 16 bp, Homo sapiens
catgtgacacatatgc

SEQ ID NO: 3033137 - DNA, 12 bp, Homo sapiens
catgtgactctg

SEQ ID NO: 3033138 - DNA, 20 bp, Homo sapiens
catgtgactctggcttggcc

SEQ ID NO: 3033139 - DNA, 17 bp, Homo sapiens
catgtgattatggacat

SEQ ID NO: 3033140 - DNA, 17 bp, Homo sapiens
catgtgcaactcttgta

SEQ ID NO: 3033141 - DNA, 18 bp, Homo sapiens
catgtgcaactcttgtat

SEQ ID NO: 3033142 - DNA, 18 bp, Homo sapiens
catgtgcggagcagcctt

SEQ ID NO: 3033143 - DNA, 23 bp, Homo sapiens
catgtgcgtggaagtgttcctgt

SEQ ID NO: 3033144 - DNA, 20 bp, Homo sapiens
catgtgctagtcactggcag

SEQ ID NO: 3033145 - DNA, 17 bp, Homo sapiens
catgtggaatataaaga

SEQ ID NO: 3033146 - DNA, 17 bp, Homo sapiens
catgtggagacttcatc

SEQ ID NO: 3033147 - DNA, 17 bp, Homo sapiens
catttcacatgccttgc

SEQ ID NO: 3033148 - DNA, 17 bp, Homo sapiens
catttcagccaaagtcc

SEQ ID NO: 3033149 - DNA, 19 bp, Homo sapiens
catttcatattctttcaat

SEQ ID NO: 3033150 - DNA, 16 bp, Homo sapiens
catttcatgtatagtt

SEQ ID NO: 3033151 - DNA, 17 bp, Homo sapiens
catttccaaattcacaa

SEQ ID NO: 3033152 - DNA, 16 bp, Homo sapiens
catttcccacatcttt

SEQ ID NO: 3033153 - DNA, 23 bp, Homo sapiens
catttcccctctgcacccagaac

SEQ ID NO: 3033154 - DNA, 18 bp, Homo sapiens
catttccgtcccccccca

SEQ ID NO: 3033155 - DNA, 19 bp, Homo sapiens
catttcctgagaccacaga

SEQ ID NO: 3033156 - DNA, 20 bp, Homo sapiens
catttcctttgttgtctaca

SEQ ID NO: 3033157 - DNA, 15 bp, Homo sapiens
catttcggtggctag

SEQ ID NO: 3033158 - DNA, 20 bp, Homo sapiens
catttcgtgagccccatctt

SEQ ID NO: 3033159 - DNA, 22 bp, Homo sapiens
catttcgtgagccccatcttca

SEQ ID NO: 3033160 - DNA, 13 bp, Homo sapiens
catttctaattaa

SEQ ID NO: 3033161 - DNA, 23 bp, Homo sapiens
catttctaattaaccttactaat

SEQ ID NO: 3033162 - DNA, 20 bp, Homo sapiens
catttctagcgcatggcctg

SEQ ID NO: 3033163 - DNA, 19 bp, Homo sapiens
catttctatttctcctcca

SEQ ID NO: 3033164 - DNA, 12 bp, Homo sapiens
catttctccaga

SEQ ID NO: 3033165 - DNA, 14 bp, Homo sapiens
catttctgtctccc

SEQ ID NO: 3033166 - DNA, 12 bp, Homo sapiens
catttctttctt

SEQ ID NO: 3033167 - DNA, 19 bp, Homo sapiens
catttctttcttccattcc

SEQ ID NO: 3033168 - DNA, 11 bp, Homo sapiens
catttgaaaga

SEQ ID NO: 3033169 - DNA, 18 bp, Homo sapiens
catttgaaagaaaggact

SEQ ID NO: 3033170 - DNA, 19 bp, Homo sapiens
catttgaaagaaaggactc

SEQ ID NO: 3033171 - DNA, 16 bp, Homo sapiens
catttgatgcatgtct

SEQ ID NO: 3033172 - DNA, 20 bp, Homo sapiens
catttgatgcatgtctttta

SEQ ID NO: 3033173 - DNA, 20 bp, Homo sapiens
catttgatttcgatgtacag

SEQ ID NO: 3033174 - DNA, 22 bp, Homo sapiens
catttgcaagggaaaagtctct

SEQ ID NO: 3033175 - DNA, 14 bp, Homo sapiens
catttgcagggtcc

SEQ ID NO: 3033176 - DNA, 22 bp, Homo sapiens
catttgcagggtcctcttctgg

SEQ ID NO: 3033177 - DNA, 14 bp, Homo sapiens
catttgctggcctg

SEQ ID NO: 3033178 - DNA, 16 bp, Homo sapiens
catttgctggcctggc

SEQ ID NO: 3033179 - DNA, 22 bp, Homo sapiens
catttgctggcctggcaggggg

SEQ ID NO: 3033180 - DNA, 17 bp, Homo sapiens
catttggaatacttttt

SEQ ID NO: 3033181 - DNA, 19 bp, Homo sapiens
catttggaatgcacacagc

SEQ ID NO: 3033182 - DNA, 20 bp, Homo sapiens
catttggagctcttgggtca

SEQ ID NO: 3033183 - DNA, 23 bp, Homo sapiens
catttggagtgttccccttccac

SEQ ID NO: 3033184 - DNA, 14 bp, Homo sapiens
catttggattgggg

SEQ ID NO: 3033185 - DNA, 20 bp, Homo sapiens
catttggcaatgccatcatc

SEQ ID NO: 3033186 - DNA, 21 bp, Homo sapiens
catttggcagaactgctgggg

SEQ ID NO: 3033187 - DNA, 19 bp, Homo sapiens
catttggcagagcttcttc

SEQ ID NO: 3033188 - DNA, 21 bp, Homo sapiens
catttggcaggggtggctgcc

SEQ ID NO: 3033189 - DNA, 17 bp, Homo sapiens
catttggccccagggga

SEQ ID NO: 3033190 - DNA, 17 bp, Homo sapiens
catttggggtagctaga

SEQ ID NO: 3033191 - DNA, 22 bp, Homo sapiens
catttggggtagctagaggaac

SEQ ID NO: 3033192 - DNA, 12 bp, Homo sapiens
catttgtaattt

SEQ ID NO: 3033193 - DNA, 13 bp, Homo sapiens
catttgtagtgag

SEQ ID NO: 3033194 - DNA, 18 bp, Homo sapiens
catttgtccttttctgca

SEQ ID NO: 3033195 - DNA, 16 bp, Homo sapiens
catttgtctgtgtttg

SEQ ID NO: 3033196 - DNA, 16 bp, Homo sapiens
catttgtgctagaaat

SEQ ID NO: 3033197 - DNA, 23 bp, Homo sapiens
catttgtggcagtcccttataat

SEQ ID NO: 3033198 - DNA, 22 bp, Homo sapiens
catttgtggtgatatagaatta

SEQ ID NO: 3033199 - DNA, 13 bp, Homo sapiens
catttgttaaaat

SEQ ID NO: 3033200 - DNA, 14 bp, Homo sapiens
catttgttgctgct

SEQ ID NO: 3033201 - DNA, 20 bp, Homo sapiens
catttgtttacatttgatgc

SEQ ID NO: 3033202 - DNA, 17 bp, Homo sapiens
catttgtttgtattcat

SEQ ID NO: 3033203 - DNA, 19 bp, Homo sapiens
catttgtttgtattcatgt

SEQ ID NO: 3033204 - DNA, 16 bp, Homo sapiens
catttgtttttctcac

SEQ ID NO: 3033205 - DNA, 12 bp, Homo sapiens
cattttaacaag

SEQ ID NO: 3033206 - DNA, 18 bp, Homo sapiens
cattttaacaagaagatg

SEQ ID NO: 3033207 - DNA, 22 bp, Homo sapiens
cattttaatttattaattgctt

SEQ ID NO: 3033208 - DNA, 20 bp, Homo sapiens
cattttacccacacacagat

SEQ ID NO: 3033209 - DNA, 20 bp, Homo sapiens
cattttactttttcctggct

SEQ ID NO: 3033210 - DNA, 15 bp, Homo sapiens
cattttagtcacttt

SEQ ID NO: 3033211 - DNA, 16 bp, Homo sapiens
cattttagtcactttt

SEQ ID NO: 3033212 - DNA, 17 bp, Homo sapiens
cattttagtcacttttt

SEQ ID NO: 3033213 - DNA, 22 bp, Homo sapiens
cattttataaagtgcttgtgta

SEQ ID NO: 3033214 - DNA, 17 bp, Homo sapiens
cattttatagacaccct

SEQ ID NO: 3033215 - DNA, 13 bp, Homo sapiens
cattttatattga

SEQ ID NO: 3033216 - DNA, 16 bp, Homo sapiens
cattttatattgaaaa

SEQ ID NO: 3033217 - DNA, 22 bp, Homo sapiens
cattttatattgaaaaaaataa

SEQ ID NO: 3033218 - DNA, 15 bp, Homo sapiens
cattttatcttatct

SEQ ID NO: 3033219 - DNA, 19 bp, Homo sapiens
cattttattaaaacagaaa

SEQ ID NO: 3033220 - DNA, 13 bp, Homo sapiens
cattttattgctt

SEQ ID NO: 3033221 - DNA, 15 bp, Homo sapiens
cattttcaatactgt

SEQ ID NO: 3033222 - DNA, 18 bp, Homo sapiens
cattttcactaaaagtgt

SEQ ID NO: 3033223 - DNA, 16 bp, Homo sapiens
cattttcccatcatcc

SEQ ID NO: 3033224 - DNA, 20 bp, Homo sapiens
cattttcccatcatcctttg

SEQ ID NO: 3033225 - DNA, 20 bp, Homo sapiens
cattttctataagaaaaagg

SEQ ID NO: 3033226 - DNA, 13 bp, Homo sapiens
cattttcttgaaa

SEQ ID NO: 3033227 - DNA, 14 bp, Homo sapiens
cattttcttgtcaa

SEQ ID NO: 3033228 - DNA, 19 bp, Homo sapiens
cattttgaaaacccctggc

SEQ ID NO: 3033229 - DNA, 21 bp, Homo sapiens
cattttgaaaacccctggctg

SEQ ID NO: 3033230 - DNA, 14 bp, Homo sapiens
cattttgacctact

SEQ ID NO: 3033231 - DNA, 15 bp, Homo sapiens
cattttgagaacaaa

SEQ ID NO: 3033232 - DNA, 17 bp, Homo sapiens
cattttgcctgacaatt

SEQ ID NO: 3033233 - DNA, 12 bp, Homo sapiens
cattttgtaaac

SEQ ID NO: 3033234 - DNA, 21 bp, Homo sapiens
cattttgtataattgtatcgt

SEQ ID NO: 3033235 - DNA, 12 bp, Homo sapiens
cattttgtgaag

SEQ ID NO: 3033236 - DNA, 13 bp, Homo sapiens
cattttgtgaagc

SEQ ID NO: 3033237 - DNA, 15 bp, Homo sapiens
cattttgtgtacagt

SEQ ID NO: 3033238 - DNA, 15 bp, Homo sapiens
cattttgtttctgta

SEQ ID NO: 3033239 - DNA, 19 bp, Homo sapiens
cattttgtttttattaaat

SEQ ID NO: 3033240 - DNA, 14 bp, Homo sapiens
catttttaaattct

SEQ ID NO: 3033241 - DNA, 15 bp, Homo sapiens
catttttaaattctt

SEQ ID NO: 3033242 - DNA, 22 bp, Homo sapiens
catttttaaattcttactctgg

SEQ ID NO: 3033243 - DNA, 13 bp, Homo sapiens
catttttatccct

SEQ ID NO: 3033244 - DNA, 12 bp, Homo sapiens
catttttatcta

SEQ ID NO: 3033245 - DNA, 21 bp, Homo sapiens
catttttcaactttgaataaa

SEQ ID NO: 3033246 - DNA, 17 bp, Homo sapiens
catttttcctctctgca

SEQ ID NO: 3033247 - DNA, 22 bp, Homo sapiens
catttttgtgagcctctttgta

SEQ ID NO: 3033248 - DNA, 23 bp, Homo sapiens
catttttgtgagcctctttgtaa

SEQ ID NO: 3033249 - DNA, 21 bp, Homo sapiens
catttttgtgggggctagaaa

SEQ ID NO: 3033250 - DNA, 17 bp, Homo sapiens
cattttttaaggaaaca

SEQ ID NO: 3033251 - DNA, 14 bp, Homo sapiens
cattttttgctata

SEQ ID NO: 3033252 - DNA, 23 bp, Homo sapiens
catttttttctctctggagcccc

SEQ ID NO: 3033253 - DNA, 14 bp, Homo sapiens
ccaaaaaaaggaaa

SEQ ID NO: 3033254 - DNA, 16 bp, Homo sapiens
ccaaaaagacaagtgc

SEQ ID NO: 3033255 - DNA, 21 bp, Homo sapiens
ccaaaacattttaaatgaaag

SEQ ID NO: 3033256 - DNA, 13 bp, Homo sapiens
ccaaaaggccgtg

SEQ ID NO: 3033257 - DNA, 11 bp, Homo sapiens
ccaaaagggaa

SEQ ID NO: 3033258 - DNA, 21 bp, Homo sapiens
ccaaaagtcaaaaggtgcctg

SEQ ID NO: 3033259 - DNA, 17 bp, Homo sapiens
ccaaaagtggctagtcc

SEQ ID NO: 3033260 - DNA, 20 bp, Homo sapiens
ccaaaagttacatgtttgca

SEQ ID NO: 3033261 - DNA, 22 bp, Homo sapiens
ccaaaatgctctagtgccttct

SEQ ID NO: 3033262 - DNA, 22 bp, Homo sapiens
ccaaacagcaaaccaagagatt

SEQ ID NO: 3033263 - DNA, 20 bp, Homo sapiens
ccaaacaggtgctggcccag

SEQ ID NO: 3033264 - DNA, 17 bp, Homo sapiens
ccaaacatatgcacatt

SEQ ID NO: 3033265 - DNA, 13 bp, Homo sapiens
ccaaacatctggc

SEQ ID NO: 3033266 - DNA, 20 bp, Homo sapiens
ccaaacccctagagacagtg

SEQ ID NO: 3033267 - DNA, 18 bp, Homo sapiens
ccaaacccttagcagccc

SEQ ID NO: 3033268 - DNA, 20 bp, Homo sapiens
ccaaacccttagcagcccag

SEQ ID NO: 3033269 - DNA, 16 bp, Homo sapiens
ccaaaccggcaggtgc

SEQ ID NO: 3033270 - DNA, 11 bp, Homo sapiens
ccaaacctctg

SEQ ID NO: 3033271 - DNA, 12 bp, Homo sapiens
ccaaacctctgt

SEQ ID NO: 3033272 - DNA, 13 bp, Homo sapiens
ccaaacctctgtt

SEQ ID NO: 3033273 - DNA, 22 bp, Homo sapiens
ccaaacgccctttcctcctcag

SEQ ID NO: 3033274 - DNA, 13 bp, Homo sapiens
ccaaactgctgtc

SEQ ID NO: 3033275 - DNA, 14 bp, Homo sapiens
ccaaactgctgtct

SEQ ID NO: 3033276 - DNA, 16 bp, Homo sapiens
ccaaagagcctttcca

SEQ ID NO: 3033277 - DNA, 17 bp, Homo sapiens
ccaaagagcctttccaa

SEQ ID NO: 3033278 - DNA, 15 bp, Homo sapiens
ccaaagagtctctgg

SEQ ID NO: 3033279 - DNA, 22 bp, Homo sapiens
ccacgtctctctgcctgctggg

SEQ ID NO: 3033280 - DNA, 13 bp, Homo sapiens
ccacgtcttcctc

SEQ ID NO: 3033281 - DNA, 14 bp, Homo sapiens
ccacgtgccaggcc

SEQ ID NO: 3033282 - DNA, 16 bp, Homo sapiens
ccacgtgccaggcccg

SEQ ID NO: 3033283 - DNA, 16 bp, Homo sapiens
ccacgtgccttaggaa

SEQ ID NO: 3033284 - DNA, 17 bp, Homo sapiens
ccacgtgccttaggaat

SEQ ID NO: 3033285 - DNA, 15 bp, Homo sapiens
ccacgtggagacagc

SEQ ID NO: 3033286 - DNA, 17 bp, Homo sapiens
ccacgttcagggagggg

SEQ ID NO: 3033287 - DNA, 21 bp, Homo sapiens
ccacgttccttactgcagaat

SEQ ID NO: 3033288 - DNA, 14 bp, Homo sapiens
ccactaagcagagg

SEQ ID NO: 3033289 - DNA, 16 bp, Homo sapiens
ccactaagcagaggag

SEQ ID NO: 3033290 - DNA, 18 bp, Homo sapiens
ccactaagcagaggaggg

SEQ ID NO: 3033291 - DNA, 19 bp, Homo sapiens
ccactaagcagaggagggg

SEQ ID NO: 3033292 - DNA, 16 bp, Homo sapiens
ccactatgcaaagaac

SEQ ID NO: 3033293 - DNA, 17 bp, Homo sapiens
ccactcaacagagagga

SEQ ID NO: 3033294 - DNA, 19 bp, Homo sapiens
ccactcacccttcctggcc

SEQ ID NO: 3033295 - DNA, 23 bp, Homo sapiens
ccactcactgaagcccagacctc

SEQ ID NO: 3033296 - DNA, 11 bp, Homo sapiens
ccactcagctc

SEQ ID NO: 3033297 - DNA, 20 bp, Homo sapiens
ccactcaggtgcacacatca

SEQ ID NO: 3033298 - DNA, 16 bp, Homo sapiens
ccactccaagccccct

SEQ ID NO: 3033299 - DNA, 22 bp, Homo sapiens
ccactccaagccccctggcagc

SEQ ID NO: 3033300 - DNA, 22 bp, Homo sapiens
ccactcccctccactctctacc

SEQ ID NO: 3033301 - DNA, 12 bp, Homo sapiens
ccactcctccaa

SEQ ID NO: 3033302 - DNA, 13 bp, Homo sapiens
ccactcctccctc

SEQ ID NO: 3033303 - DNA, 14 bp, Homo sapiens
ccactcctccctcc

SEQ ID NO: 3033304 - DNA, 12 bp, Homo sapiens
ccactcctctga

SEQ ID NO: 3033305 - DNA, 20 bp, Homo sapiens
ccactcctctgactcagggc

SEQ ID NO: 3033306 - DNA, 13 bp, Homo sapiens
ccactcctgccag

SEQ ID NO: 3033307 - DNA, 18 bp, Homo sapiens
ccactctcattccccagg

SEQ ID NO: 3033308 - DNA, 15 bp, Homo sapiens
ccactctgatagaat

SEQ ID NO: 3033309 - DNA, 14 bp, Homo sapiens
ccactctgcctgcc

SEQ ID NO: 3033310 - DNA, 15 bp, Homo sapiens
ccactctgctgcctg

SEQ ID NO: 3033311 - DNA, 22 bp, Homo sapiens
ccactcttctctccaaggaaat

SEQ ID NO: 3033312 - DNA, 21 bp, Homo sapiens
ccactgaagtagtgtgcagtt

SEQ ID NO: 3033313 - DNA, 22 bp, Homo sapiens
ccactgatagatgtctattctt

SEQ ID NO: 3033314 - DNA, 23 bp, Homo sapiens
ccactgatattcagaattatgat

SEQ ID NO: 3033315 - DNA, 23 bp, Homo sapiens
ccactgcaagtccttttgtaaag

SEQ ID NO: 3033316 - DNA, 16 bp, Homo sapiens
ccactgcacacagggt

SEQ ID NO: 3033317 - DNA, 13 bp, Homo sapiens
ccactgcactcca

SEQ ID NO: 3033318 - DNA, 14 bp, Homo sapiens
ccactgcactccag

SEQ ID NO: 3033319 - DNA, 19 bp, Homo sapiens
ccactgcactccagcctga

SEQ ID NO: 3033320 - DNA, 23 bp, Homo sapiens
ccactgcactccagcctgagtga

SEQ ID NO: 3033321 - DNA, 14 bp, Homo sapiens
ccactgcaggcccc

SEQ ID NO: 3033322 - DNA, 19 bp, Homo sapiens
ccactgcataccaacctgg

SEQ ID NO: 3033323 - DNA, 21 bp, Homo sapiens
ccactgccattacccagtgcc

SEQ ID NO: 3033324 - DNA, 21 bp, Homo sapiens
ccactgcctcctccctggctg

SEQ ID NO: 3033325 - DNA, 22 bp, Homo sapiens
ccactgcctcctccctggctgc

SEQ ID NO: 3033326 - DNA, 23 bp, Homo sapiens
ccactgctcgaaatggcccctgt

SEQ ID NO: 3033327 - DNA, 11 bp, Homo sapiens
ccactgctctt

SEQ ID NO: 3033328 - DNA, 14 bp, Homo sapiens
ccactgctggctgc

SEQ ID NO: 3033329 - DNA, 15 bp, Homo sapiens
ccactgctggctgca

SEQ ID NO: 3033330 - DNA, 14 bp, Homo sapiens
ccactggaaggagc

SEQ ID NO: 3033331 - DNA, 11 bp, Homo sapiens
ccactggacca

SEQ ID NO: 3033332 - DNA, 13 bp, Homo sapiens
ccactggactgac

SEQ ID NO: 3033333 - DNA, 11 bp, Homo sapiens
ccactgggcac

SEQ ID NO: 3033334 - DNA, 14 bp, Homo sapiens
ccactgggcacctg

SEQ ID NO: 3033335 - DNA, 11 bp, Homo sapiens
ccactggggaa

SEQ ID NO: 3033336 - DNA, 19 bp, Homo sapiens
ccactggggtccagggagc

SEQ ID NO: 3033337 - DNA, 20 bp, Homo sapiens
ccactgtcctgggcctgcag

SEQ ID NO: 3033338 - DNA, 23 bp, Homo sapiens
ccactgtggaagtccctcagagg

SEQ ID NO: 3033339 - DNA, 12 bp, Homo sapiens
ccacttacctag

SEQ ID NO: 3033340 - DNA, 16 bp, Homo sapiens
ccacttatcagtgtat

SEQ ID NO: 3033341 - DNA, 15 bp, Homo sapiens
ccacttcccaccctg

SEQ ID NO: 3033342 - DNA, 18 bp, Homo sapiens
ccacttctcatcacacac

SEQ ID NO: 3033343 - DNA, 20 bp, Homo sapiens
ccacttctcatcacacacat

SEQ ID NO: 3033344 - DNA, 15 bp, Homo sapiens
ccacttctcatctta

SEQ ID NO: 3033345 - DNA, 19 bp, Homo sapiens
ccacttctctgggtcccgg

SEQ ID NO: 3033346 - DNA, 23 bp, Homo sapiens
ccacttctggtcccctgtggtga

SEQ ID NO: 3033347 - DNA, 13 bp, Homo sapiens
ccacttctgtcca

SEQ ID NO: 3033348 - DNA, 17 bp, Homo sapiens
ccacttctgtccatatt

SEQ ID NO: 3033349 - DNA, 14 bp, Homo sapiens
ccacttctgtgcca

SEQ ID NO: 3033350 - DNA, 16 bp, Homo sapiens
ccacttcttttataac

SEQ ID NO: 3033351 - DNA, 14 bp, Homo sapiens
ccacttgccagggc

SEQ ID NO: 3033352 - DNA, 15 bp, Homo sapiens
ccacttgccagggct

SEQ ID NO: 3033353 - DNA, 20 bp, Homo sapiens
ccacttgccagggctctggg

SEQ ID NO: 3033354 - DNA, 16 bp, Homo sapiens
ccacttggaaatggca

SEQ ID NO: 3033355 - DNA, 20 bp, Homo sapiens
ccacttgtcccactatctgg

SEQ ID NO: 3033356 - DNA, 14 bp, Homo sapiens
ccacttgtgggtcc

SEQ ID NO: 3033357 - DNA, 18 bp, Homo sapiens
ccactttattgcaatgca

SEQ ID NO: 3033358 - DNA, 20 bp, Homo sapiens
ccactttgttggcccttcca

SEQ ID NO: 3033359 - DNA, 13 bp, Homo sapiens
ccacttttcattg

SEQ ID NO: 3033360 - DNA, 20 bp, Homo sapiens
ccactttttggtaatatata

SEQ ID NO: 3033361 - DNA, 21 bp, Homo sapiens
ccactttttggtaatatatat

SEQ ID NO: 3033362 - DNA, 13 bp, Homo sapiens
ccagaaaacaaaa

SEQ ID NO: 3033363 - DNA, 15 bp, Homo sapiens
ccagaaacagggaca

SEQ ID NO: 3033364 - DNA, 15 bp, Homo sapiens
ccagaaacctgggag

SEQ ID NO: 3033365 - DNA, 17 bp, Homo sapiens
ccagaaacctgggagag

SEQ ID NO: 3033366 - DNA, 13 bp, Homo sapiens
ccagaacccattt

SEQ ID NO: 3033367 - DNA, 19 bp, Homo sapiens
ccagaacgtggctctgctg

SEQ ID NO: 3033368 - DNA, 11 bp, Homo sapiens
ccagaagcctc

SEQ ID NO: 3033369 - DNA, 21 bp, Homo sapiens
ccagaagcctccttacattaa

SEQ ID NO: 3033370 - DNA, 16 bp, Homo sapiens
ccagaagcttccatag

SEQ ID NO: 3033371 - DNA, 13 bp, Homo sapiens
ccagaagttgtgg

SEQ ID NO: 3033372 - DNA, 20 bp, Homo sapiens
ccagaagtttgtcaagtcaa

SEQ ID NO: 3033373 - DNA, 16 bp, Homo sapiens
ccagaatgctgtacat

SEQ ID NO: 3033374 - DNA, 16 bp, Homo sapiens
ccagaatgtgctgcct

SEQ ID NO: 3033375 - DNA, 17 bp, Homo sapiens
ccagaattacccttcct

SEQ ID NO: 3033376 - DNA, 16 bp, Homo sapiens
ccagacaaggagagcg

SEQ ID NO: 3033377 - DNA, 18 bp, Homo sapiens
ccagacaaggagagcgga

SEQ ID NO: 3033378 - DNA, 14 bp, Homo sapiens
ccagacacaggccc

SEQ ID NO: 3033379 - DNA, 10 bp, Homo sapiens
ccagacaccc

SEQ ID NO: 3033380 - DNA, 13 bp, Homo sapiens
ccagacacccagg

SEQ ID NO: 3033381 - DNA, 14 bp, Homo sapiens
ccagacacccagga

SEQ ID NO: 3033382 - DNA, 17 bp, Homo sapiens
ccagacagagggtcaca

SEQ ID NO: 3033383 - DNA, 13 bp, Homo sapiens
ccagacagctgct

SEQ ID NO: 3033384 - DNA, 21 bp, Homo sapiens
ccagacagtcgctcagtctgt

SEQ ID NO: 3033385 - DNA, 19 bp, Homo sapiens
ccagacccactctgcggcc

SEQ ID NO: 3033386 - DNA, 20 bp, Homo sapiens
ccagacctgatcctggaggc

SEQ ID NO: 3033387 - DNA, 23 bp, Homo sapiens
ccagacctgatcctggaggccca

SEQ ID NO: 3033388 - DNA, 24 bp, Homo sapiens
ccagacctgatcctggaggcccag

SEQ ID NO: 3033389 - DNA, 15 bp, Homo sapiens
ccagacctgtcgtct

SEQ ID NO: 3033390 - DNA, 20 bp, Homo sapiens
ccagacggctccactaggac

SEQ ID NO: 3033391 - DNA, 20 bp, Homo sapiens
ccagactagacaccttctgt

SEQ ID NO: 3033392 - DNA, 12 bp, Homo sapiens
ccagactattcc

SEQ ID NO: 3033393 - DNA, 18 bp, Homo sapiens
ccagactgagctctccag

SEQ ID NO: 3033394 - DNA, 19 bp, Homo sapiens
ccagactgagctctccagg

SEQ ID NO: 3033395 - DNA, 12 bp, Homo sapiens
ccagactgggcc

SEQ ID NO: 3033396 - DNA, 17 bp, Homo sapiens
ccagactgggcccaggc

SEQ ID NO: 3033397 - DNA, 18 bp, Homo sapiens
ccagactgggcccaggca

SEQ ID NO: 3033398 - DNA, 20 bp, Homo sapiens
ccagactgggcccaggcagg

SEQ ID NO: 3033399 - DNA, 23 bp, Homo sapiens
ccagacttcccacggctcctcga

SEQ ID NO: 3033400 - DNA, 15 bp, Homo sapiens
ccagacttgcactgg

SEQ ID NO: 3033401 - DNA, 16 bp, Homo sapiens
ccagacttgcactggg

SEQ ID NO: 3033402 - DNA, 21 bp, Homo sapiens
ccagagaaagttggtgctgct

SEQ ID NO: 3033403 - DNA, 12 bp, Homo sapiens
ccagagaagcta

SEQ ID NO: 3033404 - DNA, 19 bp, Homo sapiens
ccagagaaggggtgtgcat

SEQ ID NO: 3033405 - DNA, 14 bp, Homo sapiens
ccagagaagtgaca

SEQ ID NO: 3033406 - DNA, 16 bp, Homo sapiens
ccagagaagtgacagg

SEQ ID NO: 3033407 - DNA, 18 bp, Homo sapiens
ccagagaagtgacaggga

SEQ ID NO: 3033408 - DNA, 22 bp, Homo sapiens
ccagagaagtgacagggaagct

SEQ ID NO: 3033409 - DNA, 18 bp, Homo sapiens
ccagagacatacttgaag

SEQ ID NO: 3033410 - DNA, 20 bp, Homo sapiens
ccagagacatacttgaaggg

SEQ ID NO: 3033411 - DNA, 16 bp, Homo sapiens
ccagagaggaatcaga

SEQ ID NO: 3033412 - DNA, 20 bp, Homo sapiens
ccaggtggctgacccagtcc

SEQ ID NO: 3033413 - DNA, 21 bp, Homo sapiens
ccaggtggctgacccagtccc

SEQ ID NO: 3033414 - DNA, 22 bp, Homo sapiens
ccaggttcaagcgattctcctg

SEQ ID NO: 3033415 - DNA, 14 bp, Homo sapiens
ccaggttggaaaag

SEQ ID NO: 3033416 - DNA, 16 bp, Homo sapiens
ccaggtttttgcccat

SEQ ID NO: 3033417 - DNA, 18 bp, Homo sapiens
ccagtagccaaggcccgg

SEQ ID NO: 3033418 - DNA, 17 bp, Homo sapiens
ccagtagtgtttggaat

SEQ ID NO: 3033419 - DNA, 22 bp, Homo sapiens
ccagtcatcatctcttgataaa

SEQ ID NO: 3033420 - DNA, 19 bp, Homo sapiens
ccagtccccagaagcagag

SEQ ID NO: 3033421 - DNA, 15 bp, Homo sapiens
ccagtccccccaccc

SEQ ID NO: 3033422 - DNA, 17 bp, Homo sapiens
ccagtccccccaccctc

SEQ ID NO: 3033423 - DNA, 15 bp, Homo sapiens
ccagtccctgggagc

SEQ ID NO: 3033424 - DNA, 15 bp, Homo sapiens
ccagtccctggggga

SEQ ID NO: 3033425 - DNA, 19 bp, Homo sapiens
ccagtccctgggggaagcc

SEQ ID NO: 3033426 - DNA, 18 bp, Homo sapiens
ccagtccctgtccggaat

SEQ ID NO: 3033427 - DNA, 13 bp, Homo sapiens
ccagtcctctgcc

SEQ ID NO: 3033428 - DNA, 15 bp, Homo sapiens
ccagtcctctgcctc

SEQ ID NO: 3033429 - DNA, 16 bp, Homo sapiens
ccagtcctctgcctcc

SEQ ID NO: 3033430 - DNA, 23 bp, Homo sapiens
ccagtcctggtcctggctgcact

SEQ ID NO: 3033431 - DNA, 23 bp, Homo sapiens
ccagtccttaatgtcaccatgct

SEQ ID NO: 3033432 - DNA, 13 bp, Homo sapiens
ccagtccttccac

SEQ ID NO: 3033433 - DNA, 17 bp, Homo sapiens
ccagtctgggtctgggt

SEQ ID NO: 3033434 - DNA, 22 bp, Homo sapiens
ccagtcttcctcttagcctctg

SEQ ID NO: 3033435 - DNA, 17 bp, Homo sapiens
ccagtgaatttttgcaa

SEQ ID NO: 3033436 - DNA, 19 bp, Homo sapiens
ccagtgaatttttgcaata

SEQ ID NO: 3033437 - DNA, 13 bp, Homo sapiens
ccagtgagtggcc

SEQ ID NO: 3033438 - DNA, 16 bp, Homo sapiens
ccagtgcagaatgtaa

SEQ ID NO: 3033439 - DNA, 16 bp, Homo sapiens
ccagtgcagagatcct

SEQ ID NO: 3033440 - DNA, 20 bp, Homo sapiens
ccagtgcaggctggccagcc

SEQ ID NO: 3033441 - DNA, 20 bp, Homo sapiens
ccagtgcagtttctaagcat

SEQ ID NO: 3033442 - DNA, 15 bp, Homo sapiens
ccagtgcatggtggc

SEQ ID NO: 3033443 - DNA, 18 bp, Homo sapiens
ccagtgccgaggacatgc

SEQ ID NO: 3033444 - DNA, 18 bp, Homo sapiens
ccagtgccttacctcctg

SEQ ID NO: 3033445 - DNA, 19 bp, Homo sapiens
ccagtgccttacctcctgc

SEQ ID NO: 3033446 - DNA, 22 bp, Homo sapiens
ccagtgccttacctcctgccca

SEQ ID NO: 3033447 - DNA, 14 bp, Homo sapiens
ccagtgctgcccat

SEQ ID NO: 3033448 - DNA, 17 bp, Homo sapiens
ccagtgctgcccatgag

SEQ ID NO: 3033449 - DNA, 10 bp, Homo sapiens
ccagtgggct

SEQ ID NO: 3033450 - DNA, 13 bp, Homo sapiens
ccagtgggctgca

SEQ ID NO: 3033451 - DNA, 17 bp, Homo sapiens
ccagtgggctgcacgct

SEQ ID NO: 3033452 - DNA, 12 bp, Homo sapiens
ccagtgggctgt

SEQ ID NO: 3033453 - DNA, 16 bp, Homo sapiens
ccagtgggctgtgttg

SEQ ID NO: 3033454 - DNA, 17 bp, Homo sapiens
ccagtggtctcacatgg

SEQ ID NO: 3033455 - DNA, 17 bp, Homo sapiens
ccagtgtattttgtcca

SEQ ID NO: 3033456 - DNA, 13 bp, Homo sapiens
ccagtgtccatgt

SEQ ID NO: 3033457 - DNA, 14 bp, Homo sapiens
ccagtgtccatgtt

SEQ ID NO: 3033458 - DNA, 15 bp, Homo sapiens
ccagtgtccatgttg

SEQ ID NO: 3033459 - DNA, 19 bp, Homo sapiens
ccagtgtgttactcatctt

SEQ ID NO: 3033460 - DNA, 22 bp, Homo sapiens
ccagtgttacaatcagtgtgaa

SEQ ID NO: 3033461 - DNA, 13 bp, Homo sapiens
ccagtgtttctga

SEQ ID NO: 3033462 - DNA, 14 bp, Homo sapiens
ccagtgtttctgaa

SEQ ID NO: 3033463 - DNA, 18 bp, Homo sapiens
ccagtgtttctgaatgtt

SEQ ID NO: 3033464 - DNA, 21 bp, Homo sapiens
ccagtgtttctgaatgtttgt

SEQ ID NO: 3033465 - DNA, 19 bp, Homo sapiens
ccagttaaaatgtgtttct

SEQ ID NO: 3033466 - DNA, 15 bp, Homo sapiens
ccagttaaggaaaga

SEQ ID NO: 3033467 - DNA, 19 bp, Homo sapiens
ccagttcgcctggagccct

SEQ ID NO: 3033468 - DNA, 14 bp, Homo sapiens
ccagtttgcagaaa

SEQ ID NO: 3033469 - DNA, 13 bp, Homo sapiens
ccataaagaagca

SEQ ID NO: 3033470 - DNA, 13 bp, Homo sapiens
ccataagaggagt

SEQ ID NO: 3033471 - DNA, 20 bp, Homo sapiens
ccataaggtttcgtttctgt

SEQ ID NO: 3033472 - DNA, 19 bp, Homo sapiens
ccatacaccccctcttctg

SEQ ID NO: 3033473 - DNA, 22 bp, Homo sapiens
ccatagatttgaagatctgatt

SEQ ID NO: 3033474 - DNA, 14 bp, Homo sapiens
ccatagcaccctgc

SEQ ID NO: 3033475 - DNA, 18 bp, Homo sapiens
ccatagctcttcacttcc

SEQ ID NO: 3033476 - DNA, 19 bp, Homo sapiens
ccatagctcttcacttcct

SEQ ID NO: 3033477 - DNA, 17 bp, Homo sapiens
ccataggcccacacaca

SEQ ID NO: 3033478 - DNA, 20 bp, Homo sapiens
ccataggcccacacacaggt

SEQ ID NO: 3033479 - DNA, 23 bp, Homo sapiens
ccataggcccacacacaggtggt

SEQ ID NO: 3033480 - DNA, 15 bp, Homo sapiens
ccataggtagaatgt

SEQ ID NO: 3033481 - DNA, 14 bp, Homo sapiens
ccatagtagtatga

SEQ ID NO: 3033482 - DNA, 21 bp, Homo sapiens
ccatagtggaccacttggaaa

SEQ ID NO: 3033483 - DNA, 18 bp, Homo sapiens
ccatagtttggcatttgc

SEQ ID NO: 3033484 - DNA, 15 bp, Homo sapiens
ccatataagtttgaa

SEQ ID NO: 3033485 - DNA, 19 bp, Homo sapiens
ccatataagtttgaaggaa

SEQ ID NO: 3033486 - DNA, 23 bp, Homo sapiens
ccatataagtttgaaggaaacag

SEQ ID NO: 3033487 - DNA, 21 bp, Homo sapiens
ccatatccctcttgacattca

SEQ ID NO: 3033488 - DNA, 17 bp, Homo sapiens
ccatatccttctggctg

SEQ ID NO: 3033489 - DNA, 18 bp, Homo sapiens
ccatattacgttgtttct

SEQ ID NO: 3033490 - DNA, 17 bp, Homo sapiens
ccatatttgaattggcc

SEQ ID NO: 3033491 - DNA, 19 bp, Homo sapiens
ccatatttgaattggcctg

SEQ ID NO: 3033492 - DNA, 17 bp, Homo sapiens
ccatatttgtgttcagt

SEQ ID NO: 3033493 - DNA, 22 bp, Homo sapiens
ccatatttgtgttcagttccag

SEQ ID NO: 3033494 - DNA, 22 bp, Homo sapiens
ccatattttattgtattttgat

SEQ ID NO: 3033495 - DNA, 19 bp, Homo sapiens
ccatcaaaatgctttttat

SEQ ID NO: 3033496 - DNA, 18 bp, Homo sapiens
ccatcaacaaaaattgtc

SEQ ID NO: 3033497 - DNA, 16 bp, Homo sapiens
ccatcaagcacttccc

SEQ ID NO: 3033498 - DNA, 20 bp, Homo sapiens
ccatcaagcacttcccagga

SEQ ID NO: 3033499 - DNA, 15 bp, Homo sapiens
ccatcactcagcccc

SEQ ID NO: 3033500 - DNA, 15 bp, Homo sapiens
ccatcactcgcagga

SEQ ID NO: 3033501 - DNA, 16 bp, Homo sapiens
ccatcactcgcaggac

SEQ ID NO: 3033502 - DNA, 13 bp, Homo sapiens
ccatcagcctcca

SEQ ID NO: 3033503 - DNA, 22 bp, Homo sapiens
ccatcaggtcccccccaggtgc

SEQ ID NO: 3033504 - DNA, 18 bp, Homo sapiens
ccatcagtgccagcccct

SEQ ID NO: 3033505 - DNA, 20 bp, Homo sapiens
ccatcagtgccagcccctgc

SEQ ID NO: 3033506 - DNA, 16 bp, Homo sapiens
ccatcatcatgtgtgt

SEQ ID NO: 3033507 - DNA, 13 bp, Homo sapiens
ccatcatctcctg

SEQ ID NO: 3033508 - DNA, 13 bp, Homo sapiens
ccatcatctctgc

SEQ ID NO: 3033509 - DNA, 17 bp, Homo sapiens
ccatcatctctgccttt

SEQ ID NO: 3033510 - DNA, 20 bp, Homo sapiens
ccatcatctgctgcacatag

SEQ ID NO: 3033511 - DNA, 23 bp, Homo sapiens
ccatcatgtaccaagtgcttggc

SEQ ID NO: 3033512 - DNA, 17 bp, Homo sapiens
ccatccacatgggagcc

SEQ ID NO: 3033513 - DNA, 23 bp, Homo sapiens
ccatccatctgtccgtccagagc

SEQ ID NO: 3033514 - DNA, 15 bp, Homo sapiens
ccatccattctggaa

SEQ ID NO: 3033515 - DNA, 17 bp, Homo sapiens
ccatcccaagcccagtg

SEQ ID NO: 3033516 - DNA, 20 bp, Homo sapiens
ccatccccctctcacgccac

SEQ ID NO: 3033517 - DNA, 14 bp, Homo sapiens
ccatccccgcagtg

SEQ ID NO: 3033518 - DNA, 21 bp, Homo sapiens
ccatcctaatcatccaatgct

SEQ ID NO: 3033519 - DNA, 23 bp, Homo sapiens
ccatcctaatcatccaatgctca

SEQ ID NO: 3033520 - DNA, 17 bp, Homo sapiens
ccatcctaccccctgtg

SEQ ID NO: 3033521 - DNA, 13 bp, Homo sapiens
ccatcctccagca

SEQ ID NO: 3033522 - DNA, 14 bp, Homo sapiens
ccatcctccagcag

SEQ ID NO: 3033523 - DNA, 13 bp, Homo sapiens
ccatcctccagcc

SEQ ID NO: 3033524 - DNA, 18 bp, Homo sapiens
ccatcctccagccctgcc

SEQ ID NO: 3033525 - DNA, 16 bp, Homo sapiens
ccatcctcctctccat

SEQ ID NO: 3033526 - DNA, 20 bp, Homo sapiens
ccatccttccctgtctgcca

SEQ ID NO: 3033527 - DNA, 15 bp, Homo sapiens
ccatccttccctttg

SEQ ID NO: 3033528 - DNA, 19 bp, Homo sapiens
ccatcgccccaccgcagct

SEQ ID NO: 3033529 - DNA, 18 bp, Homo sapiens
ccatctactcttttgaag

SEQ ID NO: 3033530 - DNA, 21 bp, Homo sapiens
ccatctcaaaaaaaaaaaaga

SEQ ID NO: 3033531 - DNA, 11 bp, Homo sapiens
ccatctcaggt

SEQ ID NO: 3033532 - DNA, 17 bp, Homo sapiens
ccatctcaggttggcgg

SEQ ID NO: 3033533 - DNA, 20 bp, Homo sapiens
ccatctcatgcccctggctg

SEQ ID NO: 3033534 - DNA, 17 bp, Homo sapiens
ccatctcggggctgctg

SEQ ID NO: 3033535 - DNA, 18 bp, Homo sapiens
ccatctcggggctgctgt

SEQ ID NO: 3033536 - DNA, 23 bp, Homo sapiens
ccatctctatataaaaacaaaaa

SEQ ID NO: 3033537 - DNA, 15 bp, Homo sapiens
ccatctctctccctt

SEQ ID NO: 3033538 - DNA, 14 bp, Homo sapiens
ccatctgcccgcct

SEQ ID NO: 3033539 - DNA, 23 bp, Homo sapiens
ccatctgcgtgacaataaaacat

SEQ ID NO: 3033540 - DNA, 14 bp, Homo sapiens
ccatctggcagggt

SEQ ID NO: 3033541 - DNA, 23 bp, Homo sapiens
ccatctggttaggatggcaggac

SEQ ID NO: 3033542 - DNA, 16 bp, Homo sapiens
ccatctgtccatcctc

SEQ ID NO: 3033543 - DNA, 17 bp, Homo sapiens
ccatctgtccatcctcc

SEQ ID NO: 3033544 - DNA, 17 bp, Homo sapiens
cccagactgggcccagg

SEQ ID NO: 3033545 - DNA, 18 bp, Homo sapiens
cccagactgggcccaggc

SEQ ID NO: 3033546 - DNA, 21 bp, Homo sapiens
cccagactgggcccaggcagg

SEQ ID NO: 3033547 - DNA, 20 bp, Homo sapiens
cccagacttgcactggggtg

SEQ ID NO: 3033548 - DNA, 15 bp, Homo sapiens
cccagacttgtttcc

SEQ ID NO: 3033549 - DNA, 22 bp, Homo sapiens
cccagagaaaggggagcccact

SEQ ID NO: 3033550 - DNA, 16 bp, Homo sapiens
cccagagacaggaaaa

SEQ ID NO: 3033551 - DNA, 17 bp, Homo sapiens
cccagagacaggaaaat

SEQ ID NO: 3033552 - DNA, 14 bp, Homo sapiens
cccagagatgcctc

SEQ ID NO: 3033553 - DNA, 18 bp, Homo sapiens
cccagagatgcctccacc

SEQ ID NO: 3033554 - DNA, 21 bp, Homo sapiens
cccagagatgcctccaccgct

SEQ ID NO: 3033555 - DNA, 23 bp, Homo sapiens
cccagagatgcctccaccgctgc

SEQ ID NO: 3033556 - DNA, 14 bp, Homo sapiens
cccagagccacaca

SEQ ID NO: 3033557 - DNA, 19 bp, Homo sapiens
cccagagccacacatgggc

SEQ ID NO: 3033558 - DNA, 14 bp, Homo sapiens
cccagagcccagct

SEQ ID NO: 3033559 - DNA, 15 bp, Homo sapiens
cccagagcccagctc

SEQ ID NO: 3033560 - DNA, 16 bp, Homo sapiens
cccagagcccagctcc

SEQ ID NO: 3033561 - DNA, 16 bp, Homo sapiens
cccagagcccagctct

SEQ ID NO: 3033562 - DNA, 17 bp, Homo sapiens
cccagagcccagctctt

SEQ ID NO: 3033563 - DNA, 19 bp, Homo sapiens
cccagagctggtggaccca

SEQ ID NO: 3033564 - DNA, 23 bp, Homo sapiens
cccagagctggtggacccaggga

SEQ ID NO: 3033565 - DNA, 12 bp, Homo sapiens
cccagaggcaga

SEQ ID NO: 3033566 - DNA, 14 bp, Homo sapiens
cccagaggcgtccc

SEQ ID NO: 3033567 - DNA, 23 bp, Homo sapiens
cccagagtgtgggaagggagagc

SEQ ID NO: 3033568 - DNA, 19 bp, Homo sapiens
cccagatacgggggctgtg

SEQ ID NO: 3033569 - DNA, 23 bp, Homo sapiens
cccagatacgggggctgtgactc

SEQ ID NO: 3033570 - DNA, 21 bp, Homo sapiens
cccagatgtgagggcaccacc

SEQ ID NO: 3033571 - DNA, 22 bp, Homo sapiens
cccagatgtgagggcaccacca

SEQ ID NO: 3033572 - DNA, 12 bp, Homo sapiens
cccagcacagct

SEQ ID NO: 3033573 - DNA, 16 bp, Homo sapiens
cccagcacagctcctc

SEQ ID NO: 3033574 - DNA, 21 bp, Homo sapiens
cccagcacagctcctcccctg

SEQ ID NO: 3033575 - DNA, 19 bp, Homo sapiens
cccagcaccaccaggtctc

SEQ ID NO: 3033576 - DNA, 21 bp, Homo sapiens
cccagcaccccctctcctgga

SEQ ID NO: 3033577 - DNA, 18 bp, Homo sapiens
cccagcacctcagcctgc

SEQ ID NO: 3033578 - DNA, 22 bp, Homo sapiens
cccagcacctcagcctgcacag

SEQ ID NO: 3033579 - DNA, 21 bp, Homo sapiens
cccagcactgcttgaggaaaa

SEQ ID NO: 3033580 - DNA, 20 bp, Homo sapiens
cccagcactttgggaggcag

SEQ ID NO: 3033581 - DNA, 19 bp, Homo sapiens
cccagcactttgggaggcc

SEQ ID NO: 3033582 - DNA, 13 bp, Homo sapiens
cccagcagcctgc

SEQ ID NO: 3033583 - DNA, 17 bp, Homo sapiens
cccagcattctcaggca

SEQ ID NO: 3033584 - DNA, 18 bp, Homo sapiens
cccagcatttcccgaagg

SEQ ID NO: 3033585 - DNA, 18 bp, Homo sapiens
cccagccaacgagattgc

SEQ ID NO: 3033586 - DNA, 15 bp, Homo sapiens
cccagccactccaag

SEQ ID NO: 3033587 - DNA, 18 bp, Homo sapiens
cccagccactccaagccc

SEQ ID NO: 3033588 - DNA, 13 bp, Homo sapiens
cccagcccacaga

SEQ ID NO: 3033589 - DNA, 16 bp, Homo sapiens
cccagcccacagagcc

SEQ ID NO: 3033590 - DNA, 12 bp, Homo sapiens
cccagcccagag

SEQ ID NO: 3033591 - DNA, 16 bp, Homo sapiens
cccagcccagagacat

SEQ ID NO: 3033592 - DNA, 21 bp, Homo sapiens
cccagcccattctctctcctg

SEQ ID NO: 3033593 - DNA, 19 bp, Homo sapiens
cccagcccgcggcctggac

SEQ ID NO: 3033594 - DNA, 15 bp, Homo sapiens
cccagccctcatccc

SEQ ID NO: 3033595 - DNA, 14 bp, Homo sapiens
cccagccgggcaca

SEQ ID NO: 3033596 - DNA, 18 bp, Homo sapiens
cccagcgagccacaggaa

SEQ ID NO: 3033597 - DNA, 20 bp, Homo sapiens
cccagcgagccacaggaacg

SEQ ID NO: 3033598 - DNA, 23 bp, Homo sapiens
cccagcgagccacaggaacggcc

SEQ ID NO: 3033599 - DNA, 14 bp, Homo sapiens
cccagcgctctcct

SEQ ID NO: 3033600 - DNA, 19 bp, Homo sapiens
cccagcgctctcctggacg

SEQ ID NO: 3033601 - DNA, 16 bp, Homo sapiens
cccagcggcctcaggg

SEQ ID NO: 3033602 - DNA, 15 bp, Homo sapiens
cccagctaaataatc

SEQ ID NO: 3033603 - DNA, 16 bp, Homo sapiens
cccagctaagaacctg

SEQ ID NO: 3033604 - DNA, 18 bp, Homo sapiens
cccagctaagaacctgga

SEQ ID NO: 3033605 - DNA, 18 bp, Homo sapiens
cccagctaccaagtcaga

SEQ ID NO: 3033606 - DNA, 21 bp, Homo sapiens
cccagctactcaggaggctga

SEQ ID NO: 3033607 - DNA, 17 bp, Homo sapiens
cccagctacttgggagc

SEQ ID NO: 3033608 - DNA, 13 bp, Homo sapiens
cccagctaggaag

SEQ ID NO: 3033609 - DNA, 18 bp, Homo sapiens
cccagctaggaagagcag

SEQ ID NO: 3033610 - DNA, 22 bp, Homo sapiens
cccagctaggaagagcaggact

SEQ ID NO: 3033611 - DNA, 12 bp, Homo sapiens
cccagctcagca

SEQ ID NO: 3033612 - DNA, 14 bp, Homo sapiens
cccagctccaggcc

SEQ ID NO: 3033613 - DNA, 18 bp, Homo sapiens
cccagctctaagcagcca

SEQ ID NO: 3033614 - DNA, 19 bp, Homo sapiens
cccagctctaagcagccag

SEQ ID NO: 3033615 - DNA, 12 bp, Homo sapiens
cccagctctccc

SEQ ID NO: 3033616 - DNA, 15 bp, Homo sapiens
cccagctctcccaca

SEQ ID NO: 3033617 - DNA, 15 bp, Homo sapiens
cccagctctccctct

SEQ ID NO: 3033618 - DNA, 19 bp, Homo sapiens
cccagctctccctctggcc

SEQ ID NO: 3033619 - DNA, 14 bp, Homo sapiens
cccagctctgaaac

SEQ ID NO: 3033620 - DNA, 22 bp, Homo sapiens
cccagctctgaggactgcacca

SEQ ID NO: 3033621 - DNA, 21 bp, Homo sapiens
cccagctcttgctctcttgtg

SEQ ID NO: 3033622 - DNA, 20 bp, Homo sapiens
cccagctggcccgtgacaga

SEQ ID NO: 3033623 - DNA, 17 bp, Homo sapiens
cccagctgggtcaggca

SEQ ID NO: 3033624 - DNA, 19 bp, Homo sapiens
cccagctgggtcaggcagg

SEQ ID NO: 3033625 - DNA, 19 bp, Homo sapiens
cccagctggtgggaagcgt

SEQ ID NO: 3033626 - DNA, 22 bp, Homo sapiens
cccagctggtgggaagcgtctg

SEQ ID NO: 3033627 - DNA, 17 bp, Homo sapiens
cccaggaagcccactgc

SEQ ID NO: 3033628 - DNA, 18 bp, Homo sapiens
cccaggaagcccactgcc

SEQ ID NO: 3033629 - DNA, 22 bp, Homo sapiens
cccaggaaggcctaggctagga

SEQ ID NO: 3033630 - DNA, 15 bp, Homo sapiens
cccaggaagggaggg

SEQ ID NO: 3033631 - DNA, 18 bp, Homo sapiens
cccaggaagggagggagc

SEQ ID NO: 3033632 - DNA, 20 bp, Homo sapiens
cccaggaagggagggagctg

SEQ ID NO: 3033633 - DNA, 21 bp, Homo sapiens
cccaggaagggagggagctga

SEQ ID NO: 3033634 - DNA, 22 bp, Homo sapiens
cccaggaccagctcaggacaga

SEQ ID NO: 3033635 - DNA, 12 bp, Homo sapiens
cccaggaccctg

SEQ ID NO: 3033636 - DNA, 21 bp, Homo sapiens
cccaggacctcggatgaccat

SEQ ID NO: 3033637 - DNA, 23 bp, Homo sapiens
cccaggactctgaccccagcatt

SEQ ID NO: 3033638 - DNA, 19 bp, Homo sapiens
cccaggagctctgcgccag

SEQ ID NO: 3033639 - DNA, 22 bp, Homo sapiens
cccaggagctctgcgccaggca

SEQ ID NO: 3033640 - DNA, 22 bp, Homo sapiens
cccaggaggggaacactgccct

SEQ ID NO: 3033641 - DNA, 18 bp, Homo sapiens
cccaggagtttgaggctg

SEQ ID NO: 3033642 - DNA, 23 bp, Homo sapiens
cccaggatcagattgcatgtgac

SEQ ID NO: 3033643 - DNA, 17 bp, Homo sapiens
cccaggatctgctccaa

SEQ ID NO: 3033644 - DNA, 22 bp, Homo sapiens
cccaggatttgactcgggcctt

SEQ ID NO: 3033645 - DNA, 11 bp, Homo sapiens
cccaggcaggg

SEQ ID NO: 3033646 - DNA, 23 bp, Homo sapiens
cccaggcagggccaacccttctc

SEQ ID NO: 3033647 - DNA, 14 bp, Homo sapiens
cccaggcaggtctg

SEQ ID NO: 3033648 - DNA, 13 bp, Homo sapiens
cccaggccagggc

SEQ ID NO: 3033649 - DNA, 18 bp, Homo sapiens
cccaggccagggctgggt

SEQ ID NO: 3033650 - DNA, 17 bp, Homo sapiens
cccaggccatgtggcct

SEQ ID NO: 3033651 - DNA, 21 bp, Homo sapiens
cccaggccatgtggcctgccc

SEQ ID NO: 3033652 - DNA, 23 bp, Homo sapiens
cccaggccatgtggcctgcccag

SEQ ID NO: 3033653 - DNA, 15 bp, Homo sapiens
cccaggcccactcag

SEQ ID NO: 3033654 - DNA, 17 bp, Homo sapiens
cccaggccccaggaagc

SEQ ID NO: 3033655 - DNA, 22 bp, Homo sapiens
cccaggcccgcgggcacagcca

SEQ ID NO: 3033656 - DNA, 14 bp, Homo sapiens
cccaggccctccca

SEQ ID NO: 3033657 - DNA, 16 bp, Homo sapiens
cccaggccggagccca

SEQ ID NO: 3033658 - DNA, 20 bp, Homo sapiens
cccaggccggagcccagata

SEQ ID NO: 3033659 - DNA, 17 bp, Homo sapiens
cccaggcctccagctca

SEQ ID NO: 3033660 - DNA, 13 bp, Homo sapiens
cccaggcctgccc

SEQ ID NO: 3033661 - DNA, 17 bp, Homo sapiens
cccaggcctgccctgct

SEQ ID NO: 3033662 - DNA, 22 bp, Homo sapiens
cccaggcctggctccccgaggg

SEQ ID NO: 3033663 - DNA, 18 bp, Homo sapiens
cccaggccttgctgactc

SEQ ID NO: 3033664 - DNA, 19 bp, Homo sapiens
cccaggccttgctgactct

SEQ ID NO: 3033665 - DNA, 19 bp, Homo sapiens
cccaggctagagtgcaatg

SEQ ID NO: 3033666 - DNA, 19 bp, Homo sapiens
cccaggctggagtgcagtg

SEQ ID NO: 3033667 - DNA, 13 bp, Homo sapiens
cccaggctgggaa

SEQ ID NO: 3033668 - DNA, 18 bp, Homo sapiens
cccagggacacctgggag

SEQ ID NO: 3033669 - DNA, 14 bp, Homo sapiens
cccagggagaggct

SEQ ID NO: 3033670 - DNA, 18 bp, Homo sapiens
cccagggagaggctgtgt

SEQ ID NO: 3033671 - DNA, 21 bp, Homo sapiens
cccagggagcggaaagcagct

SEQ ID NO: 3033672 - DNA, 22 bp, Homo sapiens
cccagggagcggaaagcagctc

SEQ ID NO: 3033673 - DNA, 17 bp, Homo sapiens
cccagggcccagagccc

SEQ ID NO: 3033674 - DNA, 19 bp, Homo sapiens
cccagggcctgagcctggc

SEQ ID NO: 3033675 - DNA, 15 bp, Homo sapiens
cccgctgtggccgca

SEQ ID NO: 3033676 - DNA, 15 bp, Homo sapiens
cccgctgtgtcctcc

SEQ ID NO: 3033677 - DNA, 19 bp, Homo sapiens
cccgctgtgtcctccctcc

SEQ ID NO: 3033678 - DNA, 21 bp, Homo sapiens
cccgcttagcgctctggacag

SEQ ID NO: 3033679 - DNA, 15 bp, Homo sapiens
cccgcttgtccagcg

SEQ ID NO: 3033680 - DNA, 22 bp, Homo sapiens
cccggagctgcccctctctggg

SEQ ID NO: 3033681 - DNA, 12 bp, Homo sapiens
cccggcccctca

SEQ ID NO: 3033682 - DNA, 15 bp, Homo sapiens
cccggcccctcaccc

SEQ ID NO: 3033683 - DNA, 17 bp, Homo sapiens
cccggcccctcaccctc

SEQ ID NO: 3033684 - DNA, 17 bp, Homo sapiens
cccggccgctccaccag

SEQ ID NO: 3033685 - DNA, 23 bp, Homo sapiens
cccggcgccccgcacctgtacag

SEQ ID NO: 3033686 - DNA, 15 bp, Homo sapiens
cccggcgcctgccct

SEQ ID NO: 3033687 - DNA, 20 bp, Homo sapiens
cccggcgcctgccctgccca

SEQ ID NO: 3033688 - DNA, 14 bp, Homo sapiens
cccggcgcggtggc

SEQ ID NO: 3033689 - DNA, 19 bp, Homo sapiens
cccggcgcggtggctcacg

SEQ ID NO: 3033690 - DNA, 12 bp, Homo sapiens
cccggctgaccc

SEQ ID NO: 3033691 - DNA, 13 bp, Homo sapiens
cccggctgggccc

SEQ ID NO: 3033692 - DNA, 17 bp, Homo sapiens
cccgggaagcatcctcc

SEQ ID NO: 3033693 - DNA, 22 bp, Homo sapiens
cccgggaagcatcctccccacc

SEQ ID NO: 3033694 - DNA, 19 bp, Homo sapiens
cccgggaaggaaggctctc

SEQ ID NO: 3033695 - DNA, 23 bp, Homo sapiens
cccgggactcactggcagcccca

SEQ ID NO: 3033696 - DNA, 14 bp, Homo sapiens
cccgggagctcagg

SEQ ID NO: 3033697 - DNA, 17 bp, Homo sapiens
cccgggatcctgccccc

SEQ ID NO: 3033698 - DNA, 18 bp, Homo sapiens
cccgggccctgggcccgg

SEQ ID NO: 3033699 - DNA, 23 bp, Homo sapiens
cccgggcccttcagtccctgagc

SEQ ID NO: 3033700 - DNA, 21 bp, Homo sapiens
cccgggccgaccctgcggcct

SEQ ID NO: 3033701 - DNA, 22 bp, Homo sapiens
cccggggtccccgccctctctc

SEQ ID NO: 3033702 - DNA, 19 bp, Homo sapiens
cccggggtctcctggacct

SEQ ID NO: 3033703 - DNA, 21 bp, Homo sapiens
cccgggtctctcactgttgca

SEQ ID NO: 3033704 - DNA, 19 bp, Homo sapiens
cccggtccccttcccaggg

SEQ ID NO: 3033705 - DNA, 22 bp, Homo sapiens
cccggtcccttgagacctcagc

SEQ ID NO: 3033706 - DNA, 14 bp, Homo sapiens
cccggtgctccctc

SEQ ID NO: 3033707 - DNA, 22 bp, Homo sapiens
cccggtggcggcagggccaggc

SEQ ID NO: 3033708 - DNA, 19 bp, Homo sapiens
cccggtggcggccccagca

SEQ ID NO: 3033709 - DNA, 20 bp, Homo sapiens
cccggtgggacccccgtggg

SEQ ID NO: 3033710 - DNA, 22 bp, Homo sapiens
cccgtcggagctgcctgcagca

SEQ ID NO: 3033711 - DNA, 20 bp, Homo sapiens
cccgtcgtgtgctgaagaca

SEQ ID NO: 3033712 - DNA, 23 bp, Homo sapiens
cccgtctggggttcagcccctcc

SEQ ID NO: 3033713 - DNA, 17 bp, Homo sapiens
cccgtctgtccatctgc

SEQ ID NO: 3033714 - DNA, 18 bp, Homo sapiens
cccgtctgtccatctgcc

SEQ ID NO: 3033715 - DNA, 16 bp, Homo sapiens
cccgtgccacccccag

SEQ ID NO: 3033716 - DNA, 17 bp, Homo sapiens
cccgtgcctgggcccct

SEQ ID NO: 3033717 - DNA, 19 bp, Homo sapiens
cccgtggcctggcatctgt

SEQ ID NO: 3033718 - DNA, 20 bp, Homo sapiens
cccgtggcctggcatctgtg

SEQ ID NO: 3033719 - DNA, 21 bp, Homo sapiens
cccgtggcctggcatctgtgt

SEQ ID NO: 3033720 - DNA, 22 bp, Homo sapiens
cccgtggcctggcatctgtgtg

SEQ ID NO: 3033721 - DNA, 18 bp, Homo sapiens
cccgttttccccatgaca

SEQ ID NO: 3033722 - DNA, 14 bp, Homo sapiens
ccctaaaagcacac

SEQ ID NO: 3033723 - DNA, 20 bp, Homo sapiens
ccctaaaatggcgaacatgt

SEQ ID NO: 3033724 - DNA, 22 bp, Homo sapiens
ccctaaaatggcgaacatgtgt

SEQ ID NO: 3033725 - DNA, 17 bp, Homo sapiens
ccctaaagatgggagga

SEQ ID NO: 3033726 - DNA, 18 bp, Homo sapiens
ccctaaggcatgtgtgaa

SEQ ID NO: 3033727 - DNA, 23 bp, Homo sapiens
ccctaatctttcacttgaaagat

SEQ ID NO: 3033728 - DNA, 14 bp, Homo sapiens
ccctaattcatctt

SEQ ID NO: 3033729 - DNA, 18 bp, Homo sapiens
ccctaattcatcttttaa

SEQ ID NO: 3033730 - DNA, 14 bp, Homo sapiens
ccctaccccaccac

SEQ ID NO: 3033731 - DNA, 13 bp, Homo sapiens
ccctacccctgcc

SEQ ID NO: 3033732 - DNA, 15 bp, Homo sapiens
ccctacccctgccct

SEQ ID NO: 3033733 - DNA, 20 bp, Homo sapiens
ccctacccctgccctgctcc

SEQ ID NO: 3033734 - DNA, 18 bp, Homo sapiens
ccctaccgatggtcccag

SEQ ID NO: 3033735 - DNA, 18 bp, Homo sapiens
ccctaccgcatggcagct

SEQ ID NO: 3033736 - DNA, 19 bp, Homo sapiens
ccctaccgcatggcagctg

SEQ ID NO: 3033737 - DNA, 22 bp, Homo sapiens
ccctaccgcatggcagctgggc

SEQ ID NO: 3033738 - DNA, 13 bp, Homo sapiens
ccctaccttcccc

SEQ ID NO: 3033739 - DNA, 16 bp, Homo sapiens
ccctaccttgcctcct

SEQ ID NO: 3033740 - DNA, 19 bp, Homo sapiens
ccctacttcattttcagag

SEQ ID NO: 3033741 - DNA, 13 bp, Homo sapiens
ccctagactttag

SEQ ID NO: 3033742 - DNA, 21 bp, Homo sapiens
ccctagcaaaatgctaggcct

SEQ ID NO: 3033743 - DNA, 23 bp, Homo sapiens
ccctagcagcccaccctgctgct

SEQ ID NO: 3033744 - DNA, 14 bp, Homo sapiens
ccctatccacccag

SEQ ID NO: 3033745 - DNA, 18 bp, Homo sapiens
ccctatccacccagccca

SEQ ID NO: 3033746 - DNA, 20 bp, Homo sapiens
ccctatgaagtaaagaactg

SEQ ID NO: 3033747 - DNA, 15 bp, Homo sapiens
ccctatgtctcagga

SEQ ID NO: 3033748 - DNA, 19 bp, Homo sapiens
ccctatttaaatgaaagga

SEQ ID NO: 3033749 - DNA, 16 bp, Homo sapiens
ccctcaacctcttctg

SEQ ID NO: 3033750 - DNA, 14 bp, Homo sapiens
ccctcacagactct

SEQ ID NO: 3033751 - DNA, 13 bp, Homo sapiens
ccctcaccacccc

SEQ ID NO: 3033752 - DNA, 12 bp, Homo sapiens
ccctcacctggt

SEQ ID NO: 3033753 - DNA, 16 bp, Homo sapiens
ccctcaccttctgagt

SEQ ID NO: 3033754 - DNA, 17 bp, Homo sapiens
ccctcacgtttcttccc

SEQ ID NO: 3033755 - DNA, 18 bp, Homo sapiens
ccctcacgtttcttcccc

SEQ ID NO: 3033756 - DNA, 22 bp, Homo sapiens
ccctcactcttgaagtccagga

SEQ ID NO: 3033757 - DNA, 17 bp, Homo sapiens
ccctcagaacccttggc

SEQ ID NO: 3033758 - DNA, 23 bp, Homo sapiens
ccctcagaacccttggcttgccc

SEQ ID NO: 3033759 - DNA, 16 bp, Homo sapiens
ccctcagacagccccc

SEQ ID NO: 3033760 - DNA, 17 bp, Homo sapiens
ccctcagacagccccct

SEQ ID NO: 3033761 - DNA, 15 bp, Homo sapiens
ccctcagaggccttg

SEQ ID NO: 3033762 - DNA, 21 bp, Homo sapiens
ccctcagcgggggccttgaag

SEQ ID NO: 3033763 - DNA, 17 bp, Homo sapiens
ccctcagctctgtcctg

SEQ ID NO: 3033764 - DNA, 21 bp, Homo sapiens
ccctcagctctgtcctgttag

SEQ ID NO: 3033765 - DNA, 13 bp, Homo sapiens
ccctcagttgtgc

SEQ ID NO: 3033766 - DNA, 22 bp, Homo sapiens
ccctcatcaggagttccagtgc

SEQ ID NO: 3033767 - DNA, 14 bp, Homo sapiens
ccctcatctgtccc

SEQ ID NO: 3033768 - DNA, 12 bp, Homo sapiens
ccctcattaatg

SEQ ID NO: 3033769 - DNA, 16 bp, Homo sapiens
ccctcattcaggaaaa

SEQ ID NO: 3033770 - DNA, 20 bp, Homo sapiens
ccctccacctatccctaaca

SEQ ID NO: 3033771 - DNA, 21 bp, Homo sapiens
ccctcccaagctggctggggt

SEQ ID NO: 3033772 - DNA, 18 bp, Homo sapiens
ccctcccacactcgccat

SEQ ID NO: 3033773 - DNA, 14 bp, Homo sapiens
ccctcccacagcgc

SEQ ID NO: 3033774 - DNA, 16 bp, Homo sapiens
ccctcccaccacccca

SEQ ID NO: 3033775 - DNA, 10 bp, Homo sapiens
ccctcccaga

SEQ ID NO: 3033776 - DNA, 13 bp, Homo sapiens
ccctcccagaggc

SEQ ID NO: 3033777 - DNA, 13 bp, Homo sapiens
ccctccccaaagc

SEQ ID NO: 3033778 - DNA, 14 bp, Homo sapiens
ccctccccaaagcc

SEQ ID NO: 3033779 - DNA, 12 bp, Homo sapiens
ccctccccaccc

SEQ ID NO: 3033780 - DNA, 13 bp, Homo sapiens
ccctccccagggg

SEQ ID NO: 3033781 - DNA, 15 bp, Homo sapiens
ccctcccccacgtct

SEQ ID NO: 3033782 - DNA, 21 bp, Homo sapiens
ccctcccccacgtctctctgc

SEQ ID NO: 3033783 - DNA, 15 bp, Homo sapiens
ccctcccccagcaga

SEQ ID NO: 3033784 - DNA, 12 bp, Homo sapiens
ccctcccccagg

SEQ ID NO: 3033785 - DNA, 18 bp, Homo sapiens
ccctcccccccatgcact

SEQ ID NO: 3033786 - DNA, 14 bp, Homo sapiens
ccctccccctaccg

SEQ ID NO: 3033787 - DNA, 13 bp, Homo sapiens
ccctcccgcacct

SEQ ID NO: 3033788 - DNA, 21 bp, Homo sapiens
ccctcccgcaccttcctcctc

SEQ ID NO: 3033789 - DNA, 14 bp, Homo sapiens
ccctcccggcctgg

SEQ ID NO: 3033790 - DNA, 19 bp, Homo sapiens
ccctccctagatccaggct

SEQ ID NO: 3033791 - DNA, 16 bp, Homo sapiens
ccctccctcagccgtc

SEQ ID NO: 3033792 - DNA, 11 bp, Homo sapiens
ccctccctgcc

SEQ ID NO: 3033793 - DNA, 13 bp, Homo sapiens
ccctccctgcctc

SEQ ID NO: 3033794 - DNA, 11 bp, Homo sapiens
ccctccctgtc

SEQ ID NO: 3033795 - DNA, 20 bp, Homo sapiens
ccctcccttccttgggcaga

SEQ ID NO: 3033796 - DNA, 18 bp, Homo sapiens
ccctccgccaggcgagat

SEQ ID NO: 3033797 - DNA, 22 bp, Homo sapiens
ccctccgggcaggggagccagg

SEQ ID NO: 3033798 - DNA, 23 bp, Homo sapiens
ccctccgggcaggggagccaggg

SEQ ID NO: 3033799 - DNA, 15 bp, Homo sapiens
ccctcctcacactcc

SEQ ID NO: 3033800 - DNA, 13 bp, Homo sapiens
ccctcctcacccc

SEQ ID NO: 3033801 - DNA, 14 bp, Homo sapiens
ccctcctcaccccg

SEQ ID NO: 3033802 - DNA, 16 bp, Homo sapiens
ccctcctcactcccta

SEQ ID NO: 3033803 - DNA, 21 bp, Homo sapiens
ccctcctcactccctaggccc

SEQ ID NO: 3033804 - DNA, 18 bp, Homo sapiens
ccctcctccgcatgccaa

SEQ ID NO: 3033805 - DNA, 13 bp, Homo sapiens
ccctcctctccca

SEQ ID NO: 3033806 - DNA, 21 bp, Homo sapiens
ccctcctctcccgtctcgcct

SEQ ID NO: 3033807 - DNA, 12 bp, Homo sapiens
ccggctgggcct

SEQ ID NO: 3033808 - DNA, 19 bp, Homo sapiens
ccggcttcctttcccaagc

SEQ ID NO: 3033809 - DNA, 23 bp, Homo sapiens
ccggcttcctttcccaagccttc

SEQ ID NO: 3033810 - DNA, 18 bp, Homo sapiens
ccgggaagcatcctcccc

SEQ ID NO: 3033811 - DNA, 22 bp, Homo sapiens
ccgggaagcatcctccccacca

SEQ ID NO: 3033812 - DNA, 15 bp, Homo sapiens
ccgggaagccaccct

SEQ ID NO: 3033813 - DNA, 19 bp, Homo sapiens
ccgggacaccgtggggaag

SEQ ID NO: 3033814 - DNA, 20 bp, Homo sapiens
ccgggacaccgtggggaagg

SEQ ID NO: 3033815 - DNA, 20 bp, Homo sapiens
ccgggacacctaggctaggg

SEQ ID NO: 3033816 - DNA, 20 bp, Homo sapiens
ccgggaccctcaggtgtagc

SEQ ID NO: 3033817 - DNA, 19 bp, Homo sapiens
ccgggactcactggcagcc

SEQ ID NO: 3033818 - DNA, 20 bp, Homo sapiens
ccgggactcactggcagccc

SEQ ID NO: 3033819 - DNA, 13 bp, Homo sapiens
ccgggagctcagg

SEQ ID NO: 3033820 - DNA, 15 bp, Homo sapiens
ccgggagctcaggaa

SEQ ID NO: 3033821 - DNA, 20 bp, Homo sapiens
ccgggagctggtgacagcct

SEQ ID NO: 3033822 - DNA, 20 bp, Homo sapiens
ccgggatcctgcccccaagt

SEQ ID NO: 3033823 - DNA, 21 bp, Homo sapiens
ccgggatcctgcccccaagtc

SEQ ID NO: 3033824 - DNA, 17 bp, Homo sapiens
ccgggatgggtggacca

SEQ ID NO: 3033825 - DNA, 22 bp, Homo sapiens
ccgggatggtcttgatctcctg

SEQ ID NO: 3033826 - DNA, 13 bp, Homo sapiens
ccgggcacagtgg

SEQ ID NO: 3033827 - DNA, 11 bp, Homo sapiens
ccgggcaggcg

SEQ ID NO: 3033828 - DNA, 14 bp, Homo sapiens
ccgggcaggggagc

SEQ ID NO: 3033829 - DNA, 18 bp, Homo sapiens
ccgggcaggggagccagg

SEQ ID NO: 3033830 - DNA, 21 bp, Homo sapiens
ccgggcatggtggcaggcgcc

SEQ ID NO: 3033831 - DNA, 22 bp, Homo sapiens
ccgggctcccctttcgcccaca

SEQ ID NO: 3033832 - DNA, 13 bp, Homo sapiens
ccgggctggccct

SEQ ID NO: 3033833 - DNA, 16 bp, Homo sapiens
ccgggctggccctgtg

SEQ ID NO: 3033834 - DNA, 14 bp, Homo sapiens
ccgggctggctgct

SEQ ID NO: 3033835 - DNA, 17 bp, Homo sapiens
ccggggaccgggacccg

SEQ ID NO: 3033836 - DNA, 15 bp, Homo sapiens
ccggggaggggcgct

SEQ ID NO: 3033837 - DNA, 13 bp, Homo sapiens
ccggggagggggc

SEQ ID NO: 3033838 - DNA, 20 bp, Homo sapiens
ccggggagggggcacggcag

SEQ ID NO: 3033839 - DNA, 20 bp, Homo sapiens
ccggggcctgggcaggaggg

SEQ ID NO: 3033840 - DNA, 18 bp, Homo sapiens
ccggggcgcctagagcgc

SEQ ID NO: 3033841 - DNA, 16 bp, Homo sapiens
ccgggggacagaggtt

SEQ ID NO: 3033842 - DNA, 20 bp, Homo sapiens
ccggggtccccgccctctct

SEQ ID NO: 3033843 - DNA, 22 bp, Homo sapiens
ccgggttcacgccattctcctg

SEQ ID NO: 3033844 - DNA, 21 bp, Homo sapiens
ccggtccccacagactgcccc

SEQ ID NO: 3033845 - DNA, 18 bp, Homo sapiens
ccggtcccttgagacctc

SEQ ID NO: 3033846 - DNA, 22 bp, Homo sapiens
ccggtcccttgagacctcagcc

SEQ ID NO: 3033847 - DNA, 16 bp, Homo sapiens
ccggtgctccctctgt

SEQ ID NO: 3033848 - DNA, 11 bp, Homo sapiens
ccggtgtcctt

SEQ ID NO: 3033849 - DNA, 13 bp, Homo sapiens
ccggttcccacaa

SEQ ID NO: 3033850 - DNA, 21 bp, Homo sapiens
ccgtaaacacgcctgcaaacg

SEQ ID NO: 3033851 - DNA, 16 bp, Homo sapiens
ccgtaggttattttca

SEQ ID NO: 3033852 - DNA, 16 bp, Homo sapiens
ccgtagttccctgaaa

SEQ ID NO: 3033853 - DNA, 20 bp, Homo sapiens
ccgtcacccttggtagagtt

SEQ ID NO: 3033854 - DNA, 23 bp, Homo sapiens
ccgtcacccttggtagagtttat

SEQ ID NO: 3033855 - DNA, 16 bp, Homo sapiens
ccgtccagagccggca

SEQ ID NO: 3033856 - DNA, 17 bp, Homo sapiens
ccgtccccccccaggcc

SEQ ID NO: 3033857 - DNA, 15 bp, Homo sapiens
ccgtccctctgtcca

SEQ ID NO: 3033858 - DNA, 16 bp, Homo sapiens
ccgtcggagctgcctg

SEQ ID NO: 3033859 - DNA, 18 bp, Homo sapiens
ccgtcggagctgcctgca

SEQ ID NO: 3033860 - DNA, 19 bp, Homo sapiens
ccgtcggagctgcctgcag

SEQ ID NO: 3033861 - DNA, 13 bp, Homo sapiens
ccgtcgtgtgctg

SEQ ID NO: 3033862 - DNA, 18 bp, Homo sapiens
ccgtctggcgagccctta

SEQ ID NO: 3033863 - DNA, 22 bp, Homo sapiens
ccgtctggcgagcccttagcct

SEQ ID NO: 3033864 - DNA, 23 bp, Homo sapiens
ccgtctgtgtgtgacccctcctg

SEQ ID NO: 3033865 - DNA, 22 bp, Homo sapiens
ccgtcttagaagtggaccagga

SEQ ID NO: 3033866 - DNA, 17 bp, Homo sapiens
ccgtgaaaacggagctg

SEQ ID NO: 3033867 - DNA, 20 bp, Homo sapiens
ccgtgacagactcctgagga

SEQ ID NO: 3033868 - DNA, 18 bp, Homo sapiens
ccgtgacagtggctgaca

SEQ ID NO: 3033869 - DNA, 14 bp, Homo sapiens
ccgtgacgaggctc

SEQ ID NO: 3033870 - DNA, 22 bp, Homo sapiens
ccgtgagccaatccctcacctt

SEQ ID NO: 3033871 - DNA, 14 bp, Homo sapiens
ccgtgaggatgtca

SEQ ID NO: 3033872 - DNA, 16 bp, Homo sapiens
ccgtgaggctgctgcc

SEQ ID NO: 3033873 - DNA, 21 bp, Homo sapiens
ccgtgagtgacatagcctcat

SEQ ID NO: 3033874 - DNA, 16 bp, Homo sapiens
ccgtgccaaccccacc

SEQ ID NO: 3033875 - DNA, 20 bp, Homo sapiens
ccgtgccaaccccacccagc

SEQ ID NO: 3033876 - DNA, 21 bp, Homo sapiens
ccgtgccaaccccacccagct

SEQ ID NO: 3033877 - DNA, 23 bp, Homo sapiens
ccgtgccaaccccacccagctcc

SEQ ID NO: 3033878 - DNA, 22 bp, Homo sapiens
ccgtgccacccccagccctggc

SEQ ID NO: 3033879 - DNA, 17 bp, Homo sapiens
ccgtgccattgtactcc

SEQ ID NO: 3033880 - DNA, 23 bp, Homo sapiens
ccgtgccattgtactccagcctg

SEQ ID NO: 3033881 - DNA, 21 bp, Homo sapiens
ccgtgccgcctgcactcctca

SEQ ID NO: 3033882 - DNA, 13 bp, Homo sapiens
ccgtgcctgggcc

SEQ ID NO: 3033883 - DNA, 14 bp, Homo sapiens
ccgtgcctgggccc

SEQ ID NO: 3033884 - DNA, 17 bp, Homo sapiens
ccgtgctcgccccagca

SEQ ID NO: 3033885 - DNA, 14 bp, Homo sapiens
ccgtgctgacagct

SEQ ID NO: 3033886 - DNA, 20 bp, Homo sapiens
ccgtgcttgtttgctcacct

SEQ ID NO: 3033887 - DNA, 15 bp, Homo sapiens
ccgtggcactgcata

SEQ ID NO: 3033888 - DNA, 20 bp, Homo sapiens
ccgtggccccgccctcaggc

SEQ ID NO: 3033889 - DNA, 20 bp, Homo sapiens
ccgtggcctggcatctgtgt

SEQ ID NO: 3033890 - DNA, 21 bp, Homo sapiens
ccgtggcttggcatctgtgtg

SEQ ID NO: 3033891 - DNA, 22 bp, Homo sapiens
ccgtggcttgggctggtcagag

SEQ ID NO: 3033892 - DNA, 14 bp, Homo sapiens
ccgtggggaagggg

SEQ ID NO: 3033893 - DNA, 14 bp, Homo sapiens
ccgtggggcaggga

SEQ ID NO: 3033894 - DNA, 22 bp, Homo sapiens
ccgtggggcagggagctgggcc

SEQ ID NO: 3033895 - DNA, 14 bp, Homo sapiens
ccgtgggttgctaa

SEQ ID NO: 3033896 - DNA, 17 bp, Homo sapiens
ccgtgggttgctaactg

SEQ ID NO: 3033897 - DNA, 20 bp, Homo sapiens
ccgtgggttgctaactgaac

SEQ ID NO: 3033898 - DNA, 14 bp, Homo sapiens
ccgtggtcctttgg

SEQ ID NO: 3033899 - DNA, 19 bp, Homo sapiens
ccgttataaagtgtgccac

SEQ ID NO: 3033900 - DNA, 20 bp, Homo sapiens
ccgttcaagaggcgtgtgca

SEQ ID NO: 3033901 - DNA, 13 bp, Homo sapiens
ccgttgccaaccg

SEQ ID NO: 3033902 - DNA, 23 bp, Homo sapiens
ccgttggaaacataaccattaca

SEQ ID NO: 3033903 - DNA, 22 bp, Homo sapiens
ccgtttgagaagaaaacatcta

SEQ ID NO: 3033904 - DNA, 17 bp, Homo sapiens
cctaaagatgggaggag

SEQ ID NO: 3033905 - DNA, 20 bp, Homo sapiens
cctaaatattttcaagaaaa

SEQ ID NO: 3033906 - DNA, 12 bp, Homo sapiens
cctaaccccttt

SEQ ID NO: 3033907 - DNA, 14 bp, Homo sapiens
cctaaccctctgtc

SEQ ID NO: 3033908 - DNA, 13 bp, Homo sapiens
cctaacctgccga

SEQ ID NO: 3033909 - DNA, 14 bp, Homo sapiens
cctaacctgtgtct

SEQ ID NO: 3033910 - DNA, 14 bp, Homo sapiens
cctaactgtatctt

SEQ ID NO: 3033911 - DNA, 13 bp, Homo sapiens
cctaacttattgc

SEQ ID NO: 3033912 - DNA, 16 bp, Homo sapiens
cctaacttattgcctg

SEQ ID NO: 3033913 - DNA, 17 bp, Homo sapiens
cctaaggccactgtttt

SEQ ID NO: 3033914 - DNA, 23 bp, Homo sapiens
cctaagggacatgttttgataaa

SEQ ID NO: 3033915 - DNA, 15 bp, Homo sapiens
cctaagggcagccct

SEQ ID NO: 3033916 - DNA, 17 bp, Homo sapiens
cctaagggcagccctcc

SEQ ID NO: 3033917 - DNA, 20 bp, Homo sapiens
cctaagggcagccctccatg

SEQ ID NO: 3033918 - DNA, 18 bp, Homo sapiens
cctaagtcctttatgtgg

SEQ ID NO: 3033919 - DNA, 14 bp, Homo sapiens
cctaagtggctgct

SEQ ID NO: 3033920 - DNA, 16 bp, Homo sapiens
cctaagtggctgctga

SEQ ID NO: 3033921 - DNA, 20 bp, Homo sapiens
cctaatcaagagtctctcca

SEQ ID NO: 3033922 - DNA, 21 bp, Homo sapiens
cctaatcaagagtctctccag

SEQ ID NO: 3033923 - DNA, 14 bp, Homo sapiens
cctaatccaggcag

SEQ ID NO: 3033924 - DNA, 18 bp, Homo sapiens
cctaatccaggcagatcc

SEQ ID NO: 3033925 - DNA, 19 bp, Homo sapiens
cctaatccaggcagatcca

SEQ ID NO: 3033926 - DNA, 15 bp, Homo sapiens
cctaatgctctgaaa

SEQ ID NO: 3033927 - DNA, 16 bp, Homo sapiens
cctaattcatctttta

SEQ ID NO: 3033928 - DNA, 19 bp, Homo sapiens
cctaattcatcttttaatc

SEQ ID NO: 3033929 - DNA, 15 bp, Homo sapiens
cctaattcttcatag

SEQ ID NO: 3033930 - DNA, 16 bp, Homo sapiens
cctaattgtcacatca

SEQ ID NO: 3033931 - DNA, 14 bp, Homo sapiens
cctacaatatttta

SEQ ID NO: 3033932 - DNA, 18 bp, Homo sapiens
cctacaatattttattct

SEQ ID NO: 3033933 - DNA, 21 bp, Homo sapiens
cctacactgatgcaaggatta

SEQ ID NO: 3033934 - DNA, 20 bp, Homo sapiens
cctacagctttgatccctga

SEQ ID NO: 3033935 - DNA, 21 bp, Homo sapiens
cctacagctttgatccctgac

SEQ ID NO: 3033936 - DNA, 18 bp, Homo sapiens
cctaccacctccccagcc

SEQ ID NO: 3033937 - DNA, 19 bp, Homo sapiens
cctaccacttttctgctgt

SEQ ID NO: 3033938 - DNA, 14 bp, Homo sapiens
cctgatcaatgaca

SEQ ID NO: 3033939 - DNA, 17 bp, Homo sapiens
cctgatcaatgacagag

SEQ ID NO: 3033940 - DNA, 18 bp, Homo sapiens
cctgatcagaccacggct

SEQ ID NO: 3033941 - DNA, 17 bp, Homo sapiens
cctgatcccagacctgt

SEQ ID NO: 3033942 - DNA, 13 bp, Homo sapiens
cctgatcctggag

SEQ ID NO: 3033943 - DNA, 15 bp, Homo sapiens
cctgatcctggaggc

SEQ ID NO: 3033944 - DNA, 18 bp, Homo sapiens
cctgatcctggaggccca

SEQ ID NO: 3033945 - DNA, 17 bp, Homo sapiens
cctgatgagactccact

SEQ ID NO: 3033946 - DNA, 13 bp, Homo sapiens
cctgatgctgaca

SEQ ID NO: 3033947 - DNA, 21 bp, Homo sapiens
cctgatgctgacattcacctg

SEQ ID NO: 3033948 - DNA, 12 bp, Homo sapiens
cctgatggagag

SEQ ID NO: 3033949 - DNA, 17 bp, Homo sapiens
cctgatgtcagctgctg

SEQ ID NO: 3033950 - DNA, 18 bp, Homo sapiens
cctgattgtgccagtgca

SEQ ID NO: 3033951 - DNA, 20 bp, Homo sapiens
cctgatttaggagaagccag

SEQ ID NO: 3033952 - DNA, 21 bp, Homo sapiens
cctgatttaggagaagccagg

SEQ ID NO: 3033953 - DNA, 22 bp, Homo sapiens
cctgatttaggagaagccagga

SEQ ID NO: 3033954 - DNA, 15 bp, Homo sapiens
cctgatttcttcagg

SEQ ID NO: 3033955 - DNA, 14 bp, Homo sapiens
cctgcaaaaaatac

SEQ ID NO: 3033956 - DNA, 19 bp, Homo sapiens
cctgcaaacgctgcctgcc

SEQ ID NO: 3033957 - DNA, 22 bp, Homo sapiens
cctgcaaacgctgcctgcccgt

SEQ ID NO: 3033958 - DNA, 17 bp, Homo sapiens
cctgcaagccttctaaa

SEQ ID NO: 3033959 - DNA, 13 bp, Homo sapiens
cctgcaatcccag

SEQ ID NO: 3033960 - DNA, 20 bp, Homo sapiens
cctgcacagattcccaggcc

SEQ ID NO: 3033961 - DNA, 22 bp, Homo sapiens
cctgcacagattcccaggccag

SEQ ID NO: 3033962 - DNA, 23 bp, Homo sapiens
cctgcacagattcccaggccagg

SEQ ID NO: 3033963 - DNA, 19 bp, Homo sapiens
cctgcaccgaccccgggcc

SEQ ID NO: 3033964 - DNA, 20 bp, Homo sapiens
cctgcaccgacccgaggccc

SEQ ID NO: 3033965 - DNA, 19 bp, Homo sapiens
cctgcacctccccccactg

SEQ ID NO: 3033966 - DNA, 12 bp, Homo sapiens
cctgcacctggt

SEQ ID NO: 3033967 - DNA, 17 bp, Homo sapiens
cctgcactccctcctgg

SEQ ID NO: 3033968 - DNA, 20 bp, Homo sapiens
cctgcactccctcctggagc

SEQ ID NO: 3033969 - DNA, 14 bp, Homo sapiens
cctgcactccctgg

SEQ ID NO: 3033970 - DNA, 14 bp, Homo sapiens
cctgcactgtgccc

SEQ ID NO: 3033971 - DNA, 18 bp, Homo sapiens
cctgcactgtgccccgcg

SEQ ID NO: 3033972 - DNA, 15 bp, Homo sapiens
cctgcacttcatatc

SEQ ID NO: 3033973 - DNA, 21 bp, Homo sapiens
cctgcagacgtctggccctgg

SEQ ID NO: 3033974 - DNA, 14 bp, Homo sapiens
cctgcagagctgcg

SEQ ID NO: 3033975 - DNA, 17 bp, Homo sapiens
cctgcagagctgcgggc

SEQ ID NO: 3033976 - DNA, 22 bp, Homo sapiens
cctgcagcactttttccttctg

SEQ ID NO: 3033977 - DNA, 16 bp, Homo sapiens
cctgcagctagtccta

SEQ ID NO: 3033978 - DNA, 16 bp, Homo sapiens
cctgcaggacctgcct

SEQ ID NO: 3033979 - DNA, 17 bp, Homo sapiens
cctgcaggacctgcctg

SEQ ID NO: 3033980 - DNA, 18 bp, Homo sapiens
cctgcaggacctgcctgt

SEQ ID NO: 3033981 - DNA, 17 bp, Homo sapiens
cctgcaggagcagggcg

SEQ ID NO: 3033982 - DNA, 20 bp, Homo sapiens
cctgcaggagcagggcggct

SEQ ID NO: 3033983 - DNA, 22 bp, Homo sapiens
cctgcaggagcagggcggctgc

SEQ ID NO: 3033984 - DNA, 19 bp, Homo sapiens
cctgcaggctgcaggaggg

SEQ ID NO: 3033985 - DNA, 20 bp, Homo sapiens
cctgcagggccatggctcag

SEQ ID NO: 3033986 - DNA, 15 bp, Homo sapiens
cctgcagtcatcttg

SEQ ID NO: 3033987 - DNA, 15 bp, Homo sapiens
cctgcagtgccagct

SEQ ID NO: 3033988 - DNA, 22 bp, Homo sapiens
cctgcagtgccagctccctcgt

SEQ ID NO: 3033989 - DNA, 21 bp, Homo sapiens
cctgcatatctctagtccctg

SEQ ID NO: 3033990 - DNA, 13 bp, Homo sapiens
cctgcatctaagc

SEQ ID NO: 3033991 - DNA, 16 bp, Homo sapiens
cctgcatctaagccca

SEQ ID NO: 3033992 - DNA, 23 bp, Homo sapiens
cctgcatgtaaacacgcctgcaa

SEQ ID NO: 3033993 - DNA, 12 bp, Homo sapiens
cctgcatgtgta

SEQ ID NO: 3033994 - DNA, 13 bp, Homo sapiens
cctgcatgtgtat

SEQ ID NO: 3033995 - DNA, 14 bp, Homo sapiens
cctgcatgtgtata

SEQ ID NO: 3033996 - DNA, 18 bp, Homo sapiens
cctgccaatgattccaga

SEQ ID NO: 3033997 - DNA, 13 bp, Homo sapiens
cctgccaccagca

SEQ ID NO: 3033998 - DNA, 23 bp, Homo sapiens
cctgccaccgactgcccagccac

SEQ ID NO: 3033999 - DNA, 14 bp, Homo sapiens
cctgccactcaccc

SEQ ID NO: 3034000 - DNA, 18 bp, Homo sapiens
cctgccactcacccttcc

SEQ ID NO: 3034001 - DNA, 14 bp, Homo sapiens
cctgccagaccccc

SEQ ID NO: 3034002 - DNA, 13 bp, Homo sapiens
cctgccagccggt

SEQ ID NO: 3034003 - DNA, 14 bp, Homo sapiens
cctgccagctgcac

SEQ ID NO: 3034004 - DNA, 18 bp, Homo sapiens
cctgccagctgcactgat

SEQ ID NO: 3034005 - DNA, 13 bp, Homo sapiens
cctgccagggcag

SEQ ID NO: 3034006 - DNA, 14 bp, Homo sapiens
cctgccagtgcctt

SEQ ID NO: 3034007 - DNA, 17 bp, Homo sapiens
cctgccagtgccttacc

SEQ ID NO: 3034008 - DNA, 22 bp, Homo sapiens
cctgccatccccctctcacgcc

SEQ ID NO: 3034009 - DNA, 16 bp, Homo sapiens
cctgccatgcaagaac

SEQ ID NO: 3034010 - DNA, 13 bp, Homo sapiens
cctgcccacctgc

SEQ ID NO: 3034011 - DNA, 14 bp, Homo sapiens
cctgcccacctgcc

SEQ ID NO: 3034012 - DNA, 16 bp, Homo sapiens
cctgcccacctgcctg

SEQ ID NO: 3034013 - DNA, 14 bp, Homo sapiens
cctgcccacctgtc

SEQ ID NO: 3034014 - DNA, 16 bp, Homo sapiens
cctgcccagcctcaat

SEQ ID NO: 3034015 - DNA, 12 bp, Homo sapiens
cctgcccaggag

SEQ ID NO: 3034016 - DNA, 22 bp, Homo sapiens
cctgcccaggagagccagccct

SEQ ID NO: 3034017 - DNA, 21 bp, Homo sapiens
cctgcccattctgccctgtgg

SEQ ID NO: 3034018 - DNA, 16 bp, Homo sapiens
cctgcccccaatccat

SEQ ID NO: 3034019 - DNA, 17 bp, Homo sapiens
cctgccccgcaggcctg

SEQ ID NO: 3034020 - DNA, 18 bp, Homo sapiens
cctgccccggagctggag

SEQ ID NO: 3034021 - DNA, 12 bp, Homo sapiens
cctgcccctccc

SEQ ID NO: 3034022 - DNA, 18 bp, Homo sapiens
cctgcccgcaccctggcc

SEQ ID NO: 3034023 - DNA, 15 bp, Homo sapiens
cctgcccgtaaacac

SEQ ID NO: 3034024 - DNA, 20 bp, Homo sapiens
cctgcccgtaaacacgcctg

SEQ ID NO: 3034025 - DNA, 21 bp, Homo sapiens
cctgcccgtaaacacgcctgc

SEQ ID NO: 3034026 - DNA, 23 bp, Homo sapiens
cctgcccgtaaacacgcctgcaa

SEQ ID NO: 3034027 - DNA, 14 bp, Homo sapiens
cctgcccgttcttg

SEQ ID NO: 3034028 - DNA, 13 bp, Homo sapiens
cctgccctcccct

SEQ ID NO: 3034029 - DNA, 19 bp, Homo sapiens
cctgccctccctcagccgt

SEQ ID NO: 3034030 - DNA, 14 bp, Homo sapiens
cctgccctgcccaa

SEQ ID NO: 3034031 - DNA, 17 bp, Homo sapiens
cctgccctgcccaagtg

SEQ ID NO: 3034032 - DNA, 12 bp, Homo sapiens
cctgccctgcta

SEQ ID NO: 3034033 - DNA, 13 bp, Homo sapiens
cctgccctgctcc

SEQ ID NO: 3034034 - DNA, 14 bp, Homo sapiens
cctgccgagagtcc

SEQ ID NO: 3034035 - DNA, 23 bp, Homo sapiens
cctgccgagagtccatcagcctc

SEQ ID NO: 3034036 - DNA, 14 bp, Homo sapiens
cctgccgcctcaat

SEQ ID NO: 3034037 - DNA, 22 bp, Homo sapiens
cctgccggtaaacacgcctgca

SEQ ID NO: 3034038 - DNA, 18 bp, Homo sapiens
cctgcctagctcttgggc

SEQ ID NO: 3034039 - DNA, 23 bp, Homo sapiens
cctgcctagctcttgggcctgac

SEQ ID NO: 3034040 - DNA, 17 bp, Homo sapiens
cctgcctcacatctccc

SEQ ID NO: 3034041 - DNA, 19 bp, Homo sapiens
cctgcctcacatctccctt

SEQ ID NO: 3034042 - DNA, 13 bp, Homo sapiens
cctgcctcagcct

SEQ ID NO: 3034043 - DNA, 14 bp, Homo sapiens
cctgcctcagcctc

SEQ ID NO: 3034044 - DNA, 14 bp, Homo sapiens
cctgcctcagcctt

SEQ ID NO: 3034045 - DNA, 13 bp, Homo sapiens
cctgcctcagtgg

SEQ ID NO: 3034046 - DNA, 17 bp, Homo sapiens
cctgcctccagctgtca

SEQ ID NO: 3034047 - DNA, 14 bp, Homo sapiens
cctgcctcctggct

SEQ ID NO: 3034048 - DNA, 15 bp, Homo sapiens
cctgcctcctggctc

SEQ ID NO: 3034049 - DNA, 20 bp, Homo sapiens
cctgcctcgagggccgcctg

SEQ ID NO: 3034050 - DNA, 19 bp, Homo sapiens
cctgcctcgcccccacttt

SEQ ID NO: 3034051 - DNA, 23 bp, Homo sapiens
cctgcctcgcccccacttttcta

SEQ ID NO: 3034052 - DNA, 21 bp, Homo sapiens
cctgcctctgtgtagccgccc

SEQ ID NO: 3034053 - DNA, 14 bp, Homo sapiens
cctgcctgccaccc

SEQ ID NO: 3034054 - DNA, 12 bp, Homo sapiens
cctgcctgctgt

SEQ ID NO: 3034055 - DNA, 13 bp, Homo sapiens
cctgcctgctgtg

SEQ ID NO: 3034056 - DNA, 14 bp, Homo sapiens
cctgcctgctgtgg

SEQ ID NO: 3034057 - DNA, 19 bp, Homo sapiens
cctgcctggaccagcctct

SEQ ID NO: 3034058 - DNA, 15 bp, Homo sapiens
cctgcctggccggcc

SEQ ID NO: 3034059 - DNA, 23 bp, Homo sapiens
cctgcctggccggccagccagcc

SEQ ID NO: 3034060 - DNA, 13 bp, Homo sapiens
cctgccttcagag

SEQ ID NO: 3034061 - DNA, 22 bp, Homo sapiens
cctgccttcctcctgggccctc

SEQ ID NO: 3034062 - DNA, 18 bp, Homo sapiens
cctgcctttgggagcagg

SEQ ID NO: 3034063 - DNA, 19 bp, Homo sapiens
cctgccttttctagtttta

SEQ ID NO: 3034064 - DNA, 14 bp, Homo sapiens
cctgcgaccctggg

SEQ ID NO: 3034065 - DNA, 16 bp, Homo sapiens
cctgcgaccctggggg

SEQ ID NO: 3034066 - DNA, 21 bp, Homo sapiens
cctgcgaccctgggggcacag

SEQ ID NO: 3034067 - DNA, 21 bp, Homo sapiens
cctgcgcctccatccatctgt

SEQ ID NO: 3034068 - DNA, 23 bp, Homo sapiens
cctgcgctttgaacgtgccagca

SEQ ID NO: 3034069 - DNA, 24 bp, Homo sapiens
cctgcgctttgaacgtgccagcag

SEQ ID NO: 3034070 - DNA, 14 bp, Homo sapiens
cctgcggcctccac

SEQ ID NO: 3034071 - DNA, 22 bp, Homo sapiens
ccttgtgttccttctgtgaaga

SEQ ID NO: 3034072 - DNA, 21 bp, Homo sapiens
ccttgttatttctcagacttt

SEQ ID NO: 3034073 - DNA, 16 bp, Homo sapiens
ccttgtttgttttatt

SEQ ID NO: 3034074 - DNA, 19 bp, Homo sapiens
ccttgttttgaaactagaa

SEQ ID NO: 3034075 - DNA, 22 bp, Homo sapiens
ccttgttttgaaactagaaatc

SEQ ID NO: 3034076 - DNA, 12 bp, Homo sapiens
cctttaaatact

SEQ ID NO: 3034077 - DNA, 19 bp, Homo sapiens
cctttaagatatccatctt

SEQ ID NO: 3034078 - DNA, 19 bp, Homo sapiens
cctttaagcctgcattctt

SEQ ID NO: 3034079 - DNA, 14 bp, Homo sapiens
cctttacggacacc

SEQ ID NO: 3034080 - DNA, 14 bp, Homo sapiens
cctttactcctggc

SEQ ID NO: 3034081 - DNA, 17 bp, Homo sapiens
cctttactgaccctggg

SEQ ID NO: 3034082 - DNA, 20 bp, Homo sapiens
cctttactgaccctggggct

SEQ ID NO: 3034083 - DNA, 15 bp, Homo sapiens
cctttatactgtgaa

SEQ ID NO: 3034084 - DNA, 21 bp, Homo sapiens
cctttatcaagagactcctga

SEQ ID NO: 3034085 - DNA, 16 bp, Homo sapiens
cctttatcacctcatt

SEQ ID NO: 3034086 - DNA, 21 bp, Homo sapiens
cctttatccctgcttatctga

SEQ ID NO: 3034087 - DNA, 15 bp, Homo sapiens
cctttatctcagcca

SEQ ID NO: 3034088 - DNA, 12 bp, Homo sapiens
cctttcaaagct

SEQ ID NO: 3034089 - DNA, 15 bp, Homo sapiens
cctttcaaatttaga

SEQ ID NO: 3034090 - DNA, 23 bp, Homo sapiens
cctttcacacatctgggtgccct

SEQ ID NO: 3034091 - DNA, 17 bp, Homo sapiens
cctttcaccccagggcc

SEQ ID NO: 3034092 - DNA, 13 bp, Homo sapiens
cctttcagccaca

SEQ ID NO: 3034093 - DNA, 15 bp, Homo sapiens
cctttcagcccacgt

SEQ ID NO: 3034094 - DNA, 13 bp, Homo sapiens
cctttccaaagag

SEQ ID NO: 3034095 - DNA, 13 bp, Homo sapiens
cctttccatctgt

SEQ ID NO: 3034096 - DNA, 16 bp, Homo sapiens
cctttccatctgtcca

SEQ ID NO: 3034097 - DNA, 14 bp, Homo sapiens
cctttccccagcct

SEQ ID NO: 3034098 - DNA, 22 bp, Homo sapiens
cctttccccagcctctcctcct

SEQ ID NO: 3034099 - DNA, 16 bp, Homo sapiens
cctttccccttccttt

SEQ ID NO: 3034100 - DNA, 20 bp, Homo sapiens
cctttcctatcacctcgaga

SEQ ID NO: 3034101 - DNA, 14 bp, Homo sapiens
cctttcctgtgtga

SEQ ID NO: 3034102 - DNA, 14 bp, Homo sapiens
cctttctagagcac

SEQ ID NO: 3034103 - DNA, 14 bp, Homo sapiens
cctttctcctttgt

SEQ ID NO: 3034104 - DNA, 12 bp, Homo sapiens
cctttctgcccc

SEQ ID NO: 3034105 - DNA, 22 bp, Homo sapiens
cctttctgccccccagggctag

SEQ ID NO: 3034106 - DNA, 12 bp, Homo sapiens
cctttgcccaca

SEQ ID NO: 3034107 - DNA, 19 bp, Homo sapiens
cctttgcccacacacactc

SEQ ID NO: 3034108 - DNA, 18 bp, Homo sapiens
cctttggaacaagacagc

SEQ ID NO: 3034109 - DNA, 15 bp, Homo sapiens
cctttggagatgctg

SEQ ID NO: 3034110 - DNA, 20 bp, Homo sapiens
cctttggagatgctgagggt

SEQ ID NO: 3034111 - DNA, 14 bp, Homo sapiens
cctttgggccctgc

SEQ ID NO: 3034112 - DNA, 16 bp, Homo sapiens
cctttgggccctgcat

SEQ ID NO: 3034113 - DNA, 17 bp, Homo sapiens
cctttgggccctgcatg

SEQ ID NO: 3034114 - DNA, 19 bp, Homo sapiens
cctttgggtcctgggcagg

SEQ ID NO: 3034115 - DNA, 15 bp, Homo sapiens
cctttggtatttcac

SEQ ID NO: 3034116 - DNA, 17 bp, Homo sapiens
cctttggtcctgtcccc

SEQ ID NO: 3034117 - DNA, 14 bp, Homo sapiens
cctttggttctggc

SEQ ID NO: 3034118 - DNA, 12 bp, Homo sapiens
cctttgtatatt

SEQ ID NO: 3034119 - DNA, 20 bp, Homo sapiens
cctttgtcttttttttcatc

SEQ ID NO: 3034120 - DNA, 18 bp, Homo sapiens
ccttttacattctgtgtg

SEQ ID NO: 3034121 - DNA, 15 bp, Homo sapiens
ccttttcactacacc

SEQ ID NO: 3034122 - DNA, 12 bp, Homo sapiens
ccttttccatgc

SEQ ID NO: 3034123 - DNA, 20 bp, Homo sapiens
ccttttctttaagttttatt

SEQ ID NO: 3034124 - DNA, 23 bp, Homo sapiens
ccttttgacagctggtccctgcc

SEQ ID NO: 3034125 - DNA, 23 bp, Homo sapiens
ccttttgataaaatgttcctttt

SEQ ID NO: 3034126 - DNA, 19 bp, Homo sapiens
ccttttgcagaagagggtg

SEQ ID NO: 3034127 - DNA, 12 bp, Homo sapiens
ccttttgccaat

SEQ ID NO: 3034128 - DNA, 12 bp, Homo sapiens
ccttttgtaaag

SEQ ID NO: 3034129 - DNA, 19 bp, Homo sapiens
ccttttgtagaatgaacca

SEQ ID NO: 3034130 - DNA, 18 bp, Homo sapiens
ccttttgttttgaagctg

SEQ ID NO: 3034131 - DNA, 17 bp, Homo sapiens
cctttttaaaacacatg

SEQ ID NO: 3034132 - DNA, 11 bp, Homo sapiens
cctttttaagg

SEQ ID NO: 3034133 - DNA, 23 bp, Homo sapiens
cctttttgagtaattttctgatg

SEQ ID NO: 3034134 - DNA, 22 bp, Homo sapiens
ccttttttaaaaaaatttttgc

SEQ ID NO: 3034135 - DNA, 17 bp, Homo sapiens
ccttttttatcatttct

SEQ ID NO: 3034136 - DNA, 12 bp, Homo sapiens
ccttttttcaaa

SEQ ID NO: 3034137 - DNA, 20 bp, Homo sapiens
ccttttttctcttctgtcca

SEQ ID NO: 3034138 - DNA, 23 bp, Homo sapiens
ccttttttgataaagtttctcag

SEQ ID NO: 3034139 - DNA, 23 bp, Homo sapiens
ccttttttgttttttcaaaatag

SEQ ID NO: 3034140 - DNA, 19 bp, Homo sapiens
cctttttttaaattttctc

SEQ ID NO: 3034141 - DNA, 13 bp, Homo sapiens
cgaaacagcgctg

SEQ ID NO: 3034142 - DNA, 18 bp, Homo sapiens
cgaaagctctagaatctg

SEQ ID NO: 3034143 - DNA, 16 bp, Homo sapiens
cgaaagtgtcatcaat

SEQ ID NO: 3034144 - DNA, 17 bp, Homo sapiens
cgaaattccaaggccca

SEQ ID NO: 3034145 - DNA, 14 bp, Homo sapiens
cgaacatcttcata

SEQ ID NO: 3034146 - DNA, 16 bp, Homo sapiens
cgaacatcttcatata

SEQ ID NO: 3034147 - DNA, 20 bp, Homo sapiens
cgaacatcttcatataaact

SEQ ID NO: 3034148 - DNA, 16 bp, Homo sapiens
cgaacccacctgctga

SEQ ID NO: 3034149 - DNA, 23 bp, Homo sapiens
cgaacccacctgctgagagaccc

SEQ ID NO: 3034150 - DNA, 17 bp, Homo sapiens
cgaacccctagaaagga

SEQ ID NO: 3034151 - DNA, 21 bp, Homo sapiens
cgaacccctagaaaggagaga

SEQ ID NO: 3034152 - DNA, 19 bp, Homo sapiens
cgaactccaggctgggctg

SEQ ID NO: 3034153 - DNA, 15 bp, Homo sapiens
cgaactgtgctccca

SEQ ID NO: 3034154 - DNA, 17 bp, Homo sapiens
cgaactgtgctcccacg

SEQ ID NO: 3034155 - DNA, 20 bp, Homo sapiens
cgaactgtgctcccacgggg

SEQ ID NO: 3034156 - DNA, 15 bp, Homo sapiens
cgaagaagagccaca

SEQ ID NO: 3034157 - DNA, 14 bp, Homo sapiens
cgaagaagatgctc

SEQ ID NO: 3034158 - DNA, 14 bp, Homo sapiens
cgaagagcaggcca

SEQ ID NO: 3034159 - DNA, 22 bp, Homo sapiens
cgaagcaatcagcaaacacaat

SEQ ID NO: 3034160 - DNA, 16 bp, Homo sapiens
cgaagcgttgtcctca

SEQ ID NO: 3034161 - DNA, 22 bp, Homo sapiens
cgaagctgctgtgactgtgtcc

SEQ ID NO: 3034162 - DNA, 14 bp, Homo sapiens
cgaagggcccccac

SEQ ID NO: 3034163 - DNA, 15 bp, Homo sapiens
cgaagtcctatggaa

SEQ ID NO: 3034164 - DNA, 16 bp, Homo sapiens
cgaagtcctatggaaa

SEQ ID NO: 3034165 - DNA, 13 bp, Homo sapiens
cgaagtgttgcat

SEQ ID NO: 3034166 - DNA, 20 bp, Homo sapiens
cgaatgcatattcaacacac

SEQ ID NO: 3034167 - DNA, 17 bp, Homo sapiens
cgaatgcccctgttcat

SEQ ID NO: 3034168 - DNA, 16 bp, Homo sapiens
cgaattttaaaagatg

SEQ ID NO: 3034169 - DNA, 16 bp, Homo sapiens
cgacaccactcctgcc

SEQ ID NO: 3034170 - DNA, 19 bp, Homo sapiens
cgacaccactcctgccagc

SEQ ID NO: 3034171 - DNA, 23 bp, Homo sapiens
cgacaccactcctgccagcccgg

SEQ ID NO: 3034172 - DNA, 13 bp, Homo sapiens
cgacactcagggc

SEQ ID NO: 3034173 - DNA, 17 bp, Homo sapiens
cgacactcagggcagct

SEQ ID NO: 3034174 - DNA, 14 bp, Homo sapiens
cgacactgttctcc

SEQ ID NO: 3034175 - DNA, 22 bp, Homo sapiens
cgacagagggaagaaaagagct

SEQ ID NO: 3034176 - DNA, 15 bp, Homo sapiens
cgacagcggccttga

SEQ ID NO: 3034177 - DNA, 20 bp, Homo sapiens
cgacatcccagtagtgtttg

SEQ ID NO: 3034178 - DNA, 16 bp, Homo sapiens
cgaccacaccagcctc

SEQ ID NO: 3034179 - DNA, 16 bp, Homo sapiens
cgaccagaggagcctt

SEQ ID NO: 3034180 - DNA, 13 bp, Homo sapiens
cgacccccaaggg

SEQ ID NO: 3034181 - DNA, 19 bp, Homo sapiens
cgaccccccgtgggctccc

SEQ ID NO: 3034182 - DNA, 17 bp, Homo sapiens
cgacccccgcagaggca

SEQ ID NO: 3034183 - DNA, 17 bp, Homo sapiens
cgacccctgcctcgagg

SEQ ID NO: 3034184 - DNA, 14 bp, Homo sapiens
cgacccgaggccca

SEQ ID NO: 3034185 - DNA, 15 bp, Homo sapiens
cgacccgaggcccag

SEQ ID NO: 3034186 - DNA, 12 bp, Homo sapiens
cgaccctggggg

SEQ ID NO: 3034187 - DNA, 14 bp, Homo sapiens
cgactaatttcaaa

SEQ ID NO: 3034188 - DNA, 14 bp, Homo sapiens
cgactgcctgtctc

SEQ ID NO: 3034189 - DNA, 13 bp, Homo sapiens
cgagaccagcctg

SEQ ID NO: 3034190 - DNA, 17 bp, Homo sapiens
cgagacccaagggcaga

SEQ ID NO: 3034191 - DNA, 21 bp, Homo sapiens
cgagaccccatcttccagcca

SEQ ID NO: 3034192 - DNA, 20 bp, Homo sapiens
cgagaccccggcttcctttc

SEQ ID NO: 3034193 - DNA, 23 bp, Homo sapiens
cgagagctggccaaagagccttt

SEQ ID NO: 3034194 - DNA, 22 bp, Homo sapiens
cgagatagggtggcacatctgt

SEQ ID NO: 3034195 - DNA, 23 bp, Homo sapiens
cgagattgctggaaaccaagtca

SEQ ID NO: 3034196 - DNA, 15 bp, Homo sapiens
cgagcagacacactg

SEQ ID NO: 3034197 - DNA, 22 bp, Homo sapiens
cgagcatgcggagccagcaggc

SEQ ID NO: 3034198 - DNA, 13 bp, Homo sapiens
cgagccacaggaa

SEQ ID NO: 3034199 - DNA, 15 bp, Homo sapiens
cgagcccctcggctc

SEQ ID NO: 3034200 - DNA, 16 bp, Homo sapiens
cgagcccctcggctct

SEQ ID NO: 3034201 - DNA, 13 bp, Homo sapiens
cgagcctggctcc

SEQ ID NO: 3034202 - DNA, 22 bp, Homo sapiens
cgagctctcaaatccctctcca

SEQ ID NO: 3034203 - DNA, 18 bp, Homo sapiens
cgaggaaaaacaacaaat

SEQ ID NO: 3034204 - DNA, 22 bp, Homo sapiens
ctaaaatgtgatgttctaaggc

SEQ ID NO: 3034205 - DNA, 23 bp, Homo sapiens
ctaaaatgtgatgttctaaggct

SEQ ID NO: 3034206 - DNA, 19 bp, Homo sapiens
ctaaacaatgctgatttgg

SEQ ID NO: 3034207 - DNA, 16 bp, Homo sapiens
ctaaacactgcgcttt

SEQ ID NO: 3034208 - DNA, 17 bp, Homo sapiens
ctaaacctcagttatta

SEQ ID NO: 3034209 - DNA, 14 bp, Homo sapiens
ctaaacctgtgcct

SEQ ID NO: 3034210 - DNA, 19 bp, Homo sapiens
ctaaacctgtgcctccctc

SEQ ID NO: 3034211 - DNA, 22 bp, Homo sapiens
ctaaaccttcatcattttgtga

SEQ ID NO: 3034212 - DNA, 17 bp, Homo sapiens
ctaaacggattccaaag

SEQ ID NO: 3034213 - DNA, 20 bp, Homo sapiens
ctaaacggttcagtttcttc

SEQ ID NO: 3034214 - DNA, 18 bp, Homo sapiens
ctaaacgtaagcactgtt

SEQ ID NO: 3034215 - DNA, 19 bp, Homo sapiens
ctaaacgtaagcactgttt

SEQ ID NO: 3034216 - DNA, 15 bp, Homo sapiens
ctaaactacattata

SEQ ID NO: 3034217 - DNA, 14 bp, Homo sapiens
ctaaactcatttat

SEQ ID NO: 3034218 - DNA, 15 bp, Homo sapiens
ctaaactcatttata

SEQ ID NO: 3034219 - DNA, 17 bp, Homo sapiens
ctaaactcatttataaa

SEQ ID NO: 3034220 - DNA, 21 bp, Homo sapiens
ctaaagagttattcaaatgaa

SEQ ID NO: 3034221 - DNA, 18 bp, Homo sapiens
ctaaagagtttattttaa

SEQ ID NO: 3034222 - DNA, 19 bp, Homo sapiens
ctaaagagtttattttaag

SEQ ID NO: 3034223 - DNA, 15 bp, Homo sapiens
ctaaagatcttctgt

SEQ ID NO: 3034224 - DNA, 19 bp, Homo sapiens
ctaaagatggagtttctaa

SEQ ID NO: 3034225 - DNA, 17 bp, Homo sapiens
ctaaagattctatagtt

SEQ ID NO: 3034226 - DNA, 14 bp, Homo sapiens
ctaaagcaataatc

SEQ ID NO: 3034227 - DNA, 18 bp, Homo sapiens
ctaaagccaaccagcctt

SEQ ID NO: 3034228 - DNA, 12 bp, Homo sapiens
ctaaagccttaa

SEQ ID NO: 3034229 - DNA, 18 bp, Homo sapiens
ctaaaggatggaaaaata

SEQ ID NO: 3034230 - DNA, 19 bp, Homo sapiens
ctaaaggatggaaaaataa

SEQ ID NO: 3034231 - DNA, 23 bp, Homo sapiens
ctaaaggtggccacaaattcttt

SEQ ID NO: 3034232 - DNA, 14 bp, Homo sapiens
ctaaagtgctggga

SEQ ID NO: 3034233 - DNA, 10 bp, Homo sapiens
ctaaagttat

SEQ ID NO: 3034234 - DNA, 13 bp, Homo sapiens
ctaaagttctaag

SEQ ID NO: 3034235 - DNA, 18 bp, Homo sapiens
ctaaataaaagttttaca

SEQ ID NO: 3034236 - DNA, 22 bp, Homo sapiens
ctaaataaaagttttacaaagg

SEQ ID NO: 3034237 - DNA, 20 bp, Homo sapiens
ctaaataaaatttgttgcat

SEQ ID NO: 3034238 - DNA, 18 bp, Homo sapiens
ctaaataagtcaccattg

SEQ ID NO: 3034239 - DNA, 17 bp, Homo sapiens
ctaaatacttgctccat

SEQ ID NO: 3034240 - DNA, 15 bp, Homo sapiens
ctaaatagatacttt

SEQ ID NO: 3034241 - DNA, 15 bp, Homo sapiens
ctaaatatgaatgaa

SEQ ID NO: 3034242 - DNA, 21 bp, Homo sapiens
ctaaatattggtttgttattc

SEQ ID NO: 3034243 - DNA, 20 bp, Homo sapiens
ctaaatattttcaagaaaag

SEQ ID NO: 3034244 - DNA, 21 bp, Homo sapiens
ctaaatcaccagagaccaaac

SEQ ID NO: 3034245 - DNA, 12 bp, Homo sapiens
ctaaatgcccag

SEQ ID NO: 3034246 - DNA, 18 bp, Homo sapiens
ctaaatgcccagttcact

SEQ ID NO: 3034247 - DNA, 15 bp, Homo sapiens
ctaaatgtaacagtc

SEQ ID NO: 3034248 - DNA, 19 bp, Homo sapiens
ctaaatgtaacagtctgat

SEQ ID NO: 3034249 - DNA, 19 bp, Homo sapiens
ctaaatgtgtaataatgta

SEQ ID NO: 3034250 - DNA, 23 bp, Homo sapiens
ctaaatgtgtaataatgtaacat

SEQ ID NO: 3034251 - DNA, 13 bp, Homo sapiens
ctaaattgaataa

SEQ ID NO: 3034252 - DNA, 14 bp, Homo sapiens
ctaaattgaataat

SEQ ID NO: 3034253 - DNA, 19 bp, Homo sapiens
ctaaattgatcattcataa

SEQ ID NO: 3034254 - DNA, 15 bp, Homo sapiens
ctaaatttcttccta

SEQ ID NO: 3034255 - DNA, 16 bp, Homo sapiens
ctaaattttctgaaac

SEQ ID NO: 3034256 - DNA, 13 bp, Homo sapiens
ctaacaatgacat

SEQ ID NO: 3034257 - DNA, 15 bp, Homo sapiens
ctaacaccagacaga

SEQ ID NO: 3034258 - DNA, 23 bp, Homo sapiens
ctaacacggtgctcattttttct

SEQ ID NO: 3034259 - DNA, 16 bp, Homo sapiens
ctaacacttaccccat

SEQ ID NO: 3034260 - DNA, 23 bp, Homo sapiens
ctaacacttaccccatggctgca

SEQ ID NO: 3034261 - DNA, 18 bp, Homo sapiens
ctaacagtaccagtgtaa

SEQ ID NO: 3034262 - DNA, 17 bp, Homo sapiens
ctaacatgccctgttca

SEQ ID NO: 3034263 - DNA, 21 bp, Homo sapiens
ctaacatttttgataaagcct

SEQ ID NO: 3034264 - DNA, 21 bp, Homo sapiens
ctaaccaaggctgtgtttaga

SEQ ID NO: 3034265 - DNA, 13 bp, Homo sapiens
ctaacccctttcc

SEQ ID NO: 3034266 - DNA, 16 bp, Homo sapiens
ctaacccctttcctgc

SEQ ID NO: 3034267 - DNA, 23 bp, Homo sapiens
ctaaccctatactgtagtattct

SEQ ID NO: 3034268 - DNA, 19 bp, Homo sapiens
ctaacccttcaaccccctc

SEQ ID NO: 3034269 - DNA, 22 bp, Homo sapiens
ctaacctcaagtgatcctccca

SEQ ID NO: 3034270 - DNA, 12 bp, Homo sapiens
ctaacctgccga

SEQ ID NO: 3034271 - DNA, 14 bp, Homo sapiens
ctaacctgtgtctg

SEQ ID NO: 3034272 - DNA, 15 bp, Homo sapiens
ctaactagacaccaa

SEQ ID NO: 3034273 - DNA, 14 bp, Homo sapiens
ctaactccctcctc

SEQ ID NO: 3034274 - DNA, 15 bp, Homo sapiens
ctaactccctcctca

SEQ ID NO: 3034275 - DNA, 16 bp, Homo sapiens
ctaactccgagagcag

SEQ ID NO: 3034276 - DNA, 17 bp, Homo sapiens
ctaactgtaaatcatgt

SEQ ID NO: 3034277 - DNA, 18 bp, Homo sapiens
ctaactgtaaatcatgtt

SEQ ID NO: 3034278 - DNA, 16 bp, Homo sapiens
ctaagaaacttaaatt

SEQ ID NO: 3034279 - DNA, 16 bp, Homo sapiens
ctaagaacctggaact

SEQ ID NO: 3034280 - DNA, 18 bp, Homo sapiens
ctaagaatttcactgtct

SEQ ID NO: 3034281 - DNA, 23 bp, Homo sapiens
ctaagacatagtctctacctata

SEQ ID NO: 3034282 - DNA, 19 bp, Homo sapiens
ctaagactaatgctttctg

SEQ ID NO: 3034283 - DNA, 21 bp, Homo sapiens
ctaagactaatgctttctgtg

SEQ ID NO: 3034284 - DNA, 16 bp, Homo sapiens
ctaagactcaaatgtt

SEQ ID NO: 3034285 - DNA, 21 bp, Homo sapiens
ctaagactcaaatgttctaag

SEQ ID NO: 3034286 - DNA, 22 bp, Homo sapiens
ctaagactcaaatgttctaagt

SEQ ID NO: 3034287 - DNA, 17 bp, Homo sapiens
ctaagacttactctaag

SEQ ID NO: 3034288 - DNA, 19 bp, Homo sapiens
ctaagacttactctaagat

SEQ ID NO: 3034289 - DNA, 20 bp, Homo sapiens
ctaagacttcagtcctggtc

SEQ ID NO: 3034290 - DNA, 18 bp, Homo sapiens
ctaagagattctgatttg

SEQ ID NO: 3034291 - DNA, 18 bp, Homo sapiens
ctaagagctagcgctgcc

SEQ ID NO: 3034292 - DNA, 20 bp, Homo sapiens
ctaagaggttgctaatgcct

SEQ ID NO: 3034293 - DNA, 20 bp, Homo sapiens
ctaagatcttagattctctg

SEQ ID NO: 3034294 - DNA, 19 bp, Homo sapiens
ctaagatgacattgctaag

SEQ ID NO: 3034295 - DNA, 19 bp, Homo sapiens
ctaagatgtgatattctaa

SEQ ID NO: 3034296 - DNA, 23 bp, Homo sapiens
ctaagatgtgatattctaagact

SEQ ID NO: 3034297 - DNA, 12 bp, Homo sapiens
ctaagattctaa

SEQ ID NO: 3034298 - DNA, 13 bp, Homo sapiens
ctaagattctaaa

SEQ ID NO: 3034299 - DNA, 18 bp, Homo sapiens
ctaagattctaaaggtcc

SEQ ID NO: 3034300 - DNA, 22 bp, Homo sapiens
ctaagattctagatcagatgct

SEQ ID NO: 3034301 - DNA, 11 bp, Homo sapiens
ctaagattctg

SEQ ID NO: 3034302 - DNA, 12 bp, Homo sapiens
ctaagattctga

SEQ ID NO: 3034303 - DNA, 14 bp, Homo sapiens
ctaagcagaggagg

SEQ ID NO: 3034304 - DNA, 20 bp, Homo sapiens
ctaagcagaggaggggccgc

SEQ ID NO: 3034305 - DNA, 14 bp, Homo sapiens
ctaagcagccagga

SEQ ID NO: 3034306 - DNA, 15 bp, Homo sapiens
ctaagcatgtagcca

SEQ ID NO: 3034307 - DNA, 17 bp, Homo sapiens
ctaagccaagctgtgtt

SEQ ID NO: 3034308 - DNA, 11 bp, Homo sapiens
ctaagcctgtg

SEQ ID NO: 3034309 - DNA, 13 bp, Homo sapiens
ctaagctccagcc

SEQ ID NO: 3034310 - DNA, 14 bp, Homo sapiens
ctaagctccagccc

SEQ ID NO: 3034311 - DNA, 18 bp, Homo sapiens
ctaaggaagctaaaagca

SEQ ID NO: 3034312 - DNA, 20 bp, Homo sapiens
ctaaggaagtatcagcacta

SEQ ID NO: 3034313 - DNA, 19 bp, Homo sapiens
ctaaggacctgaaattcca

SEQ ID NO: 3034314 - DNA, 22 bp, Homo sapiens
ctaaggacctgaaattccaaag

SEQ ID NO: 3034315 - DNA, 23 bp, Homo sapiens
ctaaggagcgctagtgccttgcc

SEQ ID NO: 3034316 - DNA, 20 bp, Homo sapiens
ctaaggaggggaaaaaaatg

SEQ ID NO: 3034317 - DNA, 22 bp, Homo sapiens
ctaaggaggggaaaaaaatgtt

SEQ ID NO: 3034318 - DNA, 18 bp, Homo sapiens
ctaaggataatgaaataa

SEQ ID NO: 3034319 - DNA, 13 bp, Homo sapiens
ctaaggcctactt

SEQ ID NO: 3034320 - DNA, 14 bp, Homo sapiens
ctaaggcctaggat

SEQ ID NO: 3034321 - DNA, 20 bp, Homo sapiens
ctaaggcctaggattctaaa

SEQ ID NO: 3034322 - DNA, 20 bp, Homo sapiens
ctaaggctctgagagtctag

SEQ ID NO: 3034323 - DNA, 12 bp, Homo sapiens
ctaagggcagcc

SEQ ID NO: 3034324 - DNA, 12 bp, Homo sapiens
ctaaggggcccg

SEQ ID NO: 3034325 - DNA, 22 bp, Homo sapiens
ctaaggggcccggccagccatg

SEQ ID NO: 3034326 - DNA, 21 bp, Homo sapiens
ctaaggtccggtgttctaaga

SEQ ID NO: 3034327 - DNA, 14 bp, Homo sapiens
ctaaggtgactttc

SEQ ID NO: 3034328 - DNA, 19 bp, Homo sapiens
ctaaggtgactttctgaaa

SEQ ID NO: 3034329 - DNA, 12 bp, Homo sapiens
ctaaggttctaa

SEQ ID NO: 3034330 - DNA, 20 bp, Homo sapiens
ctaagtagctgggtttacag

SEQ ID NO: 3034331 - DNA, 16 bp, Homo sapiens
ctaagtcgcgagccag

SEQ ID NO: 3034332 - DNA, 15 bp, Homo sapiens
ctaagttaatttaaa

SEQ ID NO: 3034333 - DNA, 16 bp, Homo sapiens
ctaagttattttatga

SEQ ID NO: 3034334 - DNA, 23 bp, Homo sapiens
ctaagttattttatgacatgaaa

SEQ ID NO: 3034335 - DNA, 19 bp, Homo sapiens
ctaagtttcagttgatttt

SEQ ID NO: 3034336 - DNA, 20 bp, Homo sapiens
ctatattgatttaaaagtgt

SEQ ID NO: 3034337 - DNA, 14 bp, Homo sapiens
ctatattgcccagg

SEQ ID NO: 3034338 - DNA, 22 bp, Homo sapiens
ctatattgcccaggctggtctt

SEQ ID NO: 3034339 - DNA, 15 bp, Homo sapiens
ctatcaacaataaaa

SEQ ID NO: 3034340 - DNA, 19 bp, Homo sapiens
ctatcaagaggctgagaca

SEQ ID NO: 3034341 - DNA, 16 bp, Homo sapiens
ctatcacctatttcca

SEQ ID NO: 3034342 - DNA, 13 bp, Homo sapiens
ctatcactgacac

SEQ ID NO: 3034343 - DNA, 12 bp, Homo sapiens
ctatcaggcaga

SEQ ID NO: 3034344 - DNA, 19 bp, Homo sapiens
ctatcaggcagaagaatct

SEQ ID NO: 3034345 - DNA, 14 bp, Homo sapiens
ctatcattaaagtt

SEQ ID NO: 3034346 - DNA, 15 bp, Homo sapiens
ctatcattaaagttc

SEQ ID NO: 3034347 - DNA, 18 bp, Homo sapiens
ctatcattccctagaaca

SEQ ID NO: 3034348 - DNA, 20 bp, Homo sapiens
ctatcattgcttcctcctcc

SEQ ID NO: 3034349 - DNA, 20 bp, Homo sapiens
ctatcatttccgttttgcct

SEQ ID NO: 3034350 - DNA, 15 bp, Homo sapiens
ctatccaaaggaatc

SEQ ID NO: 3034351 - DNA, 15 bp, Homo sapiens
ctatccacactgtca

SEQ ID NO: 3034352 - DNA, 13 bp, Homo sapiens
ctatccacccagc

SEQ ID NO: 3034353 - DNA, 11 bp, Homo sapiens
ctatcctggcc

SEQ ID NO: 3034354 - DNA, 19 bp, Homo sapiens
ctatcgttattataaatgt

SEQ ID NO: 3034355 - DNA, 15 bp, Homo sapiens
ctatctactaagttt

SEQ ID NO: 3034356 - DNA, 14 bp, Homo sapiens
ctatctagatggat

SEQ ID NO: 3034357 - DNA, 15 bp, Homo sapiens
ctatctatcctgaat

SEQ ID NO: 3034358 - DNA, 14 bp, Homo sapiens
ctatctcagagata

SEQ ID NO: 3034359 - DNA, 15 bp, Homo sapiens
ctatctcagccatag

SEQ ID NO: 3034360 - DNA, 15 bp, Homo sapiens
ctatctcctagggct

SEQ ID NO: 3034361 - DNA, 22 bp, Homo sapiens
ctatctgcaatgtttttgtgta

SEQ ID NO: 3034362 - DNA, 14 bp, Homo sapiens
ctatcttaattttg

SEQ ID NO: 3034363 - DNA, 23 bp, Homo sapiens
ctatcttaattttggttgtattc

SEQ ID NO: 3034364 - DNA, 18 bp, Homo sapiens
ctatcttgctctgtaatc

SEQ ID NO: 3034365 - DNA, 18 bp, Homo sapiens
ctatgaaacctttttcct

SEQ ID NO: 3034366 - DNA, 21 bp, Homo sapiens
ctatgacctcgccctccacaa

SEQ ID NO: 3034367 - DNA, 16 bp, Homo sapiens
ctatgagtctagatgt

SEQ ID NO: 3034368 - DNA, 17 bp, Homo sapiens
ctatgagtctagatgtt

SEQ ID NO: 3034369 - DNA, 17 bp, Homo sapiens
ctatgataagattgaaa

SEQ ID NO: 3034370 - DNA, 21 bp, Homo sapiens
ctatgatgtttcttttgcaat

SEQ ID NO: 3034371 - DNA, 18 bp, Homo sapiens
ctatgcaaaatgtctgtt

SEQ ID NO: 3034372 - DNA, 18 bp, Homo sapiens
ctatgcacatatggactc

SEQ ID NO: 3034373 - DNA, 18 bp, Homo sapiens
ctatgcagaggcctgggg

SEQ ID NO: 3034374 - DNA, 19 bp, Homo sapiens
ctatgcatggtgccccagg

SEQ ID NO: 3034375 - DNA, 23 bp, Homo sapiens
ctatgcatggtgccccaggacca

SEQ ID NO: 3034376 - DNA, 21 bp, Homo sapiens
ctatgcccctagtaactgctg

SEQ ID NO: 3034377 - DNA, 22 bp, Homo sapiens
ctatgcccctagtaactgctgt

SEQ ID NO: 3034378 - DNA, 23 bp, Homo sapiens
ctatgcccctagtaactgctgtc

SEQ ID NO: 3034379 - DNA, 15 bp, Homo sapiens
ctatgccgtcttctg

SEQ ID NO: 3034380 - DNA, 14 bp, Homo sapiens
ctatgcctgtgtct

SEQ ID NO: 3034381 - DNA, 19 bp, Homo sapiens
ctatgctgcttttatatct

SEQ ID NO: 3034382 - DNA, 11 bp, Homo sapiens
ctatgctttga

SEQ ID NO: 3034383 - DNA, 18 bp, Homo sapiens
ctatggaatgtcagtgtt

SEQ ID NO: 3034384 - DNA, 14 bp, Homo sapiens
ctatggacaactta

SEQ ID NO: 3034385 - DNA, 17 bp, Homo sapiens
ctatggacaacttattt

SEQ ID NO: 3034386 - DNA, 14 bp, Homo sapiens
ctatggcagaaaaa

SEQ ID NO: 3034387 - DNA, 23 bp, Homo sapiens
ctatgggagagtgtcaaccagac

SEQ ID NO: 3034388 - DNA, 19 bp, Homo sapiens
ctatggtttgccattattt

SEQ ID NO: 3034389 - DNA, 11 bp, Homo sapiens
ctatggttttt

SEQ ID NO: 3034390 - DNA, 15 bp, Homo sapiens
ctatgtaactgcatt

SEQ ID NO: 3034391 - DNA, 19 bp, Homo sapiens
ctatgtaatgcttatgtgt

SEQ ID NO: 3034392 - DNA, 19 bp, Homo sapiens
ctatgtaggaaaaaaatag

SEQ ID NO: 3034393 - DNA, 14 bp, Homo sapiens
ctatgtctcaggag

SEQ ID NO: 3034394 - DNA, 11 bp, Homo sapiens
ctatgtgattt

SEQ ID NO: 3034395 - DNA, 19 bp, Homo sapiens
ctatgtgattttaactctg

SEQ ID NO: 3034396 - DNA, 21 bp, Homo sapiens
ctatgtgattttaactctgtc

SEQ ID NO: 3034397 - DNA, 17 bp, Homo sapiens
ctatgtgtgttgtttcc

SEQ ID NO: 3034398 - DNA, 19 bp, Homo sapiens
ctatgtgtttggtttataa

SEQ ID NO: 3034399 - DNA, 18 bp, Homo sapiens
ctatgttgcatgataaac

SEQ ID NO: 3034400 - DNA, 16 bp, Homo sapiens
ctatgtttctcagact

SEQ ID NO: 3034401 - DNA, 16 bp, Homo sapiens
ctatgttttaaaataa

SEQ ID NO: 3034402 - DNA, 20 bp, Homo sapiens
ctatgtttttgttcaaagcc

SEQ ID NO: 3034403 - DNA, 22 bp, Homo sapiens
ctatgtttttgttcaaagccag

SEQ ID NO: 3034404 - DNA, 20 bp, Homo sapiens
ctattaaagtgctaaggttc

SEQ ID NO: 3034405 - DNA, 23 bp, Homo sapiens
ctattaaagtgctaaggttctaa

SEQ ID NO: 3034406 - DNA, 22 bp, Homo sapiens
ctattaaagtggagaagcacac

SEQ ID NO: 3034407 - DNA, 15 bp, Homo sapiens
ctattaatagaacac

SEQ ID NO: 3034408 - DNA, 19 bp, Homo sapiens
ctattaatcacctctctgt

SEQ ID NO: 3034409 - DNA, 18 bp, Homo sapiens
ctattatactttatcaaa

SEQ ID NO: 3034410 - DNA, 18 bp, Homo sapiens
ctattatgttgttagaga

SEQ ID NO: 3034411 - DNA, 11 bp, Homo sapiens
ctattcacaac

SEQ ID NO: 3034412 - DNA, 23 bp, Homo sapiens
ctattcagaatcaaaccttttta

SEQ ID NO: 3034413 - DNA, 13 bp, Homo sapiens
ctattccatgttt

SEQ ID NO: 3034414 - DNA, 16 bp, Homo sapiens
ctattcccactttcat

SEQ ID NO: 3034415 - DNA, 17 bp, Homo sapiens
ctattcctgtaatgaaa

SEQ ID NO: 3034416 - DNA, 21 bp, Homo sapiens
ctattctctccaaaaatgcac

SEQ ID NO: 3034417 - DNA, 16 bp, Homo sapiens
ctattgacttcaatga

SEQ ID NO: 3034418 - DNA, 20 bp, Homo sapiens
ctattgcagcaattaaaaat

SEQ ID NO: 3034419 - DNA, 19 bp, Homo sapiens
ctattgccaggaatgtttc

SEQ ID NO: 3034420 - DNA, 13 bp, Homo sapiens
ctattggatttgt

SEQ ID NO: 3034421 - DNA, 22 bp, Homo sapiens
ctattggatttgtccaaacagg

SEQ ID NO: 3034422 - DNA, 15 bp, Homo sapiens
ctattgtaaatttgg

SEQ ID NO: 3034423 - DNA, 15 bp, Homo sapiens
ctattgtacgctaga

SEQ ID NO: 3034424 - DNA, 16 bp, Homo sapiens
ctattgtttagatatt

SEQ ID NO: 3034425 - DNA, 23 bp, Homo sapiens
ctatttaaaatgctcaatttcag

SEQ ID NO: 3034426 - DNA, 18 bp, Homo sapiens
ctatttaattaggaaaaa

SEQ ID NO: 3034427 - DNA, 18 bp, Homo sapiens
ctatttacttctaatctt

SEQ ID NO: 3034428 - DNA, 22 bp, Homo sapiens
ctatttcaggccctcagctgtc

SEQ ID NO: 3034429 - DNA, 14 bp, Homo sapiens
ctatttcagtactt

SEQ ID NO: 3034430 - DNA, 14 bp, Homo sapiens
ctatttcctttgcg

SEQ ID NO: 3034431 - DNA, 22 bp, Homo sapiens
ctatttcctttgcgcaaacttt

SEQ ID NO: 3034432 - DNA, 13 bp, Homo sapiens
ctatttcggcctt

SEQ ID NO: 3034433 - DNA, 21 bp, Homo sapiens
ctatttctatgtatgtgccaa

SEQ ID NO: 3034434 - DNA, 13 bp, Homo sapiens
ctatttctctgtg

SEQ ID NO: 3034435 - DNA, 14 bp, Homo sapiens
ctatttgaacaagt

SEQ ID NO: 3034436 - DNA, 16 bp, Homo sapiens
ctatttgacccccaca

SEQ ID NO: 3034437 - DNA, 15 bp, Homo sapiens
ctatttgtgactttt

SEQ ID NO: 3034438 - DNA, 17 bp, Homo sapiens
ctattttggattgtata

SEQ ID NO: 3034439 - DNA, 23 bp, Homo sapiens
ctatttttaaataatttcctaca

SEQ ID NO: 3034440 - DNA, 13 bp, Homo sapiens
ctatttttatcat

SEQ ID NO: 3034441 - DNA, 15 bp, Homo sapiens
ctatttttatcatga

SEQ ID NO: 3034442 - DNA, 23 bp, Homo sapiens
ctatttttatgatgacaatcaaa

SEQ ID NO: 3034443 - DNA, 16 bp, Homo sapiens
ctatttttctttccaa

SEQ ID NO: 3034444 - DNA, 13 bp, Homo sapiens
ctatttttgtgaa

SEQ ID NO: 3034445 - DNA, 15 bp, Homo sapiens
ctatttttgtgaaga

SEQ ID NO: 3034446 - DNA, 23 bp, Homo sapiens
ctcaaaaaaaaaatttttttcct

SEQ ID NO: 3034447 - DNA, 13 bp, Homo sapiens
ctcaaaaagcaga

SEQ ID NO: 3034448 - DNA, 17 bp, Homo sapiens
ctcaaaaagcagaagga

SEQ ID NO: 3034449 - DNA, 21 bp, Homo sapiens
ctcaaaactgtactgtcttta

SEQ ID NO: 3034450 - DNA, 21 bp, Homo sapiens
ctcaaactcctgacctcaggt

SEQ ID NO: 3034451 - DNA, 16 bp, Homo sapiens
ctcaaacttctggctc

SEQ ID NO: 3034452 - DNA, 16 bp, Homo sapiens
ctcaaagatgtaatgt

SEQ ID NO: 3034453 - DNA, 15 bp, Homo sapiens
ctcaaatctgaggga

SEQ ID NO: 3034454 - DNA, 22 bp, Homo sapiens
ctcaaatgctcagaccagctct

SEQ ID NO: 3034455 - DNA, 20 bp, Homo sapiens
ctcaaatggggccagatcca

SEQ ID NO: 3034456 - DNA, 15 bp, Homo sapiens
ctcaaatgttctaag

SEQ ID NO: 3034457 - DNA, 17 bp, Homo sapiens
ctcaaatgttttctgca

SEQ ID NO: 3034458 - DNA, 15 bp, Homo sapiens
ctcaacaacatcttt

SEQ ID NO: 3034459 - DNA, 24 bp, Homo sapiens
ctcaacagagaggaccaacatcca

SEQ ID NO: 3034460 - DNA, 15 bp, Homo sapiens
ctcaacatgagtcaa

SEQ ID NO: 3034461 - DNA, 20 bp, Homo sapiens
ctcaaccaaattaaaaattt

SEQ ID NO: 3034462 - DNA, 12 bp, Homo sapiens
ctcaacctcttc

SEQ ID NO: 3034463 - DNA, 18 bp, Homo sapiens
ctcaacctcttctggctc

SEQ ID NO: 3034464 - DNA, 15 bp, Homo sapiens
ctcaacgtattgttt

SEQ ID NO: 3034465 - DNA, 16 bp, Homo sapiens
ctcaacgtattgtttc

SEQ ID NO: 3034466 - DNA, 20 bp, Homo sapiens
ctcaactccaccctctgcga

SEQ ID NO: 3034467 - DNA, 21 bp, Homo sapiens
ctcaagaaataaaaggaagcc

SEQ ID NO: 3034468 - DNA, 18 bp, Homo sapiens
ctcataaacatttgagtt

SEQ ID NO: 3034469 - DNA, 16 bp, Homo sapiens
ctcataaattaatgat

SEQ ID NO: 3034470 - DNA, 13 bp, Homo sapiens
ctcataatgtgaa

SEQ ID NO: 3034471 - DNA, 20 bp, Homo sapiens
ctcataatgtgaaatatgat

SEQ ID NO: 3034472 - DNA, 14 bp, Homo sapiens
ctcataatgtgaag

SEQ ID NO: 3034473 - DNA, 22 bp, Homo sapiens
ctcatagtgaacacagcagacc

SEQ ID NO: 3034474 - DNA, 16 bp, Homo sapiens
ctcatatcactgaagg

SEQ ID NO: 3034475 - DNA, 14 bp, Homo sapiens
ctcatcacacacat

SEQ ID NO: 3034476 - DNA, 15 bp, Homo sapiens
ctcatcacacacatg

SEQ ID NO: 3034477 - DNA, 15 bp, Homo sapiens
ctcatcactgtggct

SEQ ID NO: 3034478 - DNA, 19 bp, Homo sapiens
ctcatcaggagttccagtg

SEQ ID NO: 3034479 - DNA, 15 bp, Homo sapiens
ctcatcattctctgt

SEQ ID NO: 3034480 - DNA, 18 bp, Homo sapiens
ctcatcattctctgtctc

SEQ ID NO: 3034481 - DNA, 19 bp, Homo sapiens
ctcatccatcatcatgtgt

SEQ ID NO: 3034482 - DNA, 12 bp, Homo sapiens
ctcatccatcca

SEQ ID NO: 3034483 - DNA, 22 bp, Homo sapiens
ctcatcccgagcacctccacat

SEQ ID NO: 3034484 - DNA, 13 bp, Homo sapiens
ctcatcctccagt

SEQ ID NO: 3034485 - DNA, 12 bp, Homo sapiens
ctcatcctcctc

SEQ ID NO: 3034486 - DNA, 13 bp, Homo sapiens
ctcatcctcctcc

SEQ ID NO: 3034487 - DNA, 14 bp, Homo sapiens
ctcatcctgcttct

SEQ ID NO: 3034488 - DNA, 15 bp, Homo sapiens
ctcatcctgcttctc

SEQ ID NO: 3034489 - DNA, 15 bp, Homo sapiens
ctcatctgagccagc

SEQ ID NO: 3034490 - DNA, 17 bp, Homo sapiens
ctcatctgcctggaaag

SEQ ID NO: 3034491 - DNA, 15 bp, Homo sapiens
ctcatctgtgcctgt

SEQ ID NO: 3034492 - DNA, 22 bp, Homo sapiens
ctcatctgtgcctgtctgtcca

SEQ ID NO: 3034493 - DNA, 13 bp, Homo sapiens
ctcatcttactgt

SEQ ID NO: 3034494 - DNA, 21 bp, Homo sapiens
ctcatcttcaaagtttttact

SEQ ID NO: 3034495 - DNA, 16 bp, Homo sapiens
ctcatctttcttccaa

SEQ ID NO: 3034496 - DNA, 23 bp, Homo sapiens
ctcatgatccacccacctcagcc

SEQ ID NO: 3034497 - DNA, 17 bp, Homo sapiens
ctcatgcccctggctgg

SEQ ID NO: 3034498 - DNA, 16 bp, Homo sapiens
ctcatgccccttgggg

SEQ ID NO: 3034499 - DNA, 13 bp, Homo sapiens
ctcatgcctctga

SEQ ID NO: 3034500 - DNA, 15 bp, Homo sapiens
ctcatgcctctgagc

SEQ ID NO: 3034501 - DNA, 20 bp, Homo sapiens
ctcatgcctctgagcttcta

SEQ ID NO: 3034502 - DNA, 12 bp, Homo sapiens
ctcatgctctga

SEQ ID NO: 3034503 - DNA, 15 bp, Homo sapiens
ctcatgctctgatta

SEQ ID NO: 3034504 - DNA, 17 bp, Homo sapiens
ctcatggcaggattcta

SEQ ID NO: 3034505 - DNA, 17 bp, Homo sapiens
ctcatgtccctatttat

SEQ ID NO: 3034506 - DNA, 14 bp, Homo sapiens
ctcatgtgactctt

SEQ ID NO: 3034507 - DNA, 18 bp, Homo sapiens
ctcatgtgactctttcca

SEQ ID NO: 3034508 - DNA, 9 bp, Homo sapiens
ctcatgtgt

SEQ ID NO: 3034509 - DNA, 13 bp, Homo sapiens
ctcatgtgtgtgg

SEQ ID NO: 3034510 - DNA, 21 bp, Homo sapiens
ctcatgttttccattgtttga

SEQ ID NO: 3034511 - DNA, 21 bp, Homo sapiens
ctcattaaatggtgatttctt

SEQ ID NO: 3034512 - DNA, 15 bp, Homo sapiens
ctcattcaaaagttg

SEQ ID NO: 3034513 - DNA, 19 bp, Homo sapiens
ctcattcaaaagttgaaat

SEQ ID NO: 3034514 - DNA, 22 bp, Homo sapiens
ctcattcaggaaaactgacaga

SEQ ID NO: 3034515 - DNA, 21 bp, Homo sapiens
ctcattcattttatattgaaa

SEQ ID NO: 3034516 - DNA, 22 bp, Homo sapiens
ctcattcattttatattgaaaa

SEQ ID NO: 3034517 - DNA, 18 bp, Homo sapiens
ctcattccacactgttga

SEQ ID NO: 3034518 - DNA, 17 bp, Homo sapiens
ctcattccactgttggt

SEQ ID NO: 3034519 - DNA, 12 bp, Homo sapiens
ctcattccccag

SEQ ID NO: 3034520 - DNA, 18 bp, Homo sapiens
ctcattccctccccagaa

SEQ ID NO: 3034521 - DNA, 11 bp, Homo sapiens
ctcattctgaa

SEQ ID NO: 3034522 - DNA, 17 bp, Homo sapiens
ctcattctgaaggagcc

SEQ ID NO: 3034523 - DNA, 18 bp, Homo sapiens
ctcattgctgagcctctg

SEQ ID NO: 3034524 - DNA, 20 bp, Homo sapiens
ctcattgctgagcctctgct

SEQ ID NO: 3034525 - DNA, 21 bp, Homo sapiens
ctcattgctgcccgtttgtac

SEQ ID NO: 3034526 - DNA, 20 bp, Homo sapiens
ctcattgcttggaattcagc

SEQ ID NO: 3034527 - DNA, 18 bp, Homo sapiens
ctcattggacccttccat

SEQ ID NO: 3034528 - DNA, 15 bp, Homo sapiens
ctcatttagaaacaa

SEQ ID NO: 3034529 - DNA, 20 bp, Homo sapiens
ctcatttgcttttgtcacta

SEQ ID NO: 3034530 - DNA, 22 bp, Homo sapiens
ctcatttggtttgattttccct

SEQ ID NO: 3034531 - DNA, 22 bp, Homo sapiens
ctccaaaggaagtctaggagct

SEQ ID NO: 3034532 - DNA, 21 bp, Homo sapiens
ctccaaagtaatgtagcatga

SEQ ID NO: 3034533 - DNA, 15 bp, Homo sapiens
ctccaacaccaagca

SEQ ID NO: 3034534 - DNA, 14 bp, Homo sapiens
ctccaacctaacct

SEQ ID NO: 3034535 - DNA, 15 bp, Homo sapiens
ctccaacctaacctg

SEQ ID NO: 3034536 - DNA, 20 bp, Homo sapiens
ctccaacctaacctgtgtct

SEQ ID NO: 3034537 - DNA, 22 bp, Homo sapiens
ctccaacctaacctgtgtctgc

SEQ ID NO: 3034538 - DNA, 13 bp, Homo sapiens
ctccaacctctcg

SEQ ID NO: 3034539 - DNA, 14 bp, Homo sapiens
ctccaacctctcgg

SEQ ID NO: 3034540 - DNA, 15 bp, Homo sapiens
ctccaacctgaaggt

SEQ ID NO: 3034541 - DNA, 21 bp, Homo sapiens
ctccaagaatggaagcctgaa

SEQ ID NO: 3034542 - DNA, 23 bp, Homo sapiens
ctccaagcccagttcagcttggg

SEQ ID NO: 3034543 - DNA, 22 bp, Homo sapiens
ctccaagccccctggcagctgc

SEQ ID NO: 3034544 - DNA, 11 bp, Homo sapiens
ctccaagctgt

SEQ ID NO: 3034545 - DNA, 14 bp, Homo sapiens
ctccaagctgttaa

SEQ ID NO: 3034546 - DNA, 12 bp, Homo sapiens
ctccaatcctcc

SEQ ID NO: 3034547 - DNA, 13 bp, Homo sapiens
ctccaatcctccc

SEQ ID NO: 3034548 - DNA, 11 bp, Homo sapiens
ctccaatgtcg

SEQ ID NO: 3034549 - DNA, 21 bp, Homo sapiens
ctccacaaagcaaaggcagtc

SEQ ID NO: 3034550 - DNA, 22 bp, Homo sapiens
ctccacactgaccaagtgctgg

SEQ ID NO: 3034551 - DNA, 13 bp, Homo sapiens
ctccaccaaccca

SEQ ID NO: 3034552 - DNA, 22 bp, Homo sapiens
ctccaccaaccccgcggcccag

SEQ ID NO: 3034553 - DNA, 19 bp, Homo sapiens
ctccaccaccgcccgtctg

SEQ ID NO: 3034554 - DNA, 22 bp, Homo sapiens
ctccaccaccgcccgtctgtgt

SEQ ID NO: 3034555 - DNA, 20 bp, Homo sapiens
ctccacccaaaccccttccc

SEQ ID NO: 3034556 - DNA, 18 bp, Homo sapiens
ctccacccccaccactct

SEQ ID NO: 3034557 - DNA, 22 bp, Homo sapiens
ctccacccgttcccactgccct

SEQ ID NO: 3034558 - DNA, 14 bp, Homo sapiens
ctccaccgctgcct

SEQ ID NO: 3034559 - DNA, 13 bp, Homo sapiens
ctccacctcagcc

SEQ ID NO: 3034560 - DNA, 16 bp, Homo sapiens
ctccacctcagccttg

SEQ ID NO: 3034561 - DNA, 14 bp, Homo sapiens
ctccaccttcccac

SEQ ID NO: 3034562 - DNA, 17 bp, Homo sapiens
ctccacgccactgcctc

SEQ ID NO: 3034563 - DNA, 15 bp, Homo sapiens
ctccacgttctgctc

SEQ ID NO: 3034564 - DNA, 17 bp, Homo sapiens
ctccacgttctgctcat

SEQ ID NO: 3034565 - DNA, 18 bp, Homo sapiens
ctccacgttctgctcatc

SEQ ID NO: 3034566 - DNA, 20 bp, Homo sapiens
ctccacgttctgctcatcat

SEQ ID NO: 3034567 - DNA, 13 bp, Homo sapiens
ctccactcctctc

SEQ ID NO: 3034568 - DNA, 15 bp, Homo sapiens
ctccactcctctcaa

SEQ ID NO: 3034569 - DNA, 19 bp, Homo sapiens
ctccacttctggtcccctg

SEQ ID NO: 3034570 - DNA, 20 bp, Homo sapiens
ctccacttctggtcccctgt

SEQ ID NO: 3034571 - DNA, 13 bp, Homo sapiens
ctccagaagaaaa

SEQ ID NO: 3034572 - DNA, 16 bp, Homo sapiens
ctccagaagcactggg

SEQ ID NO: 3034573 - DNA, 20 bp, Homo sapiens
ctccagaagcactgggatca

SEQ ID NO: 3034574 - DNA, 12 bp, Homo sapiens
ctccagaagcct

SEQ ID NO: 3034575 - DNA, 18 bp, Homo sapiens
ctccagaatgtgctgcct

SEQ ID NO: 3034576 - DNA, 21 bp, Homo sapiens
ctccagaattacccttcctca

SEQ ID NO: 3034577 - DNA, 23 bp, Homo sapiens
ctccagaattacccttcctcatc

SEQ ID NO: 3034578 - DNA, 12 bp, Homo sapiens
ctccagacctga

SEQ ID NO: 3034579 - DNA, 18 bp, Homo sapiens
ctccagagacaggaaaga

SEQ ID NO: 3034580 - DNA, 20 bp, Homo sapiens
ctccagagacaggaaagaat

SEQ ID NO: 3034581 - DNA, 13 bp, Homo sapiens
ctccagagggcac

SEQ ID NO: 3034582 - DNA, 20 bp, Homo sapiens
ctccagaggggctcaggtca

SEQ ID NO: 3034583 - DNA, 20 bp, Homo sapiens
ctccagagtggggatgacat

SEQ ID NO: 3034584 - DNA, 23 bp, Homo sapiens
ctccagatatgaacagggcccag

SEQ ID NO: 3034585 - DNA, 16 bp, Homo sapiens
ctccagatgcagggca

SEQ ID NO: 3034586 - DNA, 18 bp, Homo sapiens
ctccagatgcagggcagt

SEQ ID NO: 3034587 - DNA, 22 bp, Homo sapiens
ctccagcaagcaaacagggtgg

SEQ ID NO: 3034588 - DNA, 16 bp, Homo sapiens
ctccagcacaaacaca

SEQ ID NO: 3034589 - DNA, 18 bp, Homo sapiens
ctccagcattctcagcca

SEQ ID NO: 3034590 - DNA, 20 bp, Homo sapiens
ctccagcattctcagccaca

SEQ ID NO: 3034591 - DNA, 22 bp, Homo sapiens
ctccagcattctcagccacaac

SEQ ID NO: 3034592 - DNA, 23 bp, Homo sapiens
ctccagccatcaagagactgagt

SEQ ID NO: 3034593 - DNA, 17 bp, Homo sapiens
ctccagcccctttccaa

SEQ ID NO: 3034594 - DNA, 21 bp, Homo sapiens
ctccagcccgagtggtctcct

SEQ ID NO: 3034595 - DNA, 21 bp, Homo sapiens
ctccagccctgcccaccctcc

SEQ ID NO: 3034596 - DNA, 20 bp, Homo sapiens
ctccagcctcacagatgctg

SEQ ID NO: 3034597 - DNA, 17 bp, Homo sapiens
ctccagcgatggtgctg

SEQ ID NO: 3034598 - DNA, 23 bp, Homo sapiens
ctccagcgatggtgctgcccagg

SEQ ID NO: 3034599 - DNA, 23 bp, Homo sapiens
ctccagcggttgccttttttatc

SEQ ID NO: 3034600 - DNA, 23 bp, Homo sapiens
ctcgacgtttacaagccccccct

SEQ ID NO: 3034601 - DNA, 22 bp, Homo sapiens
ctcgactgagctttagacagca

SEQ ID NO: 3034602 - DNA, 20 bp, Homo sapiens
ctcgaggactgtatttgtga

SEQ ID NO: 3034603 - DNA, 13 bp, Homo sapiens
ctcgagggccgcc

SEQ ID NO: 3034604 - DNA, 13 bp, Homo sapiens
ctcgaggtgcctt

SEQ ID NO: 3034605 - DNA, 15 bp, Homo sapiens
ctcgaggtgccttct

SEQ ID NO: 3034606 - DNA, 20 bp, Homo sapiens
ctcgagtactgtgggcaatt

SEQ ID NO: 3034607 - DNA, 15 bp, Homo sapiens
ctcgatgcctttgct

SEQ ID NO: 3034608 - DNA, 16 bp, Homo sapiens
ctcgatgctgctggcc

SEQ ID NO: 3034609 - DNA, 17 bp, Homo sapiens
ctcgcacctgtgctgga

SEQ ID NO: 3034610 - DNA, 20 bp, Homo sapiens
ctcgcacttgcagaggagcc

SEQ ID NO: 3034611 - DNA, 15 bp, Homo sapiens
ctcgcaggaccaagg

SEQ ID NO: 3034612 - DNA, 16 bp, Homo sapiens
ctcgcatcattgcaga

SEQ ID NO: 3034613 - DNA, 15 bp, Homo sapiens
ctcgcatccagacag

SEQ ID NO: 3034614 - DNA, 19 bp, Homo sapiens
ctcgccatttcctcacgtg

SEQ ID NO: 3034615 - DNA, 15 bp, Homo sapiens
ctcgcccatcagtgc

SEQ ID NO: 3034616 - DNA, 21 bp, Homo sapiens
ctcgcccatcagtgccagccc

SEQ ID NO: 3034617 - DNA, 19 bp, Homo sapiens
ctcgcccccacttttctag

SEQ ID NO: 3034618 - DNA, 13 bp, Homo sapiens
ctcgccctgggtc

SEQ ID NO: 3034619 - DNA, 15 bp, Homo sapiens
ctcgccctgggtcta

SEQ ID NO: 3034620 - DNA, 13 bp, Homo sapiens
ctcgccctgtttg

SEQ ID NO: 3034621 - DNA, 17 bp, Homo sapiens
ctcgcctcagcctgatc

SEQ ID NO: 3034622 - DNA, 16 bp, Homo sapiens
ctcgcctgccctcctc

SEQ ID NO: 3034623 - DNA, 18 bp, Homo sapiens
ctcgcctgccctcctctc

SEQ ID NO: 3034624 - DNA, 19 bp, Homo sapiens
ctcgcctgccctcctctcc

SEQ ID NO: 3034625 - DNA, 14 bp, Homo sapiens
ctcgcctggaaaca

SEQ ID NO: 3034626 - DNA, 18 bp, Homo sapiens
ctcgcctggaaacagagg

SEQ ID NO: 3034627 - DNA, 15 bp, Homo sapiens
ctcgccttcctgcag

SEQ ID NO: 3034628 - DNA, 16 bp, Homo sapiens
ctcgccttcctgcagt

SEQ ID NO: 3034629 - DNA, 18 bp, Homo sapiens
ctcgctccctcccaggac

SEQ ID NO: 3034630 - DNA, 19 bp, Homo sapiens
ctcgctgccagctctgtat

SEQ ID NO: 3034631 - DNA, 19 bp, Homo sapiens
ctcgctggactctcagtct

SEQ ID NO: 3034632 - DNA, 18 bp, Homo sapiens
ctcgctgtcctttctaga

SEQ ID NO: 3034633 - DNA, 22 bp, Homo sapiens
ctcgcttggacggctgggcaca

SEQ ID NO: 3034634 - DNA, 16 bp, Homo sapiens
ctcggagctggcccag

SEQ ID NO: 3034635 - DNA, 15 bp, Homo sapiens
ctcggaggctcctcc

SEQ ID NO: 3034636 - DNA, 16 bp, Homo sapiens
ctcggaggctcctccc

SEQ ID NO: 3034637 - DNA, 21 bp, Homo sapiens
ctcggatgaccatactcagac

SEQ ID NO: 3034638 - DNA, 18 bp, Homo sapiens
ctcggcagaactctctgt

SEQ ID NO: 3034639 - DNA, 19 bp, Homo sapiens
ctcggcagaactctctgtc

SEQ ID NO: 3034640 - DNA, 20 bp, Homo sapiens
ctcggcagaactctctgtct

SEQ ID NO: 3034641 - DNA, 16 bp, Homo sapiens
ctcggcaggaaggagc

SEQ ID NO: 3034642 - DNA, 15 bp, Homo sapiens
ctcggcccagggccg

SEQ ID NO: 3034643 - DNA, 15 bp, Homo sapiens
ctcggcccatctgtc

SEQ ID NO: 3034644 - DNA, 16 bp, Homo sapiens
ctcggcccatctgtcc

SEQ ID NO: 3034645 - DNA, 15 bp, Homo sapiens
ctcggccccatcgcc

SEQ ID NO: 3034646 - DNA, 22 bp, Homo sapiens
ctcggccccatcgccccaccgc

SEQ ID NO: 3034647 - DNA, 15 bp, Homo sapiens
ctcggcccctcccac

SEQ ID NO: 3034648 - DNA, 17 bp, Homo sapiens
ctcggccgcagcggcgt

SEQ ID NO: 3034649 - DNA, 18 bp, Homo sapiens
ctcggcctcccaaagtgc

SEQ ID NO: 3034650 - DNA, 22 bp, Homo sapiens
ctcggctcagtgcaacctctgc

SEQ ID NO: 3034651 - DNA, 23 bp, Homo sapiens
ctcggctcagtgcaacctctgct

SEQ ID NO: 3034652 - DNA, 21 bp, Homo sapiens
ctcggcttggatcctgggctg

SEQ ID NO: 3034653 - DNA, 18 bp, Homo sapiens
ctcggcttttctcagctg

SEQ ID NO: 3034654 - DNA, 14 bp, Homo sapiens
ctcgggggcctgtg

SEQ ID NO: 3034655 - DNA, 16 bp, Homo sapiens
ctcgggggcctgtggt

SEQ ID NO: 3034656 - DNA, 14 bp, Homo sapiens
ctcggggtgggggt

SEQ ID NO: 3034657 - DNA, 16 bp, Homo sapiens
ctcgggtgggggagcc

SEQ ID NO: 3034658 - DNA, 15 bp, Homo sapiens
ctcggttgaaacctg

SEQ ID NO: 3034659 - DNA, 23 bp, Homo sapiens
ctcggtttcccatttgttgctgc

SEQ ID NO: 3034660 - DNA, 22 bp, Homo sapiens
ctcggtttgccaaaattcattt

SEQ ID NO: 3034661 - DNA, 18 bp, Homo sapiens
ctcgtcaatccatcagca

SEQ ID NO: 3034662 - DNA, 16 bp, Homo sapiens
ctcgtcaggctgccag

SEQ ID NO: 3034663 - DNA, 14 bp, Homo sapiens
ctcgtcctccccct

SEQ ID NO: 3034664 - DNA, 16 bp, Homo sapiens
ctcgtcctccccctgc

SEQ ID NO: 3034665 - DNA, 19 bp, Homo sapiens
ctcgtctcttgtgactcag

SEQ ID NO: 3034666 - DNA, 12 bp, Homo sapiens
ctcgtgccagca

SEQ ID NO: 3034667 - DNA, 14 bp, Homo sapiens
ctcgtgccagcagc

SEQ ID NO: 3034668 - DNA, 19 bp, Homo sapiens
ctcgtgccagcagcctcgc

SEQ ID NO: 3034669 - DNA, 20 bp, Homo sapiens
ctcgtgccagcagcctcgca

SEQ ID NO: 3034670 - DNA, 21 bp, Homo sapiens
ctcgtgccagcagcctcgcac

SEQ ID NO: 3034671 - DNA, 22 bp, Homo sapiens
ctcgtgccagcagcctcgcaca

SEQ ID NO: 3034672 - DNA, 19 bp, Homo sapiens
ctcgttacttcagcccatg

SEQ ID NO: 3034673 - DNA, 19 bp, Homo sapiens
ctcgttccggtccccacag

SEQ ID NO: 3034674 - DNA, 19 bp, Homo sapiens
ctcgttgcagtctgtattt

SEQ ID NO: 3034675 - DNA, 20 bp, Homo sapiens
ctcgttgccctaattcatct

SEQ ID NO: 3034676 - DNA, 19 bp, Homo sapiens
ctcgttgcctctgattttc

SEQ ID NO: 3034677 - DNA, 12 bp, Homo sapiens
ctcgtttgatag

SEQ ID NO: 3034678 - DNA, 19 bp, Homo sapiens
ctctaaaacagattgcttt

SEQ ID NO: 3034679 - DNA, 17 bp, Homo sapiens
ctctaaagccaagcact

SEQ ID NO: 3034680 - DNA, 19 bp, Homo sapiens
ctctaaagccaagcacttt

SEQ ID NO: 3034681 - DNA, 14 bp, Homo sapiens
ctctaactccctcc

SEQ ID NO: 3034682 - DNA, 16 bp, Homo sapiens
ctctaactccctcctc

SEQ ID NO: 3034683 - DNA, 21 bp, Homo sapiens
ctctaactccctcctcacact

SEQ ID NO: 3034684 - DNA, 19 bp, Homo sapiens
ctctaagatcttagattct

SEQ ID NO: 3034685 - DNA, 22 bp, Homo sapiens
ctctaagatcttagattctctg

SEQ ID NO: 3034686 - DNA, 20 bp, Homo sapiens
ctctaagcagccaggaggga

SEQ ID NO: 3034687 - DNA, 15 bp, Homo sapiens
ctctaatatcagcaa

SEQ ID NO: 3034688 - DNA, 18 bp, Homo sapiens
ctctaattctattaaagt

SEQ ID NO: 3034689 - DNA, 19 bp, Homo sapiens
ctctacatggactcagaga

SEQ ID NO: 3034690 - DNA, 12 bp, Homo sapiens
ctctacatttaa

SEQ ID NO: 3034691 - DNA, 22 bp, Homo sapiens
ctctaccagtgcaggctggcca

SEQ ID NO: 3034692 - DNA, 14 bp, Homo sapiens
ctctacccagggcc

SEQ ID NO: 3034693 - DNA, 16 bp, Homo sapiens
ctctacctctctcctc

SEQ ID NO: 3034694 - DNA, 12 bp, Homo sapiens
ctctacctgaca

SEQ ID NO: 3034695 - DNA, 20 bp, Homo sapiens
ctctacgtttaggcacccct

SEQ ID NO: 3034696 - DNA, 19 bp, Homo sapiens
ctctactaaaaataccaaa

SEQ ID NO: 3034697 - DNA, 21 bp, Homo sapiens
ctctactaacaatcagctcct

SEQ ID NO: 3034698 - DNA, 13 bp, Homo sapiens
ctctacttcagga

SEQ ID NO: 3034699 - DNA, 15 bp, Homo sapiens
ctctactttgattct

SEQ ID NO: 3034700 - DNA, 12 bp, Homo sapiens
ctctagaatctg

SEQ ID NO: 3034701 - DNA, 16 bp, Homo sapiens
ctctagagtccaaggt

SEQ ID NO: 3034702 - DNA, 16 bp, Homo sapiens
ctctagcaaggctcat

SEQ ID NO: 3034703 - DNA, 20 bp, Homo sapiens
ctctagctgggggtgggcca

SEQ ID NO: 3034704 - DNA, 16 bp, Homo sapiens
ctctaggctctgcctt

SEQ ID NO: 3034705 - DNA, 21 bp, Homo sapiens
ctctagggcagggtgggagcc

SEQ ID NO: 3034706 - DNA, 18 bp, Homo sapiens
ctctagtagttaaaaaaa

SEQ ID NO: 3034707 - DNA, 13 bp, Homo sapiens
ctctagtccctgt

SEQ ID NO: 3034708 - DNA, 16 bp, Homo sapiens
ctctagtgccttctaa

SEQ ID NO: 3034709 - DNA, 16 bp, Homo sapiens
ctctataactttttct

SEQ ID NO: 3034710 - DNA, 21 bp, Homo sapiens
ctctatactgccctgagttgg

SEQ ID NO: 3034711 - DNA, 15 bp, Homo sapiens
ctctatcattaaagt

SEQ ID NO: 3034712 - DNA, 16 bp, Homo sapiens
ctctatcattaaagtt

SEQ ID NO: 3034713 - DNA, 18 bp, Homo sapiens
ctctatcattaaagttct

SEQ ID NO: 3034714 - DNA, 16 bp, Homo sapiens
ctctatcttgctctgt

SEQ ID NO: 3034715 - DNA, 13 bp, Homo sapiens
ctctatgagtcta

SEQ ID NO: 3034716 - DNA, 13 bp, Homo sapiens
ctctattgtaatt

SEQ ID NO: 3034717 - DNA, 16 bp, Homo sapiens
ctctatttatgtttgc

SEQ ID NO: 3034718 - DNA, 19 bp, Homo sapiens
ctctcaaacggcaacattc

SEQ ID NO: 3034719 - DNA, 12 bp, Homo sapiens
ctctcactttgg

SEQ ID NO: 3034720 - DNA, 13 bp, Homo sapiens
ctctcagccccat

SEQ ID NO: 3034721 - DNA, 18 bp, Homo sapiens
ctctcagccccatcgccc

SEQ ID NO: 3034722 - DNA, 13 bp, Homo sapiens
ctctcaggagcca

SEQ ID NO: 3034723 - DNA, 14 bp, Homo sapiens
ctctcaggagccat

SEQ ID NO: 3034724 - DNA, 13 bp, Homo sapiens
ctctcaggatcca

SEQ ID NO: 3034725 - DNA, 21 bp, Homo sapiens
ctctcaggctgtcccaagctc

SEQ ID NO: 3034726 - DNA, 18 bp, Homo sapiens
ctctcagtactttggagg

SEQ ID NO: 3034727 - DNA, 19 bp, Homo sapiens
ctctcagtactttggaggc

SEQ ID NO: 3034728 - DNA, 16 bp, Homo sapiens
ctctcagtctctgagc

SEQ ID NO: 3034729 - DNA, 18 bp, Homo sapiens
ctctcagtgccttctctc

SEQ ID NO: 3034730 - DNA, 20 bp, Homo sapiens
ctctcagtgccttctctcag

SEQ ID NO: 3034731 - DNA, 13 bp, Homo sapiens
ctctcagtgtttt

SEQ ID NO: 3034732 - DNA, 22 bp, Homo sapiens
ctctcagtgttttggactccat

SEQ ID NO: 3034733 - DNA, 15 bp, Homo sapiens
ctgaagcccagacct

SEQ ID NO: 3034734 - DNA, 21 bp, Homo sapiens
ctgaagccctcccaggtgtta

SEQ ID NO: 3034735 - DNA, 19 bp, Homo sapiens
ctgaagcctttcttttgga

SEQ ID NO: 3034736 - DNA, 16 bp, Homo sapiens
ctgaagcgaacatctt

SEQ ID NO: 3034737 - DNA, 23 bp, Homo sapiens
ctgaagcgaacatcttcatataa

SEQ ID NO: 3034738 - DNA, 14 bp, Homo sapiens
ctgaagcggtcaga

SEQ ID NO: 3034739 - DNA, 17 bp, Homo sapiens
ctgaagcggtcagactg

SEQ ID NO: 3034740 - DNA, 18 bp, Homo sapiens
ctgaagcggtcagactgg

SEQ ID NO: 3034741 - DNA, 20 bp, Homo sapiens
ctgaagctgacgaacttcca

SEQ ID NO: 3034742 - DNA, 12 bp, Homo sapiens
ctgaagctgctg

SEQ ID NO: 3034743 - DNA, 22 bp, Homo sapiens
ctgaagctgctgcagccctgcc

SEQ ID NO: 3034744 - DNA, 14 bp, Homo sapiens
ctgaagctgctgga

SEQ ID NO: 3034745 - DNA, 18 bp, Homo sapiens
ctgaagcttatgtttctt

SEQ ID NO: 3034746 - DNA, 13 bp, Homo sapiens
ctgaaggagcccc

SEQ ID NO: 3034747 - DNA, 14 bp, Homo sapiens
ctgaaggctttgtg

SEQ ID NO: 3034748 - DNA, 17 bp, Homo sapiens
ctgaaggtcccctggca

SEQ ID NO: 3034749 - DNA, 16 bp, Homo sapiens
ctgaagtcttgcattg

SEQ ID NO: 3034750 - DNA, 19 bp, Homo sapiens
ctgaagtcttgcattgaat

SEQ ID NO: 3034751 - DNA, 21 bp, Homo sapiens
ctgaagtcttgcattgaattt

SEQ ID NO: 3034752 - DNA, 14 bp, Homo sapiens
ctgaagttcaccat

SEQ ID NO: 3034753 - DNA, 11 bp, Homo sapiens
ctgaagttttt

SEQ ID NO: 3034754 - DNA, 18 bp, Homo sapiens
ctgaagtttttgaaatac

SEQ ID NO: 3034755 - DNA, 12 bp, Homo sapiens
ctgaataaacca

SEQ ID NO: 3034756 - DNA, 17 bp, Homo sapiens
ctgaataaaccaagaca

SEQ ID NO: 3034757 - DNA, 14 bp, Homo sapiens
ctgaataaagggaa

SEQ ID NO: 3034758 - DNA, 19 bp, Homo sapiens
ctgaatacttgaagtagga

SEQ ID NO: 3034759 - DNA, 14 bp, Homo sapiens
ctgaatattaagaa

SEQ ID NO: 3034760 - DNA, 20 bp, Homo sapiens
ctgaatattaagaaacaatt

SEQ ID NO: 3034761 - DNA, 18 bp, Homo sapiens
ctgaatattttttgaggc

SEQ ID NO: 3034762 - DNA, 18 bp, Homo sapiens
ctgaatcaggaaactcaa

SEQ ID NO: 3034763 - DNA, 17 bp, Homo sapiens
ctgaatgaaaataactg

SEQ ID NO: 3034764 - DNA, 18 bp, Homo sapiens
ctgaatgaaaataactga

SEQ ID NO: 3034765 - DNA, 22 bp, Homo sapiens
ctgaatgaaaataactgaacca

SEQ ID NO: 3034766 - DNA, 19 bp, Homo sapiens
ctgaatgagacttaatttt

SEQ ID NO: 3034767 - DNA, 16 bp, Homo sapiens
ctgaatgatcctgtct

SEQ ID NO: 3034768 - DNA, 18 bp, Homo sapiens
ctgaatgatcctgtctct

SEQ ID NO: 3034769 - DNA, 15 bp, Homo sapiens
ctgaatggctttgtc

SEQ ID NO: 3034770 - DNA, 19 bp, Homo sapiens
ctgaatggctttgtcttga

SEQ ID NO: 3034771 - DNA, 21 bp, Homo sapiens
ctgaatggctttgtcttgaaa

SEQ ID NO: 3034772 - DNA, 15 bp, Homo sapiens
ctgaatgtcattatt

SEQ ID NO: 3034773 - DNA, 19 bp, Homo sapiens
ctgaatgttgggactgcta

SEQ ID NO: 3034774 - DNA, 15 bp, Homo sapiens
ctgaatgtttgtgtc

SEQ ID NO: 3034775 - DNA, 18 bp, Homo sapiens
ctgaatgtttgtgtctgt

SEQ ID NO: 3034776 - DNA, 20 bp, Homo sapiens
ctgaatgtttgtgtctgtgg

SEQ ID NO: 3034777 - DNA, 23 bp, Homo sapiens
ctgaattgacatgaccctctgtc

SEQ ID NO: 3034778 - DNA, 14 bp, Homo sapiens
ctgaatttcaaaca

SEQ ID NO: 3034779 - DNA, 13 bp, Homo sapiens
ctgaatttcttct

SEQ ID NO: 3034780 - DNA, 15 bp, Homo sapiens
ctgaatttctttgat

SEQ ID NO: 3034781 - DNA, 18 bp, Homo sapiens
ctgaatttctttgattta

SEQ ID NO: 3034782 - DNA, 13 bp, Homo sapiens
ctgaatttgcaaa

SEQ ID NO: 3034783 - DNA, 15 bp, Homo sapiens
ctgaatttgcaaagt

SEQ ID NO: 3034784 - DNA, 19 bp, Homo sapiens
ctgaatttgcaaagtactg

SEQ ID NO: 3034785 - DNA, 16 bp, Homo sapiens
ctgaatttgccctggg

SEQ ID NO: 3034786 - DNA, 18 bp, Homo sapiens
ctgaatttgccctgggaa

SEQ ID NO: 3034787 - DNA, 20 bp, Homo sapiens
ctgaatttgtatatgactgc

SEQ ID NO: 3034788 - DNA, 15 bp, Homo sapiens
ctgacaacgtctctt

SEQ ID NO: 3034789 - DNA, 22 bp, Homo sapiens
ctgacaatggtgttatttgaaa

SEQ ID NO: 3034790 - DNA, 16 bp, Homo sapiens
ctgacaatgtattttg

SEQ ID NO: 3034791 - DNA, 16 bp, Homo sapiens
ctgacacatcagcatg

SEQ ID NO: 3034792 - DNA, 19 bp, Homo sapiens
ctgacacatcagcatgttt

SEQ ID NO: 3034793 - DNA, 14 bp, Homo sapiens
ctgacactcccacc

SEQ ID NO: 3034794 - DNA, 16 bp, Homo sapiens
ctgacacttcaaggtg

SEQ ID NO: 3034795 - DNA, 17 bp, Homo sapiens
ctgacagcagcctgtga

SEQ ID NO: 3034796 - DNA, 19 bp, Homo sapiens
ctgacagctgtccctgccc

SEQ ID NO: 3034797 - DNA, 15 bp, Homo sapiens
ctgacaggcagcctg

SEQ ID NO: 3034798 - DNA, 23 bp, Homo sapiens
ctgacaggcagcctggacataga

SEQ ID NO: 3034799 - DNA, 21 bp, Homo sapiens
ctgacagggacatgccctgtg

SEQ ID NO: 3034800 - DNA, 22 bp, Homo sapiens
ctgacagggacatgccctgtgt

SEQ ID NO: 3034801 - DNA, 16 bp, Homo sapiens
ctgacagtttttctgt

SEQ ID NO: 3034802 - DNA, 16 bp, Homo sapiens
ctgacattcacctgcc

SEQ ID NO: 3034803 - DNA, 23 bp, Homo sapiens
ctgacattcacctgccccaactc

SEQ ID NO: 3034804 - DNA, 19 bp, Homo sapiens
ctgacattctcaggaagcc

SEQ ID NO: 3034805 - DNA, 15 bp, Homo sapiens
ctgacattctgattc

SEQ ID NO: 3034806 - DNA, 20 bp, Homo sapiens
ctgacattgctccaagatgt

SEQ ID NO: 3034807 - DNA, 16 bp, Homo sapiens
ctgaccaacatggaga

SEQ ID NO: 3034808 - DNA, 14 bp, Homo sapiens
ctgaccacagcaca

SEQ ID NO: 3034809 - DNA, 14 bp, Homo sapiens
ctgaccagcagcgc

SEQ ID NO: 3034810 - DNA, 21 bp, Homo sapiens
ctgaccagcagcgcctttccc

SEQ ID NO: 3034811 - DNA, 15 bp, Homo sapiens
ctgaccatctgtgac

SEQ ID NO: 3034812 - DNA, 21 bp, Homo sapiens
ctgaccattttggatgtcatt

SEQ ID NO: 3034813 - DNA, 15 bp, Homo sapiens
ctgacccacagcctc

SEQ ID NO: 3034814 - DNA, 21 bp, Homo sapiens
ctgacccacagcctccaagtc

SEQ ID NO: 3034815 - DNA, 19 bp, Homo sapiens
ctgacccaccaaggtctca

SEQ ID NO: 3034816 - DNA, 12 bp, Homo sapiens
ctgacccagtcc

SEQ ID NO: 3034817 - DNA, 14 bp, Homo sapiens
ctgacccagtccct

SEQ ID NO: 3034818 - DNA, 15 bp, Homo sapiens
ctgacccagtccctg

SEQ ID NO: 3034819 - DNA, 12 bp, Homo sapiens
ctgacccagtgc

SEQ ID NO: 3034820 - DNA, 23 bp, Homo sapiens
ctgacccagtgcccccactgacc

SEQ ID NO: 3034821 - DNA, 19 bp, Homo sapiens
ctgaccccccccattagaa

SEQ ID NO: 3034822 - DNA, 23 bp, Homo sapiens
ctgaccccccccattagaatgtg

SEQ ID NO: 3034823 - DNA, 21 bp, Homo sapiens
ctgacccggattggccctgcc

SEQ ID NO: 3034824 - DNA, 14 bp, Homo sapiens
ctgaccctgggcct

SEQ ID NO: 3034825 - DNA, 19 bp, Homo sapiens
ctgaccctggggctggctt

SEQ ID NO: 3034826 - DNA, 12 bp, Homo sapiens
ctgaccctgtat

SEQ ID NO: 3034827 - DNA, 13 bp, Homo sapiens
ctgaccctgtata

SEQ ID NO: 3034828 - DNA, 20 bp, Homo sapiens
ctgaccctgtatatagccca

SEQ ID NO: 3034829 - DNA, 19 bp, Homo sapiens
ctgaccgctgcccaggtgg

SEQ ID NO: 3034830 - DNA, 18 bp, Homo sapiens
ctgaccgtgtacatagcc

SEQ ID NO: 3034831 - DNA, 15 bp, Homo sapiens
ctgacctcacctggt

SEQ ID NO: 3034832 - DNA, 18 bp, Homo sapiens
ctgacctcacctggtcct

SEQ ID NO: 3034833 - DNA, 20 bp, Homo sapiens
ctgacctcacctggtcctcc

SEQ ID NO: 3034834 - DNA, 21 bp, Homo sapiens
ctgacctcacctggtcctccg

SEQ ID NO: 3034835 - DNA, 13 bp, Homo sapiens
ctgacctccacag

SEQ ID NO: 3034836 - DNA, 16 bp, Homo sapiens
ctgacctccacagctt

SEQ ID NO: 3034837 - DNA, 18 bp, Homo sapiens
ctgacctccagtcctgct

SEQ ID NO: 3034838 - DNA, 21 bp, Homo sapiens
ctgacctccagtcctgctggc

SEQ ID NO: 3034839 - DNA, 20 bp, Homo sapiens
ctgacctgcgggtcctcagc

SEQ ID NO: 3034840 - DNA, 18 bp, Homo sapiens
ctgacctggtccacaggg

SEQ ID NO: 3034841 - DNA, 21 bp, Homo sapiens
ctgacctggtccacagggcac

SEQ ID NO: 3034842 - DNA, 12 bp, Homo sapiens
ctgacctgtcca

SEQ ID NO: 3034843 - DNA, 21 bp, Homo sapiens
ctgacgaacttccatggccct

SEQ ID NO: 3034844 - DNA, 15 bp, Homo sapiens
ctgacgccaataata

SEQ ID NO: 3034845 - DNA, 15 bp, Homo sapiens
ctgactaaaatgttt

SEQ ID NO: 3034846 - DNA, 12 bp, Homo sapiens
ctgactcagggc

SEQ ID NO: 3034847 - DNA, 16 bp, Homo sapiens
ctgactcattctgaag

SEQ ID NO: 3034848 - DNA, 16 bp, Homo sapiens
ctgactctctgagctg

SEQ ID NO: 3034849 - DNA, 20 bp, Homo sapiens
ctgactctctgagctgggga

SEQ ID NO: 3034850 - DNA, 21 bp, Homo sapiens
ctgactctctgagctggggag

SEQ ID NO: 3034851 - DNA, 18 bp, Homo sapiens
ctgactgcccagcatttg

SEQ ID NO: 3034852 - DNA, 14 bp, Homo sapiens
ctgactgggctggg

SEQ ID NO: 3034853 - DNA, 16 bp, Homo sapiens
ctgactgggctgggtt

SEQ ID NO: 3034854 - DNA, 23 bp, Homo sapiens
ctgactgggctgggtttgctgtc

SEQ ID NO: 3034855 - DNA, 20 bp, Homo sapiens
ctgactgtctcccgggacta

SEQ ID NO: 3034856 - DNA, 14 bp, Homo sapiens
ctgacttaggtttc

SEQ ID NO: 3034857 - DNA, 17 bp, Homo sapiens
ctgacttcatctcccac

SEQ ID NO: 3034858 - DNA, 14 bp, Homo sapiens
ctgacttgagtgtt

SEQ ID NO: 3034859 - DNA, 15 bp, Homo sapiens
ctgacttgagtgttc

SEQ ID NO: 3034860 - DNA, 22 bp, Homo sapiens
ctgacttgagtgttccttttta

SEQ ID NO: 3034861 - DNA, 13 bp, Homo sapiens
ctgacttgcttta

SEQ ID NO: 3034862 - DNA, 20 bp, Homo sapiens
ctgacttggatcccaaagca

SEQ ID NO: 3034863 - DNA, 21 bp, Homo sapiens
ctgacttggatcccaaagcaa

SEQ ID NO: 3034864 - DNA, 15 bp, Homo sapiens
ctgactttttgtttc

SEQ ID NO: 3034865 - DNA, 24 bp, Homo sapiens
ctgcttgtactaagccaggaggct

SEQ ID NO: 3034866 - DNA, 14 bp, Homo sapiens
ctgcttgtgcctcc

SEQ ID NO: 3034867 - DNA, 13 bp, Homo sapiens
ctgctttctcccc

SEQ ID NO: 3034868 - DNA, 12 bp, Homo sapiens
ctgctttctctt

SEQ ID NO: 3034869 - DNA, 19 bp, Homo sapiens
ctgctttctgatgttgcct

SEQ ID NO: 3034870 - DNA, 17 bp, Homo sapiens
ctgctttctgttcatct

SEQ ID NO: 3034871 - DNA, 18 bp, Homo sapiens
ctgctttctgttcatctc

SEQ ID NO: 3034872 - DNA, 23 bp, Homo sapiens
ctgctttgacgggccaggccctg

SEQ ID NO: 3034873 - DNA, 22 bp, Homo sapiens
ctgctttgcctcgaaagtgtca

SEQ ID NO: 3034874 - DNA, 13 bp, Homo sapiens
ctgcttttatatc

SEQ ID NO: 3034875 - DNA, 22 bp, Homo sapiens
ctgcttttatgtagtttaggct

SEQ ID NO: 3034876 - DNA, 23 bp, Homo sapiens
ctgcttttccttggggcaggcag

SEQ ID NO: 3034877 - DNA, 20 bp, Homo sapiens
ctgcttttgcccatataaaa

SEQ ID NO: 3034878 - DNA, 15 bp, Homo sapiens
ctgcttttggcctgg

SEQ ID NO: 3034879 - DNA, 12 bp, Homo sapiens
ctggaaaaatga

SEQ ID NO: 3034880 - DNA, 23 bp, Homo sapiens
ctggaaaatctgtaaaaaagaaa

SEQ ID NO: 3034881 - DNA, 21 bp, Homo sapiens
ctggaaacagaggtaaaaaaa

SEQ ID NO: 3034882 - DNA, 14 bp, Homo sapiens
ctggaaaccaagtc

SEQ ID NO: 3034883 - DNA, 22 bp, Homo sapiens
ctggaaaccaagtcaggccagg

SEQ ID NO: 3034884 - DNA, 23 bp, Homo sapiens
ctggaaaccaagtcaggccaggt

SEQ ID NO: 3034885 - DNA, 23 bp, Homo sapiens
ctggaaaggaaagatgatgctca

SEQ ID NO: 3034886 - DNA, 15 bp, Homo sapiens
ctggaaatctggatt

SEQ ID NO: 3034887 - DNA, 20 bp, Homo sapiens
ctggaaatctggattttcag

SEQ ID NO: 3034888 - DNA, 21 bp, Homo sapiens
ctggaaatgtaaaattgaaaa

SEQ ID NO: 3034889 - DNA, 13 bp, Homo sapiens
ctggaacccagac

SEQ ID NO: 3034890 - DNA, 16 bp, Homo sapiens
ctggaacccagactca

SEQ ID NO: 3034891 - DNA, 16 bp, Homo sapiens
ctggaacctcagcctg

SEQ ID NO: 3034892 - DNA, 22 bp, Homo sapiens
ctggaacctcagcctggccaga

SEQ ID NO: 3034893 - DNA, 15 bp, Homo sapiens
ctggaacctgcaaaa

SEQ ID NO: 3034894 - DNA, 18 bp, Homo sapiens
ctggaacctgcaaaaaat

SEQ ID NO: 3034895 - DNA, 21 bp, Homo sapiens
ctggaacctgcaaaaaatact

SEQ ID NO: 3034896 - DNA, 14 bp, Homo sapiens
ctggaagaaccact

SEQ ID NO: 3034897 - DNA, 11 bp, Homo sapiens
ctggaagaagc

SEQ ID NO: 3034898 - DNA, 15 bp, Homo sapiens
ctggaagaagcagcg

SEQ ID NO: 3034899 - DNA, 14 bp, Homo sapiens
ctggaagcagagca

SEQ ID NO: 3034900 - DNA, 15 bp, Homo sapiens
ctggaagcagagcaa

SEQ ID NO: 3034901 - DNA, 16 bp, Homo sapiens
ctggaagcagagcaaa

SEQ ID NO: 3034902 - DNA, 18 bp, Homo sapiens
ctggaagcagagcaaaat

SEQ ID NO: 3034903 - DNA, 17 bp, Homo sapiens
ctggaagctaatttgca

SEQ ID NO: 3034904 - DNA, 18 bp, Homo sapiens
ctggaagctaatttgcat

SEQ ID NO: 3034905 - DNA, 20 bp, Homo sapiens
ctggaagctggagggtgcta

SEQ ID NO: 3034906 - DNA, 16 bp, Homo sapiens
ctggaagctgtgtcct

SEQ ID NO: 3034907 - DNA, 14 bp, Homo sapiens
ctggaagctttgtc

SEQ ID NO: 3034908 - DNA, 15 bp, Homo sapiens
ctggaagctttgtcc

SEQ ID NO: 3034909 - DNA, 21 bp, Homo sapiens
ctggaagctttgtcccctgct

SEQ ID NO: 3034910 - DNA, 22 bp, Homo sapiens
ctggaagctttgtcccctgctt

SEQ ID NO: 3034911 - DNA, 15 bp, Homo sapiens
ctggaaggagcacat

SEQ ID NO: 3034912 - DNA, 19 bp, Homo sapiens
ctggaaggggcccgtggga

SEQ ID NO: 3034913 - DNA, 23 bp, Homo sapiens
ctggaagtcatctcattccactg

SEQ ID NO: 3034914 - DNA, 19 bp, Homo sapiens
ctggaatctggagaccagg

SEQ ID NO: 3034915 - DNA, 24 bp, Homo sapiens
ctggaatctggagaccagggagcc

SEQ ID NO: 3034916 - DNA, 13 bp, Homo sapiens
ctggaatgaggga

SEQ ID NO: 3034917 - DNA, 14 bp, Homo sapiens
ctggaatgagggag

SEQ ID NO: 3034918 - DNA, 20 bp, Homo sapiens
ctggaattagcttggggcca

SEQ ID NO: 3034919 - DNA, 23 bp, Homo sapiens
ctggaattcctaacttttcaatg

SEQ ID NO: 3034920 - DNA, 19 bp, Homo sapiens
ctggaatttacctcccctt

SEQ ID NO: 3034921 - DNA, 17 bp, Homo sapiens
ctggacacttctttata

SEQ ID NO: 3034922 - DNA, 17 bp, Homo sapiens
ctggacagatggacgca

SEQ ID NO: 3034923 - DNA, 21 bp, Homo sapiens
ctggacagatggacgcaggcc

SEQ ID NO: 3034924 - DNA, 13 bp, Homo sapiens
ctggacagcccca

SEQ ID NO: 3034925 - DNA, 15 bp, Homo sapiens
ctggacagccccacc

SEQ ID NO: 3034926 - DNA, 17 bp, Homo sapiens
ctggacatagagaggga

SEQ ID NO: 3034927 - DNA, 18 bp, Homo sapiens
ctggaccagcctctccac

SEQ ID NO: 3034928 - DNA, 14 bp, Homo sapiens
ctggaccaggtcct

SEQ ID NO: 3034929 - DNA, 21 bp, Homo sapiens
ctggaccagtggtctcacatg

SEQ ID NO: 3034930 - DNA, 15 bp, Homo sapiens
ctggaccccctgccc

SEQ ID NO: 3034931 - DNA, 19 bp, Homo sapiens
ctggaccccctgcccgcca

SEQ ID NO: 3034932 - DNA, 20 bp, Homo sapiens
ctggacctagggtggcctga

SEQ ID NO: 3034933 - DNA, 13 bp, Homo sapiens
ctggacctctctt

SEQ ID NO: 3034934 - DNA, 15 bp, Homo sapiens
ctggacctgtatatt

SEQ ID NO: 3034935 - DNA, 16 bp, Homo sapiens
ctggacctgtatattt

SEQ ID NO: 3034936 - DNA, 14 bp, Homo sapiens
ctggaccttgacag

SEQ ID NO: 3034937 - DNA, 19 bp, Homo sapiens
ctggaccttgacagagcag

SEQ ID NO: 3034938 - DNA, 20 bp, Homo sapiens
ctggacgaagagcaggccag

SEQ ID NO: 3034939 - DNA, 22 bp, Homo sapiens
ctggacggggtcggacggggca

SEQ ID NO: 3034940 - DNA, 22 bp, Homo sapiens
ctggactagggcctcggaggct

SEQ ID NO: 3034941 - DNA, 15 bp, Homo sapiens
ctggactccggccct

SEQ ID NO: 3034942 - DNA, 20 bp, Homo sapiens
ctggactcctgccaccagca

SEQ ID NO: 3034943 - DNA, 14 bp, Homo sapiens
ctggactctcagtc

SEQ ID NO: 3034944 - DNA, 21 bp, Homo sapiens
ctggactctcagtctctgagc

SEQ ID NO: 3034945 - DNA, 13 bp, Homo sapiens
ctggacttggagg

SEQ ID NO: 3034946 - DNA, 20 bp, Homo sapiens
ctggagacagaaccagcaga

SEQ ID NO: 3034947 - DNA, 17 bp, Homo sapiens
ctggagaccagggagcc

SEQ ID NO: 3034948 - DNA, 17 bp, Homo sapiens
ctggagactaaccccac

SEQ ID NO: 3034949 - DNA, 19 bp, Homo sapiens
ctggagagcgaggaggcgc

SEQ ID NO: 3034950 - DNA, 21 bp, Homo sapiens
ctggagagcgaggaggcgcgg

SEQ ID NO: 3034951 - DNA, 23 bp, Homo sapiens
ctggagatattataagggagagc

SEQ ID NO: 3034952 - DNA, 13 bp, Homo sapiens
ctggagcaccagg

SEQ ID NO: 3034953 - DNA, 18 bp, Homo sapiens
ctggagcagaaagtgcct

SEQ ID NO: 3034954 - DNA, 16 bp, Homo sapiens
ctggagcatggacagt

SEQ ID NO: 3034955 - DNA, 17 bp, Homo sapiens
ctggagcatggacagtg

SEQ ID NO: 3034956 - DNA, 14 bp, Homo sapiens
ctggagccacaggc

SEQ ID NO: 3034957 - DNA, 15 bp, Homo sapiens
ctggagccacaggca

SEQ ID NO: 3034958 - DNA, 21 bp, Homo sapiens
ctggagccatgggcacaaagg

SEQ ID NO: 3034959 - DNA, 13 bp, Homo sapiens
ctggagcccaggg

SEQ ID NO: 3034960 - DNA, 20 bp, Homo sapiens
ctggagcccgcactgtccca

SEQ ID NO: 3034961 - DNA, 15 bp, Homo sapiens
ctggagctgggaggt

SEQ ID NO: 3034962 - DNA, 22 bp, Homo sapiens
ctggaggatcccctccaagcct

SEQ ID NO: 3034963 - DNA, 13 bp, Homo sapiens
ctggaggcagggc

SEQ ID NO: 3034964 - DNA, 19 bp, Homo sapiens
ctggaggcagggccttgcc

SEQ ID NO: 3034965 - DNA, 20 bp, Homo sapiens
ctggaggcagggccttgccc

SEQ ID NO: 3034966 - DNA, 14 bp, Homo sapiens
ctggaggcccaggc

SEQ ID NO: 3034967 - DNA, 19 bp, Homo sapiens
ctggaggcccaggctggga

SEQ ID NO: 3034968 - DNA, 14 bp, Homo sapiens
ctggaggcccagtt

SEQ ID NO: 3034969 - DNA, 21 bp, Homo sapiens
ctggagggcgcccagcagcct

SEQ ID NO: 3034970 - DNA, 22 bp, Homo sapiens
ctggagggcgcccagcagcctg

SEQ ID NO: 3034971 - DNA, 18 bp, Homo sapiens
ctggagggggagcaccag

SEQ ID NO: 3034972 - DNA, 21 bp, Homo sapiens
ctggaggggtcatccttgccc

SEQ ID NO: 3034973 - DNA, 17 bp, Homo sapiens
ctggaggtctgaaaaga

SEQ ID NO: 3034974 - DNA, 22 bp, Homo sapiens
ctggaggttgataactttgctt

SEQ ID NO: 3034975 - DNA, 19 bp, Homo sapiens
ctggagtatttggaagcaa

SEQ ID NO: 3034976 - DNA, 16 bp, Homo sapiens
ctggagtgagcactca

SEQ ID NO: 3034977 - DNA, 22 bp, Homo sapiens
ctggagtgtgtcagagcccagg

SEQ ID NO: 3034978 - DNA, 15 bp, Homo sapiens
ctggagttgatctgg

SEQ ID NO: 3034979 - DNA, 15 bp, Homo sapiens
ctggagttgcattga

SEQ ID NO: 3034980 - DNA, 13 bp, Homo sapiens
ctggagtttcatg

SEQ ID NO: 3034981 - DNA, 22 bp, Homo sapiens
ctggagtttcatgtacaagatg

SEQ ID NO: 3034982 - DNA, 14 bp, Homo sapiens
ctggagtttgggat

SEQ ID NO: 3034983 - DNA, 20 bp, Homo sapiens
ctggataaaaaagaaaacat

SEQ ID NO: 3034984 - DNA, 20 bp, Homo sapiens
ctggataagtgaccacagaa

SEQ ID NO: 3034985 - DNA, 20 bp, Homo sapiens
ctggatacagtataaaaata

SEQ ID NO: 3034986 - DNA, 17 bp, Homo sapiens
ctggatagccttgaaaa

SEQ ID NO: 3034987 - DNA, 19 bp, Homo sapiens
ctggatagccttgaaaaca

SEQ ID NO: 3034988 - DNA, 20 bp, Homo sapiens
ctggatagccttgaaaacaa

SEQ ID NO: 3034989 - DNA, 23 bp, Homo sapiens
ctggatagccttgaaaacaaaca

SEQ ID NO: 3034990 - DNA, 19 bp, Homo sapiens
ctggatcccatcaaagaac

SEQ ID NO: 3034991 - DNA, 17 bp, Homo sapiens
ctggatccttcccaagg

SEQ ID NO: 3034992 - DNA, 22 bp, Homo sapiens
ctggatccttcccaaggtacag

SEQ ID NO: 3034993 - DNA, 23 bp, Homo sapiens
ctggatccttcccaaggtacagc

SEQ ID NO: 3034994 - DNA, 20 bp, Homo sapiens
ctggatctgggaccctttcc

SEQ ID NO: 3034995 - DNA, 21 bp, Homo sapiens
ctggatctgggaccctttcct

SEQ ID NO: 3034996 - DNA, 15 bp, Homo sapiens
ctgtcatctgtgcac

SEQ ID NO: 3034997 - DNA, 21 bp, Homo sapiens
ctgtcatctgtgcactgccca

SEQ ID NO: 3034998 - DNA, 14 bp, Homo sapiens
ctgtcatgcttcat

SEQ ID NO: 3034999 - DNA, 22 bp, Homo sapiens
ctgtcattcccctcttttgtct

SEQ ID NO: 3035000 - DNA, 14 bp, Homo sapiens
ctgtcatttacaca

SEQ ID NO: 3035001 - DNA, 23 bp, Homo sapiens
ctgtcattttggcatctgcaaag

SEQ ID NO: 3035002 - DNA, 16 bp, Homo sapiens
ctgtccaacatggtga

SEQ ID NO: 3035003 - DNA, 16 bp, Homo sapiens
ctgtccaacctaaccc

SEQ ID NO: 3035004 - DNA, 20 bp, Homo sapiens
ctgtccaacctaaccccttt

SEQ ID NO: 3035005 - DNA, 19 bp, Homo sapiens
ctgtccacttgtgggtcct

SEQ ID NO: 3035006 - DNA, 23 bp, Homo sapiens
ctgtccacttgtgggtcctgggg

SEQ ID NO: 3035007 - DNA, 14 bp, Homo sapiens
ctgtccagccccca

SEQ ID NO: 3035008 - DNA, 18 bp, Homo sapiens
ctgtccagcccccagtgc

SEQ ID NO: 3035009 - DNA, 17 bp, Homo sapiens
ctgtccagctccaacct

SEQ ID NO: 3035010 - DNA, 18 bp, Homo sapiens
ctgtccagctccaacctg

SEQ ID NO: 3035011 - DNA, 21 bp, Homo sapiens
ctgtccagctccaacctgcaa

SEQ ID NO: 3035012 - DNA, 16 bp, Homo sapiens
ctgtccaggcactgag

SEQ ID NO: 3035013 - DNA, 20 bp, Homo sapiens
ctgtccaggtgagtgtgagg

SEQ ID NO: 3035014 - DNA, 20 bp, Homo sapiens
ctgtccatcctcctctccat

SEQ ID NO: 3035015 - DNA, 21 bp, Homo sapiens
ctgtccatcctcctctccatg

SEQ ID NO: 3035016 - DNA, 17 bp, Homo sapiens
ctgtccatctgcccgcc

SEQ ID NO: 3035017 - DNA, 23 bp, Homo sapiens
ctgtccatctgcccgcctgccca

SEQ ID NO: 3035018 - DNA, 14 bp, Homo sapiens
ctgtcccaagctcc

SEQ ID NO: 3035019 - DNA, 18 bp, Homo sapiens
ctgtcccaggactcaccc

SEQ ID NO: 3035020 - DNA, 16 bp, Homo sapiens
ctgtccccaggcctgg

SEQ ID NO: 3035021 - DNA, 19 bp, Homo sapiens
ctgtccccaggcctggctc

SEQ ID NO: 3035022 - DNA, 17 bp, Homo sapiens
ctgtccccgccttccct

SEQ ID NO: 3035023 - DNA, 19 bp, Homo sapiens
ctgtccccgccttccctca

SEQ ID NO: 3035024 - DNA, 13 bp, Homo sapiens
ctgtcccctcaca

SEQ ID NO: 3035025 - DNA, 19 bp, Homo sapiens
ctgtcccctcacagactct

SEQ ID NO: 3035026 - DNA, 13 bp, Homo sapiens
ctgtcccctcagc

SEQ ID NO: 3035027 - DNA, 19 bp, Homo sapiens
ctgtcccctgcgaggagaa

SEQ ID NO: 3035028 - DNA, 14 bp, Homo sapiens
ctgtcccctggagt

SEQ ID NO: 3035029 - DNA, 12 bp, Homo sapiens
ctgtcccctggg

SEQ ID NO: 3035030 - DNA, 14 bp, Homo sapiens
ctgtcccctggggc

SEQ ID NO: 3035031 - DNA, 18 bp, Homo sapiens
ctgtcccctggggctggt

SEQ ID NO: 3035032 - DNA, 13 bp, Homo sapiens
ctgtccctcctgg

SEQ ID NO: 3035033 - DNA, 15 bp, Homo sapiens
ctgtccctcctggtg

SEQ ID NO: 3035034 - DNA, 16 bp, Homo sapiens
ctgtccctctcagtgc

SEQ ID NO: 3035035 - DNA, 17 bp, Homo sapiens
ctgtccctctcagtgcc

SEQ ID NO: 3035036 - DNA, 18 bp, Homo sapiens
ctgtccctctcagtgcct

SEQ ID NO: 3035037 - DNA, 15 bp, Homo sapiens
ctgtccctgcccttc

SEQ ID NO: 3035038 - DNA, 16 bp, Homo sapiens
ctgtccctgcccttct

SEQ ID NO: 3035039 - DNA, 21 bp, Homo sapiens
ctgtccggaatgccacccaca

SEQ ID NO: 3035040 - DNA, 15 bp, Homo sapiens
ctgtccgtccagagc

SEQ ID NO: 3035041 - DNA, 18 bp, Homo sapiens
ctgtcctcacgccccctg

SEQ ID NO: 3035042 - DNA, 21 bp, Homo sapiens
ctgtcctcagccttgccagag

SEQ ID NO: 3035043 - DNA, 15 bp, Homo sapiens
ctgtcctcaggtggc

SEQ ID NO: 3035044 - DNA, 17 bp, Homo sapiens
ctgtcctcaggtggcca

SEQ ID NO: 3035045 - DNA, 23 bp, Homo sapiens
ctgtcctcctcggatcaccgaga

SEQ ID NO: 3035046 - DNA, 15 bp, Homo sapiens
ctgtcctcttctgca

SEQ ID NO: 3035047 - DNA, 13 bp, Homo sapiens
ctgtcctgggcct

SEQ ID NO: 3035048 - DNA, 14 bp, Homo sapiens
ctgtcctgggcctg

SEQ ID NO: 3035049 - DNA, 12 bp, Homo sapiens
ctgtcctggtgg

SEQ ID NO: 3035050 - DNA, 19 bp, Homo sapiens
ctgtcctggtggctgggcc

SEQ ID NO: 3035051 - DNA, 21 bp, Homo sapiens
ctgtcctggtggctgggccca

SEQ ID NO: 3035052 - DNA, 20 bp, Homo sapiens
ctgtcctgtgaggtttccca

SEQ ID NO: 3035053 - DNA, 21 bp, Homo sapiens
ctgtcctgttaggccaactgc

SEQ ID NO: 3035054 - DNA, 17 bp, Homo sapiens
ctgtccttacccatctg

SEQ ID NO: 3035055 - DNA, 17 bp, Homo sapiens
ctgtccttactcagagc

SEQ ID NO: 3035056 - DNA, 18 bp, Homo sapiens
ctgtccttactcagagct

SEQ ID NO: 3035057 - DNA, 21 bp, Homo sapiens
ctgtccttactcagagctgcg

SEQ ID NO: 3035058 - DNA, 24 bp, Homo sapiens
ctgtccttactcagagctgcgggc

SEQ ID NO: 3035059 - DNA, 17 bp, Homo sapiens
ctgtccttggcaacttt

SEQ ID NO: 3035060 - DNA, 17 bp, Homo sapiens
ctgtcgattagactgga

SEQ ID NO: 3035061 - DNA, 19 bp, Homo sapiens
ctgtcgattagactggaca

SEQ ID NO: 3035062 - DNA, 13 bp, Homo sapiens
ctgtcggaggaaa

SEQ ID NO: 3035063 - DNA, 15 bp, Homo sapiens
ctgtcggaggaaaga

SEQ ID NO: 3035064 - DNA, 18 bp, Homo sapiens
ctgtcgggggccactgtg

SEQ ID NO: 3035065 - DNA, 17 bp, Homo sapiens
ctgtcggtggctgcctt

SEQ ID NO: 3035066 - DNA, 15 bp, Homo sapiens
ctgtctaacctgtga

SEQ ID NO: 3035067 - DNA, 23 bp, Homo sapiens
ctgtctaagcagttttgtaaatg

SEQ ID NO: 3035068 - DNA, 17 bp, Homo sapiens
ctgtctactttctcttg

SEQ ID NO: 3035069 - DNA, 15 bp, Homo sapiens
ctgtctagactggcc

SEQ ID NO: 3035070 - DNA, 16 bp, Homo sapiens
ctgtctagagagggag

SEQ ID NO: 3035071 - DNA, 18 bp, Homo sapiens
ctgtctagagagggaggc

SEQ ID NO: 3035072 - DNA, 12 bp, Homo sapiens
ctgtctagagta

SEQ ID NO: 3035073 - DNA, 15 bp, Homo sapiens
ctgtctagcatgcca

SEQ ID NO: 3035074 - DNA, 15 bp, Homo sapiens
ctgtctagccttagt

SEQ ID NO: 3035075 - DNA, 16 bp, Homo sapiens
ctgtctcaatagctcc

SEQ ID NO: 3035076 - DNA, 16 bp, Homo sapiens
ctgtctcatccatcat

SEQ ID NO: 3035077 - DNA, 20 bp, Homo sapiens
ctgtctcatccatcatcatg

SEQ ID NO: 3035078 - DNA, 17 bp, Homo sapiens
ctgtctcccctaccagg

SEQ ID NO: 3035079 - DNA, 17 bp, Homo sapiens
ctgtctcgccagaagac

SEQ ID NO: 3035080 - DNA, 11 bp, Homo sapiens
ctgtctctccc

SEQ ID NO: 3035081 - DNA, 11 bp, Homo sapiens
ctgtctctctc

SEQ ID NO: 3035082 - DNA, 19 bp, Homo sapiens
ctgtctctcttgtcacatg

SEQ ID NO: 3035083 - DNA, 12 bp, Homo sapiens
ctgtctctgtgg

SEQ ID NO: 3035084 - DNA, 14 bp, Homo sapiens
ctgtctgaacaaaa

SEQ ID NO: 3035085 - DNA, 15 bp, Homo sapiens
ctgtctgcagccttg

SEQ ID NO: 3035086 - DNA, 19 bp, Homo sapiens
ctgtctggatccttcccaa

SEQ ID NO: 3035087 - DNA, 14 bp, Homo sapiens
ctgtctgtacctaa

SEQ ID NO: 3035088 - DNA, 16 bp, Homo sapiens
ctgtctgtcatctgct

SEQ ID NO: 3035089 - DNA, 15 bp, Homo sapiens
ctgtctgtccaaccc

SEQ ID NO: 3035090 - DNA, 18 bp, Homo sapiens
ctgtctgtccaacccctc

SEQ ID NO: 3035091 - DNA, 23 bp, Homo sapiens
ctgtctgtccaacccctccccca

SEQ ID NO: 3035092 - DNA, 13 bp, Homo sapiens
ctgtctgtctctc

SEQ ID NO: 3035093 - DNA, 14 bp, Homo sapiens
ctgtctgtctctcc

SEQ ID NO: 3035094 - DNA, 17 bp, Homo sapiens
ctgtcttcacctgattc

SEQ ID NO: 3035095 - DNA, 20 bp, Homo sapiens
ctgtcttcaggctctgccca

SEQ ID NO: 3035096 - DNA, 14 bp, Homo sapiens
ctgtcttctctcca

SEQ ID NO: 3035097 - DNA, 13 bp, Homo sapiens
ctgtcttctggac

SEQ ID NO: 3035098 - DNA, 14 bp, Homo sapiens
ctgtcttctggact

SEQ ID NO: 3035099 - DNA, 19 bp, Homo sapiens
ctgtcttctgtatataaat

SEQ ID NO: 3035100 - DNA, 14 bp, Homo sapiens
ctgtcttgctcctg

SEQ ID NO: 3035101 - DNA, 18 bp, Homo sapiens
ctgtcttgctcctgggga

SEQ ID NO: 3035102 - DNA, 16 bp, Homo sapiens
ctgtctttgcagggca

SEQ ID NO: 3035103 - DNA, 17 bp, Homo sapiens
ctgtctttgcagggcac

SEQ ID NO: 3035104 - DNA, 22 bp, Homo sapiens
ctgtctttgcggggcctgtctc

SEQ ID NO: 3035105 - DNA, 18 bp, Homo sapiens
ctgtctttgtggactgtg

SEQ ID NO: 3035106 - DNA, 13 bp, Homo sapiens
ctgtctttttcct

SEQ ID NO: 3035107 - DNA, 21 bp, Homo sapiens
ctgtgaaaaaaccgttcaaat

SEQ ID NO: 3035108 - DNA, 19 bp, Homo sapiens
ctgtgaaccaacccccatc

SEQ ID NO: 3035109 - DNA, 11 bp, Homo sapiens
ctgtgaagaag

SEQ ID NO: 3035110 - DNA, 14 bp, Homo sapiens
ctgtgaagatctca

SEQ ID NO: 3035111 - DNA, 20 bp, Homo sapiens
ctgtgaagatctcactctgc

SEQ ID NO: 3035112 - DNA, 21 bp, Homo sapiens
ctgtgaagatctcactctgcc

SEQ ID NO: 3035113 - DNA, 23 bp, Homo sapiens
ctgtgaagcattcgagacagaac

SEQ ID NO: 3035114 - DNA, 17 bp, Homo sapiens
ctgtgaagccctttgcc

SEQ ID NO: 3035115 - DNA, 16 bp, Homo sapiens
ctgtgaataaaaagaa

SEQ ID NO: 3035116 - DNA, 21 bp, Homo sapiens
ctgtgaatcctggcaagaaag

SEQ ID NO: 3035117 - DNA, 16 bp, Homo sapiens
ctgtgaatgcttctga

SEQ ID NO: 3035118 - DNA, 21 bp, Homo sapiens
ctgtgacacactacaccacac

SEQ ID NO: 3035119 - DNA, 19 bp, Homo sapiens
ctgtgacattgctggtcat

SEQ ID NO: 3035120 - DNA, 23 bp, Homo sapiens
ctgtgaccagtctgacccttaca

SEQ ID NO: 3035121 - DNA, 16 bp, Homo sapiens
ctgtgacccccagctc

SEQ ID NO: 3035122 - DNA, 15 bp, Homo sapiens
ctgtgaccctctcac

SEQ ID NO: 3035123 - DNA, 13 bp, Homo sapiens
ctgtgaccttggg

SEQ ID NO: 3035124 - DNA, 20 bp, Homo sapiens
ctgtgaccttgggaccaaag

SEQ ID NO: 3035125 - DNA, 15 bp, Homo sapiens
ctgtgactataaagc

SEQ ID NO: 3035126 - DNA, 19 bp, Homo sapiens
ctgtgactataaagctgtt

SEQ ID NO: 3035127 - DNA, 19 bp, Homo sapiens
ctgtgactctgggcaggga

SEQ ID NO: 3035128 - DNA, 15 bp, Homo sapiens
ctgtgagacagtggg

SEQ ID NO: 3035129 - DNA, 19 bp, Homo sapiens
cttatccttcatcttttaa

SEQ ID NO: 3035130 - DNA, 14 bp, Homo sapiens
cttatctccaagac

SEQ ID NO: 3035131 - DNA, 15 bp, Homo sapiens
cttatctccctgctt

SEQ ID NO: 3035132 - DNA, 20 bp, Homo sapiens
cttatctgagctgagccagg

SEQ ID NO: 3035133 - DNA, 21 bp, Homo sapiens
cttatctgagctgagccaggc

SEQ ID NO: 3035134 - DNA, 12 bp, Homo sapiens
cttatgaatgtt

SEQ ID NO: 3035135 - DNA, 15 bp, Homo sapiens
cttatgaatgtttcc

SEQ ID NO: 3035136 - DNA, 17 bp, Homo sapiens
cttatgaatgtttccgg

SEQ ID NO: 3035137 - DNA, 14 bp, Homo sapiens
cttatggaacaggg

SEQ ID NO: 3035138 - DNA, 20 bp, Homo sapiens
cttatggaattgatttgcat

SEQ ID NO: 3035139 - DNA, 23 bp, Homo sapiens
cttatggaattgatttgcattga

SEQ ID NO: 3035140 - DNA, 19 bp, Homo sapiens
cttatgtttcttattctct

SEQ ID NO: 3035141 - DNA, 22 bp, Homo sapiens
cttattaagttcgaacatgttt

SEQ ID NO: 3035142 - DNA, 16 bp, Homo sapiens
cttattacataactga

SEQ ID NO: 3035143 - DNA, 17 bp, Homo sapiens
cttattacataactgat

SEQ ID NO: 3035144 - DNA, 14 bp, Homo sapiens
cttattacatttaa

SEQ ID NO: 3035145 - DNA, 20 bp, Homo sapiens
cttattagagtgtctttcca

SEQ ID NO: 3035146 - DNA, 15 bp, Homo sapiens
cttattcaaagatga

SEQ ID NO: 3035147 - DNA, 12 bp, Homo sapiens
cttattcacttt

SEQ ID NO: 3035148 - DNA, 13 bp, Homo sapiens
cttattcactttt

SEQ ID NO: 3035149 - DNA, 20 bp, Homo sapiens
cttattccacagatatcttt

SEQ ID NO: 3035150 - DNA, 18 bp, Homo sapiens
cttattctctgtttgctt

SEQ ID NO: 3035151 - DNA, 13 bp, Homo sapiens
cttattcttttat

SEQ ID NO: 3035152 - DNA, 19 bp, Homo sapiens
cttattgcctgggcagtgc

SEQ ID NO: 3035153 - DNA, 19 bp, Homo sapiens
cttattgtgtgcgctgcct

SEQ ID NO: 3035154 - DNA, 21 bp, Homo sapiens
cttatttaaaaatatttcaga

SEQ ID NO: 3035155 - DNA, 18 bp, Homo sapiens
cttatttagaaaaaaggg

SEQ ID NO: 3035156 - DNA, 12 bp, Homo sapiens
cttcaaaacatt

SEQ ID NO: 3035157 - DNA, 15 bp, Homo sapiens
cttcaaaagtaatgc

SEQ ID NO: 3035158 - DNA, 16 bp, Homo sapiens
cttcaaaagtattttc

SEQ ID NO: 3035159 - DNA, 22 bp, Homo sapiens
cttcaaaatgttatcttctcaa

SEQ ID NO: 3035160 - DNA, 16 bp, Homo sapiens
cttcaaatgcctgact

SEQ ID NO: 3035161 - DNA, 13 bp, Homo sapiens
cttcaaattaaag

SEQ ID NO: 3035162 - DNA, 24 bp, Homo sapiens
cttcaacagaccccctctagaaat

SEQ ID NO: 3035163 - DNA, 15 bp, Homo sapiens
cttcaacatttacat

SEQ ID NO: 3035164 - DNA, 16 bp, Homo sapiens
cttcaacgtttcttca

SEQ ID NO: 3035165 - DNA, 19 bp, Homo sapiens
cttcaacgtttcttcactt

SEQ ID NO: 3035166 - DNA, 22 bp, Homo sapiens
cttcaacgtttcttcacttttg

SEQ ID NO: 3035167 - DNA, 22 bp, Homo sapiens
cttcaagaatcagaagaaaggc

SEQ ID NO: 3035168 - DNA, 21 bp, Homo sapiens
cttcaagcatcctcagaagcc

SEQ ID NO: 3035169 - DNA, 14 bp, Homo sapiens
cttcaaggcttcag

SEQ ID NO: 3035170 - DNA, 15 bp, Homo sapiens
cttcaaggcttcagt

SEQ ID NO: 3035171 - DNA, 17 bp, Homo sapiens
cttcaaggcttcagtct

SEQ ID NO: 3035172 - DNA, 15 bp, Homo sapiens
cttcaaggtgacaga

SEQ ID NO: 3035173 - DNA, 23 bp, Homo sapiens
cttcaaggtgacagaaggaccag

SEQ ID NO: 3035174 - DNA, 18 bp, Homo sapiens
cttcaagtgagtggcatg

SEQ ID NO: 3035175 - DNA, 16 bp, Homo sapiens
cttcaataattgtcca

SEQ ID NO: 3035176 - DNA, 15 bp, Homo sapiens
cttcaatctcgttta

SEQ ID NO: 3035177 - DNA, 15 bp, Homo sapiens
cttcacactgcaaga

SEQ ID NO: 3035178 - DNA, 20 bp, Homo sapiens
cttcacagtgacactggacc

SEQ ID NO: 3035179 - DNA, 21 bp, Homo sapiens
cttcacagtgacactggacca

SEQ ID NO: 3035180 - DNA, 22 bp, Homo sapiens
cttcaccagaggaatcactctt

SEQ ID NO: 3035181 - DNA, 18 bp, Homo sapiens
cttcaccatggatcctgg

SEQ ID NO: 3035182 - DNA, 15 bp, Homo sapiens
cttcacccaggccta

SEQ ID NO: 3035183 - DNA, 20 bp, Homo sapiens
cttcacctgattcaactaaa

SEQ ID NO: 3035184 - DNA, 19 bp, Homo sapiens
cttcactgcaattttgtgt

SEQ ID NO: 3035185 - DNA, 15 bp, Homo sapiens
cttcactgctacatg

SEQ ID NO: 3035186 - DNA, 16 bp, Homo sapiens
cttcactggcgccttc

SEQ ID NO: 3035187 - DNA, 17 bp, Homo sapiens
cttcactggcgccttct

SEQ ID NO: 3035188 - DNA, 15 bp, Homo sapiens
cttcactgtaaaata

SEQ ID NO: 3035189 - DNA, 17 bp, Homo sapiens
cttcactgtcctccaag

SEQ ID NO: 3035190 - DNA, 14 bp, Homo sapiens
cttcacttcctcca

SEQ ID NO: 3035191 - DNA, 16 bp, Homo sapiens
cttcagaacagaggca

SEQ ID NO: 3035192 - DNA, 23 bp, Homo sapiens
cttcagaggccctcgctgccagc

SEQ ID NO: 3035193 - DNA, 23 bp, Homo sapiens
cttcagagtttgtcatatactgc

SEQ ID NO: 3035194 - DNA, 17 bp, Homo sapiens
cttcagatcagtgcttg

SEQ ID NO: 3035195 - DNA, 18 bp, Homo sapiens
cttcagatgtggagccag

SEQ ID NO: 3035196 - DNA, 20 bp, Homo sapiens
cttcagatgtggagccaggc

SEQ ID NO: 3035197 - DNA, 21 bp, Homo sapiens
cttcagatgtggagccaggcg

SEQ ID NO: 3035198 - DNA, 14 bp, Homo sapiens
cttcagcaagagag

SEQ ID NO: 3035199 - DNA, 15 bp, Homo sapiens
cttcagcagcagctc

SEQ ID NO: 3035200 - DNA, 20 bp, Homo sapiens
cttcagcagcagctcacacc

SEQ ID NO: 3035201 - DNA, 17 bp, Homo sapiens
cttcagccacctctctt

SEQ ID NO: 3035202 - DNA, 23 bp, Homo sapiens
cttcagcctagtggcttgtcctc

SEQ ID NO: 3035203 - DNA, 20 bp, Homo sapiens
cttcagcctccccaccttct

SEQ ID NO: 3035204 - DNA, 20 bp, Homo sapiens
cttcagctcacgcttcacag

SEQ ID NO: 3035205 - DNA, 11 bp, Homo sapiens
cttcagctcca

SEQ ID NO: 3035206 - DNA, 15 bp, Homo sapiens
cttcagctccagccc

SEQ ID NO: 3035207 - DNA, 16 bp, Homo sapiens
cttcagctccagcccc

SEQ ID NO: 3035208 - DNA, 19 bp, Homo sapiens
cttcagctccagccccttt

SEQ ID NO: 3035209 - DNA, 11 bp, Homo sapiens
cttcagctggt

SEQ ID NO: 3035210 - DNA, 21 bp, Homo sapiens
cttcaggaacctcgagtactg

SEQ ID NO: 3035211 - DNA, 21 bp, Homo sapiens
cttcaggagtttcatgttgga

SEQ ID NO: 3035212 - DNA, 18 bp, Homo sapiens
cttcaggcaattctcctg

SEQ ID NO: 3035213 - DNA, 13 bp, Homo sapiens
cttcagggcctgg

SEQ ID NO: 3035214 - DNA, 17 bp, Homo sapiens
cttcaggggcacttcat

SEQ ID NO: 3035215 - DNA, 18 bp, Homo sapiens
cttcagggtgatgccagg

SEQ ID NO: 3035216 - DNA, 14 bp, Homo sapiens
cttcaggtgtgact

SEQ ID NO: 3035217 - DNA, 14 bp, Homo sapiens
cttcagtccctgag

SEQ ID NO: 3035218 - DNA, 15 bp, Homo sapiens
cttcagtgcccacca

SEQ ID NO: 3035219 - DNA, 17 bp, Homo sapiens
cttcagtgcccaccaac

SEQ ID NO: 3035220 - DNA, 19 bp, Homo sapiens
cttcagtggaacacaaatg

SEQ ID NO: 3035221 - DNA, 16 bp, Homo sapiens
cttcagtgtaatgtga

SEQ ID NO: 3035222 - DNA, 21 bp, Homo sapiens
cttcataccgcctcgtgccag

SEQ ID NO: 3035223 - DNA, 23 bp, Homo sapiens
cttcataccgcctcgtgccagca

SEQ ID NO: 3035224 - DNA, 23 bp, Homo sapiens
cttcatagggacctttaaaaagc

SEQ ID NO: 3035225 - DNA, 13 bp, Homo sapiens
cttcatataaact

SEQ ID NO: 3035226 - DNA, 15 bp, Homo sapiens
cttcatatctctccc

SEQ ID NO: 3035227 - DNA, 22 bp, Homo sapiens
cttcatattaatataagtttct

SEQ ID NO: 3035228 - DNA, 17 bp, Homo sapiens
cttcatcattccctctc

SEQ ID NO: 3035229 - DNA, 14 bp, Homo sapiens
cttcatctccctgc

SEQ ID NO: 3035230 - DNA, 17 bp, Homo sapiens
cttcatctccctgccat

SEQ ID NO: 3035231 - DNA, 20 bp, Homo sapiens
cttcatctccctgccatccc

SEQ ID NO: 3035232 - DNA, 14 bp, Homo sapiens
cttcatctggctgc

SEQ ID NO: 3035233 - DNA, 22 bp, Homo sapiens
cttcatgcaggtgaaacccagt

SEQ ID NO: 3035234 - DNA, 19 bp, Homo sapiens
cttcatgcctgatgaaagc

SEQ ID NO: 3035235 - DNA, 23 bp, Homo sapiens
cttcatggatgggggaactcaga

SEQ ID NO: 3035236 - DNA, 21 bp, Homo sapiens
cttcatggcagaaggcaaacc

SEQ ID NO: 3035237 - DNA, 17 bp, Homo sapiens
cttcatgggcccacagg

SEQ ID NO: 3035238 - DNA, 14 bp, Homo sapiens
cttcatttcatcct

SEQ ID NO: 3035239 - DNA, 14 bp, Homo sapiens
cttcattttcagag

SEQ ID NO: 3035240 - DNA, 16 bp, Homo sapiens
cttcattttcagagtg

SEQ ID NO: 3035241 - DNA, 17 bp, Homo sapiens
cttcattttcagagtga

SEQ ID NO: 3035242 - DNA, 22 bp, Homo sapiens
cttccaaagactccctccatag

SEQ ID NO: 3035243 - DNA, 18 bp, Homo sapiens
cttccaagaccatttgta

SEQ ID NO: 3035244 - DNA, 20 bp, Homo sapiens
cttccaaggagcagagaggt

SEQ ID NO: 3035245 - DNA, 20 bp, Homo sapiens
cttccacatttttgcacaga

SEQ ID NO: 3035246 - DNA, 22 bp, Homo sapiens
cttccaccagagcaggggctgc

SEQ ID NO: 3035247 - DNA, 23 bp, Homo sapiens
cttccacctcacctctttgttct

SEQ ID NO: 3035248 - DNA, 14 bp, Homo sapiens
cttccactgagggc

SEQ ID NO: 3035249 - DNA, 14 bp, Homo sapiens
cttccacttctcca

SEQ ID NO: 3035250 - DNA, 20 bp, Homo sapiens
cttccacttctccaagaatg

SEQ ID NO: 3035251 - DNA, 18 bp, Homo sapiens
cttccagagctctgaccc

SEQ ID NO: 3035252 - DNA, 16 bp, Homo sapiens
cttccagcaaaatcca

SEQ ID NO: 3035253 - DNA, 19 bp, Homo sapiens
cttccagcaaaatccaaac

SEQ ID NO: 3035254 - DNA, 20 bp, Homo sapiens
cttccagcaaaatccaaact

SEQ ID NO: 3035255 - DNA, 21 bp, Homo sapiens
cttccaggagccaccttgcca

SEQ ID NO: 3035256 - DNA, 17 bp, Homo sapiens
cttccaggatggtgtta

SEQ ID NO: 3035257 - DNA, 22 bp, Homo sapiens
cttccagggacgaagaagagcc

SEQ ID NO: 3035258 - DNA, 19 bp, Homo sapiens
cttccaggtgcccagctat

SEQ ID NO: 3035259 - DNA, 19 bp, Homo sapiens
cttccaggtgttactgtaa

SEQ ID NO: 3035260 - DNA, 16 bp, Homo sapiens
cttgtttaaaaaaaga

SEQ ID NO: 3035261 - DNA, 18 bp, Homo sapiens
cttgtttaaaaaaagaaa

SEQ ID NO: 3035262 - DNA, 20 bp, Homo sapiens
cttgtttccttagcttggta

SEQ ID NO: 3035263 - DNA, 14 bp, Homo sapiens
cttgtttctcaact

SEQ ID NO: 3035264 - DNA, 16 bp, Homo sapiens
cttgtttctttctgaa

SEQ ID NO: 3035265 - DNA, 14 bp, Homo sapiens
cttgtttcttttca

SEQ ID NO: 3035266 - DNA, 20 bp, Homo sapiens
cttgtttgattttagctgca

SEQ ID NO: 3035267 - DNA, 23 bp, Homo sapiens
cttgtttgattttagctgcagaa

SEQ ID NO: 3035268 - DNA, 20 bp, Homo sapiens
cttgtttgctcacctggggt

SEQ ID NO: 3035269 - DNA, 13 bp, Homo sapiens
cttgtttgtcagc

SEQ ID NO: 3035270 - DNA, 19 bp, Homo sapiens
cttgtttgtcagcatctga

SEQ ID NO: 3035271 - DNA, 21 bp, Homo sapiens
cttgtttgtcagcatctgacc

SEQ ID NO: 3035272 - DNA, 22 bp, Homo sapiens
cttgtttgtcagcatctgacca

SEQ ID NO: 3035273 - DNA, 21 bp, Homo sapiens
cttgttttaagcaaatgcatt

SEQ ID NO: 3035274 - DNA, 15 bp, Homo sapiens
cttgttttaatttta

SEQ ID NO: 3035275 - DNA, 15 bp, Homo sapiens
cttgttttattttgg

SEQ ID NO: 3035276 - DNA, 11 bp, Homo sapiens
cttgttttcca

SEQ ID NO: 3035277 - DNA, 13 bp, Homo sapiens
ctttaaaaaagaa

SEQ ID NO: 3035278 - DNA, 23 bp, Homo sapiens
ctttaaaaaagaaaagtgcatat

SEQ ID NO: 3035279 - DNA, 23 bp, Homo sapiens
ctttaaaaaagaaattatcttta

SEQ ID NO: 3035280 - DNA, 15 bp, Homo sapiens
ctttaaaaagaaaaa

SEQ ID NO: 3035281 - DNA, 18 bp, Homo sapiens
ctttaaaagatgctttta

SEQ ID NO: 3035282 - DNA, 19 bp, Homo sapiens
ctttaaaatgtaaagccat

SEQ ID NO: 3035283 - DNA, 17 bp, Homo sapiens
ctttaaaattacaacta

SEQ ID NO: 3035284 - DNA, 20 bp, Homo sapiens
ctttaaaattacaactaagt

SEQ ID NO: 3035285 - DNA, 13 bp, Homo sapiens
ctttaaagccagt

SEQ ID NO: 3035286 - DNA, 13 bp, Homo sapiens
ctttaaattaaaa

SEQ ID NO: 3035287 - DNA, 18 bp, Homo sapiens
ctttaaccgtttttcaag

SEQ ID NO: 3035288 - DNA, 20 bp, Homo sapiens
ctttaaccgtttttcaagaa

SEQ ID NO: 3035289 - DNA, 21 bp, Homo sapiens
ctttaaccgtttttcaagaaa

SEQ ID NO: 3035290 - DNA, 16 bp, Homo sapiens
ctttaacctgaacctt

SEQ ID NO: 3035291 - DNA, 18 bp, Homo sapiens
ctttaactcgttgcagtc

SEQ ID NO: 3035292 - DNA, 17 bp, Homo sapiens
ctttaactctgcggata

SEQ ID NO: 3035293 - DNA, 20 bp, Homo sapiens
ctttaagaaccttattttga

SEQ ID NO: 3035294 - DNA, 14 bp, Homo sapiens
ctttaagaatgaac

SEQ ID NO: 3035295 - DNA, 23 bp, Homo sapiens
ctttaagacatactccttccatc

SEQ ID NO: 3035296 - DNA, 17 bp, Homo sapiens
ctttaagatatccatct

SEQ ID NO: 3035297 - DNA, 18 bp, Homo sapiens
ctttaatatttccaatgt

SEQ ID NO: 3035298 - DNA, 15 bp, Homo sapiens
ctttaatcaatgtga

SEQ ID NO: 3035299 - DNA, 18 bp, Homo sapiens
ctttacagctgtttacag

SEQ ID NO: 3035300 - DNA, 16 bp, Homo sapiens
ctttacaggatcatgt

SEQ ID NO: 3035301 - DNA, 17 bp, Homo sapiens
ctttacaggatcatgta

SEQ ID NO: 3035302 - DNA, 23 bp, Homo sapiens
ctttacaggatcatgtaaatgct

SEQ ID NO: 3035303 - DNA, 18 bp, Homo sapiens
ctttaccaaacagcaaac

SEQ ID NO: 3035304 - DNA, 23 bp, Homo sapiens
ctttaccaaaggtttttaaagta

SEQ ID NO: 3035305 - DNA, 16 bp, Homo sapiens
ctttacccttgagccc

SEQ ID NO: 3035306 - DNA, 18 bp, Homo sapiens
ctttactaagatgacatt

SEQ ID NO: 3035307 - DNA, 19 bp, Homo sapiens
ctttactcctcacacttac

SEQ ID NO: 3035308 - DNA, 15 bp, Homo sapiens
ctttactcctggctc

SEQ ID NO: 3035309 - DNA, 23 bp, Homo sapiens
ctttactgcctgaataaagagcc

SEQ ID NO: 3035310 - DNA, 23 bp, Homo sapiens
ctttactgggttggaagaaatat

SEQ ID NO: 3035311 - DNA, 14 bp, Homo sapiens
ctttactgtttgtt

SEQ ID NO: 3035312 - DNA, 22 bp, Homo sapiens
ctttagaatgagagtgtgaaat

SEQ ID NO: 3035313 - DNA, 15 bp, Homo sapiens
ctttagagaactgaa

SEQ ID NO: 3035314 - DNA, 20 bp, Homo sapiens
ctttagagaactgaaaagag

SEQ ID NO: 3035315 - DNA, 17 bp, Homo sapiens
ctttagagcaacagtaa

SEQ ID NO: 3035316 - DNA, 19 bp, Homo sapiens
ctttagtacctgaaaagta

SEQ ID NO: 3035317 - DNA, 18 bp, Homo sapiens
ctttagtgattgctttta

SEQ ID NO: 3035318 - DNA, 13 bp, Homo sapiens
ctttagtgtattt

SEQ ID NO: 3035319 - DNA, 22 bp, Homo sapiens
ctttagttgaattccaagtgta

SEQ ID NO: 3035320 - DNA, 13 bp, Homo sapiens
ctttatactctct

SEQ ID NO: 3035321 - DNA, 15 bp, Homo sapiens
ctttatactctcttc

SEQ ID NO: 3035322 - DNA, 15 bp, Homo sapiens
ctttatagttgtaga

SEQ ID NO: 3035323 - DNA, 13 bp, Homo sapiens
ctttatataaggt

SEQ ID NO: 3035324 - DNA, 20 bp, Homo sapiens
ctttatataaggtcatagat

SEQ ID NO: 3035325 - DNA, 17 bp, Homo sapiens
ctttatcacctcattct

SEQ ID NO: 3035326 - DNA, 20 bp, Homo sapiens
ctttatcacctcattctgaa

SEQ ID NO: 3035327 - DNA, 19 bp, Homo sapiens
ctttatcacctggcttgtt

SEQ ID NO: 3035328 - DNA, 20 bp, Homo sapiens
ctttatcacctggcttgttt

SEQ ID NO: 3035329 - DNA, 22 bp, Homo sapiens
ctttatcacctggcttgtttat

SEQ ID NO: 3035330 - DNA, 21 bp, Homo sapiens
ctttatctaatacctctgtgt

SEQ ID NO: 3035331 - DNA, 22 bp, Homo sapiens
ctttatgagctaaaaatatgca

SEQ ID NO: 3035332 - DNA, 20 bp, Homo sapiens
ctttatgataatagattctc

SEQ ID NO: 3035333 - DNA, 13 bp, Homo sapiens
ctttatgcttgca

SEQ ID NO: 3035334 - DNA, 16 bp, Homo sapiens
ctttatggtaaagatg

SEQ ID NO: 3035335 - DNA, 18 bp, Homo sapiens
ctttatgtggaaaacaga

SEQ ID NO: 3035336 - DNA, 12 bp, Homo sapiens
ctttatgtgtaa

SEQ ID NO: 3035337 - DNA, 14 bp, Homo sapiens
ctttattaaaaact

SEQ ID NO: 3035338 - DNA, 20 bp, Homo sapiens
ctttattaccccctccttca

SEQ ID NO: 3035339 - DNA, 20 bp, Homo sapiens
ctttattccagaatgctgta

SEQ ID NO: 3035340 - DNA, 13 bp, Homo sapiens
ctttattcttttc

SEQ ID NO: 3035341 - DNA, 14 bp, Homo sapiens
ctttattgcaatgc

SEQ ID NO: 3035342 - DNA, 11 bp, Homo sapiens
ctttatttctg

SEQ ID NO: 3035343 - DNA, 21 bp, Homo sapiens
ctttattttctataatttaaa

SEQ ID NO: 3035344 - DNA, 22 bp, Homo sapiens
ctttcaaagacaatcactgaaa

SEQ ID NO: 3035345 - DNA, 11 bp, Homo sapiens
ctttcaaattt

SEQ ID NO: 3035346 - DNA, 13 bp, Homo sapiens
ctttcaagaatga

SEQ ID NO: 3035347 - DNA, 14 bp, Homo sapiens
ctttcacacatctg

SEQ ID NO: 3035348 - DNA, 18 bp, Homo sapiens
ctttcagacttgccatgt

SEQ ID NO: 3035349 - DNA, 17 bp, Homo sapiens
ctttcagcgcccccagg

SEQ ID NO: 3035350 - DNA, 20 bp, Homo sapiens
ctttcagcgcccccaggcct

SEQ ID NO: 3035351 - DNA, 22 bp, Homo sapiens
ctttcagcgcccccaggcctgc

SEQ ID NO: 3035352 - DNA, 13 bp, Homo sapiens
ctttcagggcagc

SEQ ID NO: 3035353 - DNA, 17 bp, Homo sapiens
ctttcagggcagcccct

SEQ ID NO: 3035354 - DNA, 15 bp, Homo sapiens
ctttcagtacttttt

SEQ ID NO: 3035355 - DNA, 21 bp, Homo sapiens
ctttcagtacttttttaaata

SEQ ID NO: 3035356 - DNA, 23 bp, Homo sapiens
ctttcagtattaaactctccttt

SEQ ID NO: 3035357 - DNA, 18 bp, Homo sapiens
ctttcataatctttgctt

SEQ ID NO: 3035358 - DNA, 15 bp, Homo sapiens
ctttcatagagaggc

SEQ ID NO: 3035359 - DNA, 16 bp, Homo sapiens
ctttcatagagaggcc

SEQ ID NO: 3035360 - DNA, 19 bp, Homo sapiens
ctttcatagagaggcctgc

SEQ ID NO: 3035361 - DNA, 20 bp, Homo sapiens
ctttcatcaatgggattttc

SEQ ID NO: 3035362 - DNA, 23 bp, Homo sapiens
ctttcatcaatgggattttctag

SEQ ID NO: 3035363 - DNA, 15 bp, Homo sapiens
ctttcatccaactct

SEQ ID NO: 3035364 - DNA, 15 bp, Homo sapiens
ctttcatcctgtgtc

SEQ ID NO: 3035365 - DNA, 16 bp, Homo sapiens
ctttcatcctgtgtcc

SEQ ID NO: 3035366 - DNA, 22 bp, Homo sapiens
ctttcatgagtttttcccagct

SEQ ID NO: 3035367 - DNA, 22 bp, Homo sapiens
ctttcatgtgtgccaaggctga

SEQ ID NO: 3035368 - DNA, 17 bp, Homo sapiens
ctttcatttgaaagtgg

SEQ ID NO: 3035369 - DNA, 17 bp, Homo sapiens
ctttccaaaatttttca

SEQ ID NO: 3035370 - DNA, 18 bp, Homo sapiens
ctttccaaaatttttcaa

SEQ ID NO: 3035371 - DNA, 11 bp, Homo sapiens
ctttccaaaga

SEQ ID NO: 3035372 - DNA, 17 bp, Homo sapiens
ctttccaaatccaggag

SEQ ID NO: 3035373 - DNA, 15 bp, Homo sapiens
ctttccaaggcttct

SEQ ID NO: 3035374 - DNA, 15 bp, Homo sapiens
ctttccactcccact

SEQ ID NO: 3035375 - DNA, 16 bp, Homo sapiens
ctttccacttctctgg

SEQ ID NO: 3035376 - DNA, 23 bp, Homo sapiens
ctttccactttgttggcccttcc

SEQ ID NO: 3035377 - DNA, 21 bp, Homo sapiens
ctttccaggcttccctgactt

SEQ ID NO: 3035378 - DNA, 22 bp, Homo sapiens
ctttccagttccctttgcttgt

SEQ ID NO: 3035379 - DNA, 16 bp, Homo sapiens
ctttccatctgtccac

SEQ ID NO: 3035380 - DNA, 17 bp, Homo sapiens
ctttccatctgtccaca

SEQ ID NO: 3035381 - DNA, 23 bp, Homo sapiens
ctttccatctgtccacatcccca

SEQ ID NO: 3035382 - DNA, 18 bp, Homo sapiens
ctttccattggatctcat

SEQ ID NO: 3035383 - DNA, 16 bp, Homo sapiens
ctttcccaactctagc

SEQ ID NO: 3035384 - DNA, 13 bp, Homo sapiens
ctttccccagcct

SEQ ID NO: 3035385 - DNA, 19 bp, Homo sapiens
ctttccccattcctaccca

SEQ ID NO: 3035386 - DNA, 22 bp, Homo sapiens
ctttccctcctaaagctgaatc

SEQ ID NO: 3035387 - DNA, 22 bp, Homo sapiens
ctttccgtcaacgttgtactgt

SEQ ID NO: 3035388 - DNA, 16 bp, Homo sapiens
ctttcctaaggctgca

SEQ ID NO: 3035389 - DNA, 20 bp, Homo sapiens
ctttcctaaggctgcaaggt

SEQ ID NO: 3035390 - DNA, 16 bp, Homo sapiens
ctttcctactttctat

SEQ ID NO: 3035391 - DNA, 16 bp, Homo sapiens
gaccctgagctgacca

SEQ ID NO: 3035392 - DNA, 15 bp, Homo sapiens
gaccctgggcctgga

SEQ ID NO: 3035393 - DNA, 16 bp, Homo sapiens
gaccctgggcctggag

SEQ ID NO: 3035394 - DNA, 18 bp, Homo sapiens
gaccctgggggcacagga

SEQ ID NO: 3035395 - DNA, 11 bp, Homo sapiens
gaccctgtata

SEQ ID NO: 3035396 - DNA, 19 bp, Homo sapiens
gaccctgtatatagcccag

SEQ ID NO: 3035397 - DNA, 15 bp, Homo sapiens
gaccctgtgcaggag

SEQ ID NO: 3035398 - DNA, 17 bp, Homo sapiens
gacccttacagcctctg

SEQ ID NO: 3035399 - DNA, 18 bp, Homo sapiens
gaccgcccttttccccta

SEQ ID NO: 3035400 - DNA, 17 bp, Homo sapiens
gaccgcctcctgctctg

SEQ ID NO: 3035401 - DNA, 23 bp, Homo sapiens
gaccgggcactcccgggatgggt

SEQ ID NO: 3035402 - DNA, 21 bp, Homo sapiens
gaccgtgccattgtactccag

SEQ ID NO: 3035403 - DNA, 20 bp, Homo sapiens
gacctagaaatgtagcagca

SEQ ID NO: 3035404 - DNA, 22 bp, Homo sapiens
gacctatgtacttaatccttta

SEQ ID NO: 3035405 - DNA, 14 bp, Homo sapiens
gacctcagcctgca

SEQ ID NO: 3035406 - DNA, 18 bp, Homo sapiens
gacctcagggctatgtgg

SEQ ID NO: 3035407 - DNA, 15 bp, Homo sapiens
gacctccagtcctgc

SEQ ID NO: 3035408 - DNA, 20 bp, Homo sapiens
gacctccagtcctgctggcc

SEQ ID NO: 3035409 - DNA, 18 bp, Homo sapiens
gacctccgtgcccaggcc

SEQ ID NO: 3035410 - DNA, 22 bp, Homo sapiens
gacctcctgacaacgtctcttc

SEQ ID NO: 3035411 - DNA, 18 bp, Homo sapiens
gacctcggatgaccatac

SEQ ID NO: 3035412 - DNA, 13 bp, Homo sapiens
gacctcgtcctcc

SEQ ID NO: 3035413 - DNA, 16 bp, Homo sapiens
gacctcgtcctccccc

SEQ ID NO: 3035414 - DNA, 17 bp, Homo sapiens
gacctcgtcctccccct

SEQ ID NO: 3035415 - DNA, 22 bp, Homo sapiens
gacctcgtcctccccctgccag

SEQ ID NO: 3035416 - DNA, 19 bp, Homo sapiens
gacctctccatcttcagct

SEQ ID NO: 3035417 - DNA, 12 bp, Homo sapiens
gacctctcccag

SEQ ID NO: 3035418 - DNA, 17 bp, Homo sapiens
gacctctctcagcccca

SEQ ID NO: 3035419 - DNA, 22 bp, Homo sapiens
gacctctctcagccccatcgcc

SEQ ID NO: 3035420 - DNA, 15 bp, Homo sapiens
gacctgaaattccaa

SEQ ID NO: 3035421 - DNA, 23 bp, Homo sapiens
gacctgaaattccaaagtctcta

SEQ ID NO: 3035422 - DNA, 13 bp, Homo sapiens
gacctgaagttca

SEQ ID NO: 3035423 - DNA, 22 bp, Homo sapiens
gacctgaagttcaccattaaaa

SEQ ID NO: 3035424 - DNA, 21 bp, Homo sapiens
gacctgatcctggaggcccag

SEQ ID NO: 3035425 - DNA, 13 bp, Homo sapiens
gacctgatggaga

SEQ ID NO: 3035426 - DNA, 15 bp, Homo sapiens
gacctgatttattga

SEQ ID NO: 3035427 - DNA, 20 bp, Homo sapiens
gacctgatttattgaaattt

SEQ ID NO: 3035428 - DNA, 19 bp, Homo sapiens
gacctggactagggcctcg

SEQ ID NO: 3035429 - DNA, 11 bp, Homo sapiens
gacctggcagt

SEQ ID NO: 3035430 - DNA, 12 bp, Homo sapiens
gacctggcttgg

SEQ ID NO: 3035431 - DNA, 17 bp, Homo sapiens
gacctggtccacagggc

SEQ ID NO: 3035432 - DNA, 19 bp, Homo sapiens
gacctggtccacagggcac

SEQ ID NO: 3035433 - DNA, 14 bp, Homo sapiens
gacctggtgctcta

SEQ ID NO: 3035434 - DNA, 18 bp, Homo sapiens
gacctggttaaacaaacc

SEQ ID NO: 3035435 - DNA, 21 bp, Homo sapiens
gacctgtatatttgtaaagct

SEQ ID NO: 3035436 - DNA, 11 bp, Homo sapiens
gacctgtccag

SEQ ID NO: 3035437 - DNA, 15 bp, Homo sapiens
gacctgtgagcccag

SEQ ID NO: 3035438 - DNA, 16 bp, Homo sapiens
gacctgtgagcccagc

SEQ ID NO: 3035439 - DNA, 19 bp, Homo sapiens
gaccttaaatgctactgaa

SEQ ID NO: 3035440 - DNA, 22 bp, Homo sapiens
gaccttaatttaactttccagt

SEQ ID NO: 3035441 - DNA, 13 bp, Homo sapiens
gaccttaggcctt

SEQ ID NO: 3035442 - DNA, 16 bp, Homo sapiens
gaccttaggccttcct

SEQ ID NO: 3035443 - DNA, 20 bp, Homo sapiens
gaccttagtgtttctgtgca

SEQ ID NO: 3035444 - DNA, 18 bp, Homo sapiens
gaccttcagagccagccg

SEQ ID NO: 3035445 - DNA, 18 bp, Homo sapiens
gaccttccaagagcctga

SEQ ID NO: 3035446 - DNA, 19 bp, Homo sapiens
gaccttcgggctgtgcccg

SEQ ID NO: 3035447 - DNA, 17 bp, Homo sapiens
gaccttctgagaggggc

SEQ ID NO: 3035448 - DNA, 19 bp, Homo sapiens
gaccttctgatcttggaaa

SEQ ID NO: 3035449 - DNA, 16 bp, Homo sapiens
gacctttgcccacaca

SEQ ID NO: 3035450 - DNA, 14 bp, Homo sapiens
gacgaacttccatg

SEQ ID NO: 3035451 - DNA, 21 bp, Homo sapiens
gacgaacttccatggccctca

SEQ ID NO: 3035452 - DNA, 18 bp, Homo sapiens
gacgaagaagagccacag

SEQ ID NO: 3035453 - DNA, 15 bp, Homo sapiens
gacgaagagcaggcc

SEQ ID NO: 3035454 - DNA, 22 bp, Homo sapiens
gacgaatgcatattcaacacac

SEQ ID NO: 3035455 - DNA, 14 bp, Homo sapiens
gacgcaggcccctc

SEQ ID NO: 3035456 - DNA, 13 bp, Homo sapiens
gacgcaggccctg

SEQ ID NO: 3035457 - DNA, 17 bp, Homo sapiens
gacgcaggccctgtcca

SEQ ID NO: 3035458 - DNA, 15 bp, Homo sapiens
gacgccaataataaa

SEQ ID NO: 3035459 - DNA, 22 bp, Homo sapiens
gacgcccccgcccgcacagctc

SEQ ID NO: 3035460 - DNA, 12 bp, Homo sapiens
gacgcctggggg

SEQ ID NO: 3035461 - DNA, 21 bp, Homo sapiens
gacgcctgggggtgccaggac

SEQ ID NO: 3035462 - DNA, 16 bp, Homo sapiens
gacgcgaggggaaagg

SEQ ID NO: 3035463 - DNA, 14 bp, Homo sapiens
gacgctcttttcta

SEQ ID NO: 3035464 - DNA, 18 bp, Homo sapiens
gacgctgtgctggttctg

SEQ ID NO: 3035465 - DNA, 18 bp, Homo sapiens
gacggctccactaggact

SEQ ID NO: 3035466 - DNA, 13 bp, Homo sapiens
gacggctgggcac

SEQ ID NO: 3035467 - DNA, 20 bp, Homo sapiens
gacggctgtgacgcagccgg

SEQ ID NO: 3035468 - DNA, 16 bp, Homo sapiens
gacggctgtgggacca

SEQ ID NO: 3035469 - DNA, 11 bp, Homo sapiens
gacgggacaga

SEQ ID NO: 3035470 - DNA, 13 bp, Homo sapiens
gacgggccaggcc

SEQ ID NO: 3035471 - DNA, 16 bp, Homo sapiens
gacgggccaggccctg

SEQ ID NO: 3035472 - DNA, 20 bp, Homo sapiens
gacggggtcggacggggcag

SEQ ID NO: 3035473 - DNA, 17 bp, Homo sapiens
gacggggtttctccatg

SEQ ID NO: 3035474 - DNA, 16 bp, Homo sapiens
gacggtgcagtctggg

SEQ ID NO: 3035475 - DNA, 13 bp, Homo sapiens
gacggtgtcttgt

SEQ ID NO: 3035476 - DNA, 22 bp, Homo sapiens
gacggtttccagggaggggccg

SEQ ID NO: 3035477 - DNA, 18 bp, Homo sapiens
gacgtcccttttttctct

SEQ ID NO: 3035478 - DNA, 15 bp, Homo sapiens
gacgtgactcagagc

SEQ ID NO: 3035479 - DNA, 12 bp, Homo sapiens
gacgtggctcag

SEQ ID NO: 3035480 - DNA, 15 bp, Homo sapiens
gacgtggctcagcca

SEQ ID NO: 3035481 - DNA, 16 bp, Homo sapiens
gacgtggctcagccag

SEQ ID NO: 3035482 - DNA, 13 bp, Homo sapiens
gacgtgggccctg

SEQ ID NO: 3035483 - DNA, 19 bp, Homo sapiens
gacgtgggccctgcaggct

SEQ ID NO: 3035484 - DNA, 13 bp, Homo sapiens
gacgtgggctggg

SEQ ID NO: 3035485 - DNA, 20 bp, Homo sapiens
gacgtgttacccactgccat

SEQ ID NO: 3035486 - DNA, 18 bp, Homo sapiens
gacgtttacaagcccccc

SEQ ID NO: 3035487 - DNA, 12 bp, Homo sapiens
gacgtttctcat

SEQ ID NO: 3035488 - DNA, 18 bp, Homo sapiens
gactaaaatgtttcattt

SEQ ID NO: 3035489 - DNA, 18 bp, Homo sapiens
gactaaccccaccacacc

SEQ ID NO: 3035490 - DNA, 17 bp, Homo sapiens
gactaaccctgtggttg

SEQ ID NO: 3035491 - DNA, 21 bp, Homo sapiens
gactaactagacaccaaagtt

SEQ ID NO: 3035492 - DNA, 19 bp, Homo sapiens
gactaagccaagctgtgtt

SEQ ID NO: 3035493 - DNA, 14 bp, Homo sapiens
gactaatggcatga

SEQ ID NO: 3035494 - DNA, 20 bp, Homo sapiens
gactaatggcatgagaaata

SEQ ID NO: 3035495 - DNA, 15 bp, Homo sapiens
gactaattgtataac

SEQ ID NO: 3035496 - DNA, 20 bp, Homo sapiens
gactaattgtataacaggtt

SEQ ID NO: 3035497 - DNA, 13 bp, Homo sapiens
gactaatttcaaa

SEQ ID NO: 3035498 - DNA, 17 bp, Homo sapiens
gactacattttgctctg

SEQ ID NO: 3035499 - DNA, 22 bp, Homo sapiens
gactacctactggtgtaatctc

SEQ ID NO: 3035500 - DNA, 14 bp, Homo sapiens
gactacctgggacc

SEQ ID NO: 3035501 - DNA, 18 bp, Homo sapiens
gactacttgggagcaccg

SEQ ID NO: 3035502 - DNA, 20 bp, Homo sapiens
gactacttgggagcaccgcc

SEQ ID NO: 3035503 - DNA, 12 bp, Homo sapiens
gactagaattct

SEQ ID NO: 3035504 - DNA, 17 bp, Homo sapiens
gactagagggacctctc

SEQ ID NO: 3035505 - DNA, 19 bp, Homo sapiens
gactagagggacctctccc

SEQ ID NO: 3035506 - DNA, 20 bp, Homo sapiens
gactagagggacctctccca

SEQ ID NO: 3035507 - DNA, 14 bp, Homo sapiens
gactagatgatgga

SEQ ID NO: 3035508 - DNA, 14 bp, Homo sapiens
gactataaagctgt

SEQ ID NO: 3035509 - DNA, 19 bp, Homo sapiens
gactatatttgggcctgct

SEQ ID NO: 3035510 - DNA, 15 bp, Homo sapiens
gactatggaatgtca

SEQ ID NO: 3035511 - DNA, 22 bp, Homo sapiens
gactattaggtgcaatttcaag

SEQ ID NO: 3035512 - DNA, 15 bp, Homo sapiens
gactattatgttgtt

SEQ ID NO: 3035513 - DNA, 17 bp, Homo sapiens
gactattccttttctgt

SEQ ID NO: 3035514 - DNA, 19 bp, Homo sapiens
gactatttgacccccacaa

SEQ ID NO: 3035515 - DNA, 18 bp, Homo sapiens
gactcaaagtttcagaga

SEQ ID NO: 3035516 - DNA, 22 bp, Homo sapiens
gactcaaatgctcagaccagct

SEQ ID NO: 3035517 - DNA, 15 bp, Homo sapiens
gactcaaatgttcta

SEQ ID NO: 3035518 - DNA, 18 bp, Homo sapiens
gactcaaatgttctaagt

SEQ ID NO: 3035519 - DNA, 18 bp, Homo sapiens
gactcacaacctgaacct

SEQ ID NO: 3035520 - DNA, 19 bp, Homo sapiens
gactcacaacctgaaccta

SEQ ID NO: 3035521 - DNA, 14 bp, Homo sapiens
gactcacctctgcc

SEQ ID NO: 3035522 - DNA, 14 bp, Homo sapiens
gactcactggcagc

SEQ ID NO: 3035523 - DNA, 23 bp, Homo sapiens
gactcacttgatgtttcctggaa

SEQ ID NO: 3035524 - DNA, 13 bp, Homo sapiens
gagagggtctgga

SEQ ID NO: 3035525 - DNA, 21 bp, Homo sapiens
gagaggtggccaccgggggtg

SEQ ID NO: 3035526 - DNA, 20 bp, Homo sapiens
gagaggttaaagcaaaccag

SEQ ID NO: 3035527 - DNA, 18 bp, Homo sapiens
gagagtagccgagagcct

SEQ ID NO: 3035528 - DNA, 20 bp, Homo sapiens
gagagtagccgagagcctgc

SEQ ID NO: 3035529 - DNA, 22 bp, Homo sapiens
gagagtagccgagagcctgctc

SEQ ID NO: 3035530 - DNA, 13 bp, Homo sapiens
gagagtctagatt

SEQ ID NO: 3035531 - DNA, 16 bp, Homo sapiens
gagagtctagattctc

SEQ ID NO: 3035532 - DNA, 15 bp, Homo sapiens
gagagtgagtgcctt

SEQ ID NO: 3035533 - DNA, 23 bp, Homo sapiens
gagagtgtcaaccagacagaggg

SEQ ID NO: 3035534 - DNA, 21 bp, Homo sapiens
gagagtgtcttcacggcagga

SEQ ID NO: 3035535 - DNA, 20 bp, Homo sapiens
gagagtgtgaaatagacatt

SEQ ID NO: 3035536 - DNA, 11 bp, Homo sapiens
gagagtgtgac

SEQ ID NO: 3035537 - DNA, 17 bp, Homo sapiens
gagagttttgtcttgaa

SEQ ID NO: 3035538 - DNA, 19 bp, Homo sapiens
gagataaaccaataaatcc

SEQ ID NO: 3035539 - DNA, 20 bp, Homo sapiens
gagataaaccaataaatcca

SEQ ID NO: 3035540 - DNA, 16 bp, Homo sapiens
gagataatacattccg

SEQ ID NO: 3035541 - DNA, 15 bp, Homo sapiens
gagatactattttca

SEQ ID NO: 3035542 - DNA, 15 bp, Homo sapiens
gagatagcattgtga

SEQ ID NO: 3035543 - DNA, 20 bp, Homo sapiens
gagatagcattgtgaactga

SEQ ID NO: 3035544 - DNA, 23 bp, Homo sapiens
gagatagcattgtgaactgacag

SEQ ID NO: 3035545 - DNA, 14 bp, Homo sapiens
gagatagcctgtgg

SEQ ID NO: 3035546 - DNA, 16 bp, Homo sapiens
gagatagcctgtggcc

SEQ ID NO: 3035547 - DNA, 20 bp, Homo sapiens
gagatagcctgtggccctgt

SEQ ID NO: 3035548 - DNA, 21 bp, Homo sapiens
gagatagcctgtggccctgtc

SEQ ID NO: 3035549 - DNA, 14 bp, Homo sapiens
gagatattataagg

SEQ ID NO: 3035550 - DNA, 22 bp, Homo sapiens
gagatatttatggggggagaac

SEQ ID NO: 3035551 - DNA, 22 bp, Homo sapiens
gagatcacgccattgtactcca

SEQ ID NO: 3035552 - DNA, 19 bp, Homo sapiens
gagatcccaacactgccag

SEQ ID NO: 3035553 - DNA, 15 bp, Homo sapiens
gagatcgtgccactg

SEQ ID NO: 3035554 - DNA, 18 bp, Homo sapiens
gagatctgaacccagctg

SEQ ID NO: 3035555 - DNA, 23 bp, Homo sapiens
gagatctgcacagtcagaaggac

SEQ ID NO: 3035556 - DNA, 21 bp, Homo sapiens
gagatgacccctaccccctca

SEQ ID NO: 3035557 - DNA, 20 bp, Homo sapiens
gagatgatgaaaatatttaa

SEQ ID NO: 3035558 - DNA, 13 bp, Homo sapiens
gagatgatttgta

SEQ ID NO: 3035559 - DNA, 20 bp, Homo sapiens
gagatgcctccaccgctgcc

SEQ ID NO: 3035560 - DNA, 22 bp, Homo sapiens
gagatgcctccaccgctgccta

SEQ ID NO: 3035561 - DNA, 14 bp, Homo sapiens
gagatgcttggagc

SEQ ID NO: 3035562 - DNA, 16 bp, Homo sapiens
gagatggagtttctct

SEQ ID NO: 3035563 - DNA, 16 bp, Homo sapiens
gagatgggggtgtatt

SEQ ID NO: 3035564 - DNA, 15 bp, Homo sapiens
gagatgtttgccaaa

SEQ ID NO: 3035565 - DNA, 12 bp, Homo sapiens
gagattgaactt

SEQ ID NO: 3035566 - DNA, 22 bp, Homo sapiens
gagattgtagtatttagtatat

SEQ ID NO: 3035567 - DNA, 19 bp, Homo sapiens
gagcaaaaatgtaaaaaac

SEQ ID NO: 3035568 - DNA, 21 bp, Homo sapiens
gagcaaaaatgtaaaaaacaa

SEQ ID NO: 3035569 - DNA, 20 bp, Homo sapiens
gagcaaaactccgtctcaaa

SEQ ID NO: 3035570 - DNA, 15 bp, Homo sapiens
gagcaacctactgtc

SEQ ID NO: 3035571 - DNA, 18 bp, Homo sapiens
gagcaacctactgtctaa

SEQ ID NO: 3035572 - DNA, 12 bp, Homo sapiens
gagcaagcctag

SEQ ID NO: 3035573 - DNA, 20 bp, Homo sapiens
gagcaagggttccctcaaga

SEQ ID NO: 3035574 - DNA, 20 bp, Homo sapiens
gagcaaggtttcgtggcagc

SEQ ID NO: 3035575 - DNA, 18 bp, Homo sapiens
gagcaagttccttctggt

SEQ ID NO: 3035576 - DNA, 14 bp, Homo sapiens
gagcaagttgcagt

SEQ ID NO: 3035577 - DNA, 18 bp, Homo sapiens
gagcaatcacaggaaaat

SEQ ID NO: 3035578 - DNA, 13 bp, Homo sapiens
gagcacaatctgt

SEQ ID NO: 3035579 - DNA, 15 bp, Homo sapiens
gagcacacccagccc

SEQ ID NO: 3035580 - DNA, 16 bp, Homo sapiens
gagcacagcctcactc

SEQ ID NO: 3035581 - DNA, 17 bp, Homo sapiens
gagcaccacggccagaa

SEQ ID NO: 3035582 - DNA, 13 bp, Homo sapiens
gagcaccagggga

SEQ ID NO: 3035583 - DNA, 14 bp, Homo sapiens
gagcacctccacat

SEQ ID NO: 3035584 - DNA, 19 bp, Homo sapiens
gagcacctccacatcctcc

SEQ ID NO: 3035585 - DNA, 23 bp, Homo sapiens
gagcacctgccagaggatgctct

SEQ ID NO: 3035586 - DNA, 13 bp, Homo sapiens
gagcacctggacc

SEQ ID NO: 3035587 - DNA, 22 bp, Homo sapiens
gagcacctggaccccctgcccg

SEQ ID NO: 3035588 - DNA, 15 bp, Homo sapiens
gagcacgcctgccat

SEQ ID NO: 3035589 - DNA, 17 bp, Homo sapiens
gagcacgcctgccatct

SEQ ID NO: 3035590 - DNA, 22 bp, Homo sapiens
gagcacgcctgccatcttctcc

SEQ ID NO: 3035591 - DNA, 17 bp, Homo sapiens
gagcactcctgattttt

SEQ ID NO: 3035592 - DNA, 22 bp, Homo sapiens
gagcactggagtggctcgccag

SEQ ID NO: 3035593 - DNA, 14 bp, Homo sapiens
gagcactgtgttca

SEQ ID NO: 3035594 - DNA, 20 bp, Homo sapiens
gagcactgtgttcacacttt

SEQ ID NO: 3035595 - DNA, 14 bp, Homo sapiens
gagcagacaggaca

SEQ ID NO: 3035596 - DNA, 14 bp, Homo sapiens
gagcagaggtctcc

SEQ ID NO: 3035597 - DNA, 18 bp, Homo sapiens
gagcagcttcggtgtgca

SEQ ID NO: 3035598 - DNA, 16 bp, Homo sapiens
gagcaggccagcccgg

SEQ ID NO: 3035599 - DNA, 18 bp, Homo sapiens
gagcaggcggtgggcacc

SEQ ID NO: 3035600 - DNA, 14 bp, Homo sapiens
gagcagggcggctg

SEQ ID NO: 3035601 - DNA, 16 bp, Homo sapiens
gagcagggcggctgcc

SEQ ID NO: 3035602 - DNA, 17 bp, Homo sapiens
gagcagggcggctgccg

SEQ ID NO: 3035603 - DNA, 15 bp, Homo sapiens
gagcaggggctgctg

SEQ ID NO: 3035604 - DNA, 20 bp, Homo sapiens
gagcaggggctgctgggggc

SEQ ID NO: 3035605 - DNA, 23 bp, Homo sapiens
gagcagtaactgtccctgctttc

SEQ ID NO: 3035606 - DNA, 15 bp, Homo sapiens
gagcagtccctgctt

SEQ ID NO: 3035607 - DNA, 16 bp, Homo sapiens
gagcagtccctgctta

SEQ ID NO: 3035608 - DNA, 14 bp, Homo sapiens
gagcagtgggcagg

SEQ ID NO: 3035609 - DNA, 17 bp, Homo sapiens
gagcagtgggcaggtgg

SEQ ID NO: 3035610 - DNA, 18 bp, Homo sapiens
gagcagtgggcaggtggc

SEQ ID NO: 3035611 - DNA, 21 bp, Homo sapiens
gagcatacatcttaaatcttt

SEQ ID NO: 3035612 - DNA, 22 bp, Homo sapiens
gagcatagtccaaaaagctcct

SEQ ID NO: 3035613 - DNA, 13 bp, Homo sapiens
gagcatcacagaa

SEQ ID NO: 3035614 - DNA, 17 bp, Homo sapiens
gagcatcactagtgaca

SEQ ID NO: 3035615 - DNA, 17 bp, Homo sapiens
gagcatctcaaatgttt

SEQ ID NO: 3035616 - DNA, 21 bp, Homo sapiens
gagcatctcaaatgttttctg

SEQ ID NO: 3035617 - DNA, 23 bp, Homo sapiens
gagcatctccagcattctcagcc

SEQ ID NO: 3035618 - DNA, 18 bp, Homo sapiens
gagcatgcggagccagca

SEQ ID NO: 3035619 - DNA, 20 bp, Homo sapiens
gagcatgcggagccagcagg

SEQ ID NO: 3035620 - DNA, 16 bp, Homo sapiens
gagcattaaaataact

SEQ ID NO: 3035621 - DNA, 20 bp, Homo sapiens
gagcattcaggcagcactga

SEQ ID NO: 3035622 - DNA, 21 bp, Homo sapiens
gagcatttatgtagacattgt

SEQ ID NO: 3035623 - DNA, 15 bp, Homo sapiens
gagccaaagccagag

SEQ ID NO: 3035624 - DNA, 20 bp, Homo sapiens
gagccaaaggcatccaggcc

SEQ ID NO: 3035625 - DNA, 22 bp, Homo sapiens
gagccacaggcaggggtgagag

SEQ ID NO: 3035626 - DNA, 23 bp, Homo sapiens
gagccaccacacctggctaattt

SEQ ID NO: 3035627 - DNA, 18 bp, Homo sapiens
gagccaccgcgcccagcc

SEQ ID NO: 3035628 - DNA, 15 bp, Homo sapiens
gagccagagaagtga

SEQ ID NO: 3035629 - DNA, 15 bp, Homo sapiens
gagccagccctccct

SEQ ID NO: 3035630 - DNA, 11 bp, Homo sapiens
gagccagggta

SEQ ID NO: 3035631 - DNA, 13 bp, Homo sapiens
gagccagggtaga

SEQ ID NO: 3035632 - DNA, 17 bp, Homo sapiens
gagccagggtagagcaa

SEQ ID NO: 3035633 - DNA, 19 bp, Homo sapiens
gagccagttgtcctatgga

SEQ ID NO: 3035634 - DNA, 23 bp, Homo sapiens
gagccagttgtcctatggacaac

SEQ ID NO: 3035635 - DNA, 23 bp, Homo sapiens
gagccatataagtttgaaggaaa

SEQ ID NO: 3035636 - DNA, 18 bp, Homo sapiens
gagccatggaaggtgcca

SEQ ID NO: 3035637 - DNA, 17 bp, Homo sapiens
gagccatgggcacaaag

SEQ ID NO: 3035638 - DNA, 18 bp, Homo sapiens
gagccatgggcacaaagg

SEQ ID NO: 3035639 - DNA, 11 bp, Homo sapiens
gagcccaccca

SEQ ID NO: 3035640 - DNA, 11 bp, Homo sapiens
gagcccactgt

SEQ ID NO: 3035641 - DNA, 22 bp, Homo sapiens
gagcccagattgtgccactgct

SEQ ID NO: 3035642 - DNA, 15 bp, Homo sapiens
gagcccagccctccc

SEQ ID NO: 3035643 - DNA, 14 bp, Homo sapiens
gagcccagctccaa

SEQ ID NO: 3035644 - DNA, 12 bp, Homo sapiens
gagcccagctct

SEQ ID NO: 3035645 - DNA, 22 bp, Homo sapiens
gagcccaggggagaatgcagcc

SEQ ID NO: 3035646 - DNA, 14 bp, Homo sapiens
gagcccattgtgga

SEQ ID NO: 3035647 - DNA, 12 bp, Homo sapiens
gagccccatctg

SEQ ID NO: 3035648 - DNA, 13 bp, Homo sapiens
gagccccatcttc

SEQ ID NO: 3035649 - DNA, 19 bp, Homo sapiens
gagccccatcttcacccag

SEQ ID NO: 3035650 - DNA, 20 bp, Homo sapiens
gagccccatcttcacccagg

SEQ ID NO: 3035651 - DNA, 18 bp, Homo sapiens
gagccccattcctgggaa

SEQ ID NO: 3035652 - DNA, 21 bp, Homo sapiens
gagcccctcagacagccccct

SEQ ID NO: 3035653 - DNA, 17 bp, Homo sapiens
gagccccttctgctcag

SEQ ID NO: 3035654 - DNA, 20 bp, Homo sapiens
gagccccttctgctcagctc

SEQ ID NO: 3035655 - DNA, 14 bp, Homo sapiens
gagcccgcactgtc

SEQ ID NO: 3035656 - DNA, 19 bp, Homo sapiens
gagttaaaatgtttactgt

SEQ ID NO: 3035657 - DNA, 21 bp, Homo sapiens
gagttaaaatgtttactgtaa

SEQ ID NO: 3035658 - DNA, 23 bp, Homo sapiens
gagttaaaatgtttactgtaaat

SEQ ID NO: 3035659 - DNA, 14 bp, Homo sapiens
gagttaagacctgg

SEQ ID NO: 3035660 - DNA, 17 bp, Homo sapiens
gagttaggctattcaca

SEQ ID NO: 3035661 - DNA, 16 bp, Homo sapiens
gagttattcaaatgaa

SEQ ID NO: 3035662 - DNA, 15 bp, Homo sapiens
gagttcaactacatg

SEQ ID NO: 3035663 - DNA, 18 bp, Homo sapiens
gagttcaagaccagcctg

SEQ ID NO: 3035664 - DNA, 21 bp, Homo sapiens
gagttcaggtagctgcccctg

SEQ ID NO: 3035665 - DNA, 19 bp, Homo sapiens
gagttccagttcctctttg

SEQ ID NO: 3035666 - DNA, 23 bp, Homo sapiens
gagttcgtgaagagggaagccag

SEQ ID NO: 3035667 - DNA, 20 bp, Homo sapiens
gagttctcactatgtttctc

SEQ ID NO: 3035668 - DNA, 21 bp, Homo sapiens
gagttctcactatgtttctca

SEQ ID NO: 3035669 - DNA, 22 bp, Homo sapiens
gagttctttgcaagcttattta

SEQ ID NO: 3035670 - DNA, 21 bp, Homo sapiens
gagttgaaaatcttataattt

SEQ ID NO: 3035671 - DNA, 14 bp, Homo sapiens
gagttgatctggaa

SEQ ID NO: 3035672 - DNA, 21 bp, Homo sapiens
gagttgatctggaacccagac

SEQ ID NO: 3035673 - DNA, 20 bp, Homo sapiens
gagttgcaccattctttctt

SEQ ID NO: 3035674 - DNA, 20 bp, Homo sapiens
gagttggcgttgtgggcagg

SEQ ID NO: 3035675 - DNA, 16 bp, Homo sapiens
gagttggggaaggcaa

SEQ ID NO: 3035676 - DNA, 14 bp, Homo sapiens
gagttgtcactgct

SEQ ID NO: 3035677 - DNA, 16 bp, Homo sapiens
gagttgttgtgtacag

SEQ ID NO: 3035678 - DNA, 15 bp, Homo sapiens
gagtttagggtgggg

SEQ ID NO: 3035679 - DNA, 19 bp, Homo sapiens
gagtttatacagtgtacat

SEQ ID NO: 3035680 - DNA, 21 bp, Homo sapiens
gagtttatacagtgtacatgt

SEQ ID NO: 3035681 - DNA, 22 bp, Homo sapiens
gagtttatttttttgatggcta

SEQ ID NO: 3035682 - DNA, 13 bp, Homo sapiens
gagtttcagctgg

SEQ ID NO: 3035683 - DNA, 16 bp, Homo sapiens
gagtttcagctggaaa

SEQ ID NO: 3035684 - DNA, 17 bp, Homo sapiens
gagtttcagctggaaac

SEQ ID NO: 3035685 - DNA, 12 bp, Homo sapiens
gagtttctaagg

SEQ ID NO: 3035686 - DNA, 17 bp, Homo sapiens
gagtttgagaccaggct

SEQ ID NO: 3035687 - DNA, 14 bp, Homo sapiens
gagtttgctgtttt

SEQ ID NO: 3035688 - DNA, 20 bp, Homo sapiens
gagtttggttaatcagtgtt

SEQ ID NO: 3035689 - DNA, 23 bp, Homo sapiens
gagttttcttatatatatattga

SEQ ID NO: 3035690 - DNA, 21 bp, Homo sapiens
gagttttctttctttctgttt

SEQ ID NO: 3035691 - DNA, 19 bp, Homo sapiens
gagttttgttttaaaatta

SEQ ID NO: 3035692 - DNA, 18 bp, Homo sapiens
gagtttttatggggctga

SEQ ID NO: 3035693 - DNA, 20 bp, Homo sapiens
gagtttttattttgtctctg

SEQ ID NO: 3035694 - DNA, 19 bp, Homo sapiens
gataaaaaagaaaacattc

SEQ ID NO: 3035695 - DNA, 17 bp, Homo sapiens
gataaaaaggaaggaga

SEQ ID NO: 3035696 - DNA, 21 bp, Homo sapiens
gataaaagaaaaacctgtgat

SEQ ID NO: 3035697 - DNA, 17 bp, Homo sapiens
gataaaatactaaacta

SEQ ID NO: 3035698 - DNA, 15 bp, Homo sapiens
gataaaatgttcctt

SEQ ID NO: 3035699 - DNA, 13 bp, Homo sapiens
gataaacattcat

SEQ ID NO: 3035700 - DNA, 22 bp, Homo sapiens
gataaactgagcctcacttgcc

SEQ ID NO: 3035701 - DNA, 14 bp, Homo sapiens
gataaataaaagat

SEQ ID NO: 3035702 - DNA, 18 bp, Homo sapiens
gataaataatcggcccac

SEQ ID NO: 3035703 - DNA, 21 bp, Homo sapiens
gataaataatgtagttttgtt

SEQ ID NO: 3035704 - DNA, 18 bp, Homo sapiens
gataaatcagtggttatt

SEQ ID NO: 3035705 - DNA, 13 bp, Homo sapiens
gataacaaagata

SEQ ID NO: 3035706 - DNA, 17 bp, Homo sapiens
gataacaaagatatctt

SEQ ID NO: 3035707 - DNA, 17 bp, Homo sapiens
gataacatttgtgtgtt

SEQ ID NO: 3035708 - DNA, 18 bp, Homo sapiens
gataacttgctttcttct

SEQ ID NO: 3035709 - DNA, 22 bp, Homo sapiens
gataagagtagaaactgcaggg

SEQ ID NO: 3035710 - DNA, 14 bp, Homo sapiens
gataagatggtttc

SEQ ID NO: 3035711 - DNA, 16 bp, Homo sapiens
gataagcacattaaag

SEQ ID NO: 3035712 - DNA, 13 bp, Homo sapiens
gataaggaagaaa

SEQ ID NO: 3035713 - DNA, 15 bp, Homo sapiens
gataaggaagaaaca

SEQ ID NO: 3035714 - DNA, 19 bp, Homo sapiens
gataagtgttcttcagtgt

SEQ ID NO: 3035715 - DNA, 21 bp, Homo sapiens
gataagtgttcttcagtgtaa

SEQ ID NO: 3035716 - DNA, 13 bp, Homo sapiens
gataataaaaatt

SEQ ID NO: 3035717 - DNA, 11 bp, Homo sapiens
gataataataa

SEQ ID NO: 3035718 - DNA, 15 bp, Homo sapiens
gataatcttttacat

SEQ ID NO: 3035719 - DNA, 20 bp, Homo sapiens
gataatgaaataatcagtga

SEQ ID NO: 3035720 - DNA, 23 bp, Homo sapiens
gataatgaaataatcagtgactg

SEQ ID NO: 3035721 - DNA, 12 bp, Homo sapiens
gataatttcagg

SEQ ID NO: 3035722 - DNA, 16 bp, Homo sapiens
gatacaagattagaag

SEQ ID NO: 3035723 - DNA, 21 bp, Homo sapiens
gatacacccaaagtatcagga

SEQ ID NO: 3035724 - DNA, 14 bp, Homo sapiens
gatacagtcattat

SEQ ID NO: 3035725 - DNA, 17 bp, Homo sapiens
gatacagtgttttttag

SEQ ID NO: 3035726 - DNA, 21 bp, Homo sapiens
gataccacttttcattgcaaa

SEQ ID NO: 3035727 - DNA, 15 bp, Homo sapiens
gataccagcgaggag

SEQ ID NO: 3035728 - DNA, 15 bp, Homo sapiens
gataccagctcaggg

SEQ ID NO: 3035729 - DNA, 16 bp, Homo sapiens
gataccagctcagggg

SEQ ID NO: 3035730 - DNA, 13 bp, Homo sapiens
gataccagctgga

SEQ ID NO: 3035731 - DNA, 16 bp, Homo sapiens
gataccatatgaatga

SEQ ID NO: 3035732 - DNA, 14 bp, Homo sapiens
gatacctaaaacat

SEQ ID NO: 3035733 - DNA, 11 bp, Homo sapiens
gataccttcaa

SEQ ID NO: 3035734 - DNA, 16 bp, Homo sapiens
gataccttgaaaaagt

SEQ ID NO: 3035735 - DNA, 13 bp, Homo sapiens
gatactattttca

SEQ ID NO: 3035736 - DNA, 14 bp, Homo sapiens
gatactcatttctt

SEQ ID NO: 3035737 - DNA, 20 bp, Homo sapiens
gatactgcatgtttgctgtt

SEQ ID NO: 3035738 - DNA, 22 bp, Homo sapiens
gatactgtgagcttacattgaa

SEQ ID NO: 3035739 - DNA, 13 bp, Homo sapiens
gatagaactgtac

SEQ ID NO: 3035740 - DNA, 15 bp, Homo sapiens
gatagaactgtactg

SEQ ID NO: 3035741 - DNA, 15 bp, Homo sapiens
gatagagcctttgat

SEQ ID NO: 3035742 - DNA, 18 bp, Homo sapiens
gatagatgactttgcaga

SEQ ID NO: 3035743 - DNA, 21 bp, Homo sapiens
gatagatgctggcccagggcc

SEQ ID NO: 3035744 - DNA, 13 bp, Homo sapiens
gatagatgtttga

SEQ ID NO: 3035745 - DNA, 20 bp, Homo sapiens
gatagattgtatctcttaaa

SEQ ID NO: 3035746 - DNA, 20 bp, Homo sapiens
gatagccttgaaaacaaaca

SEQ ID NO: 3035747 - DNA, 16 bp, Homo sapiens
gatagctaactgtaaa

SEQ ID NO: 3035748 - DNA, 19 bp, Homo sapiens
gatagctaactgtaaatca

SEQ ID NO: 3035749 - DNA, 19 bp, Homo sapiens
gataggaaaaatgagtaat

SEQ ID NO: 3035750 - DNA, 21 bp, Homo sapiens
gataggactccatttctttct

SEQ ID NO: 3035751 - DNA, 14 bp, Homo sapiens
gataggagggggcg

SEQ ID NO: 3035752 - DNA, 17 bp, Homo sapiens
gatagtactaagcattt

SEQ ID NO: 3035753 - DNA, 16 bp, Homo sapiens
gatagtctgggtcaga

SEQ ID NO: 3035754 - DNA, 13 bp, Homo sapiens
gatagtgagattt

SEQ ID NO: 3035755 - DNA, 17 bp, Homo sapiens
gatagtgcttcttgtaa

SEQ ID NO: 3035756 - DNA, 23 bp, Homo sapiens
gatagtggggagacttcttggct

SEQ ID NO: 3035757 - DNA, 16 bp, Homo sapiens
gatataaattaattgt

SEQ ID NO: 3035758 - DNA, 21 bp, Homo sapiens
gatataaattaattgtgcctg

SEQ ID NO: 3035759 - DNA, 16 bp, Homo sapiens
gatatatctttatact

SEQ ID NO: 3035760 - DNA, 22 bp, Homo sapiens
gatatatgtattaataaataga

SEQ ID NO: 3035761 - DNA, 12 bp, Homo sapiens
gatatcaaaatt

SEQ ID NO: 3035762 - DNA, 14 bp, Homo sapiens
gatatcaaaattct

SEQ ID NO: 3035763 - DNA, 15 bp, Homo sapiens
gatatccatcttttt

SEQ ID NO: 3035764 - DNA, 21 bp, Homo sapiens
gatatgagttgttttcagact

SEQ ID NO: 3035765 - DNA, 14 bp, Homo sapiens
gatatgatttaaaa

SEQ ID NO: 3035766 - DNA, 20 bp, Homo sapiens
gatatgatttaaaacatgta

SEQ ID NO: 3035767 - DNA, 14 bp, Homo sapiens
gatatgcttagtaa

SEQ ID NO: 3035768 - DNA, 23 bp, Homo sapiens
gatatgttttatttcattggtta

SEQ ID NO: 3035769 - DNA, 18 bp, Homo sapiens
gatattataagggagagc

SEQ ID NO: 3035770 - DNA, 17 bp, Homo sapiens
gatattcagaattatga

SEQ ID NO: 3035771 - DNA, 19 bp, Homo sapiens
gatattcttctcttgcttt

SEQ ID NO: 3035772 - DNA, 19 bp, Homo sapiens
gatattgtcctaagtgtca

SEQ ID NO: 3035773 - DNA, 20 bp, Homo sapiens
gatattgtgaacatttgtga

SEQ ID NO: 3035774 - DNA, 20 bp, Homo sapiens
gatatttaaaagacaaacac

SEQ ID NO: 3035775 - DNA, 11 bp, Homo sapiens
gatatttcatg

SEQ ID NO: 3035776 - DNA, 21 bp, Homo sapiens
gatatttctacaaggtgttca

SEQ ID NO: 3035777 - DNA, 23 bp, Homo sapiens
gatatttctatttcctggaatgg

SEQ ID NO: 3035778 - DNA, 22 bp, Homo sapiens
gatatttctctagtagttaaaa

SEQ ID NO: 3035779 - DNA, 14 bp, Homo sapiens
gatattttgaaatg

SEQ ID NO: 3035780 - DNA, 16 bp, Homo sapiens
gatattttgaaatgaa

SEQ ID NO: 3035781 - DNA, 14 bp, Homo sapiens
gatatttttattca

SEQ ID NO: 3035782 - DNA, 20 bp, Homo sapiens
gatcaagcatgaaaggcttt

SEQ ID NO: 3035783 - DNA, 13 bp, Homo sapiens
gatcaaggcctta

SEQ ID NO: 3035784 - DNA, 22 bp, Homo sapiens
gatcaaggccttattggaaagc

SEQ ID NO: 3035785 - DNA, 15 bp, Homo sapiens
gatcaaggtgaaata

SEQ ID NO: 3035786 - DNA, 16 bp, Homo sapiens
gatcaattatagtttc

SEQ ID NO: 3035787 - DNA, 19 bp, Homo sapiens
gatcaattatagtttctga

SEQ ID NO: 3035788 - DNA, 15 bp, Homo sapiens
gatttttagaattaa

SEQ ID NO: 3035789 - DNA, 19 bp, Homo sapiens
gatttttattaactgcttt

SEQ ID NO: 3035790 - DNA, 23 bp, Homo sapiens
gatttttctggaggttgataact

SEQ ID NO: 3035791 - DNA, 21 bp, Homo sapiens
gatttttgttttccactgtgc

SEQ ID NO: 3035792 - DNA, 21 bp, Homo sapiens
gattttttcagacttgtcaag

SEQ ID NO: 3035793 - DNA, 19 bp, Homo sapiens
gatttttttataaacagtt

SEQ ID NO: 3035794 - DNA, 18 bp, Homo sapiens
gatttttttgttcttgtt

SEQ ID NO: 3035795 - DNA, 13 bp, Homo sapiens
gcaaaaaaagaaa

SEQ ID NO: 3035796 - DNA, 12 bp, Homo sapiens
gcaaaaaaatta

SEQ ID NO: 3035797 - DNA, 21 bp, Homo sapiens
gcaaaaaaattaaaatggatg

SEQ ID NO: 3035798 - DNA, 11 bp, Homo sapiens
gcaaaaaatac

SEQ ID NO: 3035799 - DNA, 12 bp, Homo sapiens
gcaaaaaatact

SEQ ID NO: 3035800 - DNA, 18 bp, Homo sapiens
gcaaaaaatactttttct

SEQ ID NO: 3035801 - DNA, 20 bp, Homo sapiens
gcaaaaaatactttttctaa

SEQ ID NO: 3035802 - DNA, 17 bp, Homo sapiens
gcaaaaaggactggaaa

SEQ ID NO: 3035803 - DNA, 15 bp, Homo sapiens
gcaaaaataatttat

SEQ ID NO: 3035804 - DNA, 16 bp, Homo sapiens
gcaaaaataatttatt

SEQ ID NO: 3035805 - DNA, 17 bp, Homo sapiens
gcaaaaataatttattt

SEQ ID NO: 3035806 - DNA, 21 bp, Homo sapiens
gcaaaaataatttattttgct

SEQ ID NO: 3035807 - DNA, 22 bp, Homo sapiens
gcaaaaataatttattttgctc

SEQ ID NO: 3035808 - DNA, 12 bp, Homo sapiens
gcaaaaatgcta

SEQ ID NO: 3035809 - DNA, 14 bp, Homo sapiens
gcaaaaatgctaat

SEQ ID NO: 3035810 - DNA, 23 bp, Homo sapiens
gcaaaactaaatacttgctccat

SEQ ID NO: 3035811 - DNA, 14 bp, Homo sapiens
gcaaaagaaagcaa

SEQ ID NO: 3035812 - DNA, 19 bp, Homo sapiens
gcaaaatcaagcaagcctc

SEQ ID NO: 3035813 - DNA, 18 bp, Homo sapiens
gcaaaatccaaactgctg

SEQ ID NO: 3035814 - DNA, 16 bp, Homo sapiens
gcaaaatgtcttgtgt

SEQ ID NO: 3035815 - DNA, 19 bp, Homo sapiens
gcaaaatgtcttgtgtatt

SEQ ID NO: 3035816 - DNA, 17 bp, Homo sapiens
gcaaacacaagaaatca

SEQ ID NO: 3035817 - DNA, 18 bp, Homo sapiens
gcaaacagggtggcccag

SEQ ID NO: 3035818 - DNA, 18 bp, Homo sapiens
gcaaaccaacctttctga

SEQ ID NO: 3035819 - DNA, 23 bp, Homo sapiens
gcaaaccaacctttctgacatca

SEQ ID NO: 3035820 - DNA, 16 bp, Homo sapiens
gcaaaccaagagattg

SEQ ID NO: 3035821 - DNA, 18 bp, Homo sapiens
gcaaaccaagagattgct

SEQ ID NO: 3035822 - DNA, 20 bp, Homo sapiens
gcaaaccaagagattgctaa

SEQ ID NO: 3035823 - DNA, 22 bp, Homo sapiens
gcaaaccaagagattgctaatt

SEQ ID NO: 3035824 - DNA, 21 bp, Homo sapiens
gcaaacctagccggaaggccg

SEQ ID NO: 3035825 - DNA, 15 bp, Homo sapiens
gcaaacgctgcctgc

SEQ ID NO: 3035826 - DNA, 14 bp, Homo sapiens
gcaaactctgctgt

SEQ ID NO: 3035827 - DNA, 23 bp, Homo sapiens
gcaaactttgtatgtcatttcct

SEQ ID NO: 3035828 - DNA, 15 bp, Homo sapiens
gcaaagaagcttcat

SEQ ID NO: 3035829 - DNA, 19 bp, Homo sapiens
gcaaagatatatattcacc

SEQ ID NO: 3035830 - DNA, 21 bp, Homo sapiens
gcaaagcgcccacccaggtcc

SEQ ID NO: 3035831 - DNA, 12 bp, Homo sapiens
gcaaaggagaca

SEQ ID NO: 3035832 - DNA, 20 bp, Homo sapiens
gcaaagggcatgggtcggga

SEQ ID NO: 3035833 - DNA, 22 bp, Homo sapiens
gcaaagggtccagaaggagaca

SEQ ID NO: 3035834 - DNA, 16 bp, Homo sapiens
gcaaagggtgggtttg

SEQ ID NO: 3035835 - DNA, 11 bp, Homo sapiens
gcaaagtactg

SEQ ID NO: 3035836 - DNA, 15 bp, Homo sapiens
gcaaagtattgtaaa

SEQ ID NO: 3035837 - DNA, 21 bp, Homo sapiens
gcaaagtattgtaaattatat

SEQ ID NO: 3035838 - DNA, 16 bp, Homo sapiens
gcaaagtcacttctcc

SEQ ID NO: 3035839 - DNA, 20 bp, Homo sapiens
gcaaagtcacttctccatca

SEQ ID NO: 3035840 - DNA, 14 bp, Homo sapiens
gcaaagtgttttgt

SEQ ID NO: 3035841 - DNA, 12 bp, Homo sapiens
gcaaataaaagt

SEQ ID NO: 3035842 - DNA, 22 bp, Homo sapiens
gcaaatcagaaacttgtgaagt

SEQ ID NO: 3035843 - DNA, 15 bp, Homo sapiens
gcaaatcctatgtga

SEQ ID NO: 3035844 - DNA, 17 bp, Homo sapiens
gcaaatcctatgtgatt

SEQ ID NO: 3035845 - DNA, 22 bp, Homo sapiens
gcaaatccttgtgggaaaagaa

SEQ ID NO: 3035846 - DNA, 21 bp, Homo sapiens
gcaaatgccaactgttggaat

SEQ ID NO: 3035847 - DNA, 15 bp, Homo sapiens
gcaaattagaaacac

SEQ ID NO: 3035848 - DNA, 17 bp, Homo sapiens
gcaaattatttttaaaa

SEQ ID NO: 3035849 - DNA, 17 bp, Homo sapiens
gcaaattccagatttgt

SEQ ID NO: 3035850 - DNA, 12 bp, Homo sapiens
gcaaattctttt

SEQ ID NO: 3035851 - DNA, 20 bp, Homo sapiens
gcaaattcttttgaattgtt

SEQ ID NO: 3035852 - DNA, 22 bp, Homo sapiens
gcaacaagaccaccacttcgaa

SEQ ID NO: 3035853 - DNA, 13 bp, Homo sapiens
gcaacacaacatt

SEQ ID NO: 3035854 - DNA, 18 bp, Homo sapiens
gcaacacagcctgggccc

SEQ ID NO: 3035855 - DNA, 17 bp, Homo sapiens
gcaacagagagaaaaag

SEQ ID NO: 3035856 - DNA, 12 bp, Homo sapiens
gcaacagatctg

SEQ ID NO: 3035857 - DNA, 18 bp, Homo sapiens
gcaacagatctggaacct

SEQ ID NO: 3035858 - DNA, 17 bp, Homo sapiens
gcaacatccaaaatagt

SEQ ID NO: 3035859 - DNA, 18 bp, Homo sapiens
gcaacatctagcaaatgt

SEQ ID NO: 3035860 - DNA, 15 bp, Homo sapiens
gcaacatggattcca

SEQ ID NO: 3035861 - DNA, 21 bp, Homo sapiens
gcaacatggattccaaagcat

SEQ ID NO: 3035862 - DNA, 14 bp, Homo sapiens
gcaacattccaaga

SEQ ID NO: 3035863 - DNA, 12 bp, Homo sapiens
gcaaccaaaagg

SEQ ID NO: 3035864 - DNA, 18 bp, Homo sapiens
gcaaccaaaagggaaaaa

SEQ ID NO: 3035865 - DNA, 19 bp, Homo sapiens
gcaaccaaaagggaaaaaa

SEQ ID NO: 3035866 - DNA, 13 bp, Homo sapiens
gcaaccagaagtt

SEQ ID NO: 3035867 - DNA, 13 bp, Homo sapiens
gcaacctctgcct

SEQ ID NO: 3035868 - DNA, 23 bp, Homo sapiens
gcaacctcttggcctgatcagac

SEQ ID NO: 3035869 - DNA, 22 bp, Homo sapiens
gcaacggtctcctgactggtgc

SEQ ID NO: 3035870 - DNA, 18 bp, Homo sapiens
gcaactctggctccaggc

SEQ ID NO: 3035871 - DNA, 12 bp, Homo sapiens
gcaacttgaaga

SEQ ID NO: 3035872 - DNA, 13 bp, Homo sapiens
gcaacttgaagaa

SEQ ID NO: 3035873 - DNA, 14 bp, Homo sapiens
gcaacttgaagaaa

SEQ ID NO: 3035874 - DNA, 17 bp, Homo sapiens
gcaagaaaaaaaaatgc

SEQ ID NO: 3035875 - DNA, 14 bp, Homo sapiens
gcaagagagaacct

SEQ ID NO: 3035876 - DNA, 22 bp, Homo sapiens
gcaagagccttggtgtccacct

SEQ ID NO: 3035877 - DNA, 14 bp, Homo sapiens
gcaagagggaaggt

SEQ ID NO: 3035878 - DNA, 18 bp, Homo sapiens
gcaagattctgaaacatt

SEQ ID NO: 3035879 - DNA, 19 bp, Homo sapiens
gcaagattggaaagacagg

SEQ ID NO: 3035880 - DNA, 20 bp, Homo sapiens
gcaagattggaaagacagga

SEQ ID NO: 3035881 - DNA, 22 bp, Homo sapiens
gcaagcaaacagggtggcccag

SEQ ID NO: 3035882 - DNA, 12 bp, Homo sapiens
gcaagcagaact

SEQ ID NO: 3035883 - DNA, 12 bp, Homo sapiens
gcaagcagagga

SEQ ID NO: 3035884 - DNA, 16 bp, Homo sapiens
gcaagcagaggaccag

SEQ ID NO: 3035885 - DNA, 21 bp, Homo sapiens
gcaagcagaggaccagggcct

SEQ ID NO: 3035886 - DNA, 15 bp, Homo sapiens
gcaagcatgcttgtg

SEQ ID NO: 3035887 - DNA, 11 bp, Homo sapiens
gcaagccaacc

SEQ ID NO: 3035888 - DNA, 19 bp, Homo sapiens
gcaagcctgtaatcccagc

SEQ ID NO: 3035889 - DNA, 22 bp, Homo sapiens
gcaagccttctaaatgagtcac

SEQ ID NO: 3035890 - DNA, 11 bp, Homo sapiens
gcaagctgtgt

SEQ ID NO: 3035891 - DNA, 12 bp, Homo sapiens
gcaagctgtgtt

SEQ ID NO: 3035892 - DNA, 16 bp, Homo sapiens
gcaagctgtgttactt

SEQ ID NO: 3035893 - DNA, 17 bp, Homo sapiens
gcaagctgtgttacttg

SEQ ID NO: 3035894 - DNA, 19 bp, Homo sapiens
gcaagctgtgttacttgaa

SEQ ID NO: 3035895 - DNA, 23 bp, Homo sapiens
gcaagctgtgttacttgaagtaa

SEQ ID NO: 3035896 - DNA, 16 bp, Homo sapiens
gcaagcttatttagca

SEQ ID NO: 3035897 - DNA, 21 bp, Homo sapiens
gcaagcttatttagcacattt

SEQ ID NO: 3035898 - DNA, 9 bp, Homo sapiens
gcaaggaaa

SEQ ID NO: 3035899 - DNA, 16 bp, Homo sapiens
gcaaggaaaaacaggt

SEQ ID NO: 3035900 - DNA, 19 bp, Homo sapiens
gcaaggagtttaaatgaga

SEQ ID NO: 3035901 - DNA, 16 bp, Homo sapiens
gcaaggattacagaaa

SEQ ID NO: 3035902 - DNA, 17 bp, Homo sapiens
gcaaggattacagaaac

SEQ ID NO: 3035903 - DNA, 14 bp, Homo sapiens
gcaagggcccagag

SEQ ID NO: 3035904 - DNA, 13 bp, Homo sapiens
gcaagggcctgga

SEQ ID NO: 3035905 - DNA, 16 bp, Homo sapiens
gcaagggggaaggctg

SEQ ID NO: 3035906 - DNA, 16 bp, Homo sapiens
gcaagggttccctcaa

SEQ ID NO: 3035907 - DNA, 18 bp, Homo sapiens
gcaagggttccctcaaga

SEQ ID NO: 3035908 - DNA, 14 bp, Homo sapiens
gcaaggttccacag

SEQ ID NO: 3035909 - DNA, 23 bp, Homo sapiens
gcaaggttccacagagtaagaca

SEQ ID NO: 3035910 - DNA, 22 bp, Homo sapiens
gcaaggtttaggctggtggccc

SEQ ID NO: 3035911 - DNA, 23 bp, Homo sapiens
gcaaggtttaggctggtggccca

SEQ ID NO: 3035912 - DNA, 18 bp, Homo sapiens
gcaagtcacactgcattg

SEQ ID NO: 3035913 - DNA, 14 bp, Homo sapiens
gcaagtcatgtaaa

SEQ ID NO: 3035914 - DNA, 21 bp, Homo sapiens
gcaagtctttaggtctttgta

SEQ ID NO: 3035915 - DNA, 19 bp, Homo sapiens
gcaagtgagaggggaggga

SEQ ID NO: 3035916 - DNA, 21 bp, Homo sapiens
gcaagtgagaggggagggagg

SEQ ID NO: 3035917 - DNA, 20 bp, Homo sapiens
gcaagtgctgtttgggcagg

SEQ ID NO: 3035918 - DNA, 15 bp, Homo sapiens
gcaagtggatgggaa

SEQ ID NO: 3035919 - DNA, 21 bp, Homo sapiens
gcaagtggatgggaatttgtc

SEQ ID NO: 3035920 - DNA, 19 bp, Homo sapiens
gcaagtgtctggagcggct

SEQ ID NO: 3035921 - DNA, 20 bp, Homo sapiens
gcaggcggccagggcggcca

SEQ ID NO: 3035922 - DNA, 20 bp, Homo sapiens
gcaggcggggggggcgcctg

SEQ ID NO: 3035923 - DNA, 23 bp, Homo sapiens
gcaggcggggggggcgcctggag

SEQ ID NO: 3035924 - DNA, 16 bp, Homo sapiens
gcaggcggtgggcacc

SEQ ID NO: 3035925 - DNA, 16 bp, Homo sapiens
gcaggcgtgactcagc

SEQ ID NO: 3035926 - DNA, 22 bp, Homo sapiens
gcaggcgtgactcagcagcctg

SEQ ID NO: 3035927 - DNA, 16 bp, Homo sapiens
gcaggcgtgtggcagc

SEQ ID NO: 3035928 - DNA, 22 bp, Homo sapiens
gcaggcgtgtggcagccacacg

SEQ ID NO: 3035929 - DNA, 23 bp, Homo sapiens
gcaggctcccagggacacctggg

SEQ ID NO: 3035930 - DNA, 16 bp, Homo sapiens
gcaggctcccctgagg

SEQ ID NO: 3035931 - DNA, 20 bp, Homo sapiens
gcaggctgcaggagggcact

SEQ ID NO: 3035932 - DNA, 20 bp, Homo sapiens
gcaggctggccagccgctct

SEQ ID NO: 3035933 - DNA, 22 bp, Homo sapiens
gcaggcttaataaaaatgacag

SEQ ID NO: 3035934 - DNA, 22 bp, Homo sapiens
gcagggacccggggtctcctgg

SEQ ID NO: 3035935 - DNA, 13 bp, Homo sapiens
gcagggatgccct

SEQ ID NO: 3035936 - DNA, 21 bp, Homo sapiens
gcagggatgccctggaggtgg

SEQ ID NO: 3035937 - DNA, 23 bp, Homo sapiens
gcagggccactcaacagagagga

SEQ ID NO: 3035938 - DNA, 21 bp, Homo sapiens
gcagggccccaggcattgcca

SEQ ID NO: 3035939 - DNA, 15 bp, Homo sapiens
gcagggccgccaggg

SEQ ID NO: 3035940 - DNA, 23 bp, Homo sapiens
gcagggccgctcgatgcctttgc

SEQ ID NO: 3035941 - DNA, 17 bp, Homo sapiens
gcagggcctagctgcta

SEQ ID NO: 3035942 - DNA, 20 bp, Homo sapiens
gcagggcctagctgctacaa

SEQ ID NO: 3035943 - DNA, 21 bp, Homo sapiens
gcagggccttgcccagagatg

SEQ ID NO: 3035944 - DNA, 17 bp, Homo sapiens
gcagggcgggcagaggg

SEQ ID NO: 3035945 - DNA, 11 bp, Homo sapiens
gcagggctggt

SEQ ID NO: 3035946 - DNA, 14 bp, Homo sapiens
gcagggctggtttg

SEQ ID NO: 3035947 - DNA, 12 bp, Homo sapiens
gcaggggactgg

SEQ ID NO: 3035948 - DNA, 14 bp, Homo sapiens
gcaggggagccagg

SEQ ID NO: 3035949 - DNA, 15 bp, Homo sapiens
gcaggggctgctggg

SEQ ID NO: 3035950 - DNA, 16 bp, Homo sapiens
gcagggggactgcttg

SEQ ID NO: 3035951 - DNA, 22 bp, Homo sapiens
gcaggggttgagagctttctgc

SEQ ID NO: 3035952 - DNA, 21 bp, Homo sapiens
gcagggtctgtttggactgca

SEQ ID NO: 3035953 - DNA, 16 bp, Homo sapiens
gcagggtcttttcatc

SEQ ID NO: 3035954 - DNA, 23 bp, Homo sapiens
gcagggtcttttcatctgggaaa

SEQ ID NO: 3035955 - DNA, 22 bp, Homo sapiens
gcagggtgcagtatcatgccct

SEQ ID NO: 3035956 - DNA, 20 bp, Homo sapiens
gcagggtggtggtattctgt

SEQ ID NO: 3035957 - DNA, 22 bp, Homo sapiens
gcagggtggtggtattctgtca

SEQ ID NO: 3035958 - DNA, 15 bp, Homo sapiens
gcagggtttgagcac

SEQ ID NO: 3035959 - DNA, 14 bp, Homo sapiens
gcaggtaccactga

SEQ ID NO: 3035960 - DNA, 16 bp, Homo sapiens
gcaggtgaaacccagt

SEQ ID NO: 3035961 - DNA, 20 bp, Homo sapiens
gcaggtgaaacccagtcact

SEQ ID NO: 3035962 - DNA, 17 bp, Homo sapiens
gcaggtggccgcccctg

SEQ ID NO: 3035963 - DNA, 18 bp, Homo sapiens
gcaggtggccgcccctga

SEQ ID NO: 3035964 - DNA, 22 bp, Homo sapiens
gcaggtggccgcccctgaggct

SEQ ID NO: 3035965 - DNA, 18 bp, Homo sapiens
gcaggtggcctctgctgg

SEQ ID NO: 3035966 - DNA, 19 bp, Homo sapiens
gcaggtggcctctgctggt

SEQ ID NO: 3035967 - DNA, 21 bp, Homo sapiens
gcaggtggcctctgctggtct

SEQ ID NO: 3035968 - DNA, 13 bp, Homo sapiens
gcaggttcccaag

SEQ ID NO: 3035969 - DNA, 15 bp, Homo sapiens
gcaggttcccaagct

SEQ ID NO: 3035970 - DNA, 16 bp, Homo sapiens
gcaggttcccaagctc

SEQ ID NO: 3035971 - DNA, 21 bp, Homo sapiens
gcaggttggcaaacgggcttg

SEQ ID NO: 3035972 - DNA, 15 bp, Homo sapiens
gcaggtttgaccagg

SEQ ID NO: 3035973 - DNA, 17 bp, Homo sapiens
gcaggtttgaccaggaa

SEQ ID NO: 3035974 - DNA, 19 bp, Homo sapiens
gcaggtttgaccaggaaag

SEQ ID NO: 3035975 - DNA, 15 bp, Homo sapiens
gcagtagattttctt

SEQ ID NO: 3035976 - DNA, 12 bp, Homo sapiens
gcagtatatttc

SEQ ID NO: 3035977 - DNA, 17 bp, Homo sapiens
gcagtatggtacatttt

SEQ ID NO: 3035978 - DNA, 15 bp, Homo sapiens
gcagtccagagcttt

SEQ ID NO: 3035979 - DNA, 23 bp, Homo sapiens
gcagtccttttactacagctatg

SEQ ID NO: 3035980 - DNA, 17 bp, Homo sapiens
gcagtcgcttgccaaag

SEQ ID NO: 3035981 - DNA, 15 bp, Homo sapiens
gcagtcggcatgcca

SEQ ID NO: 3035982 - DNA, 16 bp, Homo sapiens
gcagtcggcatgccag

SEQ ID NO: 3035983 - DNA, 20 bp, Homo sapiens
gcagtcggcatgccaggacc

SEQ ID NO: 3035984 - DNA, 13 bp, Homo sapiens
gcagtctctgcct

SEQ ID NO: 3035985 - DNA, 14 bp, Homo sapiens
gcagtgaagtgttc

SEQ ID NO: 3035986 - DNA, 14 bp, Homo sapiens
gcagtgagctgaga

SEQ ID NO: 3035987 - DNA, 15 bp, Homo sapiens
gcagtgagctgagat

SEQ ID NO: 3035988 - DNA, 21 bp, Homo sapiens
gcagtgatgctggatgctcct

SEQ ID NO: 3035989 - DNA, 13 bp, Homo sapiens
gcagtgcacattt

SEQ ID NO: 3035990 - DNA, 13 bp, Homo sapiens
gcagtgccagcca

SEQ ID NO: 3035991 - DNA, 22 bp, Homo sapiens
gcagtgctgagggaccgagccc

SEQ ID NO: 3035992 - DNA, 22 bp, Homo sapiens
gcagtggccacgttcagggagg

SEQ ID NO: 3035993 - DNA, 23 bp, Homo sapiens
gcagtggccacgttcagggaggg

SEQ ID NO: 3035994 - DNA, 12 bp, Homo sapiens
gcagtgggcagg

SEQ ID NO: 3035995 - DNA, 17 bp, Homo sapiens
gcagtgggcaggtggcc

SEQ ID NO: 3035996 - DNA, 16 bp, Homo sapiens
gcagtgggcctggcca

SEQ ID NO: 3035997 - DNA, 17 bp, Homo sapiens
gcagtgggcctggccag

SEQ ID NO: 3035998 - DNA, 14 bp, Homo sapiens
gcagtggtgcgatc

SEQ ID NO: 3035999 - DNA, 21 bp, Homo sapiens
gcagtgtccagaagcggcctg

SEQ ID NO: 3036000 - DNA, 16 bp, Homo sapiens
gcagtgtcttaaggag

SEQ ID NO: 3036001 - DNA, 21 bp, Homo sapiens
gcagtgtcttaaggagactgg

SEQ ID NO: 3036002 - DNA, 19 bp, Homo sapiens
gcagtgtgaggccagggca

SEQ ID NO: 3036003 - DNA, 21 bp, Homo sapiens
gcagtgtgcactaaggggccc

SEQ ID NO: 3036004 - DNA, 22 bp, Homo sapiens
gcagtgtgtccatcatattaaa

SEQ ID NO: 3036005 - DNA, 18 bp, Homo sapiens
gcagttacatgcatactt

SEQ ID NO: 3036006 - DNA, 23 bp, Homo sapiens
gcagttactccctacactgatgc

SEQ ID NO: 3036007 - DNA, 15 bp, Homo sapiens
gcagttccatcaggt

SEQ ID NO: 3036008 - DNA, 16 bp, Homo sapiens
gcagttctagtttgca

SEQ ID NO: 3036009 - DNA, 14 bp, Homo sapiens
gcagttgaggtggg

SEQ ID NO: 3036010 - DNA, 15 bp, Homo sapiens
gcagtttatcattca

SEQ ID NO: 3036011 - DNA, 13 bp, Homo sapiens
gcagtttgaaatt

SEQ ID NO: 3036012 - DNA, 21 bp, Homo sapiens
gcagttttgacatcagccagc

SEQ ID NO: 3036013 - DNA, 16 bp, Homo sapiens
gcagttttgtaaatgt

SEQ ID NO: 3036014 - DNA, 22 bp, Homo sapiens
gcataaatctgaagtggttcag

SEQ ID NO: 3036015 - DNA, 14 bp, Homo sapiens
gcataaatgggaac

SEQ ID NO: 3036016 - DNA, 13 bp, Homo sapiens
gcataaatttaat

SEQ ID NO: 3036017 - DNA, 16 bp, Homo sapiens
gcataacaattcctct

SEQ ID NO: 3036018 - DNA, 17 bp, Homo sapiens
gcataacaattcctcta

SEQ ID NO: 3036019 - DNA, 12 bp, Homo sapiens
gcataagaaaaa

SEQ ID NO: 3036020 - DNA, 16 bp, Homo sapiens
gcataagaccaatctc

SEQ ID NO: 3036021 - DNA, 21 bp, Homo sapiens
gcataattccgaaacaaaact

SEQ ID NO: 3036022 - DNA, 21 bp, Homo sapiens
gcataatttgtttaaaattct

SEQ ID NO: 3036023 - DNA, 22 bp, Homo sapiens
gcataatttgtttaaaattctc

SEQ ID NO: 3036024 - DNA, 11 bp, Homo sapiens
gcatacacaca

SEQ ID NO: 3036025 - DNA, 14 bp, Homo sapiens
gcatacacacacac

SEQ ID NO: 3036026 - DNA, 19 bp, Homo sapiens
gcatacctttcacagcttt

SEQ ID NO: 3036027 - DNA, 21 bp, Homo sapiens
gcatactccgtgaggctgctg

SEQ ID NO: 3036028 - DNA, 13 bp, Homo sapiens
gcatacttcaaaa

SEQ ID NO: 3036029 - DNA, 17 bp, Homo sapiens
gcatacttcaaaagtat

SEQ ID NO: 3036030 - DNA, 18 bp, Homo sapiens
gcatacttcaaaagtatt

SEQ ID NO: 3036031 - DNA, 21 bp, Homo sapiens
gcatacttcaaaagtattttc

SEQ ID NO: 3036032 - DNA, 14 bp, Homo sapiens
gcatactttgtaaa

SEQ ID NO: 3036033 - DNA, 15 bp, Homo sapiens
gcatacttttaatca

SEQ ID NO: 3036034 - DNA, 18 bp, Homo sapiens
gcatacttttaatcaagt

SEQ ID NO: 3036035 - DNA, 18 bp, Homo sapiens
gcatagcgtcctgccctg

SEQ ID NO: 3036036 - DNA, 19 bp, Homo sapiens
gcatagcgtcctgccctgc

SEQ ID NO: 3036037 - DNA, 15 bp, Homo sapiens
gcataggtatgctta

SEQ ID NO: 3036038 - DNA, 20 bp, Homo sapiens
gcatatcatgctttgaaaaa

SEQ ID NO: 3036039 - DNA, 22 bp, Homo sapiens
gcatatctctagtccctgtgtt

SEQ ID NO: 3036040 - DNA, 20 bp, Homo sapiens
gcatatgttgaatacttttt

SEQ ID NO: 3036041 - DNA, 18 bp, Homo sapiens
gcatattcaacacactgc

SEQ ID NO: 3036042 - DNA, 18 bp, Homo sapiens
gcatattgtacacttttt

SEQ ID NO: 3036043 - DNA, 23 bp, Homo sapiens
gcatatttatccaaaatgtgtat

SEQ ID NO: 3036044 - DNA, 14 bp, Homo sapiens
gcatcaaaagacaa

SEQ ID NO: 3036045 - DNA, 16 bp, Homo sapiens
gcatcaaaagacaatt

SEQ ID NO: 3036046 - DNA, 17 bp, Homo sapiens
gcatcaaaagacaattc

SEQ ID NO: 3036047 - DNA, 22 bp, Homo sapiens
gcatcaaaagacaattctttat

SEQ ID NO: 3036048 - DNA, 14 bp, Homo sapiens
gcatcaaacatgaa

SEQ ID NO: 3036049 - DNA, 16 bp, Homo sapiens
gcatcaaacatgaaaa

SEQ ID NO: 3036050 - DNA, 22 bp, Homo sapiens
gcatcaaacatgaaaacattga

SEQ ID NO: 3036051 - DNA, 22 bp, Homo sapiens
gcatcaaggggtcacttacaga

SEQ ID NO: 3036052 - DNA, 21 bp, Homo sapiens
gccaggcccccaccacacatc

SEQ ID NO: 3036053 - DNA, 15 bp, Homo sapiens
gccaggccctggagg

SEQ ID NO: 3036054 - DNA, 23 bp, Homo sapiens
gccaggccctggagggcagagac

SEQ ID NO: 3036055 - DNA, 19 bp, Homo sapiens
gccaggccggcgagccctg

SEQ ID NO: 3036056 - DNA, 21 bp, Homo sapiens
gccaggccgggcctgtacagt

SEQ ID NO: 3036057 - DNA, 13 bp, Homo sapiens
gccaggcctcgca

SEQ ID NO: 3036058 - DNA, 14 bp, Homo sapiens
gccaggcctcgcct

SEQ ID NO: 3036059 - DNA, 17 bp, Homo sapiens
gccaggcctcgcctgcc

SEQ ID NO: 3036060 - DNA, 19 bp, Homo sapiens
gccaggcctcgcctgccct

SEQ ID NO: 3036061 - DNA, 21 bp, Homo sapiens
gccaggcctcttggcagtcac

SEQ ID NO: 3036062 - DNA, 12 bp, Homo sapiens
gccaggcgctgc

SEQ ID NO: 3036063 - DNA, 17 bp, Homo sapiens
gccaggcgctgcagggc

SEQ ID NO: 3036064 - DNA, 16 bp, Homo sapiens
gccaggctgaccacag

SEQ ID NO: 3036065 - DNA, 22 bp, Homo sapiens
gccaggctgaccacagcacagc

SEQ ID NO: 3036066 - DNA, 15 bp, Homo sapiens
gccaggctgatctcg

SEQ ID NO: 3036067 - DNA, 14 bp, Homo sapiens
gccaggctgcctgg

SEQ ID NO: 3036068 - DNA, 14 bp, Homo sapiens
gccaggctgcggtg

SEQ ID NO: 3036069 - DNA, 21 bp, Homo sapiens
gccaggctgggccgcaagggc

SEQ ID NO: 3036070 - DNA, 17 bp, Homo sapiens
gccaggctggtccgagc

SEQ ID NO: 3036071 - DNA, 13 bp, Homo sapiens
gccaggcttgcct

SEQ ID NO: 3036072 - DNA, 16 bp, Homo sapiens
gccaggcttgcctggg

SEQ ID NO: 3036073 - DNA, 19 bp, Homo sapiens
gccaggcttgcctgggctg

SEQ ID NO: 3036074 - DNA, 17 bp, Homo sapiens
gccaggcttggatggaa

SEQ ID NO: 3036075 - DNA, 15 bp, Homo sapiens
gccagggagaagctc

SEQ ID NO: 3036076 - DNA, 15 bp, Homo sapiens
gccagggagacctgg

SEQ ID NO: 3036077 - DNA, 21 bp, Homo sapiens
gccagggagacctggacacag

SEQ ID NO: 3036078 - DNA, 15 bp, Homo sapiens
gccagggaggcagag

SEQ ID NO: 3036079 - DNA, 20 bp, Homo sapiens
gccagggaggcagagcggga

SEQ ID NO: 3036080 - DNA, 15 bp, Homo sapiens
gccagggcagagtga

SEQ ID NO: 3036081 - DNA, 16 bp, Homo sapiens
gccagggcagagtgag

SEQ ID NO: 3036082 - DNA, 14 bp, Homo sapiens
gccagggcagggcc

SEQ ID NO: 3036083 - DNA, 19 bp, Homo sapiens
gccagggcagggccccagg

SEQ ID NO: 3036084 - DNA, 20 bp, Homo sapiens
gccagggccacgctccagct

SEQ ID NO: 3036085 - DNA, 17 bp, Homo sapiens
gccagggcccaggccat

SEQ ID NO: 3036086 - DNA, 22 bp, Homo sapiens
gccagggctcctgtggcagctg

SEQ ID NO: 3036087 - DNA, 16 bp, Homo sapiens
gccagggctctggggg

SEQ ID NO: 3036088 - DNA, 17 bp, Homo sapiens
gccagggctgggtcaca

SEQ ID NO: 3036089 - DNA, 18 bp, Homo sapiens
gccagggctgggtcacag

SEQ ID NO: 3036090 - DNA, 10 bp, Homo sapiens
gccagggctt

SEQ ID NO: 3036091 - DNA, 19 bp, Homo sapiens
gccaggggggtgaggagct

SEQ ID NO: 3036092 - DNA, 21 bp, Homo sapiens
gccaggtaatgtgaataaatt

SEQ ID NO: 3036093 - DNA, 18 bp, Homo sapiens
gccaggtccccctgcagc

SEQ ID NO: 3036094 - DNA, 19 bp, Homo sapiens
gccaggtccccctgcagct

SEQ ID NO: 3036095 - DNA, 14 bp, Homo sapiens
gccaggtgcggcct

SEQ ID NO: 3036096 - DNA, 15 bp, Homo sapiens
gccaggtgcggcctg

SEQ ID NO: 3036097 - DNA, 17 bp, Homo sapiens
gccaggtgcggcctggg

SEQ ID NO: 3036098 - DNA, 22 bp, Homo sapiens
gccaggtgcggcctggggggaa

SEQ ID NO: 3036099 - DNA, 16 bp, Homo sapiens
gccaggtgggcggaca

SEQ ID NO: 3036100 - DNA, 22 bp, Homo sapiens
gccagtatctatatatgtgtat

SEQ ID NO: 3036101 - DNA, 12 bp, Homo sapiens
gccagtcctggt

SEQ ID NO: 3036102 - DNA, 18 bp, Homo sapiens
gccagtcgggagagccag

SEQ ID NO: 3036103 - DNA, 20 bp, Homo sapiens
gccagtcgggagagccaggc

SEQ ID NO: 3036104 - DNA, 22 bp, Homo sapiens
gccagtctcactgtgggaaggc

SEQ ID NO: 3036105 - DNA, 14 bp, Homo sapiens
gccagtcttcctct

SEQ ID NO: 3036106 - DNA, 20 bp, Homo sapiens
gccagtcttgacgagtgtga

SEQ ID NO: 3036107 - DNA, 20 bp, Homo sapiens
gccagtgccttacctcctgc

SEQ ID NO: 3036108 - DNA, 22 bp, Homo sapiens
gccagtgccttacctcctgccc

SEQ ID NO: 3036109 - DNA, 12 bp, Homo sapiens
gccagtgtttct

SEQ ID NO: 3036110 - DNA, 15 bp, Homo sapiens
gccagtgtttctgaa

SEQ ID NO: 3036111 - DNA, 15 bp, Homo sapiens
gccagttttctgttc

SEQ ID NO: 3036112 - DNA, 21 bp, Homo sapiens
gccataacagattatgtatta

SEQ ID NO: 3036113 - DNA, 18 bp, Homo sapiens
gccatacattaaggagca

SEQ ID NO: 3036114 - DNA, 14 bp, Homo sapiens
gccataggccaagg

SEQ ID NO: 3036115 - DNA, 15 bp, Homo sapiens
gccataggccaaggt

SEQ ID NO: 3036116 - DNA, 16 bp, Homo sapiens
gccatagtcacatggc

SEQ ID NO: 3036117 - DNA, 19 bp, Homo sapiens
gccatataagtttgaagga

SEQ ID NO: 3036118 - DNA, 22 bp, Homo sapiens
gccatataagtttgaaggaaac

SEQ ID NO: 3036119 - DNA, 16 bp, Homo sapiens
gccatatgaaaaggct

SEQ ID NO: 3036120 - DNA, 20 bp, Homo sapiens
gccatatggacactgtgaca

SEQ ID NO: 3036121 - DNA, 19 bp, Homo sapiens
gccatcaaaatgcttttta

SEQ ID NO: 3036122 - DNA, 15 bp, Homo sapiens
gccatcaagcacttc

SEQ ID NO: 3036123 - DNA, 19 bp, Homo sapiens
gccatcaagcacttcccag

SEQ ID NO: 3036124 - DNA, 15 bp, Homo sapiens
gccatcactcagccc

SEQ ID NO: 3036125 - DNA, 21 bp, Homo sapiens
gccatcactcagcccctaccc

SEQ ID NO: 3036126 - DNA, 22 bp, Homo sapiens
gccatcactcagcccctacccc

SEQ ID NO: 3036127 - DNA, 18 bp, Homo sapiens
gccatcattgctgtctgc

SEQ ID NO: 3036128 - DNA, 19 bp, Homo sapiens
gccatcattgctgtctgca

SEQ ID NO: 3036129 - DNA, 15 bp, Homo sapiens
gccatccacatttta

SEQ ID NO: 3036130 - DNA, 16 bp, Homo sapiens
gccatccccagggggc

SEQ ID NO: 3036131 - DNA, 19 bp, Homo sapiens
gccatccccctctcacgcc

SEQ ID NO: 3036132 - DNA, 23 bp, Homo sapiens
gccatccgcagactgcttggcca

SEQ ID NO: 3036133 - DNA, 18 bp, Homo sapiens
gccatctaatgcttgttt

SEQ ID NO: 3036134 - DNA, 12 bp, Homo sapiens
gccatctcaggt

SEQ ID NO: 3036135 - DNA, 16 bp, Homo sapiens
gccatctgcgcagggt

SEQ ID NO: 3036136 - DNA, 21 bp, Homo sapiens
gccatctgcgtgacaataaaa

SEQ ID NO: 3036137 - DNA, 16 bp, Homo sapiens
gccatcttggcagggt

SEQ ID NO: 3036138 - DNA, 16 bp, Homo sapiens
gccatcttggtaaatt

SEQ ID NO: 3036139 - DNA, 18 bp, Homo sapiens
gccatgatgcctctgtct

SEQ ID NO: 3036140 - DNA, 21 bp, Homo sapiens
gccatgatggcaacagatctg

SEQ ID NO: 3036141 - DNA, 19 bp, Homo sapiens
gccatgatttcccactgca

SEQ ID NO: 3036142 - DNA, 23 bp, Homo sapiens
gccatgatttcccactgcactcc

SEQ ID NO: 3036143 - DNA, 22 bp, Homo sapiens
gccatgcaccaggactggctgt

SEQ ID NO: 3036144 - DNA, 14 bp, Homo sapiens
gccatgctgtccct

SEQ ID NO: 3036145 - DNA, 15 bp, Homo sapiens
gccatgctgtccctg

SEQ ID NO: 3036146 - DNA, 17 bp, Homo sapiens
gccatgctgtccctgca

SEQ ID NO: 3036147 - DNA, 18 bp, Homo sapiens
gccatgctgtccctgcac

SEQ ID NO: 3036148 - DNA, 20 bp, Homo sapiens
gccatggagtgagacccagg

SEQ ID NO: 3036149 - DNA, 21 bp, Homo sapiens
gccatggagtgagacccagga

SEQ ID NO: 3036150 - DNA, 19 bp, Homo sapiens
gccatggatttccactgct

SEQ ID NO: 3036151 - DNA, 12 bp, Homo sapiens
gccatggcctct

SEQ ID NO: 3036152 - DNA, 23 bp, Homo sapiens
gccatggctcagggtggtctctt

SEQ ID NO: 3036153 - DNA, 18 bp, Homo sapiens
gccatggctttcatcctg

SEQ ID NO: 3036154 - DNA, 19 bp, Homo sapiens
gccatggctttcatcctgt

SEQ ID NO: 3036155 - DNA, 17 bp, Homo sapiens
gccatgtacagacagag

SEQ ID NO: 3036156 - DNA, 16 bp, Homo sapiens
gccatgtctgtgctgt

SEQ ID NO: 3036157 - DNA, 14 bp, Homo sapiens
gccatgtgactctg

SEQ ID NO: 3036158 - DNA, 15 bp, Homo sapiens
gccatgtggcctgcc

SEQ ID NO: 3036159 - DNA, 20 bp, Homo sapiens
gccatgttccacttggaaat

SEQ ID NO: 3036160 - DNA, 16 bp, Homo sapiens
gccatgtttttgccaa

SEQ ID NO: 3036161 - DNA, 17 bp, Homo sapiens
gccatgtttttgccaaa

SEQ ID NO: 3036162 - DNA, 18 bp, Homo sapiens
gccattacccagctaaat

SEQ ID NO: 3036163 - DNA, 14 bp, Homo sapiens
gccattacccagtg

SEQ ID NO: 3036164 - DNA, 15 bp, Homo sapiens
gccattctccccctc

SEQ ID NO: 3036165 - DNA, 20 bp, Homo sapiens
gccattctcctgcctcagcc

SEQ ID NO: 3036166 - DNA, 23 bp, Homo sapiens
gccattctcctgcctcagccttc

SEQ ID NO: 3036167 - DNA, 12 bp, Homo sapiens
gccattctttcc

SEQ ID NO: 3036168 - DNA, 15 bp, Homo sapiens
gccattgtactccag

SEQ ID NO: 3036169 - DNA, 22 bp, Homo sapiens
gccattgtcttcggaaaccttg

SEQ ID NO: 3036170 - DNA, 16 bp, Homo sapiens
gccatttatttattga

SEQ ID NO: 3036171 - DNA, 20 bp, Homo sapiens
gccatttcctcacgtgcagg

SEQ ID NO: 3036172 - DNA, 22 bp, Homo sapiens
gccattttaaggaaaactacct

SEQ ID NO: 3036173 - DNA, 13 bp, Homo sapiens
gccattttggaaa

SEQ ID NO: 3036174 - DNA, 17 bp, Homo sapiens
gccattttgtaaactaa

SEQ ID NO: 3036175 - DNA, 15 bp, Homo sapiens
gcccaaaccttgggc

SEQ ID NO: 3036176 - DNA, 18 bp, Homo sapiens
gcccaaagcttgtaaata

SEQ ID NO: 3036177 - DNA, 15 bp, Homo sapiens
gcccaaatggctctg

SEQ ID NO: 3036178 - DNA, 19 bp, Homo sapiens
gcccaaatttaatttgcaa

SEQ ID NO: 3036179 - DNA, 23 bp, Homo sapiens
gcccaacagacaccatcttttgt

SEQ ID NO: 3036180 - DNA, 14 bp, Homo sapiens
gcccaacagcactt

SEQ ID NO: 3036181 - DNA, 13 bp, Homo sapiens
gcccaagagcccg

SEQ ID NO: 3036182 - DNA, 14 bp, Homo sapiens
gcccaaggctcccg

SEQ ID NO: 3036183 - DNA, 15 bp, Homo sapiens
gcccaagggatctgg

SEQ ID NO: 3036184 - DNA, 23 bp, Homo sapiens
gccggaggccttggggtgggggc

SEQ ID NO: 3036185 - DNA, 18 bp, Homo sapiens
gccggatgaaacttctca

SEQ ID NO: 3036186 - DNA, 20 bp, Homo sapiens
gccggatgaaacttctcagt

SEQ ID NO: 3036187 - DNA, 16 bp, Homo sapiens
gccggcatccttgcct

SEQ ID NO: 3036188 - DNA, 12 bp, Homo sapiens
gccggccagcca

SEQ ID NO: 3036189 - DNA, 15 bp, Homo sapiens
gccggccagccagcc

SEQ ID NO: 3036190 - DNA, 17 bp, Homo sapiens
gccggccagccagccac

SEQ ID NO: 3036191 - DNA, 18 bp, Homo sapiens
gccggccctgcccctccc

SEQ ID NO: 3036192 - DNA, 19 bp, Homo sapiens
gccggctggcctggaggct

SEQ ID NO: 3036193 - DNA, 16 bp, Homo sapiens
gccggctgtgctcaga

SEQ ID NO: 3036194 - DNA, 15 bp, Homo sapiens
gccgggaccctcagg

SEQ ID NO: 3036195 - DNA, 17 bp, Homo sapiens
gccgggagaagccacct

SEQ ID NO: 3036196 - DNA, 14 bp, Homo sapiens
gccgggagaggatg

SEQ ID NO: 3036197 - DNA, 20 bp, Homo sapiens
gccgggcacagtggctcacg

SEQ ID NO: 3036198 - DNA, 12 bp, Homo sapiens
gccgggcaggcg

SEQ ID NO: 3036199 - DNA, 22 bp, Homo sapiens
gccgggcaggcgtgactcagca

SEQ ID NO: 3036200 - DNA, 15 bp, Homo sapiens
gccgggcatgatggt

SEQ ID NO: 3036201 - DNA, 14 bp, Homo sapiens
gccgggcctgtaca

SEQ ID NO: 3036202 - DNA, 16 bp, Homo sapiens
gccgggctagagcctt

SEQ ID NO: 3036203 - DNA, 13 bp, Homo sapiens
gccggggaggggg

SEQ ID NO: 3036204 - DNA, 15 bp, Homo sapiens
gccggggagggggca

SEQ ID NO: 3036205 - DNA, 16 bp, Homo sapiens
gccggggagggggcac

SEQ ID NO: 3036206 - DNA, 18 bp, Homo sapiens
gccggggagggggcacgg

SEQ ID NO: 3036207 - DNA, 23 bp, Homo sapiens
gccggggagggggcacggcaggc

SEQ ID NO: 3036208 - DNA, 17 bp, Homo sapiens
gccggggtcctgggagg

SEQ ID NO: 3036209 - DNA, 23 bp, Homo sapiens
gccggggtcctgggaggctgcag

SEQ ID NO: 3036210 - DNA, 21 bp, Homo sapiens
gccgggtgtggcacgcacctg

SEQ ID NO: 3036211 - DNA, 22 bp, Homo sapiens
gccgtacctgcaagtatccaga

SEQ ID NO: 3036212 - DNA, 20 bp, Homo sapiens
gccgtcaaggaaagggcagt

SEQ ID NO: 3036213 - DNA, 19 bp, Homo sapiens
gccgtcagccatcagccat

SEQ ID NO: 3036214 - DNA, 20 bp, Homo sapiens
gccgtgctcgccccagcagg

SEQ ID NO: 3036215 - DNA, 12 bp, Homo sapiens
gccgtggctcca

SEQ ID NO: 3036216 - DNA, 13 bp, Homo sapiens
gccgtggctccag

SEQ ID NO: 3036217 - DNA, 15 bp, Homo sapiens
gccgtggctccagaa

SEQ ID NO: 3036218 - DNA, 18 bp, Homo sapiens
gccgtggcttgggctggt

SEQ ID NO: 3036219 - DNA, 15 bp, Homo sapiens
gccgttactctccaa

SEQ ID NO: 3036220 - DNA, 20 bp, Homo sapiens
gccgttactctccaacctgg

SEQ ID NO: 3036221 - DNA, 17 bp, Homo sapiens
gcctaaatttattaaat

SEQ ID NO: 3036222 - DNA, 16 bp, Homo sapiens
gcctaagtggctgctg

SEQ ID NO: 3036223 - DNA, 17 bp, Homo sapiens
gcctaagtggctgctga

SEQ ID NO: 3036224 - DNA, 23 bp, Homo sapiens
gcctaattacgataaggaagaaa

SEQ ID NO: 3036225 - DNA, 14 bp, Homo sapiens
gcctaattgtcaca

SEQ ID NO: 3036226 - DNA, 18 bp, Homo sapiens
gcctaattgtcacatcaa

SEQ ID NO: 3036227 - DNA, 19 bp, Homo sapiens
gcctaccgggttctcctga

SEQ ID NO: 3036228 - DNA, 17 bp, Homo sapiens
gcctaccttgtgaggga

SEQ ID NO: 3036229 - DNA, 12 bp, Homo sapiens
gcctactcacga

SEQ ID NO: 3036230 - DNA, 17 bp, Homo sapiens
gcctactgagtagcttt

SEQ ID NO: 3036231 - DNA, 19 bp, Homo sapiens
gcctactgagtagctttca

SEQ ID NO: 3036232 - DNA, 17 bp, Homo sapiens
gcctagaagctggtggc

SEQ ID NO: 3036233 - DNA, 16 bp, Homo sapiens
gcctagaatctttatt

SEQ ID NO: 3036234 - DNA, 15 bp, Homo sapiens
gcctagctgctacaa

SEQ ID NO: 3036235 - DNA, 16 bp, Homo sapiens
gcctagctgctacaaa

SEQ ID NO: 3036236 - DNA, 17 bp, Homo sapiens
gcctagctgctacaaag

SEQ ID NO: 3036237 - DNA, 19 bp, Homo sapiens
gcctagctgctacaaagaa

SEQ ID NO: 3036238 - DNA, 22 bp, Homo sapiens
gcctagctgctacaaagaagac

SEQ ID NO: 3036239 - DNA, 14 bp, Homo sapiens
gcctaggattctaa

SEQ ID NO: 3036240 - DNA, 13 bp, Homo sapiens
gcctaggatttca

SEQ ID NO: 3036241 - DNA, 23 bp, Homo sapiens
gcctagtgaaggcttctctctgt

SEQ ID NO: 3036242 - DNA, 23 bp, Homo sapiens
gcctagtggggtctccctctcct

SEQ ID NO: 3036243 - DNA, 14 bp, Homo sapiens
gcctataaatttac

SEQ ID NO: 3036244 - DNA, 14 bp, Homo sapiens
gcctataacttttt

SEQ ID NO: 3036245 - DNA, 20 bp, Homo sapiens
gcctataatcccagctactg

SEQ ID NO: 3036246 - DNA, 14 bp, Homo sapiens
gcctatcctggcca

SEQ ID NO: 3036247 - DNA, 23 bp, Homo sapiens
gcctatgcacatatggactctgc

SEQ ID NO: 3036248 - DNA, 14 bp, Homo sapiens
gcctcaacctcctg

SEQ ID NO: 3036249 - DNA, 22 bp, Homo sapiens
gcctcaactccaccctctgcga

SEQ ID NO: 3036250 - DNA, 18 bp, Homo sapiens
gcctcaagccatcttccc

SEQ ID NO: 3036251 - DNA, 20 bp, Homo sapiens
gcctcaagttccagtgcaga

SEQ ID NO: 3036252 - DNA, 21 bp, Homo sapiens
gcctcaatgtggttgcaaggc

SEQ ID NO: 3036253 - DNA, 14 bp, Homo sapiens
gcctcacagatgct

SEQ ID NO: 3036254 - DNA, 14 bp, Homo sapiens
gcctcacatctccc

SEQ ID NO: 3036255 - DNA, 19 bp, Homo sapiens
gcctcacccacccctgcac

SEQ ID NO: 3036256 - DNA, 20 bp, Homo sapiens
gcctcacccacccctgcaca

SEQ ID NO: 3036257 - DNA, 14 bp, Homo sapiens
gcctcactggctca

SEQ ID NO: 3036258 - DNA, 20 bp, Homo sapiens
gcctcactggctcatgcccc

SEQ ID NO: 3036259 - DNA, 22 bp, Homo sapiens
gcctcagaagaaaacaaagttc

SEQ ID NO: 3036260 - DNA, 20 bp, Homo sapiens
gcctcagactgcacccagga

SEQ ID NO: 3036261 - DNA, 15 bp, Homo sapiens
gcctcagccagagaa

SEQ ID NO: 3036262 - DNA, 13 bp, Homo sapiens
gcctcaggcactc

SEQ ID NO: 3036263 - DNA, 16 bp, Homo sapiens
gcctcagggccaggaa

SEQ ID NO: 3036264 - DNA, 17 bp, Homo sapiens
gcctcagggccaggaag

SEQ ID NO: 3036265 - DNA, 19 bp, Homo sapiens
gcctcagggccaggaagga

SEQ ID NO: 3036266 - DNA, 22 bp, Homo sapiens
gcctcagggccaggaaggacag

SEQ ID NO: 3036267 - DNA, 19 bp, Homo sapiens
gcctcagggtctaaggagc

SEQ ID NO: 3036268 - DNA, 19 bp, Homo sapiens
gcctcagtggctctgggta

SEQ ID NO: 3036269 - DNA, 13 bp, Homo sapiens
gcctcataaatta

SEQ ID NO: 3036270 - DNA, 13 bp, Homo sapiens
gcctcatcctcct

SEQ ID NO: 3036271 - DNA, 18 bp, Homo sapiens
gcctcatcctcctcctca

SEQ ID NO: 3036272 - DNA, 22 bp, Homo sapiens
gcctcatctataacatgcattt

SEQ ID NO: 3036273 - DNA, 13 bp, Homo sapiens
gcctcatgttctg

SEQ ID NO: 3036274 - DNA, 14 bp, Homo sapiens
gcctcatgttctgt

SEQ ID NO: 3036275 - DNA, 16 bp, Homo sapiens
gcctccaagtcaggtg

SEQ ID NO: 3036276 - DNA, 15 bp, Homo sapiens
gcctccacccacagt

SEQ ID NO: 3036277 - DNA, 21 bp, Homo sapiens
gcctccacccacagtggagag

SEQ ID NO: 3036278 - DNA, 22 bp, Homo sapiens
gcctccacccacagtggagagg

SEQ ID NO: 3036279 - DNA, 17 bp, Homo sapiens
gcctccagaactcactg

SEQ ID NO: 3036280 - DNA, 18 bp, Homo sapiens
gcctccagctgccccggg

SEQ ID NO: 3036281 - DNA, 19 bp, Homo sapiens
gcctccaggaaccacacca

SEQ ID NO: 3036282 - DNA, 18 bp, Homo sapiens
gcctccagttgtagcagg

SEQ ID NO: 3036283 - DNA, 13 bp, Homo sapiens
gcctcccactggg

SEQ ID NO: 3036284 - DNA, 17 bp, Homo sapiens
gcctcccagagtgctgg

SEQ ID NO: 3036285 - DNA, 22 bp, Homo sapiens
gcctcccatccagggcccccat

SEQ ID NO: 3036286 - DNA, 14 bp, Homo sapiens
gcctccccaatcca

SEQ ID NO: 3036287 - DNA, 21 bp, Homo sapiens
gcctcccctctccttcctgtg

SEQ ID NO: 3036288 - DNA, 20 bp, Homo sapiens
gcctcccctgaggatcccct

SEQ ID NO: 3036289 - DNA, 21 bp, Homo sapiens
gcctcccctgaggatcccctg

SEQ ID NO: 3036290 - DNA, 22 bp, Homo sapiens
gcctcccctgaggatcccctgt

SEQ ID NO: 3036291 - DNA, 15 bp, Homo sapiens
gcctcccctgccagg

SEQ ID NO: 3036292 - DNA, 17 bp, Homo sapiens
gcctcccctgccagggc

SEQ ID NO: 3036293 - DNA, 16 bp, Homo sapiens
gcctcccgaggagggg

SEQ ID NO: 3036294 - DNA, 22 bp, Homo sapiens
gcctcccgggaagcatcctccc

SEQ ID NO: 3036295 - DNA, 23 bp, Homo sapiens
gcctcccgggaagcatcctcccc

SEQ ID NO: 3036296 - DNA, 14 bp, Homo sapiens
gcctccctcaaccc

SEQ ID NO: 3036297 - DNA, 20 bp, Homo sapiens
gcctccctctcttccgggag

SEQ ID NO: 3036298 - DNA, 21 bp, Homo sapiens
gcctccctgaaacactgcttc

SEQ ID NO: 3036299 - DNA, 13 bp, Homo sapiens
gcctccctgaagc

SEQ ID NO: 3036300 - DNA, 16 bp, Homo sapiens
gcctccctgcctcagc

SEQ ID NO: 3036301 - DNA, 18 bp, Homo sapiens
gcctcccttcccagtggg

SEQ ID NO: 3036302 - DNA, 21 bp, Homo sapiens
gcctcccttgagtaggccctg

SEQ ID NO: 3036303 - DNA, 22 bp, Homo sapiens
gcctcccttgagtaggccctgc

SEQ ID NO: 3036304 - DNA, 17 bp, Homo sapiens
gcctccgatgcctggcc

SEQ ID NO: 3036305 - DNA, 21 bp, Homo sapiens
gcctccgatgcctggcctgcc

SEQ ID NO: 3036306 - DNA, 22 bp, Homo sapiens
gcctccgcacctgaccgctgcc

SEQ ID NO: 3036307 - DNA, 17 bp, Homo sapiens
gcctccgcttatcctgc

SEQ ID NO: 3036308 - DNA, 14 bp, Homo sapiens
gcctccggaagctg

SEQ ID NO: 3036309 - DNA, 14 bp, Homo sapiens
gcctcctcagcttt

SEQ ID NO: 3036310 - DNA, 17 bp, Homo sapiens
gcctcctccctggctgc

SEQ ID NO: 3036311 - DNA, 19 bp, Homo sapiens
gcctcctccctggctgcag

SEQ ID NO: 3036312 - DNA, 18 bp, Homo sapiens
gcctcctctctccctgcc

SEQ ID NO: 3036313 - DNA, 19 bp, Homo sapiens
gcctcctctctccctgcct

SEQ ID NO: 3036314 - DNA, 21 bp, Homo sapiens
gcctcctctctccctgcctca

SEQ ID NO: 3036315 - DNA, 15 bp, Homo sapiens
gcctcctggcccagg

SEQ ID NO: 3036316 - DNA, 14 bp, Homo sapiens
gctccctcccagga

SEQ ID NO: 3036317 - DNA, 20 bp, Homo sapiens
gctccctcccatcctccagc

SEQ ID NO: 3036318 - DNA, 23 bp, Homo sapiens
gctccctcgtcttcagctgcatt

SEQ ID NO: 3036319 - DNA, 12 bp, Homo sapiens
gctccctctctc

SEQ ID NO: 3036320 - DNA, 15 bp, Homo sapiens
gctccctctctcctg

SEQ ID NO: 3036321 - DNA, 20 bp, Homo sapiens
gctccctctctcctggactg

SEQ ID NO: 3036322 - DNA, 22 bp, Homo sapiens
gctccctctctcctggactggt

SEQ ID NO: 3036323 - DNA, 15 bp, Homo sapiens
gctccgaaattccaa

SEQ ID NO: 3036324 - DNA, 16 bp, Homo sapiens
gctccgacctctctca

SEQ ID NO: 3036325 - DNA, 22 bp, Homo sapiens
gctccgacctctctcagcccca

SEQ ID NO: 3036326 - DNA, 17 bp, Homo sapiens
gctccgctgcctggaac

SEQ ID NO: 3036327 - DNA, 12 bp, Homo sapiens
gctccgtctctg

SEQ ID NO: 3036328 - DNA, 13 bp, Homo sapiens
gctccgtctctgt

SEQ ID NO: 3036329 - DNA, 17 bp, Homo sapiens
gctccgtctctgtcctc

SEQ ID NO: 3036330 - DNA, 21 bp, Homo sapiens
gctccgtggactgcagtcggc

SEQ ID NO: 3036331 - DNA, 15 bp, Homo sapiens
gctcctagagggagg

SEQ ID NO: 3036332 - DNA, 15 bp, Homo sapiens
gctcctcactgtggt

SEQ ID NO: 3036333 - DNA, 15 bp, Homo sapiens
gctcctccagggcca

SEQ ID NO: 3036334 - DNA, 23 bp, Homo sapiens
gctcctccagggccacgtgccag

SEQ ID NO: 3036335 - DNA, 20 bp, Homo sapiens
gctcctccagggtgtgtgct

SEQ ID NO: 3036336 - DNA, 16 bp, Homo sapiens
gctcctcccctgccgc

SEQ ID NO: 3036337 - DNA, 17 bp, Homo sapiens
gctcctcccctgccgcc

SEQ ID NO: 3036338 - DNA, 19 bp, Homo sapiens
gctcctcccctgccgcctc

SEQ ID NO: 3036339 - DNA, 12 bp, Homo sapiens
gctcctccctct

SEQ ID NO: 3036340 - DNA, 14 bp, Homo sapiens
gctcctccctctgc

SEQ ID NO: 3036341 - DNA, 15 bp, Homo sapiens
gctcctccctctgcc

SEQ ID NO: 3036342 - DNA, 16 bp, Homo sapiens
gctcctccctctgcct

SEQ ID NO: 3036343 - DNA, 14 bp, Homo sapiens
gctcctcctccctg

SEQ ID NO: 3036344 - DNA, 13 bp, Homo sapiens
gctcctcctcctg

SEQ ID NO: 3036345 - DNA, 17 bp, Homo sapiens
gctcctcctcctgggct

SEQ ID NO: 3036346 - DNA, 12 bp, Homo sapiens
gctcctctcagt

SEQ ID NO: 3036347 - DNA, 12 bp, Homo sapiens
gctcctctgctt

SEQ ID NO: 3036348 - DNA, 23 bp, Homo sapiens
gctcctctttcccctcctttgtc

SEQ ID NO: 3036349 - DNA, 13 bp, Homo sapiens
gctcctgcccagc

SEQ ID NO: 3036350 - DNA, 17 bp, Homo sapiens
gctcctgcccagccacc

SEQ ID NO: 3036351 - DNA, 14 bp, Homo sapiens
gctcctggggagaa

SEQ ID NO: 3036352 - DNA, 14 bp, Homo sapiens
gctcctgtggcagc

SEQ ID NO: 3036353 - DNA, 18 bp, Homo sapiens
gctcctgtggcagctgcc

SEQ ID NO: 3036354 - DNA, 17 bp, Homo sapiens
gctccttaaggctcttt

SEQ ID NO: 3036355 - DNA, 21 bp, Homo sapiens
gctccttaaggctcttttgta

SEQ ID NO: 3036356 - DNA, 13 bp, Homo sapiens
gctccttagctgc

SEQ ID NO: 3036357 - DNA, 15 bp, Homo sapiens
gctccttagctgcca

SEQ ID NO: 3036358 - DNA, 18 bp, Homo sapiens
gctccttagctgccaagc

SEQ ID NO: 3036359 - DNA, 23 bp, Homo sapiens
gctccttcctggagactgcccag

SEQ ID NO: 3036360 - DNA, 13 bp, Homo sapiens
gctccttgggagg

SEQ ID NO: 3036361 - DNA, 17 bp, Homo sapiens
gctccttgggccctttg

SEQ ID NO: 3036362 - DNA, 14 bp, Homo sapiens
gctccttttctgtg

SEQ ID NO: 3036363 - DNA, 24 bp, Homo sapiens
gctccttttctgtgaagccctttg

SEQ ID NO: 3036364 - DNA, 15 bp, Homo sapiens
gctcgaagactgtga

SEQ ID NO: 3036365 - DNA, 18 bp, Homo sapiens
gctcgatgcctttgctgt

SEQ ID NO: 3036366 - DNA, 15 bp, Homo sapiens
gctcgcccaggaagg

SEQ ID NO: 3036367 - DNA, 23 bp, Homo sapiens
gctcgcccatacccgtgacagtg

SEQ ID NO: 3036368 - DNA, 15 bp, Homo sapiens
gctcggaggaagccc

SEQ ID NO: 3036369 - DNA, 14 bp, Homo sapiens
gctcggcccagcac

SEQ ID NO: 3036370 - DNA, 23 bp, Homo sapiens
gctcggcccagcaccccctctcc

SEQ ID NO: 3036371 - DNA, 21 bp, Homo sapiens
gctcggttaagtacccgaggc

SEQ ID NO: 3036372 - DNA, 18 bp, Homo sapiens
gctcgttacttcagccca

SEQ ID NO: 3036373 - DNA, 22 bp, Homo sapiens
gctcgttccggtccccacagac

SEQ ID NO: 3036374 - DNA, 15 bp, Homo sapiens
gctctaaaacataga

SEQ ID NO: 3036375 - DNA, 15 bp, Homo sapiens
gctctaagcagccag

SEQ ID NO: 3036376 - DNA, 15 bp, Homo sapiens
gctctaagtctcaac

SEQ ID NO: 3036377 - DNA, 15 bp, Homo sapiens
gctctacacaacatg

SEQ ID NO: 3036378 - DNA, 20 bp, Homo sapiens
gctctacacaacatgtatgt

SEQ ID NO: 3036379 - DNA, 15 bp, Homo sapiens
gctctacccagggcc

SEQ ID NO: 3036380 - DNA, 20 bp, Homo sapiens
gctctaccctgtgctaagca

SEQ ID NO: 3036381 - DNA, 17 bp, Homo sapiens
gctctagtcctttataa

SEQ ID NO: 3036382 - DNA, 18 bp, Homo sapiens
gctctagtcctttataag

SEQ ID NO: 3036383 - DNA, 15 bp, Homo sapiens
gctctagtgccttct

SEQ ID NO: 3036384 - DNA, 16 bp, Homo sapiens
gctctatctgcaatgt

SEQ ID NO: 3036385 - DNA, 19 bp, Homo sapiens
gctctatcttgctctgtaa

SEQ ID NO: 3036386 - DNA, 14 bp, Homo sapiens
gctctatgagtcta

SEQ ID NO: 3036387 - DNA, 21 bp, Homo sapiens
gctctatgagtctagatgttt

SEQ ID NO: 3036388 - DNA, 21 bp, Homo sapiens
gctctattatataaactttat

SEQ ID NO: 3036389 - DNA, 13 bp, Homo sapiens
gctctatttactt

SEQ ID NO: 3036390 - DNA, 14 bp, Homo sapiens
gctctcaaatgtga

SEQ ID NO: 3036391 - DNA, 13 bp, Homo sapiens
gctctccacctca

SEQ ID NO: 3036392 - DNA, 21 bp, Homo sapiens
gctctccacctcagccttgga

SEQ ID NO: 3036393 - DNA, 13 bp, Homo sapiens
gctctccaggcca

SEQ ID NO: 3036394 - DNA, 22 bp, Homo sapiens
gctctccctaccttgcctcctt

SEQ ID NO: 3036395 - DNA, 14 bp, Homo sapiens
gctctccctctggc

SEQ ID NO: 3036396 - DNA, 15 bp, Homo sapiens
gctctccctctggcc

SEQ ID NO: 3036397 - DNA, 17 bp, Homo sapiens
gctctccctctggccct

SEQ ID NO: 3036398 - DNA, 19 bp, Homo sapiens
gctctccctctggccctgc

SEQ ID NO: 3036399 - DNA, 23 bp, Homo sapiens
gctctccctctggccctgccttc

SEQ ID NO: 3036400 - DNA, 14 bp, Homo sapiens
gctctcctgacttt

SEQ ID NO: 3036401 - DNA, 19 bp, Homo sapiens
gctctcgggtgggggagcc

SEQ ID NO: 3036402 - DNA, 13 bp, Homo sapiens
gctctctgcagcc

SEQ ID NO: 3036403 - DNA, 14 bp, Homo sapiens
gctctctgcagcca

SEQ ID NO: 3036404 - DNA, 18 bp, Homo sapiens
gctctctgtgtctgagag

SEQ ID NO: 3036405 - DNA, 21 bp, Homo sapiens
gctctcttgtgacgtgcactg

SEQ ID NO: 3036406 - DNA, 17 bp, Homo sapiens
gctctgacccacagcct

SEQ ID NO: 3036407 - DNA, 15 bp, Homo sapiens
gctctgaggcctcac

SEQ ID NO: 3036408 - DNA, 16 bp, Homo sapiens
gctctgcccacctctc

SEQ ID NO: 3036409 - DNA, 18 bp, Homo sapiens
gctctgcccacctctctt

SEQ ID NO: 3036410 - DNA, 20 bp, Homo sapiens
gctctgccgccgcccgctgg

SEQ ID NO: 3036411 - DNA, 21 bp, Homo sapiens
gctctgccgccgcccgctggg

SEQ ID NO: 3036412 - DNA, 16 bp, Homo sapiens
gctctgccgtctctgg

SEQ ID NO: 3036413 - DNA, 19 bp, Homo sapiens
gctctgcctctaactccct

SEQ ID NO: 3036414 - DNA, 22 bp, Homo sapiens
gctctgcctctaactccctcct

SEQ ID NO: 3036415 - DNA, 18 bp, Homo sapiens
gctctgcgccaggcagag

SEQ ID NO: 3036416 - DNA, 13 bp, Homo sapiens
gctctggacagat

SEQ ID NO: 3036417 - DNA, 16 bp, Homo sapiens
gctctggacagcccca

SEQ ID NO: 3036418 - DNA, 16 bp, Homo sapiens
gctctggacgtgaaat

SEQ ID NO: 3036419 - DNA, 11 bp, Homo sapiens
gctctggctct

SEQ ID NO: 3036420 - DNA, 21 bp, Homo sapiens
gctctggggggcaacctggag

SEQ ID NO: 3036421 - DNA, 20 bp, Homo sapiens
gctctgggtacctgcaagca

SEQ ID NO: 3036422 - DNA, 16 bp, Homo sapiens
gctctggtccaggccc

SEQ ID NO: 3036423 - DNA, 19 bp, Homo sapiens
gctctgtaatctcgtttca

SEQ ID NO: 3036424 - DNA, 18 bp, Homo sapiens
gctctgtatcaggaccca

SEQ ID NO: 3036425 - DNA, 18 bp, Homo sapiens
gctctgtcaccctggcca

SEQ ID NO: 3036426 - DNA, 13 bp, Homo sapiens
gctctgtctactt

SEQ ID NO: 3036427 - DNA, 23 bp, Homo sapiens
gctctgtgaaatcagaagtgcaa

SEQ ID NO: 3036428 - DNA, 15 bp, Homo sapiens
gctctgtgggtctct

SEQ ID NO: 3036429 - DNA, 23 bp, Homo sapiens
gctctgttacccagggtggagtg

SEQ ID NO: 3036430 - DNA, 19 bp, Homo sapiens
gctctgttatcagctgggc

SEQ ID NO: 3036431 - DNA, 21 bp, Homo sapiens
gctctgttatcagctgggcag

SEQ ID NO: 3036432 - DNA, 22 bp, Homo sapiens
gctctgttatcagctgggcagt

SEQ ID NO: 3036433 - DNA, 16 bp, Homo sapiens
gctcttacttccccca

SEQ ID NO: 3036434 - DNA, 20 bp, Homo sapiens
gctcttacttcccccaccct

SEQ ID NO: 3036435 - DNA, 13 bp, Homo sapiens
gctcttcacttcc

SEQ ID NO: 3036436 - DNA, 17 bp, Homo sapiens
gctcttcacttcctcca

SEQ ID NO: 3036437 - DNA, 17 bp, Homo sapiens
gctcttctccttggagg

SEQ ID NO: 3036438 - DNA, 13 bp, Homo sapiens
gctcttctgggca

SEQ ID NO: 3036439 - DNA, 22 bp, Homo sapiens
gctcttctgggcagagcctgtc

SEQ ID NO: 3036440 - DNA, 12 bp, Homo sapiens
gctcttcttaaa

SEQ ID NO: 3036441 - DNA, 15 bp, Homo sapiens
gctcttcttgaaaaa

SEQ ID NO: 3036442 - DNA, 18 bp, Homo sapiens
gctcttgaccttgtagag

SEQ ID NO: 3036443 - DNA, 13 bp, Homo sapiens
gctcttgggcctg

SEQ ID NO: 3036444 - DNA, 21 bp, Homo sapiens
gctcttgggcctgacctccag

SEQ ID NO: 3036445 - DNA, 12 bp, Homo sapiens
gctcttgtttct

SEQ ID NO: 3036446 - DNA, 14 bp, Homo sapiens
gctctttcccagga

SEQ ID NO: 3036447 - DNA, 15 bp, Homo sapiens
gctctttcccaggac

SEQ ID NO: 3036448 - DNA, 16 bp, Homo sapiens
gctctttcccaggacg

SEQ ID NO: 3036449 - DNA, 16 bp, Homo sapiens
gcttctcctttggcat

SEQ ID NO: 3036450 - DNA, 17 bp, Homo sapiens
gcttctcggccagcccg

SEQ ID NO: 3036451 - DNA, 20 bp, Homo sapiens
gcttctcggggtccagtgca

SEQ ID NO: 3036452 - DNA, 14 bp, Homo sapiens
gcttctcttttcct

SEQ ID NO: 3036453 - DNA, 20 bp, Homo sapiens
gcttctcttttcctcgcaga

SEQ ID NO: 3036454 - DNA, 14 bp, Homo sapiens
gcttctggccagga

SEQ ID NO: 3036455 - DNA, 12 bp, Homo sapiens
gcttctggggtc

SEQ ID NO: 3036456 - DNA, 19 bp, Homo sapiens
gcttctggtgaccttccaa

SEQ ID NO: 3036457 - DNA, 15 bp, Homo sapiens
gcttcttcagctgac

SEQ ID NO: 3036458 - DNA, 15 bp, Homo sapiens
gcttcttccaggtgc

SEQ ID NO: 3036459 - DNA, 19 bp, Homo sapiens
gcttcttccaggtgcccag

SEQ ID NO: 3036460 - DNA, 12 bp, Homo sapiens
gcttcttgtgaa

SEQ ID NO: 3036461 - DNA, 20 bp, Homo sapiens
gcttcttgtgaaggccatga

SEQ ID NO: 3036462 - DNA, 21 bp, Homo sapiens
gcttgaacctgggaagtggag

SEQ ID NO: 3036463 - DNA, 13 bp, Homo sapiens
gcttgaatttgca

SEQ ID NO: 3036464 - DNA, 15 bp, Homo sapiens
gcttgacaacatctg

SEQ ID NO: 3036465 - DNA, 15 bp, Homo sapiens
gcttgacacctttga

SEQ ID NO: 3036466 - DNA, 23 bp, Homo sapiens
gcttgagacaaatcctttctgcc

SEQ ID NO: 3036467 - DNA, 19 bp, Homo sapiens
gcttgagttaggaatgaga

SEQ ID NO: 3036468 - DNA, 17 bp, Homo sapiens
gcttgagttctgcactc

SEQ ID NO: 3036469 - DNA, 19 bp, Homo sapiens
gcttgagttctgcactcca

SEQ ID NO: 3036470 - DNA, 19 bp, Homo sapiens
gcttgagtttggggaatgc

SEQ ID NO: 3036471 - DNA, 20 bp, Homo sapiens
gcttgatagaaatgccaagc

SEQ ID NO: 3036472 - DNA, 14 bp, Homo sapiens
gcttgcagccagga

SEQ ID NO: 3036473 - DNA, 22 bp, Homo sapiens
gcttgcctgcagggccatggct

SEQ ID NO: 3036474 - DNA, 13 bp, Homo sapiens
gcttgcctgggct

SEQ ID NO: 3036475 - DNA, 11 bp, Homo sapiens
gcttggagcaa

SEQ ID NO: 3036476 - DNA, 16 bp, Homo sapiens
gcttggagcagagggg

SEQ ID NO: 3036477 - DNA, 15 bp, Homo sapiens
gcttggatcctgggc

SEQ ID NO: 3036478 - DNA, 16 bp, Homo sapiens
gcttggcccgcggcct

SEQ ID NO: 3036479 - DNA, 19 bp, Homo sapiens
gcttggcccgcggcctgca

SEQ ID NO: 3036480 - DNA, 16 bp, Homo sapiens
gcttggcctatctcct

SEQ ID NO: 3036481 - DNA, 17 bp, Homo sapiens
gcttgggcagcatcccc

SEQ ID NO: 3036482 - DNA, 23 bp, Homo sapiens
gcttgggggtttttgaagtcttt

SEQ ID NO: 3036483 - DNA, 20 bp, Homo sapiens
gcttgggtggagaagccatt

SEQ ID NO: 3036484 - DNA, 16 bp, Homo sapiens
gcttggtgctggttta

SEQ ID NO: 3036485 - DNA, 22 bp, Homo sapiens
gcttgtaactccaccaacccat

SEQ ID NO: 3036486 - DNA, 21 bp, Homo sapiens
gcttgtacatttttaaattct

SEQ ID NO: 3036487 - DNA, 17 bp, Homo sapiens
gcttgtactaagccagg

SEQ ID NO: 3036488 - DNA, 18 bp, Homo sapiens
gcttgtactaagccagga

SEQ ID NO: 3036489 - DNA, 22 bp, Homo sapiens
gcttgtcccctcctcactccct

SEQ ID NO: 3036490 - DNA, 18 bp, Homo sapiens
gcttgtgaaaatgtgttc

SEQ ID NO: 3036491 - DNA, 12 bp, Homo sapiens
gcttgtgaggaa

SEQ ID NO: 3036492 - DNA, 17 bp, Homo sapiens
gcttgtgcctcccttcc

SEQ ID NO: 3036493 - DNA, 21 bp, Homo sapiens
gcttgtgcctcccttcccagt

SEQ ID NO: 3036494 - DNA, 19 bp, Homo sapiens
gcttgtgtatccattatca

SEQ ID NO: 3036495 - DNA, 22 bp, Homo sapiens
gcttgtgtatccattatcatgt

SEQ ID NO: 3036496 - DNA, 23 bp, Homo sapiens
gcttgttgtcaagtataaagtca

SEQ ID NO: 3036497 - DNA, 16 bp, Homo sapiens
gcttgttttattttgg

SEQ ID NO: 3036498 - DNA, 19 bp, Homo sapiens
gctttaaccgtttttcaag

SEQ ID NO: 3036499 - DNA, 17 bp, Homo sapiens
gctttacaggatcatgt

SEQ ID NO: 3036500 - DNA, 18 bp, Homo sapiens
gctttacgctcatcacct

SEQ ID NO: 3036501 - DNA, 11 bp, Homo sapiens
gctttagagct

SEQ ID NO: 3036502 - DNA, 23 bp, Homo sapiens
gctttataccccatttgatttcg

SEQ ID NO: 3036503 - DNA, 19 bp, Homo sapiens
gctttatgaagtttgagtt

SEQ ID NO: 3036504 - DNA, 19 bp, Homo sapiens
gctttatttatagaaatga

SEQ ID NO: 3036505 - DNA, 19 bp, Homo sapiens
gctttatttttctttaaag

SEQ ID NO: 3036506 - DNA, 21 bp, Homo sapiens
gctttcaattccgtagccagc

SEQ ID NO: 3036507 - DNA, 17 bp, Homo sapiens
gctttcagcgcccccag

SEQ ID NO: 3036508 - DNA, 18 bp, Homo sapiens
gctttcagggaggccctg

SEQ ID NO: 3036509 - DNA, 21 bp, Homo sapiens
gctttcagggcagcccctgca

SEQ ID NO: 3036510 - DNA, 18 bp, Homo sapiens
gctttcatgattagcaag

SEQ ID NO: 3036511 - DNA, 21 bp, Homo sapiens
gctttcccacttcccaccctg

SEQ ID NO: 3036512 - DNA, 20 bp, Homo sapiens
gctttcccccaggcgcctgc

SEQ ID NO: 3036513 - DNA, 22 bp, Homo sapiens
gctttcccccaggcgcctgcgc

SEQ ID NO: 3036514 - DNA, 15 bp, Homo sapiens
gctttcctaaatcag

SEQ ID NO: 3036515 - DNA, 17 bp, Homo sapiens
gctttccttttttaaaa

SEQ ID NO: 3036516 - DNA, 16 bp, Homo sapiens
gctttcgaactgctag

SEQ ID NO: 3036517 - DNA, 16 bp, Homo sapiens
gctttcggggagggcg

SEQ ID NO: 3036518 - DNA, 13 bp, Homo sapiens
gctttcgtccaca

SEQ ID NO: 3036519 - DNA, 20 bp, Homo sapiens
gctttctattacccctcatt

SEQ ID NO: 3036520 - DNA, 13 bp, Homo sapiens
gctttctgaaatt

SEQ ID NO: 3036521 - DNA, 22 bp, Homo sapiens
gctttctggtataaagctctca

SEQ ID NO: 3036522 - DNA, 22 bp, Homo sapiens
gctttctttggtaggtaaatct

SEQ ID NO: 3036523 - DNA, 11 bp, Homo sapiens
gctttgaaaaa

SEQ ID NO: 3036524 - DNA, 18 bp, Homo sapiens
gctttgaaaaaaagtttc

SEQ ID NO: 3036525 - DNA, 20 bp, Homo sapiens
gctttgaacgtgccagcagc

SEQ ID NO: 3036526 - DNA, 18 bp, Homo sapiens
gctttgacgggccaggcc

SEQ ID NO: 3036527 - DNA, 15 bp, Homo sapiens
gctttgagcaactaa

SEQ ID NO: 3036528 - DNA, 19 bp, Homo sapiens
gctttgaggtggaagaggg

SEQ ID NO: 3036529 - DNA, 15 bp, Homo sapiens
gctttgatccctgac

SEQ ID NO: 3036530 - DNA, 21 bp, Homo sapiens
gctttgattagttttcttgtt

SEQ ID NO: 3036531 - DNA, 15 bp, Homo sapiens
gctttgattcatagt

SEQ ID NO: 3036532 - DNA, 19 bp, Homo sapiens
gctttgctgctgaaggctc

SEQ ID NO: 3036533 - DNA, 21 bp, Homo sapiens
gctttgcttatggtaataaaa

SEQ ID NO: 3036534 - DNA, 18 bp, Homo sapiens
gctttgctttctgctcag

SEQ ID NO: 3036535 - DNA, 14 bp, Homo sapiens
gctttgctttgtct

SEQ ID NO: 3036536 - DNA, 16 bp, Homo sapiens
gctttggaatagatgg

SEQ ID NO: 3036537 - DNA, 17 bp, Homo sapiens
gctttggacccaaggaa

SEQ ID NO: 3036538 - DNA, 18 bp, Homo sapiens
gctttggacccaaggaaa

SEQ ID NO: 3036539 - DNA, 18 bp, Homo sapiens
gctttggcagtgttttgg

SEQ ID NO: 3036540 - DNA, 16 bp, Homo sapiens
gctttggcccaatgcc

SEQ ID NO: 3036541 - DNA, 13 bp, Homo sapiens
gctttggcttctt

SEQ ID NO: 3036542 - DNA, 17 bp, Homo sapiens
gctttggtgagaacctg

SEQ ID NO: 3036543 - DNA, 16 bp, Homo sapiens
gctttgtaggtgtctc

SEQ ID NO: 3036544 - DNA, 21 bp, Homo sapiens
gctttgtcccctgcttcagat

SEQ ID NO: 3036545 - DNA, 19 bp, Homo sapiens
gctttgtgtgaaggcagag

SEQ ID NO: 3036546 - DNA, 22 bp, Homo sapiens
gctttgttcttgtcatcagtaa

SEQ ID NO: 3036547 - DNA, 16 bp, Homo sapiens
gctttgttttccctgg

SEQ ID NO: 3036548 - DNA, 14 bp, Homo sapiens
gctttgttttgcac

SEQ ID NO: 3036549 - DNA, 13 bp, Homo sapiens
gcttttagtaaaa

SEQ ID NO: 3036550 - DNA, 18 bp, Homo sapiens
gcttttagtaaaaacatt

SEQ ID NO: 3036551 - DNA, 16 bp, Homo sapiens
gcttttatatctgtat

SEQ ID NO: 3036552 - DNA, 18 bp, Homo sapiens
gcttttatgtttgtacac

SEQ ID NO: 3036553 - DNA, 20 bp, Homo sapiens
gcttttattttttcttttgt

SEQ ID NO: 3036554 - DNA, 14 bp, Homo sapiens
gcttttcagccaat

SEQ ID NO: 3036555 - DNA, 20 bp, Homo sapiens
gcttttcctggacagctaga

SEQ ID NO: 3036556 - DNA, 23 bp, Homo sapiens
gcttttcgaactgtgctcccacg

SEQ ID NO: 3036557 - DNA, 12 bp, Homo sapiens
gcttttctgttt

SEQ ID NO: 3036558 - DNA, 14 bp, Homo sapiens
gcttttggcctgga

SEQ ID NO: 3036559 - DNA, 20 bp, Homo sapiens
gcttttgtctaattaaaaca

SEQ ID NO: 3036560 - DNA, 18 bp, Homo sapiens
gcttttttttttcttttg

SEQ ID NO: 3036561 - DNA, 23 bp, Homo sapiens
gcttttttttttcttttgttttg

SEQ ID NO: 3036562 - DNA, 21 bp, Homo sapiens
ggaaaaaaaaaaaaagaaatt

SEQ ID NO: 3036563 - DNA, 17 bp, Homo sapiens
ggaaaaaaaaaaaagag

SEQ ID NO: 3036564 - DNA, 21 bp, Homo sapiens
ggaaaaaaacataaaaagcag

SEQ ID NO: 3036565 - DNA, 19 bp, Homo sapiens
ggaaaaaaatcgtccaggg

SEQ ID NO: 3036566 - DNA, 12 bp, Homo sapiens
ggaaaaaaatgt

SEQ ID NO: 3036567 - DNA, 13 bp, Homo sapiens
ggaaaaaaatgtt

SEQ ID NO: 3036568 - DNA, 19 bp, Homo sapiens
ggaaaaagaaagaaacact

SEQ ID NO: 3036569 - DNA, 19 bp, Homo sapiens
ggaaaaagacgatgtttat

SEQ ID NO: 3036570 - DNA, 22 bp, Homo sapiens
ggaaaaagccatatcatgctaa

SEQ ID NO: 3036571 - DNA, 18 bp, Homo sapiens
ggaaaaataaaagaaaat

SEQ ID NO: 3036572 - DNA, 16 bp, Homo sapiens
ggaaaaattcttggtt

SEQ ID NO: 3036573 - DNA, 22 bp, Homo sapiens
ggaaaaccagactacttgggag

SEQ ID NO: 3036574 - DNA, 22 bp, Homo sapiens
ggaaaactacctgtatttaaaa

SEQ ID NO: 3036575 - DNA, 13 bp, Homo sapiens
ggaaaagaaatca

SEQ ID NO: 3036576 - DNA, 15 bp, Homo sapiens
ggaaaagcacaagaa

SEQ ID NO: 3036577 - DNA, 18 bp, Homo sapiens
ggaaaagcagctctcccc

SEQ ID NO: 3036578 - DNA, 19 bp, Homo sapiens
ggaaaataggcaggaagcc

SEQ ID NO: 3036579 - DNA, 17 bp, Homo sapiens
ggaaaatatttcctgac

SEQ ID NO: 3036580 - DNA, 19 bp, Homo sapiens
ggaaaatctgtaaaaaaga

SEQ ID NO: 3036581 - DNA, 14 bp, Homo sapiens
ggagcggaaagcag

SEQ ID NO: 3036582 - DNA, 15 bp, Homo sapiens
ggagcggaaagcagc

SEQ ID NO: 3036583 - DNA, 13 bp, Homo sapiens
ggagcgggcaggg

SEQ ID NO: 3036584 - DNA, 13 bp, Homo sapiens
ggagcgttctaaa

SEQ ID NO: 3036585 - DNA, 20 bp, Homo sapiens
ggagcgtttgctgtgccagg

SEQ ID NO: 3036586 - DNA, 15 bp, Homo sapiens
ggagctagccagagg

SEQ ID NO: 3036587 - DNA, 17 bp, Homo sapiens
ggagctcatgtgtccct

SEQ ID NO: 3036588 - DNA, 16 bp, Homo sapiens
ggagctctgcgccagg

SEQ ID NO: 3036589 - DNA, 20 bp, Homo sapiens
ggagctctgcgccaggcaga

SEQ ID NO: 3036590 - DNA, 21 bp, Homo sapiens
ggagctctgtgggtctctgga

SEQ ID NO: 3036591 - DNA, 17 bp, Homo sapiens
ggagctcttctgtgccc

SEQ ID NO: 3036592 - DNA, 18 bp, Homo sapiens
ggagctcttctgtgccct

SEQ ID NO: 3036593 - DNA, 16 bp, Homo sapiens
ggagctcttgggtcag

SEQ ID NO: 3036594 - DNA, 16 bp, Homo sapiens
ggagctgaaaaggatc

SEQ ID NO: 3036595 - DNA, 13 bp, Homo sapiens
ggagctgagggag

SEQ ID NO: 3036596 - DNA, 15 bp, Homo sapiens
ggagctgcccctctc

SEQ ID NO: 3036597 - DNA, 21 bp, Homo sapiens
ggagctgccttggctcagaca

SEQ ID NO: 3036598 - DNA, 18 bp, Homo sapiens
ggagctgctatagcctgg

SEQ ID NO: 3036599 - DNA, 13 bp, Homo sapiens
ggagctggcccag

SEQ ID NO: 3036600 - DNA, 16 bp, Homo sapiens
ggagctggccccgccg

SEQ ID NO: 3036601 - DNA, 21 bp, Homo sapiens
ggagctgggacacttaacaga

SEQ ID NO: 3036602 - DNA, 16 bp, Homo sapiens
ggagctgggaggtctc

SEQ ID NO: 3036603 - DNA, 18 bp, Homo sapiens
ggagctggtgacagcctt

SEQ ID NO: 3036604 - DNA, 19 bp, Homo sapiens
ggagctgtcaccaaggaaa

SEQ ID NO: 3036605 - DNA, 19 bp, Homo sapiens
ggagcttcctgtcctccca

SEQ ID NO: 3036606 - DNA, 15 bp, Homo sapiens
ggagcttctggggtc

SEQ ID NO: 3036607 - DNA, 14 bp, Homo sapiens
ggagctttctgtat

SEQ ID NO: 3036608 - DNA, 18 bp, Homo sapiens
ggagctttcttgtttctt

SEQ ID NO: 3036609 - DNA, 15 bp, Homo sapiens
ggaggaaagggcctg

SEQ ID NO: 3036610 - DNA, 18 bp, Homo sapiens
ggaggaagagagagactg

SEQ ID NO: 3036611 - DNA, 21 bp, Homo sapiens
ggaggaatgtgtgccttgttc

SEQ ID NO: 3036612 - DNA, 23 bp, Homo sapiens
ggaggacaagaccctctcaggct

SEQ ID NO: 3036613 - DNA, 20 bp, Homo sapiens
ggaggaccagggcagggcca

SEQ ID NO: 3036614 - DNA, 17 bp, Homo sapiens
ggaggaccttaaatgct

SEQ ID NO: 3036615 - DNA, 15 bp, Homo sapiens
ggaggagcacagttt

SEQ ID NO: 3036616 - DNA, 21 bp, Homo sapiens
ggaggagctgcctcttctctt

SEQ ID NO: 3036617 - DNA, 20 bp, Homo sapiens
ggaggatcctgagctgctgt

SEQ ID NO: 3036618 - DNA, 20 bp, Homo sapiens
ggaggcaaagctggctcacc

SEQ ID NO: 3036619 - DNA, 21 bp, Homo sapiens
ggaggcagagcgggagggagt

SEQ ID NO: 3036620 - DNA, 14 bp, Homo sapiens
ggaggcaggcatgg

SEQ ID NO: 3036621 - DNA, 19 bp, Homo sapiens
ggaggcagggccttgccca

SEQ ID NO: 3036622 - DNA, 19 bp, Homo sapiens
ggaggccaaggtgggcgga

SEQ ID NO: 3036623 - DNA, 11 bp, Homo sapiens
ggaggccaggc

SEQ ID NO: 3036624 - DNA, 14 bp, Homo sapiens
ggaggccaggccgg

SEQ ID NO: 3036625 - DNA, 14 bp, Homo sapiens
ggaggccaggcgag

SEQ ID NO: 3036626 - DNA, 17 bp, Homo sapiens
ggaggccagtgagccac

SEQ ID NO: 3036627 - DNA, 14 bp, Homo sapiens
ggaggccccagggg

SEQ ID NO: 3036628 - DNA, 20 bp, Homo sapiens
ggaggccccggcgcccgcac

SEQ ID NO: 3036629 - DNA, 15 bp, Homo sapiens
ggaggccctgtgccc

SEQ ID NO: 3036630 - DNA, 19 bp, Homo sapiens
ggaggcctgcgaccctggg

SEQ ID NO: 3036631 - DNA, 20 bp, Homo sapiens
ggaggcctgcgaccctgggg

SEQ ID NO: 3036632 - DNA, 19 bp, Homo sapiens
ggaggccttggggtggggg

SEQ ID NO: 3036633 - DNA, 20 bp, Homo sapiens
ggaggccttggggtgggggc

SEQ ID NO: 3036634 - DNA, 16 bp, Homo sapiens
ggaggcgctcctccct

SEQ ID NO: 3036635 - DNA, 20 bp, Homo sapiens
ggaggcggatgttgaagtga

SEQ ID NO: 3036636 - DNA, 13 bp, Homo sapiens
ggaggcggcagct

SEQ ID NO: 3036637 - DNA, 23 bp, Homo sapiens
ggaggcggcagctcttctgggca

SEQ ID NO: 3036638 - DNA, 21 bp, Homo sapiens
ggaggctcacccccttctcca

SEQ ID NO: 3036639 - DNA, 16 bp, Homo sapiens
ggaggctccagagggc

SEQ ID NO: 3036640 - DNA, 14 bp, Homo sapiens
ggaggctcctccct

SEQ ID NO: 3036641 - DNA, 15 bp, Homo sapiens
ggaggctcctccctc

SEQ ID NO: 3036642 - DNA, 21 bp, Homo sapiens
ggaggctcctgttagctcctc

SEQ ID NO: 3036643 - DNA, 13 bp, Homo sapiens
ggaggctgcactg

SEQ ID NO: 3036644 - DNA, 19 bp, Homo sapiens
ggaggctgcactggagcca

SEQ ID NO: 3036645 - DNA, 12 bp, Homo sapiens
ggaggctgcagc

SEQ ID NO: 3036646 - DNA, 17 bp, Homo sapiens
ggaggctgcagccaggc

SEQ ID NO: 3036647 - DNA, 20 bp, Homo sapiens
ggaggctgcagccaggcctc

SEQ ID NO: 3036648 - DNA, 21 bp, Homo sapiens
ggagggaaactgtgaatgctt

SEQ ID NO: 3036649 - DNA, 17 bp, Homo sapiens
ggagggactgctgaccc

SEQ ID NO: 3036650 - DNA, 20 bp, Homo sapiens
ggagggactgctgacccacc

SEQ ID NO: 3036651 - DNA, 14 bp, Homo sapiens
ggagggagaaagga

SEQ ID NO: 3036652 - DNA, 12 bp, Homo sapiens
ggagggagctga

SEQ ID NO: 3036653 - DNA, 19 bp, Homo sapiens
ggagggagctgaggcctcc

SEQ ID NO: 3036654 - DNA, 21 bp, Homo sapiens
ggagggagctgaggcctccct

SEQ ID NO: 3036655 - DNA, 20 bp, Homo sapiens
ggagggatgaagggcgagtg

SEQ ID NO: 3036656 - DNA, 19 bp, Homo sapiens
ggagggcactggagctggg

SEQ ID NO: 3036657 - DNA, 11 bp, Homo sapiens
ggagggcagag

SEQ ID NO: 3036658 - DNA, 12 bp, Homo sapiens
ggagggcagaga

SEQ ID NO: 3036659 - DNA, 15 bp, Homo sapiens
ggagggcagcagggc

SEQ ID NO: 3036660 - DNA, 16 bp, Homo sapiens
ggagggcagcagggct

SEQ ID NO: 3036661 - DNA, 14 bp, Homo sapiens
ggagggcaggcatc

SEQ ID NO: 3036662 - DNA, 23 bp, Homo sapiens
ggagggccacatgggaggctcac

SEQ ID NO: 3036663 - DNA, 19 bp, Homo sapiens
ggagggcgcccagcagcct

SEQ ID NO: 3036664 - DNA, 21 bp, Homo sapiens
ggagggcgcccagcagcctgc

SEQ ID NO: 3036665 - DNA, 15 bp, Homo sapiens
ggaggggaaggggcc

SEQ ID NO: 3036666 - DNA, 21 bp, Homo sapiens
ggaggggcccggtggcggcag

SEQ ID NO: 3036667 - DNA, 18 bp, Homo sapiens
ggaggggccggctggcct

SEQ ID NO: 3036668 - DNA, 18 bp, Homo sapiens
ggagggggcacggcaggc

SEQ ID NO: 3036669 - DNA, 21 bp, Homo sapiens
ggagggggtacctcatgagga

SEQ ID NO: 3036670 - DNA, 18 bp, Homo sapiens
ggaggtaaaggatgaggg

SEQ ID NO: 3036671 - DNA, 21 bp, Homo sapiens
ggaggtagctttgaggtggaa

SEQ ID NO: 3036672 - DNA, 16 bp, Homo sapiens
ggaggtgggaggccag

SEQ ID NO: 3036673 - DNA, 18 bp, Homo sapiens
ggaggtgggaggccaggc

SEQ ID NO: 3036674 - DNA, 19 bp, Homo sapiens
ggaggtgggaggccaggcg

SEQ ID NO: 3036675 - DNA, 13 bp, Homo sapiens
ggaggtgttcact

SEQ ID NO: 3036676 - DNA, 19 bp, Homo sapiens
ggaggttaaggctgaggaa

SEQ ID NO: 3036677 - DNA, 21 bp, Homo sapiens
ggaggttgcagtgagctgaga

SEQ ID NO: 3036678 - DNA, 17 bp, Homo sapiens
ggaggttgcattgagct

SEQ ID NO: 3036679 - DNA, 21 bp, Homo sapiens
ggagtaatagtaaacacaggg

SEQ ID NO: 3036680 - DNA, 18 bp, Homo sapiens
ggagtaatctgtgtacaa

SEQ ID NO: 3036681 - DNA, 15 bp, Homo sapiens
ggagtcaatttgcct

SEQ ID NO: 3036682 - DNA, 15 bp, Homo sapiens
ggagtcagccaggag

SEQ ID NO: 3036683 - DNA, 18 bp, Homo sapiens
ggagtcagccaggagctg

SEQ ID NO: 3036684 - DNA, 17 bp, Homo sapiens
ggagtcatctcaaccat

SEQ ID NO: 3036685 - DNA, 21 bp, Homo sapiens
ggagtcatttgagtctcttaa

SEQ ID NO: 3036686 - DNA, 13 bp, Homo sapiens
ggagtcccagagc

SEQ ID NO: 3036687 - DNA, 21 bp, Homo sapiens
ggagtcccaggggcagccaca

SEQ ID NO: 3036688 - DNA, 22 bp, Homo sapiens
ggagtcccaggggcagccacac

SEQ ID NO: 3036689 - DNA, 14 bp, Homo sapiens
ggagtctcaggagg

SEQ ID NO: 3036690 - DNA, 20 bp, Homo sapiens
ggagtctcaggaggaggctg

SEQ ID NO: 3036691 - DNA, 14 bp, Homo sapiens
ggagtctgaagcag

SEQ ID NO: 3036692 - DNA, 16 bp, Homo sapiens
ggagtgcagagaaaga

SEQ ID NO: 3036693 - DNA, 14 bp, Homo sapiens
ggagtgctgcttgt

SEQ ID NO: 3036694 - DNA, 14 bp, Homo sapiens
ggagtgctgtgctg

SEQ ID NO: 3036695 - DNA, 18 bp, Homo sapiens
ggagtggctcgccaggcc

SEQ ID NO: 3036696 - DNA, 16 bp, Homo sapiens
ggagtggggtagagga

SEQ ID NO: 3036697 - DNA, 20 bp, Homo sapiens
ggagtggggtagaggaagac

SEQ ID NO: 3036698 - DNA, 20 bp, Homo sapiens
ggagtgtcctcttccctctc

SEQ ID NO: 3036699 - DNA, 19 bp, Homo sapiens
ggagtgtgtcagagcccag

SEQ ID NO: 3036700 - DNA, 12 bp, Homo sapiens
ggagtgtttgac

SEQ ID NO: 3036701 - DNA, 21 bp, Homo sapiens
ggagttcctgctccgtggact

SEQ ID NO: 3036702 - DNA, 22 bp, Homo sapiens
ggagttcctgctccgtggactg

SEQ ID NO: 3036703 - DNA, 22 bp, Homo sapiens
ggagttctaacaaaacaagttg

SEQ ID NO: 3036704 - DNA, 20 bp, Homo sapiens
ggagttgggggcaggtcagg

SEQ ID NO: 3036705 - DNA, 14 bp, Homo sapiens
ggagtttctaaggt

SEQ ID NO: 3036706 - DNA, 15 bp, Homo sapiens
ggagtttgtgtgtct

SEQ ID NO: 3036707 - DNA, 13 bp, Homo sapiens
ggataacaaagat

SEQ ID NO: 3036708 - DNA, 18 bp, Homo sapiens
ggataacaaagatatctt

SEQ ID NO: 3036709 - DNA, 20 bp, Homo sapiens
ggataacaaagatatctttt

SEQ ID NO: 3036710 - DNA, 10 bp, Homo sapiens
ggataataaa

SEQ ID NO: 3036711 - DNA, 21 bp, Homo sapiens
ggataccagatagctcaatac

SEQ ID NO: 3036712 - DNA, 15 bp, Homo sapiens
ggataccagctcagg

SEQ ID NO: 3036713 - DNA, 13 bp, Homo sapiens
ggcagagggctgg

SEQ ID NO: 3036714 - DNA, 20 bp, Homo sapiens
ggcagagggctggaggccca

SEQ ID NO: 3036715 - DNA, 21 bp, Homo sapiens
ggcagagttctataatgtaaa

SEQ ID NO: 3036716 - DNA, 21 bp, Homo sapiens
ggcagagtttgtgtgttgtct

SEQ ID NO: 3036717 - DNA, 16 bp, Homo sapiens
ggcagataactgctgt

SEQ ID NO: 3036718 - DNA, 16 bp, Homo sapiens
ggcagatccaggacta

SEQ ID NO: 3036719 - DNA, 21 bp, Homo sapiens
ggcagatggcagggctgagga

SEQ ID NO: 3036720 - DNA, 16 bp, Homo sapiens
ggcagatgtggggctg

SEQ ID NO: 3036721 - DNA, 19 bp, Homo sapiens
ggcagatttgtggggacct

SEQ ID NO: 3036722 - DNA, 13 bp, Homo sapiens
ggcagcactggga

SEQ ID NO: 3036723 - DNA, 19 bp, Homo sapiens
ggcagcactgggaagctgg

SEQ ID NO: 3036724 - DNA, 19 bp, Homo sapiens
ggcagcagcatcccagcct

SEQ ID NO: 3036725 - DNA, 19 bp, Homo sapiens
ggcagcaggcatggcttcc

SEQ ID NO: 3036726 - DNA, 22 bp, Homo sapiens
ggcagcagtgtgaggccagggc

SEQ ID NO: 3036727 - DNA, 15 bp, Homo sapiens
ggcagcagttgaggt

SEQ ID NO: 3036728 - DNA, 17 bp, Homo sapiens
ggcagcatccccttgaa

SEQ ID NO: 3036729 - DNA, 17 bp, Homo sapiens
ggcagccacacgcaggc

SEQ ID NO: 3036730 - DNA, 22 bp, Homo sapiens
ggcagccacacgcaggcggcca

SEQ ID NO: 3036731 - DNA, 13 bp, Homo sapiens
ggcagccaggctg

SEQ ID NO: 3036732 - DNA, 16 bp, Homo sapiens
ggcagccaggctgggc

SEQ ID NO: 3036733 - DNA, 14 bp, Homo sapiens
ggcagccccagcac

SEQ ID NO: 3036734 - DNA, 23 bp, Homo sapiens
ggcagccccagcaccaccaggtc

SEQ ID NO: 3036735 - DNA, 14 bp, Homo sapiens
ggcagcccctgcag

SEQ ID NO: 3036736 - DNA, 16 bp, Homo sapiens
ggcagccctccatggt

SEQ ID NO: 3036737 - DNA, 13 bp, Homo sapiens
ggcagccctcctt

SEQ ID NO: 3036738 - DNA, 21 bp, Homo sapiens
ggcagctcttctgggcagagc

SEQ ID NO: 3036739 - DNA, 12 bp, Homo sapiens
ggcagctgccac

SEQ ID NO: 3036740 - DNA, 19 bp, Homo sapiens
ggcagctgcccctggcacc

SEQ ID NO: 3036741 - DNA, 14 bp, Homo sapiens
ggcagctgcctggc

SEQ ID NO: 3036742 - DNA, 15 bp, Homo sapiens
ggcagctgcctggcc

SEQ ID NO: 3036743 - DNA, 20 bp, Homo sapiens
ggcagctgcctggccatgct

SEQ ID NO: 3036744 - DNA, 15 bp, Homo sapiens
ggcagctgggcccac

SEQ ID NO: 3036745 - DNA, 18 bp, Homo sapiens
ggcagctgggcccacagc

SEQ ID NO: 3036746 - DNA, 22 bp, Homo sapiens
ggcagctgggcccacagccccc

SEQ ID NO: 3036747 - DNA, 15 bp, Homo sapiens
ggcaggaaggagcgg

SEQ ID NO: 3036748 - DNA, 19 bp, Homo sapiens
ggcaggacaacgaggaagc

SEQ ID NO: 3036749 - DNA, 20 bp, Homo sapiens
ggcaggacaacgaggaagcc

SEQ ID NO: 3036750 - DNA, 23 bp, Homo sapiens
ggcaggaccttcgggctgtgccc

SEQ ID NO: 3036751 - DNA, 23 bp, Homo sapiens
ggcaggagtcaccatgcaagggt

SEQ ID NO: 3036752 - DNA, 15 bp, Homo sapiens
ggcaggatgacttta

SEQ ID NO: 3036753 - DNA, 15 bp, Homo sapiens
ggcaggcatggccct

SEQ ID NO: 3036754 - DNA, 17 bp, Homo sapiens
ggcaggcatggccctgg

SEQ ID NO: 3036755 - DNA, 14 bp, Homo sapiens
ggcaggcctttcct

SEQ ID NO: 3036756 - DNA, 23 bp, Homo sapiens
ggcaggcggggggggcgcctgga

SEQ ID NO: 3036757 - DNA, 22 bp, Homo sapiens
ggcaggcgtgactcagcagcct

SEQ ID NO: 3036758 - DNA, 23 bp, Homo sapiens
ggcaggcgtgactcagcagcctg

SEQ ID NO: 3036759 - DNA, 20 bp, Homo sapiens
ggcaggcgtgtggcagccac

SEQ ID NO: 3036760 - DNA, 22 bp, Homo sapiens
ggcaggctgtctggccaggcct

SEQ ID NO: 3036761 - DNA, 22 bp, Homo sapiens
ggcagggagcggccggccagcc

SEQ ID NO: 3036762 - DNA, 17 bp, Homo sapiens
ggcagggagctgggccc

SEQ ID NO: 3036763 - DNA, 13 bp, Homo sapiens
ggcagggccaggc

SEQ ID NO: 3036764 - DNA, 17 bp, Homo sapiens
ggcagggccagggggtg

SEQ ID NO: 3036765 - DNA, 19 bp, Homo sapiens
ggcagggccttgcccagag

SEQ ID NO: 3036766 - DNA, 21 bp, Homo sapiens
ggcagggccttgcccagagat

SEQ ID NO: 3036767 - DNA, 21 bp, Homo sapiens
ggcagggcgggcagagggctg

SEQ ID NO: 3036768 - DNA, 22 bp, Homo sapiens
ggcagggcgggcagagggctgg

SEQ ID NO: 3036769 - DNA, 23 bp, Homo sapiens
ggcagggcgggcagagggctgga

SEQ ID NO: 3036770 - DNA, 14 bp, Homo sapiens
ggcagggctgagga

SEQ ID NO: 3036771 - DNA, 16 bp, Homo sapiens
ggcaggggcaggaggg

SEQ ID NO: 3036772 - DNA, 12 bp, Homo sapiens
ggcaggggcgga

SEQ ID NO: 3036773 - DNA, 19 bp, Homo sapiens
ggcagggggtgaaggcagg

SEQ ID NO: 3036774 - DNA, 21 bp, Homo sapiens
ggcagggggtgaaggcaggag

SEQ ID NO: 3036775 - DNA, 14 bp, Homo sapiens
ggcaggggtgagag

SEQ ID NO: 3036776 - DNA, 22 bp, Homo sapiens
ggcaggggtgagagcacccact

SEQ ID NO: 3036777 - DNA, 16 bp, Homo sapiens
ggcagggtctctgctc

SEQ ID NO: 3036778 - DNA, 19 bp, Homo sapiens
ggcagggtctctgctccag

SEQ ID NO: 3036779 - DNA, 21 bp, Homo sapiens
ggcagggtctctgctccagca

SEQ ID NO: 3036780 - DNA, 16 bp, Homo sapiens
ggcagggtgggatgga

SEQ ID NO: 3036781 - DNA, 15 bp, Homo sapiens
ggcaggtcactgtca

SEQ ID NO: 3036782 - DNA, 17 bp, Homo sapiens
ggcaggtcaggaccagg

SEQ ID NO: 3036783 - DNA, 17 bp, Homo sapiens
ggcaggtggcctctgct

SEQ ID NO: 3036784 - DNA, 16 bp, Homo sapiens
ggcaggtgggagctga

SEQ ID NO: 3036785 - DNA, 23 bp, Homo sapiens
ggcagtagctgtggtgaggtggg

SEQ ID NO: 3036786 - DNA, 14 bp, Homo sapiens
ggcagtattttctg

SEQ ID NO: 3036787 - DNA, 13 bp, Homo sapiens
ggcagtccagagc

SEQ ID NO: 3036788 - DNA, 16 bp, Homo sapiens
ggcagtcccgggagaa

SEQ ID NO: 3036789 - DNA, 20 bp, Homo sapiens
ggcagtcgctgcagggagca

SEQ ID NO: 3036790 - DNA, 16 bp, Homo sapiens
ggcagtgagggagggc

SEQ ID NO: 3036791 - DNA, 18 bp, Homo sapiens
ggcagtgtcttaaggaga

SEQ ID NO: 3036792 - DNA, 11 bp, Homo sapiens
ggcagttacat

SEQ ID NO: 3036793 - DNA, 23 bp, Homo sapiens
ggcagttttgacatcagccagct

SEQ ID NO: 3036794 - DNA, 14 bp, Homo sapiens
ggcatatacagtga

SEQ ID NO: 3036795 - DNA, 18 bp, Homo sapiens
ggcatcaccttaggcagg

SEQ ID NO: 3036796 - DNA, 23 bp, Homo sapiens
ggcatcatgcatcttactgaagg

SEQ ID NO: 3036797 - DNA, 13 bp, Homo sapiens
ggcatcatgcatg

SEQ ID NO: 3036798 - DNA, 22 bp, Homo sapiens
ggcatccagagtccctgcctgg

SEQ ID NO: 3036799 - DNA, 21 bp, Homo sapiens
ggcatccaggccagggctcct

SEQ ID NO: 3036800 - DNA, 14 bp, Homo sapiens
ggcatccagggctg

SEQ ID NO: 3036801 - DNA, 14 bp, Homo sapiens
ggcatccttgcctg

SEQ ID NO: 3036802 - DNA, 20 bp, Homo sapiens
ggcatccttgcctgtctaaa

SEQ ID NO: 3036803 - DNA, 21 bp, Homo sapiens
ggcatccttgcctgtctaaag

SEQ ID NO: 3036804 - DNA, 22 bp, Homo sapiens
ggcatccttgcctgtctaaagc

SEQ ID NO: 3036805 - DNA, 22 bp, Homo sapiens
ggcatctaattcttatttttaa

SEQ ID NO: 3036806 - DNA, 20 bp, Homo sapiens
ggcatctctgagtgtctctg

SEQ ID NO: 3036807 - DNA, 14 bp, Homo sapiens
ggcatctgcaaagg

SEQ ID NO: 3036808 - DNA, 13 bp, Homo sapiens
ggcatctgtgtgc

SEQ ID NO: 3036809 - DNA, 13 bp, Homo sapiens
ggcatgacccagt

SEQ ID NO: 3036810 - DNA, 19 bp, Homo sapiens
ggcatgacccagtgaagat

SEQ ID NO: 3036811 - DNA, 21 bp, Homo sapiens
ggcatgagactcagtgcagat

SEQ ID NO: 3036812 - DNA, 17 bp, Homo sapiens
ggcatgcacacggctgg

SEQ ID NO: 3036813 - DNA, 19 bp, Homo sapiens
ggcatgcacacggctggtc

SEQ ID NO: 3036814 - DNA, 14 bp, Homo sapiens
ggcatgcacctgca

SEQ ID NO: 3036815 - DNA, 18 bp, Homo sapiens
ggcatgcacgggcatgca

SEQ ID NO: 3036816 - DNA, 23 bp, Homo sapiens
ggcatgccaggacccgccagccc

SEQ ID NO: 3036817 - DNA, 16 bp, Homo sapiens
ggcatggccctgggcg

SEQ ID NO: 3036818 - DNA, 13 bp, Homo sapiens
ggcatggctccct

SEQ ID NO: 3036819 - DNA, 17 bp, Homo sapiens
ggcatggctggtgcctg

SEQ ID NO: 3036820 - DNA, 19 bp, Homo sapiens
ggcatgggtcgggagaggg

SEQ ID NO: 3036821 - DNA, 20 bp, Homo sapiens
ggcatgggtcgggagagggg

SEQ ID NO: 3036822 - DNA, 21 bp, Homo sapiens
ggcatggtggcgcaagcctgt

SEQ ID NO: 3036823 - DNA, 20 bp, Homo sapiens
ggcatgtattagccagtcat

SEQ ID NO: 3036824 - DNA, 23 bp, Homo sapiens
ggcatgtcctttccatctgtcca

SEQ ID NO: 3036825 - DNA, 13 bp, Homo sapiens
ggcatgtctgcct

SEQ ID NO: 3036826 - DNA, 14 bp, Homo sapiens
ggcatgtgggcttc

SEQ ID NO: 3036827 - DNA, 12 bp, Homo sapiens
ggcattccacag

SEQ ID NO: 3036828 - DNA, 17 bp, Homo sapiens
ggcattctacacctgga

SEQ ID NO: 3036829 - DNA, 16 bp, Homo sapiens
ggcattgatggggaag

SEQ ID NO: 3036830 - DNA, 23 bp, Homo sapiens
ggcattgatggggaaggaggctg

SEQ ID NO: 3036831 - DNA, 13 bp, Homo sapiens
ggcattgctttcc

SEQ ID NO: 3036832 - DNA, 13 bp, Homo sapiens
ggcatttcacaaa

SEQ ID NO: 3036833 - DNA, 11 bp, Homo sapiens
ggcatttccta

SEQ ID NO: 3036834 - DNA, 17 bp, Homo sapiens
ggcattttgaatgtgat

SEQ ID NO: 3036835 - DNA, 20 bp, Homo sapiens
ggcatttttgcaggctggct

SEQ ID NO: 3036836 - DNA, 12 bp, Homo sapiens
ggccaaacctct

SEQ ID NO: 3036837 - DNA, 14 bp, Homo sapiens
ggccaacaaagaac

SEQ ID NO: 3036838 - DNA, 13 bp, Homo sapiens
ggccaacatggta

SEQ ID NO: 3036839 - DNA, 20 bp, Homo sapiens
ggccaacccttctcctcttg

SEQ ID NO: 3036840 - DNA, 13 bp, Homo sapiens
ggccaagagaagg

SEQ ID NO: 3036841 - DNA, 16 bp, Homo sapiens
ggccaaggagggtgag

SEQ ID NO: 3036842 - DNA, 16 bp, Homo sapiens
ggccacatcaaagagg

SEQ ID NO: 3036843 - DNA, 17 bp, Homo sapiens
ggccaccacccaacctg

SEQ ID NO: 3036844 - DNA, 14 bp, Homo sapiens
ggccacctcaccct

SEQ ID NO: 3036845 - DNA, 20 bp, Homo sapiens
ggctcctccctctgcctcat

SEQ ID NO: 3036846 - DNA, 23 bp, Homo sapiens
ggctcctccctctgcctcatcct

SEQ ID NO: 3036847 - DNA, 13 bp, Homo sapiens
ggctcggcccagc

SEQ ID NO: 3036848 - DNA, 14 bp, Homo sapiens
ggctcggcccagca

SEQ ID NO: 3036849 - DNA, 15 bp, Homo sapiens
ggctcggcccagcac

SEQ ID NO: 3036850 - DNA, 23 bp, Homo sapiens
ggctctaaacctcaggccacatc

SEQ ID NO: 3036851 - DNA, 11 bp, Homo sapiens
ggctctagatc

SEQ ID NO: 3036852 - DNA, 22 bp, Homo sapiens
ggctctattggatttgtccaaa

SEQ ID NO: 3036853 - DNA, 23 bp, Homo sapiens
ggctctcatgttttcaactgcca

SEQ ID NO: 3036854 - DNA, 14 bp, Homo sapiens
ggctctccacctca

SEQ ID NO: 3036855 - DNA, 17 bp, Homo sapiens
ggctctccacctcagcc

SEQ ID NO: 3036856 - DNA, 18 bp, Homo sapiens
ggctctccacctcagcct

SEQ ID NO: 3036857 - DNA, 17 bp, Homo sapiens
ggctctcgggtggggga

SEQ ID NO: 3036858 - DNA, 12 bp, Homo sapiens
ggctctctgagt

SEQ ID NO: 3036859 - DNA, 23 bp, Homo sapiens
ggctctgaagcaaggcggtggac

SEQ ID NO: 3036860 - DNA, 15 bp, Homo sapiens
ggctctgagagtcta

SEQ ID NO: 3036861 - DNA, 22 bp, Homo sapiens
ggctctgagagtctagattctc

SEQ ID NO: 3036862 - DNA, 19 bp, Homo sapiens
ggctctgctggccggagca

SEQ ID NO: 3036863 - DNA, 14 bp, Homo sapiens
ggctctgggggcag

SEQ ID NO: 3036864 - DNA, 14 bp, Homo sapiens
ggctctgtgccttg

SEQ ID NO: 3036865 - DNA, 19 bp, Homo sapiens
ggctctgttatcagctggg

SEQ ID NO: 3036866 - DNA, 13 bp, Homo sapiens
ggctctgttcctc

SEQ ID NO: 3036867 - DNA, 20 bp, Homo sapiens
ggctctgttcctcaatggcc

SEQ ID NO: 3036868 - DNA, 20 bp, Homo sapiens
ggctcttctccttggaggac

SEQ ID NO: 3036869 - DNA, 15 bp, Homo sapiens
ggctcttctgagcag

SEQ ID NO: 3036870 - DNA, 18 bp, Homo sapiens
ggctcttgaactgagctt

SEQ ID NO: 3036871 - DNA, 15 bp, Homo sapiens
ggctgaacagtgctc

SEQ ID NO: 3036872 - DNA, 20 bp, Homo sapiens
ggctgaacagtgctctgcct

SEQ ID NO: 3036873 - DNA, 17 bp, Homo sapiens
ggctgaacggggagaaa

SEQ ID NO: 3036874 - DNA, 13 bp, Homo sapiens
ggctgaccacagc

SEQ ID NO: 3036875 - DNA, 16 bp, Homo sapiens
ggctgaccacagcaca

SEQ ID NO: 3036876 - DNA, 22 bp, Homo sapiens
ggctgacggtgcagtctgggtg

SEQ ID NO: 3036877 - DNA, 15 bp, Homo sapiens
ggctgagccaaagcc

SEQ ID NO: 3036878 - DNA, 13 bp, Homo sapiens
ggctgagctgggg

SEQ ID NO: 3036879 - DNA, 18 bp, Homo sapiens
ggctgaggatgggctctg

SEQ ID NO: 3036880 - DNA, 14 bp, Homo sapiens
ggctgaggcagaag

SEQ ID NO: 3036881 - DNA, 18 bp, Homo sapiens
ggctgaggctggcacagg

SEQ ID NO: 3036882 - DNA, 15 bp, Homo sapiens
ggctgagggcatctc

SEQ ID NO: 3036883 - DNA, 16 bp, Homo sapiens
ggctgagggtgccctt

SEQ ID NO: 3036884 - DNA, 16 bp, Homo sapiens
ggctgagtctccaggg

SEQ ID NO: 3036885 - DNA, 20 bp, Homo sapiens
ggctgatggattccaaacca

SEQ ID NO: 3036886 - DNA, 21 bp, Homo sapiens
ggctgatggattccaaaccag

SEQ ID NO: 3036887 - DNA, 14 bp, Homo sapiens
ggctgatttctagg

SEQ ID NO: 3036888 - DNA, 17 bp, Homo sapiens
ggctgcacgctcccctc

SEQ ID NO: 3036889 - DNA, 18 bp, Homo sapiens
ggctgcactggagccaca

SEQ ID NO: 3036890 - DNA, 20 bp, Homo sapiens
ggctgcactggagccacagg

SEQ ID NO: 3036891 - DNA, 19 bp, Homo sapiens
ggctgcagagtctgcccca

SEQ ID NO: 3036892 - DNA, 17 bp, Homo sapiens
ggctgcagccaggcctc

SEQ ID NO: 3036893 - DNA, 18 bp, Homo sapiens
ggctgcagccaggcctcg

SEQ ID NO: 3036894 - DNA, 20 bp, Homo sapiens
ggctgcagccaggcctcgcc

SEQ ID NO: 3036895 - DNA, 13 bp, Homo sapiens
ggctgcaggtgct

SEQ ID NO: 3036896 - DNA, 14 bp, Homo sapiens
ggctgcaggtgctg

SEQ ID NO: 3036897 - DNA, 23 bp, Homo sapiens
ggctgccccaggccggagcccag

SEQ ID NO: 3036898 - DNA, 20 bp, Homo sapiens
ggctgccgactcccccaacc

SEQ ID NO: 3036899 - DNA, 19 bp, Homo sapiens
ggctgccgagacagaccct

SEQ ID NO: 3036900 - DNA, 22 bp, Homo sapiens
ggctgccgagacagaccctctg

SEQ ID NO: 3036901 - DNA, 19 bp, Homo sapiens
ggctgcctttgatcacagg

SEQ ID NO: 3036902 - DNA, 20 bp, Homo sapiens
ggctgcctttgatcacagga

SEQ ID NO: 3036903 - DNA, 12 bp, Homo sapiens
ggctgcctttgt

SEQ ID NO: 3036904 - DNA, 23 bp, Homo sapiens
ggctgcctttgtggtgggcgctg

SEQ ID NO: 3036905 - DNA, 16 bp, Homo sapiens
ggctgcggtgggcagc

SEQ ID NO: 3036906 - DNA, 15 bp, Homo sapiens
ggctgctcctccagg

SEQ ID NO: 3036907 - DNA, 15 bp, Homo sapiens
ggctgctcgcccagg

SEQ ID NO: 3036908 - DNA, 19 bp, Homo sapiens
ggctgctcgcccaggaagg

SEQ ID NO: 3036909 - DNA, 22 bp, Homo sapiens
ggctgctcgcccaggaaggcct

SEQ ID NO: 3036910 - DNA, 12 bp, Homo sapiens
ggctgctgccac

SEQ ID NO: 3036911 - DNA, 14 bp, Homo sapiens
ggctgctgccatcc

SEQ ID NO: 3036912 - DNA, 11 bp, Homo sapiens
ggctgctggga

SEQ ID NO: 3036913 - DNA, 23 bp, Homo sapiens
ggctgctgggggctccccttgcc

SEQ ID NO: 3036914 - DNA, 15 bp, Homo sapiens
ggctgctgtgtggac

SEQ ID NO: 3036915 - DNA, 18 bp, Homo sapiens
ggctgcttctacggccat

SEQ ID NO: 3036916 - DNA, 14 bp, Homo sapiens
ggctgcttgcagcc

SEQ ID NO: 3036917 - DNA, 20 bp, Homo sapiens
ggctggagaatgtggagaac

SEQ ID NO: 3036918 - DNA, 19 bp, Homo sapiens
ggctggaggcagggccttg

SEQ ID NO: 3036919 - DNA, 20 bp, Homo sapiens
ggctggagtacagtggtgcc

SEQ ID NO: 3036920 - DNA, 20 bp, Homo sapiens
ggctggagtgcagtggtgca

SEQ ID NO: 3036921 - DNA, 20 bp, Homo sapiens
ggctggagtgcagtggtgtg

SEQ ID NO: 3036922 - DNA, 15 bp, Homo sapiens
ggctggcacaggaca

SEQ ID NO: 3036923 - DNA, 22 bp, Homo sapiens
ggctggcatgatccaagcaaga

SEQ ID NO: 3036924 - DNA, 13 bp, Homo sapiens
ggctggccagccg

SEQ ID NO: 3036925 - DNA, 16 bp, Homo sapiens
ggctggccagccgctc

SEQ ID NO: 3036926 - DNA, 18 bp, Homo sapiens
ggctggccctgtgcagac

SEQ ID NO: 3036927 - DNA, 20 bp, Homo sapiens
ggctggcctggaggctcagc

SEQ ID NO: 3036928 - DNA, 20 bp, Homo sapiens
ggctggcggctactcagcag

SEQ ID NO: 3036929 - DNA, 20 bp, Homo sapiens
ggctggctctgtggaggggc

SEQ ID NO: 3036930 - DNA, 10 bp, Homo sapiens
ggctggctgg

SEQ ID NO: 3036931 - DNA, 19 bp, Homo sapiens
ggctgggacgtggctcagc

SEQ ID NO: 3036932 - DNA, 23 bp, Homo sapiens
ggctgggacgtggctcagccagc

SEQ ID NO: 3036933 - DNA, 13 bp, Homo sapiens
ggctgggaggagg

SEQ ID NO: 3036934 - DNA, 14 bp, Homo sapiens
ggctgggcctcctt

SEQ ID NO: 3036935 - DNA, 11 bp, Homo sapiens
ggctgggctga

SEQ ID NO: 3036936 - DNA, 14 bp, Homo sapiens
ggctgggctgagcc

SEQ ID NO: 3036937 - DNA, 21 bp, Homo sapiens
ggctgggggagggactgctga

SEQ ID NO: 3036938 - DNA, 20 bp, Homo sapiens
ggctggggtggcctgtgtgg

SEQ ID NO: 3036939 - DNA, 18 bp, Homo sapiens
ggctgggtcacaggaagg

SEQ ID NO: 3036940 - DNA, 18 bp, Homo sapiens
ggctgggtccttgggcct

SEQ ID NO: 3036941 - DNA, 14 bp, Homo sapiens
ggctgggtggcccc

SEQ ID NO: 3036942 - DNA, 16 bp, Homo sapiens
ggctggtattctctct

SEQ ID NO: 3036943 - DNA, 13 bp, Homo sapiens
ggctggtcactct

SEQ ID NO: 3036944 - DNA, 15 bp, Homo sapiens
ggctggtcactctgc

SEQ ID NO: 3036945 - DNA, 17 bp, Homo sapiens
ggctggtcactctgccc

SEQ ID NO: 3036946 - DNA, 17 bp, Homo sapiens
ggctggtgcctgagccc

SEQ ID NO: 3036947 - DNA, 19 bp, Homo sapiens
ggctggtggattgggcaga

SEQ ID NO: 3036948 - DNA, 14 bp, Homo sapiens
ggctggtttgttct

SEQ ID NO: 3036949 - DNA, 13 bp, Homo sapiens
ggctgtcccaagc

SEQ ID NO: 3036950 - DNA, 14 bp, Homo sapiens
ggctgtcccaagct

SEQ ID NO: 3036951 - DNA, 19 bp, Homo sapiens
ggctgtcccaagctcccaa

SEQ ID NO: 3036952 - DNA, 22 bp, Homo sapiens
ggctgtctttgcagggcacaga

SEQ ID NO: 3036953 - DNA, 19 bp, Homo sapiens
ggctgtgaatgccaaagcc

SEQ ID NO: 3036954 - DNA, 18 bp, Homo sapiens
ggctgtgactctgggcag

SEQ ID NO: 3036955 - DNA, 19 bp, Homo sapiens
ggctgtgactctgggcagg

SEQ ID NO: 3036956 - DNA, 14 bp, Homo sapiens
ggctgtgctcagag

SEQ ID NO: 3036957 - DNA, 21 bp, Homo sapiens
ggctgtggagacaatgtctgc

SEQ ID NO: 3036958 - DNA, 23 bp, Homo sapiens
ggctgtggcatccagagtccctg

SEQ ID NO: 3036959 - DNA, 15 bp, Homo sapiens
ggctgtgggaccagg

SEQ ID NO: 3036960 - DNA, 13 bp, Homo sapiens
ggctgttgcatgg

SEQ ID NO: 3036961 - DNA, 19 bp, Homo sapiens
ggcttaagaaatctagtat

SEQ ID NO: 3036962 - DNA, 13 bp, Homo sapiens
ggcttaataaaaa

SEQ ID NO: 3036963 - DNA, 14 bp, Homo sapiens
ggcttaataaaaat

SEQ ID NO: 3036964 - DNA, 14 bp, Homo sapiens
ggcttaatcatttt

SEQ ID NO: 3036965 - DNA, 22 bp, Homo sapiens
ggcttacaggggggtcggaagc

SEQ ID NO: 3036966 - DNA, 16 bp, Homo sapiens
ggcttatttagaaaaa

SEQ ID NO: 3036967 - DNA, 11 bp, Homo sapiens
ggcttcagcct

SEQ ID NO: 3036968 - DNA, 21 bp, Homo sapiens
ggcttcagcctagtggcttgt

SEQ ID NO: 3036969 - DNA, 24 bp, Homo sapiens
ggcttcagcctagtggcttgtcct

SEQ ID NO: 3036970 - DNA, 20 bp, Homo sapiens
ggcttcagctccagcccctt

SEQ ID NO: 3036971 - DNA, 16 bp, Homo sapiens
ggcttcaggtccaggc

SEQ ID NO: 3036972 - DNA, 18 bp, Homo sapiens
ggcttcagtctcatattt

SEQ ID NO: 3036973 - DNA, 12 bp, Homo sapiens
ggcttcatacac

SEQ ID NO: 3036974 - DNA, 22 bp, Homo sapiens
ggcttcctcttccgggcagaaa

SEQ ID NO: 3036975 - DNA, 22 bp, Homo sapiens
ggcttctgcgtccaccaggcct

SEQ ID NO: 3036976 - DNA, 15 bp, Homo sapiens
ggcttgaatttgcat

SEQ ID NO: 3036977 - DNA, 22 bp, Homo sapiens
gggggctccccttgcccttcct

SEQ ID NO: 3036978 - DNA, 12 bp, Homo sapiens
ggggggctgcct

SEQ ID NO: 3036979 - DNA, 19 bp, Homo sapiens
gggggtcggaagcctgtcc

SEQ ID NO: 3036980 - DNA, 21 bp, Homo sapiens
ggggtaaagggcgcaaagggc

SEQ ID NO: 3036981 - DNA, 23 bp, Homo sapiens
ggggtagaggaagacgagacagg

SEQ ID NO: 3036982 - DNA, 19 bp, Homo sapiens
ggggtagctagaggaacca

SEQ ID NO: 3036983 - DNA, 16 bp, Homo sapiens
ggggtcaagctgagct

SEQ ID NO: 3036984 - DNA, 18 bp, Homo sapiens
ggggtcaagctgagctgg

SEQ ID NO: 3036985 - DNA, 15 bp, Homo sapiens
ggggtcatccttgcc

SEQ ID NO: 3036986 - DNA, 16 bp, Homo sapiens
ggggtcatccttgccc

SEQ ID NO: 3036987 - DNA, 21 bp, Homo sapiens
ggggtcatgccctcctctccc

SEQ ID NO: 3036988 - DNA, 16 bp, Homo sapiens
ggggtccctagcagcc

SEQ ID NO: 3036989 - DNA, 18 bp, Homo sapiens
ggggtcctgccggagagg

SEQ ID NO: 3036990 - DNA, 11 bp, Homo sapiens
ggggtcctggc

SEQ ID NO: 3036991 - DNA, 13 bp, Homo sapiens
ggggtcctggcca

SEQ ID NO: 3036992 - DNA, 14 bp, Homo sapiens
ggggtcctggccat

SEQ ID NO: 3036993 - DNA, 23 bp, Homo sapiens
ggggtcctgggaggctgcagcca

SEQ ID NO: 3036994 - DNA, 19 bp, Homo sapiens
ggggtctccctctcctgcc

SEQ ID NO: 3036995 - DNA, 20 bp, Homo sapiens
ggggtctccctctcctgcct

SEQ ID NO: 3036996 - DNA, 22 bp, Homo sapiens
ggggtctccctctcctgcctac

SEQ ID NO: 3036997 - DNA, 16 bp, Homo sapiens
ggggtctcctggacct

SEQ ID NO: 3036998 - DNA, 14 bp, Homo sapiens
ggggtgaggagctg

SEQ ID NO: 3036999 - DNA, 15 bp, Homo sapiens
ggggtgaggagctgg

SEQ ID NO: 3037000 - DNA, 16 bp, Homo sapiens
ggggtggagtcccaga

SEQ ID NO: 3037001 - DNA, 17 bp, Homo sapiens
ggggtggagtcccagag

SEQ ID NO: 3037002 - DNA, 13 bp, Homo sapiens
ggggtggcctgtg

SEQ ID NO: 3037003 - DNA, 15 bp, Homo sapiens
ggggtggcctgtgtg

SEQ ID NO: 3037004 - DNA, 19 bp, Homo sapiens
ggggtggcgcgcctgcctt

SEQ ID NO: 3037005 - DNA, 13 bp, Homo sapiens
ggggtgggcagca

SEQ ID NO: 3037006 - DNA, 12 bp, Homo sapiens
ggggtggggtgg

SEQ ID NO: 3037007 - DNA, 18 bp, Homo sapiens
ggggtgtccgagaggctg

SEQ ID NO: 3037008 - DNA, 15 bp, Homo sapiens
ggggttgtgttgtca

SEQ ID NO: 3037009 - DNA, 23 bp, Homo sapiens
gggtaaagggcgcaaagggcatg

SEQ ID NO: 3037010 - DNA, 20 bp, Homo sapiens
gggtaagggatttcttaggg

SEQ ID NO: 3037011 - DNA, 22 bp, Homo sapiens
gggtagaggaagacgagacagg

SEQ ID NO: 3037012 - DNA, 14 bp, Homo sapiens
gggtaggccccaca

SEQ ID NO: 3037013 - DNA, 17 bp, Homo sapiens
gggtcaagctgagctgg

SEQ ID NO: 3037014 - DNA, 23 bp, Homo sapiens
gggtcaagctgagctggcttcgg

SEQ ID NO: 3037015 - DNA, 15 bp, Homo sapiens
gggtcaccctgtgac

SEQ ID NO: 3037016 - DNA, 18 bp, Homo sapiens
gggtcagaaacaggaccg

SEQ ID NO: 3037017 - DNA, 21 bp, Homo sapiens
gggtcatgccctcctctccca

SEQ ID NO: 3037018 - DNA, 19 bp, Homo sapiens
gggtcatttttaactactg

SEQ ID NO: 3037019 - DNA, 13 bp, Homo sapiens
gggtccagaagga

SEQ ID NO: 3037020 - DNA, 17 bp, Homo sapiens
gggtccagaaggagaca

SEQ ID NO: 3037021 - DNA, 16 bp, Homo sapiens
gggtccagggagcagg

SEQ ID NO: 3037022 - DNA, 17 bp, Homo sapiens
gggtccagggagcaggc

SEQ ID NO: 3037023 - DNA, 13 bp, Homo sapiens
gggtccccagggc

SEQ ID NO: 3037024 - DNA, 15 bp, Homo sapiens
gggtcccctgccacc

SEQ ID NO: 3037025 - DNA, 15 bp, Homo sapiens
gggtccgcatccctg

SEQ ID NO: 3037026 - DNA, 13 bp, Homo sapiens
gggtcctcggccc

SEQ ID NO: 3037027 - DNA, 10 bp, Homo sapiens
gggtcctggg

SEQ ID NO: 3037028 - DNA, 11 bp, Homo sapiens
gggtcctggga

SEQ ID NO: 3037029 - DNA, 15 bp, Homo sapiens
gggtcctgggggcag

SEQ ID NO: 3037030 - DNA, 18 bp, Homo sapiens
gggtcggaagcctgtcct

SEQ ID NO: 3037031 - DNA, 18 bp, Homo sapiens
gggtcgggagaggggacg

SEQ ID NO: 3037032 - DNA, 21 bp, Homo sapiens
gggtctaaggagcgctagtgc

SEQ ID NO: 3037033 - DNA, 23 bp, Homo sapiens
gggtctaaggagcgctagtgcct

SEQ ID NO: 3037034 - DNA, 23 bp, Homo sapiens
gggtctaccaatacaaaatgtat

SEQ ID NO: 3037035 - DNA, 17 bp, Homo sapiens
gggtctattccagctca

SEQ ID NO: 3037036 - DNA, 17 bp, Homo sapiens
gggtctcaggtccagct

SEQ ID NO: 3037037 - DNA, 18 bp, Homo sapiens
gggtctccctctcctgcc

SEQ ID NO: 3037038 - DNA, 19 bp, Homo sapiens
gggtctccctctcctgcct

SEQ ID NO: 3037039 - DNA, 14 bp, Homo sapiens
gggtcttagctctt

SEQ ID NO: 3037040 - DNA, 21 bp, Homo sapiens
gggtcttttcatctgggaaag

SEQ ID NO: 3037041 - DNA, 21 bp, Homo sapiens
gggtctttttctcttctgttc

SEQ ID NO: 3037042 - DNA, 15 bp, Homo sapiens
gggtgaggagctggg

SEQ ID NO: 3037043 - DNA, 15 bp, Homo sapiens
gggtgatttctagaa

SEQ ID NO: 3037044 - DNA, 23 bp, Homo sapiens
gggtgcagtatcatgccctgtgc

SEQ ID NO: 3037045 - DNA, 17 bp, Homo sapiens
gggtgccaagtcctagc

SEQ ID NO: 3037046 - DNA, 12 bp, Homo sapiens
gggtgccctgaa

SEQ ID NO: 3037047 - DNA, 21 bp, Homo sapiens
gggtgctgccccatgaagcca

SEQ ID NO: 3037048 - DNA, 15 bp, Homo sapiens
gggtggagaagccat

SEQ ID NO: 3037049 - DNA, 16 bp, Homo sapiens
gggtggagaagccatt

SEQ ID NO: 3037050 - DNA, 22 bp, Homo sapiens
gggtggagctgagaagaggagg

SEQ ID NO: 3037051 - DNA, 11 bp, Homo sapiens
gggtggcctgt

SEQ ID NO: 3037052 - DNA, 18 bp, Homo sapiens
gggtggcgcgcctgcctt

SEQ ID NO: 3037053 - DNA, 16 bp, Homo sapiens
gggtggctagtcagag

SEQ ID NO: 3037054 - DNA, 18 bp, Homo sapiens
gggtggctagtcagagag

SEQ ID NO: 3037055 - DNA, 15 bp, Homo sapiens
gggtggctggagtga

SEQ ID NO: 3037056 - DNA, 15 bp, Homo sapiens
gggtgggaaggggct

SEQ ID NO: 3037057 - DNA, 17 bp, Homo sapiens
gggtgggatggaggaga

SEQ ID NO: 3037058 - DNA, 12 bp, Homo sapiens
gggtgggcagca

SEQ ID NO: 3037059 - DNA, 18 bp, Homo sapiens
gggtggggagagacgggc

SEQ ID NO: 3037060 - DNA, 14 bp, Homo sapiens
gggtggggaggggc

SEQ ID NO: 3037061 - DNA, 14 bp, Homo sapiens
gggtggggctgctc

SEQ ID NO: 3037062 - DNA, 17 bp, Homo sapiens
gggtgtccgagaggctg

SEQ ID NO: 3037063 - DNA, 21 bp, Homo sapiens
gggtgtcctgcaccggggcct

SEQ ID NO: 3037064 - DNA, 15 bp, Homo sapiens
gggtgttaatttatg

SEQ ID NO: 3037065 - DNA, 17 bp, Homo sapiens
gggttaaatcaaagata

SEQ ID NO: 3037066 - DNA, 18 bp, Homo sapiens
gggttatgtatcagaaga

SEQ ID NO: 3037067 - DNA, 16 bp, Homo sapiens
gggttcagcctcctgt

SEQ ID NO: 3037068 - DNA, 19 bp, Homo sapiens
gggttctcagtgccggagg

SEQ ID NO: 3037069 - DNA, 19 bp, Homo sapiens
gggttgattaaggcagtac

SEQ ID NO: 3037070 - DNA, 17 bp, Homo sapiens
gggttggagaaggaggt

SEQ ID NO: 3037071 - DNA, 17 bp, Homo sapiens
gggtttacaacaaacac

SEQ ID NO: 3037072 - DNA, 20 bp, Homo sapiens
gggtttcctgcatggacagt

SEQ ID NO: 3037073 - DNA, 13 bp, Homo sapiens
gggtttctctccc

SEQ ID NO: 3037074 - DNA, 23 bp, Homo sapiens
gggtttggcccaagactgggctg

SEQ ID NO: 3037075 - DNA, 15 bp, Homo sapiens
gggtttggcccctgg

SEQ ID NO: 3037076 - DNA, 13 bp, Homo sapiens
gggttttaatgta

SEQ ID NO: 3037077 - DNA, 13 bp, Homo sapiens
ggtaaaatgccat

SEQ ID NO: 3037078 - DNA, 16 bp, Homo sapiens
ggtaaatctagagttt

SEQ ID NO: 3037079 - DNA, 13 bp, Homo sapiens
ggtaaatgccaca

SEQ ID NO: 3037080 - DNA, 19 bp, Homo sapiens
ggtaacatttatagaagaa

SEQ ID NO: 3037081 - DNA, 15 bp, Homo sapiens
ggtaactaagaagtg

SEQ ID NO: 3037082 - DNA, 20 bp, Homo sapiens
ggtaagctagagagaaaaag

SEQ ID NO: 3037083 - DNA, 16 bp, Homo sapiens
ggtaatatatatattt

SEQ ID NO: 3037084 - DNA, 20 bp, Homo sapiens
ggtaattatgttttgtgatt

SEQ ID NO: 3037085 - DNA, 13 bp, Homo sapiens
ggtaattgtacaa

SEQ ID NO: 3037086 - DNA, 19 bp, Homo sapiens
ggtacaaaaataaatttat

SEQ ID NO: 3037087 - DNA, 17 bp, Homo sapiens
ggtacagttgcaggagc

SEQ ID NO: 3037088 - DNA, 19 bp, Homo sapiens
ggtacagttgcaggagcgt

SEQ ID NO: 3037089 - DNA, 12 bp, Homo sapiens
ggtacagtttgg

SEQ ID NO: 3037090 - DNA, 23 bp, Homo sapiens
ggtacatttttcaactttgaata

SEQ ID NO: 3037091 - DNA, 22 bp, Homo sapiens
ggtaccagatgcagctcaagag

SEQ ID NO: 3037092 - DNA, 23 bp, Homo sapiens
ggtaccaggcacatggctggggg

SEQ ID NO: 3037093 - DNA, 11 bp, Homo sapiens
ggtaccctggg

SEQ ID NO: 3037094 - DNA, 14 bp, Homo sapiens
ggtacctcatgagg

SEQ ID NO: 3037095 - DNA, 17 bp, Homo sapiens
ggtacctgcaagcagaa

SEQ ID NO: 3037096 - DNA, 19 bp, Homo sapiens
ggtacttcttgaaggtgct

SEQ ID NO: 3037097 - DNA, 19 bp, Homo sapiens
ggtagaaaactccagggtc

SEQ ID NO: 3037098 - DNA, 12 bp, Homo sapiens
ggtagaagccac

SEQ ID NO: 3037099 - DNA, 18 bp, Homo sapiens
ggtagaagccacccttcc

SEQ ID NO: 3037100 - DNA, 22 bp, Homo sapiens
ggtagaagccacccttccctgc

SEQ ID NO: 3037101 - DNA, 23 bp, Homo sapiens
ggtagaagccacccttccctgcc

SEQ ID NO: 3037102 - DNA, 19 bp, Homo sapiens
ggtagaatgtaaagcttgt

SEQ ID NO: 3037103 - DNA, 23 bp, Homo sapiens
ggtagagcaaaggagacaaagca

SEQ ID NO: 3037104 - DNA, 12 bp, Homo sapiens
ggtagagtttat

SEQ ID NO: 3037105 - DNA, 17 bp, Homo sapiens
ggtagccatcaagcact

SEQ ID NO: 3037106 - DNA, 22 bp, Homo sapiens
ggtagccatcaagcacttccca

SEQ ID NO: 3037107 - DNA, 15 bp, Homo sapiens
ggtagctagaggaac

SEQ ID NO: 3037108 - DNA, 13 bp, Homo sapiens
ggtagctccagcg

SEQ ID NO: 3037109 - DNA, 17 bp, Homo sapiens
ggtagctttgaggtgga

SEQ ID NO: 3037110 - DNA, 22 bp, Homo sapiens
gtaagaagtttcttaaacattg

SEQ ID NO: 3037111 - DNA, 14 bp, Homo sapiens
gtaagacatttcct

SEQ ID NO: 3037112 - DNA, 16 bp, Homo sapiens
gtaagaccttggtagg

SEQ ID NO: 3037113 - DNA, 19 bp, Homo sapiens
gtaagatggttttcaaatc

SEQ ID NO: 3037114 - DNA, 23 bp, Homo sapiens
gtaagattatagattctaaagat

SEQ ID NO: 3037115 - DNA, 12 bp, Homo sapiens
gtaagctgtgtg

SEQ ID NO: 3037116 - DNA, 20 bp, Homo sapiens
gtaagcttagattttctgta

SEQ ID NO: 3037117 - DNA, 15 bp, Homo sapiens
gtaagggatttctta

SEQ ID NO: 3037118 - DNA, 16 bp, Homo sapiens
gtaagggatttcttag

SEQ ID NO: 3037119 - DNA, 22 bp, Homo sapiens
gtaaggtcttacattgcctgac

SEQ ID NO: 3037120 - DNA, 14 bp, Homo sapiens
gtaaggtctttgta

SEQ ID NO: 3037121 - DNA, 12 bp, Homo sapiens
gtaaggtgcctt

SEQ ID NO: 3037122 - DNA, 17 bp, Homo sapiens
gtaagtctcaactctgt

SEQ ID NO: 3037123 - DNA, 14 bp, Homo sapiens
gtaagtgggcccac

SEQ ID NO: 3037124 - DNA, 16 bp, Homo sapiens
gtaagtgggcccaccc

SEQ ID NO: 3037125 - DNA, 18 bp, Homo sapiens
gtaagttaataagcaaaa

SEQ ID NO: 3037126 - DNA, 21 bp, Homo sapiens
gtaagtttaaaggatgttggt

SEQ ID NO: 3037127 - DNA, 17 bp, Homo sapiens
gtaatacagcttgtgag

SEQ ID NO: 3037128 - DNA, 22 bp, Homo sapiens
gtaatactttcggagaaattct

SEQ ID NO: 3037129 - DNA, 11 bp, Homo sapiens
gtaatatatat

SEQ ID NO: 3037130 - DNA, 12 bp, Homo sapiens
gtaatatgaaat

SEQ ID NO: 3037131 - DNA, 19 bp, Homo sapiens
gtaatattctctgatgttt

SEQ ID NO: 3037132 - DNA, 19 bp, Homo sapiens
gtaatatttcttcaagtga

SEQ ID NO: 3037133 - DNA, 13 bp, Homo sapiens
gtaatcaataaac

SEQ ID NO: 3037134 - DNA, 18 bp, Homo sapiens
gtaatcaataaacgattt

SEQ ID NO: 3037135 - DNA, 15 bp, Homo sapiens
gtaatcccagcactt

SEQ ID NO: 3037136 - DNA, 16 bp, Homo sapiens
gtaatcccagcacttt

SEQ ID NO: 3037137 - DNA, 12 bp, Homo sapiens
gtaatcccagct

SEQ ID NO: 3037138 - DNA, 18 bp, Homo sapiens
gtaatctcgtttcaaaaa

SEQ ID NO: 3037139 - DNA, 20 bp, Homo sapiens
gtaatctcgtttcaaaaaca

SEQ ID NO: 3037140 - DNA, 20 bp, Homo sapiens
gtaatctgtgtacaaagaaa

SEQ ID NO: 3037141 - DNA, 17 bp, Homo sapiens
gtaatcttgggtttcta

SEQ ID NO: 3037142 - DNA, 17 bp, Homo sapiens
gtaatgtagttctttgt

SEQ ID NO: 3037143 - DNA, 19 bp, Homo sapiens
gtaatgtcaccaccttccc

SEQ ID NO: 3037144 - DNA, 14 bp, Homo sapiens
gtaatgtcttcagt

SEQ ID NO: 3037145 - DNA, 14 bp, Homo sapiens
gtaatgtgaataaa

SEQ ID NO: 3037146 - DNA, 16 bp, Homo sapiens
gtaattaataaacgaa

SEQ ID NO: 3037147 - DNA, 23 bp, Homo sapiens
gtaattagtaacatgtgttaagt

SEQ ID NO: 3037148 - DNA, 15 bp, Homo sapiens
gtaattgacatgtgc

SEQ ID NO: 3037149 - DNA, 16 bp, Homo sapiens
gtaattgtacaatact

SEQ ID NO: 3037150 - DNA, 22 bp, Homo sapiens
gtaatttaaaacttttgtttaa

SEQ ID NO: 3037151 - DNA, 17 bp, Homo sapiens
gtaatttagattgtaaa

SEQ ID NO: 3037152 - DNA, 13 bp, Homo sapiens
gtaatttcagttc

SEQ ID NO: 3037153 - DNA, 16 bp, Homo sapiens
gtacaaaatggtccta

SEQ ID NO: 3037154 - DNA, 16 bp, Homo sapiens
gtacaagctcttgttt

SEQ ID NO: 3037155 - DNA, 20 bp, Homo sapiens
gtacaagctcttgtttctgt

SEQ ID NO: 3037156 - DNA, 14 bp, Homo sapiens
gtacaagttgcttt

SEQ ID NO: 3037157 - DNA, 17 bp, Homo sapiens
gtacaagttgctttgtt

SEQ ID NO: 3037158 - DNA, 11 bp, Homo sapiens
gtacaataaaa

SEQ ID NO: 3037159 - DNA, 14 bp, Homo sapiens
gtacaattcattgt

SEQ ID NO: 3037160 - DNA, 17 bp, Homo sapiens
gtacacgtgtcctgtag

SEQ ID NO: 3037161 - DNA, 16 bp, Homo sapiens
gtacagacttgttgtg

SEQ ID NO: 3037162 - DNA, 14 bp, Homo sapiens
gtacagaggggaca

SEQ ID NO: 3037163 - DNA, 12 bp, Homo sapiens
gtacaggcagca

SEQ ID NO: 3037164 - DNA, 15 bp, Homo sapiens
gtacaggcagcacag

SEQ ID NO: 3037165 - DNA, 22 bp, Homo sapiens
gtacagtctcaattttgtattt

SEQ ID NO: 3037166 - DNA, 13 bp, Homo sapiens
gtacagtctgtct

SEQ ID NO: 3037167 - DNA, 17 bp, Homo sapiens
gtacagtctgtcttctg

SEQ ID NO: 3037168 - DNA, 20 bp, Homo sapiens
gtacagtctgtcttctgtat

SEQ ID NO: 3037169 - DNA, 21 bp, Homo sapiens
gtacagtctgtcttctgtata

SEQ ID NO: 3037170 - DNA, 15 bp, Homo sapiens
gtacagttcataaat

SEQ ID NO: 3037171 - DNA, 16 bp, Homo sapiens
gtacagttgcaggagc

SEQ ID NO: 3037172 - DNA, 15 bp, Homo sapiens
gtacagttttgtgga

SEQ ID NO: 3037173 - DNA, 14 bp, Homo sapiens
gtacataagttaaa

SEQ ID NO: 3037174 - DNA, 21 bp, Homo sapiens
gtacataagttaaatgattga

SEQ ID NO: 3037175 - DNA, 23 bp, Homo sapiens
gtacataatacacttgccctgct

SEQ ID NO: 3037176 - DNA, 20 bp, Homo sapiens
gtacataattgattaaaatc

SEQ ID NO: 3037177 - DNA, 17 bp, Homo sapiens
gtacatagtaaagtatt

SEQ ID NO: 3037178 - DNA, 18 bp, Homo sapiens
gtacatagtaaagtattt

SEQ ID NO: 3037179 - DNA, 20 bp, Homo sapiens
gtacatcccatgtaacagaa

SEQ ID NO: 3037180 - DNA, 22 bp, Homo sapiens
gtacatcccatgtaacagaaag

SEQ ID NO: 3037181 - DNA, 18 bp, Homo sapiens
gtacatctattttggatt

SEQ ID NO: 3037182 - DNA, 19 bp, Homo sapiens
gtacatgggactgattctg

SEQ ID NO: 3037183 - DNA, 16 bp, Homo sapiens
gtacatgtacatagta

SEQ ID NO: 3037184 - DNA, 18 bp, Homo sapiens
gtacatttcaccatggcc

SEQ ID NO: 3037185 - DNA, 21 bp, Homo sapiens
gtacatttctataaatagatg

SEQ ID NO: 3037186 - DNA, 19 bp, Homo sapiens
gtacattttggatttcttt

SEQ ID NO: 3037187 - DNA, 15 bp, Homo sapiens
gtacattttgtaaca

SEQ ID NO: 3037188 - DNA, 10 bp, Homo sapiens
gtacattttt

SEQ ID NO: 3037189 - DNA, 16 bp, Homo sapiens
gtaccaagccaccgca

SEQ ID NO: 3037190 - DNA, 18 bp, Homo sapiens
gtaccacaccctgcctgc

SEQ ID NO: 3037191 - DNA, 20 bp, Homo sapiens
gtaccacaccctgcctgctg

SEQ ID NO: 3037192 - DNA, 21 bp, Homo sapiens
gtaccacaccctgcctgctgt

SEQ ID NO: 3037193 - DNA, 23 bp, Homo sapiens
gtaccacaccctgcctgctgtgg

SEQ ID NO: 3037194 - DNA, 21 bp, Homo sapiens
gtaccaggcacatggctgggg

SEQ ID NO: 3037195 - DNA, 22 bp, Homo sapiens
gtaccaggcacatggctggggg

SEQ ID NO: 3037196 - DNA, 15 bp, Homo sapiens
gtaccagtgaatttt

SEQ ID NO: 3037197 - DNA, 16 bp, Homo sapiens
gtaccagtgaattttt

SEQ ID NO: 3037198 - DNA, 17 bp, Homo sapiens
gtacccctaaaatccca

SEQ ID NO: 3037199 - DNA, 13 bp, Homo sapiens
gtaccctgggtgt

SEQ ID NO: 3037200 - DNA, 13 bp, Homo sapiens
gtaccctttaaga

SEQ ID NO: 3037201 - DNA, 22 bp, Homo sapiens
gtacctatattgatttaaaagt

SEQ ID NO: 3037202 - DNA, 16 bp, Homo sapiens
gtacctattaaaagtt

SEQ ID NO: 3037203 - DNA, 15 bp, Homo sapiens
gtacctcagcattta

SEQ ID NO: 3037204 - DNA, 19 bp, Homo sapiens
gtacctcctctcagtgttt

SEQ ID NO: 3037205 - DNA, 12 bp, Homo sapiens
gtacctgaaaag

SEQ ID NO: 3037206 - DNA, 18 bp, Homo sapiens
gtacctgaaaagtaactt

SEQ ID NO: 3037207 - DNA, 16 bp, Homo sapiens
gtacctgcaagcagaa

SEQ ID NO: 3037208 - DNA, 17 bp, Homo sapiens
gtacctgcccccaatcc

SEQ ID NO: 3037209 - DNA, 11 bp, Homo sapiens
gtaccttgctt

SEQ ID NO: 3037210 - DNA, 23 bp, Homo sapiens
gtaccttgcttcttactgataat

SEQ ID NO: 3037211 - DNA, 19 bp, Homo sapiens
gtaccttttaacacctgat

SEQ ID NO: 3037212 - DNA, 15 bp, Homo sapiens
gtaccttttaatatg

SEQ ID NO: 3037213 - DNA, 12 bp, Homo sapiens
gtacgcacagac

SEQ ID NO: 3037214 - DNA, 15 bp, Homo sapiens
gtacgtagccacagg

SEQ ID NO: 3037215 - DNA, 13 bp, Homo sapiens
gtacgtcccagcg

SEQ ID NO: 3037216 - DNA, 15 bp, Homo sapiens
gtacgtcccagcggc

SEQ ID NO: 3037217 - DNA, 22 bp, Homo sapiens
gtacgtcccagcggcctcaggg

SEQ ID NO: 3037218 - DNA, 16 bp, Homo sapiens
gtactaagccaggagg

SEQ ID NO: 3037219 - DNA, 16 bp, Homo sapiens
gtactagttacacatc

SEQ ID NO: 3037220 - DNA, 14 bp, Homo sapiens
gtactcacttttca

SEQ ID NO: 3037221 - DNA, 16 bp, Homo sapiens
gtactccagcctgggt

SEQ ID NO: 3037222 - DNA, 20 bp, Homo sapiens
gtactccctctcaggatcca

SEQ ID NO: 3037223 - DNA, 18 bp, Homo sapiens
gtactgaaataatgatct

SEQ ID NO: 3037224 - DNA, 15 bp, Homo sapiens
gtactgaaggtgtgt

SEQ ID NO: 3037225 - DNA, 13 bp, Homo sapiens
gtactggtccctt

SEQ ID NO: 3037226 - DNA, 20 bp, Homo sapiens
gtactgttaagaataataaa

SEQ ID NO: 3037227 - DNA, 19 bp, Homo sapiens
gtactgtttaatgttctgt

SEQ ID NO: 3037228 - DNA, 14 bp, Homo sapiens
gtacttcagcaaga

SEQ ID NO: 3037229 - DNA, 18 bp, Homo sapiens
gtacttcagcaagagaga

SEQ ID NO: 3037230 - DNA, 19 bp, Homo sapiens
gtacttcagcaagagagaa

SEQ ID NO: 3037231 - DNA, 21 bp, Homo sapiens
gtacttcagcaagagagaacc

SEQ ID NO: 3037232 - DNA, 22 bp, Homo sapiens
gtacttgactacctactggtgt

SEQ ID NO: 3037233 - DNA, 23 bp, Homo sapiens
gtacttgccagaagttgtggatt

SEQ ID NO: 3037234 - DNA, 22 bp, Homo sapiens
gtacttgccttattagagtgtc

SEQ ID NO: 3037235 - DNA, 16 bp, Homo sapiens
gtacttggagggctca

SEQ ID NO: 3037236 - DNA, 15 bp, Homo sapiens
gtacttggtccaact

SEQ ID NO: 3037237 - DNA, 21 bp, Homo sapiens
gtacttggtccaactgcaact

SEQ ID NO: 3037238 - DNA, 21 bp, Homo sapiens
gtacttggttgggtcagattt

SEQ ID NO: 3037239 - DNA, 22 bp, Homo sapiens
gtacttggttgggtcagattta

SEQ ID NO: 3037240 - DNA, 11 bp, Homo sapiens
gtacttgtcaa

SEQ ID NO: 3037241 - DNA, 17 bp, Homo sapiens
gtactttgtttttccat

SEQ ID NO: 3037242 - DNA, 23 bp, Homo sapiens
gtacttttattttacacagaaac

SEQ ID NO: 3037243 - DNA, 23 bp, Homo sapiens
gtcccaaggtgaaatgaagcaac

SEQ ID NO: 3037244 - DNA, 19 bp, Homo sapiens
gtcccaccttggagcattt

SEQ ID NO: 3037245 - DNA, 16 bp, Homo sapiens
gtcccactcaagccaa

SEQ ID NO: 3037246 - DNA, 14 bp, Homo sapiens
gtcccacttctcat

SEQ ID NO: 3037247 - DNA, 10 bp, Homo sapiens
gtcccagagc

SEQ ID NO: 3037248 - DNA, 19 bp, Homo sapiens
gtcccagcggcctcagggt

SEQ ID NO: 3037249 - DNA, 18 bp, Homo sapiens
gtcccaggaagcagggag

SEQ ID NO: 3037250 - DNA, 16 bp, Homo sapiens
gtcccaggcagggaga

SEQ ID NO: 3037251 - DNA, 15 bp, Homo sapiens
gtcccaggggcagcc

SEQ ID NO: 3037252 - DNA, 19 bp, Homo sapiens
gtcccaggggcagccacac

SEQ ID NO: 3037253 - DNA, 12 bp, Homo sapiens
gtcccagtgaac

SEQ ID NO: 3037254 - DNA, 22 bp, Homo sapiens
gtccccaaatccgaacctcctc

SEQ ID NO: 3037255 - DNA, 15 bp, Homo sapiens
gtccccaacatggat

SEQ ID NO: 3037256 - DNA, 20 bp, Homo sapiens
gtccccacagactgccccag

SEQ ID NO: 3037257 - DNA, 18 bp, Homo sapiens
gtccccagactctgccta

SEQ ID NO: 3037258 - DNA, 12 bp, Homo sapiens
gtccccaggcct

SEQ ID NO: 3037259 - DNA, 17 bp, Homo sapiens
gtccccaggcctggctc

SEQ ID NO: 3037260 - DNA, 18 bp, Homo sapiens
gtccccaggcctggctcc

SEQ ID NO: 3037261 - DNA, 21 bp, Homo sapiens
gtcccccaaagggcctcctca

SEQ ID NO: 3037262 - DNA, 18 bp, Homo sapiens
gtccccccccaggccctc

SEQ ID NO: 3037263 - DNA, 13 bp, Homo sapiens
gtccccctgcagc

SEQ ID NO: 3037264 - DNA, 15 bp, Homo sapiens
gtccccctgcagcta

SEQ ID NO: 3037265 - DNA, 15 bp, Homo sapiens
gtccccggggcccag

SEQ ID NO: 3037266 - DNA, 21 bp, Homo sapiens
gtcccctcacagactcttcca

SEQ ID NO: 3037267 - DNA, 23 bp, Homo sapiens
gtcccctcacagactcttccacc

SEQ ID NO: 3037268 - DNA, 12 bp, Homo sapiens
gtcccctcagcg

SEQ ID NO: 3037269 - DNA, 22 bp, Homo sapiens
gtcccctcccagagctggtgga

SEQ ID NO: 3037270 - DNA, 18 bp, Homo sapiens
gtcccctgacctgtccag

SEQ ID NO: 3037271 - DNA, 23 bp, Homo sapiens
gtcccctggagtgtgtcagagcc

SEQ ID NO: 3037272 - DNA, 12 bp, Homo sapiens
gtcccctggcag

SEQ ID NO: 3037273 - DNA, 13 bp, Homo sapiens
gtcccctggcagt

SEQ ID NO: 3037274 - DNA, 17 bp, Homo sapiens
gtcccctggggctggtg

SEQ ID NO: 3037275 - DNA, 23 bp, Homo sapiens
gtcccctgtggtgatgtgcctgt

SEQ ID NO: 3037276 - DNA, 15 bp, Homo sapiens
gtccccttcccaggg

SEQ ID NO: 3037277 - DNA, 15 bp, Homo sapiens
gtcccggggccagca

SEQ ID NO: 3037278 - DNA, 23 bp, Homo sapiens
gtccctccgggacctggtgctgc

SEQ ID NO: 3037279 - DNA, 21 bp, Homo sapiens
gtccctcctggtgtcacccca

SEQ ID NO: 3037280 - DNA, 23 bp, Homo sapiens
gtccctcgtctcttgtgactcag

SEQ ID NO: 3037281 - DNA, 18 bp, Homo sapiens
gtccctctcagtgccttc

SEQ ID NO: 3037282 - DNA, 11 bp, Homo sapiens
gtccctctgcc

SEQ ID NO: 3037283 - DNA, 14 bp, Homo sapiens
gtccctctgcccca

SEQ ID NO: 3037284 - DNA, 13 bp, Homo sapiens
gtccctgcctgga

SEQ ID NO: 3037285 - DNA, 14 bp, Homo sapiens
gtccctgcctggac

SEQ ID NO: 3037286 - DNA, 21 bp, Homo sapiens
gtccctgcctggaccagcctc

SEQ ID NO: 3037287 - DNA, 22 bp, Homo sapiens
gtccctgctgctgccagggctt

SEQ ID NO: 3037288 - DNA, 16 bp, Homo sapiens
gtccctggcgctgtgc

SEQ ID NO: 3037289 - DNA, 11 bp, Homo sapiens
gtccctggggc

SEQ ID NO: 3037290 - DNA, 21 bp, Homo sapiens
gtccctggggcactcccccag

SEQ ID NO: 3037291 - DNA, 19 bp, Homo sapiens
gtccctgggggaagccctg

SEQ ID NO: 3037292 - DNA, 13 bp, Homo sapiens
gtccctggtcctt

SEQ ID NO: 3037293 - DNA, 12 bp, Homo sapiens
gtcccttcctgc

SEQ ID NO: 3037294 - DNA, 19 bp, Homo sapiens
gtcccttgagacctcagcc

SEQ ID NO: 3037295 - DNA, 22 bp, Homo sapiens
gtcccttgcttgcctgcagggc

SEQ ID NO: 3037296 - DNA, 17 bp, Homo sapiens
gtcccttgtttccagct

SEQ ID NO: 3037297 - DNA, 13 bp, Homo sapiens
gtccgatgctgga

SEQ ID NO: 3037298 - DNA, 17 bp, Homo sapiens
gtccgcataagaaaaag

SEQ ID NO: 3037299 - DNA, 20 bp, Homo sapiens
gtccgcatccctgcttctgg

SEQ ID NO: 3037300 - DNA, 14 bp, Homo sapiens
gtccgcggcctgca

SEQ ID NO: 3037301 - DNA, 18 bp, Homo sapiens
gtccgcggcctgcaccga

SEQ ID NO: 3037302 - DNA, 24 bp, Homo sapiens
gtccggtgtccttttcactacacc

SEQ ID NO: 3037303 - DNA, 19 bp, Homo sapiens
gtccgtgctgacagctgct

SEQ ID NO: 3037304 - DNA, 22 bp, Homo sapiens
gtccgtgctgacagctgctcct

SEQ ID NO: 3037305 - DNA, 17 bp, Homo sapiens
gtccgtgggttgctaac

SEQ ID NO: 3037306 - DNA, 12 bp, Homo sapiens
gtcctaggagta

SEQ ID NO: 3037307 - DNA, 16 bp, Homo sapiens
gtcctagtcgggcagg

SEQ ID NO: 3037308 - DNA, 18 bp, Homo sapiens
gtcctagtctcctttgaa

SEQ ID NO: 3037309 - DNA, 18 bp, Homo sapiens
gtcctatccaaaggaatc

SEQ ID NO: 3037310 - DNA, 20 bp, Homo sapiens
gtcctatccaaaggaatcag

SEQ ID NO: 3037311 - DNA, 16 bp, Homo sapiens
gtcctatgaatgcttt

SEQ ID NO: 3037312 - DNA, 20 bp, Homo sapiens
gtcctatgaatgctttgcat

SEQ ID NO: 3037313 - DNA, 13 bp, Homo sapiens
gtcctatggaaac

SEQ ID NO: 3037314 - DNA, 17 bp, Homo sapiens
gtcctatggacaactta

SEQ ID NO: 3037315 - DNA, 20 bp, Homo sapiens
gtcctatggacaacttattt

SEQ ID NO: 3037316 - DNA, 15 bp, Homo sapiens
gtcctatttttgtga

SEQ ID NO: 3037317 - DNA, 14 bp, Homo sapiens
gtcctcaaagaagt

SEQ ID NO: 3037318 - DNA, 19 bp, Homo sapiens
gtcctcacctggttgaccc

SEQ ID NO: 3037319 - DNA, 20 bp, Homo sapiens
gtcctcacgccccctgtgac

SEQ ID NO: 3037320 - DNA, 13 bp, Homo sapiens
gtcctcagctgct

SEQ ID NO: 3037321 - DNA, 17 bp, Homo sapiens
gtcctcagctgctccca

SEQ ID NO: 3037322 - DNA, 17 bp, Homo sapiens
gtcctcaggtggccatg

SEQ ID NO: 3037323 - DNA, 23 bp, Homo sapiens
gtcctcaggtggccatgcctcag

SEQ ID NO: 3037324 - DNA, 15 bp, Homo sapiens
gtcctcatttctcca

SEQ ID NO: 3037325 - DNA, 17 bp, Homo sapiens
gtcctcatttctccaga

SEQ ID NO: 3037326 - DNA, 22 bp, Homo sapiens
gtcctccaacaccaagcacagc

SEQ ID NO: 3037327 - DNA, 22 bp, Homo sapiens
gtcctccctccctcccttcctt

SEQ ID NO: 3037328 - DNA, 14 bp, Homo sapiens
gtcctccgcctact

SEQ ID NO: 3037329 - DNA, 20 bp, Homo sapiens
gtcctccgcctactgtccct

SEQ ID NO: 3037330 - DNA, 18 bp, Homo sapiens
gtcctcctctacctctct

SEQ ID NO: 3037331 - DNA, 20 bp, Homo sapiens
gtcctcctctacctctctcc

SEQ ID NO: 3037332 - DNA, 12 bp, Homo sapiens
gtcctcctctgt

SEQ ID NO: 3037333 - DNA, 13 bp, Homo sapiens
gtcctcctctgtg

SEQ ID NO: 3037334 - DNA, 23 bp, Homo sapiens
gtcctcgaattttatctgtggag

SEQ ID NO: 3037335 - DNA, 12 bp, Homo sapiens
gtcctcggagct

SEQ ID NO: 3037336 - DNA, 20 bp, Homo sapiens
gtcctcggcccatctgtcca

SEQ ID NO: 3037337 - DNA, 13 bp, Homo sapiens
gtcctctgaatga

SEQ ID NO: 3037338 - DNA, 15 bp, Homo sapiens
gtcctctttcaaagg

SEQ ID NO: 3037339 - DNA, 20 bp, Homo sapiens
gtcctgcacagattcccagg

SEQ ID NO: 3037340 - DNA, 15 bp, Homo sapiens
gtcctgcaccggggc

SEQ ID NO: 3037341 - DNA, 14 bp, Homo sapiens
gtcctgccctgccc

SEQ ID NO: 3037342 - DNA, 11 bp, Homo sapiens
gtcctgctggc

SEQ ID NO: 3037343 - DNA, 14 bp, Homo sapiens
gtcctgctggcctg

SEQ ID NO: 3037344 - DNA, 18 bp, Homo sapiens
gtcctgctggcctgctct

SEQ ID NO: 3037345 - DNA, 20 bp, Homo sapiens
gtcctggacaccgggccagt

SEQ ID NO: 3037346 - DNA, 15 bp, Homo sapiens
gtcctggccatccca

SEQ ID NO: 3037347 - DNA, 18 bp, Homo sapiens
gtcctggccatcccacaa

SEQ ID NO: 3037348 - DNA, 16 bp, Homo sapiens
gtcctggctgcactct

SEQ ID NO: 3037349 - DNA, 15 bp, Homo sapiens
gtcctggcttcaggc

SEQ ID NO: 3037350 - DNA, 19 bp, Homo sapiens
gtcctgggaggatcctgag

SEQ ID NO: 3037351 - DNA, 17 bp, Homo sapiens
gtcctgggaggctgcag

SEQ ID NO: 3037352 - DNA, 21 bp, Homo sapiens
gtcctgggaggctgcagccag

SEQ ID NO: 3037353 - DNA, 15 bp, Homo sapiens
gtcctgggcaggtgg

SEQ ID NO: 3037354 - DNA, 17 bp, Homo sapiens
gtcctgggcctgcagaa

SEQ ID NO: 3037355 - DNA, 14 bp, Homo sapiens
gtcctgggggcagg

SEQ ID NO: 3037356 - DNA, 12 bp, Homo sapiens
gtcctggtggct

SEQ ID NO: 3037357 - DNA, 19 bp, Homo sapiens
gtcctggtggctgggccca

SEQ ID NO: 3037358 - DNA, 23 bp, Homo sapiens
gtcctgtagttgcgtggactctg

SEQ ID NO: 3037359 - DNA, 18 bp, Homo sapiens
gtcctgtatgtctgtcat

SEQ ID NO: 3037360 - DNA, 19 bp, Homo sapiens
gtcctgtgaggtttcccaa

SEQ ID NO: 3037361 - DNA, 22 bp, Homo sapiens
gtcctgttaggccaactgcctc

SEQ ID NO: 3037362 - DNA, 19 bp, Homo sapiens
gtccttaaaaatcacactg

SEQ ID NO: 3037363 - DNA, 22 bp, Homo sapiens
gtccttaaaaatcacactgtaa

SEQ ID NO: 3037364 - DNA, 14 bp, Homo sapiens
gtccttaaaatgtg

SEQ ID NO: 3037365 - DNA, 15 bp, Homo sapiens
gtccttactcagagc

SEQ ID NO: 3037366 - DNA, 17 bp, Homo sapiens
gtccttactcagagctg

SEQ ID NO: 3037367 - DNA, 13 bp, Homo sapiens
gtccttcaaaggc

SEQ ID NO: 3037368 - DNA, 14 bp, Homo sapiens
gtccttccacctcg

SEQ ID NO: 3037369 - DNA, 17 bp, Homo sapiens
gtccttcctgtgccctg

SEQ ID NO: 3037370 - DNA, 14 bp, Homo sapiens
gtccttcttcctca

SEQ ID NO: 3037371 - DNA, 15 bp, Homo sapiens
gtccttgcacctgca

SEQ ID NO: 3037372 - DNA, 16 bp, Homo sapiens
gtccttgcacctgcat

SEQ ID NO: 3037373 - DNA, 14 bp, Homo sapiens
gtccttgggcctgg

SEQ ID NO: 3037374 - DNA, 13 bp, Homo sapiens
gtcctttatgtgg

SEQ ID NO: 3037375 - DNA, 16 bp, Homo sapiens
gtcctttatgtggaaa

SEQ ID NO: 3037376 - DNA, 19 bp, Homo sapiens
gtgcactgtgaatcctggc

SEQ ID NO: 3037377 - DNA, 14 bp, Homo sapiens
gtgcactttgtaaa

SEQ ID NO: 3037378 - DNA, 15 bp, Homo sapiens
gtgcactttgtaaat

SEQ ID NO: 3037379 - DNA, 14 bp, Homo sapiens
gtgcagaacacctg

SEQ ID NO: 3037380 - DNA, 16 bp, Homo sapiens
gtgcagaacacctggc

SEQ ID NO: 3037381 - DNA, 17 bp, Homo sapiens
gtgcagaacacctggcc

SEQ ID NO: 3037382 - DNA, 13 bp, Homo sapiens
gtgcagaatgtaa

SEQ ID NO: 3037383 - DNA, 23 bp, Homo sapiens
gtgcagaggaagtggaaggcatc

SEQ ID NO: 3037384 - DNA, 22 bp, Homo sapiens
gtgcagatcatccgtctgtgtg

SEQ ID NO: 3037385 - DNA, 12 bp, Homo sapiens
gtgcagccagag

SEQ ID NO: 3037386 - DNA, 14 bp, Homo sapiens
gtgcagccagaggc

SEQ ID NO: 3037387 - DNA, 17 bp, Homo sapiens
gtgcagccgctgagcga

SEQ ID NO: 3037388 - DNA, 16 bp, Homo sapiens
gtgcaggacagctctt

SEQ ID NO: 3037389 - DNA, 17 bp, Homo sapiens
gtgcaggacagctcttg

SEQ ID NO: 3037390 - DNA, 15 bp, Homo sapiens
gtgcaggctggccag

SEQ ID NO: 3037391 - DNA, 20 bp, Homo sapiens
gtgcaggctggccagccgct

SEQ ID NO: 3037392 - DNA, 21 bp, Homo sapiens
gtgcaggggatggggtggggg

SEQ ID NO: 3037393 - DNA, 14 bp, Homo sapiens
gtgcagtctgggtg

SEQ ID NO: 3037394 - DNA, 19 bp, Homo sapiens
gtgcagttctagtttgcat

SEQ ID NO: 3037395 - DNA, 20 bp, Homo sapiens
gtgcagttctagtttgcatt

SEQ ID NO: 3037396 - DNA, 19 bp, Homo sapiens
gtgcatactggcattggcc

SEQ ID NO: 3037397 - DNA, 14 bp, Homo sapiens
gtgcatagcgtcct

SEQ ID NO: 3037398 - DNA, 15 bp, Homo sapiens
gtgcatccccacgac

SEQ ID NO: 3037399 - DNA, 23 bp, Homo sapiens
gtgcatccccacgacccctgcct

SEQ ID NO: 3037400 - DNA, 22 bp, Homo sapiens
gtgcatctgcaggcaccgggct

SEQ ID NO: 3037401 - DNA, 20 bp, Homo sapiens
gtgcatgacgtttaaggcca

SEQ ID NO: 3037402 - DNA, 22 bp, Homo sapiens
gtgcatggaactaaaatgttat

SEQ ID NO: 3037403 - DNA, 23 bp, Homo sapiens
gtgcatgtatgtcttggacactg

SEQ ID NO: 3037404 - DNA, 21 bp, Homo sapiens
gtgcattttctaagtgggaca

SEQ ID NO: 3037405 - DNA, 22 bp, Homo sapiens
gtgcattttctaagtgggacat

SEQ ID NO: 3037406 - DNA, 14 bp, Homo sapiens
gtgccaaagaaagt

SEQ ID NO: 3037407 - DNA, 17 bp, Homo sapiens
gtgccaaatagccccag

SEQ ID NO: 3037408 - DNA, 14 bp, Homo sapiens
gtgccaaccccacc

SEQ ID NO: 3037409 - DNA, 18 bp, Homo sapiens
gtgccaaccccacccagc

SEQ ID NO: 3037410 - DNA, 21 bp, Homo sapiens
gtgccaaccccacccagctcc

SEQ ID NO: 3037411 - DNA, 16 bp, Homo sapiens
gtgccaagtcctagct

SEQ ID NO: 3037412 - DNA, 18 bp, Homo sapiens
gtgccacaacgcctggct

SEQ ID NO: 3037413 - DNA, 19 bp, Homo sapiens
gtgccacccccagccctgg

SEQ ID NO: 3037414 - DNA, 14 bp, Homo sapiens
gtgccagaaggaag

SEQ ID NO: 3037415 - DNA, 13 bp, Homo sapiens
gtgccagcagcct

SEQ ID NO: 3037416 - DNA, 21 bp, Homo sapiens
gtgccagcagcctcgcacagg

SEQ ID NO: 3037417 - DNA, 12 bp, Homo sapiens
gtgccagcccct

SEQ ID NO: 3037418 - DNA, 19 bp, Homo sapiens
gtgccagcccctgctggct

SEQ ID NO: 3037419 - DNA, 21 bp, Homo sapiens
gtgccagcccctgctggctgg

SEQ ID NO: 3037420 - DNA, 20 bp, Homo sapiens
gtgccagcccggaggggact

SEQ ID NO: 3037421 - DNA, 19 bp, Homo sapiens
gtgccatggatttccactg

SEQ ID NO: 3037422 - DNA, 20 bp, Homo sapiens
gtgccatggatttccactgc

SEQ ID NO: 3037423 - DNA, 21 bp, Homo sapiens
gtgccattgtactccagcctg

SEQ ID NO: 3037424 - DNA, 23 bp, Homo sapiens
gtgcccaccaacatcccattgcc

SEQ ID NO: 3037425 - DNA, 15 bp, Homo sapiens
gtgccccagactgag

SEQ ID NO: 3037426 - DNA, 21 bp, Homo sapiens
gtgccccagactgagctctcc

SEQ ID NO: 3037427 - DNA, 22 bp, Homo sapiens
gtgccccagactgagctctcca

SEQ ID NO: 3037428 - DNA, 20 bp, Homo sapiens
gtgcccccagacagctgctc

SEQ ID NO: 3037429 - DNA, 21 bp, Homo sapiens
gtgcccccttcaagcctgtgc

SEQ ID NO: 3037430 - DNA, 14 bp, Homo sapiens
gtgcccttgatttt

SEQ ID NO: 3037431 - DNA, 16 bp, Homo sapiens
gtgcccttggaggcca

SEQ ID NO: 3037432 - DNA, 14 bp, Homo sapiens
gtgcctcattgctt

SEQ ID NO: 3037433 - DNA, 23 bp, Homo sapiens
gtgcctccagaggggctcaggtc

SEQ ID NO: 3037434 - DNA, 11 bp, Homo sapiens
gtgcctccctc

SEQ ID NO: 3037435 - DNA, 18 bp, Homo sapiens
gtgcctcccttcccagtg

SEQ ID NO: 3037436 - DNA, 22 bp, Homo sapiens
gtgcctcccttcccagtgggct

SEQ ID NO: 3037437 - DNA, 14 bp, Homo sapiens
gtgcctctgtccta

SEQ ID NO: 3037438 - DNA, 12 bp, Homo sapiens
gtgcctgagccc

SEQ ID NO: 3037439 - DNA, 18 bp, Homo sapiens
gtgcctgagcccctcaga

SEQ ID NO: 3037440 - DNA, 16 bp, Homo sapiens
gtgcctgggcccctcc

SEQ ID NO: 3037441 - DNA, 11 bp, Homo sapiens
gtgcctggggt

SEQ ID NO: 3037442 - DNA, 17 bp, Homo sapiens
gtgcctgggtggggctg

SEQ ID NO: 3037443 - DNA, 20 bp, Homo sapiens
gtgcctgggtggggctgctc

SEQ ID NO: 3037444 - DNA, 15 bp, Homo sapiens
gtgcctgtctgtcca

SEQ ID NO: 3037445 - DNA, 16 bp, Homo sapiens
gtgcctgtgaggcagg

SEQ ID NO: 3037446 - DNA, 15 bp, Homo sapiens
gtgccttacctcctg

SEQ ID NO: 3037447 - DNA, 19 bp, Homo sapiens
gtgccttcttattctcact

SEQ ID NO: 3037448 - DNA, 20 bp, Homo sapiens
gtgccttcttcagggcctgg

SEQ ID NO: 3037449 - DNA, 21 bp, Homo sapiens
gtgccttcttcagggcctggt

SEQ ID NO: 3037450 - DNA, 12 bp, Homo sapiens
gtgccttgccca

SEQ ID NO: 3037451 - DNA, 19 bp, Homo sapiens
gtgccttgtcacgccagac

SEQ ID NO: 3037452 - DNA, 13 bp, Homo sapiens
gtgcctttcaaat

SEQ ID NO: 3037453 - DNA, 18 bp, Homo sapiens
gtgcctttccctcctaaa

SEQ ID NO: 3037454 - DNA, 14 bp, Homo sapiens
gtgcctttcctatc

SEQ ID NO: 3037455 - DNA, 21 bp, Homo sapiens
gtgccttttgcagaagagggt

SEQ ID NO: 3037456 - DNA, 19 bp, Homo sapiens
gtgcgctcgttccggtccc

SEQ ID NO: 3037457 - DNA, 14 bp, Homo sapiens
gtgcgctgcctggc

SEQ ID NO: 3037458 - DNA, 17 bp, Homo sapiens
gtgcgctgcctggccag
